United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 165

SEQ ID NO: 6905667 - DNA, 22 bp, Homo sapiens
cctgcctttctcagtaatcttt

SEQ ID NO: 6905668 - DNA, 22 bp, Homo sapiens
tgtcctatttctctgtgcatga

SEQ ID NO: 6905669 - DNA, 22 bp, Homo sapiens
ttgccacacaagtaaagaaaca

SEQ ID NO: 6905670 - DNA, 19 bp, Homo sapiens
ctggaaagttggcagtgag

SEQ ID NO: 6905671 - DNA, 22 bp, Homo sapiens
tttctgcatctctacagttgtt

SEQ ID NO: 6905672 - DNA, 22 bp, Homo sapiens
gcagggctgctgaaacttgttt

SEQ ID NO: 6905673 - DNA, 19 bp, Homo sapiens
cagctcaggactcagcccc

SEQ ID NO: 6905674 - DNA, 22 bp, Homo sapiens
gcagcccttcaggtgaggggca

SEQ ID NO: 6905675 - DNA, 22 bp, Homo sapiens
cagcttccacagacttggctcg

SEQ ID NO: 6905676 - DNA, 22 bp, Homo sapiens
agagatgactgatggctgatta

SEQ ID NO: 6905677 - DNA, 22 bp, Homo sapiens
atgcacatgtatctatatacaa

SEQ ID NO: 6905678 - DNA, 19 bp, Homo sapiens
atgcatctgcattgacagg

SEQ ID NO: 6905679 - DNA, 22 bp, Homo sapiens
aggagagaattactgggtgtca

SEQ ID NO: 6905680 - DNA, 22 bp, Homo sapiens
ttgaatgctgactgtagtccag

SEQ ID NO: 6905681 - DNA, 22 bp, Homo sapiens
tctctgagcatgccatattgct

SEQ ID NO: 6905682 - DNA, 22 bp, Homo sapiens
gaaacctgggatatataagttt

SEQ ID NO: 6905683 - DNA, 22 bp, Homo sapiens
tcctacaatgcacagaatagcc

SEQ ID NO: 6905684 - DNA, 22 bp, Homo sapiens
tggaagcctcagtttgccttct

SEQ ID NO: 6905685 - DNA, 22 bp, Homo sapiens
aagcacagagaggtaaagtaac

SEQ ID NO: 6905686 - DNA, 23 bp, Homo sapiens
ttggaagggaagagcatttgaga

SEQ ID NO: 6905687 - DNA, 22 bp, Homo sapiens
gtgggaagtctctcggaggaag

SEQ ID NO: 6905688 - DNA, 22 bp, Homo sapiens
actttaaggaggcactcatctc

SEQ ID NO: 6905689 - DNA, 22 bp, Homo sapiens
ctggcctgaggccgccttcaga

SEQ ID NO: 6905690 - DNA, 22 bp, Homo sapiens
aattttacttccctcagtgtag

SEQ ID NO: 6905691 - DNA, 22 bp, Homo sapiens
gtttcatacagattattcatgg

SEQ ID NO: 6905692 - DNA, 22 bp, Homo sapiens
tttaccacaataatcatcacaa

SEQ ID NO: 6905693 - DNA, 22 bp, Homo sapiens
aatgtcattggtaaagattagg

SEQ ID NO: 6905694 - DNA, 22 bp, Homo sapiens
attgtgcttcctgaaatttgat

SEQ ID NO: 6905695 - DNA, 22 bp, Homo sapiens
aggctgagtcgggaggatcact

SEQ ID NO: 6905696 - DNA, 22 bp, Homo sapiens
gaggagtctagtttatggcttc

SEQ ID NO: 6905697 - DNA, 22 bp, Homo sapiens
tagtatgtcttactctaataca

SEQ ID NO: 6905698 - DNA, 22 bp, Homo sapiens
attacacaggctggctctttga

SEQ ID NO: 6905699 - DNA, 22 bp, Homo sapiens
gtggcaggagagacacagccat

SEQ ID NO: 6905700 - DNA, 23 bp, Homo sapiens
aagtgctatgtttataagagctg

SEQ ID NO: 6905701 - DNA, 18 bp, Homo sapiens
gcaagtgtctgtcccctt

SEQ ID NO: 6905702 - DNA, 22 bp, Homo sapiens
tccaggctggaaatgtcaaact

SEQ ID NO: 6905703 - DNA, 22 bp, Homo sapiens
tctttcctaggtgatatgcaat

SEQ ID NO: 6905704 - DNA, 22 bp, Homo sapiens
tctccaggcttaatctcagctt

SEQ ID NO: 6905705 - DNA, 22 bp, Homo sapiens
tcagaggtgcaagaagttctga

SEQ ID NO: 6905706 - DNA, 17 bp, Homo sapiens
ggtggcctgcagtggct

SEQ ID NO: 6905707 - DNA, 22 bp, Homo sapiens
atgagacacatgtgacttcttt

SEQ ID NO: 6905708 - DNA, 22 bp, Homo sapiens
agctggttgcttaacctctctg

SEQ ID NO: 6905709 - DNA, 22 bp, Homo sapiens
ccatccatggtgttggttgtat

SEQ ID NO: 6905710 - DNA, 22 bp, Homo sapiens
atgtgtgtgcatttctctccct

SEQ ID NO: 6905711 - DNA, 22 bp, Homo sapiens
tctctgcatcccagggctcagc

SEQ ID NO: 6905712 - DNA, 22 bp, Homo sapiens
attattgtgataggtgtcagtg

SEQ ID NO: 6905713 - DNA, 22 bp, Homo sapiens
taaccacattattatgggttct

SEQ ID NO: 6905714 - DNA, 22 bp, Homo sapiens
ttcttaagtatgatcttaacgg

SEQ ID NO: 6905715 - DNA, 22 bp, Homo sapiens
cctgagcaacttcaagggcctg

SEQ ID NO: 6905716 - DNA, 22 bp, Homo sapiens
ttgtctggtcaaatcacttgta

SEQ ID NO: 6905717 - DNA, 22 bp, Homo sapiens
gccagctgaagggaagctcctg

SEQ ID NO: 6905718 - DNA, 22 bp, Homo sapiens
tatgtacacttaagtttgagaa

SEQ ID NO: 6905719 - DNA, 20 bp, Homo sapiens
gggaggccccagagtccagg

SEQ ID NO: 6905720 - DNA, 22 bp, Homo sapiens
cctgggaagaccggcagtgggg

SEQ ID NO: 6905721 - DNA, 22 bp, Homo sapiens
agctagtgggctgggagaggaa

SEQ ID NO: 6905722 - DNA, 22 bp, Homo sapiens
agtttgctgatgaagaaaattt

SEQ ID NO: 6905723 - DNA, 22 bp, Homo sapiens
gtccaagagatgtaacgaagaa

SEQ ID NO: 6905724 - DNA, 23 bp, Homo sapiens
actcagtgagggccttgggctgc

SEQ ID NO: 6905725 - DNA, 22 bp, Homo sapiens
ctagtctgcagcggggaggggt

SEQ ID NO: 6905726 - DNA, 22 bp, Homo sapiens
cgtgtgtgtacctgcgcattta

SEQ ID NO: 6905727 - DNA, 22 bp, Homo sapiens
gcctaacttggctttgttcacc

SEQ ID NO: 6905728 - DNA, 22 bp, Homo sapiens
gtagctgcatattttcttagaa

SEQ ID NO: 6905729 - DNA, 22 bp, Homo sapiens
atcccacctcaatctgaagctc

SEQ ID NO: 6905730 - DNA, 23 bp, Homo sapiens
agtcttactgtcccagaacaggg

SEQ ID NO: 6905731 - DNA, 22 bp, Homo sapiens
ttccttggccccatgcccaggg

SEQ ID NO: 6905732 - DNA, 22 bp, Homo sapiens
ctaggctggagtgcattggcgt

SEQ ID NO: 6905733 - DNA, 22 bp, Homo sapiens
tcagacagattttgacacttgc

SEQ ID NO: 6905734 - DNA, 20 bp, Homo sapiens
ctctctggaaggtgggagcc

SEQ ID NO: 6905735 - DNA, 19 bp, Homo sapiens
gggacaccagaagaacaag

SEQ ID NO: 6905736 - DNA, 22 bp, Homo sapiens
gctggcctgggcagcctgtcgg

SEQ ID NO: 6905737 - DNA, 20 bp, Homo sapiens
tgcttcattatgtgagatag

SEQ ID NO: 6905738 - DNA, 22 bp, Homo sapiens
ggcttccctttccgagaggaga

SEQ ID NO: 6905739 - DNA, 22 bp, Homo sapiens
cctaggagttcgaagctgcagt

SEQ ID NO: 6905740 - DNA, 22 bp, Homo sapiens
ttaattatgagaaagggaaaag

SEQ ID NO: 6905741 - DNA, 23 bp, Homo sapiens
ggtattcattcatttatgctaag

SEQ ID NO: 6905742 - DNA, 22 bp, Homo sapiens
tagcatctggagaaacaagtcc

SEQ ID NO: 6905743 - DNA, 22 bp, Homo sapiens
agaacctgcctttactctcctt

SEQ ID NO: 6905744 - DNA, 22 bp, Homo sapiens
atccagggtgtggagagagctc

SEQ ID NO: 6905745 - DNA, 22 bp, Homo sapiens
agggccactggctgacggctgc

SEQ ID NO: 6905746 - DNA, 22 bp, Homo sapiens
agagagaattggataaattggt

SEQ ID NO: 6905747 - DNA, 22 bp, Homo sapiens
caatgtacaaaataattacaca

SEQ ID NO: 6905748 - DNA, 22 bp, Homo sapiens
aggtacagatgaaagtctagtt

SEQ ID NO: 6905749 - DNA, 22 bp, Homo sapiens
tgtgctccacactcccagtcct

SEQ ID NO: 6905750 - DNA, 22 bp, Homo sapiens
cagcagtgtacaaggtgtcaga

SEQ ID NO: 6905751 - DNA, 22 bp, Homo sapiens
tacagtatggaaaatgtatagt

SEQ ID NO: 6905752 - DNA, 22 bp, Homo sapiens
ttccctctccaggagccctgag

SEQ ID NO: 6905753 - DNA, 22 bp, Homo sapiens
tcctgcacaccttgagcttgga

SEQ ID NO: 6905754 - DNA, 22 bp, Homo sapiens
ctgtgtcttcaatgtactggga

SEQ ID NO: 6905755 - DNA, 22 bp, Homo sapiens
cagctgagcatcactagtctgg

SEQ ID NO: 6905756 - DNA, 22 bp, Homo sapiens
cagctgccctgccttgccctta

SEQ ID NO: 6905757 - DNA, 22 bp, Homo sapiens
cgccttcaggccctttttgttg

SEQ ID NO: 6905758 - DNA, 22 bp, Homo sapiens
aactggttatgttacctatgtc

SEQ ID NO: 6905759 - DNA, 22 bp, Homo sapiens
atgagtaaaacagtggtgttgc

SEQ ID NO: 6905760 - DNA, 22 bp, Homo sapiens
cctgtggggctgaaagaggctt

SEQ ID NO: 6905761 - DNA, 22 bp, Homo sapiens
tcaggagtgcagcagtttggag

SEQ ID NO: 6905762 - DNA, 22 bp, Homo sapiens
gtccccagctgtgacgagagcc

SEQ ID NO: 6905763 - DNA, 18 bp, Homo sapiens
acccaggttttgaagctt

SEQ ID NO: 6905764 - DNA, 22 bp, Homo sapiens
aagtacataaaggaattagcca

SEQ ID NO: 6905765 - DNA, 22 bp, Homo sapiens
acagtgtggtgatggcacttgc

SEQ ID NO: 6905766 - DNA, 22 bp, Homo sapiens
ggtaactgcacctttggcctga

SEQ ID NO: 6905767 - DNA, 22 bp, Homo sapiens
ccttctgtctccctcatattga

SEQ ID NO: 6905768 - DNA, 22 bp, Homo sapiens
caggaggcgtcttcagtttgtt

SEQ ID NO: 6905769 - DNA, 22 bp, Homo sapiens
actggtttgggacaatttgtgc

SEQ ID NO: 6905770 - DNA, 22 bp, Homo sapiens
aagagacagagccatgtttcta

SEQ ID NO: 6905771 - DNA, 22 bp, Homo sapiens
tcatctccctcctggatacctg

SEQ ID NO: 6905772 - DNA, 22 bp, Homo sapiens
catttgaagacttagaagagga

SEQ ID NO: 6905773 - DNA, 21 bp, Homo sapiens
gattggttcactcatgttgac

SEQ ID NO: 6905774 - DNA, 22 bp, Homo sapiens
actttgctcatattgagtttct

SEQ ID NO: 6905775 - DNA, 22 bp, Homo sapiens
gatgacaacttgtttctgttat

SEQ ID NO: 6905776 - DNA, 22 bp, Homo sapiens
acatcatttctagttcctgtca

SEQ ID NO: 6905777 - DNA, 21 bp, Homo sapiens
tgttttctaaagggcggatca

SEQ ID NO: 6905778 - DNA, 22 bp, Homo sapiens
ccagcttggagtaacaaatggt

SEQ ID NO: 6905779 - DNA, 22 bp, Homo sapiens
tgccctgtgccagacttcctgg

SEQ ID NO: 6905780 - DNA, 22 bp, Homo sapiens
ttttattgtcaatgaagacaga

SEQ ID NO: 6905781 - DNA, 22 bp, Homo sapiens
ttctgtagtattcttttggtca

SEQ ID NO: 6905782 - DNA, 18 bp, Homo sapiens
agggagagaccgcgggtc

SEQ ID NO: 6905783 - DNA, 22 bp, Homo sapiens
tcaggtatttcttttagctgtg

SEQ ID NO: 6905784 - DNA, 22 bp, Homo sapiens
agaccctctcctcatggacatg

SEQ ID NO: 6905785 - DNA, 20 bp, Homo sapiens
acagatgaggaaaatgaagt

SEQ ID NO: 6905786 - DNA, 22 bp, Homo sapiens
ttgaaaaccgtgggaggctgaa

SEQ ID NO: 6905787 - DNA, 21 bp, Homo sapiens
gaggaaatgctctggtgttca

SEQ ID NO: 6905788 - DNA, 21 bp, Homo sapiens
gtggctctgccaggactgaaa

SEQ ID NO: 6905789 - DNA, 22 bp, Homo sapiens
aggactttagagccagaaagac

SEQ ID NO: 6905790 - DNA, 22 bp, Homo sapiens
tttataaccaagttctgcttgt

SEQ ID NO: 6905791 - DNA, 22 bp, Homo sapiens
agggctccgggcaggcgatgga

SEQ ID NO: 6905792 - DNA, 22 bp, Homo sapiens
gtttgcaaagatcattttctcc

SEQ ID NO: 6905793 - DNA, 23 bp, Homo sapiens
ttattgctttccctgccttcctg

SEQ ID NO: 6905794 - DNA, 22 bp, Homo sapiens
agagggctaaggtttgggagat

SEQ ID NO: 6905795 - DNA, 22 bp, Homo sapiens
atttaaagtggtagattggcag

SEQ ID NO: 6905796 - DNA, 22 bp, Homo sapiens
aatcagaaaattcagtggaatt

SEQ ID NO: 6905797 - DNA, 22 bp, Homo sapiens
gctgggaaccatgggaaggcag

SEQ ID NO: 6905798 - DNA, 22 bp, Homo sapiens
gctctctgaggtgctggcagag

SEQ ID NO: 6905799 - DNA, 22 bp, Homo sapiens
tcctcagtcgtttgagccaaaa

SEQ ID NO: 6905800 - DNA, 22 bp, Homo sapiens
tagcttgagtgtttcataaata

SEQ ID NO: 6905801 - DNA, 22 bp, Homo sapiens
gagtgtggtatgctctgaggct

SEQ ID NO: 6905802 - DNA, 16 bp, Homo sapiens
agggccagaagcatca

SEQ ID NO: 6905803 - DNA, 22 bp, Homo sapiens
tgatctggaattccctgtggta

SEQ ID NO: 6905804 - DNA, 22 bp, Homo sapiens
taagttagaggttaggcactta

SEQ ID NO: 6905805 - DNA, 22 bp, Homo sapiens
ctttggctgtcctcttggctgg

SEQ ID NO: 6905806 - DNA, 22 bp, Homo sapiens
tcttctgtattgttaactcagg

SEQ ID NO: 6905807 - DNA, 22 bp, Homo sapiens
gagagactgatgtggctatgta

SEQ ID NO: 6905808 - DNA, 22 bp, Homo sapiens
catgggcagttggcagggctca

SEQ ID NO: 6905809 - DNA, 22 bp, Homo sapiens
catttgaactaataactgtgct

SEQ ID NO: 6905810 - DNA, 22 bp, Homo sapiens
acatgtgttaaaattctcacca

SEQ ID NO: 6905811 - DNA, 22 bp, Homo sapiens
aggctacttctagagggacaat

SEQ ID NO: 6905812 - DNA, 22 bp, Homo sapiens
ctaggcaaagtattaatgagtg

SEQ ID NO: 6905813 - DNA, 22 bp, Homo sapiens
agaggctcctcggtgcctcgtg

SEQ ID NO: 6905814 - DNA, 22 bp, Homo sapiens
gtgcccaggtgtccctgagaag

SEQ ID NO: 6905815 - DNA, 22 bp, Homo sapiens
tgtgccctctctgagccataaa

SEQ ID NO: 6905816 - DNA, 22 bp, Homo sapiens
cattccctgtctcttcaatcct

SEQ ID NO: 6905817 - DNA, 22 bp, Homo sapiens
actaaagtatggaagtgaataa

SEQ ID NO: 6905818 - DNA, 22 bp, Homo sapiens
aagtcactggcaaaagctgcag

SEQ ID NO: 6905819 - DNA, 22 bp, Homo sapiens
ttcatgttcatgcttaggaaaa

SEQ ID NO: 6905820 - DNA, 22 bp, Homo sapiens
agatatggtttgcataaataag

SEQ ID NO: 6905821 - DNA, 21 bp, Homo sapiens
caattactatgaaccagttga

SEQ ID NO: 6905822 - DNA, 22 bp, Homo sapiens
attccactttatgtctgtatga

SEQ ID NO: 6905823 - DNA, 22 bp, Homo sapiens
caggtgcccaggggacagtggc

SEQ ID NO: 6905824 - DNA, 22 bp, Homo sapiens
gaagccttatcagtcacttata

SEQ ID NO: 6905825 - DNA, 22 bp, Homo sapiens
gtggttgtttaggtcgtggatc

SEQ ID NO: 6905826 - DNA, 22 bp, Homo sapiens
aggacagagcctgtgcagaccg

SEQ ID NO: 6905827 - DNA, 22 bp, Homo sapiens
agcaaagtcagtggaaccatcc

SEQ ID NO: 6905828 - DNA, 22 bp, Homo sapiens
ctttacttgctttgttacaaaa

SEQ ID NO: 6905829 - DNA, 22 bp, Homo sapiens
cctatacagcctcagctgagat

SEQ ID NO: 6905830 - DNA, 22 bp, Homo sapiens
caggaactggaaccctggccga

SEQ ID NO: 6905831 - DNA, 22 bp, Homo sapiens
gttcatgtttgagaacaaggag

SEQ ID NO: 6905832 - DNA, 23 bp, Homo sapiens
aggcaggtttgggctcttcttgt

SEQ ID NO: 6905833 - DNA, 22 bp, Homo sapiens
cctctggccacatgggacatag

SEQ ID NO: 6905834 - DNA, 22 bp, Homo sapiens
agacatgccaagaaacccagtg

SEQ ID NO: 6905835 - DNA, 22 bp, Homo sapiens
agtcttcagcagggttaaaccc

SEQ ID NO: 6905836 - DNA, 22 bp, Homo sapiens
ttatacagggagtttccctgca

SEQ ID NO: 6905837 - DNA, 21 bp, Homo sapiens
tggtacaccttgcctgtcaga

SEQ ID NO: 6905838 - DNA, 22 bp, Homo sapiens
ttcacagaattgtcttgactgg

SEQ ID NO: 6905839 - DNA, 22 bp, Homo sapiens
tcggagagttggaagtagcaga

SEQ ID NO: 6905840 - DNA, 22 bp, Homo sapiens
tctcagtcagccttgatgtccc

SEQ ID NO: 6905841 - DNA, 22 bp, Homo sapiens
tgacatttcctagtgctttgtg

SEQ ID NO: 6905842 - DNA, 22 bp, Homo sapiens
ttacctgtgtgtttgatacata

SEQ ID NO: 6905843 - DNA, 22 bp, Homo sapiens
tttcaacagctctcaaatgatc

SEQ ID NO: 6905844 - DNA, 22 bp, Homo sapiens
gggccactcctggctgctgagt

SEQ ID NO: 6905845 - DNA, 22 bp, Homo sapiens
acagaatattttatttagatca

SEQ ID NO: 6905846 - DNA, 22 bp, Homo sapiens
tattctgcatgaaaataaacag

SEQ ID NO: 6905847 - DNA, 22 bp, Homo sapiens
tgtggctgtctgttctcctagg

SEQ ID NO: 6905848 - DNA, 22 bp, Homo sapiens
ggaggtcacaaggtgagtaaag

SEQ ID NO: 6905849 - DNA, 22 bp, Homo sapiens
aggcaagcaccgggggcctttt

SEQ ID NO: 6905850 - DNA, 23 bp, Homo sapiens
gccaatttttgactgtcagtagg

SEQ ID NO: 6905851 - DNA, 21 bp, Homo sapiens
agcagaggcagaatgtatgca

SEQ ID NO: 6905852 - DNA, 22 bp, Homo sapiens
attggtgcaatagtcaggagct

SEQ ID NO: 6905853 - DNA, 22 bp, Homo sapiens
tggctgcttaaaattgctgcaa

SEQ ID NO: 6905854 - DNA, 20 bp, Homo sapiens
aaggattgttggaagcatcc

SEQ ID NO: 6905855 - DNA, 22 bp, Homo sapiens
agggtcagtagtgatgcgtgaa

SEQ ID NO: 6905856 - DNA, 22 bp, Homo sapiens
gcacacagattaggaaacagaa

SEQ ID NO: 6905857 - DNA, 18 bp, Homo sapiens
accctgggcaattcactc

SEQ ID NO: 6905858 - DNA, 22 bp, Homo sapiens
aacttgtatatgttattcagag

SEQ ID NO: 6905859 - DNA, 22 bp, Homo sapiens
ctgtccatgacttgcactataa

SEQ ID NO: 6905860 - DNA, 18 bp, Homo sapiens
gctatctctaagatcttt

SEQ ID NO: 6905861 - DNA, 22 bp, Homo sapiens
tgacctcatgatccgcccacct

SEQ ID NO: 6905862 - DNA, 22 bp, Homo sapiens
cacttcaaataagctcttctca

SEQ ID NO: 6905863 - DNA, 22 bp, Homo sapiens
ctggtcatcactctaacagact

SEQ ID NO: 6905864 - DNA, 22 bp, Homo sapiens
agatggggctgaaagttccaat

SEQ ID NO: 6905865 - DNA, 22 bp, Homo sapiens
tcagggacaggatgggcatttc

SEQ ID NO: 6905866 - DNA, 22 bp, Homo sapiens
tgagagctgacagtaagctgca

SEQ ID NO: 6905867 - DNA, 22 bp, Homo sapiens
agtcaacatttgagatgcaatg

SEQ ID NO: 6905868 - DNA, 22 bp, Homo sapiens
tattaaatgttatttgggttgt

SEQ ID NO: 6905869 - DNA, 17 bp, Homo sapiens
agccgggcatggaccag

SEQ ID NO: 6905870 - DNA, 22 bp, Homo sapiens
ggagtctgggaattggagagaa

SEQ ID NO: 6905871 - DNA, 22 bp, Homo sapiens
cttggaggaaggggctcttctg

SEQ ID NO: 6905872 - DNA, 17 bp, Homo sapiens
agcagctgaagcagcca

SEQ ID NO: 6905873 - DNA, 22 bp, Homo sapiens
tggcccagtcagcaggagaggg

SEQ ID NO: 6905874 - DNA, 22 bp, Homo sapiens
aagacatatagttctccccaag

SEQ ID NO: 6905875 - DNA, 22 bp, Homo sapiens
acatgaatgcagccataacact

SEQ ID NO: 6905876 - DNA, 22 bp, Homo sapiens
tggcttaagatttatgctttta

SEQ ID NO: 6905877 - DNA, 22 bp, Homo sapiens
tggcgtgccctccagacttggc

SEQ ID NO: 6905878 - DNA, 22 bp, Homo sapiens
gggaggtgaaaggtcatgtgtg

SEQ ID NO: 6905879 - DNA, 22 bp, Homo sapiens
atagtatgaattaaatcatgag

SEQ ID NO: 6905880 - DNA, 22 bp, Homo sapiens
actctaatctttgtcttttgtg

SEQ ID NO: 6905881 - DNA, 22 bp, Homo sapiens
tagcacactgccttcactgagg

SEQ ID NO: 6905882 - DNA, 22 bp, Homo sapiens
ctagaaattctgattcagtagg

SEQ ID NO: 6905883 - DNA, 22 bp, Homo sapiens
gatgttcgctttggtttgtccc

SEQ ID NO: 6905884 - DNA, 22 bp, Homo sapiens
cccaaaggctctggagatttga

SEQ ID NO: 6905885 - DNA, 22 bp, Homo sapiens
tctctgagatcagccactgact

SEQ ID NO: 6905886 - DNA, 22 bp, Homo sapiens
cttaattggcttatttcctcaa

SEQ ID NO: 6905887 - DNA, 22 bp, Homo sapiens
tcttcataacctagagatagca

SEQ ID NO: 6905888 - DNA, 22 bp, Homo sapiens
tacatgctcttcaaggactcat

SEQ ID NO: 6905889 - DNA, 22 bp, Homo sapiens
aggtatatgttcatgtatgtgt

SEQ ID NO: 6905890 - DNA, 22 bp, Homo sapiens
gaagatacaaatgtgggctttc

SEQ ID NO: 6905891 - DNA, 22 bp, Homo sapiens
ccccacagccgccagcagggag

SEQ ID NO: 6905892 - DNA, 22 bp, Homo sapiens
caaatgaagaaccttctcacct

SEQ ID NO: 6905893 - DNA, 22 bp, Homo sapiens
caggtgacctttgtcctaagtt

SEQ ID NO: 6905894 - DNA, 22 bp, Homo sapiens
tcagatttggacacaggaactt

SEQ ID NO: 6905895 - DNA, 22 bp, Homo sapiens
agcccaggagcctttggagggt

SEQ ID NO: 6905896 - DNA, 22 bp, Homo sapiens
taactggcttaaattttatcaa

SEQ ID NO: 6905897 - DNA, 22 bp, Homo sapiens
ccatggcttttgagtctcaaga

SEQ ID NO: 6905898 - DNA, 22 bp, Homo sapiens
cttggagagggagaaaaataac

SEQ ID NO: 6905899 - DNA, 22 bp, Homo sapiens
gaacagagaagctttactaaag

SEQ ID NO: 6905900 - DNA, 22 bp, Homo sapiens
taaaccttatttgaataccaac

SEQ ID NO: 6905901 - DNA, 22 bp, Homo sapiens
ggggctaactttctgagggtag

SEQ ID NO: 6905902 - DNA, 22 bp, Homo sapiens
cagatcatgggactgtctcagc

SEQ ID NO: 6905903 - DNA, 22 bp, Homo sapiens
ttaggcaatgctctcaaatttg

SEQ ID NO: 6905904 - DNA, 22 bp, Homo sapiens
tctacaatgagaaatgatcagt

SEQ ID NO: 6905905 - DNA, 22 bp, Homo sapiens
ccaggaggcagaggttacagtg

SEQ ID NO: 6905906 - DNA, 22 bp, Homo sapiens
tgctggcataccacctagttca

SEQ ID NO: 6905907 - DNA, 22 bp, Homo sapiens
ttaatgaaacattgactatgat

SEQ ID NO: 6905908 - DNA, 22 bp, Homo sapiens
ggtgtgaattttgaccttttaa

SEQ ID NO: 6905909 - DNA, 22 bp, Homo sapiens
atctcttctgagcaattcctgt

SEQ ID NO: 6905910 - DNA, 22 bp, Homo sapiens
catctcacagcaaactgctgaa

SEQ ID NO: 6905911 - DNA, 22 bp, Homo sapiens
tgaaggagctcaatgatgatgc

SEQ ID NO: 6905912 - DNA, 22 bp, Homo sapiens
ccagccggactccacttcccgt

SEQ ID NO: 6905913 - DNA, 22 bp, Homo sapiens
gctttagtttccacggttataa

SEQ ID NO: 6905914 - DNA, 22 bp, Homo sapiens
agaaaaggttgaaagtaggatt

SEQ ID NO: 6905915 - DNA, 22 bp, Homo sapiens
actcccagctcagggctttccc

SEQ ID NO: 6905916 - DNA, 22 bp, Homo sapiens
acagatgagattcattgaccac

SEQ ID NO: 6905917 - DNA, 22 bp, Homo sapiens
accctgagaatgagtgtctcct

SEQ ID NO: 6905918 - DNA, 22 bp, Homo sapiens
cactctggttagtttaagcatg

SEQ ID NO: 6905919 - DNA, 21 bp, Homo sapiens
tccagccagtaaatgctcagc

SEQ ID NO: 6905920 - DNA, 22 bp, Homo sapiens
cccaggctgcatgagtccatgg

SEQ ID NO: 6905921 - DNA, 22 bp, Homo sapiens
tcacttatgtgtaggcagctta

SEQ ID NO: 6905922 - DNA, 22 bp, Homo sapiens
catcaaatggcaagtgaaagct

SEQ ID NO: 6905923 - DNA, 22 bp, Homo sapiens
ggggatggaatgtagtagtgat

SEQ ID NO: 6905924 - DNA, 22 bp, Homo sapiens
tacagttagtgcctggctactt

SEQ ID NO: 6905925 - DNA, 22 bp, Homo sapiens
aagaacattcgaactattttct

SEQ ID NO: 6905926 - DNA, 22 bp, Homo sapiens
gtctggagacttgggtcatcaa

SEQ ID NO: 6905927 - DNA, 22 bp, Homo sapiens
ctataactgggtattagactac

SEQ ID NO: 6905928 - DNA, 22 bp, Homo sapiens
tgaaggagctgatgtaaggggt

SEQ ID NO: 6905929 - DNA, 23 bp, Homo sapiens
tatttggaaagagggaagaagac

SEQ ID NO: 6905930 - DNA, 22 bp, Homo sapiens
gggaatgtgtctgatggaaaga

SEQ ID NO: 6905931 - DNA, 22 bp, Homo sapiens
aggtaagcagctgtttctaagg

SEQ ID NO: 6905932 - DNA, 22 bp, Homo sapiens
gatgcacagccatgttaatgtg

SEQ ID NO: 6905933 - DNA, 22 bp, Homo sapiens
tttacctttgtgggtctccctc

SEQ ID NO: 6905934 - DNA, 17 bp, Homo sapiens
gcagactgcgggtcccc

SEQ ID NO: 6905935 - DNA, 22 bp, Homo sapiens
atgtctttcgcatcagtagcta

SEQ ID NO: 6905936 - DNA, 22 bp, Homo sapiens
cacccaggttggagtgcagtgg

SEQ ID NO: 6905937 - DNA, 22 bp, Homo sapiens
aatctgtttgatgcttgtgata

SEQ ID NO: 6905938 - DNA, 22 bp, Homo sapiens
gtgtacacatacacatattgaa

SEQ ID NO: 6905939 - DNA, 22 bp, Homo sapiens
agccaggtttctttagctgtca

SEQ ID NO: 6905940 - DNA, 22 bp, Homo sapiens
caagcagatattttagtcaaga

SEQ ID NO: 6905941 - DNA, 22 bp, Homo sapiens
aacagtcagcttctcgggacat

SEQ ID NO: 6905942 - DNA, 22 bp, Homo sapiens
tatgtttcatcaggcatggagt

SEQ ID NO: 6905943 - DNA, 22 bp, Homo sapiens
agtattcagcaaacgtgaacag

SEQ ID NO: 6905944 - DNA, 22 bp, Homo sapiens
agtgtttcaatcctaggggttg

SEQ ID NO: 6905945 - DNA, 17 bp, Homo sapiens
agggagtcagtaggagc

SEQ ID NO: 6905946 - DNA, 22 bp, Homo sapiens
tgcaggaatcagaggggaagcg

SEQ ID NO: 6905947 - DNA, 22 bp, Homo sapiens
tattagcagcatgagaatgggc

SEQ ID NO: 6905948 - DNA, 22 bp, Homo sapiens
tttgcattcctgcctgcattca

SEQ ID NO: 6905949 - DNA, 19 bp, Homo sapiens
aaggcttggctgagctggg

SEQ ID NO: 6905950 - DNA, 22 bp, Homo sapiens
acatgttaaacatcatggaatg

SEQ ID NO: 6905951 - DNA, 19 bp, Homo sapiens
tctgcccacaagaaaggga

SEQ ID NO: 6905952 - DNA, 22 bp, Homo sapiens
ctggctggctcatttttcattg

SEQ ID NO: 6905953 - DNA, 22 bp, Homo sapiens
agtggtgtctgagtggccaggg

SEQ ID NO: 6905954 - DNA, 22 bp, Homo sapiens
tgcaagaattgtataccctcat

SEQ ID NO: 6905955 - DNA, 22 bp, Homo sapiens
gcagagattgtaatgatacctg

SEQ ID NO: 6905956 - DNA, 22 bp, Homo sapiens
gcagacagggctacagaggtac

SEQ ID NO: 6905957 - DNA, 22 bp, Homo sapiens
atacatctagagtcataaaaac

SEQ ID NO: 6905958 - DNA, 22 bp, Homo sapiens
gctgccagccctcggggtctga

SEQ ID NO: 6905959 - DNA, 22 bp, Homo sapiens
gcttcggggtccaagcgcgtgt

SEQ ID NO: 6905960 - DNA, 22 bp, Homo sapiens
gagcacttcagaattgggcaat

SEQ ID NO: 6905961 - DNA, 22 bp, Homo sapiens
tggcacatatttttagtgctca

SEQ ID NO: 6905962 - DNA, 22 bp, Homo sapiens
agctcaagcgtgggctgggcgc

SEQ ID NO: 6905963 - DNA, 22 bp, Homo sapiens
acatggaaagtactccacaatt

SEQ ID NO: 6905964 - DNA, 22 bp, Homo sapiens
ttacttgaggaaaagtagtgtc

SEQ ID NO: 6905965 - DNA, 22 bp, Homo sapiens
atggtgactcctaaatgtgaaa

SEQ ID NO: 6905966 - DNA, 22 bp, Homo sapiens
tgcagggctcctggctccaatc

SEQ ID NO: 6905967 - DNA, 22 bp, Homo sapiens
ctccatatggccctgggacctg

SEQ ID NO: 6905968 - DNA, 22 bp, Homo sapiens
catatctcctccagcacaggcc

SEQ ID NO: 6905969 - DNA, 22 bp, Homo sapiens
gctctaaagagaatctatgcgg

SEQ ID NO: 6905970 - DNA, 22 bp, Homo sapiens
ttgttaaaactccattggtttg

SEQ ID NO: 6905971 - DNA, 22 bp, Homo sapiens
ctggctgccagcatttggggga

SEQ ID NO: 6905972 - DNA, 22 bp, Homo sapiens
acgttcaatgtcagtcaacttt

SEQ ID NO: 6905973 - DNA, 22 bp, Homo sapiens
ccagtcagagcagcgctcgcat

SEQ ID NO: 6905974 - DNA, 22 bp, Homo sapiens
ctacaacattatgctttctgtc

SEQ ID NO: 6905975 - DNA, 22 bp, Homo sapiens
gatttcttcattcattagatgg

SEQ ID NO: 6905976 - DNA, 21 bp, Homo sapiens
tgtcagctccctgtcctgtgt

SEQ ID NO: 6905977 - DNA, 22 bp, Homo sapiens
aaggaagacacagatgaagtga

SEQ ID NO: 6905978 - DNA, 22 bp, Homo sapiens
tttgtagaaagggttgtatgaa

SEQ ID NO: 6905979 - DNA, 22 bp, Homo sapiens
agtctatttcagtcttactagt

SEQ ID NO: 6905980 - DNA, 22 bp, Homo sapiens
agacatcctggggagggcaatg

SEQ ID NO: 6905981 - DNA, 22 bp, Homo sapiens
actagggctcaggcctacctag

SEQ ID NO: 6905982 - DNA, 22 bp, Homo sapiens
tattaaatatatctgttagttg

SEQ ID NO: 6905983 - DNA, 22 bp, Homo sapiens
tgcaggactcaagggtagcagg

SEQ ID NO: 6905984 - DNA, 18 bp, Homo sapiens
tccaggactctgcgtggc

SEQ ID NO: 6905985 - DNA, 22 bp, Homo sapiens
caatttgattaataccatactt

SEQ ID NO: 6905986 - DNA, 22 bp, Homo sapiens
tttctagtggttaagatttaca

SEQ ID NO: 6905987 - DNA, 22 bp, Homo sapiens
cttgtaaaatatccagttaagg

SEQ ID NO: 6905988 - DNA, 22 bp, Homo sapiens
tcagaacctcctagcagtgttc

SEQ ID NO: 6905989 - DNA, 22 bp, Homo sapiens
agaaggccatgtcttggtactt

SEQ ID NO: 6905990 - DNA, 22 bp, Homo sapiens
actgcctgcatccttagggtag

SEQ ID NO: 6905991 - DNA, 22 bp, Homo sapiens
aagcagactcccggccagctca

SEQ ID NO: 6905992 - DNA, 22 bp, Homo sapiens
gagccagactgcctgaagctca

SEQ ID NO: 6905993 - DNA, 22 bp, Homo sapiens
tcaggctttgctctgttgattt

SEQ ID NO: 6905994 - DNA, 22 bp, Homo sapiens
ttctagatgataaaccagcagc

SEQ ID NO: 6905995 - DNA, 22 bp, Homo sapiens
gactctgggagtttatgtgatt

SEQ ID NO: 6905996 - DNA, 22 bp, Homo sapiens
tctggcctatttctgtcagatc

SEQ ID NO: 6905997 - DNA, 22 bp, Homo sapiens
gaaacattcatatgagaaacct

SEQ ID NO: 6905998 - DNA, 22 bp, Homo sapiens
gtgacaggtatactcaccattg

SEQ ID NO: 6905999 - DNA, 22 bp, Homo sapiens
tggaagtgatgctgaggtgacg

SEQ ID NO: 6906000 - DNA, 22 bp, Homo sapiens
catgaagtcaggatttccatga

SEQ ID NO: 6906001 - DNA, 22 bp, Homo sapiens
cttttttaaggtagctcctcct

SEQ ID NO: 6906002 - DNA, 22 bp, Homo sapiens
gtgtaattatataaagatctac

SEQ ID NO: 6906003 - DNA, 22 bp, Homo sapiens
gtgcagctcagttgaaatgcag

SEQ ID NO: 6906004 - DNA, 22 bp, Homo sapiens
atccctgaatgctcctgactgg

SEQ ID NO: 6906005 - DNA, 22 bp, Homo sapiens
gctacagtgataggaaacacat

SEQ ID NO: 6906006 - DNA, 18 bp, Homo sapiens
tccagcaggtctgaggtg

SEQ ID NO: 6906007 - DNA, 16 bp, Homo sapiens
aaggaatgtcattctg

SEQ ID NO: 6906008 - DNA, 22 bp, Homo sapiens
aggcacagggatgcggagccag

SEQ ID NO: 6906009 - DNA, 22 bp, Homo sapiens
agcaagagatttccctacctcc

SEQ ID NO: 6906010 - DNA, 22 bp, Homo sapiens
gtgtactgcaaatgctgctgcc

SEQ ID NO: 6906011 - DNA, 22 bp, Homo sapiens
taggaagctgatggaactagag

SEQ ID NO: 6906012 - DNA, 22 bp, Homo sapiens
gaagaagggagtgcgtgtaata

SEQ ID NO: 6906013 - DNA, 22 bp, Homo sapiens
aggcagctttcagtgtctctca

SEQ ID NO: 6906014 - DNA, 21 bp, Homo sapiens
accctgctttatgccgtcctc

SEQ ID NO: 6906015 - DNA, 22 bp, Homo sapiens
tagattctccacatgtagcaat

SEQ ID NO: 6906016 - DNA, 22 bp, Homo sapiens
tgtcaaaatgactttactacag

SEQ ID NO: 6906017 - DNA, 22 bp, Homo sapiens
ctggtgggagcagcaggcagct

SEQ ID NO: 6906018 - DNA, 22 bp, Homo sapiens
tcagtttagagttatttaatct

SEQ ID NO: 6906019 - DNA, 22 bp, Homo sapiens
cttgaagtggatgttggtataa

SEQ ID NO: 6906020 - DNA, 21 bp, Homo sapiens
ctttggcaagggagaagtcac

SEQ ID NO: 6906021 - DNA, 22 bp, Homo sapiens
taaagacactggttttaatcat

SEQ ID NO: 6906022 - DNA, 22 bp, Homo sapiens
atttctcatctttgtgaatggt

SEQ ID NO: 6906023 - DNA, 22 bp, Homo sapiens
tctgggaaagtaaatgtaaagg

SEQ ID NO: 6906024 - DNA, 22 bp, Homo sapiens
ctgctgagaacccagattacta

SEQ ID NO: 6906025 - DNA, 21 bp, Homo sapiens
atggtctgaggatagcaaaaa

SEQ ID NO: 6906026 - DNA, 22 bp, Homo sapiens
gtataggcattttgattagagt

SEQ ID NO: 6906027 - DNA, 22 bp, Homo sapiens
tcactgctttgagccactgagc

SEQ ID NO: 6906028 - DNA, 22 bp, Homo sapiens
cagacagggtgggtttctgggc

SEQ ID NO: 6906029 - DNA, 22 bp, Homo sapiens
cccattctaggctttgctcttc

SEQ ID NO: 6906030 - DNA, 22 bp, Homo sapiens
gggggacaggatgaatatctgt

SEQ ID NO: 6906031 - DNA, 22 bp, Homo sapiens
ctgtctgttttaccttctccag

SEQ ID NO: 6906032 - DNA, 22 bp, Homo sapiens
cacaatttggacttcactggtt

SEQ ID NO: 6906033 - DNA, 22 bp, Homo sapiens
tggcaggcagagagcggccttt

SEQ ID NO: 6906034 - DNA, 22 bp, Homo sapiens
ttcccagtcccaagaaaagcca

SEQ ID NO: 6906035 - DNA, 22 bp, Homo sapiens
ttcctggtggctttgccaactg

SEQ ID NO: 6906036 - DNA, 22 bp, Homo sapiens
gcattgattctgaagtgaaatg

SEQ ID NO: 6906037 - DNA, 22 bp, Homo sapiens
agggcccatagatcgtcagctt

SEQ ID NO: 6906038 - DNA, 22 bp, Homo sapiens
gagggccagcctgccaagggcc

SEQ ID NO: 6906039 - DNA, 22 bp, Homo sapiens
caagttacctacccaaggcctt

SEQ ID NO: 6906040 - DNA, 22 bp, Homo sapiens
tgggtccagtgcagctgcgcgt

SEQ ID NO: 6906041 - DNA, 22 bp, Homo sapiens
ctgcctggaccggcagccctcc

SEQ ID NO: 6906042 - DNA, 22 bp, Homo sapiens
tgctcagtgagtctgtgacagg

SEQ ID NO: 6906043 - DNA, 22 bp, Homo sapiens
caagtcctcgcttctagctgtg

SEQ ID NO: 6906044 - DNA, 22 bp, Homo sapiens
gtctgctgcagtcgtggctcta

SEQ ID NO: 6906045 - DNA, 22 bp, Homo sapiens
aaagatcacgtcccaggactcg

SEQ ID NO: 6906046 - DNA, 22 bp, Homo sapiens
aaatgtgcttgtgatcagctgt

SEQ ID NO: 6906047 - DNA, 22 bp, Homo sapiens
ctgcagatggtattgttctggt

SEQ ID NO: 6906048 - DNA, 22 bp, Homo sapiens
ctcagtaaggatgcttcagcgg

SEQ ID NO: 6906049 - DNA, 22 bp, Homo sapiens
ttattgttaggcttttggaatt

SEQ ID NO: 6906050 - DNA, 22 bp, Homo sapiens
actgacatttttccctaagcat

SEQ ID NO: 6906051 - DNA, 22 bp, Homo sapiens
gtggactgcgcttgagggggcc

SEQ ID NO: 6906052 - DNA, 20 bp, Homo sapiens
actttggttattgggaccat

SEQ ID NO: 6906053 - DNA, 22 bp, Homo sapiens
atgctttgatagtttattacat

SEQ ID NO: 6906054 - DNA, 22 bp, Homo sapiens
acatttgaaaaagttgatggag

SEQ ID NO: 6906055 - DNA, 22 bp, Homo sapiens
tcaacccttcctccatatttcc

SEQ ID NO: 6906056 - DNA, 22 bp, Homo sapiens
ttttctcaagatccaatgcact

SEQ ID NO: 6906057 - DNA, 22 bp, Homo sapiens
agctctgtgaagccagcagttc

SEQ ID NO: 6906058 - DNA, 22 bp, Homo sapiens
agtggcagttttatatttcatg

SEQ ID NO: 6906059 - DNA, 22 bp, Homo sapiens
gcagcctttggaattagagact

SEQ ID NO: 6906060 - DNA, 22 bp, Homo sapiens
ctgccgagtacagccatagaaa

SEQ ID NO: 6906061 - DNA, 22 bp, Homo sapiens
tgctctggagtgaatttgacaa

SEQ ID NO: 6906062 - DNA, 22 bp, Homo sapiens
atcagcttcataaagttggtca

SEQ ID NO: 6906063 - DNA, 22 bp, Homo sapiens
gaagctaaaagagatgtggttt

SEQ ID NO: 6906064 - DNA, 22 bp, Homo sapiens
attctgggaactttgtctctca

SEQ ID NO: 6906065 - DNA, 22 bp, Homo sapiens
accctctgagaggcacactttg

SEQ ID NO: 6906066 - DNA, 22 bp, Homo sapiens
ctgcggctggggacagctgttg

SEQ ID NO: 6906067 - DNA, 22 bp, Homo sapiens
gctggccagtgtggtgaccacc

SEQ ID NO: 6906068 - DNA, 22 bp, Homo sapiens
gaatcttacctctctattgttg

SEQ ID NO: 6906069 - DNA, 22 bp, Homo sapiens
taactttgataagaatcaggga

SEQ ID NO: 6906070 - DNA, 22 bp, Homo sapiens
aaaatatgtataactcttctgc

SEQ ID NO: 6906071 - DNA, 22 bp, Homo sapiens
tgcgatgtatgcagtatttgtt

SEQ ID NO: 6906072 - DNA, 16 bp, Homo sapiens
acagagtatcaagcga

SEQ ID NO: 6906073 - DNA, 22 bp, Homo sapiens
ctagaacaaattaggaggcata

SEQ ID NO: 6906074 - DNA, 22 bp, Homo sapiens
tcagaatgtggagagctgccct

SEQ ID NO: 6906075 - DNA, 22 bp, Homo sapiens
gcagtggctaagctcgcatgca

SEQ ID NO: 6906076 - DNA, 22 bp, Homo sapiens
taaaatcaccaaaagcaggtgg

SEQ ID NO: 6906077 - DNA, 22 bp, Homo sapiens
ttcacagatgcctgatgtgtgg

SEQ ID NO: 6906078 - DNA, 22 bp, Homo sapiens
attgccctagggctaagcagga

SEQ ID NO: 6906079 - DNA, 22 bp, Homo sapiens
ttgggaagaatggaggtggtta

SEQ ID NO: 6906080 - DNA, 20 bp, Homo sapiens
gtcttatttaacacatgact

SEQ ID NO: 6906081 - DNA, 22 bp, Homo sapiens
tactgcctattcaattggaatt

SEQ ID NO: 6906082 - DNA, 22 bp, Homo sapiens
ttgcaatcagcagtgttttcac

SEQ ID NO: 6906083 - DNA, 22 bp, Homo sapiens
tggctaacaaacaagacattag

SEQ ID NO: 6906084 - DNA, 22 bp, Homo sapiens
tgggaggcccaggcctggcagg

SEQ ID NO: 6906085 - DNA, 22 bp, Homo sapiens
tgcatggtgaatacagttcatt

SEQ ID NO: 6906086 - DNA, 22 bp, Homo sapiens
gccttattttactcaactgtaa

SEQ ID NO: 6906087 - DNA, 22 bp, Homo sapiens
cttcttgttgttagggtcctgt

SEQ ID NO: 6906088 - DNA, 22 bp, Homo sapiens
caagtcacatggccaactgatg

SEQ ID NO: 6906089 - DNA, 22 bp, Homo sapiens
accctgcctgacaacagaggat

SEQ ID NO: 6906090 - DNA, 22 bp, Homo sapiens
cacatgctagaataaatctcca

SEQ ID NO: 6906091 - DNA, 22 bp, Homo sapiens
ccagggtcttcgaggcagcaat

SEQ ID NO: 6906092 - DNA, 22 bp, Homo sapiens
ctaccatccttaggctgaagtg

SEQ ID NO: 6906093 - DNA, 23 bp, Homo sapiens
ttggaacacagtaaatgcacaat

SEQ ID NO: 6906094 - DNA, 22 bp, Homo sapiens
ctatgcttcagagttccaggtg

SEQ ID NO: 6906095 - DNA, 22 bp, Homo sapiens
agcggcagcagatgtgatcagg

SEQ ID NO: 6906096 - DNA, 22 bp, Homo sapiens
gtgaagcagagtgtggaagcaa

SEQ ID NO: 6906097 - DNA, 22 bp, Homo sapiens
ggtcagggttccaggtatcttc

SEQ ID NO: 6906098 - DNA, 22 bp, Homo sapiens
ttatcttggtgttttagtaatt

SEQ ID NO: 6906099 - DNA, 22 bp, Homo sapiens
attgatggaaaacaaatgatga

SEQ ID NO: 6906100 - DNA, 22 bp, Homo sapiens
ggtcacatctaaatggagcatt

SEQ ID NO: 6906101 - DNA, 22 bp, Homo sapiens
ctagggcaatgactcaaagcgg

SEQ ID NO: 6906102 - DNA, 22 bp, Homo sapiens
actgtggagcagtggctaggga

SEQ ID NO: 6906103 - DNA, 22 bp, Homo sapiens
tgccttgggatatatggacact

SEQ ID NO: 6906104 - DNA, 22 bp, Homo sapiens
tacatgcttctatatgtgaagt

SEQ ID NO: 6906105 - DNA, 22 bp, Homo sapiens
tcaggctctgagctgatgctaa

SEQ ID NO: 6906106 - DNA, 22 bp, Homo sapiens
ccacaaaactgtgtgtcaaaga

SEQ ID NO: 6906107 - DNA, 22 bp, Homo sapiens
gtcccactgggcaactagaaaa

SEQ ID NO: 6906108 - DNA, 21 bp, Homo sapiens
aagtaatgtgtctcttctacc

SEQ ID NO: 6906109 - DNA, 22 bp, Homo sapiens
ggccttagtgaggtcctgatgc

SEQ ID NO: 6906110 - DNA, 19 bp, Homo sapiens
cacttcaatcctttatcaa

SEQ ID NO: 6906111 - DNA, 17 bp, Homo sapiens
tatcagaatgtgtttac

SEQ ID NO: 6906112 - DNA, 22 bp, Homo sapiens
ctgtgtctcatccgcctctggc

SEQ ID NO: 6906113 - DNA, 22 bp, Homo sapiens
aggcatatgaattgatcaaatt

SEQ ID NO: 6906114 - DNA, 18 bp, Homo sapiens
ggtcctgggcctggctca

SEQ ID NO: 6906115 - DNA, 19 bp, Homo sapiens
ttctgtgttaattccttta

SEQ ID NO: 6906116 - DNA, 22 bp, Homo sapiens
acattgaagctgtgaaatcaaa

SEQ ID NO: 6906117 - DNA, 22 bp, Homo sapiens
ggaatcttaatggcatggagtt

SEQ ID NO: 6906118 - DNA, 21 bp, Homo sapiens
ctagcccctactccaagttga

SEQ ID NO: 6906119 - DNA, 22 bp, Homo sapiens
ttgagtctgcaatacataacac

SEQ ID NO: 6906120 - DNA, 22 bp, Homo sapiens
actgtgtatgatatgtactggg

SEQ ID NO: 6906121 - DNA, 22 bp, Homo sapiens
ggctgtgcgtcatccggctgca

SEQ ID NO: 6906122 - DNA, 22 bp, Homo sapiens
agtcagtcaccatttaagaaca

SEQ ID NO: 6906123 - DNA, 23 bp, Homo sapiens
ctgtctcctgggctaggtggaat

SEQ ID NO: 6906124 - DNA, 22 bp, Homo sapiens
agagacaatgccaatgcacacg

SEQ ID NO: 6906125 - DNA, 22 bp, Homo sapiens
tcctccttgttttcctgtttac

SEQ ID NO: 6906126 - DNA, 19 bp, Homo sapiens
catgaggcagctgcacccc

SEQ ID NO: 6906127 - DNA, 22 bp, Homo sapiens
aagtcactcatattcctcaagc

SEQ ID NO: 6906128 - DNA, 22 bp, Homo sapiens
attcagaaagcaagtgctgggt

SEQ ID NO: 6906129 - DNA, 22 bp, Homo sapiens
gccaatggctcatgagcaggac

SEQ ID NO: 6906130 - DNA, 23 bp, Homo sapiens
atggtttatgttgttgtgaagca

SEQ ID NO: 6906131 - DNA, 15 bp, Homo sapiens
gcaggcaggtcacct

SEQ ID NO: 6906132 - DNA, 22 bp, Homo sapiens
atctgaagtccttataatctga

SEQ ID NO: 6906133 - DNA, 22 bp, Homo sapiens
aggtgctgttaacatatgaggt

SEQ ID NO: 6906134 - DNA, 22 bp, Homo sapiens
ctcttcattagttcctgtccca

SEQ ID NO: 6906135 - DNA, 22 bp, Homo sapiens
tagcccatggactggtcagctg

SEQ ID NO: 6906136 - DNA, 22 bp, Homo sapiens
tctcctctatttctgtatgtat

SEQ ID NO: 6906137 - DNA, 22 bp, Homo sapiens
ctggcccttgacttacagcagg

SEQ ID NO: 6906138 - DNA, 21 bp, Homo sapiens
tttgttcatagctcactcttt

SEQ ID NO: 6906139 - DNA, 22 bp, Homo sapiens
tcatggcagccctttactagag

SEQ ID NO: 6906140 - DNA, 18 bp, Homo sapiens
ttccttgattagagagaa

SEQ ID NO: 6906141 - DNA, 22 bp, Homo sapiens
gtgactttaacttcagattaga

SEQ ID NO: 6906142 - DNA, 22 bp, Homo sapiens
tagtattcagcttctcaggcaa

SEQ ID NO: 6906143 - DNA, 22 bp, Homo sapiens
agtaaaaattgaggtgcaaaat

SEQ ID NO: 6906144 - DNA, 22 bp, Homo sapiens
gtgaagttggccagtttagttt

SEQ ID NO: 6906145 - DNA, 16 bp, Homo sapiens
gcacacacatcaatga

SEQ ID NO: 6906146 - DNA, 22 bp, Homo sapiens
atggctctgctgggcaaagcaa

SEQ ID NO: 6906147 - DNA, 22 bp, Homo sapiens
tgctgcagattgcagattaact

SEQ ID NO: 6906148 - DNA, 22 bp, Homo sapiens
cagttttggtgatatttgagaa

SEQ ID NO: 6906149 - DNA, 17 bp, Homo sapiens
acccattttgcacaggc

SEQ ID NO: 6906150 - DNA, 19 bp, Homo sapiens
agggagaattccaagagga

SEQ ID NO: 6906151 - DNA, 22 bp, Homo sapiens
tttcctaaggctcattttaaaa

SEQ ID NO: 6906152 - DNA, 22 bp, Homo sapiens
tgcagtttaaacttggcaactt

SEQ ID NO: 6906153 - DNA, 22 bp, Homo sapiens
tggtgcagtcattggcccaggg

SEQ ID NO: 6906154 - DNA, 22 bp, Homo sapiens
tagctcagcaggtgggacaggt

SEQ ID NO: 6906155 - DNA, 23 bp, Homo sapiens
tgtattacagatgcatcagtgat

SEQ ID NO: 6906156 - DNA, 22 bp, Homo sapiens
ccatgctctggggaggtcaagc

SEQ ID NO: 6906157 - DNA, 22 bp, Homo sapiens
cgacagcagaagaagcaagcca

SEQ ID NO: 6906158 - DNA, 22 bp, Homo sapiens
aaatctctgcaggcaaatgtga

SEQ ID NO: 6906159 - DNA, 22 bp, Homo sapiens
atcaccagtaagttttcagttt

SEQ ID NO: 6906160 - DNA, 22 bp, Homo sapiens
cacatataacctagacaaggcc

SEQ ID NO: 6906161 - DNA, 19 bp, Homo sapiens
atgggctatggtgctgttt

SEQ ID NO: 6906162 - DNA, 22 bp, Homo sapiens
atgtagtactgggtatgtttct

SEQ ID NO: 6906163 - DNA, 23 bp, Homo sapiens
agagtaatgtttttactgtattc

SEQ ID NO: 6906164 - DNA, 22 bp, Homo sapiens
aggcaagcattgggaacagggc

SEQ ID NO: 6906165 - DNA, 22 bp, Homo sapiens
tgccttcttctccctggctcag

SEQ ID NO: 6906166 - DNA, 22 bp, Homo sapiens
ctggatgtaacgaaggtttcac

SEQ ID NO: 6906167 - DNA, 22 bp, Homo sapiens
accttgtgaggttacataatgt

SEQ ID NO: 6906168 - DNA, 22 bp, Homo sapiens
acactcagtaaacgacaatggg

SEQ ID NO: 6906169 - DNA, 22 bp, Homo sapiens
tctggtaataggcaatagcttg

SEQ ID NO: 6906170 - DNA, 22 bp, Homo sapiens
tttccagtgaaattttgaatgt

SEQ ID NO: 6906171 - DNA, 21 bp, Homo sapiens
agtgtgttcttggcattacct

SEQ ID NO: 6906172 - DNA, 22 bp, Homo sapiens
cttgtttaaataagatagcagt

SEQ ID NO: 6906173 - DNA, 22 bp, Homo sapiens
actagaccaaggaatcctggaa

SEQ ID NO: 6906174 - DNA, 22 bp, Homo sapiens
gtggtccaaggagtttccagca

SEQ ID NO: 6906175 - DNA, 22 bp, Homo sapiens
gcagagcatttcggttgcttcc

SEQ ID NO: 6906176 - DNA, 22 bp, Homo sapiens
tacaatcaggctctagcttctc

SEQ ID NO: 6906177 - DNA, 18 bp, Homo sapiens
aggtgcagcctctgaggc

SEQ ID NO: 6906178 - DNA, 19 bp, Homo sapiens
ttgaagaataaaaacacat

SEQ ID NO: 6906179 - DNA, 22 bp, Homo sapiens
agcgggctcacccggttgttgt

SEQ ID NO: 6906180 - DNA, 22 bp, Homo sapiens
gctatgtgtgttttgctgcagc

SEQ ID NO: 6906181 - DNA, 22 bp, Homo sapiens
gagcttagacttttcacttcca

SEQ ID NO: 6906182 - DNA, 22 bp, Homo sapiens
aatgaaatgtagcttatccata

SEQ ID NO: 6906183 - DNA, 22 bp, Homo sapiens
tcatgcaagcaggcactgggaa

SEQ ID NO: 6906184 - DNA, 22 bp, Homo sapiens
gtatgtgaggttggtttccagg

SEQ ID NO: 6906185 - DNA, 22 bp, Homo sapiens
ctaagcacactgccttgctgtg

SEQ ID NO: 6906186 - DNA, 17 bp, Homo sapiens
atgtaagaagaaagcag

SEQ ID NO: 6906187 - DNA, 22 bp, Homo sapiens
catgtttctgagaaaagtagga

SEQ ID NO: 6906188 - DNA, 22 bp, Homo sapiens
caggaagcaagtgattttcttg

SEQ ID NO: 6906189 - DNA, 22 bp, Homo sapiens
cacttagtctcaccagttcagt

SEQ ID NO: 6906190 - DNA, 22 bp, Homo sapiens
taagagaccgatattcttaagt

SEQ ID NO: 6906191 - DNA, 22 bp, Homo sapiens
tgaggctcagagaacagtgact

SEQ ID NO: 6906192 - DNA, 21 bp, Homo sapiens
tgctttcagactcttacagaa

SEQ ID NO: 6906193 - DNA, 22 bp, Homo sapiens
gtcagctagaggatgtgacatt

SEQ ID NO: 6906194 - DNA, 18 bp, Homo sapiens
atggcttctgagtggagg

SEQ ID NO: 6906195 - DNA, 22 bp, Homo sapiens
aggctgccatagggaactgcat

SEQ ID NO: 6906196 - DNA, 22 bp, Homo sapiens
tttgactcattaaagtctccgt

SEQ ID NO: 6906197 - DNA, 22 bp, Homo sapiens
ggagcctggttactagagcctg

SEQ ID NO: 6906198 - DNA, 22 bp, Homo sapiens
aattacttaagagaaactttga

SEQ ID NO: 6906199 - DNA, 22 bp, Homo sapiens
gggcagccgcgtgacctgccag

SEQ ID NO: 6906200 - DNA, 21 bp, Homo sapiens
ccttctccacagggtctccgg

SEQ ID NO: 6906201 - DNA, 23 bp, Homo sapiens
cttttaacttgatctgagaccag

SEQ ID NO: 6906202 - DNA, 22 bp, Homo sapiens
gggaggtaaagatgagctcagt

SEQ ID NO: 6906203 - DNA, 22 bp, Homo sapiens
gctggcaaggtgctggagggcc

SEQ ID NO: 6906204 - DNA, 22 bp, Homo sapiens
aagaggaatgggtgtgtttatg

SEQ ID NO: 6906205 - DNA, 22 bp, Homo sapiens
ggacagcattcctagttccaaa

SEQ ID NO: 6906206 - DNA, 22 bp, Homo sapiens
tgccctgggctttgctatgact

SEQ ID NO: 6906207 - DNA, 22 bp, Homo sapiens
tgtgtggggaaggaaggagctg

SEQ ID NO: 6906208 - DNA, 22 bp, Homo sapiens
tctgtaatcttccccagctcag

SEQ ID NO: 6906209 - DNA, 22 bp, Homo sapiens
tcatgcagtgaatctttcttgc

SEQ ID NO: 6906210 - DNA, 22 bp, Homo sapiens
agagatctgaaacaaattagga

SEQ ID NO: 6906211 - DNA, 22 bp, Homo sapiens
cacaggaacttactggccactt

SEQ ID NO: 6906212 - DNA, 22 bp, Homo sapiens
tgtaccgcaaatgctgctgcct

SEQ ID NO: 6906213 - DNA, 22 bp, Homo sapiens
tgtgctaaggcagtctatcaca

SEQ ID NO: 6906214 - DNA, 22 bp, Homo sapiens
aggccaggcctttctccattcc

SEQ ID NO: 6906215 - DNA, 22 bp, Homo sapiens
aggccaggcgagacacccggct

SEQ ID NO: 6906216 - DNA, 22 bp, Homo sapiens
cactgattaagtctgctagagg

SEQ ID NO: 6906217 - DNA, 22 bp, Homo sapiens
tcactcagctagcttcaggagc

SEQ ID NO: 6906218 - DNA, 17 bp, Homo sapiens
ggatagtgctgggctgg

SEQ ID NO: 6906219 - DNA, 22 bp, Homo sapiens
aacttgaattctgccattcaga

SEQ ID NO: 6906220 - DNA, 22 bp, Homo sapiens
caacacagccattcccctagaa

SEQ ID NO: 6906221 - DNA, 22 bp, Homo sapiens
tggttggctgagcagagtcact

SEQ ID NO: 6906222 - DNA, 22 bp, Homo sapiens
ccatgttggaacttcacattct

SEQ ID NO: 6906223 - DNA, 22 bp, Homo sapiens
ttcagacaaatttgaggaagct

SEQ ID NO: 6906224 - DNA, 18 bp, Homo sapiens
gcactgaggaaaacctct

SEQ ID NO: 6906225 - DNA, 19 bp, Homo sapiens
aggaggccatgccactaga

SEQ ID NO: 6906226 - DNA, 22 bp, Homo sapiens
tttatgtagttacggactatca

SEQ ID NO: 6906227 - DNA, 22 bp, Homo sapiens
tgggagtcaaccctcacgagca

SEQ ID NO: 6906228 - DNA, 22 bp, Homo sapiens
atcccatagggttatcataggg

SEQ ID NO: 6906229 - DNA, 22 bp, Homo sapiens
tcctggccttatccccaaactg

SEQ ID NO: 6906230 - DNA, 22 bp, Homo sapiens
tgggatatacctatcctagaag

SEQ ID NO: 6906231 - DNA, 22 bp, Homo sapiens
ttcttgtatataaaaatcattt

SEQ ID NO: 6906232 - DNA, 22 bp, Homo sapiens
acctctggccttcaggcatcat

SEQ ID NO: 6906233 - DNA, 22 bp, Homo sapiens
gtggaatggccatgggatcctt

SEQ ID NO: 6906234 - DNA, 22 bp, Homo sapiens
cacatttgaaggaattagcatt

SEQ ID NO: 6906235 - DNA, 22 bp, Homo sapiens
ggtagcacagggcactgatctc

SEQ ID NO: 6906236 - DNA, 22 bp, Homo sapiens
aagtcaggctggggtctggcag

SEQ ID NO: 6906237 - DNA, 22 bp, Homo sapiens
gagtagcattctagagtatgct

SEQ ID NO: 6906238 - DNA, 22 bp, Homo sapiens
cagtgcctgtgggcttcttcca

SEQ ID NO: 6906239 - DNA, 22 bp, Homo sapiens
tttctgccttgtagactagaat

SEQ ID NO: 6906240 - DNA, 22 bp, Homo sapiens
atttgaatgcaggtagctgagt

SEQ ID NO: 6906241 - DNA, 22 bp, Homo sapiens
tcacagagttaaaagtttcttt

SEQ ID NO: 6906242 - DNA, 22 bp, Homo sapiens
tttaatagggcccaatgagact

SEQ ID NO: 6906243 - DNA, 22 bp, Homo sapiens
ctacacttgcatgagtcttgaa

SEQ ID NO: 6906244 - DNA, 22 bp, Homo sapiens
aggaatgtaacaggagtaaaaa

SEQ ID NO: 6906245 - DNA, 22 bp, Homo sapiens
aagcatccgtatctctttttta

SEQ ID NO: 6906246 - DNA, 22 bp, Homo sapiens
aacctcgaatgccttcctgagg

SEQ ID NO: 6906247 - DNA, 20 bp, Homo sapiens
ctcaccaggtgtaggctgag

SEQ ID NO: 6906248 - DNA, 22 bp, Homo sapiens
atgcccaatgtcacaatttttg

SEQ ID NO: 6906249 - DNA, 22 bp, Homo sapiens
ttctccttttccagttcccagt

SEQ ID NO: 6906250 - DNA, 20 bp, Homo sapiens
gaggtagggcttaaggcaag

SEQ ID NO: 6906251 - DNA, 22 bp, Homo sapiens
ggtaggagtattttgcagcagt

SEQ ID NO: 6906252 - DNA, 22 bp, Homo sapiens
gtggcccttggagttgtgacct

SEQ ID NO: 6906253 - DNA, 22 bp, Homo sapiens
ttatggcattcattggggcttt

SEQ ID NO: 6906254 - DNA, 22 bp, Homo sapiens
tctggctgcgtggcctttagca

SEQ ID NO: 6906255 - DNA, 22 bp, Homo sapiens
ctttctttgtccaccaacaatg

SEQ ID NO: 6906256 - DNA, 22 bp, Homo sapiens
ggttttccaaccggctatcatc

SEQ ID NO: 6906257 - DNA, 22 bp, Homo sapiens
aggcagattacttgaggccagg

SEQ ID NO: 6906258 - DNA, 22 bp, Homo sapiens
caatgggagcagaaattgtttg

SEQ ID NO: 6906259 - DNA, 22 bp, Homo sapiens
taactgtaatataaatatgagt

SEQ ID NO: 6906260 - DNA, 19 bp, Homo sapiens
ggcagaattttatgagctg

SEQ ID NO: 6906261 - DNA, 22 bp, Homo sapiens
aagtacagattcctagtgagat

SEQ ID NO: 6906262 - DNA, 22 bp, Homo sapiens
ctgtctctgttgcctgtaggtg

SEQ ID NO: 6906263 - DNA, 23 bp, Homo sapiens
aactaccacaactcttgagatgc

SEQ ID NO: 6906264 - DNA, 22 bp, Homo sapiens
tacgaatcctgtggatgaatgt

SEQ ID NO: 6906265 - DNA, 22 bp, Homo sapiens
cagaaaggacagagtgagggtg

SEQ ID NO: 6906266 - DNA, 22 bp, Homo sapiens
tggtcctgctacaggggattag

SEQ ID NO: 6906267 - DNA, 22 bp, Homo sapiens
ttcacatgaaagtaggaaagga

SEQ ID NO: 6906268 - DNA, 22 bp, Homo sapiens
aaacttttataaagctgcagat

SEQ ID NO: 6906269 - DNA, 22 bp, Homo sapiens
catgctaattaattccacctgc

SEQ ID NO: 6906270 - DNA, 22 bp, Homo sapiens
cagggcttcgatggatggatgg

SEQ ID NO: 6906271 - DNA, 22 bp, Homo sapiens
tggaccccctcaaggcagagct

SEQ ID NO: 6906272 - DNA, 22 bp, Homo sapiens
tctgggcctcagtttcttcatc

SEQ ID NO: 6906273 - DNA, 22 bp, Homo sapiens
atcacgtgaagtccataatagt

SEQ ID NO: 6906274 - DNA, 22 bp, Homo sapiens
atatcagtatctatgtatttgt

SEQ ID NO: 6906275 - DNA, 22 bp, Homo sapiens
gagatactttacagtgattgcc

SEQ ID NO: 6906276 - DNA, 22 bp, Homo sapiens
ccttttctatccttctaggttc

SEQ ID NO: 6906277 - DNA, 22 bp, Homo sapiens
ggcagatgctggcttctgctgt

SEQ ID NO: 6906278 - DNA, 22 bp, Homo sapiens
cctcttcagcaaagttcggccc

SEQ ID NO: 6906279 - DNA, 22 bp, Homo sapiens
ggtcccaagcaatgcccttggc

SEQ ID NO: 6906280 - DNA, 22 bp, Homo sapiens
cacatttctgtacttaggtaga

SEQ ID NO: 6906281 - DNA, 22 bp, Homo sapiens
taaaagacatataactgtagga

SEQ ID NO: 6906282 - DNA, 22 bp, Homo sapiens
ctacagccagatgcagaaagtt

SEQ ID NO: 6906283 - DNA, 22 bp, Homo sapiens
acaggtccttataagagcactc

SEQ ID NO: 6906284 - DNA, 22 bp, Homo sapiens
attctagacatctgcagttgtt

SEQ ID NO: 6906285 - DNA, 22 bp, Homo sapiens
gtgtgtggaaagttttccatgg

SEQ ID NO: 6906286 - DNA, 22 bp, Homo sapiens
tatagcttcaaatgctatagct

SEQ ID NO: 6906287 - DNA, 22 bp, Homo sapiens
atctggagaatgtttgtctccg

SEQ ID NO: 6906288 - DNA, 22 bp, Homo sapiens
ccctggaggtcagaggcctggg

SEQ ID NO: 6906289 - DNA, 15 bp, Homo sapiens
gccttgaatgtgaat

SEQ ID NO: 6906290 - DNA, 22 bp, Homo sapiens
cagtgttactgggcctgggtgt

SEQ ID NO: 6906291 - DNA, 22 bp, Homo sapiens
ccagctctgcatgtttcccttg

SEQ ID NO: 6906292 - DNA, 22 bp, Homo sapiens
gctgcttttcacagagacaaga

SEQ ID NO: 6906293 - DNA, 22 bp, Homo sapiens
agattcatgggaaagctttagg

SEQ ID NO: 6906294 - DNA, 22 bp, Homo sapiens
ctccaggacactaacccaggct

SEQ ID NO: 6906295 - DNA, 22 bp, Homo sapiens
tattttgaaagtctgttttgaa

SEQ ID NO: 6906296 - DNA, 22 bp, Homo sapiens
agggctgagaatgacagggccg

SEQ ID NO: 6906297 - DNA, 22 bp, Homo sapiens
gaaggcccagtcaaggggctag

SEQ ID NO: 6906298 - DNA, 21 bp, Homo sapiens
aggtttctcttttatggaggg

SEQ ID NO: 6906299 - DNA, 19 bp, Homo sapiens
tcagaattctgtctcttga

SEQ ID NO: 6906300 - DNA, 22 bp, Homo sapiens
caccagcttctcattgcgggtc

SEQ ID NO: 6906301 - DNA, 22 bp, Homo sapiens
caggttggtcggcaagtacaca

SEQ ID NO: 6906302 - DNA, 22 bp, Homo sapiens
gcagcttggtgaaaggtgatgg

SEQ ID NO: 6906303 - DNA, 20 bp, Homo sapiens
tggccaccactgtatatcaa

SEQ ID NO: 6906304 - DNA, 21 bp, Homo sapiens
agaggaagaagagtgtattat

SEQ ID NO: 6906305 - DNA, 22 bp, Homo sapiens
gacagctccttttggtgcatat

SEQ ID NO: 6906306 - DNA, 22 bp, Homo sapiens
agctgctttgccaatgcgttcc

SEQ ID NO: 6906307 - DNA, 22 bp, Homo sapiens
attgattctaccagctactttg

SEQ ID NO: 6906308 - DNA, 22 bp, Homo sapiens
agtacacagaattctacttgtt

SEQ ID NO: 6906309 - DNA, 22 bp, Homo sapiens
cctcacagcttttcaaagtgga

SEQ ID NO: 6906310 - DNA, 22 bp, Homo sapiens
ttgaaagaggcaaagtttgatc

SEQ ID NO: 6906311 - DNA, 22 bp, Homo sapiens
gtctcagaccaccctctttggc

SEQ ID NO: 6906312 - DNA, 22 bp, Homo sapiens
atcactatgggcattatattta

SEQ ID NO: 6906313 - DNA, 22 bp, Homo sapiens
tacagcaatgcctgaaatagta

SEQ ID NO: 6906314 - DNA, 22 bp, Homo sapiens
attgctgacaccaagtagtagc

SEQ ID NO: 6906315 - DNA, 18 bp, Homo sapiens
tttctgaatgtctatttc

SEQ ID NO: 6906316 - DNA, 22 bp, Homo sapiens
agaccctctccatgcccactgc

SEQ ID NO: 6906317 - DNA, 22 bp, Homo sapiens
tcactgcactccagcctgggca

SEQ ID NO: 6906318 - DNA, 22 bp, Homo sapiens
gcttttgtgagattaagctact

SEQ ID NO: 6906319 - DNA, 22 bp, Homo sapiens
aaggagaatttggcttgtgatg

SEQ ID NO: 6906320 - DNA, 22 bp, Homo sapiens
ctccccacacactaggcctgat

SEQ ID NO: 6906321 - DNA, 22 bp, Homo sapiens
tgtcatgccatttaaaatgttt

SEQ ID NO: 6906322 - DNA, 22 bp, Homo sapiens
tcctgggaccaggcacctactg

SEQ ID NO: 6906323 - DNA, 22 bp, Homo sapiens
tttgtcctgcttgggcttaaaa

SEQ ID NO: 6906324 - DNA, 23 bp, Homo sapiens
tggaaatctgggtgaggacagaa

SEQ ID NO: 6906325 - DNA, 22 bp, Homo sapiens
tgcccttgggtaacttgctgat

SEQ ID NO: 6906326 - DNA, 22 bp, Homo sapiens
ctggagggagattcaaaggagg

SEQ ID NO: 6906327 - DNA, 22 bp, Homo sapiens
tgtgtaattatagggagatcta

SEQ ID NO: 6906328 - DNA, 22 bp, Homo sapiens
tccgcgctctcacccgctcccg

SEQ ID NO: 6906329 - DNA, 22 bp, Homo sapiens
tagcacagacagaatggtcata

SEQ ID NO: 6906330 - DNA, 22 bp, Homo sapiens
tgccatactataaggctgtcaa

SEQ ID NO: 6906331 - DNA, 22 bp, Homo sapiens
ctgccttgaggaggttgtggga

SEQ ID NO: 6906332 - DNA, 22 bp, Homo sapiens
gtcacagtgacagagatgttag

SEQ ID NO: 6906333 - DNA, 22 bp, Homo sapiens
gggactgggagatcctcctggc

SEQ ID NO: 6906334 - DNA, 22 bp, Homo sapiens
tgatttcctctactagcaatta

SEQ ID NO: 6906335 - DNA, 22 bp, Homo sapiens
tggctccacaggccagggtgtg

SEQ ID NO: 6906336 - DNA, 23 bp, Homo sapiens
actggctttgatccagatagatt

SEQ ID NO: 6906337 - DNA, 22 bp, Homo sapiens
ccatggccgccgctgctcagga

SEQ ID NO: 6906338 - DNA, 22 bp, Homo sapiens
tatgtatcatggacatgagact

SEQ ID NO: 6906339 - DNA, 22 bp, Homo sapiens
aagccctggaactttcctagcc

SEQ ID NO: 6906340 - DNA, 19 bp, Homo sapiens
agtctttcccactcgtctt

SEQ ID NO: 6906341 - DNA, 22 bp, Homo sapiens
tttgcatcctgtgtgtgaaagt

SEQ ID NO: 6906342 - DNA, 22 bp, Homo sapiens
ctgtccatggtgctggacggtc

SEQ ID NO: 6906343 - DNA, 22 bp, Homo sapiens
agaccagttcccttcttggctg

SEQ ID NO: 6906344 - DNA, 22 bp, Homo sapiens
aataccatgcagaaataacata

SEQ ID NO: 6906345 - DNA, 22 bp, Homo sapiens
gcagccagggagagaaccaggg

SEQ ID NO: 6906346 - DNA, 18 bp, Homo sapiens
aggcagacactagaggtc

SEQ ID NO: 6906347 - DNA, 22 bp, Homo sapiens
cacagagaatgatgagtcactg

SEQ ID NO: 6906348 - DNA, 20 bp, Homo sapiens
aggaaggagaatctgagcaa

SEQ ID NO: 6906349 - DNA, 22 bp, Homo sapiens
aagtcttaggcattttatttct

SEQ ID NO: 6906350 - DNA, 22 bp, Homo sapiens
aaacttcttgctgcattttctg

SEQ ID NO: 6906351 - DNA, 19 bp, Homo sapiens
atagaacctgcagtttcaa

SEQ ID NO: 6906352 - DNA, 18 bp, Homo sapiens
tctgaaggaatgattcca

SEQ ID NO: 6906353 - DNA, 22 bp, Homo sapiens
aagagactaagaaagggcaata

SEQ ID NO: 6906354 - DNA, 22 bp, Homo sapiens
taaggagagaatttagaggttt

SEQ ID NO: 6906355 - DNA, 22 bp, Homo sapiens
agtgggcagtgcgctcggatgc

SEQ ID NO: 6906356 - DNA, 17 bp, Homo sapiens
ctgagccccgggcagct

SEQ ID NO: 6906357 - DNA, 19 bp, Homo sapiens
agcacctgtgagagcctgg

SEQ ID NO: 6906358 - DNA, 22 bp, Homo sapiens
taagtttccagattgtaagtcc

SEQ ID NO: 6906359 - DNA, 22 bp, Homo sapiens
caggcagagaactcatccgtga

SEQ ID NO: 6906360 - DNA, 22 bp, Homo sapiens
tgcttgatgattgctgtctccc

SEQ ID NO: 6906361 - DNA, 23 bp, Homo sapiens
tgctggctgtgttattgccaaca

SEQ ID NO: 6906362 - DNA, 22 bp, Homo sapiens
tggtccagactttgacctctca

SEQ ID NO: 6906363 - DNA, 19 bp, Homo sapiens
ttttccttctcctcttaat

SEQ ID NO: 6906364 - DNA, 22 bp, Homo sapiens
tcactttgatgacattgtagct

SEQ ID NO: 6906365 - DNA, 22 bp, Homo sapiens
ttgcagcccgggttggtttgtg

SEQ ID NO: 6906366 - DNA, 22 bp, Homo sapiens
cccaggagtaagtgacattgtt

SEQ ID NO: 6906367 - DNA, 22 bp, Homo sapiens
actggtttttccatatgagatg

SEQ ID NO: 6906368 - DNA, 22 bp, Homo sapiens
tcccatacctagggcttttccc

SEQ ID NO: 6906369 - DNA, 22 bp, Homo sapiens
ggaaggaaattggggcagttgt

SEQ ID NO: 6906370 - DNA, 17 bp, Homo sapiens
agcccctcagcgtcacc

SEQ ID NO: 6906371 - DNA, 22 bp, Homo sapiens
cttctagagaggtgagctggag

SEQ ID NO: 6906372 - DNA, 21 bp, Homo sapiens
tataggaatcagtcacatctg

SEQ ID NO: 6906373 - DNA, 21 bp, Homo sapiens
gggctatgttggccaccttcc

SEQ ID NO: 6906374 - DNA, 18 bp, Homo sapiens
catccttatagctgagaa

SEQ ID NO: 6906375 - DNA, 22 bp, Homo sapiens
agcagctcctgccatgagtgct

SEQ ID NO: 6906376 - DNA, 22 bp, Homo sapiens
agtggtagaattccatataccc

SEQ ID NO: 6906377 - DNA, 22 bp, Homo sapiens
caggatttcatacatctttact

SEQ ID NO: 6906378 - DNA, 22 bp, Homo sapiens
aggcttttgtggtgtggaatgg

SEQ ID NO: 6906379 - DNA, 22 bp, Homo sapiens
gttaacatttctaggtgcaggg

SEQ ID NO: 6906380 - DNA, 22 bp, Homo sapiens
attaggaaatgtgttgcaagca

SEQ ID NO: 6906381 - DNA, 22 bp, Homo sapiens
ggcgctggtggtcttgcgagcg

SEQ ID NO: 6906382 - DNA, 22 bp, Homo sapiens
tggctccactctccaggagttt

SEQ ID NO: 6906383 - DNA, 22 bp, Homo sapiens
tcaaatacatggtcaatcaact

SEQ ID NO: 6906384 - DNA, 22 bp, Homo sapiens
gtttataatccaactctgctcc

SEQ ID NO: 6906385 - DNA, 22 bp, Homo sapiens
caattgtattactgagcttata

SEQ ID NO: 6906386 - DNA, 22 bp, Homo sapiens
tttcttcttaatactggctgct

SEQ ID NO: 6906387 - DNA, 22 bp, Homo sapiens
ttcagtagggccctcacacagt

SEQ ID NO: 6906388 - DNA, 22 bp, Homo sapiens
cagggcggggtctgccggccct

SEQ ID NO: 6906389 - DNA, 21 bp, Homo sapiens
aagtagatcactgttctcttg

SEQ ID NO: 6906390 - DNA, 22 bp, Homo sapiens
tagctagctgcacaggccctgg

SEQ ID NO: 6906391 - DNA, 22 bp, Homo sapiens
tctggatttgtcatctttaggg

SEQ ID NO: 6906392 - DNA, 22 bp, Homo sapiens
attcaaatgtcaaatccaccag

SEQ ID NO: 6906393 - DNA, 22 bp, Homo sapiens
tcagaagcatccatttcaccac

SEQ ID NO: 6906394 - DNA, 22 bp, Homo sapiens
gcaaatgctctccttggtcagg

SEQ ID NO: 6906395 - DNA, 22 bp, Homo sapiens
ctgctcaagtgcgcacccaggg

SEQ ID NO: 6906396 - DNA, 22 bp, Homo sapiens
gtctaaagcccttagaatagta

SEQ ID NO: 6906397 - DNA, 21 bp, Homo sapiens
agctgcaagagcaacatcttt

SEQ ID NO: 6906398 - DNA, 20 bp, Homo sapiens
acgggctgggacccatgcac

SEQ ID NO: 6906399 - DNA, 20 bp, Homo sapiens
tgtgccaaaactgtttgctt

SEQ ID NO: 6906400 - DNA, 22 bp, Homo sapiens
aggacacttggctattgttcca

SEQ ID NO: 6906401 - DNA, 22 bp, Homo sapiens
cagagacaacaagtttaactat

SEQ ID NO: 6906402 - DNA, 22 bp, Homo sapiens
taatgtcaaggtgatagatttg

SEQ ID NO: 6906403 - DNA, 22 bp, Homo sapiens
ttgtaccagctcatttcagaac

SEQ ID NO: 6906404 - DNA, 22 bp, Homo sapiens
gtccatccacgcccacacactc

SEQ ID NO: 6906405 - DNA, 22 bp, Homo sapiens
ttattttgagagaatgtgtgct

SEQ ID NO: 6906406 - DNA, 22 bp, Homo sapiens
gagccctcaccgcctgaccagg

SEQ ID NO: 6906407 - DNA, 23 bp, Homo sapiens
tggtggcttgtggtggccaccag

SEQ ID NO: 6906408 - DNA, 22 bp, Homo sapiens
cccacaggtccccatgaactcg

SEQ ID NO: 6906409 - DNA, 22 bp, Homo sapiens
tgctgaggtttctgactatgga

SEQ ID NO: 6906410 - DNA, 22 bp, Homo sapiens
cctggccctggaatagggcagg

SEQ ID NO: 6906411 - DNA, 23 bp, Homo sapiens
agcagtcagggtggtaagccatc

SEQ ID NO: 6906412 - DNA, 22 bp, Homo sapiens
gccctgagcactgctgctgggg

SEQ ID NO: 6906413 - DNA, 22 bp, Homo sapiens
tcagtctctggctgtgtctgac

SEQ ID NO: 6906414 - DNA, 22 bp, Homo sapiens
aaaatgtctgctgttggtttat

SEQ ID NO: 6906415 - DNA, 22 bp, Homo sapiens
atgcacaggctgtgggctggtt

SEQ ID NO: 6906416 - DNA, 22 bp, Homo sapiens
gcagagatgggccagtgacgca

SEQ ID NO: 6906417 - DNA, 22 bp, Homo sapiens
atgcaggaagtcggggagcggg

SEQ ID NO: 6906418 - DNA, 19 bp, Homo sapiens
acccaatccactccattcc

SEQ ID NO: 6906419 - DNA, 22 bp, Homo sapiens
tgcagggcatctttgaagtgtg

SEQ ID NO: 6906420 - DNA, 22 bp, Homo sapiens
ctgcagggcagggcctcctggc

SEQ ID NO: 6906421 - DNA, 22 bp, Homo sapiens
tcttggagactcttgtatattt

SEQ ID NO: 6906422 - DNA, 21 bp, Homo sapiens
tcagattctctcattttgatg

SEQ ID NO: 6906423 - DNA, 22 bp, Homo sapiens
tggccttggtcacaatgcaaac

SEQ ID NO: 6906424 - DNA, 22 bp, Homo sapiens
gaaaactaacggaaaagttagg

SEQ ID NO: 6906425 - DNA, 22 bp, Homo sapiens
actgtctcctcatcatgcctgg

SEQ ID NO: 6906426 - DNA, 22 bp, Homo sapiens
tggaagctgtggcataactgag

SEQ ID NO: 6906427 - DNA, 22 bp, Homo sapiens
attgaactgtagtcttctgtct

SEQ ID NO: 6906428 - DNA, 22 bp, Homo sapiens
ataaggttaggattatagtgtt

SEQ ID NO: 6906429 - DNA, 22 bp, Homo sapiens
ttctttaggtagatccagtttt

SEQ ID NO: 6906430 - DNA, 22 bp, Homo sapiens
ggccttcctgctgctccgggcc

SEQ ID NO: 6906431 - DNA, 22 bp, Homo sapiens
atccaggtatgaattgtgtgac

SEQ ID NO: 6906432 - DNA, 22 bp, Homo sapiens
gctgtttgcccccactccttca

SEQ ID NO: 6906433 - DNA, 22 bp, Homo sapiens
aagaccagcctatgttttccat

SEQ ID NO: 6906434 - DNA, 22 bp, Homo sapiens
tgtgagattttatttgatatgc

SEQ ID NO: 6906435 - DNA, 22 bp, Homo sapiens
gctgtcacacatggccccagct

SEQ ID NO: 6906436 - DNA, 20 bp, Homo sapiens
tttaccaactcaccagtatc

SEQ ID NO: 6906437 - DNA, 22 bp, Homo sapiens
cataactgttaagataattttt

SEQ ID NO: 6906438 - DNA, 22 bp, Homo sapiens
tgtcttcagtgtgttaccatgg

SEQ ID NO: 6906439 - DNA, 22 bp, Homo sapiens
atgatatagagagtagattaaa

SEQ ID NO: 6906440 - DNA, 22 bp, Homo sapiens
tcataggagtagcagtgagagg

SEQ ID NO: 6906441 - DNA, 22 bp, Homo sapiens
tgtttcttgggtgctcacatca

SEQ ID NO: 6906442 - DNA, 22 bp, Homo sapiens
cccaccagacctgcaccggcac

SEQ ID NO: 6906443 - DNA, 22 bp, Homo sapiens
gcctttatattacatttggaag

SEQ ID NO: 6906444 - DNA, 22 bp, Homo sapiens
tgattcaagattggttagctgt

SEQ ID NO: 6906445 - DNA, 19 bp, Homo sapiens
agtctttgcctggggcctt

SEQ ID NO: 6906446 - DNA, 22 bp, Homo sapiens
gacaggcagttttccagatcag

SEQ ID NO: 6906447 - DNA, 22 bp, Homo sapiens
tcctgatgtgcacttgcacctc

SEQ ID NO: 6906448 - DNA, 22 bp, Homo sapiens
aagatggtggccagagtggaaa

SEQ ID NO: 6906449 - DNA, 22 bp, Homo sapiens
aggtcaaaccacagctctaggc

SEQ ID NO: 6906450 - DNA, 22 bp, Homo sapiens
catcttggttcaatttcttcat

SEQ ID NO: 6906451 - DNA, 22 bp, Homo sapiens
tcagaacttaaagccgattggg

SEQ ID NO: 6906452 - DNA, 22 bp, Homo sapiens
agagtctggaagcgcttctaaa

SEQ ID NO: 6906453 - DNA, 17 bp, Homo sapiens
ttgtgtgtagttctgat

SEQ ID NO: 6906454 - DNA, 22 bp, Homo sapiens
aggtggccaagactgtttgaca

SEQ ID NO: 6906455 - DNA, 22 bp, Homo sapiens
gggaagtgccctcttcaggaga

SEQ ID NO: 6906456 - DNA, 19 bp, Homo sapiens
accctctccccactgggtc

SEQ ID NO: 6906457 - DNA, 22 bp, Homo sapiens
ctccagcttccctcagctgtgg

SEQ ID NO: 6906458 - DNA, 19 bp, Homo sapiens
tcctagcacctggcacata

SEQ ID NO: 6906459 - DNA, 22 bp, Homo sapiens
ggcatgcatgcaaggtggtgta

SEQ ID NO: 6906460 - DNA, 22 bp, Homo sapiens
aaccaattaatagataggaaac

SEQ ID NO: 6906461 - DNA, 22 bp, Homo sapiens
tctgtctgcttcacttgcattt

SEQ ID NO: 6906462 - DNA, 22 bp, Homo sapiens
cttagagatgggttttacttag

SEQ ID NO: 6906463 - DNA, 22 bp, Homo sapiens
aataattagtgggacagagaac

SEQ ID NO: 6906464 - DNA, 22 bp, Homo sapiens
gcagtcatccagcctttccact

SEQ ID NO: 6906465 - DNA, 22 bp, Homo sapiens
ttctcttgagctggtcatgttt

SEQ ID NO: 6906466 - DNA, 22 bp, Homo sapiens
tgcaaaaaggcagactggtgat

SEQ ID NO: 6906467 - DNA, 22 bp, Homo sapiens
ttcagacagtaagaaagaggtt

SEQ ID NO: 6906468 - DNA, 21 bp, Homo sapiens
acatgtaagagagtttcaaga

SEQ ID NO: 6906469 - DNA, 19 bp, Homo sapiens
ggcagacacagttgacatg

SEQ ID NO: 6906470 - DNA, 22 bp, Homo sapiens
atgaatgcatgcttattttgca

SEQ ID NO: 6906471 - DNA, 22 bp, Homo sapiens
tcacagtagccatttcatgagt

SEQ ID NO: 6906472 - DNA, 22 bp, Homo sapiens
tgtccgcggtttgcgttgtggg

SEQ ID NO: 6906473 - DNA, 22 bp, Homo sapiens
ttcctacatttgcctcactccc

SEQ ID NO: 6906474 - DNA, 22 bp, Homo sapiens
aaaactgtaggaattgggtgcc

SEQ ID NO: 6906475 - DNA, 22 bp, Homo sapiens
acccaggggcagccttgctgtg

SEQ ID NO: 6906476 - DNA, 22 bp, Homo sapiens
catcaaatctgacttttcttcc

SEQ ID NO: 6906477 - DNA, 19 bp, Homo sapiens
agcagagcagggccgtggg

SEQ ID NO: 6906478 - DNA, 22 bp, Homo sapiens
tctctcagactccccatggttt

SEQ ID NO: 6906479 - DNA, 21 bp, Homo sapiens
gttcccttattggggcaggca

SEQ ID NO: 6906480 - DNA, 22 bp, Homo sapiens
ggcagcattgcctttgcagtga

SEQ ID NO: 6906481 - DNA, 22 bp, Homo sapiens
aaggttaaataggtattttcca

SEQ ID NO: 6906482 - DNA, 20 bp, Homo sapiens
atcaaaatcctattgaggtt

SEQ ID NO: 6906483 - DNA, 22 bp, Homo sapiens
gctgcaggagctggagctgtgg

SEQ ID NO: 6906484 - DNA, 22 bp, Homo sapiens
agaagccaaatgccagtgacct

SEQ ID NO: 6906485 - DNA, 21 bp, Homo sapiens
gctactcaagaagaaggcttt

SEQ ID NO: 6906486 - DNA, 22 bp, Homo sapiens
tgctggagagccttggccaagg

SEQ ID NO: 6906487 - DNA, 22 bp, Homo sapiens
ccagggaaggctgctggctgtg

SEQ ID NO: 6906488 - DNA, 22 bp, Homo sapiens
cagagcaccagtgggagacaag

SEQ ID NO: 6906489 - DNA, 22 bp, Homo sapiens
ttattgtgtgcgttagcctatg

SEQ ID NO: 6906490 - DNA, 21 bp, Homo sapiens
agatacttgctaacttaggca

SEQ ID NO: 6906491 - DNA, 22 bp, Homo sapiens
tttcacagctgatacctcttcc

SEQ ID NO: 6906492 - DNA, 22 bp, Homo sapiens
gctgagtgaggctgtcaaaatg

SEQ ID NO: 6906493 - DNA, 22 bp, Homo sapiens
gggcactgagtggatgatgcag

SEQ ID NO: 6906494 - DNA, 20 bp, Homo sapiens
tgctatattgaagtgcagtt

SEQ ID NO: 6906495 - DNA, 22 bp, Homo sapiens
acagtctgcctctcagagcagc

SEQ ID NO: 6906496 - DNA, 22 bp, Homo sapiens
tcagtccttatctggtgttcag

SEQ ID NO: 6906497 - DNA, 22 bp, Homo sapiens
agctgcaagtgttgcctcctac

SEQ ID NO: 6906498 - DNA, 22 bp, Homo sapiens
ggagtcagtgatcgcgtgtctc

SEQ ID NO: 6906499 - DNA, 21 bp, Homo sapiens
aaaggccataatcacggagca

SEQ ID NO: 6906500 - DNA, 22 bp, Homo sapiens
gcggggcctgactctgacccgc

SEQ ID NO: 6906501 - DNA, 22 bp, Homo sapiens
agatcacagtggcaactccctt

SEQ ID NO: 6906502 - DNA, 23 bp, Homo sapiens
cagggctgggcttggtgttaggc

SEQ ID NO: 6906503 - DNA, 22 bp, Homo sapiens
gctgccctccagttcccacagt

SEQ ID NO: 6906504 - DNA, 22 bp, Homo sapiens
gatcacaatttagactttttaa

SEQ ID NO: 6906505 - DNA, 22 bp, Homo sapiens
taaggacagcagctacttttcc

SEQ ID NO: 6906506 - DNA, 22 bp, Homo sapiens
ggatgcacgaaggcgcctcgga

SEQ ID NO: 6906507 - DNA, 15 bp, Homo sapiens
agtgattttggactc

SEQ ID NO: 6906508 - DNA, 22 bp, Homo sapiens
ttatggagactttcagaagcgg

SEQ ID NO: 6906509 - DNA, 22 bp, Homo sapiens
aaccctttcttgcttgttctaa

SEQ ID NO: 6906510 - DNA, 19 bp, Homo sapiens
gaatgtttctgtctcttct

SEQ ID NO: 6906511 - DNA, 22 bp, Homo sapiens
ttccatttattcttgtccagat

SEQ ID NO: 6906512 - DNA, 22 bp, Homo sapiens
tccatgaggcagggaggctggc

SEQ ID NO: 6906513 - DNA, 19 bp, Homo sapiens
ctctccacctaacaggtat

SEQ ID NO: 6906514 - DNA, 22 bp, Homo sapiens
caggaaccttgtctgtgttgtt

SEQ ID NO: 6906515 - DNA, 22 bp, Homo sapiens
atctacaggctgaggtgggagg

SEQ ID NO: 6906516 - DNA, 22 bp, Homo sapiens
tcctgcttcaggtagagggggt

SEQ ID NO: 6906517 - DNA, 22 bp, Homo sapiens
gccgtccacctcgatggccact

SEQ ID NO: 6906518 - DNA, 22 bp, Homo sapiens
catgtcaagcttatctctgtgg

SEQ ID NO: 6906519 - DNA, 22 bp, Homo sapiens
acagctcctactgaagccatgt

SEQ ID NO: 6906520 - DNA, 22 bp, Homo sapiens
tgtcttaagtagattacagcct

SEQ ID NO: 6906521 - DNA, 20 bp, Homo sapiens
ccagtctctggccagcatca

SEQ ID NO: 6906522 - DNA, 22 bp, Homo sapiens
cccaggaggaggaaaaagctcg

SEQ ID NO: 6906523 - DNA, 22 bp, Homo sapiens
ggaaatattttgtctaatttgt

SEQ ID NO: 6906524 - DNA, 22 bp, Homo sapiens
tctgggagatccaagcagaact

SEQ ID NO: 6906525 - DNA, 22 bp, Homo sapiens
ggacacttggtggcccattgtg

SEQ ID NO: 6906526 - DNA, 22 bp, Homo sapiens
aagaagctgcgtggtatgtgaa

SEQ ID NO: 6906527 - DNA, 19 bp, Homo sapiens
ggaaccttggagcttcggc

SEQ ID NO: 6906528 - DNA, 19 bp, Homo sapiens
ggaaccttagagcttcagc

SEQ ID NO: 6906529 - DNA, 22 bp, Homo sapiens
ggcaggctgggagtcatcagag

SEQ ID NO: 6906530 - DNA, 22 bp, Homo sapiens
agagcacaaattagttggtctt

SEQ ID NO: 6906531 - DNA, 22 bp, Homo sapiens
tcaagataagtcagtatatcaa

SEQ ID NO: 6906532 - DNA, 22 bp, Homo sapiens
catataaatacaacatgtgtta

SEQ ID NO: 6906533 - DNA, 22 bp, Homo sapiens
aaagtcaatgatttctcctgga

SEQ ID NO: 6906534 - DNA, 22 bp, Homo sapiens
aacatttatatgggttcatgaa

SEQ ID NO: 6906535 - DNA, 22 bp, Homo sapiens
gatgcacaggtgagcaggtgca

SEQ ID NO: 6906536 - DNA, 22 bp, Homo sapiens
gccactgtcataccctggcaat

SEQ ID NO: 6906537 - DNA, 23 bp, Homo sapiens
tctttagttgaaggcaaggggag

SEQ ID NO: 6906538 - DNA, 22 bp, Homo sapiens
ctgcctctattcactgaggcag

SEQ ID NO: 6906539 - DNA, 22 bp, Homo sapiens
cagctctacgtttctatgaatc

SEQ ID NO: 6906540 - DNA, 22 bp, Homo sapiens
tgaattgcctcttatatgacca

SEQ ID NO: 6906541 - DNA, 22 bp, Homo sapiens
tgtcaacatctgagccttcccc

SEQ ID NO: 6906542 - DNA, 22 bp, Homo sapiens
ttgaaagtaataactttgttca

SEQ ID NO: 6906543 - DNA, 22 bp, Homo sapiens
ggcggccgcagctcttgctctg

SEQ ID NO: 6906544 - DNA, 22 bp, Homo sapiens
tatgtattattcatcagtggga

SEQ ID NO: 6906545 - DNA, 21 bp, Homo sapiens
tgcttctctagatcaactact

SEQ ID NO: 6906546 - DNA, 22 bp, Homo sapiens
tctctgtatcccagaaccaaaa

SEQ ID NO: 6906547 - DNA, 18 bp, Homo sapiens
tgtctctgaattccagtg

SEQ ID NO: 6906548 - DNA, 22 bp, Homo sapiens
agctgcctcctggtgccccatc

SEQ ID NO: 6906549 - DNA, 22 bp, Homo sapiens
ttctgcatgccctctgtgtggc

SEQ ID NO: 6906550 - DNA, 22 bp, Homo sapiens
gtcaggctggggctgctgccag

SEQ ID NO: 6906551 - DNA, 22 bp, Homo sapiens
aggagctagacttagatcttcc

SEQ ID NO: 6906552 - DNA, 22 bp, Homo sapiens
ttggctctgaactatgcagttt

SEQ ID NO: 6906553 - DNA, 21 bp, Homo sapiens
tgcaggagtgtaatgtgaccc

SEQ ID NO: 6906554 - DNA, 22 bp, Homo sapiens
ctgctctaggggcagggccctt

SEQ ID NO: 6906555 - DNA, 22 bp, Homo sapiens
ctggctgaggtcaccagtagct

SEQ ID NO: 6906556 - DNA, 22 bp, Homo sapiens
ctgagcttcagtgcactgggag

SEQ ID NO: 6906557 - DNA, 17 bp, Homo sapiens
ggcagctgccacttttt

SEQ ID NO: 6906558 - DNA, 22 bp, Homo sapiens
aacatgcatttgtgggatggaa

SEQ ID NO: 6906559 - DNA, 22 bp, Homo sapiens
aaattgctctttaaaagtactg

SEQ ID NO: 6906560 - DNA, 22 bp, Homo sapiens
agttaccccacacactgagaaa

SEQ ID NO: 6906561 - DNA, 22 bp, Homo sapiens
tgaggtagggaaggctggtatt

SEQ ID NO: 6906562 - DNA, 22 bp, Homo sapiens
ctgtgggagcagcaccaaggac

SEQ ID NO: 6906563 - DNA, 22 bp, Homo sapiens
agaaagcatctccattgtaggt

SEQ ID NO: 6906564 - DNA, 17 bp, Homo sapiens
ggtctgtgtctagggaa

SEQ ID NO: 6906565 - DNA, 22 bp, Homo sapiens
tctgtatcacccgttcccagaa

SEQ ID NO: 6906566 - DNA, 22 bp, Homo sapiens
tagctttgtgtcctgatttagc

SEQ ID NO: 6906567 - DNA, 22 bp, Homo sapiens
tacagttccaggatcatagggt

SEQ ID NO: 6906568 - DNA, 22 bp, Homo sapiens
gctcaaagcactttgcaaatat

SEQ ID NO: 6906569 - DNA, 22 bp, Homo sapiens
tttctgactccagagaggaata

SEQ ID NO: 6906570 - DNA, 22 bp, Homo sapiens
aaaggttctcttgttcattatt

SEQ ID NO: 6906571 - DNA, 22 bp, Homo sapiens
ggttcacactttcatgatttca

SEQ ID NO: 6906572 - DNA, 22 bp, Homo sapiens
ttgtaacaaagacactccaaaa

SEQ ID NO: 6906573 - DNA, 22 bp, Homo sapiens
gccagcatgggtgggattttcc

SEQ ID NO: 6906574 - DNA, 22 bp, Homo sapiens
gaaggctgctgggaagtgtggt

SEQ ID NO: 6906575 - DNA, 22 bp, Homo sapiens
tgtccatctccatcgagtcctc

SEQ ID NO: 6906576 - DNA, 23 bp, Homo sapiens
tggagaattcagtctttgttttg

SEQ ID NO: 6906577 - DNA, 22 bp, Homo sapiens
atgtatatgcatgcattcaaag

SEQ ID NO: 6906578 - DNA, 22 bp, Homo sapiens
tcatgacagaagtggtcatatt

SEQ ID NO: 6906579 - DNA, 19 bp, Homo sapiens
agcaaatataatagtgttc

SEQ ID NO: 6906580 - DNA, 22 bp, Homo sapiens
ggctgctgggtcatgatgcaga

SEQ ID NO: 6906581 - DNA, 22 bp, Homo sapiens
tgctgcgaggggaaataattta

SEQ ID NO: 6906582 - DNA, 22 bp, Homo sapiens
ggcaggcagatggctgcaccaa

SEQ ID NO: 6906583 - DNA, 22 bp, Homo sapiens
aagctgtagaggcagtacattt

SEQ ID NO: 6906584 - DNA, 22 bp, Homo sapiens
aagtagcagggattacaggtgt

SEQ ID NO: 6906585 - DNA, 22 bp, Homo sapiens
cccagggagcttggagaacggg

SEQ ID NO: 6906586 - DNA, 20 bp, Homo sapiens
ccaatgcagtatctcgttcc

SEQ ID NO: 6906587 - DNA, 22 bp, Homo sapiens
actgcacagaattatggttggt

SEQ ID NO: 6906588 - DNA, 22 bp, Homo sapiens
gaatgatatattagcagatttt

SEQ ID NO: 6906589 - DNA, 22 bp, Homo sapiens
aatgagggagtggggcttgtcc

SEQ ID NO: 6906590 - DNA, 22 bp, Homo sapiens
ggctctgggttctgcaatgcgt

SEQ ID NO: 6906591 - DNA, 22 bp, Homo sapiens
gtagaaaattaggatgaggctt

SEQ ID NO: 6906592 - DNA, 22 bp, Homo sapiens
caacagtcttgagataaaactt

SEQ ID NO: 6906593 - DNA, 22 bp, Homo sapiens
acagctgggaatcagctgggga

SEQ ID NO: 6906594 - DNA, 22 bp, Homo sapiens
aggactgggtgcagagggcatc

SEQ ID NO: 6906595 - DNA, 22 bp, Homo sapiens
cagcaactcctgtagcttatgc

SEQ ID NO: 6906596 - DNA, 22 bp, Homo sapiens
agctgtggtacttgattcacaa

SEQ ID NO: 6906597 - DNA, 22 bp, Homo sapiens
aagtaacttatttgcaaacagg

SEQ ID NO: 6906598 - DNA, 22 bp, Homo sapiens
ttcttgccatatttcagccctt

SEQ ID NO: 6906599 - DNA, 22 bp, Homo sapiens
tccctgggtcctgcttgctctc

SEQ ID NO: 6906600 - DNA, 22 bp, Homo sapiens
ttaagatgttcagataatttgg

SEQ ID NO: 6906601 - DNA, 22 bp, Homo sapiens
ttattgcaactcctaaatagag

SEQ ID NO: 6906602 - DNA, 22 bp, Homo sapiens
tctgtaaagtctgtgtaaagtc

SEQ ID NO: 6906603 - DNA, 22 bp, Homo sapiens
agttacacaattattgcatgga

SEQ ID NO: 6906604 - DNA, 22 bp, Homo sapiens
gtggcaggtggagcctcctgca

SEQ ID NO: 6906605 - DNA, 22 bp, Homo sapiens
tactgcaaaactactcagtaat

SEQ ID NO: 6906606 - DNA, 22 bp, Homo sapiens
ttccaaaggctgcaccttgccc

SEQ ID NO: 6906607 - DNA, 22 bp, Homo sapiens
ggctgcctggtttagtgctgac

SEQ ID NO: 6906608 - DNA, 22 bp, Homo sapiens
cctgtgccctgccaggctggtg

SEQ ID NO: 6906609 - DNA, 21 bp, Homo sapiens
aaagatgtttcttttcctcac

SEQ ID NO: 6906610 - DNA, 22 bp, Homo sapiens
ctgccatgttacctgcacaggt

SEQ ID NO: 6906611 - DNA, 22 bp, Homo sapiens
ggatctggggtagagcagtggg

SEQ ID NO: 6906612 - DNA, 22 bp, Homo sapiens
gaattttaagtgttcgcctctt

SEQ ID NO: 6906613 - DNA, 22 bp, Homo sapiens
atactcaaggttaatgattgaa

SEQ ID NO: 6906614 - DNA, 22 bp, Homo sapiens
ttggaaggaccaggccttgatt

SEQ ID NO: 6906615 - DNA, 22 bp, Homo sapiens
ctgggttcttggcacagcagga

SEQ ID NO: 6906616 - DNA, 21 bp, Homo sapiens
tactacagtctctttatcagt

SEQ ID NO: 6906617 - DNA, 22 bp, Homo sapiens
agtcagtggtatttaggggaat

SEQ ID NO: 6906618 - DNA, 22 bp, Homo sapiens
agtctgacttggccaggagctg

SEQ ID NO: 6906619 - DNA, 22 bp, Homo sapiens
gagctactgaaatattgatttt

SEQ ID NO: 6906620 - DNA, 22 bp, Homo sapiens
gccaggcatttgttaggtgctg

SEQ ID NO: 6906621 - DNA, 22 bp, Homo sapiens
acagttaggcttatgtctgtag

SEQ ID NO: 6906622 - DNA, 18 bp, Homo sapiens
tgagagtgtgtgctcttg

SEQ ID NO: 6906623 - DNA, 22 bp, Homo sapiens
gtgtccttcattggaatctctc

SEQ ID NO: 6906624 - DNA, 18 bp, Homo sapiens
tgtggctggtccacactg

SEQ ID NO: 6906625 - DNA, 22 bp, Homo sapiens
aaactcctgcatactcagaagc

SEQ ID NO: 6906626 - DNA, 22 bp, Homo sapiens
gggcttaagatttggcgcggtt

SEQ ID NO: 6906627 - DNA, 22 bp, Homo sapiens
cctcacagcaaggatttcagtg

SEQ ID NO: 6906628 - DNA, 17 bp, Homo sapiens
actttggtcctgtgctc

SEQ ID NO: 6906629 - DNA, 22 bp, Homo sapiens
tcaatagataaagctacataaa

SEQ ID NO: 6906630 - DNA, 22 bp, Homo sapiens
accaggcactcctgaggtctga

SEQ ID NO: 6906631 - DNA, 22 bp, Homo sapiens
cttccaggacaccagggtagta

SEQ ID NO: 6906632 - DNA, 22 bp, Homo sapiens
tagatagaagagccacattagc

SEQ ID NO: 6906633 - DNA, 22 bp, Homo sapiens
tgaaatcaatgtcttctgtctc

SEQ ID NO: 6906634 - DNA, 22 bp, Homo sapiens
agaccactcaaaattagtgtct

SEQ ID NO: 6906635 - DNA, 22 bp, Homo sapiens
accacctcatcaagctggattg

SEQ ID NO: 6906636 - DNA, 22 bp, Homo sapiens
tggtcctgaggcttgtttccac

SEQ ID NO: 6906637 - DNA, 22 bp, Homo sapiens
ctgtctgctagaacatctatac

SEQ ID NO: 6906638 - DNA, 22 bp, Homo sapiens
cagagcctcatcatccactcca

SEQ ID NO: 6906639 - DNA, 22 bp, Homo sapiens
tccagctcttcagttctgcaaa

SEQ ID NO: 6906640 - DNA, 22 bp, Homo sapiens
tcacagaaaagctgagcatcag

SEQ ID NO: 6906641 - DNA, 22 bp, Homo sapiens
ttcaagatctgggttttcagct

SEQ ID NO: 6906642 - DNA, 22 bp, Homo sapiens
gaagtatttctgagttgcccag

SEQ ID NO: 6906643 - DNA, 22 bp, Homo sapiens
aaagagtttccattgacatttc

SEQ ID NO: 6906644 - DNA, 22 bp, Homo sapiens
atgctacaacattatctggggt

SEQ ID NO: 6906645 - DNA, 22 bp, Homo sapiens
aggacgtttcctggagagaatt

SEQ ID NO: 6906646 - DNA, 22 bp, Homo sapiens
aaagttgaccgaaagattttga

SEQ ID NO: 6906647 - DNA, 22 bp, Homo sapiens
aggcacctggccagttgtcttg

SEQ ID NO: 6906648 - DNA, 22 bp, Homo sapiens
atgtcacaaaagtcccattatg

SEQ ID NO: 6906649 - DNA, 23 bp, Homo sapiens
cagacctttctgtatcagttatc

SEQ ID NO: 6906650 - DNA, 22 bp, Homo sapiens
aagctggcaattatcaaaactg

SEQ ID NO: 6906651 - DNA, 22 bp, Homo sapiens
catactttctttttcacgcata

SEQ ID NO: 6906652 - DNA, 23 bp, Homo sapiens
caggtggtagagaaaaatccaga

SEQ ID NO: 6906653 - DNA, 22 bp, Homo sapiens
tgagagaggatgccctcatatt

SEQ ID NO: 6906654 - DNA, 22 bp, Homo sapiens
cgtgaagcaggaaggctgccca

SEQ ID NO: 6906655 - DNA, 18 bp, Homo sapiens
ggaaaaggagtgtctagc

SEQ ID NO: 6906656 - DNA, 22 bp, Homo sapiens
cagtcaggggtgggatcaaggc

SEQ ID NO: 6906657 - DNA, 22 bp, Homo sapiens
gttggcacttcataatatgaaa

SEQ ID NO: 6906658 - DNA, 22 bp, Homo sapiens
taactaggattacaagcgtgcg

SEQ ID NO: 6906659 - DNA, 22 bp, Homo sapiens
actctggggtgatgtctctgag

SEQ ID NO: 6906660 - DNA, 20 bp, Homo sapiens
aacagcacacattcgcatta

SEQ ID NO: 6906661 - DNA, 22 bp, Homo sapiens
gcagcttcagtaggtgaagaca

SEQ ID NO: 6906662 - DNA, 22 bp, Homo sapiens
ggtgtcacaggaggccgtgtgg

SEQ ID NO: 6906663 - DNA, 22 bp, Homo sapiens
tcatgacaatggtagcctgtta

SEQ ID NO: 6906664 - DNA, 22 bp, Homo sapiens
atccttacctgtgcataagcct

SEQ ID NO: 6906665 - DNA, 22 bp, Homo sapiens
tttaagggattgtgattttcac

SEQ ID NO: 6906666 - DNA, 22 bp, Homo sapiens
tgcaaaggtttgtgcttggaaa

SEQ ID NO: 6906667 - DNA, 22 bp, Homo sapiens
cctgggagctgtggaaaggctg

SEQ ID NO: 6906668 - DNA, 20 bp, Homo sapiens
tttcaaactgcacctttgct

SEQ ID NO: 6906669 - DNA, 22 bp, Homo sapiens
ttctaacaagtggcttgttagt

SEQ ID NO: 6906670 - DNA, 22 bp, Homo sapiens
cctttctgatggcctcccagcc

SEQ ID NO: 6906671 - DNA, 23 bp, Homo sapiens
cctgcagctgctggggctccacc

SEQ ID NO: 6906672 - DNA, 22 bp, Homo sapiens
actgtactgtgtattgtagaat

SEQ ID NO: 6906673 - DNA, 22 bp, Homo sapiens
caatacatcaggtcaaaatgtg

SEQ ID NO: 6906674 - DNA, 22 bp, Homo sapiens
tgtctaggtctaggttggcaat

SEQ ID NO: 6906675 - DNA, 18 bp, Homo sapiens
gctagttcattaggtagg

SEQ ID NO: 6906676 - DNA, 22 bp, Homo sapiens
acgttgaatggttaatttgtat

SEQ ID NO: 6906677 - DNA, 22 bp, Homo sapiens
agtgtgctgtttccagaagggc

SEQ ID NO: 6906678 - DNA, 22 bp, Homo sapiens
cactgcaacctccgcctaccgg

SEQ ID NO: 6906679 - DNA, 20 bp, Homo sapiens
tcagttaggaagaggcactc

SEQ ID NO: 6906680 - DNA, 22 bp, Homo sapiens
gagtcctgctttcaattctttt

SEQ ID NO: 6906681 - DNA, 22 bp, Homo sapiens
agcagcaggctgtgtggactga

SEQ ID NO: 6906682 - DNA, 22 bp, Homo sapiens
agagactaagaagttttaactt

SEQ ID NO: 6906683 - DNA, 22 bp, Homo sapiens
taacacagtgtcctcagaaaca

SEQ ID NO: 6906684 - DNA, 22 bp, Homo sapiens
acatagaaatttatttcttaca

SEQ ID NO: 6906685 - DNA, 22 bp, Homo sapiens
ccaggcagccaagtgtgtgtgt

SEQ ID NO: 6906686 - DNA, 22 bp, Homo sapiens
acagcagtttagaggacagcca

SEQ ID NO: 6906687 - DNA, 22 bp, Homo sapiens
aacttagttcaatatcagtgct

SEQ ID NO: 6906688 - DNA, 22 bp, Homo sapiens
cacatgcatctgtcatgtttgg

SEQ ID NO: 6906689 - DNA, 22 bp, Homo sapiens
aaattctgatttaataagtgta

SEQ ID NO: 6906690 - DNA, 22 bp, Homo sapiens
acaggccttggcaggcatgtga

SEQ ID NO: 6906691 - DNA, 17 bp, Homo sapiens
gacttcaacttctgctg

SEQ ID NO: 6906692 - DNA, 22 bp, Homo sapiens
tggcctgggcatgaagcatcgt

SEQ ID NO: 6906693 - DNA, 22 bp, Homo sapiens
tctgggctgtggttccactccg

SEQ ID NO: 6906694 - DNA, 22 bp, Homo sapiens
agccagttctctagtgatattt

SEQ ID NO: 6906695 - DNA, 22 bp, Homo sapiens
catctgtcatcaaccctggcta

SEQ ID NO: 6906696 - DNA, 22 bp, Homo sapiens
aagaggtgagaagctacactta

SEQ ID NO: 6906697 - DNA, 22 bp, Homo sapiens
ggggtaggaagagaaaatagtg

SEQ ID NO: 6906698 - DNA, 22 bp, Homo sapiens
tattcaccctgcctcctagttg

SEQ ID NO: 6906699 - DNA, 22 bp, Homo sapiens
aggagttgtatgtccaagggac

SEQ ID NO: 6906700 - DNA, 22 bp, Homo sapiens
tggcttctcatttgcattaaac

SEQ ID NO: 6906701 - DNA, 22 bp, Homo sapiens
cacagtgacctctttaaaaggg

SEQ ID NO: 6906702 - DNA, 22 bp, Homo sapiens
tccatgttgagaatgctataat

SEQ ID NO: 6906703 - DNA, 22 bp, Homo sapiens
ctgcctatcaaatggggagggc

SEQ ID NO: 6906704 - DNA, 22 bp, Homo sapiens
gccttaattgcagagcaatata

SEQ ID NO: 6906705 - DNA, 22 bp, Homo sapiens
aatggctttaggaatccagtgc

SEQ ID NO: 6906706 - DNA, 22 bp, Homo sapiens
atttcccactctactacatgct

SEQ ID NO: 6906707 - DNA, 22 bp, Homo sapiens
cagggcttactggaggctgctt

SEQ ID NO: 6906708 - DNA, 22 bp, Homo sapiens
tttacactgccattctgaatac

SEQ ID NO: 6906709 - DNA, 22 bp, Homo sapiens
caggcctggggctggcttccag

SEQ ID NO: 6906710 - DNA, 23 bp, Homo sapiens
tatgataccataatgtggaatgt

SEQ ID NO: 6906711 - DNA, 22 bp, Homo sapiens
ctcctggcagcaacatttatat

SEQ ID NO: 6906712 - DNA, 22 bp, Homo sapiens
ggctgtgacaaggctgcgggaa

SEQ ID NO: 6906713 - DNA, 23 bp, Homo sapiens
tgcattagtgtgaacctagcctt

SEQ ID NO: 6906714 - DNA, 22 bp, Homo sapiens
agcatttaattacagtttaatt

SEQ ID NO: 6906715 - DNA, 22 bp, Homo sapiens
catggtgaggggtgaagggcag

SEQ ID NO: 6906716 - DNA, 16 bp, Homo sapiens
ccagaggcctggcctc

SEQ ID NO: 6906717 - DNA, 22 bp, Homo sapiens
aattgctagtttgtagcatttg

SEQ ID NO: 6906718 - DNA, 22 bp, Homo sapiens
ttacaatagttccttcttttgt

SEQ ID NO: 6906719 - DNA, 22 bp, Homo sapiens
gatgctgtagatgagaacattg

SEQ ID NO: 6906720 - DNA, 22 bp, Homo sapiens
cagcagctacttggagcagcag

SEQ ID NO: 6906721 - DNA, 22 bp, Homo sapiens
ttggcaatgatctcaatcttct

SEQ ID NO: 6906722 - DNA, 19 bp, Homo sapiens
tctctgcagcgcgcccggc

SEQ ID NO: 6906723 - DNA, 22 bp, Homo sapiens
aaggcaaggttcaccgtgctat

SEQ ID NO: 6906724 - DNA, 22 bp, Homo sapiens
tgtgtgcattcacatgcatgcc

SEQ ID NO: 6906725 - DNA, 23 bp, Homo sapiens
ttcaaacagctacaagggggtgg

SEQ ID NO: 6906726 - DNA, 22 bp, Homo sapiens
gatgataacagcatttcaactg

SEQ ID NO: 6906727 - DNA, 19 bp, Homo sapiens
tcaggagttagttgtgctc

SEQ ID NO: 6906728 - DNA, 22 bp, Homo sapiens
tctctgtagggctgcttgagta

SEQ ID NO: 6906729 - DNA, 19 bp, Homo sapiens
tgcacacagataagtatct

SEQ ID NO: 6906730 - DNA, 22 bp, Homo sapiens
tgaaagcattagtctaaggtag

SEQ ID NO: 6906731 - DNA, 22 bp, Homo sapiens
tctgggtggcagtgatggcgtg

SEQ ID NO: 6906732 - DNA, 22 bp, Homo sapiens
gcatggaattcccttatgggcc

SEQ ID NO: 6906733 - DNA, 22 bp, Homo sapiens
catttgcttgcctcccccaggt

SEQ ID NO: 6906734 - DNA, 22 bp, Homo sapiens
tctccaggcactacctgggtaa

SEQ ID NO: 6906735 - DNA, 22 bp, Homo sapiens
ttctgggaggcctttgtgtctg

SEQ ID NO: 6906736 - DNA, 22 bp, Homo sapiens
tcccattttggatgcggattgg

SEQ ID NO: 6906737 - DNA, 22 bp, Homo sapiens
cagggcttgcaggagaaagttt

SEQ ID NO: 6906738 - DNA, 22 bp, Homo sapiens
tgtggagcactgttcctggcat

SEQ ID NO: 6906739 - DNA, 22 bp, Homo sapiens
ccaaggttgagaaactgtagga

SEQ ID NO: 6906740 - DNA, 22 bp, Homo sapiens
cagtcctgctggccttccctgg

SEQ ID NO: 6906741 - DNA, 22 bp, Homo sapiens
tctgacaataactgagtttaac

SEQ ID NO: 6906742 - DNA, 22 bp, Homo sapiens
ctcagacgcatcaacgattctg

SEQ ID NO: 6906743 - DNA, 22 bp, Homo sapiens
tgcaaggtgctccaagggcgct

SEQ ID NO: 6906744 - DNA, 22 bp, Homo sapiens
agtaccatgcttcctgactggt

SEQ ID NO: 6906745 - DNA, 22 bp, Homo sapiens
aagatacatcaaagcaaattgg

SEQ ID NO: 6906746 - DNA, 22 bp, Homo sapiens
aggtcattggggactatctccg

SEQ ID NO: 6906747 - DNA, 22 bp, Homo sapiens
acagaggaagcatatagcacaa

SEQ ID NO: 6906748 - DNA, 22 bp, Homo sapiens
atgtggacagttctggatgtaa

SEQ ID NO: 6906749 - DNA, 22 bp, Homo sapiens
gtttagaaaatagtgaagcaag

SEQ ID NO: 6906750 - DNA, 22 bp, Homo sapiens
gttatacttatgtgcaaaaata

SEQ ID NO: 6906751 - DNA, 23 bp, Homo sapiens
gcctggccaccccagggctgctt

SEQ ID NO: 6906752 - DNA, 22 bp, Homo sapiens
ataggtaaatgtgtgccacggt

SEQ ID NO: 6906753 - DNA, 22 bp, Homo sapiens
ggcagtcatttaatccctgcat

SEQ ID NO: 6906754 - DNA, 22 bp, Homo sapiens
atgtccaatttcagagtctcat

SEQ ID NO: 6906755 - DNA, 22 bp, Homo sapiens
atgttatgacaagcatgacaga

SEQ ID NO: 6906756 - DNA, 22 bp, Homo sapiens
acatctgaccattacaagacat

SEQ ID NO: 6906757 - DNA, 22 bp, Homo sapiens
taacactgcttcattttggaga

SEQ ID NO: 6906758 - DNA, 22 bp, Homo sapiens
gagattctgtgaaacggacatt

SEQ ID NO: 6906759 - DNA, 22 bp, Homo sapiens
agcagtggctggatggtgtgct

SEQ ID NO: 6906760 - DNA, 22 bp, Homo sapiens
agtctgtctctgctaatcacta

SEQ ID NO: 6906761 - DNA, 22 bp, Homo sapiens
tggtttgggcgctggagcaagg

SEQ ID NO: 6906762 - DNA, 22 bp, Homo sapiens
agtgttgggtctttagaattta

SEQ ID NO: 6906763 - DNA, 22 bp, Homo sapiens
gaggagtgggttagtgcttatt

SEQ ID NO: 6906764 - DNA, 22 bp, Homo sapiens
agaggtcttcagcatttgaact

SEQ ID NO: 6906765 - DNA, 22 bp, Homo sapiens
ttccattgtttctgtcttcact

SEQ ID NO: 6906766 - DNA, 22 bp, Homo sapiens
cattctattgtagcaccctgta

SEQ ID NO: 6906767 - DNA, 22 bp, Homo sapiens
tctccaagaaaagatctcagct

SEQ ID NO: 6906768 - DNA, 22 bp, Homo sapiens
aaaacagtttaggcatcacagt

SEQ ID NO: 6906769 - DNA, 22 bp, Homo sapiens
tgagtcaccgacctggctggtt

SEQ ID NO: 6906770 - DNA, 22 bp, Homo sapiens
atacctatgtgacagtattatt

SEQ ID NO: 6906771 - DNA, 22 bp, Homo sapiens
gtgtaagtggaatcatatagta

SEQ ID NO: 6906772 - DNA, 22 bp, Homo sapiens
tgaacagtgggcatgtgaagac

SEQ ID NO: 6906773 - DNA, 22 bp, Homo sapiens
ctcagccatgtcatgcctacct

SEQ ID NO: 6906774 - DNA, 19 bp, Homo sapiens
cacagccacagccaacctc

SEQ ID NO: 6906775 - DNA, 17 bp, Homo sapiens
agagataaggcggagaa

SEQ ID NO: 6906776 - DNA, 22 bp, Homo sapiens
aggtttctcctttaaagcatgg

SEQ ID NO: 6906777 - DNA, 20 bp, Homo sapiens
aggccctgtgcatcttgttt

SEQ ID NO: 6906778 - DNA, 22 bp, Homo sapiens
atgggagtgacagggccactgg

SEQ ID NO: 6906779 - DNA, 22 bp, Homo sapiens
gtatacatgcaggtcacagggg

SEQ ID NO: 6906780 - DNA, 22 bp, Homo sapiens
cactgcaacctccgcctcttgg

SEQ ID NO: 6906781 - DNA, 20 bp, Homo sapiens
gccagagttatgatgagagg

SEQ ID NO: 6906782 - DNA, 22 bp, Homo sapiens
ccagctaggcttgcactcttgt

SEQ ID NO: 6906783 - DNA, 22 bp, Homo sapiens
tcagagaattcgattaaatgca

SEQ ID NO: 6906784 - DNA, 22 bp, Homo sapiens
tgtatgaatctcatttgtttaa

SEQ ID NO: 6906785 - DNA, 20 bp, Homo sapiens
ctggaatgggtgtgggttag

SEQ ID NO: 6906786 - DNA, 22 bp, Homo sapiens
gctttatccgcttgacccttac

SEQ ID NO: 6906787 - DNA, 22 bp, Homo sapiens
tttcagacaggacttcatatgt

SEQ ID NO: 6906788 - DNA, 22 bp, Homo sapiens
gtttgggtacaggcttcaggtg

SEQ ID NO: 6906789 - DNA, 22 bp, Homo sapiens
aaattccattaggaaacttcca

SEQ ID NO: 6906790 - DNA, 22 bp, Homo sapiens
cctaagattgcaaactctctcc

SEQ ID NO: 6906791 - DNA, 22 bp, Homo sapiens
tggtccctgagacctttgggag

SEQ ID NO: 6906792 - DNA, 22 bp, Homo sapiens
acaaactgaatgggttttctgt

SEQ ID NO: 6906793 - DNA, 22 bp, Homo sapiens
ttattaatcttatctttggaaa

SEQ ID NO: 6906794 - DNA, 22 bp, Homo sapiens
ttattccacctccattttccta

SEQ ID NO: 6906795 - DNA, 22 bp, Homo sapiens
cagttctgactttcataatgtc

SEQ ID NO: 6906796 - DNA, 22 bp, Homo sapiens
gcacttgacccccagagctggt

SEQ ID NO: 6906797 - DNA, 22 bp, Homo sapiens
tcgcccagctcatctcccacaa

SEQ ID NO: 6906798 - DNA, 21 bp, Homo sapiens
cagaggcaggctctgtgtgtg

SEQ ID NO: 6906799 - DNA, 17 bp, Homo sapiens
tatctctgcttcatggt

SEQ ID NO: 6906800 - DNA, 22 bp, Homo sapiens
tcagtcaacataaatccaaggt

SEQ ID NO: 6906801 - DNA, 22 bp, Homo sapiens
ggcacagggagccgcagttgca

SEQ ID NO: 6906802 - DNA, 19 bp, Homo sapiens
actagcacccaggtaaatg

SEQ ID NO: 6906803 - DNA, 22 bp, Homo sapiens
tggcacagaaaaatgctccatt

SEQ ID NO: 6906804 - DNA, 22 bp, Homo sapiens
gaatgcagtggcaccatctcag

SEQ ID NO: 6906805 - DNA, 22 bp, Homo sapiens
gagcagtggtcacagggaggga

SEQ ID NO: 6906806 - DNA, 22 bp, Homo sapiens
tgcaggtgctgtgtcaagagag

SEQ ID NO: 6906807 - DNA, 22 bp, Homo sapiens
tttttcagccatgaattacact

SEQ ID NO: 6906808 - DNA, 22 bp, Homo sapiens
ttctgctgaagccagggagcaa

SEQ ID NO: 6906809 - DNA, 18 bp, Homo sapiens
gtggcagcctttggcttt

SEQ ID NO: 6906810 - DNA, 22 bp, Homo sapiens
ttccttggagttaagaccctgg

SEQ ID NO: 6906811 - DNA, 16 bp, Homo sapiens
tcagtgtcagctcctg

SEQ ID NO: 6906812 - DNA, 22 bp, Homo sapiens
caggcacacagggaatttggct

SEQ ID NO: 6906813 - DNA, 22 bp, Homo sapiens
actcagtatgagctccgtgaga

SEQ ID NO: 6906814 - DNA, 21 bp, Homo sapiens
ttgttcctatctgcctcctgc

SEQ ID NO: 6906815 - DNA, 22 bp, Homo sapiens
tggtaagggtattatttcatcc

SEQ ID NO: 6906816 - DNA, 22 bp, Homo sapiens
gtaatgaatcaacattaatgat

SEQ ID NO: 6906817 - DNA, 22 bp, Homo sapiens
aaggtctctgttgagaacattt

SEQ ID NO: 6906818 - DNA, 22 bp, Homo sapiens
gcacagggccctgtgcgtaggt

SEQ ID NO: 6906819 - DNA, 22 bp, Homo sapiens
actgtgtggaccactctgaggc

SEQ ID NO: 6906820 - DNA, 22 bp, Homo sapiens
aaggtatatctgatccatgagg

SEQ ID NO: 6906821 - DNA, 22 bp, Homo sapiens
aggaaattgagaatcagaataa

SEQ ID NO: 6906822 - DNA, 22 bp, Homo sapiens
tcccaaggccaggcatctagaa

SEQ ID NO: 6906823 - DNA, 22 bp, Homo sapiens
ttagcatttcatttcaagagga

SEQ ID NO: 6906824 - DNA, 22 bp, Homo sapiens
gtgcaaaatttggccaataaca

SEQ ID NO: 6906825 - DNA, 22 bp, Homo sapiens
atatccgagaccaaataactgg

SEQ ID NO: 6906826 - DNA, 22 bp, Homo sapiens
ttcactggtcctttataggaac

SEQ ID NO: 6906827 - DNA, 22 bp, Homo sapiens
ttgaaagtctaggcttacagta

SEQ ID NO: 6906828 - DNA, 22 bp, Homo sapiens
gagcatggctgcctccctgtgc

SEQ ID NO: 6906829 - DNA, 22 bp, Homo sapiens
ttgctttcccaaggcagaacat

SEQ ID NO: 6906830 - DNA, 19 bp, Homo sapiens
gcctcacaggtctcaggcc

SEQ ID NO: 6906831 - DNA, 22 bp, Homo sapiens
gcaagatttcttttaggtgaag

SEQ ID NO: 6906832 - DNA, 22 bp, Homo sapiens
gcacaggaggccgatgctcatg

SEQ ID NO: 6906833 - DNA, 22 bp, Homo sapiens
tgcaggcaggggatgagcagcc

SEQ ID NO: 6906834 - DNA, 22 bp, Homo sapiens
gatcaaccacgccgggttgcca

SEQ ID NO: 6906835 - DNA, 22 bp, Homo sapiens
gctggctcaagaggtccagagg

SEQ ID NO: 6906836 - DNA, 22 bp, Homo sapiens
ttggtcaattctgtgaggcaac

SEQ ID NO: 6906837 - DNA, 22 bp, Homo sapiens
gagatatgttagaaagctattg

SEQ ID NO: 6906838 - DNA, 22 bp, Homo sapiens
ggggactgccttccacagacac

SEQ ID NO: 6906839 - DNA, 22 bp, Homo sapiens
ttgtaacttaagttttgcatat

SEQ ID NO: 6906840 - DNA, 22 bp, Homo sapiens
aaagtgctgggattacaggcat

SEQ ID NO: 6906841 - DNA, 22 bp, Homo sapiens
ggggctgagaattcagtctcgg

SEQ ID NO: 6906842 - DNA, 22 bp, Homo sapiens
ttggaaacaagatttctactta

SEQ ID NO: 6906843 - DNA, 22 bp, Homo sapiens
ggcgggagcagcagctctgagc

SEQ ID NO: 6906844 - DNA, 21 bp, Homo sapiens
agaccttttctcagataactt

SEQ ID NO: 6906845 - DNA, 22 bp, Homo sapiens
aaaatccttagccgagtgaggt

SEQ ID NO: 6906846 - DNA, 22 bp, Homo sapiens
cagtggaaatcagagtgagagt

SEQ ID NO: 6906847 - DNA, 22 bp, Homo sapiens
aaaggcatgctgctgaatgatg

SEQ ID NO: 6906848 - DNA, 22 bp, Homo sapiens
ctgcttggagtcctccagcacc

SEQ ID NO: 6906849 - DNA, 22 bp, Homo sapiens
gatggctcaagagcttttgaga

SEQ ID NO: 6906850 - DNA, 22 bp, Homo sapiens
cagcagttgaaattgacatgtg

SEQ ID NO: 6906851 - DNA, 22 bp, Homo sapiens
ttctcctttcattccctgtaga

SEQ ID NO: 6906852 - DNA, 22 bp, Homo sapiens
ccattgtaaattctgtggaagt

SEQ ID NO: 6906853 - DNA, 22 bp, Homo sapiens
tatgagaaagtcgtatgtctcc

SEQ ID NO: 6906854 - DNA, 21 bp, Homo sapiens
ggcacagcctgaaatgcctca

SEQ ID NO: 6906855 - DNA, 22 bp, Homo sapiens
tctgctgccaccttgtggtgag

SEQ ID NO: 6906856 - DNA, 22 bp, Homo sapiens
cttccaagcccaggagccattt

SEQ ID NO: 6906857 - DNA, 22 bp, Homo sapiens
cctgaggcttgggagttccgcc

SEQ ID NO: 6906858 - DNA, 22 bp, Homo sapiens
aagggcaggagaagacggatat

SEQ ID NO: 6906859 - DNA, 22 bp, Homo sapiens
attcttattaaatagccagaag

SEQ ID NO: 6906860 - DNA, 22 bp, Homo sapiens
tcctggttaccaagcagctctc

SEQ ID NO: 6906861 - DNA, 22 bp, Homo sapiens
ctaggaagagaaggaattcccc

SEQ ID NO: 6906862 - DNA, 18 bp, Homo sapiens
gcttggctgcagagagag

SEQ ID NO: 6906863 - DNA, 22 bp, Homo sapiens
aggttataaaatggtgtacaat

SEQ ID NO: 6906864 - DNA, 22 bp, Homo sapiens
aagttggttctgtgacatgttg

SEQ ID NO: 6906865 - DNA, 22 bp, Homo sapiens
ttgaaatgagcaaactgtcagc

SEQ ID NO: 6906866 - DNA, 22 bp, Homo sapiens
tcacaatatttatcttccaatt

SEQ ID NO: 6906867 - DNA, 22 bp, Homo sapiens
ctgggttctctgcttagggcct

SEQ ID NO: 6906868 - DNA, 22 bp, Homo sapiens
gagtcattgcacactagctcag

SEQ ID NO: 6906869 - DNA, 22 bp, Homo sapiens
taagtctctcgtttgattcatt

SEQ ID NO: 6906870 - DNA, 22 bp, Homo sapiens
tcaggcctccaggttaccattt

SEQ ID NO: 6906871 - DNA, 22 bp, Homo sapiens
caccaggacttaacacattccc

SEQ ID NO: 6906872 - DNA, 22 bp, Homo sapiens
ggaggggaggattaatgacaaa

SEQ ID NO: 6906873 - DNA, 22 bp, Homo sapiens
gaacagtcttgagggtggccag

SEQ ID NO: 6906874 - DNA, 22 bp, Homo sapiens
taatcttagcaacctccagtgt

SEQ ID NO: 6906875 - DNA, 22 bp, Homo sapiens
tgggcttaggtacctccctggt

SEQ ID NO: 6906876 - DNA, 22 bp, Homo sapiens
ttattcctgccttaggtggctg

SEQ ID NO: 6906877 - DNA, 22 bp, Homo sapiens
gggctctgcgggcccggactcc

SEQ ID NO: 6906878 - DNA, 22 bp, Homo sapiens
agcaatgtaaaccctgaagttg

SEQ ID NO: 6906879 - DNA, 21 bp, Homo sapiens
cagtgtggtgaccagggtctc

SEQ ID NO: 6906880 - DNA, 22 bp, Homo sapiens
aagtgtttatggttattgttaa

SEQ ID NO: 6906881 - DNA, 22 bp, Homo sapiens
tagccaggcaattatgggtgat

SEQ ID NO: 6906882 - DNA, 22 bp, Homo sapiens
tcctggatggcctgcaggcggt

SEQ ID NO: 6906883 - DNA, 22 bp, Homo sapiens
tgaaacaaatttggaaaatcta

SEQ ID NO: 6906884 - DNA, 22 bp, Homo sapiens
tgtggctgtggttttcataaat

SEQ ID NO: 6906885 - DNA, 22 bp, Homo sapiens
actgagacagctccgctgcccg

SEQ ID NO: 6906886 - DNA, 22 bp, Homo sapiens
ccctggaggaagaaacaatggc

SEQ ID NO: 6906887 - DNA, 22 bp, Homo sapiens
tttcttggtcttcccgacctgg

SEQ ID NO: 6906888 - DNA, 19 bp, Homo sapiens
tcaagtcctaggcccacaa

SEQ ID NO: 6906889 - DNA, 22 bp, Homo sapiens
ccagtgactggctttctggtgt

SEQ ID NO: 6906890 - DNA, 22 bp, Homo sapiens
acagggcagtgtcttgaaaaat

SEQ ID NO: 6906891 - DNA, 22 bp, Homo sapiens
tggaccctgaagcaacagggag

SEQ ID NO: 6906892 - DNA, 22 bp, Homo sapiens
gttgtactttgactagttgact

SEQ ID NO: 6906893 - DNA, 22 bp, Homo sapiens
gtattcctaagtcatgacaaat

SEQ ID NO: 6906894 - DNA, 22 bp, Homo sapiens
attgtgcatctactgtgtgcag

SEQ ID NO: 6906895 - DNA, 20 bp, Homo sapiens
ttcgctgggagtggccaggc

SEQ ID NO: 6906896 - DNA, 22 bp, Homo sapiens
tttctttccagagtgattggca

SEQ ID NO: 6906897 - DNA, 22 bp, Homo sapiens
tcagcactcgctacctagtaaa

SEQ ID NO: 6906898 - DNA, 22 bp, Homo sapiens
ccacttgaattttagtggtttt

SEQ ID NO: 6906899 - DNA, 22 bp, Homo sapiens
gatttctctgcacccactcagg

SEQ ID NO: 6906900 - DNA, 22 bp, Homo sapiens
tccgtgagattaagcagaattc

SEQ ID NO: 6906901 - DNA, 22 bp, Homo sapiens
tggcacagcttgtcataaactc

SEQ ID NO: 6906902 - DNA, 22 bp, Homo sapiens
atcattaacccttgatgctggg

SEQ ID NO: 6906903 - DNA, 22 bp, Homo sapiens
taggatttggctttagtcaggt

SEQ ID NO: 6906904 - DNA, 22 bp, Homo sapiens
aggggagcgacattccgtgccg

SEQ ID NO: 6906905 - DNA, 22 bp, Homo sapiens
acttggccttatttccacagaa

SEQ ID NO: 6906906 - DNA, 22 bp, Homo sapiens
acttggagagcattgctgggga

SEQ ID NO: 6906907 - DNA, 22 bp, Homo sapiens
acctgggagagaggagccggcg

SEQ ID NO: 6906908 - DNA, 17 bp, Homo sapiens
ctcagcagggctcactt

SEQ ID NO: 6906909 - DNA, 22 bp, Homo sapiens
gctgccttcccaggcctttgct

SEQ ID NO: 6906910 - DNA, 22 bp, Homo sapiens
gtgctgagcacaaggcccagag

SEQ ID NO: 6906911 - DNA, 22 bp, Homo sapiens
aaggctttccagaaagtcttga

SEQ ID NO: 6906912 - DNA, 21 bp, Homo sapiens
ctggactgaggagacagtcgc

SEQ ID NO: 6906913 - DNA, 22 bp, Homo sapiens
acccaggtctctcgacttctgg

SEQ ID NO: 6906914 - DNA, 22 bp, Homo sapiens
tttgtataaattggagcaatgt

SEQ ID NO: 6906915 - DNA, 22 bp, Homo sapiens
aaatccagctacggggcaacat

SEQ ID NO: 6906916 - DNA, 22 bp, Homo sapiens
tgctttattaagagagaaattt

SEQ ID NO: 6906917 - DNA, 21 bp, Homo sapiens
tatcagaagagaaagaatgat

SEQ ID NO: 6906918 - DNA, 22 bp, Homo sapiens
gcacgtgcacacatgtgtacaa

SEQ ID NO: 6906919 - DNA, 22 bp, Homo sapiens
tctctgtggcaacaattcacta

SEQ ID NO: 6906920 - DNA, 22 bp, Homo sapiens
ccctgtctgtaccgtgatgagc

SEQ ID NO: 6906921 - DNA, 22 bp, Homo sapiens
agaactggtggtgatcagttat

SEQ ID NO: 6906922 - DNA, 22 bp, Homo sapiens
ttccagtcagtgtgagtttatt

SEQ ID NO: 6906923 - DNA, 22 bp, Homo sapiens
gtgatcttgtaattgggcaatg

SEQ ID NO: 6906924 - DNA, 22 bp, Homo sapiens
ttctagggttacagtttcttcc

SEQ ID NO: 6906925 - DNA, 22 bp, Homo sapiens
gtgcaatctggttaatacgact

SEQ ID NO: 6906926 - DNA, 21 bp, Homo sapiens
aagtggagaagaaaagctgga

SEQ ID NO: 6906927 - DNA, 22 bp, Homo sapiens
gatgcctccaaatgagggcaga

SEQ ID NO: 6906928 - DNA, 22 bp, Homo sapiens
gatgatgctctagtggagtttt

SEQ ID NO: 6906929 - DNA, 22 bp, Homo sapiens
agctaacatgactagaagcttc

SEQ ID NO: 6906930 - DNA, 22 bp, Homo sapiens
agcgtgtgcctcggggtacacg

SEQ ID NO: 6906931 - DNA, 22 bp, Homo sapiens
tctcccaagcctggcaggggca

SEQ ID NO: 6906932 - DNA, 22 bp, Homo sapiens
tggaaatagatagtatcattca

SEQ ID NO: 6906933 - DNA, 22 bp, Homo sapiens
tcccccagtctgggcgtggtca

SEQ ID NO: 6906934 - DNA, 22 bp, Homo sapiens
tgcttctgcaacttgaatgtac

SEQ ID NO: 6906935 - DNA, 23 bp, Homo sapiens
gatacactccctgctgggcactg

SEQ ID NO: 6906936 - DNA, 22 bp, Homo sapiens
cctttgggtgaattcctctctt

SEQ ID NO: 6906937 - DNA, 22 bp, Homo sapiens
tgtttgttccctctctttcctg

SEQ ID NO: 6906938 - DNA, 22 bp, Homo sapiens
ccctgcaggggacctgcagcct

SEQ ID NO: 6906939 - DNA, 22 bp, Homo sapiens
cataaagtaggcaagcattcca

SEQ ID NO: 6906940 - DNA, 22 bp, Homo sapiens
tgctggagcaacattattgtgc

SEQ ID NO: 6906941 - DNA, 23 bp, Homo sapiens
gagaccagggccagctgtgtcat

SEQ ID NO: 6906942 - DNA, 22 bp, Homo sapiens
tcctgaccactaggaccaggct

SEQ ID NO: 6906943 - DNA, 22 bp, Homo sapiens
ctgctacttaccagctgtgtaa

SEQ ID NO: 6906944 - DNA, 22 bp, Homo sapiens
cttccctttttatgtcttcagc

SEQ ID NO: 6906945 - DNA, 22 bp, Homo sapiens
accccagaagcagcagtggcag

SEQ ID NO: 6906946 - DNA, 22 bp, Homo sapiens
tctgtcatctgttcagtgctca

SEQ ID NO: 6906947 - DNA, 18 bp, Homo sapiens
tggaggaatcacaatggc

SEQ ID NO: 6906948 - DNA, 22 bp, Homo sapiens
cctcaggctgctcacacttgtc

SEQ ID NO: 6906949 - DNA, 22 bp, Homo sapiens
tgttaggagcttcctgggctga

SEQ ID NO: 6906950 - DNA, 22 bp, Homo sapiens
tccagtggagtgtgggggtgaa

SEQ ID NO: 6906951 - DNA, 22 bp, Homo sapiens
agcttcaacttactaaaagata

SEQ ID NO: 6906952 - DNA, 22 bp, Homo sapiens
tcagaaactaaatgtggatttg

SEQ ID NO: 6906953 - DNA, 22 bp, Homo sapiens
ctatggtgatagaaatcagaat

SEQ ID NO: 6906954 - DNA, 22 bp, Homo sapiens
taaacaagctgtctgatattct

SEQ ID NO: 6906955 - DNA, 22 bp, Homo sapiens
accagcatttgcagaaatggag

SEQ ID NO: 6906956 - DNA, 22 bp, Homo sapiens
aaatctctggcagaaataaact

SEQ ID NO: 6906957 - DNA, 22 bp, Homo sapiens
atggtcacatgaccctttccaa

SEQ ID NO: 6906958 - DNA, 22 bp, Homo sapiens
acagatgacttgtctgctgtaa

SEQ ID NO: 6906959 - DNA, 23 bp, Homo sapiens
cacttcccctgtggcgagcctgc

SEQ ID NO: 6906960 - DNA, 22 bp, Homo sapiens
ttcaagtaaatcactttttgtc

SEQ ID NO: 6906961 - DNA, 22 bp, Homo sapiens
gtgtatgcaattgagtcataga

SEQ ID NO: 6906962 - DNA, 22 bp, Homo sapiens
gaggccacagctatcagggaca

SEQ ID NO: 6906963 - DNA, 22 bp, Homo sapiens
attctacatgatagaagggaga

SEQ ID NO: 6906964 - DNA, 22 bp, Homo sapiens
tttcaaactccagctcaccaat

SEQ ID NO: 6906965 - DNA, 22 bp, Homo sapiens
gacaggcttccactatgttgcc

SEQ ID NO: 6906966 - DNA, 22 bp, Homo sapiens
tttcttgtgcctaattttgggc

SEQ ID NO: 6906967 - DNA, 22 bp, Homo sapiens
gcaggagttcaattgcccatga

SEQ ID NO: 6906968 - DNA, 18 bp, Homo sapiens
ggagagtgacagagtcgt

SEQ ID NO: 6906969 - DNA, 22 bp, Homo sapiens
tttaccacaattttaaacaatg

SEQ ID NO: 6906970 - DNA, 22 bp, Homo sapiens
atcagaggtggaactggggact

SEQ ID NO: 6906971 - DNA, 22 bp, Homo sapiens
gagctgctgaagggaaaatgaa

SEQ ID NO: 6906972 - DNA, 22 bp, Homo sapiens
aaggctttctcaggccctggaa

SEQ ID NO: 6906973 - DNA, 22 bp, Homo sapiens
tctacagtgagtcattcaaaca

SEQ ID NO: 6906974 - DNA, 21 bp, Homo sapiens
tggccaaaaccatattattaa

SEQ ID NO: 6906975 - DNA, 22 bp, Homo sapiens
tcccccatcccaaggaggtcat

SEQ ID NO: 6906976 - DNA, 22 bp, Homo sapiens
caaagcctctgatttcacttgt

SEQ ID NO: 6906977 - DNA, 22 bp, Homo sapiens
cctgtgggccctggacagagac

SEQ ID NO: 6906978 - DNA, 22 bp, Homo sapiens
aattcagagacatgaagtgaca

SEQ ID NO: 6906979 - DNA, 22 bp, Homo sapiens
attagcaattgccctgtgcaat

SEQ ID NO: 6906980 - DNA, 22 bp, Homo sapiens
gcataaatgtgcacacacatgt

SEQ ID NO: 6906981 - DNA, 22 bp, Homo sapiens
acaggtttttggataatccttt

SEQ ID NO: 6906982 - DNA, 22 bp, Homo sapiens
acagacagtatggtggggctga

SEQ ID NO: 6906983 - DNA, 22 bp, Homo sapiens
agctgcaggcgccggggccgat

SEQ ID NO: 6906984 - DNA, 22 bp, Homo sapiens
gatgctgccagtcaatcccaag

SEQ ID NO: 6906985 - DNA, 22 bp, Homo sapiens
aaactctacatggtcgcaaaaa

SEQ ID NO: 6906986 - DNA, 22 bp, Homo sapiens
tgcagtggaggccgtgagacag

SEQ ID NO: 6906987 - DNA, 22 bp, Homo sapiens
gtggtcagaaatctcagtggca

SEQ ID NO: 6906988 - DNA, 16 bp, Homo sapiens
catgcataaacgatgg

SEQ ID NO: 6906989 - DNA, 22 bp, Homo sapiens
aggtgggcacacctcccttctc

SEQ ID NO: 6906990 - DNA, 19 bp, Homo sapiens
atgaaggcactgagtggga

SEQ ID NO: 6906991 - DNA, 22 bp, Homo sapiens
ttagtacatagatgatggttga

SEQ ID NO: 6906992 - DNA, 22 bp, Homo sapiens
agaaaggaggaagaatgacctc

SEQ ID NO: 6906993 - DNA, 22 bp, Homo sapiens
cagcaggtcttgttgctgctga

SEQ ID NO: 6906994 - DNA, 22 bp, Homo sapiens
aagctggctctgatgtcagaat

SEQ ID NO: 6906995 - DNA, 22 bp, Homo sapiens
ccaagtgatttctaagtttatt

SEQ ID NO: 6906996 - DNA, 22 bp, Homo sapiens
gagggaagattccccatatggg

SEQ ID NO: 6906997 - DNA, 22 bp, Homo sapiens
tagattcagatatttaggacaa

SEQ ID NO: 6906998 - DNA, 22 bp, Homo sapiens
tatgtatatatgttgggtagaa

SEQ ID NO: 6906999 - DNA, 22 bp, Homo sapiens
tgctgcacgataaataatttct

SEQ ID NO: 6907000 - DNA, 22 bp, Homo sapiens
gtgaagtggttagggagttggc

SEQ ID NO: 6907001 - DNA, 22 bp, Homo sapiens
ttatgcagatggcatgaggagg

SEQ ID NO: 6907002 - DNA, 22 bp, Homo sapiens
ctggcacaggatccgagacctt

SEQ ID NO: 6907003 - DNA, 22 bp, Homo sapiens
gattcttgggccttctgaagtt

SEQ ID NO: 6907004 - DNA, 22 bp, Homo sapiens
tactgatagcacaaatgacatt

SEQ ID NO: 6907005 - DNA, 22 bp, Homo sapiens
aaagcagagcagggcacttatg

SEQ ID NO: 6907006 - DNA, 22 bp, Homo sapiens
cacactgatagcactaagtcag

SEQ ID NO: 6907007 - DNA, 22 bp, Homo sapiens
gggaaactgcaactcagagagg

SEQ ID NO: 6907008 - DNA, 22 bp, Homo sapiens
tgtattcagtgatttcacaata

SEQ ID NO: 6907009 - DNA, 22 bp, Homo sapiens
atttatgacaaccaaagagtga

SEQ ID NO: 6907010 - DNA, 22 bp, Homo sapiens
ttctcaggctgtggagccgtct

SEQ ID NO: 6907011 - DNA, 22 bp, Homo sapiens
ccttgcagacatcagtagtggc

SEQ ID NO: 6907012 - DNA, 23 bp, Homo sapiens
gccaggagtgggtagactaatgc

SEQ ID NO: 6907013 - DNA, 22 bp, Homo sapiens
tagtcctttaatagttaatgtg

SEQ ID NO: 6907014 - DNA, 22 bp, Homo sapiens
gctgtgttggtgaagctgtagc

SEQ ID NO: 6907015 - DNA, 22 bp, Homo sapiens
acagtcatagcagcctttgtta

SEQ ID NO: 6907016 - DNA, 22 bp, Homo sapiens
tacagatatatagtgtgtgcct

SEQ ID NO: 6907017 - DNA, 22 bp, Homo sapiens
attgcaaagaaatacatgctta

SEQ ID NO: 6907018 - DNA, 22 bp, Homo sapiens
tttgcctagtagattacctgtt

SEQ ID NO: 6907019 - DNA, 22 bp, Homo sapiens
tcagaattctagctcttccctt

SEQ ID NO: 6907020 - DNA, 22 bp, Homo sapiens
attctggatattacttatctat

SEQ ID NO: 6907021 - DNA, 22 bp, Homo sapiens
agtgggggctggctctgtctgt

SEQ ID NO: 6907022 - DNA, 22 bp, Homo sapiens
agagtctgatttggtaagacca

SEQ ID NO: 6907023 - DNA, 22 bp, Homo sapiens
tttcagcactttaggcagcagg

SEQ ID NO: 6907024 - DNA, 22 bp, Homo sapiens
gtgctgctgaaaaacaaagtct

SEQ ID NO: 6907025 - DNA, 22 bp, Homo sapiens
cttcctaggaagtcagacttcc

SEQ ID NO: 6907026 - DNA, 22 bp, Homo sapiens
ttctctgcagctcctggctggg

SEQ ID NO: 6907027 - DNA, 22 bp, Homo sapiens
tatgggtagagatgggggttag

SEQ ID NO: 6907028 - DNA, 22 bp, Homo sapiens
ataaagctatttttaattctgt

SEQ ID NO: 6907029 - DNA, 22 bp, Homo sapiens
tattgtctatcgctgctttcat

SEQ ID NO: 6907030 - DNA, 22 bp, Homo sapiens
atacagatgaaatactaagcta

SEQ ID NO: 6907031 - DNA, 22 bp, Homo sapiens
acatttgactgtagatacttgc

SEQ ID NO: 6907032 - DNA, 18 bp, Homo sapiens
aagtcttggaatttccac

SEQ ID NO: 6907033 - DNA, 17 bp, Homo sapiens
agggacagcagtttagg

SEQ ID NO: 6907034 - DNA, 22 bp, Homo sapiens
tttcccaggctggaatgcagtg

SEQ ID NO: 6907035 - DNA, 22 bp, Homo sapiens
tgaccctgaaatgtagtggttt

SEQ ID NO: 6907036 - DNA, 22 bp, Homo sapiens
ttcacataatctgcagcaagcg

SEQ ID NO: 6907037 - DNA, 22 bp, Homo sapiens
tcttacaagaaggaaaagggag

SEQ ID NO: 6907038 - DNA, 22 bp, Homo sapiens
agctgcttcaaaatgggctcct

SEQ ID NO: 6907039 - DNA, 22 bp, Homo sapiens
catgttaactaagattaactat

SEQ ID NO: 6907040 - DNA, 22 bp, Homo sapiens
acctggaacttggtcatttttc

SEQ ID NO: 6907041 - DNA, 22 bp, Homo sapiens
ccagagagggcgccacctggag

SEQ ID NO: 6907042 - DNA, 22 bp, Homo sapiens
tagaaacaagtttctctttggg

SEQ ID NO: 6907043 - DNA, 22 bp, Homo sapiens
aattgtgcatttttaaatcacg

SEQ ID NO: 6907044 - DNA, 22 bp, Homo sapiens
ttgttcttttgcttagacagat

SEQ ID NO: 6907045 - DNA, 18 bp, Homo sapiens
ctgaggcttagagaggtt

SEQ ID NO: 6907046 - DNA, 20 bp, Homo sapiens
ccactccaggtgattctgat

SEQ ID NO: 6907047 - DNA, 17 bp, Homo sapiens
ccactcagtaatttctc

SEQ ID NO: 6907048 - DNA, 22 bp, Homo sapiens
tctgtgattgatttaatgctct

SEQ ID NO: 6907049 - DNA, 23 bp, Homo sapiens
gtgtcattactgtaattattgtg

SEQ ID NO: 6907050 - DNA, 22 bp, Homo sapiens
ggcccctggcaccaggctgatt

SEQ ID NO: 6907051 - DNA, 20 bp, Homo sapiens
aagcactgtggtggcatgga

SEQ ID NO: 6907052 - DNA, 23 bp, Homo sapiens
ttgtaaaacagtgtgacggttcc

SEQ ID NO: 6907053 - DNA, 22 bp, Homo sapiens
tttccttttataaggcttgagg

SEQ ID NO: 6907054 - DNA, 22 bp, Homo sapiens
ctacagaaaatcagccacaggc

SEQ ID NO: 6907055 - DNA, 22 bp, Homo sapiens
tgttacaacagtaccgtgctgt

SEQ ID NO: 6907056 - DNA, 22 bp, Homo sapiens
taccatcattgtcacaccggaa

SEQ ID NO: 6907057 - DNA, 22 bp, Homo sapiens
gtgacagcattgcagggcctct

SEQ ID NO: 6907058 - DNA, 22 bp, Homo sapiens
agctgaagcagtcagttcagct

SEQ ID NO: 6907059 - DNA, 22 bp, Homo sapiens
tgggaaatgctgcattgggcaa

SEQ ID NO: 6907060 - DNA, 21 bp, Homo sapiens
gcttcagcaaggcttgctggt

SEQ ID NO: 6907061 - DNA, 19 bp, Homo sapiens
gaagtcattctgaaattct

SEQ ID NO: 6907062 - DNA, 22 bp, Homo sapiens
tgactttagaattttatccaga

SEQ ID NO: 6907063 - DNA, 22 bp, Homo sapiens
ggaggctctaaactttccttgg

SEQ ID NO: 6907064 - DNA, 22 bp, Homo sapiens
aaagagaacttttacccaagaa

SEQ ID NO: 6907065 - DNA, 22 bp, Homo sapiens
agcttcttgacggatgttctgg

SEQ ID NO: 6907066 - DNA, 23 bp, Homo sapiens
tccttgggcctgcccagagtggt

SEQ ID NO: 6907067 - DNA, 22 bp, Homo sapiens
catctgtcttttgttacaaggc

SEQ ID NO: 6907068 - DNA, 22 bp, Homo sapiens
gcagaggtgagaagggcctccc

SEQ ID NO: 6907069 - DNA, 22 bp, Homo sapiens
tatttagatgcatttggattgc

SEQ ID NO: 6907070 - DNA, 22 bp, Homo sapiens
agcagaggaggatttagttagg

SEQ ID NO: 6907071 - DNA, 22 bp, Homo sapiens
aaggaggcactcgctctcaggg

SEQ ID NO: 6907072 - DNA, 23 bp, Homo sapiens
cagtgcagggcaactcagactcc

SEQ ID NO: 6907073 - DNA, 22 bp, Homo sapiens
gaataattgtgatgcttgaagt

SEQ ID NO: 6907074 - DNA, 22 bp, Homo sapiens
tctatgtatggaccttttctgt

SEQ ID NO: 6907075 - DNA, 22 bp, Homo sapiens
tgtgcaaagtgtacaaattaat

SEQ ID NO: 6907076 - DNA, 21 bp, Homo sapiens
catcagatttagaagttctat

SEQ ID NO: 6907077 - DNA, 22 bp, Homo sapiens
cgtcatttgtaaatgatcaaga

SEQ ID NO: 6907078 - DNA, 22 bp, Homo sapiens
ctggccttgttcctccccaagt

SEQ ID NO: 6907079 - DNA, 22 bp, Homo sapiens
gcagaagcacaggtgacgggcc

SEQ ID NO: 6907080 - DNA, 22 bp, Homo sapiens
gcaggaacttgggtgaagtcag

SEQ ID NO: 6907081 - DNA, 22 bp, Homo sapiens
tcactttgacagagaaatgaat

SEQ ID NO: 6907082 - DNA, 16 bp, Homo sapiens
gtgagggacatagctt

SEQ ID NO: 6907083 - DNA, 22 bp, Homo sapiens
gcaactttagaaaaatctataa

SEQ ID NO: 6907084 - DNA, 22 bp, Homo sapiens
agcctctcttatcccttcaaag

SEQ ID NO: 6907085 - DNA, 22 bp, Homo sapiens
gaggctcagggaaacagcgcag

SEQ ID NO: 6907086 - DNA, 23 bp, Homo sapiens
tgacaccctcattgtgtgtcgca

SEQ ID NO: 6907087 - DNA, 17 bp, Homo sapiens
atacatgtaaagtgctt

SEQ ID NO: 6907088 - DNA, 22 bp, Homo sapiens
caggcctcaccagcggagctgc

SEQ ID NO: 6907089 - DNA, 22 bp, Homo sapiens
ttgggcagatgtttcctgtgga

SEQ ID NO: 6907090 - DNA, 18 bp, Homo sapiens
caggaacctctccttttt

SEQ ID NO: 6907091 - DNA, 22 bp, Homo sapiens
tcagtagcagaaagcaatgagt

SEQ ID NO: 6907092 - DNA, 22 bp, Homo sapiens
ctgcaggggctggagttggctt

SEQ ID NO: 6907093 - DNA, 22 bp, Homo sapiens
gggcactggcaccaaagacttg

SEQ ID NO: 6907094 - DNA, 22 bp, Homo sapiens
agagtcttggctgagaacaaga

SEQ ID NO: 6907095 - DNA, 22 bp, Homo sapiens
tgttccttgaatatatcagacg

SEQ ID NO: 6907096 - DNA, 22 bp, Homo sapiens
ttggtttagcaacttcctgtgt

SEQ ID NO: 6907097 - DNA, 22 bp, Homo sapiens
tctttcttacaaagaaaacggt

SEQ ID NO: 6907098 - DNA, 22 bp, Homo sapiens
aatgaaacaattagctgtaata

SEQ ID NO: 6907099 - DNA, 22 bp, Homo sapiens
ttcttctccgaggagggctggt

SEQ ID NO: 6907100 - DNA, 22 bp, Homo sapiens
gaccaccagaggtccgtgggta

SEQ ID NO: 6907101 - DNA, 22 bp, Homo sapiens
tggatgaaatattgcatttatg

SEQ ID NO: 6907102 - DNA, 22 bp, Homo sapiens
aggcagcaaagaaatgatgctg

SEQ ID NO: 6907103 - DNA, 22 bp, Homo sapiens
aaatctggccccttgcctattt

SEQ ID NO: 6907104 - DNA, 22 bp, Homo sapiens
aagtgcatatttttgttgtaga

SEQ ID NO: 6907105 - DNA, 22 bp, Homo sapiens
tggtgcccttgtgggtgagatg

SEQ ID NO: 6907106 - DNA, 22 bp, Homo sapiens
agtttctattttcatgtctgtt

SEQ ID NO: 6907107 - DNA, 22 bp, Homo sapiens
tttgtgtatgtatgcttgtaca

SEQ ID NO: 6907108 - DNA, 22 bp, Homo sapiens
tgacacaattttctgaccttca

SEQ ID NO: 6907109 - DNA, 20 bp, Homo sapiens
tgagcacctgggtgttctgg

SEQ ID NO: 6907110 - DNA, 22 bp, Homo sapiens
gctgggaggaatttggggaata

SEQ ID NO: 6907111 - DNA, 22 bp, Homo sapiens
ggtgctgagtgagctagaggct

SEQ ID NO: 6907112 - DNA, 22 bp, Homo sapiens
tgaggggagcccgccctggacg

SEQ ID NO: 6907113 - DNA, 22 bp, Homo sapiens
gttctgggagatcttgagcttc

SEQ ID NO: 6907114 - DNA, 22 bp, Homo sapiens
cttcccccaaatcaagagacct

SEQ ID NO: 6907115 - DNA, 22 bp, Homo sapiens
ttagaatgatagagaatttgtt

SEQ ID NO: 6907116 - DNA, 22 bp, Homo sapiens
tctgaagccacctctgcttgtc

SEQ ID NO: 6907117 - DNA, 17 bp, Homo sapiens
agccagttcatagcact

SEQ ID NO: 6907118 - DNA, 22 bp, Homo sapiens
gatacagatctttaactgccct

SEQ ID NO: 6907119 - DNA, 22 bp, Homo sapiens
cagccttagcaggatcatctga

SEQ ID NO: 6907120 - DNA, 22 bp, Homo sapiens
gacactggatttctagaaatgt

SEQ ID NO: 6907121 - DNA, 22 bp, Homo sapiens
tggcagtctgcctcttcaccat

SEQ ID NO: 6907122 - DNA, 22 bp, Homo sapiens
atccagtctgtctaccttctca

SEQ ID NO: 6907123 - DNA, 22 bp, Homo sapiens
ggcagctgtctcattcacacct

SEQ ID NO: 6907124 - DNA, 22 bp, Homo sapiens
cctacatatagggctttgctgt

SEQ ID NO: 6907125 - DNA, 22 bp, Homo sapiens
gatgtgtcatttggtcatctgc

SEQ ID NO: 6907126 - DNA, 20 bp, Homo sapiens
gcagggcgacacgggggagg

SEQ ID NO: 6907127 - DNA, 22 bp, Homo sapiens
aggcagattttctttactcagt

SEQ ID NO: 6907128 - DNA, 22 bp, Homo sapiens
attcagtgtgaggttttcaagt

SEQ ID NO: 6907129 - DNA, 22 bp, Homo sapiens
gtcagtgcttgaagggcagaga

SEQ ID NO: 6907130 - DNA, 22 bp, Homo sapiens
cttcatttggcaggctggcctc

SEQ ID NO: 6907131 - DNA, 22 bp, Homo sapiens
agttctcagcttagtatgctgt

SEQ ID NO: 6907132 - DNA, 22 bp, Homo sapiens
tgtcctgggaaatcccttaggc

SEQ ID NO: 6907133 - DNA, 22 bp, Homo sapiens
gcacccagtgggatgcttagca

SEQ ID NO: 6907134 - DNA, 22 bp, Homo sapiens
acagctgggtgtcccacttctg

SEQ ID NO: 6907135 - DNA, 22 bp, Homo sapiens
gtttattaactgtcaagtgatt

SEQ ID NO: 6907136 - DNA, 23 bp, Homo sapiens
tgcctccaccgagggccaggcat

SEQ ID NO: 6907137 - DNA, 18 bp, Homo sapiens
cctggagtgtgttaggct

SEQ ID NO: 6907138 - DNA, 20 bp, Homo sapiens
actctgtactgtcaatgttg

SEQ ID NO: 6907139 - DNA, 22 bp, Homo sapiens
atgctttaaaacgtatgtgtaa

SEQ ID NO: 6907140 - DNA, 23 bp, Homo sapiens
tggcagatacaggcatgacttct

SEQ ID NO: 6907141 - DNA, 22 bp, Homo sapiens
ggaaatcatctgattggctttc

SEQ ID NO: 6907142 - DNA, 22 bp, Homo sapiens
accagtccgcggagctccgggg

SEQ ID NO: 6907143 - DNA, 22 bp, Homo sapiens
cagaaggcctgaatctttgttc

SEQ ID NO: 6907144 - DNA, 22 bp, Homo sapiens
ctagcaattaggtttataaggc

SEQ ID NO: 6907145 - DNA, 22 bp, Homo sapiens
actcagagtctgtttggtacct

SEQ ID NO: 6907146 - DNA, 22 bp, Homo sapiens
tacattcagagaaagtttccat

SEQ ID NO: 6907147 - DNA, 22 bp, Homo sapiens
aaagagaaaaagatcccggctc

SEQ ID NO: 6907148 - DNA, 20 bp, Homo sapiens
gggaggcgagggctgagcag

SEQ ID NO: 6907149 - DNA, 22 bp, Homo sapiens
ggccagctgctcagtgtctctg

SEQ ID NO: 6907150 - DNA, 22 bp, Homo sapiens
acatgagagaaaagtattctga

SEQ ID NO: 6907151 - DNA, 22 bp, Homo sapiens
aattgcttatgccaggtgagag

SEQ ID NO: 6907152 - DNA, 22 bp, Homo sapiens
tgtgtgtataataatgtctgca

SEQ ID NO: 6907153 - DNA, 22 bp, Homo sapiens
agctcccagtctcctctccatg

SEQ ID NO: 6907154 - DNA, 22 bp, Homo sapiens
acagtgattttaggatagatgg

SEQ ID NO: 6907155 - DNA, 22 bp, Homo sapiens
ctctccctaggttagcggtcag

SEQ ID NO: 6907156 - DNA, 21 bp, Homo sapiens
agctggcaatgttgtcctctt

SEQ ID NO: 6907157 - DNA, 22 bp, Homo sapiens
ctggctggcgttttccaaaagc

SEQ ID NO: 6907158 - DNA, 19 bp, Homo sapiens
tcatgcactttgatgtaac

SEQ ID NO: 6907159 - DNA, 22 bp, Homo sapiens
aaaaggtagattctccttctat

SEQ ID NO: 6907160 - DNA, 22 bp, Homo sapiens
ttaactgtgacagtttctcaga

SEQ ID NO: 6907161 - DNA, 22 bp, Homo sapiens
acccatgagcttcttaaaatat

SEQ ID NO: 6907162 - DNA, 22 bp, Homo sapiens
gcactgtgaatatactagcaaa

SEQ ID NO: 6907163 - DNA, 20 bp, Homo sapiens
taacatagtccagagaacga

SEQ ID NO: 6907164 - DNA, 22 bp, Homo sapiens
gtgctaggtgttggagatacag

SEQ ID NO: 6907165 - DNA, 22 bp, Homo sapiens
gggagctgctgaacacaagggt

SEQ ID NO: 6907166 - DNA, 22 bp, Homo sapiens
tgcctgccaggtgcttcttcat

SEQ ID NO: 6907167 - DNA, 20 bp, Homo sapiens
tattgccttaatggagctta

SEQ ID NO: 6907168 - DNA, 22 bp, Homo sapiens
gatcctggcacaggttggtccc

SEQ ID NO: 6907169 - DNA, 22 bp, Homo sapiens
ctggagctgggctagggtagga

SEQ ID NO: 6907170 - DNA, 22 bp, Homo sapiens
ccctgctgcagagagctttcca

SEQ ID NO: 6907171 - DNA, 22 bp, Homo sapiens
gaagaccaatttgggccatggc

SEQ ID NO: 6907172 - DNA, 22 bp, Homo sapiens
ttgttagtttatataatgtagt

SEQ ID NO: 6907173 - DNA, 22 bp, Homo sapiens
gagtgctgcttgggatagtgag

SEQ ID NO: 6907174 - DNA, 23 bp, Homo sapiens
tagagcagtagatcaccatggga

SEQ ID NO: 6907175 - DNA, 22 bp, Homo sapiens
tgctttatgttatcagaagggt

SEQ ID NO: 6907176 - DNA, 22 bp, Homo sapiens
tttcagacataccagttattga

SEQ ID NO: 6907177 - DNA, 22 bp, Homo sapiens
tcttacccggcaacgtgtgtcg

SEQ ID NO: 6907178 - DNA, 22 bp, Homo sapiens
cagtgcaggtggcagaggacag

SEQ ID NO: 6907179 - DNA, 22 bp, Homo sapiens
tgtcaaaaccttggaggcaagg

SEQ ID NO: 6907180 - DNA, 22 bp, Homo sapiens
agcaccatttatcatctaggta

SEQ ID NO: 6907181 - DNA, 22 bp, Homo sapiens
gtagcatctgttggctgctcct

SEQ ID NO: 6907182 - DNA, 22 bp, Homo sapiens
gtccacaacatcagactaactg

SEQ ID NO: 6907183 - DNA, 22 bp, Homo sapiens
aaggttactcagaataacttcc

SEQ ID NO: 6907184 - DNA, 22 bp, Homo sapiens
tgtaaagaaagacgcagagtta

SEQ ID NO: 6907185 - DNA, 22 bp, Homo sapiens
ccagtgttttcatcctcccttg

SEQ ID NO: 6907186 - DNA, 22 bp, Homo sapiens
gtcattcaaactgtatcacttg

SEQ ID NO: 6907187 - DNA, 23 bp, Homo sapiens
gctctggcagcttgtgtcagcac

SEQ ID NO: 6907188 - DNA, 18 bp, Homo sapiens
gtgaaagagacagggcag

SEQ ID NO: 6907189 - DNA, 22 bp, Homo sapiens
ggcttggctgtagctttagcgc

SEQ ID NO: 6907190 - DNA, 22 bp, Homo sapiens
aggcacgtggcgccaggagtga

SEQ ID NO: 6907191 - DNA, 22 bp, Homo sapiens
cagctgggcctcctgagccctg

SEQ ID NO: 6907192 - DNA, 22 bp, Homo sapiens
gaggcggaggttgcagtgagct

SEQ ID NO: 6907193 - DNA, 22 bp, Homo sapiens
ttgaatactcagaaaatgacat

SEQ ID NO: 6907194 - DNA, 23 bp, Homo sapiens
gggggccgtcctggggattatag

SEQ ID NO: 6907195 - DNA, 22 bp, Homo sapiens
agcaactttggatagttgcagg

SEQ ID NO: 6907196 - DNA, 22 bp, Homo sapiens
tgcctgcttgtttacctactcc

SEQ ID NO: 6907197 - DNA, 22 bp, Homo sapiens
ggcagagttggtggagtcagtt

SEQ ID NO: 6907198 - DNA, 22 bp, Homo sapiens
ctgtgtagtcaggtggtcccac

SEQ ID NO: 6907199 - DNA, 22 bp, Homo sapiens
gacacaggattcctggctctgc

SEQ ID NO: 6907200 - DNA, 21 bp, Homo sapiens
tggctctgttcaatatatgga

SEQ ID NO: 6907201 - DNA, 22 bp, Homo sapiens
ttggttttatcttaagattctt

SEQ ID NO: 6907202 - DNA, 22 bp, Homo sapiens
gcctgggactggatgtgtttgt

SEQ ID NO: 6907203 - DNA, 22 bp, Homo sapiens
agtcatctccaatatacaaagc

SEQ ID NO: 6907204 - DNA, 20 bp, Homo sapiens
ctgcatcatggttaagaaca

SEQ ID NO: 6907205 - DNA, 22 bp, Homo sapiens
cctgatggtatattgttgggag

SEQ ID NO: 6907206 - DNA, 22 bp, Homo sapiens
taggacttggaaggagctccca

SEQ ID NO: 6907207 - DNA, 22 bp, Homo sapiens
ttggggtaagtttgtcaagctg

SEQ ID NO: 6907208 - DNA, 22 bp, Homo sapiens
acacagcttcaaagtctaattc

SEQ ID NO: 6907209 - DNA, 22 bp, Homo sapiens
ggagtctgattttttatgggtg

SEQ ID NO: 6907210 - DNA, 22 bp, Homo sapiens
gtgaggtgggctgggctctatg

SEQ ID NO: 6907211 - DNA, 22 bp, Homo sapiens
agtagcttggccctttgttctt

SEQ ID NO: 6907212 - DNA, 22 bp, Homo sapiens
gggtacttaatatttacggggt

SEQ ID NO: 6907213 - DNA, 22 bp, Homo sapiens
tgacacagtagaaagatgatga

SEQ ID NO: 6907214 - DNA, 22 bp, Homo sapiens
actatttactcaaatgaggttg

SEQ ID NO: 6907215 - DNA, 22 bp, Homo sapiens
tggctcctaatgctgcccagac

SEQ ID NO: 6907216 - DNA, 22 bp, Homo sapiens
tgttctgtgcatctagccagta

SEQ ID NO: 6907217 - DNA, 18 bp, Homo sapiens
cagtaactatgttgttac

SEQ ID NO: 6907218 - DNA, 22 bp, Homo sapiens
ttgagcaatgctgcaaagagat

SEQ ID NO: 6907219 - DNA, 22 bp, Homo sapiens
tggtgctccctggagttgtgca

SEQ ID NO: 6907220 - DNA, 22 bp, Homo sapiens
atgtggctccttactcatcagc

SEQ ID NO: 6907221 - DNA, 20 bp, Homo sapiens
agtgactgggagaatggatt

SEQ ID NO: 6907222 - DNA, 23 bp, Homo sapiens
tctcagttccagaggctacaagt

SEQ ID NO: 6907223 - DNA, 22 bp, Homo sapiens
ttgcttatagagagtttcatac

SEQ ID NO: 6907224 - DNA, 22 bp, Homo sapiens
agcaggttccaggcactgtggc

SEQ ID NO: 6907225 - DNA, 22 bp, Homo sapiens
ttgacccagctttccccacaat

SEQ ID NO: 6907226 - DNA, 22 bp, Homo sapiens
tattttactatttggcaaagtc

SEQ ID NO: 6907227 - DNA, 22 bp, Homo sapiens
tgtaacatcacagtgatgtttg

SEQ ID NO: 6907228 - DNA, 22 bp, Homo sapiens
ggtccctgcccaaagcccttgg

SEQ ID NO: 6907229 - DNA, 22 bp, Homo sapiens
caggccaactgcatggtgacca

SEQ ID NO: 6907230 - DNA, 20 bp, Homo sapiens
tcttattgtcttgaggagtt

SEQ ID NO: 6907231 - DNA, 22 bp, Homo sapiens
gatttctcactgtggatttcct

SEQ ID NO: 6907232 - DNA, 22 bp, Homo sapiens
atgtgcatactcttggccagct

SEQ ID NO: 6907233 - DNA, 22 bp, Homo sapiens
acatacattgcctcattggtaa

SEQ ID NO: 6907234 - DNA, 22 bp, Homo sapiens
atctaagctcacaggcttgttg

SEQ ID NO: 6907235 - DNA, 19 bp, Homo sapiens
actgagaccacagacaagt

SEQ ID NO: 6907236 - DNA, 22 bp, Homo sapiens
tcaggcagatgcagggatggat

SEQ ID NO: 6907237 - DNA, 22 bp, Homo sapiens
ttgtaactttgcatactcctgt

SEQ ID NO: 6907238 - DNA, 22 bp, Homo sapiens
agaggcctccctcccagctggt

SEQ ID NO: 6907239 - DNA, 22 bp, Homo sapiens
gtggcaacaaaagagcctagtg

SEQ ID NO: 6907240 - DNA, 22 bp, Homo sapiens
tctttgatttagaaggaaatga

SEQ ID NO: 6907241 - DNA, 22 bp, Homo sapiens
tggaaactagagtgtgggaagc

SEQ ID NO: 6907242 - DNA, 18 bp, Homo sapiens
gtttctcccaggcggggc

SEQ ID NO: 6907243 - DNA, 22 bp, Homo sapiens
gtcagtgtgagttgattccata

SEQ ID NO: 6907244 - DNA, 22 bp, Homo sapiens
catgctgtgtggttagaactgt

SEQ ID NO: 6907245 - DNA, 22 bp, Homo sapiens
ttctgtatcttcagtgcccagc

SEQ ID NO: 6907246 - DNA, 22 bp, Homo sapiens
acccaggacaaaataaccaggt

SEQ ID NO: 6907247 - DNA, 22 bp, Homo sapiens
aagccaggtgtttaggccagcg

SEQ ID NO: 6907248 - DNA, 22 bp, Homo sapiens
tcatcacatatgtcatgatttg

SEQ ID NO: 6907249 - DNA, 22 bp, Homo sapiens
aaaattgtcagaagttgatctt

SEQ ID NO: 6907250 - DNA, 21 bp, Homo sapiens
tggccagctggagtctccaca

SEQ ID NO: 6907251 - DNA, 22 bp, Homo sapiens
ttggaggactagttaagagacc

SEQ ID NO: 6907252 - DNA, 22 bp, Homo sapiens
tttttccagggttagatgttta

SEQ ID NO: 6907253 - DNA, 21 bp, Homo sapiens
ggaaggggtcctcccaacagt

SEQ ID NO: 6907254 - DNA, 22 bp, Homo sapiens
cctaaggaaagccaaagaggcc

SEQ ID NO: 6907255 - DNA, 22 bp, Homo sapiens
gatcattttatagctatagcaa

SEQ ID NO: 6907256 - DNA, 22 bp, Homo sapiens
gacctggactgagttagatggc

SEQ ID NO: 6907257 - DNA, 22 bp, Homo sapiens
tgtatagttgagtcaagtttca

SEQ ID NO: 6907258 - DNA, 22 bp, Homo sapiens
gaagtgggtggtgatatcactg

SEQ ID NO: 6907259 - DNA, 22 bp, Homo sapiens
tttaccacagaaaaaagtaact

SEQ ID NO: 6907260 - DNA, 23 bp, Homo sapiens
agttctcattcatcacggcctat

SEQ ID NO: 6907261 - DNA, 22 bp, Homo sapiens
cactgcactccagcctgggtga

SEQ ID NO: 6907262 - DNA, 22 bp, Homo sapiens
cattgcactctagcctgggtga

SEQ ID NO: 6907263 - DNA, 20 bp, Homo sapiens
ctgggctgcccagctatggg

SEQ ID NO: 6907264 - DNA, 22 bp, Homo sapiens
agcagctgatcaaagcacttat

SEQ ID NO: 6907265 - DNA, 22 bp, Homo sapiens
cccttcagctgagtgggacagc

SEQ ID NO: 6907266 - DNA, 21 bp, Homo sapiens
attccacttttccttcaggga

SEQ ID NO: 6907267 - DNA, 22 bp, Homo sapiens
ggctgcctgctcaggtgcggcg

SEQ ID NO: 6907268 - DNA, 22 bp, Homo sapiens
tgtttcaggcttctgggatttt

SEQ ID NO: 6907269 - DNA, 22 bp, Homo sapiens
ggagccagtgccctctggtgga

SEQ ID NO: 6907270 - DNA, 20 bp, Homo sapiens
atggccaacctgcttatgac

SEQ ID NO: 6907271 - DNA, 22 bp, Homo sapiens
ttgtccaagtggatgttctcag

SEQ ID NO: 6907272 - DNA, 22 bp, Homo sapiens
tccaagtccattatggtggtct

SEQ ID NO: 6907273 - DNA, 22 bp, Homo sapiens
aattggtttgaataaataaaga

SEQ ID NO: 6907274 - DNA, 22 bp, Homo sapiens
acacccacctctttaggccatg

SEQ ID NO: 6907275 - DNA, 23 bp, Homo sapiens
ccaggaaagatccaggaagaggc

SEQ ID NO: 6907276 - DNA, 22 bp, Homo sapiens
tcagtcaggagatgccagagat

SEQ ID NO: 6907277 - DNA, 22 bp, Homo sapiens
tggagccagagcgcagcctggg

SEQ ID NO: 6907278 - DNA, 22 bp, Homo sapiens
tcaggagctgcactgggcccac

SEQ ID NO: 6907279 - DNA, 22 bp, Homo sapiens
cttgcttgaggtatggaatggg

SEQ ID NO: 6907280 - DNA, 22 bp, Homo sapiens
agtgtattaagttatgaagtta

SEQ ID NO: 6907281 - DNA, 22 bp, Homo sapiens
ctggctgggttccaggattcca

SEQ ID NO: 6907282 - DNA, 22 bp, Homo sapiens
ctggtcccagctctgccaccaa

SEQ ID NO: 6907283 - DNA, 22 bp, Homo sapiens
agcatcagcagactctcagcta

SEQ ID NO: 6907284 - DNA, 22 bp, Homo sapiens
ctctgatgtgaccacgtagaca

SEQ ID NO: 6907285 - DNA, 22 bp, Homo sapiens
gacagtctggcctaaagggtta

SEQ ID NO: 6907286 - DNA, 22 bp, Homo sapiens
tagaggagggctgttcttcagt

SEQ ID NO: 6907287 - DNA, 22 bp, Homo sapiens
tgtgcttgtcgtggagccaggc

SEQ ID NO: 6907288 - DNA, 20 bp, Homo sapiens
aggtttatatttagaggtgt

SEQ ID NO: 6907289 - DNA, 22 bp, Homo sapiens
aaggcaatttgttgtgaggatt

SEQ ID NO: 6907290 - DNA, 22 bp, Homo sapiens
attcaaagatcatgatctctac

SEQ ID NO: 6907291 - DNA, 22 bp, Homo sapiens
ttggaccaaggtctgctctttc

SEQ ID NO: 6907292 - DNA, 22 bp, Homo sapiens
cccatggggacaccatgaagga

SEQ ID NO: 6907293 - DNA, 22 bp, Homo sapiens
tgctgggctgcacccccagagt

SEQ ID NO: 6907294 - DNA, 22 bp, Homo sapiens
ctggtttgtcttgggaggatgt

SEQ ID NO: 6907295 - DNA, 22 bp, Homo sapiens
tccagccaatcagagctgaggc

SEQ ID NO: 6907296 - DNA, 22 bp, Homo sapiens
tggctcatctttttagacttat

SEQ ID NO: 6907297 - DNA, 22 bp, Homo sapiens
gggagctccactgcctctcatt

SEQ ID NO: 6907298 - DNA, 22 bp, Homo sapiens
ttttctgcctgcgtgtttagga

SEQ ID NO: 6907299 - DNA, 22 bp, Homo sapiens
cggtcctggcacttgcggctcc

SEQ ID NO: 6907300 - DNA, 22 bp, Homo sapiens
ctggtctgtccgcaggtcacct

SEQ ID NO: 6907301 - DNA, 22 bp, Homo sapiens
tccttctctacaaatccaggca

SEQ ID NO: 6907302 - DNA, 22 bp, Homo sapiens
agtctcctctttccttgttatt

SEQ ID NO: 6907303 - DNA, 22 bp, Homo sapiens
caagagcaggtgctgcttccat

SEQ ID NO: 6907304 - DNA, 19 bp, Homo sapiens
gcaaccttcccttggctcc

SEQ ID NO: 6907305 - DNA, 22 bp, Homo sapiens
tccccacatctctgcatcaggc

SEQ ID NO: 6907306 - DNA, 22 bp, Homo sapiens
agaacttcagcaaaaccagtta

SEQ ID NO: 6907307 - DNA, 22 bp, Homo sapiens
atcctggcgccacacggctcta

SEQ ID NO: 6907308 - DNA, 22 bp, Homo sapiens
accagttaaagggaaattgaaa

SEQ ID NO: 6907309 - DNA, 20 bp, Homo sapiens
aatgccgcaatagataaata

SEQ ID NO: 6907310 - DNA, 22 bp, Homo sapiens
gtgtgcatgaggataggaataa

SEQ ID NO: 6907311 - DNA, 22 bp, Homo sapiens
catcatctgtgctggagagcct

SEQ ID NO: 6907312 - DNA, 22 bp, Homo sapiens
agcagggcaggtaaggatcaga

SEQ ID NO: 6907313 - DNA, 23 bp, Homo sapiens
ttggattcagtttctgggcttct

SEQ ID NO: 6907314 - DNA, 22 bp, Homo sapiens
acaaatggactctcatcttttg

SEQ ID NO: 6907315 - DNA, 23 bp, Homo sapiens
tgacaaagtggtcgttcaaggtg

SEQ ID NO: 6907316 - DNA, 22 bp, Homo sapiens
aataaagacaaacaggggagcc

SEQ ID NO: 6907317 - DNA, 22 bp, Homo sapiens
aaggctccaccctcatggatgc

SEQ ID NO: 6907318 - DNA, 22 bp, Homo sapiens
aagtggtagacaaagataattg

SEQ ID NO: 6907319 - DNA, 22 bp, Homo sapiens
aaatgttcatttctcactcaca

SEQ ID NO: 6907320 - DNA, 22 bp, Homo sapiens
tagtctaagaaatctttacttt

SEQ ID NO: 6907321 - DNA, 22 bp, Homo sapiens
atctgaaaagctttaatgagct

SEQ ID NO: 6907322 - DNA, 22 bp, Homo sapiens
gggcctgaaaccttcagggctt

SEQ ID NO: 6907323 - DNA, 22 bp, Homo sapiens
cctttgtgaatatgcagaaaat

SEQ ID NO: 6907324 - DNA, 22 bp, Homo sapiens
ccacagctagggcaatctgatt

SEQ ID NO: 6907325 - DNA, 20 bp, Homo sapiens
tgcaggtgggcccttctggg

SEQ ID NO: 6907326 - DNA, 22 bp, Homo sapiens
gcagggctgatgttattgacga

SEQ ID NO: 6907327 - DNA, 22 bp, Homo sapiens
tgtgggattcatttggatcagc

SEQ ID NO: 6907328 - DNA, 22 bp, Homo sapiens
aatcagttaaatattgagtaca

SEQ ID NO: 6907329 - DNA, 22 bp, Homo sapiens
gaggaagcttttgatcgcccag

SEQ ID NO: 6907330 - DNA, 22 bp, Homo sapiens
ggcatggctgggttctggtgag

SEQ ID NO: 6907331 - DNA, 22 bp, Homo sapiens
tgcatctgattctcaggcagaa

SEQ ID NO: 6907332 - DNA, 22 bp, Homo sapiens
atccaagatccaggaacttgga

SEQ ID NO: 6907333 - DNA, 22 bp, Homo sapiens
ggccttggctcctgcagggagt

SEQ ID NO: 6907334 - DNA, 22 bp, Homo sapiens
tcatgttttagctgcaaaatga

SEQ ID NO: 6907335 - DNA, 22 bp, Homo sapiens
cctggcatataaatagaagatg

SEQ ID NO: 6907336 - DNA, 22 bp, Homo sapiens
caagatcttcctcaatagacct

SEQ ID NO: 6907337 - DNA, 22 bp, Homo sapiens
tatttgaaggcatacattttga

SEQ ID NO: 6907338 - DNA, 22 bp, Homo sapiens
gattcataccgtttcttctcca

SEQ ID NO: 6907339 - DNA, 22 bp, Homo sapiens
tctattgtgctaccagaattac

SEQ ID NO: 6907340 - DNA, 22 bp, Homo sapiens
ggagggagcagagaacccaacc

SEQ ID NO: 6907341 - DNA, 22 bp, Homo sapiens
cactaaatgcctaggaagaagc

SEQ ID NO: 6907342 - DNA, 22 bp, Homo sapiens
atgttcattagtcaacatttct

SEQ ID NO: 6907343 - DNA, 22 bp, Homo sapiens
atacatgtgtgtgcatacatgt

SEQ ID NO: 6907344 - DNA, 21 bp, Homo sapiens
cttcccaaggcttcaaagcct

SEQ ID NO: 6907345 - DNA, 22 bp, Homo sapiens
tagggcaggggaggaatctgaa

SEQ ID NO: 6907346 - DNA, 22 bp, Homo sapiens
taagttcaagtcttggatataa

SEQ ID NO: 6907347 - DNA, 22 bp, Homo sapiens
atttctcaaaggaatagagtga

SEQ ID NO: 6907348 - DNA, 22 bp, Homo sapiens
cccaggtgctgaaggaggccgc

SEQ ID NO: 6907349 - DNA, 22 bp, Homo sapiens
atttgcatttagaaagatcact

SEQ ID NO: 6907350 - DNA, 22 bp, Homo sapiens
agttctaattgcgttttcttgc

SEQ ID NO: 6907351 - DNA, 22 bp, Homo sapiens
tgtcacagagcgtgcaacagaa

SEQ ID NO: 6907352 - DNA, 22 bp, Homo sapiens
cacctgggctttctctgggact

SEQ ID NO: 6907353 - DNA, 22 bp, Homo sapiens
atatctggttggtaatataaca

SEQ ID NO: 6907354 - DNA, 22 bp, Homo sapiens
gcctggagggatagaatgcaag

SEQ ID NO: 6907355 - DNA, 22 bp, Homo sapiens
aggacttctgagctgctttaaa

SEQ ID NO: 6907356 - DNA, 22 bp, Homo sapiens
tcacatgccctacctaatctta

SEQ ID NO: 6907357 - DNA, 22 bp, Homo sapiens
atcagctgaaaaacaggcagca

SEQ ID NO: 6907358 - DNA, 22 bp, Homo sapiens
tctctaaatgattgtgtactcc

SEQ ID NO: 6907359 - DNA, 22 bp, Homo sapiens
ctctgagaaagctgtgagctaa

SEQ ID NO: 6907360 - DNA, 22 bp, Homo sapiens
aatcttctttcttaacagtaca

SEQ ID NO: 6907361 - DNA, 22 bp, Homo sapiens
gaggacatagtggactagggtt

SEQ ID NO: 6907362 - DNA, 22 bp, Homo sapiens
ctttccctgcttagaaggattt

SEQ ID NO: 6907363 - DNA, 22 bp, Homo sapiens
acaccttctgagaactgagcag

SEQ ID NO: 6907364 - DNA, 22 bp, Homo sapiens
tcacacacatttgctgtctgat

SEQ ID NO: 6907365 - DNA, 22 bp, Homo sapiens
cttattgaaagcccctgtgcct

SEQ ID NO: 6907366 - DNA, 22 bp, Homo sapiens
actttggggatctacggctgga

SEQ ID NO: 6907367 - DNA, 22 bp, Homo sapiens
tgcacaaaggctccctgctgag

SEQ ID NO: 6907368 - DNA, 22 bp, Homo sapiens
tgtagccagaagtcatagggtg

SEQ ID NO: 6907369 - DNA, 22 bp, Homo sapiens
atgttcagcattctataaatat

SEQ ID NO: 6907370 - DNA, 22 bp, Homo sapiens
ctgtgcatcttcttcctggagg

SEQ ID NO: 6907371 - DNA, 22 bp, Homo sapiens
agttcactctttatgagaaagt

SEQ ID NO: 6907372 - DNA, 22 bp, Homo sapiens
atgtgtagaactgtaatgccca

SEQ ID NO: 6907373 - DNA, 22 bp, Homo sapiens
ataaatggctttcattcctagg

SEQ ID NO: 6907374 - DNA, 22 bp, Homo sapiens
tccctgccctgccttcatggtt

SEQ ID NO: 6907375 - DNA, 23 bp, Homo sapiens
agaaaccactgaagagatccagt

SEQ ID NO: 6907376 - DNA, 22 bp, Homo sapiens
gaattacataataaaatgagag

SEQ ID NO: 6907377 - DNA, 22 bp, Homo sapiens
gagcagctgttctgacttgtct

SEQ ID NO: 6907378 - DNA, 22 bp, Homo sapiens
tcagggcctttgcagttgtttt

SEQ ID NO: 6907379 - DNA, 22 bp, Homo sapiens
cccaggagagggaaccaaatgt

SEQ ID NO: 6907380 - DNA, 22 bp, Homo sapiens
tccaagaacccaagcgaatgcc

SEQ ID NO: 6907381 - DNA, 22 bp, Homo sapiens
cagagcctgctcacgtctctgt

SEQ ID NO: 6907382 - DNA, 22 bp, Homo sapiens
taaacatctgtcatgtgtttat

SEQ ID NO: 6907383 - DNA, 22 bp, Homo sapiens
taggttcagctttcatcctgaa

SEQ ID NO: 6907384 - DNA, 22 bp, Homo sapiens
attagcctccttgtctcatgcg

SEQ ID NO: 6907385 - DNA, 22 bp, Homo sapiens
aacatttccggccttttgttct

SEQ ID NO: 6907386 - DNA, 22 bp, Homo sapiens
ttggccttctctgacactgccc

SEQ ID NO: 6907387 - DNA, 21 bp, Homo sapiens
cagcaaggaagtcgagtaggt

SEQ ID NO: 6907388 - DNA, 22 bp, Homo sapiens
gcatgctctgcaaaggcttttg

SEQ ID NO: 6907389 - DNA, 22 bp, Homo sapiens
ggctttctatgaactcaaaggc

SEQ ID NO: 6907390 - DNA, 22 bp, Homo sapiens
tgggttgttgtgacagttacca

SEQ ID NO: 6907391 - DNA, 17 bp, Homo sapiens
gtctctgtcttgctttt

SEQ ID NO: 6907392 - DNA, 22 bp, Homo sapiens
ccactgctcctgaccaaggtca

SEQ ID NO: 6907393 - DNA, 22 bp, Homo sapiens
ttccttcctctttcacaacagc

SEQ ID NO: 6907394 - DNA, 22 bp, Homo sapiens
acatcagtaactgtaaaacagg

SEQ ID NO: 6907395 - DNA, 22 bp, Homo sapiens
agaggcacaaactggaaaggac

SEQ ID NO: 6907396 - DNA, 22 bp, Homo sapiens
gagaagaaatagaatcacattt

SEQ ID NO: 6907397 - DNA, 22 bp, Homo sapiens
caggttccctagcagcaaagcc

SEQ ID NO: 6907398 - DNA, 22 bp, Homo sapiens
tccttgcagcaggtgatattaa

SEQ ID NO: 6907399 - DNA, 22 bp, Homo sapiens
tctgtttagactcagttgaaac

SEQ ID NO: 6907400 - DNA, 22 bp, Homo sapiens
cctcaaagcggtatgcagacgg

SEQ ID NO: 6907401 - DNA, 22 bp, Homo sapiens
gttcactgtactggtgatggtt

SEQ ID NO: 6907402 - DNA, 22 bp, Homo sapiens
tttccaagataatacacagaaa

SEQ ID NO: 6907403 - DNA, 22 bp, Homo sapiens
agcaggtggatttagacgggag

SEQ ID NO: 6907404 - DNA, 23 bp, Homo sapiens
gtaaaatacgcagtgcagtgtga

SEQ ID NO: 6907405 - DNA, 22 bp, Homo sapiens
aaatggctgcatttgtgtaaat

SEQ ID NO: 6907406 - DNA, 19 bp, Homo sapiens
atcctttcccacatacttt

SEQ ID NO: 6907407 - DNA, 17 bp, Homo sapiens
cacatgttcttagagcc

SEQ ID NO: 6907408 - DNA, 22 bp, Homo sapiens
tcaacaatcccatggttcagtt

SEQ ID NO: 6907409 - DNA, 20 bp, Homo sapiens
aagctagcaaaagccacaaa

SEQ ID NO: 6907410 - DNA, 22 bp, Homo sapiens
ttacaagatatgtgagaactag

SEQ ID NO: 6907411 - DNA, 22 bp, Homo sapiens
agctggttgacgttatccagga

SEQ ID NO: 6907412 - DNA, 22 bp, Homo sapiens
gcctggtgtctccccaaggaag

SEQ ID NO: 6907413 - DNA, 22 bp, Homo sapiens
gcctgacctcttctgccctggg

SEQ ID NO: 6907414 - DNA, 23 bp, Homo sapiens
agggaagaaacatgaagggctgt

SEQ ID NO: 6907415 - DNA, 18 bp, Homo sapiens
gggtgctggggccccttg

SEQ ID NO: 6907416 - DNA, 22 bp, Homo sapiens
gaacctctttagtgcatccttc

SEQ ID NO: 6907417 - DNA, 22 bp, Homo sapiens
caggtccacagcccatcactgc

SEQ ID NO: 6907418 - DNA, 22 bp, Homo sapiens
cagcttcagaagaagccgtgag

SEQ ID NO: 6907419 - DNA, 22 bp, Homo sapiens
ttgaagtttaatggtagattcc

SEQ ID NO: 6907420 - DNA, 22 bp, Homo sapiens
gagcagagaatccagctaagtg

SEQ ID NO: 6907421 - DNA, 22 bp, Homo sapiens
tttcagtcatgagttgttttca

SEQ ID NO: 6907422 - DNA, 22 bp, Homo sapiens
ttaaggttgagctcacttttat

SEQ ID NO: 6907423 - DNA, 22 bp, Homo sapiens
taacatgctaggaagagtgatt

SEQ ID NO: 6907424 - DNA, 22 bp, Homo sapiens
ccttcatgatggaaagggttca

SEQ ID NO: 6907425 - DNA, 22 bp, Homo sapiens
cattatgcaaagaacacttgag

SEQ ID NO: 6907426 - DNA, 22 bp, Homo sapiens
taacagtagccttatgtggtct

SEQ ID NO: 6907427 - DNA, 22 bp, Homo sapiens
agctgggtgttcttgggcctaa

SEQ ID NO: 6907428 - DNA, 20 bp, Homo sapiens
gcagagtgtgagagggtgaa

SEQ ID NO: 6907429 - DNA, 22 bp, Homo sapiens
gatggaatgaatggcagataca

SEQ ID NO: 6907430 - DNA, 19 bp, Homo sapiens
gaacacttactatatttct

SEQ ID NO: 6907431 - DNA, 22 bp, Homo sapiens
acaaggcactttatgaagagga

SEQ ID NO: 6907432 - DNA, 20 bp, Homo sapiens
tcctccaaccagctgctaat

SEQ ID NO: 6907433 - DNA, 23 bp, Homo sapiens
ttctgaaaatagatagtggctcc

SEQ ID NO: 6907434 - DNA, 22 bp, Homo sapiens
agtgggggccaacgagggcagc

SEQ ID NO: 6907435 - DNA, 19 bp, Homo sapiens
caggagagcatgcactttg

SEQ ID NO: 6907436 - DNA, 22 bp, Homo sapiens
aggtccaaggtagggcccagac

SEQ ID NO: 6907437 - DNA, 22 bp, Homo sapiens
tgcaaaagaatatagatattgt

SEQ ID NO: 6907438 - DNA, 22 bp, Homo sapiens
ttggcttgatgactggcagtgt

SEQ ID NO: 6907439 - DNA, 22 bp, Homo sapiens
agggaagagcttgcaagaaacc

SEQ ID NO: 6907440 - DNA, 22 bp, Homo sapiens
cagagccccccttctgatcaca

SEQ ID NO: 6907441 - DNA, 22 bp, Homo sapiens
catgtctgggtatatgcatatg

SEQ ID NO: 6907442 - DNA, 22 bp, Homo sapiens
aggaaacaggcagcctttgaac

SEQ ID NO: 6907443 - DNA, 22 bp, Homo sapiens
tccctcaggtggttcttgtttc

SEQ ID NO: 6907444 - DNA, 22 bp, Homo sapiens
gcagccactttgcaaccaagag

SEQ ID NO: 6907445 - DNA, 22 bp, Homo sapiens
ttaggatatgaaacagtataag

SEQ ID NO: 6907446 - DNA, 22 bp, Homo sapiens
agaccttagtagcttttaatgg

SEQ ID NO: 6907447 - DNA, 15 bp, Homo sapiens
aggcactgtgggacc

SEQ ID NO: 6907448 - DNA, 22 bp, Homo sapiens
agtgctttgtagtttcattgtg

SEQ ID NO: 6907449 - DNA, 22 bp, Homo sapiens
aggtcacacaactgtcagaggc

SEQ ID NO: 6907450 - DNA, 22 bp, Homo sapiens
tgagcccatgtagcacttccat

SEQ ID NO: 6907451 - DNA, 17 bp, Homo sapiens
gaacagcagaggggaca

SEQ ID NO: 6907452 - DNA, 17 bp, Homo sapiens
ggactgggcggggcagg

SEQ ID NO: 6907453 - DNA, 22 bp, Homo sapiens
aagtttggtttcagaggtcagt

SEQ ID NO: 6907454 - DNA, 22 bp, Homo sapiens
cagttggtcttcccttggagca

SEQ ID NO: 6907455 - DNA, 22 bp, Homo sapiens
aggctgtgcacagggcacctgc

SEQ ID NO: 6907456 - DNA, 22 bp, Homo sapiens
tcaaatgcttctactcctaaga

SEQ ID NO: 6907457 - DNA, 22 bp, Homo sapiens
atacaactttatctgtaatgag

SEQ ID NO: 6907458 - DNA, 22 bp, Homo sapiens
gtactttaagactccagtagca

SEQ ID NO: 6907459 - DNA, 22 bp, Homo sapiens
acactgaagagcactttcaaag

SEQ ID NO: 6907460 - DNA, 22 bp, Homo sapiens
acaataggtgtccaattaacaa

SEQ ID NO: 6907461 - DNA, 22 bp, Homo sapiens
tcctgtgttgatagagatggtt

SEQ ID NO: 6907462 - DNA, 22 bp, Homo sapiens
ctggaagagtaatataaattag

SEQ ID NO: 6907463 - DNA, 22 bp, Homo sapiens
tccgataagcaattcttgtgct

SEQ ID NO: 6907464 - DNA, 20 bp, Homo sapiens
agcaaactcttcccatcttc

SEQ ID NO: 6907465 - DNA, 22 bp, Homo sapiens
agatcggctttgcagacctcat

SEQ ID NO: 6907466 - DNA, 22 bp, Homo sapiens
agcaatatttcagctagcaggt

SEQ ID NO: 6907467 - DNA, 22 bp, Homo sapiens
ctgagaaaagctttcttataca

SEQ ID NO: 6907468 - DNA, 22 bp, Homo sapiens
agccaagagttctttagcggtg

SEQ ID NO: 6907469 - DNA, 23 bp, Homo sapiens
tatcagtgtgatgaggctgctgc

SEQ ID NO: 6907470 - DNA, 22 bp, Homo sapiens
tcagtggttaagttctgtccac

SEQ ID NO: 6907471 - DNA, 22 bp, Homo sapiens
atctcaaagcatggagcagaat

SEQ ID NO: 6907472 - DNA, 22 bp, Homo sapiens
ctgcactgagcatctaacctta

SEQ ID NO: 6907473 - DNA, 22 bp, Homo sapiens
agtgttctagcgctgtgcttgt

SEQ ID NO: 6907474 - DNA, 22 bp, Homo sapiens
ttctatgtagataaggctgctc

SEQ ID NO: 6907475 - DNA, 22 bp, Homo sapiens
gatccgaatcattgctctttta

SEQ ID NO: 6907476 - DNA, 22 bp, Homo sapiens
tgcatctaagtggctaacaacc

SEQ ID NO: 6907477 - DNA, 22 bp, Homo sapiens
ttaacagtaaagaattgtgcaa

SEQ ID NO: 6907478 - DNA, 22 bp, Homo sapiens
gggctgtggagccgcgagggct

SEQ ID NO: 6907479 - DNA, 22 bp, Homo sapiens
ctcctgctcctgcttgcaagga

SEQ ID NO: 6907480 - DNA, 22 bp, Homo sapiens
catgctcacaaaagatggcaaa

SEQ ID NO: 6907481 - DNA, 22 bp, Homo sapiens
aactatgagagcccagcgaagg

SEQ ID NO: 6907482 - DNA, 22 bp, Homo sapiens
cacaggcctgtctctttctaac

SEQ ID NO: 6907483 - DNA, 22 bp, Homo sapiens
ccagagagaaaatggagggcca

SEQ ID NO: 6907484 - DNA, 22 bp, Homo sapiens
cagtttaagacaagggggtgta

SEQ ID NO: 6907485 - DNA, 22 bp, Homo sapiens
agcgtggactgctgggcaaggt

SEQ ID NO: 6907486 - DNA, 22 bp, Homo sapiens
ttgctatactcattagttattt

SEQ ID NO: 6907487 - DNA, 22 bp, Homo sapiens
tggctccaaatcaactgctgtt

SEQ ID NO: 6907488 - DNA, 22 bp, Homo sapiens
cggcacagccgggcaaggctgg

SEQ ID NO: 6907489 - DNA, 22 bp, Homo sapiens
tttatcacagaataagaagtca

SEQ ID NO: 6907490 - DNA, 22 bp, Homo sapiens
ctttatgttcagtacaatgctt

SEQ ID NO: 6907491 - DNA, 22 bp, Homo sapiens
gtggcagtagacagtgcatcta

SEQ ID NO: 6907492 - DNA, 20 bp, Homo sapiens
ttacaagccttgttaaatct

SEQ ID NO: 6907493 - DNA, 22 bp, Homo sapiens
gaggctcactgggcaaagactc

SEQ ID NO: 6907494 - DNA, 22 bp, Homo sapiens
tcttggccccacctgtgccagc

SEQ ID NO: 6907495 - DNA, 22 bp, Homo sapiens
ccgtggtttggcataggaagaa

SEQ ID NO: 6907496 - DNA, 22 bp, Homo sapiens
tcccaggatgaagacagtgttg

SEQ ID NO: 6907497 - DNA, 22 bp, Homo sapiens
gccaaataagtggaatcacaca

SEQ ID NO: 6907498 - DNA, 22 bp, Homo sapiens
gggagctggagttgtgttgcct

SEQ ID NO: 6907499 - DNA, 22 bp, Homo sapiens
ctggctgcgtctgctctgacag

SEQ ID NO: 6907500 - DNA, 22 bp, Homo sapiens
gcactgggggcagcagtgaggg

SEQ ID NO: 6907501 - DNA, 22 bp, Homo sapiens
gcaggagaacaaagcaagctgc

SEQ ID NO: 6907502 - DNA, 22 bp, Homo sapiens
ggcctggcatggggactaaggg

SEQ ID NO: 6907503 - DNA, 22 bp, Homo sapiens
tgagtgaggctgggcagtccct

SEQ ID NO: 6907504 - DNA, 20 bp, Homo sapiens
agccaggctcaagctccccc

SEQ ID NO: 6907505 - DNA, 22 bp, Homo sapiens
tggcagatgcgttttcattttc

SEQ ID NO: 6907506 - DNA, 22 bp, Homo sapiens
tcacaaatgtttgcatgtgtct

SEQ ID NO: 6907507 - DNA, 22 bp, Homo sapiens
gagattggcctggcttgccaac

SEQ ID NO: 6907508 - DNA, 22 bp, Homo sapiens
atttattgagcctttcctatgt

SEQ ID NO: 6907509 - DNA, 19 bp, Homo sapiens
caatatatagtgagtggat

SEQ ID NO: 6907510 - DNA, 22 bp, Homo sapiens
gaggaaccaccttgggtaggct

SEQ ID NO: 6907511 - DNA, 22 bp, Homo sapiens
tttgggaaatattgtgttcaag

SEQ ID NO: 6907512 - DNA, 22 bp, Homo sapiens
agtccaagatcaaggtgtcaac

SEQ ID NO: 6907513 - DNA, 22 bp, Homo sapiens
tcttttcacaaaggagctggag

SEQ ID NO: 6907514 - DNA, 22 bp, Homo sapiens
gtggccgccaggtcctcgtcca

SEQ ID NO: 6907515 - DNA, 22 bp, Homo sapiens
tggaggcattgtgactgctgaa

SEQ ID NO: 6907516 - DNA, 22 bp, Homo sapiens
caggcctcagggctgtccgtag

SEQ ID NO: 6907517 - DNA, 23 bp, Homo sapiens
agcccaccttgttagtcctgtgg

SEQ ID NO: 6907518 - DNA, 22 bp, Homo sapiens
tgctatataatggaatttctaa

SEQ ID NO: 6907519 - DNA, 22 bp, Homo sapiens
cttggtgagactcccacccacc

SEQ ID NO: 6907520 - DNA, 22 bp, Homo sapiens
aggtccctcagaggcctcaccg

SEQ ID NO: 6907521 - DNA, 22 bp, Homo sapiens
agctgcttattcattgatcgat

SEQ ID NO: 6907522 - DNA, 22 bp, Homo sapiens
gttaacaaatgtaaagcaatta

SEQ ID NO: 6907523 - DNA, 22 bp, Homo sapiens
ccagcagcatcctgcagcactt

SEQ ID NO: 6907524 - DNA, 22 bp, Homo sapiens
actggcttgtgagacaatgcct

SEQ ID NO: 6907525 - DNA, 22 bp, Homo sapiens
tcacccagaaaagacagcagat

SEQ ID NO: 6907526 - DNA, 22 bp, Homo sapiens
tcttaaaagtatgccaattgga

SEQ ID NO: 6907527 - DNA, 22 bp, Homo sapiens
agacatccttcaagtgatatgt

SEQ ID NO: 6907528 - DNA, 20 bp, Homo sapiens
caaagcagtaggataaaaat

SEQ ID NO: 6907529 - DNA, 18 bp, Homo sapiens
ggcttctgggacatttta

SEQ ID NO: 6907530 - DNA, 22 bp, Homo sapiens
gtgcattaacaacccagaactc

SEQ ID NO: 6907531 - DNA, 22 bp, Homo sapiens
tgcactttaaaaaatggtgatg

SEQ ID NO: 6907532 - DNA, 22 bp, Homo sapiens
gaatgatttggttgtttagatt

SEQ ID NO: 6907533 - DNA, 22 bp, Homo sapiens
tgtcgggcatgcattctgagaa

SEQ ID NO: 6907534 - DNA, 22 bp, Homo sapiens
tatggacatctgaagttgcaga

SEQ ID NO: 6907535 - DNA, 22 bp, Homo sapiens
gtttccagcttgggcccgggga

SEQ ID NO: 6907536 - DNA, 22 bp, Homo sapiens
ccagccataatacgaacccagc

SEQ ID NO: 6907537 - DNA, 22 bp, Homo sapiens
tgtcttttgccaaagatcagtt

SEQ ID NO: 6907538 - DNA, 22 bp, Homo sapiens
aagagttatacctatttctaac

SEQ ID NO: 6907539 - DNA, 20 bp, Homo sapiens
gtgctgagggctgggcaatg

SEQ ID NO: 6907540 - DNA, 19 bp, Homo sapiens
tctgtggccttccctgatg

SEQ ID NO: 6907541 - DNA, 20 bp, Homo sapiens
tcacttcttccttttgtcta

SEQ ID NO: 6907542 - DNA, 22 bp, Homo sapiens
tgagcttcaaagttggatctga

SEQ ID NO: 6907543 - DNA, 22 bp, Homo sapiens
tggaggtctctgtctgggcagg

SEQ ID NO: 6907544 - DNA, 22 bp, Homo sapiens
tccctctctggctggggtgcgg

SEQ ID NO: 6907545 - DNA, 22 bp, Homo sapiens
gggctctgagctctgggaatta

SEQ ID NO: 6907546 - DNA, 22 bp, Homo sapiens
cctgaggaggtgaagtctccat

SEQ ID NO: 6907547 - DNA, 22 bp, Homo sapiens
cttctgattagcaagtttgtat

SEQ ID NO: 6907548 - DNA, 22 bp, Homo sapiens
agatgggttgagaacacatgct

SEQ ID NO: 6907549 - DNA, 22 bp, Homo sapiens
tctaaagctccttccactaaaa

SEQ ID NO: 6907550 - DNA, 22 bp, Homo sapiens
agtcttcttttattacttgggg

SEQ ID NO: 6907551 - DNA, 22 bp, Homo sapiens
gagtttaatcattgttctatcc

SEQ ID NO: 6907552 - DNA, 22 bp, Homo sapiens
tccaagaagtttcgttaaatgt

SEQ ID NO: 6907553 - DNA, 21 bp, Homo sapiens
gttgtccagctggtttgggcc

SEQ ID NO: 6907554 - DNA, 22 bp, Homo sapiens
tcccagcctgacagtgcatcaa

SEQ ID NO: 6907555 - DNA, 22 bp, Homo sapiens
tctgaagatatgagctttatga

SEQ ID NO: 6907556 - DNA, 22 bp, Homo sapiens
ttaagagcaacatatggtgaca

SEQ ID NO: 6907557 - DNA, 22 bp, Homo sapiens
cctaggcttgttttcatcagct

SEQ ID NO: 6907558 - DNA, 22 bp, Homo sapiens
tatttgttgagttgttatgtct

SEQ ID NO: 6907559 - DNA, 22 bp, Homo sapiens
aaggaaatacttctgcagagca

SEQ ID NO: 6907560 - DNA, 22 bp, Homo sapiens
aaatctctgaacttaataatgc

SEQ ID NO: 6907561 - DNA, 22 bp, Homo sapiens
ggaataggatttacctctgtaa

SEQ ID NO: 6907562 - DNA, 22 bp, Homo sapiens
ggaatgtgctgacacgcgagag

SEQ ID NO: 6907563 - DNA, 23 bp, Homo sapiens
ggggcctgcaccggtctgcgcgg

SEQ ID NO: 6907564 - DNA, 22 bp, Homo sapiens
acaaatttgtgtagttatggca

SEQ ID NO: 6907565 - DNA, 19 bp, Homo sapiens
agcagccatagacaatatg

SEQ ID NO: 6907566 - DNA, 22 bp, Homo sapiens
ggcctcctcaccctgctcaggc

SEQ ID NO: 6907567 - DNA, 22 bp, Homo sapiens
ccagagacaaggagctggagtc

SEQ ID NO: 6907568 - DNA, 22 bp, Homo sapiens
cctggagacgaggctggaccat

SEQ ID NO: 6907569 - DNA, 22 bp, Homo sapiens
ccacccttccattcttcctctt

SEQ ID NO: 6907570 - DNA, 22 bp, Homo sapiens
tctgagggttggctggctgtag

SEQ ID NO: 6907571 - DNA, 22 bp, Homo sapiens
ctgacctgagtggtacaaggca

SEQ ID NO: 6907572 - DNA, 19 bp, Homo sapiens
atgagtacacttgtacatt

SEQ ID NO: 6907573 - DNA, 22 bp, Homo sapiens
tctgatgtatcctaagaatcta

SEQ ID NO: 6907574 - DNA, 22 bp, Homo sapiens
atcattagttgtggaattcttg

SEQ ID NO: 6907575 - DNA, 22 bp, Homo sapiens
tgggggctgtgcacaggctcac

SEQ ID NO: 6907576 - DNA, 22 bp, Homo sapiens
attgatcatgcagatgcttcac

SEQ ID NO: 6907577 - DNA, 22 bp, Homo sapiens
atggcagtatttgtatcacaga

SEQ ID NO: 6907578 - DNA, 22 bp, Homo sapiens
gttctaatttggggctccttag

SEQ ID NO: 6907579 - DNA, 22 bp, Homo sapiens
tctgccattgatgagctggcat

SEQ ID NO: 6907580 - DNA, 22 bp, Homo sapiens
ttgtacataatgaaaggaggct

SEQ ID NO: 6907581 - DNA, 22 bp, Homo sapiens
agtacactatggtaactggagt

SEQ ID NO: 6907582 - DNA, 23 bp, Homo sapiens
aaagactgctgagaattttagga

SEQ ID NO: 6907583 - DNA, 22 bp, Homo sapiens
gagttacatttggtgacacttc

SEQ ID NO: 6907584 - DNA, 22 bp, Homo sapiens
cacatctactgaatgagcagtg

SEQ ID NO: 6907585 - DNA, 22 bp, Homo sapiens
tgctttgcactgactccttcct

SEQ ID NO: 6907586 - DNA, 22 bp, Homo sapiens
agcagtgtttaggcattcagta

SEQ ID NO: 6907587 - DNA, 22 bp, Homo sapiens
tcagtgtccataaataaagttt

SEQ ID NO: 6907588 - DNA, 22 bp, Homo sapiens
agacagccaatgctggaagatg

SEQ ID NO: 6907589 - DNA, 22 bp, Homo sapiens
tgctaggcagtgcttccctgac

SEQ ID NO: 6907590 - DNA, 21 bp, Homo sapiens
ctggctctgttgtcacccggc

SEQ ID NO: 6907591 - DNA, 22 bp, Homo sapiens
tggtaccaggggttatttctgc

SEQ ID NO: 6907592 - DNA, 22 bp, Homo sapiens
ctttctctgtgtttcacatgct

SEQ ID NO: 6907593 - DNA, 22 bp, Homo sapiens
gccctgagcacacagtagcaaa

SEQ ID NO: 6907594 - DNA, 22 bp, Homo sapiens
aaaggctttaaaatgtacatat

SEQ ID NO: 6907595 - DNA, 22 bp, Homo sapiens
aacctgtaaatccaaacaatct

SEQ ID NO: 6907596 - DNA, 22 bp, Homo sapiens
tagtgattccaatgtgaagtgg

SEQ ID NO: 6907597 - DNA, 22 bp, Homo sapiens
ctgtgtgcctcctgtgatcagg

SEQ ID NO: 6907598 - DNA, 22 bp, Homo sapiens
gcagggccttggtcatcttttt

SEQ ID NO: 6907599 - DNA, 18 bp, Homo sapiens
cggcttctgtcaccttgc

SEQ ID NO: 6907600 - DNA, 22 bp, Homo sapiens
agtcccatttgtgaccttggga

SEQ ID NO: 6907601 - DNA, 22 bp, Homo sapiens
tcatctgtttctctgtagttct

SEQ ID NO: 6907602 - DNA, 22 bp, Homo sapiens
caagtcctaggtctgattgaac

SEQ ID NO: 6907603 - DNA, 22 bp, Homo sapiens
aggctctcaatatgatccagtc

SEQ ID NO: 6907604 - DNA, 22 bp, Homo sapiens
actcttatagtattggttatta

SEQ ID NO: 6907605 - DNA, 22 bp, Homo sapiens
tgtgaaatgtgtgtataattaa

SEQ ID NO: 6907606 - DNA, 22 bp, Homo sapiens
cccaggctggagtgcaatggtg

SEQ ID NO: 6907607 - DNA, 22 bp, Homo sapiens
aagtatgtcaatcatacttcaa

SEQ ID NO: 6907608 - DNA, 22 bp, Homo sapiens
gctggcagccaagtgaagaggg

SEQ ID NO: 6907609 - DNA, 22 bp, Homo sapiens
cacatttctctacctcacacaa

SEQ ID NO: 6907610 - DNA, 22 bp, Homo sapiens
ttattcaggaaggtgttactta

SEQ ID NO: 6907611 - DNA, 23 bp, Homo sapiens
atgtctctgggcagtagggcttg

SEQ ID NO: 6907612 - DNA, 22 bp, Homo sapiens
aagaagaagtgttatttttaga

SEQ ID NO: 6907613 - DNA, 22 bp, Homo sapiens
tgccaggaggaggtgggacaga

SEQ ID NO: 6907614 - DNA, 22 bp, Homo sapiens
gtgtaattagtagtaaattcaa

SEQ ID NO: 6907615 - DNA, 22 bp, Homo sapiens
gtttgttttaagataggatgga

SEQ ID NO: 6907616 - DNA, 22 bp, Homo sapiens
tttagacatggcttgctcactt

SEQ ID NO: 6907617 - DNA, 22 bp, Homo sapiens
cctgctggcattcttgctccct

SEQ ID NO: 6907618 - DNA, 21 bp, Homo sapiens
ggtggggtacctaaggtagct

SEQ ID NO: 6907619 - DNA, 22 bp, Homo sapiens
agtgcaggagcctggccagagc

SEQ ID NO: 6907620 - DNA, 18 bp, Homo sapiens
ggccagagggagggtccc

SEQ ID NO: 6907621 - DNA, 22 bp, Homo sapiens
tggataaaacgttctgaaaaac

SEQ ID NO: 6907622 - DNA, 19 bp, Homo sapiens
aggttacaggtgtcacaga

SEQ ID NO: 6907623 - DNA, 22 bp, Homo sapiens
atcttctgggcagtgaaaattg

SEQ ID NO: 6907624 - DNA, 22 bp, Homo sapiens
gtgttactaaaatttgattctt

SEQ ID NO: 6907625 - DNA, 22 bp, Homo sapiens
atttggttactcagttgtctga

SEQ ID NO: 6907626 - DNA, 22 bp, Homo sapiens
agcaggttgttttcttcaatat

SEQ ID NO: 6907627 - DNA, 22 bp, Homo sapiens
tggcttcttgtctaatttgtta

SEQ ID NO: 6907628 - DNA, 22 bp, Homo sapiens
ctggcactgtgtctgcggaggg

SEQ ID NO: 6907629 - DNA, 22 bp, Homo sapiens
gccctgctctgttggtcacctg

SEQ ID NO: 6907630 - DNA, 22 bp, Homo sapiens
caggaaccattttctctttata

SEQ ID NO: 6907631 - DNA, 22 bp, Homo sapiens
tcagaatggcccataaatagtc

SEQ ID NO: 6907632 - DNA, 22 bp, Homo sapiens
caggaacaaggcctatgggact

SEQ ID NO: 6907633 - DNA, 22 bp, Homo sapiens
ggtggcatggcagttgatgtaa

SEQ ID NO: 6907634 - DNA, 22 bp, Homo sapiens
catgaatttttctgtgggttaa

SEQ ID NO: 6907635 - DNA, 22 bp, Homo sapiens
gcatacattgcaccctggtagt

SEQ ID NO: 6907636 - DNA, 23 bp, Homo sapiens
agcatggaagaagctggactcct

SEQ ID NO: 6907637 - DNA, 22 bp, Homo sapiens
actggtactcagctggcactca

SEQ ID NO: 6907638 - DNA, 19 bp, Homo sapiens
agagaaggatcctatggtt

SEQ ID NO: 6907639 - DNA, 22 bp, Homo sapiens
ttttgaaagggtgatttggctt

SEQ ID NO: 6907640 - DNA, 22 bp, Homo sapiens
ctctgtggttagactatggctg

SEQ ID NO: 6907641 - DNA, 23 bp, Homo sapiens
aaatgactaaatgttcttataga

SEQ ID NO: 6907642 - DNA, 22 bp, Homo sapiens
atgacactctgcagggtgaatg

SEQ ID NO: 6907643 - DNA, 22 bp, Homo sapiens
taagaacataaattcatacggg

SEQ ID NO: 6907644 - DNA, 22 bp, Homo sapiens
actactgatgtaaaggagcaat

SEQ ID NO: 6907645 - DNA, 22 bp, Homo sapiens
cactgaaaggaaaccagagcat

SEQ ID NO: 6907646 - DNA, 22 bp, Homo sapiens
actttcaattcccttagcaact

SEQ ID NO: 6907647 - DNA, 22 bp, Homo sapiens
aatctggcatttgagagtagga

SEQ ID NO: 6907648 - DNA, 22 bp, Homo sapiens
aaaaagtttcaactgccaactc

SEQ ID NO: 6907649 - DNA, 22 bp, Homo sapiens
gtcctgtgatgagtaccaggtg

SEQ ID NO: 6907650 - DNA, 22 bp, Homo sapiens
ctggtttttagtgcttaggagt

SEQ ID NO: 6907651 - DNA, 22 bp, Homo sapiens
gcagtgttatgttttctataat

SEQ ID NO: 6907652 - DNA, 22 bp, Homo sapiens
cttagatgaagtcacagaaccc

SEQ ID NO: 6907653 - DNA, 20 bp, Homo sapiens
agtgatttatctttttccac

SEQ ID NO: 6907654 - DNA, 18 bp, Homo sapiens
tggtttctggaggaataa

SEQ ID NO: 6907655 - DNA, 22 bp, Homo sapiens
gcctctggcttctgcatcagtg

SEQ ID NO: 6907656 - DNA, 22 bp, Homo sapiens
gaggagaggctggacgcggtga

SEQ ID NO: 6907657 - DNA, 16 bp, Homo sapiens
cctggaggtcacttca

SEQ ID NO: 6907658 - DNA, 22 bp, Homo sapiens
gagggatgtcaggggaccttgg

SEQ ID NO: 6907659 - DNA, 22 bp, Homo sapiens
ttggtctgcagggagggctgga

SEQ ID NO: 6907660 - DNA, 22 bp, Homo sapiens
ctgtgctacaacctgacgtgtg

SEQ ID NO: 6907661 - DNA, 18 bp, Homo sapiens
actgttccttcagaggac

SEQ ID NO: 6907662 - DNA, 22 bp, Homo sapiens
tggcatgtatttgtggtgaatt

SEQ ID NO: 6907663 - DNA, 23 bp, Homo sapiens
ttctggaagatttacttgagaca

SEQ ID NO: 6907664 - DNA, 22 bp, Homo sapiens
tggtcctcaggttctctgtgcg

SEQ ID NO: 6907665 - DNA, 22 bp, Homo sapiens
gggctgcaatgcttcagttgtt

SEQ ID NO: 6907666 - DNA, 22 bp, Homo sapiens
gtctgtagaataaatatgagta

SEQ ID NO: 6907667 - DNA, 17 bp, Homo sapiens
tttcagattcactttct

SEQ ID NO: 6907668 - DNA, 22 bp, Homo sapiens
ggttatcatagttgttatcagg

SEQ ID NO: 6907669 - DNA, 20 bp, Homo sapiens
taacagttgaagaacaagga

SEQ ID NO: 6907670 - DNA, 22 bp, Homo sapiens
gatcatgctcacttaatagatt

SEQ ID NO: 6907671 - DNA, 18 bp, Homo sapiens
gctctgcccaggctgccc

SEQ ID NO: 6907672 - DNA, 22 bp, Homo sapiens
acaatatctcagacagaaagac

SEQ ID NO: 6907673 - DNA, 20 bp, Homo sapiens
cccaggtaggtgccatgagt

SEQ ID NO: 6907674 - DNA, 18 bp, Homo sapiens
tccatggcttaacctcag

SEQ ID NO: 6907675 - DNA, 22 bp, Homo sapiens
aatactgaaagtattttcaaat

SEQ ID NO: 6907676 - DNA, 22 bp, Homo sapiens
ggctccagtttccccttggggc

SEQ ID NO: 6907677 - DNA, 22 bp, Homo sapiens
agagtaacttttaactttacgt

SEQ ID NO: 6907678 - DNA, 22 bp, Homo sapiens
agcttcctgactggtgctctta

SEQ ID NO: 6907679 - DNA, 22 bp, Homo sapiens
gcctctgtaggagtgagagcat

SEQ ID NO: 6907680 - DNA, 22 bp, Homo sapiens
tccatagtagaaaatgggacag

SEQ ID NO: 6907681 - DNA, 22 bp, Homo sapiens
tgtggaatttctttcaggtatg

SEQ ID NO: 6907682 - DNA, 17 bp, Homo sapiens
ggttgagtaatctgagg

SEQ ID NO: 6907683 - DNA, 22 bp, Homo sapiens
tgtgtctcaagtcagagcatca

SEQ ID NO: 6907684 - DNA, 22 bp, Homo sapiens
gctgcctgcttcatgtgggaga

SEQ ID NO: 6907685 - DNA, 22 bp, Homo sapiens
tgtgtgcaagtgacattagaaa

SEQ ID NO: 6907686 - DNA, 22 bp, Homo sapiens
atgcatactgtatgtgtattta

SEQ ID NO: 6907687 - DNA, 22 bp, Homo sapiens
cttgaaagaagggtcttttaat

SEQ ID NO: 6907688 - DNA, 22 bp, Homo sapiens
ggtctgagatatttgttcagct

SEQ ID NO: 6907689 - DNA, 22 bp, Homo sapiens
cgggttcttaaacgactgggct

SEQ ID NO: 6907690 - DNA, 22 bp, Homo sapiens
tggcatttagagaaatgaagga

SEQ ID NO: 6907691 - DNA, 22 bp, Homo sapiens
aacaggctggccttgaagcagt

SEQ ID NO: 6907692 - DNA, 22 bp, Homo sapiens
gccatcatcaagaatgtacagc

SEQ ID NO: 6907693 - DNA, 22 bp, Homo sapiens
gccaggctccccggatccctgg

SEQ ID NO: 6907694 - DNA, 22 bp, Homo sapiens
aaacatgatcactccggctttt

SEQ ID NO: 6907695 - DNA, 22 bp, Homo sapiens
gctggctctgatgggctccagg

SEQ ID NO: 6907696 - DNA, 22 bp, Homo sapiens
cactctcagcataatgaatgtg

SEQ ID NO: 6907697 - DNA, 22 bp, Homo sapiens
tcagacagaggagctcgtgcag

SEQ ID NO: 6907698 - DNA, 20 bp, Homo sapiens
gctggcagatgtcttgagat

SEQ ID NO: 6907699 - DNA, 22 bp, Homo sapiens
ttcctacagccctgaatctcta

SEQ ID NO: 6907700 - DNA, 22 bp, Homo sapiens
agtggtcccaggtggtcacagc

SEQ ID NO: 6907701 - DNA, 22 bp, Homo sapiens
aggaaagtggtgggaaatcagg

SEQ ID NO: 6907702 - DNA, 22 bp, Homo sapiens
ggacatttcataagaccattct

SEQ ID NO: 6907703 - DNA, 20 bp, Homo sapiens
tccctgccttttactgctgg

SEQ ID NO: 6907704 - DNA, 22 bp, Homo sapiens
gccaggaatcactgctgagtaa

SEQ ID NO: 6907705 - DNA, 22 bp, Homo sapiens
acaggtttagctcttagtagtc

SEQ ID NO: 6907706 - DNA, 22 bp, Homo sapiens
tagggcactatttgtgactgaa

SEQ ID NO: 6907707 - DNA, 22 bp, Homo sapiens
tgagcctgtcctgtgcatgtga

SEQ ID NO: 6907708 - DNA, 22 bp, Homo sapiens
actgagaaatttccagacttgc

SEQ ID NO: 6907709 - DNA, 22 bp, Homo sapiens
tgcatttaatagatgctccctg

SEQ ID NO: 6907710 - DNA, 17 bp, Homo sapiens
ggagctccagctactgc

SEQ ID NO: 6907711 - DNA, 21 bp, Homo sapiens
agctgcaaaaacatacagttc

SEQ ID NO: 6907712 - DNA, 22 bp, Homo sapiens
ttgttgttggagccaatatgca

SEQ ID NO: 6907713 - DNA, 22 bp, Homo sapiens
gcaggtgggggtcggtgcatct

SEQ ID NO: 6907714 - DNA, 22 bp, Homo sapiens
tgcagagtgggagaggtgcggg

SEQ ID NO: 6907715 - DNA, 22 bp, Homo sapiens
tcctttctccttccgacttcat

SEQ ID NO: 6907716 - DNA, 22 bp, Homo sapiens
aggcatggatgtagcagtgacc

SEQ ID NO: 6907717 - DNA, 22 bp, Homo sapiens
cctgggcttctgtctagatgtt

SEQ ID NO: 6907718 - DNA, 22 bp, Homo sapiens
gcttttgtcattcaaatgctct

SEQ ID NO: 6907719 - DNA, 22 bp, Homo sapiens
ggaacactcagtaattcagata

SEQ ID NO: 6907720 - DNA, 22 bp, Homo sapiens
gggagctgagctctgagccacg

SEQ ID NO: 6907721 - DNA, 22 bp, Homo sapiens
gggattaaacaccacttgaagg

SEQ ID NO: 6907722 - DNA, 22 bp, Homo sapiens
ccggaatgattcaggatccacg

SEQ ID NO: 6907723 - DNA, 22 bp, Homo sapiens
agttttatatcttccattggtt

SEQ ID NO: 6907724 - DNA, 22 bp, Homo sapiens
gtggatctggctctgtctggtc

SEQ ID NO: 6907725 - DNA, 22 bp, Homo sapiens
gttctgtcacacactggtactt

SEQ ID NO: 6907726 - DNA, 22 bp, Homo sapiens
atatacagggagaaacagctta

SEQ ID NO: 6907727 - DNA, 22 bp, Homo sapiens
aggcctctggaggtggcagtgt

SEQ ID NO: 6907728 - DNA, 22 bp, Homo sapiens
cagatgaagtaggtgacgagca

SEQ ID NO: 6907729 - DNA, 22 bp, Homo sapiens
tacagaatgatgtgtttaaata

SEQ ID NO: 6907730 - DNA, 22 bp, Homo sapiens
acttggagagataatcccatat

SEQ ID NO: 6907731 - DNA, 22 bp, Homo sapiens
cctgcctgcctgctggccggga

SEQ ID NO: 6907732 - DNA, 22 bp, Homo sapiens
tctgtagagacgaatgtgttat

SEQ ID NO: 6907733 - DNA, 22 bp, Homo sapiens
aagctcagagtctcggagggaa

SEQ ID NO: 6907734 - DNA, 22 bp, Homo sapiens
tgcctggaaggcccatgggaag

SEQ ID NO: 6907735 - DNA, 22 bp, Homo sapiens
ggagtctgatactgagttcctc

SEQ ID NO: 6907736 - DNA, 22 bp, Homo sapiens
ccctctggtttgcccttgggtg

SEQ ID NO: 6907737 - DNA, 22 bp, Homo sapiens
tgtgcaataatcatagtgattt

SEQ ID NO: 6907738 - DNA, 22 bp, Homo sapiens
attaagtgtattgctgagggta

SEQ ID NO: 6907739 - DNA, 22 bp, Homo sapiens
aagtctgtttgagtgtcacact

SEQ ID NO: 6907740 - DNA, 21 bp, Homo sapiens
gcagagctggaaccaggaccc

SEQ ID NO: 6907741 - DNA, 22 bp, Homo sapiens
tcactccaaaccccaggcttgt

SEQ ID NO: 6907742 - DNA, 21 bp, Homo sapiens
tgcatgctatgtttttatttc

SEQ ID NO: 6907743 - DNA, 22 bp, Homo sapiens
gggtaatgggggcttatgcctc

SEQ ID NO: 6907744 - DNA, 17 bp, Homo sapiens
gcccaggaaggacggcc

SEQ ID NO: 6907745 - DNA, 22 bp, Homo sapiens
aagcagctgatttcacagctca

SEQ ID NO: 6907746 - DNA, 22 bp, Homo sapiens
agctagcagttttgtggtttgg

SEQ ID NO: 6907747 - DNA, 22 bp, Homo sapiens
cttggctccaatcccagctctg

SEQ ID NO: 6907748 - DNA, 22 bp, Homo sapiens
ctcaggacagattccagagaaa

SEQ ID NO: 6907749 - DNA, 22 bp, Homo sapiens
ggaactgagcaatggcatgaaa

SEQ ID NO: 6907750 - DNA, 22 bp, Homo sapiens
tgctggcagaaggctcgtggaa

SEQ ID NO: 6907751 - DNA, 22 bp, Homo sapiens
agagactgtcacataacagagg

SEQ ID NO: 6907752 - DNA, 22 bp, Homo sapiens
aggctgcctctgcaggatccct

SEQ ID NO: 6907753 - DNA, 22 bp, Homo sapiens
gccaggtgagtgcgcgccgtcc

SEQ ID NO: 6907754 - DNA, 22 bp, Homo sapiens
aagtcagcactccaggaagcca

SEQ ID NO: 6907755 - DNA, 22 bp, Homo sapiens
tggtatgcttattatcttcaac

SEQ ID NO: 6907756 - DNA, 22 bp, Homo sapiens
ggccactatttattaacaggat

SEQ ID NO: 6907757 - DNA, 20 bp, Homo sapiens
agagtaactggcacataggg

SEQ ID NO: 6907758 - DNA, 23 bp, Homo sapiens
ttatggagtgccagacatttggc

SEQ ID NO: 6907759 - DNA, 21 bp, Homo sapiens
tttcctgccctttgtcatcac

SEQ ID NO: 6907760 - DNA, 22 bp, Homo sapiens
acctcctggcttatcatggaca

SEQ ID NO: 6907761 - DNA, 22 bp, Homo sapiens
ctggtgaagcccctcatgctgg

SEQ ID NO: 6907762 - DNA, 22 bp, Homo sapiens
acggtgccggtggtgatgagcc

SEQ ID NO: 6907763 - DNA, 22 bp, Homo sapiens
agggccagccgacttccagcct

SEQ ID NO: 6907764 - DNA, 22 bp, Homo sapiens
gagctcaggagcatcagaagaa

SEQ ID NO: 6907765 - DNA, 22 bp, Homo sapiens
tgctcagtagcagtgtgctgct

SEQ ID NO: 6907766 - DNA, 22 bp, Homo sapiens
taagatagaactctgaggctac

SEQ ID NO: 6907767 - DNA, 23 bp, Homo sapiens
tgggagacttttcattttgttct

SEQ ID NO: 6907768 - DNA, 22 bp, Homo sapiens
tactttcagtttcagctgaagt

SEQ ID NO: 6907769 - DNA, 22 bp, Homo sapiens
taggtaggtgcaattaaaagta

SEQ ID NO: 6907770 - DNA, 22 bp, Homo sapiens
atccttcagtggaagacagtag

SEQ ID NO: 6907771 - DNA, 23 bp, Homo sapiens
tggcttcaactctgtcggcagcc

SEQ ID NO: 6907772 - DNA, 22 bp, Homo sapiens
gagggcgttcagtcagtgtctc

SEQ ID NO: 6907773 - DNA, 22 bp, Homo sapiens
gcccagcccagaaaggttcgga

SEQ ID NO: 6907774 - DNA, 22 bp, Homo sapiens
agagtttgaagttatctttgac

SEQ ID NO: 6907775 - DNA, 22 bp, Homo sapiens
aatttcactggaaaagataatt

SEQ ID NO: 6907776 - DNA, 22 bp, Homo sapiens
aattatacattgaacaatctag

SEQ ID NO: 6907777 - DNA, 22 bp, Homo sapiens
aagatttttttccacagactca

SEQ ID NO: 6907778 - DNA, 22 bp, Homo sapiens
ccacagctgacaatggatagac

SEQ ID NO: 6907779 - DNA, 22 bp, Homo sapiens
ttacacaaaaataagatatggc

SEQ ID NO: 6907780 - DNA, 22 bp, Homo sapiens
tgcgcgggtgcctatctgtata

SEQ ID NO: 6907781 - DNA, 22 bp, Homo sapiens
gctaggaatcggacccaggaag

SEQ ID NO: 6907782 - DNA, 22 bp, Homo sapiens
atacatgtgggtctaaacatat

SEQ ID NO: 6907783 - DNA, 22 bp, Homo sapiens
cagctctggctattgaggacca

SEQ ID NO: 6907784 - DNA, 22 bp, Homo sapiens
ctcaacagctctgccatactcc

SEQ ID NO: 6907785 - DNA, 19 bp, Homo sapiens
catggctgctgcttgggag

SEQ ID NO: 6907786 - DNA, 22 bp, Homo sapiens
tgtacagactttgcagtgtgca

SEQ ID NO: 6907787 - DNA, 22 bp, Homo sapiens
ggacggggagctggaaagggga

SEQ ID NO: 6907788 - DNA, 22 bp, Homo sapiens
gctgagagcagtgtggccttaa

SEQ ID NO: 6907789 - DNA, 22 bp, Homo sapiens
ttcacaagaggcccaggggagc

SEQ ID NO: 6907790 - DNA, 22 bp, Homo sapiens
tgtgtctggaccggggaggagc

SEQ ID NO: 6907791 - DNA, 22 bp, Homo sapiens
tgctatgtgactgcttcagatt

SEQ ID NO: 6907792 - DNA, 22 bp, Homo sapiens
attcttggagcagtcaaagaag

SEQ ID NO: 6907793 - DNA, 22 bp, Homo sapiens
cagtctccaaatcagtctgaat

SEQ ID NO: 6907794 - DNA, 22 bp, Homo sapiens
ttcagtttgctacaagcaacat

SEQ ID NO: 6907795 - DNA, 22 bp, Homo sapiens
taaattactcaatgcacataaa

SEQ ID NO: 6907796 - DNA, 22 bp, Homo sapiens
ttgttagtttcagacacttgcc

SEQ ID NO: 6907797 - DNA, 22 bp, Homo sapiens
aaagactgcaaaaacgcacaga

SEQ ID NO: 6907798 - DNA, 22 bp, Homo sapiens
accatgcaggctattttcaaat

SEQ ID NO: 6907799 - DNA, 21 bp, Homo sapiens
gcacaccctccaggcccggcg

SEQ ID NO: 6907800 - DNA, 22 bp, Homo sapiens
ctgtccagtgcagagaacagag

SEQ ID NO: 6907801 - DNA, 22 bp, Homo sapiens
gcaggcagttgcagttttctag

SEQ ID NO: 6907802 - DNA, 22 bp, Homo sapiens
gttgaatgaatcattctatgta

SEQ ID NO: 6907803 - DNA, 22 bp, Homo sapiens
acaaagtgttttctgaaggcct

SEQ ID NO: 6907804 - DNA, 22 bp, Homo sapiens
agcagggcaaagtcaggctaac

SEQ ID NO: 6907805 - DNA, 22 bp, Homo sapiens
caggctatgttttaggagctta

SEQ ID NO: 6907806 - DNA, 22 bp, Homo sapiens
ataccctgttctggagtgaatg

SEQ ID NO: 6907807 - DNA, 22 bp, Homo sapiens
tcctctggggcgtggtcctgga

SEQ ID NO: 6907808 - DNA, 22 bp, Homo sapiens
taaagaataatacccatggagc

SEQ ID NO: 6907809 - DNA, 18 bp, Homo sapiens
agcctgtcccttctcctg

SEQ ID NO: 6907810 - DNA, 22 bp, Homo sapiens
cacagtagccatgtctcaagta

SEQ ID NO: 6907811 - DNA, 20 bp, Homo sapiens
tttagcacattgtacaaaac

SEQ ID NO: 6907812 - DNA, 22 bp, Homo sapiens
ctggcagcgcagcatgaagtcg

SEQ ID NO: 6907813 - DNA, 22 bp, Homo sapiens
caagctgctataggttgctggg

SEQ ID NO: 6907814 - DNA, 22 bp, Homo sapiens
atgcattggtcagggtcttagg

SEQ ID NO: 6907815 - DNA, 22 bp, Homo sapiens
caccaggctggagtgcagaggt

SEQ ID NO: 6907816 - DNA, 23 bp, Homo sapiens
cagagtcagggggccccacctct

SEQ ID NO: 6907817 - DNA, 22 bp, Homo sapiens
ttatgttttatggctatatcat

SEQ ID NO: 6907818 - DNA, 22 bp, Homo sapiens
gggagcgggactgcgcaggctt

SEQ ID NO: 6907819 - DNA, 22 bp, Homo sapiens
gtgcatatgtgtgtatacaaac

SEQ ID NO: 6907820 - DNA, 22 bp, Homo sapiens
gacacagcactgtacaaggaat

SEQ ID NO: 6907821 - DNA, 22 bp, Homo sapiens
attggcataggttaaacagcgg

SEQ ID NO: 6907822 - DNA, 21 bp, Homo sapiens
ggtcagctctatccacgcctt

SEQ ID NO: 6907823 - DNA, 22 bp, Homo sapiens
cattatgccaaagtagaaatat

SEQ ID NO: 6907824 - DNA, 23 bp, Homo sapiens
attcctgaggctccttatgcacc

SEQ ID NO: 6907825 - DNA, 22 bp, Homo sapiens
aaaggcactgatcttatccagt

SEQ ID NO: 6907826 - DNA, 21 bp, Homo sapiens
ttgttacaatgcaagagtatg

SEQ ID NO: 6907827 - DNA, 22 bp, Homo sapiens
ggctttgccctggactgaggca

SEQ ID NO: 6907828 - DNA, 22 bp, Homo sapiens
acggcaggctcagagctggaat

SEQ ID NO: 6907829 - DNA, 22 bp, Homo sapiens
cctccaagtttgactcaggaca

SEQ ID NO: 6907830 - DNA, 22 bp, Homo sapiens
caaatgaagggagctgaagtct

SEQ ID NO: 6907831 - DNA, 22 bp, Homo sapiens
gcatgtgttggtttatgcatgt

SEQ ID NO: 6907832 - DNA, 22 bp, Homo sapiens
gcttggcccattgatcagctgg

SEQ ID NO: 6907833 - DNA, 20 bp, Homo sapiens
taaatgcatgaatgtaaggc

SEQ ID NO: 6907834 - DNA, 16 bp, Homo sapiens
atccagacagcacagg

SEQ ID NO: 6907835 - DNA, 22 bp, Homo sapiens
ttactttatgtgatggattagt

SEQ ID NO: 6907836 - DNA, 21 bp, Homo sapiens
atgtttacactgactactgtg

SEQ ID NO: 6907837 - DNA, 22 bp, Homo sapiens
actgaatttatgtttaaaaaca

SEQ ID NO: 6907838 - DNA, 22 bp, Homo sapiens
aactgaaacgtatttttgagat

SEQ ID NO: 6907839 - DNA, 22 bp, Homo sapiens
ttgtttcatggggatgtttatt

SEQ ID NO: 6907840 - DNA, 22 bp, Homo sapiens
cacttcaaatatggcttcatga

SEQ ID NO: 6907841 - DNA, 22 bp, Homo sapiens
gagtatatgactttcttttgca

SEQ ID NO: 6907842 - DNA, 22 bp, Homo sapiens
tatgtactaactttcattctag

SEQ ID NO: 6907843 - DNA, 22 bp, Homo sapiens
ccctttaaggtctgattttcag

SEQ ID NO: 6907844 - DNA, 22 bp, Homo sapiens
atgggaggatgctcgggtgctc

SEQ ID NO: 6907845 - DNA, 22 bp, Homo sapiens
ggcctctctccttggcttgcag

SEQ ID NO: 6907846 - DNA, 22 bp, Homo sapiens
cctatttgtaggctgggccagt

SEQ ID NO: 6907847 - DNA, 23 bp, Homo sapiens
tgatattcaggatgggtgatggg

SEQ ID NO: 6907848 - DNA, 22 bp, Homo sapiens
ctgcgatggctgtatgtgctca

SEQ ID NO: 6907849 - DNA, 22 bp, Homo sapiens
tctcaggctcttggaacctgtt

SEQ ID NO: 6907850 - DNA, 22 bp, Homo sapiens
tgtatagagttggaagatgact

SEQ ID NO: 6907851 - DNA, 18 bp, Homo sapiens
tgacagaacctggagcct

SEQ ID NO: 6907852 - DNA, 22 bp, Homo sapiens
aagtgagttcagcattcactcg

SEQ ID NO: 6907853 - DNA, 16 bp, Homo sapiens
agaggtttacagcctg

SEQ ID NO: 6907854 - DNA, 22 bp, Homo sapiens
ctacatagatggatgattgtaa

SEQ ID NO: 6907855 - DNA, 22 bp, Homo sapiens
ttcaaaagcggtccaggaagat

SEQ ID NO: 6907856 - DNA, 22 bp, Homo sapiens
gcacagaataacactctgggct

SEQ ID NO: 6907857 - DNA, 22 bp, Homo sapiens
gtgtccagagccgggctgaatg

SEQ ID NO: 6907858 - DNA, 22 bp, Homo sapiens
acacttttagctatgagttaat

SEQ ID NO: 6907859 - DNA, 23 bp, Homo sapiens
tgttgctgcctttctaggatcag

SEQ ID NO: 6907860 - DNA, 22 bp, Homo sapiens
tattgccgtggaaggggccagg

SEQ ID NO: 6907861 - DNA, 22 bp, Homo sapiens
ctgcttcctccctgtaaaggca

SEQ ID NO: 6907862 - DNA, 22 bp, Homo sapiens
tgccagactttcttaccagtgt

SEQ ID NO: 6907863 - DNA, 22 bp, Homo sapiens
taactgtacctagataacgaac

SEQ ID NO: 6907864 - DNA, 22 bp, Homo sapiens
tatacagtatcttttgaaggca

SEQ ID NO: 6907865 - DNA, 22 bp, Homo sapiens
agctggaggggccagcaggtgt

SEQ ID NO: 6907866 - DNA, 22 bp, Homo sapiens
ggctgcctttagaacggatgct

SEQ ID NO: 6907867 - DNA, 22 bp, Homo sapiens
tggcttcattattgtttttcct

SEQ ID NO: 6907868 - DNA, 22 bp, Homo sapiens
tgaaatgagagcacagaataaa

SEQ ID NO: 6907869 - DNA, 22 bp, Homo sapiens
accttcagacatcaactatctc

SEQ ID NO: 6907870 - DNA, 22 bp, Homo sapiens
tctcccaagggcacattcaagg

SEQ ID NO: 6907871 - DNA, 22 bp, Homo sapiens
cccaggatggggctgcagttat

SEQ ID NO: 6907872 - DNA, 22 bp, Homo sapiens
actctcaatgtggttaatccaa

SEQ ID NO: 6907873 - DNA, 22 bp, Homo sapiens
caccctagctgtcatttcagtt

SEQ ID NO: 6907874 - DNA, 22 bp, Homo sapiens
tcacccaggctggagtgtagtg

SEQ ID NO: 6907875 - DNA, 22 bp, Homo sapiens
gccaggagagctccttcaggtt

SEQ ID NO: 6907876 - DNA, 22 bp, Homo sapiens
tgatggtaaacaaagacattta

SEQ ID NO: 6907877 - DNA, 19 bp, Homo sapiens
tccaaagaagttcacattt

SEQ ID NO: 6907878 - DNA, 22 bp, Homo sapiens
tggctcccacaaactcactact

SEQ ID NO: 6907879 - DNA, 20 bp, Homo sapiens
aggtggctcctgctgggggt

SEQ ID NO: 6907880 - DNA, 22 bp, Homo sapiens
agctggcaagttgaaggtggct

SEQ ID NO: 6907881 - DNA, 22 bp, Homo sapiens
acaaaggactgaaactggctgt

SEQ ID NO: 6907882 - DNA, 22 bp, Homo sapiens
catacatactgagtggactgat

SEQ ID NO: 6907883 - DNA, 22 bp, Homo sapiens
ggcagcatccgcccggcaccct

SEQ ID NO: 6907884 - DNA, 22 bp, Homo sapiens
tccaggaggtagtgcttaattt

SEQ ID NO: 6907885 - DNA, 22 bp, Homo sapiens
tcgcagaggcacgagtgcagaa

SEQ ID NO: 6907886 - DNA, 22 bp, Homo sapiens
gtacagtgtgactttggagtga

SEQ ID NO: 6907887 - DNA, 22 bp, Homo sapiens
tgagataattaaatcaaaacct

SEQ ID NO: 6907888 - DNA, 22 bp, Homo sapiens
caagggcagcagcctcaagcgg

SEQ ID NO: 6907889 - DNA, 22 bp, Homo sapiens
gctctttaattcattcatggat

SEQ ID NO: 6907890 - DNA, 22 bp, Homo sapiens
tggcatggaccttggaagaatt

SEQ ID NO: 6907891 - DNA, 22 bp, Homo sapiens
atttagtctgtaacagtacagt

SEQ ID NO: 6907892 - DNA, 22 bp, Homo sapiens
ctgtgtgtcatttgtcaatcct

SEQ ID NO: 6907893 - DNA, 22 bp, Homo sapiens
tgtcttttataactgacatata

SEQ ID NO: 6907894 - DNA, 18 bp, Homo sapiens
tagtttctaatggccttt

SEQ ID NO: 6907895 - DNA, 22 bp, Homo sapiens
gtcagaggaggctgagtaggaa

SEQ ID NO: 6907896 - DNA, 20 bp, Homo sapiens
tcctgcttccaccagagcac

SEQ ID NO: 6907897 - DNA, 22 bp, Homo sapiens
ggagtgactctcggggccacta

SEQ ID NO: 6907898 - DNA, 22 bp, Homo sapiens
cctatgaaacgtaatggaatgt

SEQ ID NO: 6907899 - DNA, 22 bp, Homo sapiens
tcaggtgtttaaggatagtgat

SEQ ID NO: 6907900 - DNA, 22 bp, Homo sapiens
agaaagcacagcgggtccattt

SEQ ID NO: 6907901 - DNA, 22 bp, Homo sapiens
tagtgtcatgaaaagtacacta

SEQ ID NO: 6907902 - DNA, 21 bp, Homo sapiens
acatggatataggactgaatt

SEQ ID NO: 6907903 - DNA, 22 bp, Homo sapiens
agcagctggtaggagtggccac

SEQ ID NO: 6907904 - DNA, 22 bp, Homo sapiens
tgattcagtctcttcaggagaa

SEQ ID NO: 6907905 - DNA, 22 bp, Homo sapiens
gccaaagcccaggagacagcca

SEQ ID NO: 6907906 - DNA, 22 bp, Homo sapiens
atgccattttatactcattcaa

SEQ ID NO: 6907907 - DNA, 22 bp, Homo sapiens
tttctatctagggttagagtga

SEQ ID NO: 6907908 - DNA, 22 bp, Homo sapiens
aagctacacatctgttgggtat

SEQ ID NO: 6907909 - DNA, 22 bp, Homo sapiens
aacccgagggccccaggctcgg

SEQ ID NO: 6907910 - DNA, 20 bp, Homo sapiens
agctcctggtataggtgcct

SEQ ID NO: 6907911 - DNA, 22 bp, Homo sapiens
taaaactgaatacatactgagg

SEQ ID NO: 6907912 - DNA, 22 bp, Homo sapiens
gtgtatgcttagccagagattt

SEQ ID NO: 6907913 - DNA, 22 bp, Homo sapiens
gttcctaagctgtggccctgga

SEQ ID NO: 6907914 - DNA, 22 bp, Homo sapiens
ttgcctagagttgcacatctgg

SEQ ID NO: 6907915 - DNA, 22 bp, Homo sapiens
ccaggacttcgaggctacagtg

SEQ ID NO: 6907916 - DNA, 22 bp, Homo sapiens
ctttgactccatctctctttgt

SEQ ID NO: 6907917 - DNA, 22 bp, Homo sapiens
tctgtttaatgggaatgatact

SEQ ID NO: 6907918 - DNA, 22 bp, Homo sapiens
taggttctccacaggttctcca

SEQ ID NO: 6907919 - DNA, 22 bp, Homo sapiens
aaggaagactcgcaggtctatg

SEQ ID NO: 6907920 - DNA, 22 bp, Homo sapiens
tgctcattaggactgcaaattc

SEQ ID NO: 6907921 - DNA, 22 bp, Homo sapiens
catcatcacctgctatacgatc

SEQ ID NO: 6907922 - DNA, 22 bp, Homo sapiens
ttggatgggcattaggaaagtc

SEQ ID NO: 6907923 - DNA, 22 bp, Homo sapiens
gcctgtgtttttaactctagga

SEQ ID NO: 6907924 - DNA, 22 bp, Homo sapiens
taggaatgagagggtgaggatt

SEQ ID NO: 6907925 - DNA, 22 bp, Homo sapiens
cccaggaggcagatgttgcagt

SEQ ID NO: 6907926 - DNA, 22 bp, Homo sapiens
tgggaactctctgggaggcatc

SEQ ID NO: 6907927 - DNA, 22 bp, Homo sapiens
gccctgttttctgggttccttg

SEQ ID NO: 6907928 - DNA, 22 bp, Homo sapiens
atttgcagagctctgaattttg

SEQ ID NO: 6907929 - DNA, 20 bp, Homo sapiens
atcagacttgcatttcagga

SEQ ID NO: 6907930 - DNA, 22 bp, Homo sapiens
aagcatccggggctccaggtgc

SEQ ID NO: 6907931 - DNA, 22 bp, Homo sapiens
gtgctctcctggctgccctgac

SEQ ID NO: 6907932 - DNA, 22 bp, Homo sapiens
actgtaaaactgctttggaaac

SEQ ID NO: 6907933 - DNA, 22 bp, Homo sapiens
ctttcttggtcctgaagatggc

SEQ ID NO: 6907934 - DNA, 22 bp, Homo sapiens
aaatgcaattgtatgtactcca

SEQ ID NO: 6907935 - DNA, 19 bp, Homo sapiens
aaggctttctgagtgaaaa

SEQ ID NO: 6907936 - DNA, 22 bp, Homo sapiens
gatatacaatccacagttgatt

SEQ ID NO: 6907937 - DNA, 22 bp, Homo sapiens
ggtcactgccctcccttttgca

SEQ ID NO: 6907938 - DNA, 22 bp, Homo sapiens
agaagggtagttgtaagagtga

SEQ ID NO: 6907939 - DNA, 22 bp, Homo sapiens
gagtggtaggcagtgttaggaa

SEQ ID NO: 6907940 - DNA, 22 bp, Homo sapiens
tgggagaagcatggggtgcaga

SEQ ID NO: 6907941 - DNA, 21 bp, Homo sapiens
agacatgtgaactaaaggtga

SEQ ID NO: 6907942 - DNA, 22 bp, Homo sapiens
actaaagaagccaaagttttct

SEQ ID NO: 6907943 - DNA, 18 bp, Homo sapiens
actatgctgaataaatgg

SEQ ID NO: 6907944 - DNA, 22 bp, Homo sapiens
ctgctttaggtggaatgttcta

SEQ ID NO: 6907945 - DNA, 22 bp, Homo sapiens
agctcccagaagccagagtcgg

SEQ ID NO: 6907946 - DNA, 22 bp, Homo sapiens
cctgcctgtctttatcccctgt

SEQ ID NO: 6907947 - DNA, 22 bp, Homo sapiens
aaaagacatatgtgggcattct

SEQ ID NO: 6907948 - DNA, 22 bp, Homo sapiens
cagtttaagtgtgttgaaggta

SEQ ID NO: 6907949 - DNA, 23 bp, Homo sapiens
tggctggcagaaactgaagcatg

SEQ ID NO: 6907950 - DNA, 22 bp, Homo sapiens
aacactttgggcatggccttcc

SEQ ID NO: 6907951 - DNA, 19 bp, Homo sapiens
acaagggcaggcaaggtga

SEQ ID NO: 6907952 - DNA, 18 bp, Homo sapiens
aggtgtgtttctaggagc

SEQ ID NO: 6907953 - DNA, 22 bp, Homo sapiens
aaatcctgtccatttaccagat

SEQ ID NO: 6907954 - DNA, 22 bp, Homo sapiens
gaaagaatcaactatgtctctg

SEQ ID NO: 6907955 - DNA, 22 bp, Homo sapiens
cagacttgaaagagactcagtt

SEQ ID NO: 6907956 - DNA, 22 bp, Homo sapiens
cacccactgagctcatgtccca

SEQ ID NO: 6907957 - DNA, 19 bp, Homo sapiens
gcaggcagtggcattcgga

SEQ ID NO: 6907958 - DNA, 23 bp, Homo sapiens
agagcttagggaattcacatgag

SEQ ID NO: 6907959 - DNA, 22 bp, Homo sapiens
atccagagtgtaattctccatg

SEQ ID NO: 6907960 - DNA, 22 bp, Homo sapiens
aaatggagttctaagtatagta

SEQ ID NO: 6907961 - DNA, 18 bp, Homo sapiens
ggtggcggggatggaggt

SEQ ID NO: 6907962 - DNA, 16 bp, Homo sapiens
gcactgggatgtcttc

SEQ ID NO: 6907963 - DNA, 22 bp, Homo sapiens
ctccttctgaggctctgggttc

SEQ ID NO: 6907964 - DNA, 22 bp, Homo sapiens
aacttctgccaaacagctgtta

SEQ ID NO: 6907965 - DNA, 22 bp, Homo sapiens
tcccgtcttgctgttgtctgcg

SEQ ID NO: 6907966 - DNA, 22 bp, Homo sapiens
tgggcaagtcacttctgtcttt

SEQ ID NO: 6907967 - DNA, 22 bp, Homo sapiens
gacaggatattatgatagattc

SEQ ID NO: 6907968 - DNA, 21 bp, Homo sapiens
tgcgtgtgcatggccttcggg

SEQ ID NO: 6907969 - DNA, 22 bp, Homo sapiens
agagaaactgatgtcctttgaa

SEQ ID NO: 6907970 - DNA, 22 bp, Homo sapiens
gccaggtgctatccctgcgctg

SEQ ID NO: 6907971 - DNA, 22 bp, Homo sapiens
atgactcaaaattattgttttg

SEQ ID NO: 6907972 - DNA, 22 bp, Homo sapiens
tggcttctaaagtttcttttag

SEQ ID NO: 6907973 - DNA, 22 bp, Homo sapiens
attagcaattgtttcattgatc

SEQ ID NO: 6907974 - DNA, 22 bp, Homo sapiens
aagtgtttaacggtgattgagc

SEQ ID NO: 6907975 - DNA, 22 bp, Homo sapiens
tcctggagggctcacaggcggc

SEQ ID NO: 6907976 - DNA, 20 bp, Homo sapiens
gctcaggtttgggctttgtg

SEQ ID NO: 6907977 - DNA, 22 bp, Homo sapiens
ctcactgaaacctccgcctccc

SEQ ID NO: 6907978 - DNA, 22 bp, Homo sapiens
cctttggagcaactgagagcta

SEQ ID NO: 6907979 - DNA, 22 bp, Homo sapiens
aaagctgccaaggagaatacta

SEQ ID NO: 6907980 - DNA, 22 bp, Homo sapiens
agcagagtctgtgtgcacttta

SEQ ID NO: 6907981 - DNA, 22 bp, Homo sapiens
ccagggtgaccagctggcctag

SEQ ID NO: 6907982 - DNA, 22 bp, Homo sapiens
ctggagcattttctgcttctgc

SEQ ID NO: 6907983 - DNA, 22 bp, Homo sapiens
aggaggcagtctgtcccttagc

SEQ ID NO: 6907984 - DNA, 22 bp, Homo sapiens
ctgcacatgttcatcatgacaa

SEQ ID NO: 6907985 - DNA, 22 bp, Homo sapiens
ctggctcagggtggtctgggtc

SEQ ID NO: 6907986 - DNA, 22 bp, Homo sapiens
tgtttgcattaattagaaggta

SEQ ID NO: 6907987 - DNA, 22 bp, Homo sapiens
cagtaaatataggaacgtggaa

SEQ ID NO: 6907988 - DNA, 22 bp, Homo sapiens
ttcagacattgctctccaccca

SEQ ID NO: 6907989 - DNA, 22 bp, Homo sapiens
ttgatgaattgctagattgcta

SEQ ID NO: 6907990 - DNA, 22 bp, Homo sapiens
taccagtaatgtaactttgcaa

SEQ ID NO: 6907991 - DNA, 22 bp, Homo sapiens
cagtggttctcaatcaggaatg

SEQ ID NO: 6907992 - DNA, 21 bp, Homo sapiens
ccagcccagcctccttctctt

SEQ ID NO: 6907993 - DNA, 22 bp, Homo sapiens
aatgtggggaagccatggctga

SEQ ID NO: 6907994 - DNA, 22 bp, Homo sapiens
actctctggtgtagaaagacct

SEQ ID NO: 6907995 - DNA, 22 bp, Homo sapiens
gcaataaacatgtttgatgcgc

SEQ ID NO: 6907996 - DNA, 22 bp, Homo sapiens
cccagtggggagcttctgcctt

SEQ ID NO: 6907997 - DNA, 22 bp, Homo sapiens
taggctttcacagctggactcc

SEQ ID NO: 6907998 - DNA, 22 bp, Homo sapiens
agccccttgctgccctctagag

SEQ ID NO: 6907999 - DNA, 22 bp, Homo sapiens
cttcctgaaggatggcagcctc

SEQ ID NO: 6908000 - DNA, 23 bp, Homo sapiens
ttgtatttttagtagagacaggg

SEQ ID NO: 6908001 - DNA, 22 bp, Homo sapiens
ctcagactaaaatgggaatgta

SEQ ID NO: 6908002 - DNA, 22 bp, Homo sapiens
attcctgcattggtcaacccat

SEQ ID NO: 6908003 - DNA, 22 bp, Homo sapiens
agtctgtgtgaatgtgggcttt

SEQ ID NO: 6908004 - DNA, 22 bp, Homo sapiens
tacaggtggatcactagtatag

SEQ ID NO: 6908005 - DNA, 22 bp, Homo sapiens
ttgtacacagcttgcggctata

SEQ ID NO: 6908006 - DNA, 22 bp, Homo sapiens
ggactctgttttcctgatcact

SEQ ID NO: 6908007 - DNA, 23 bp, Homo sapiens
tggataaagctgtgctgcatagg

SEQ ID NO: 6908008 - DNA, 22 bp, Homo sapiens
acaattcaagatgagattcagg

SEQ ID NO: 6908009 - DNA, 20 bp, Homo sapiens
tgaatagagagcacatatgc

SEQ ID NO: 6908010 - DNA, 22 bp, Homo sapiens
aggctgggctccgcccaactcc

SEQ ID NO: 6908011 - DNA, 22 bp, Homo sapiens
taaatggttccgtgattcatga

SEQ ID NO: 6908012 - DNA, 22 bp, Homo sapiens
ttcctccagaagctgtagggga

SEQ ID NO: 6908013 - DNA, 22 bp, Homo sapiens
ctggctcagacagctgtgcagt

SEQ ID NO: 6908014 - DNA, 18 bp, Homo sapiens
acatttctaggtgaaagc

SEQ ID NO: 6908015 - DNA, 22 bp, Homo sapiens
atagaagtggtctgcatttgca

SEQ ID NO: 6908016 - DNA, 22 bp, Homo sapiens
aaagtggccatcctctgcatcg

SEQ ID NO: 6908017 - DNA, 22 bp, Homo sapiens
cagcttctggcgtggagcctga

SEQ ID NO: 6908018 - DNA, 22 bp, Homo sapiens
tatacaagtgagaagaagagtt

SEQ ID NO: 6908019 - DNA, 22 bp, Homo sapiens
agtgtacagttctatgaatttc

SEQ ID NO: 6908020 - DNA, 18 bp, Homo sapiens
gcaaggctcaggccaggc

SEQ ID NO: 6908021 - DNA, 22 bp, Homo sapiens
ctggagccatgtcttgactgct

SEQ ID NO: 6908022 - DNA, 22 bp, Homo sapiens
ctgcctcagccttctgggtgac

SEQ ID NO: 6908023 - DNA, 22 bp, Homo sapiens
tgcagcatgtgtgcaattagtt

SEQ ID NO: 6908024 - DNA, 19 bp, Homo sapiens
tctgggagagtgaatctga

SEQ ID NO: 6908025 - DNA, 22 bp, Homo sapiens
ggctgaaaggtagtagtaggct

SEQ ID NO: 6908026 - DNA, 22 bp, Homo sapiens
tgtgaaatcacaggctatttag

SEQ ID NO: 6908027 - DNA, 22 bp, Homo sapiens
ttagaaagctttccatagtcaa

SEQ ID NO: 6908028 - DNA, 22 bp, Homo sapiens
ccagcctcatcatattcctgct

SEQ ID NO: 6908029 - DNA, 17 bp, Homo sapiens
cactttgttgctgtggg

SEQ ID NO: 6908030 - DNA, 22 bp, Homo sapiens
cagaatttttcgaatgtactgt

SEQ ID NO: 6908031 - DNA, 22 bp, Homo sapiens
ttgagggattgcaccagaagag

SEQ ID NO: 6908032 - DNA, 22 bp, Homo sapiens
gatttataaaggttgcactgga

SEQ ID NO: 6908033 - DNA, 22 bp, Homo sapiens
cagctagaaagtctgttaggga

SEQ ID NO: 6908034 - DNA, 22 bp, Homo sapiens
gcagtgtgatgcttccagccac

SEQ ID NO: 6908035 - DNA, 20 bp, Homo sapiens
tgtacacagtactttacaat

SEQ ID NO: 6908036 - DNA, 22 bp, Homo sapiens
agtacatttagtttatgaacat

SEQ ID NO: 6908037 - DNA, 22 bp, Homo sapiens
gaacttgggagaagggagtgtg

SEQ ID NO: 6908038 - DNA, 22 bp, Homo sapiens
gggagggattagttctgcctgg

SEQ ID NO: 6908039 - DNA, 22 bp, Homo sapiens
aaagcagtatagtggaagggct

SEQ ID NO: 6908040 - DNA, 22 bp, Homo sapiens
cctgagtcaagatgtatggtaa

SEQ ID NO: 6908041 - DNA, 22 bp, Homo sapiens
cttctgggcattcagctgcaca

SEQ ID NO: 6908042 - DNA, 22 bp, Homo sapiens
aggagccatggaggtgaggcgg

SEQ ID NO: 6908043 - DNA, 22 bp, Homo sapiens
ctctgagacttttcacctccca

SEQ ID NO: 6908044 - DNA, 22 bp, Homo sapiens
gcagcagccactattctggcat

SEQ ID NO: 6908045 - DNA, 22 bp, Homo sapiens
tctggcaatctgattctgcatc

SEQ ID NO: 6908046 - DNA, 22 bp, Homo sapiens
ctcaggatgtcggtgactattg

SEQ ID NO: 6908047 - DNA, 22 bp, Homo sapiens
tatcactacactaagatacaga

SEQ ID NO: 6908048 - DNA, 22 bp, Homo sapiens
ggcggcctgtgggtcggcctca

SEQ ID NO: 6908049 - DNA, 22 bp, Homo sapiens
ctttttcactgtgtcctcacac

SEQ ID NO: 6908050 - DNA, 22 bp, Homo sapiens
agtagtgaacagccacaggatt

SEQ ID NO: 6908051 - DNA, 22 bp, Homo sapiens
gaaggctgagcagacaggccaa

SEQ ID NO: 6908052 - DNA, 22 bp, Homo sapiens
gcagctgcaagcacttctggca

SEQ ID NO: 6908053 - DNA, 22 bp, Homo sapiens
tatgcccagcttaaagtacaca

SEQ ID NO: 6908054 - DNA, 22 bp, Homo sapiens
ctggacaaaggactcacaggat

SEQ ID NO: 6908055 - DNA, 22 bp, Homo sapiens
gcaaactgttggagtagagtct

SEQ ID NO: 6908056 - DNA, 21 bp, Homo sapiens
tggcacagaaaggaaagttca

SEQ ID NO: 6908057 - DNA, 22 bp, Homo sapiens
cttcttcttttaataaatgtct

SEQ ID NO: 6908058 - DNA, 22 bp, Homo sapiens
caggcatttcgcaaaggctgag

SEQ ID NO: 6908059 - DNA, 22 bp, Homo sapiens
gctagtttcttgttggcagaga

SEQ ID NO: 6908060 - DNA, 22 bp, Homo sapiens
atactgtacgtcccagatagga

SEQ ID NO: 6908061 - DNA, 22 bp, Homo sapiens
ttgagcaaatcagattgtaatt

SEQ ID NO: 6908062 - DNA, 22 bp, Homo sapiens
tacaaagtcttgggttctaggc

SEQ ID NO: 6908063 - DNA, 22 bp, Homo sapiens
ccggaatgccggctgaccgcgg

SEQ ID NO: 6908064 - DNA, 22 bp, Homo sapiens
gtgtcttttctgtctagcacaa

SEQ ID NO: 6908065 - DNA, 22 bp, Homo sapiens
ttctcaactctcaagagaagct

SEQ ID NO: 6908066 - DNA, 22 bp, Homo sapiens
aatgtatctagacttgctggct

SEQ ID NO: 6908067 - DNA, 22 bp, Homo sapiens
tttagcacagaactccactcac

SEQ ID NO: 6908068 - DNA, 22 bp, Homo sapiens
cctggtgctgctatcaggggta

SEQ ID NO: 6908069 - DNA, 22 bp, Homo sapiens
atgggtagaatcatttctggac

SEQ ID NO: 6908070 - DNA, 22 bp, Homo sapiens
ttaagtgagcttgaataatctt

SEQ ID NO: 6908071 - DNA, 22 bp, Homo sapiens
agagttgctaaattcaggtctt

SEQ ID NO: 6908072 - DNA, 22 bp, Homo sapiens
gcagccatcacgatgaactcag

SEQ ID NO: 6908073 - DNA, 22 bp, Homo sapiens
agagatgccacctttttgctgt

SEQ ID NO: 6908074 - DNA, 22 bp, Homo sapiens
gaaactgaatataagaaaggta

SEQ ID NO: 6908075 - DNA, 22 bp, Homo sapiens
tcctggcccgatccctgtgaag

SEQ ID NO: 6908076 - DNA, 22 bp, Homo sapiens
catcttaatttctaacaggcac

SEQ ID NO: 6908077 - DNA, 22 bp, Homo sapiens
gctgccctgactccagcagcct

SEQ ID NO: 6908078 - DNA, 22 bp, Homo sapiens
ttgagcaagagtaggaactgaa

SEQ ID NO: 6908079 - DNA, 22 bp, Homo sapiens
gaagaaactgaaaggggttggt

SEQ ID NO: 6908080 - DNA, 22 bp, Homo sapiens
caggtagctgcagagactattt

SEQ ID NO: 6908081 - DNA, 20 bp, Homo sapiens
tcacatgagctggggcaggc

SEQ ID NO: 6908082 - DNA, 22 bp, Homo sapiens
cccagcctgtgacagccgtcct

SEQ ID NO: 6908083 - DNA, 22 bp, Homo sapiens
agccgctgtctcttgggccgcg

SEQ ID NO: 6908084 - DNA, 22 bp, Homo sapiens
gtggccttaggacacgtttatt

SEQ ID NO: 6908085 - DNA, 22 bp, Homo sapiens
atgtcaacaggcctttaaacat

SEQ ID NO: 6908086 - DNA, 22 bp, Homo sapiens
tgtaccataggtctatcattct

SEQ ID NO: 6908087 - DNA, 22 bp, Homo sapiens
ttgaatctatgtattcagtgta

SEQ ID NO: 6908088 - DNA, 22 bp, Homo sapiens
gaccctgaggattccctgctga

SEQ ID NO: 6908089 - DNA, 22 bp, Homo sapiens
gaggcagagtgcaccccaggag

SEQ ID NO: 6908090 - DNA, 22 bp, Homo sapiens
caagccgcggctccagatgtgg

SEQ ID NO: 6908091 - DNA, 22 bp, Homo sapiens
ctgaattaatacacagaatggc

SEQ ID NO: 6908092 - DNA, 20 bp, Homo sapiens
ttctggcaaacagagttctt

SEQ ID NO: 6908093 - DNA, 22 bp, Homo sapiens
cttgacacaatgaacatctgta

SEQ ID NO: 6908094 - DNA, 22 bp, Homo sapiens
cctgagcagctctgaggggcga

SEQ ID NO: 6908095 - DNA, 22 bp, Homo sapiens
agaacatttgtcaaaaagccaa

SEQ ID NO: 6908096 - DNA, 20 bp, Homo sapiens
ggcctcagtgtccttgtttg

SEQ ID NO: 6908097 - DNA, 22 bp, Homo sapiens
agcatttccgccctcttctgcc

SEQ ID NO: 6908098 - DNA, 22 bp, Homo sapiens
ttagcaacacccatttgtgtgc

SEQ ID NO: 6908099 - DNA, 22 bp, Homo sapiens
tgaattcaaattgtgcctatta

SEQ ID NO: 6908100 - DNA, 22 bp, Homo sapiens
tggaaatagtaatgcataagtg

SEQ ID NO: 6908101 - DNA, 22 bp, Homo sapiens
gcccagacatttggccaaacat

SEQ ID NO: 6908102 - DNA, 22 bp, Homo sapiens
tggactcaccttgagttagcca

SEQ ID NO: 6908103 - DNA, 22 bp, Homo sapiens
tttgcagagtgcagaagcatct

SEQ ID NO: 6908104 - DNA, 22 bp, Homo sapiens
actatgccatgtgaggataaag

SEQ ID NO: 6908105 - DNA, 22 bp, Homo sapiens
gtggtccccagagctgtgtaca

SEQ ID NO: 6908106 - DNA, 22 bp, Homo sapiens
actgcacagattaagttagatt

SEQ ID NO: 6908107 - DNA, 20 bp, Homo sapiens
cgtccccttgagcaggtccc

SEQ ID NO: 6908108 - DNA, 22 bp, Homo sapiens
ttgcttcattttcccagtacgg

SEQ ID NO: 6908109 - DNA, 22 bp, Homo sapiens
acttgcatgtgtaaatcttcct

SEQ ID NO: 6908110 - DNA, 22 bp, Homo sapiens
gtggcagttctgtgtctcttgt

SEQ ID NO: 6908111 - DNA, 22 bp, Homo sapiens
gctgccagaatgggaaatctga

SEQ ID NO: 6908112 - DNA, 20 bp, Homo sapiens
cctgatcacaagggtccttg

SEQ ID NO: 6908113 - DNA, 22 bp, Homo sapiens
tccagtgtggtcaaaggggaat

SEQ ID NO: 6908114 - DNA, 22 bp, Homo sapiens
atatgaatttggggaggacaca

SEQ ID NO: 6908115 - DNA, 22 bp, Homo sapiens
tgtaagatattcagcttattga

SEQ ID NO: 6908116 - DNA, 22 bp, Homo sapiens
gccttgccaagagaggattttg

SEQ ID NO: 6908117 - DNA, 22 bp, Homo sapiens
ctgagggccctgaagcttggca

SEQ ID NO: 6908118 - DNA, 22 bp, Homo sapiens
ttgatttctattcagatgtaga

SEQ ID NO: 6908119 - DNA, 21 bp, Homo sapiens
gcaaagtgtgggcataaacag

SEQ ID NO: 6908120 - DNA, 19 bp, Homo sapiens
gaaacaagtcattccagag

SEQ ID NO: 6908121 - DNA, 20 bp, Homo sapiens
tgacatagctttgcagagtt

SEQ ID NO: 6908122 - DNA, 22 bp, Homo sapiens
ccttgctctcccaagcccgcag

SEQ ID NO: 6908123 - DNA, 22 bp, Homo sapiens
aatgtgttcagttaaatgaact

SEQ ID NO: 6908124 - DNA, 22 bp, Homo sapiens
gcagctgctcacattctcacaa

SEQ ID NO: 6908125 - DNA, 22 bp, Homo sapiens
gagtggctgggtgtttgaatcc

SEQ ID NO: 6908126 - DNA, 22 bp, Homo sapiens
aggctccaggcctccctgcatg

SEQ ID NO: 6908127 - DNA, 22 bp, Homo sapiens
gctgcaactgttgctctctgca

SEQ ID NO: 6908128 - DNA, 22 bp, Homo sapiens
agcttactgtaattaaaagact

SEQ ID NO: 6908129 - DNA, 22 bp, Homo sapiens
gcaaaaaatgcttgttgcttag

SEQ ID NO: 6908130 - DNA, 22 bp, Homo sapiens
ggagatttatagcacacttcag

SEQ ID NO: 6908131 - DNA, 22 bp, Homo sapiens
acaaagtcacaataattaacct

SEQ ID NO: 6908132 - DNA, 22 bp, Homo sapiens
aaggatatgggtagtatgatgt

SEQ ID NO: 6908133 - DNA, 22 bp, Homo sapiens
atccataggttttgattattaa

SEQ ID NO: 6908134 - DNA, 22 bp, Homo sapiens
aagtcagaaattattcaggaat

SEQ ID NO: 6908135 - DNA, 22 bp, Homo sapiens
tcagcccaaccctgcacaagga

SEQ ID NO: 6908136 - DNA, 22 bp, Homo sapiens
ttgaaagctccatattgtagag

SEQ ID NO: 6908137 - DNA, 22 bp, Homo sapiens
caggatggtctcgatctcctga

SEQ ID NO: 6908138 - DNA, 22 bp, Homo sapiens
tctcagcaaggaaagaggcagg

SEQ ID NO: 6908139 - DNA, 22 bp, Homo sapiens
aaggcttgtagatttgggcttt

SEQ ID NO: 6908140 - DNA, 22 bp, Homo sapiens
aaaattctcttgatcttgacag

SEQ ID NO: 6908141 - DNA, 22 bp, Homo sapiens
ttgaagtcccaacctccagtac

SEQ ID NO: 6908142 - DNA, 22 bp, Homo sapiens
gtagcaaagggacggctctaga

SEQ ID NO: 6908143 - DNA, 22 bp, Homo sapiens
gcaaggatctgttgtggggcca

SEQ ID NO: 6908144 - DNA, 22 bp, Homo sapiens
gcgatttggttacagaagggca

SEQ ID NO: 6908145 - DNA, 22 bp, Homo sapiens
aacagcttcatcacatggcata

SEQ ID NO: 6908146 - DNA, 18 bp, Homo sapiens
gctcagtgtgttaacact

SEQ ID NO: 6908147 - DNA, 22 bp, Homo sapiens
tggctcctccctgtgtgtgcgt

SEQ ID NO: 6908148 - DNA, 22 bp, Homo sapiens
gtctcccatctctgtccttgtg

SEQ ID NO: 6908149 - DNA, 22 bp, Homo sapiens
tcaaccacagtcccatgtctcc

SEQ ID NO: 6908150 - DNA, 22 bp, Homo sapiens
gggattaatgtctctttgaaag

SEQ ID NO: 6908151 - DNA, 22 bp, Homo sapiens
gctgggtgattcatttccataa

SEQ ID NO: 6908152 - DNA, 22 bp, Homo sapiens
tggaataatgaccacagaaaca

SEQ ID NO: 6908153 - DNA, 22 bp, Homo sapiens
caaggccaaagggccactgtca

SEQ ID NO: 6908154 - DNA, 22 bp, Homo sapiens
gactctgctaggaaaatctcag

SEQ ID NO: 6908155 - DNA, 22 bp, Homo sapiens
gttcactgctttcttagtactc

SEQ ID NO: 6908156 - DNA, 22 bp, Homo sapiens
attgagaaaattcgagcaagtt

SEQ ID NO: 6908157 - DNA, 22 bp, Homo sapiens
ctgaatgctttggttctaaaag

SEQ ID NO: 6908158 - DNA, 22 bp, Homo sapiens
tcccacagtctcacaatgcata

SEQ ID NO: 6908159 - DNA, 22 bp, Homo sapiens
gcagaattggatagttgtgata

SEQ ID NO: 6908160 - DNA, 22 bp, Homo sapiens
agcttcccaaggttggaaggtt

SEQ ID NO: 6908161 - DNA, 22 bp, Homo sapiens
tcgtacagcagactgaagtcct

SEQ ID NO: 6908162 - DNA, 22 bp, Homo sapiens
cagcaggattggatacatctca

SEQ ID NO: 6908163 - DNA, 22 bp, Homo sapiens
cagagctgtgataaatagatat

SEQ ID NO: 6908164 - DNA, 17 bp, Homo sapiens
acactggtgctggagtc

SEQ ID NO: 6908165 - DNA, 18 bp, Homo sapiens
aggtatatgaatctcttt

SEQ ID NO: 6908166 - DNA, 22 bp, Homo sapiens
agggtgcagggacaggtgtgca

SEQ ID NO: 6908167 - DNA, 22 bp, Homo sapiens
tctgaagaagggtgccaggctg

SEQ ID NO: 6908168 - DNA, 22 bp, Homo sapiens
catggggatgaggctgagactt

SEQ ID NO: 6908169 - DNA, 22 bp, Homo sapiens
ctgagctgctttgcttttgggg

SEQ ID NO: 6908170 - DNA, 22 bp, Homo sapiens
gaaagtgctaggaagtgttaga

SEQ ID NO: 6908171 - DNA, 22 bp, Homo sapiens
tgcagacttagaaaagtctaga

SEQ ID NO: 6908172 - DNA, 22 bp, Homo sapiens
aatagcttgcctaatcctcatg

SEQ ID NO: 6908173 - DNA, 22 bp, Homo sapiens
ttgcatttgctcatttgatatg

SEQ ID NO: 6908174 - DNA, 22 bp, Homo sapiens
tgccagaagattctctatcaga

SEQ ID NO: 6908175 - DNA, 22 bp, Homo sapiens
gttgggaagcagatggatgagc

SEQ ID NO: 6908176 - DNA, 22 bp, Homo sapiens
tttatagtcgtctcagtaataa

SEQ ID NO: 6908177 - DNA, 22 bp, Homo sapiens
ccagccctcctccatcagagga

SEQ ID NO: 6908178 - DNA, 22 bp, Homo sapiens
ctcagagtccccagtgggtttg

SEQ ID NO: 6908179 - DNA, 22 bp, Homo sapiens
acactagtggaaattgatttgt

SEQ ID NO: 6908180 - DNA, 20 bp, Homo sapiens
caggctccgcaggactaggg

SEQ ID NO: 6908181 - DNA, 22 bp, Homo sapiens
agagaagggtagcccattctcc

SEQ ID NO: 6908182 - DNA, 22 bp, Homo sapiens
tgttctttagcagaccatgttg

SEQ ID NO: 6908183 - DNA, 22 bp, Homo sapiens
cagattcaacctaagacaatct

SEQ ID NO: 6908184 - DNA, 22 bp, Homo sapiens
gactatgtgtattttactcacc

SEQ ID NO: 6908185 - DNA, 22 bp, Homo sapiens
aggctggtcccagggagggaat

SEQ ID NO: 6908186 - DNA, 22 bp, Homo sapiens
agcatttcttggcccattgtag

SEQ ID NO: 6908187 - DNA, 22 bp, Homo sapiens
tcagcccgggttcgcaaacact

SEQ ID NO: 6908188 - DNA, 22 bp, Homo sapiens
atgggcagggcagtgtataaga

SEQ ID NO: 6908189 - DNA, 21 bp, Homo sapiens
tcctcagggccccagagcact

SEQ ID NO: 6908190 - DNA, 22 bp, Homo sapiens
ttccttctttgtggtagaaagt

SEQ ID NO: 6908191 - DNA, 22 bp, Homo sapiens
tagatgaaatgtgtgttattat

SEQ ID NO: 6908192 - DNA, 22 bp, Homo sapiens
aacaaatgtaaaatgcagatgc

SEQ ID NO: 6908193 - DNA, 22 bp, Homo sapiens
tcctgaattgaactcagttaat

SEQ ID NO: 6908194 - DNA, 22 bp, Homo sapiens
ttaaagcccagcatatactagg

SEQ ID NO: 6908195 - DNA, 22 bp, Homo sapiens
taggccttttgaattggtttcc

SEQ ID NO: 6908196 - DNA, 21 bp, Homo sapiens
gggtaatgcagaatgttctta

SEQ ID NO: 6908197 - DNA, 22 bp, Homo sapiens
ttcttcagcttctacctgcgtc

SEQ ID NO: 6908198 - DNA, 22 bp, Homo sapiens
tttctggattcatacagatgta

SEQ ID NO: 6908199 - DNA, 22 bp, Homo sapiens
acccattgctagagagagtgtg

SEQ ID NO: 6908200 - DNA, 22 bp, Homo sapiens
cagtggttgtcagcaacaatat

SEQ ID NO: 6908201 - DNA, 22 bp, Homo sapiens
ataggtctgaaagtgtatcctg

SEQ ID NO: 6908202 - DNA, 22 bp, Homo sapiens
taccagggaacagggatattaa

SEQ ID NO: 6908203 - DNA, 22 bp, Homo sapiens
ccaggacactgcttcacagcag

SEQ ID NO: 6908204 - DNA, 22 bp, Homo sapiens
gggtcaattctgaggtccgttt

SEQ ID NO: 6908205 - DNA, 22 bp, Homo sapiens
tgaatgcatggcttagatctac

SEQ ID NO: 6908206 - DNA, 22 bp, Homo sapiens
tcttgtgcttgcagctggggag

SEQ ID NO: 6908207 - DNA, 22 bp, Homo sapiens
atgcataagtgcagcagatttg

SEQ ID NO: 6908208 - DNA, 23 bp, Homo sapiens
tcagtagtcattgggaaagtgtg

SEQ ID NO: 6908209 - DNA, 22 bp, Homo sapiens
aatgcaaagcaagcagagattt

SEQ ID NO: 6908210 - DNA, 22 bp, Homo sapiens
catcattcctaggtgcagagct

SEQ ID NO: 6908211 - DNA, 22 bp, Homo sapiens
gctcactgcaagctctgcctcc

SEQ ID NO: 6908212 - DNA, 21 bp, Homo sapiens
atacttgaaaatggttactct

SEQ ID NO: 6908213 - DNA, 22 bp, Homo sapiens
gcagcccaagcctgagcatcct

SEQ ID NO: 6908214 - DNA, 22 bp, Homo sapiens
agctccagtttcctgactgagc

SEQ ID NO: 6908215 - DNA, 22 bp, Homo sapiens
tctctgggcccagaccttcctt

SEQ ID NO: 6908216 - DNA, 22 bp, Homo sapiens
aactccagctcacacagtgacc

SEQ ID NO: 6908217 - DNA, 22 bp, Homo sapiens
ggctccaaagggcagtgtgagg

SEQ ID NO: 6908218 - DNA, 22 bp, Homo sapiens
catcagctttggcgctgagcat

SEQ ID NO: 6908219 - DNA, 22 bp, Homo sapiens
atgacttattacaagtcatatt

SEQ ID NO: 6908220 - DNA, 22 bp, Homo sapiens
cttctgaggactctaaagagga

SEQ ID NO: 6908221 - DNA, 22 bp, Homo sapiens
cagtggtttaggtcaaggggag

SEQ ID NO: 6908222 - DNA, 23 bp, Homo sapiens
ttgatacagaagaatcagtttgt

SEQ ID NO: 6908223 - DNA, 22 bp, Homo sapiens
aaccagagctttaaaaatctgt

SEQ ID NO: 6908224 - DNA, 22 bp, Homo sapiens
agaatcctattgtcagattctt

SEQ ID NO: 6908225 - DNA, 22 bp, Homo sapiens
gctgaagagcaaggctgggtct

SEQ ID NO: 6908226 - DNA, 22 bp, Homo sapiens
tgcccaggcttcaccctcagag

SEQ ID NO: 6908227 - DNA, 22 bp, Homo sapiens
ggctctgggtgtgaccttgggt

SEQ ID NO: 6908228 - DNA, 22 bp, Homo sapiens
gcttcagcctcacactgatatc

SEQ ID NO: 6908229 - DNA, 20 bp, Homo sapiens
tagaacttttcagtatggat

SEQ ID NO: 6908230 - DNA, 22 bp, Homo sapiens
ttccctttggcagccttctcct

SEQ ID NO: 6908231 - DNA, 19 bp, Homo sapiens
caacagtactggtttgtcc

SEQ ID NO: 6908232 - DNA, 22 bp, Homo sapiens
actggattccattgtgcaaaga

SEQ ID NO: 6908233 - DNA, 22 bp, Homo sapiens
ccttagaagaaagttacttttt

SEQ ID NO: 6908234 - DNA, 22 bp, Homo sapiens
ttgctaaatttattttcgaaca

SEQ ID NO: 6908235 - DNA, 22 bp, Homo sapiens
gttcagtgtttttattgacagg

SEQ ID NO: 6908236 - DNA, 22 bp, Homo sapiens
ccactgccgtgggccttgggga

SEQ ID NO: 6908237 - DNA, 22 bp, Homo sapiens
tttctaacgtagacagggaggt

SEQ ID NO: 6908238 - DNA, 22 bp, Homo sapiens
tggcctcaaccgtcctaagcac

SEQ ID NO: 6908239 - DNA, 22 bp, Homo sapiens
gcagggcagacctccagcctat

SEQ ID NO: 6908240 - DNA, 22 bp, Homo sapiens
ctaagacatgccctgcatgata

SEQ ID NO: 6908241 - DNA, 22 bp, Homo sapiens
acagtcttcccttattccactc

SEQ ID NO: 6908242 - DNA, 22 bp, Homo sapiens
agcatctggcctggttactttt

SEQ ID NO: 6908243 - DNA, 22 bp, Homo sapiens
aggcccagcccgtcctcgtgct

SEQ ID NO: 6908244 - DNA, 22 bp, Homo sapiens
tctgtacttcctttaaacttta

SEQ ID NO: 6908245 - DNA, 22 bp, Homo sapiens
tacctttgatctggaattttaa

SEQ ID NO: 6908246 - DNA, 22 bp, Homo sapiens
tggtctgaatgacttgttagtt

SEQ ID NO: 6908247 - DNA, 22 bp, Homo sapiens
gatgagacagaatagcccaagg

SEQ ID NO: 6908248 - DNA, 22 bp, Homo sapiens
acatagtgttttgagagacagc

SEQ ID NO: 6908249 - DNA, 22 bp, Homo sapiens
ctgtagagaaagcatggaagct

SEQ ID NO: 6908250 - DNA, 22 bp, Homo sapiens
taattagtgtccagcttctgct

SEQ ID NO: 6908251 - DNA, 22 bp, Homo sapiens
gagctaaatgaatcataaatca

SEQ ID NO: 6908252 - DNA, 22 bp, Homo sapiens
gctgtccacctccagagcctta

SEQ ID NO: 6908253 - DNA, 22 bp, Homo sapiens
tggattctggggagaaagtcac

SEQ ID NO: 6908254 - DNA, 22 bp, Homo sapiens
ttcttgtttattaagatataaa

SEQ ID NO: 6908255 - DNA, 22 bp, Homo sapiens
tgtcagcagctggtttgctgtt

SEQ ID NO: 6908256 - DNA, 22 bp, Homo sapiens
gctctgaaaaagaaaccatggt

SEQ ID NO: 6908257 - DNA, 22 bp, Homo sapiens
gtggaatgaatagatttgcatt

SEQ ID NO: 6908258 - DNA, 22 bp, Homo sapiens
atgtatgatatttccagtatca

SEQ ID NO: 6908259 - DNA, 22 bp, Homo sapiens
gcctcccctgcaattgtccttg

SEQ ID NO: 6908260 - DNA, 22 bp, Homo sapiens
atgtgaaaaatttcttattaca

SEQ ID NO: 6908261 - DNA, 22 bp, Homo sapiens
gaagggcttggctgggaggcca

SEQ ID NO: 6908262 - DNA, 22 bp, Homo sapiens
agaaatctctagcacatcgaat

SEQ ID NO: 6908263 - DNA, 22 bp, Homo sapiens
aactgcttatctttggtagatg

SEQ ID NO: 6908264 - DNA, 18 bp, Homo sapiens
tcctcctttggccttttc

SEQ ID NO: 6908265 - DNA, 22 bp, Homo sapiens
gtagttatttatttaccactcc

SEQ ID NO: 6908266 - DNA, 22 bp, Homo sapiens
gcatggtggccttagggtagcc

SEQ ID NO: 6908267 - DNA, 22 bp, Homo sapiens
ctgcctgtgtctattccttttt

SEQ ID NO: 6908268 - DNA, 22 bp, Homo sapiens
acttatctgcaattagtacata

SEQ ID NO: 6908269 - DNA, 22 bp, Homo sapiens
tgagagccaggatctgctctat

SEQ ID NO: 6908270 - DNA, 22 bp, Homo sapiens
tctgtagtctctgatatatctg

SEQ ID NO: 6908271 - DNA, 22 bp, Homo sapiens
ggtgtctgcttccctccagctg

SEQ ID NO: 6908272 - DNA, 22 bp, Homo sapiens
gtgagctgtctgagtctcttgg

SEQ ID NO: 6908273 - DNA, 22 bp, Homo sapiens
taggccagattgttatccatgg

SEQ ID NO: 6908274 - DNA, 18 bp, Homo sapiens
tggaggaaaaatctcatg

SEQ ID NO: 6908275 - DNA, 23 bp, Homo sapiens
ttttattgatatgtagctgttgt

SEQ ID NO: 6908276 - DNA, 22 bp, Homo sapiens
tactctgcaggatggactatgg

SEQ ID NO: 6908277 - DNA, 22 bp, Homo sapiens
aatgccttggagagcctagagg

SEQ ID NO: 6908278 - DNA, 22 bp, Homo sapiens
gccacctggtggcatcttctgg

SEQ ID NO: 6908279 - DNA, 22 bp, Homo sapiens
tcatgtggcttatagaatttgt

SEQ ID NO: 6908280 - DNA, 22 bp, Homo sapiens
tctgggggttaagtgaggacaa

SEQ ID NO: 6908281 - DNA, 22 bp, Homo sapiens
tatttccaaaaaggccatattc

SEQ ID NO: 6908282 - DNA, 22 bp, Homo sapiens
agtgtagcctagtggttaaggg

SEQ ID NO: 6908283 - DNA, 22 bp, Homo sapiens
gcttaatgagcagagaatctac

SEQ ID NO: 6908284 - DNA, 22 bp, Homo sapiens
aagtccataggtttcatgaggg

SEQ ID NO: 6908285 - DNA, 22 bp, Homo sapiens
ctgctttctgcaccccaggtcg

SEQ ID NO: 6908286 - DNA, 22 bp, Homo sapiens
atttgtttcagggccttggtat

SEQ ID NO: 6908287 - DNA, 22 bp, Homo sapiens
tagaatcattgagaataacagg

SEQ ID NO: 6908288 - DNA, 22 bp, Homo sapiens
tgccctgcctgagagacagtaa

SEQ ID NO: 6908289 - DNA, 22 bp, Homo sapiens
tcctctccaggtgagccgaaat

SEQ ID NO: 6908290 - DNA, 22 bp, Homo sapiens
gacagcaatgacggggcagctg

SEQ ID NO: 6908291 - DNA, 22 bp, Homo sapiens
tgctggctgaggcctgagcggg

SEQ ID NO: 6908292 - DNA, 22 bp, Homo sapiens
ccctgcagaccaatgccataga

SEQ ID NO: 6908293 - DNA, 22 bp, Homo sapiens
atcacagttttaccatttggta

SEQ ID NO: 6908294 - DNA, 22 bp, Homo sapiens
ctatctcagagaaggacatttg

SEQ ID NO: 6908295 - DNA, 22 bp, Homo sapiens
atgctttgatttggtttctcta

SEQ ID NO: 6908296 - DNA, 22 bp, Homo sapiens
tgagttagctctattcttttgg

SEQ ID NO: 6908297 - DNA, 22 bp, Homo sapiens
cagggctggctgtggcaatctc

SEQ ID NO: 6908298 - DNA, 22 bp, Homo sapiens
tacaggcatgtagcatggtgat

SEQ ID NO: 6908299 - DNA, 22 bp, Homo sapiens
caggagtgtttgctacagtttc

SEQ ID NO: 6908300 - DNA, 23 bp, Homo sapiens
aggcttaaatccttggttttgcc

SEQ ID NO: 6908301 - DNA, 22 bp, Homo sapiens
tggcaatgtaggcaagaacatt

SEQ ID NO: 6908302 - DNA, 22 bp, Homo sapiens
ttgagtgtactttagtcatctg

SEQ ID NO: 6908303 - DNA, 22 bp, Homo sapiens
gaagcagcaagtataggacagg

SEQ ID NO: 6908304 - DNA, 22 bp, Homo sapiens
gctgccttatgtctattagtat

SEQ ID NO: 6908305 - DNA, 23 bp, Homo sapiens
aggagccaggaaccagcttcccc

SEQ ID NO: 6908306 - DNA, 22 bp, Homo sapiens
ggcagtgagtcccggagaggcc

SEQ ID NO: 6908307 - DNA, 22 bp, Homo sapiens
gtgtgagagactgaagaaagcc

SEQ ID NO: 6908308 - DNA, 22 bp, Homo sapiens
tttcacctcagtctttttatat

SEQ ID NO: 6908309 - DNA, 22 bp, Homo sapiens
agcctaatgcttttcccaaagt

SEQ ID NO: 6908310 - DNA, 22 bp, Homo sapiens
taagtgttgctctctctcagct

SEQ ID NO: 6908311 - DNA, 22 bp, Homo sapiens
gagcagcctgaggagcgtgggc

SEQ ID NO: 6908312 - DNA, 22 bp, Homo sapiens
gttttatatgtctctgctgaca

SEQ ID NO: 6908313 - DNA, 22 bp, Homo sapiens
aggcctgtctggggctcagcca

SEQ ID NO: 6908314 - DNA, 22 bp, Homo sapiens
agacagacacatggtaacagat

SEQ ID NO: 6908315 - DNA, 22 bp, Homo sapiens
ggtggctcacgcctgtaagccc

SEQ ID NO: 6908316 - DNA, 22 bp, Homo sapiens
tggctctgtcactgtgagctat

SEQ ID NO: 6908317 - DNA, 22 bp, Homo sapiens
gctctgagagtgcatgatagca

SEQ ID NO: 6908318 - DNA, 22 bp, Homo sapiens
agattttgtctcaatacttctg

SEQ ID NO: 6908319 - DNA, 21 bp, Homo sapiens
gagtccttccaatgtcctcag

SEQ ID NO: 6908320 - DNA, 21 bp, Homo sapiens
agtctctctaataaatgcttg

SEQ ID NO: 6908321 - DNA, 22 bp, Homo sapiens
ccagggtgtagggattccagat

SEQ ID NO: 6908322 - DNA, 22 bp, Homo sapiens
aatgggataatagaagtagaat

SEQ ID NO: 6908323 - DNA, 22 bp, Homo sapiens
tctggcttcaagtcccagctct

SEQ ID NO: 6908324 - DNA, 22 bp, Homo sapiens
actgcattatcaccaagatgta

SEQ ID NO: 6908325 - DNA, 19 bp, Homo sapiens
ttagggacatgaattctag

SEQ ID NO: 6908326 - DNA, 22 bp, Homo sapiens
aaggtgaactggtaatgacaga

SEQ ID NO: 6908327 - DNA, 22 bp, Homo sapiens
atttgtctagtggtattcacgt

SEQ ID NO: 6908328 - DNA, 22 bp, Homo sapiens
cataaattgtacccattccaac

SEQ ID NO: 6908329 - DNA, 22 bp, Homo sapiens
accactgggcgggcagcctgct

SEQ ID NO: 6908330 - DNA, 22 bp, Homo sapiens
attcagcaaacatttattgtgt

SEQ ID NO: 6908331 - DNA, 22 bp, Homo sapiens
aggctttaagcaagcatattgt

SEQ ID NO: 6908332 - DNA, 22 bp, Homo sapiens
tacagggattgttttaatcacc

SEQ ID NO: 6908333 - DNA, 22 bp, Homo sapiens
tccatttactattctcatatcg

SEQ ID NO: 6908334 - DNA, 22 bp, Homo sapiens
agaggagcttttggaaaaggcc

SEQ ID NO: 6908335 - DNA, 22 bp, Homo sapiens
ttcaatttgtgctaaggcaccg

SEQ ID NO: 6908336 - DNA, 22 bp, Homo sapiens
gatacagacaccactcttttcc

SEQ ID NO: 6908337 - DNA, 22 bp, Homo sapiens
aagcttgaggtcagtagatgtt

SEQ ID NO: 6908338 - DNA, 22 bp, Homo sapiens
ttccaggcaaaggaagcagctt

SEQ ID NO: 6908339 - DNA, 22 bp, Homo sapiens
gggctggagatgcttatggaga

SEQ ID NO: 6908340 - DNA, 22 bp, Homo sapiens
gggcataacgggcagccaggtg

SEQ ID NO: 6908341 - DNA, 22 bp, Homo sapiens
tgttaggcccatctctgaaggt

SEQ ID NO: 6908342 - DNA, 22 bp, Homo sapiens
tctttagagcacgggaaaaaca

SEQ ID NO: 6908343 - DNA, 22 bp, Homo sapiens
aagttcttgaagactttaaata

SEQ ID NO: 6908344 - DNA, 22 bp, Homo sapiens
ttgcaagttccttatgagaatc

SEQ ID NO: 6908345 - DNA, 19 bp, Homo sapiens
tatcaatcacggcatcttt

SEQ ID NO: 6908346 - DNA, 22 bp, Homo sapiens
aggggcttgtggagttgctggt

SEQ ID NO: 6908347 - DNA, 23 bp, Homo sapiens
gagtttcttccaggagccctggg

SEQ ID NO: 6908348 - DNA, 20 bp, Homo sapiens
aatagcacagctcaaacatt

SEQ ID NO: 6908349 - DNA, 22 bp, Homo sapiens
gattgtggaagtcagtggttct

SEQ ID NO: 6908350 - DNA, 22 bp, Homo sapiens
ctgcagggagcagatggcgtgt

SEQ ID NO: 6908351 - DNA, 22 bp, Homo sapiens
aagatggtttctgtaggtttat

SEQ ID NO: 6908352 - DNA, 20 bp, Homo sapiens
tttcacaatgaacatgtctc

SEQ ID NO: 6908353 - DNA, 22 bp, Homo sapiens
ctgacagatgctgctggcagta

SEQ ID NO: 6908354 - DNA, 20 bp, Homo sapiens
attaatgaatacattttgat

SEQ ID NO: 6908355 - DNA, 22 bp, Homo sapiens
gtgggccaggcgtctaggccct

SEQ ID NO: 6908356 - DNA, 22 bp, Homo sapiens
gccagagcttcccccgagtgtg

SEQ ID NO: 6908357 - DNA, 20 bp, Homo sapiens
agggtgagacatgagcctcc

SEQ ID NO: 6908358 - DNA, 22 bp, Homo sapiens
aaaggctttccagcgcgcggac

SEQ ID NO: 6908359 - DNA, 22 bp, Homo sapiens
ttgcaggaaactgagtgtgagc

SEQ ID NO: 6908360 - DNA, 22 bp, Homo sapiens
agccagggatggcagtgcccag

SEQ ID NO: 6908361 - DNA, 22 bp, Homo sapiens
cagccagctcaggaaggatttt

SEQ ID NO: 6908362 - DNA, 22 bp, Homo sapiens
aaagagcctatattcagctgca

SEQ ID NO: 6908363 - DNA, 22 bp, Homo sapiens
gtccatctaagtatccagcctg

SEQ ID NO: 6908364 - DNA, 22 bp, Homo sapiens
tcccagcctttctttctccagc

SEQ ID NO: 6908365 - DNA, 22 bp, Homo sapiens
gttaggcatgagtgtgtattaa

SEQ ID NO: 6908366 - DNA, 20 bp, Homo sapiens
ttctagaagtttgctaccca

SEQ ID NO: 6908367 - DNA, 22 bp, Homo sapiens
ctctaatactgaccaagtcacc

SEQ ID NO: 6908368 - DNA, 22 bp, Homo sapiens
cactctccagcacaccccattt

SEQ ID NO: 6908369 - DNA, 20 bp, Homo sapiens
tgttccatgactatttggat

SEQ ID NO: 6908370 - DNA, 22 bp, Homo sapiens
tggtccgggatggacgcgggct

SEQ ID NO: 6908371 - DNA, 22 bp, Homo sapiens
tgtggaagtcgcctctccttgg

SEQ ID NO: 6908372 - DNA, 22 bp, Homo sapiens
aggaaactaacttatctttata

SEQ ID NO: 6908373 - DNA, 22 bp, Homo sapiens
tgccctgcggctatctagatga

SEQ ID NO: 6908374 - DNA, 23 bp, Homo sapiens
tggtgcctcagaagcagtgggct

SEQ ID NO: 6908375 - DNA, 22 bp, Homo sapiens
ctcttcagataaaagggatatt

SEQ ID NO: 6908376 - DNA, 22 bp, Homo sapiens
gcctgttggtgactttctgttg

SEQ ID NO: 6908377 - DNA, 22 bp, Homo sapiens
tgggcccaagagagtctccaac

SEQ ID NO: 6908378 - DNA, 22 bp, Homo sapiens
tgctgggtcagtgagagcaggg

SEQ ID NO: 6908379 - DNA, 22 bp, Homo sapiens
gttgtgcaaacactggggtctg

SEQ ID NO: 6908380 - DNA, 22 bp, Homo sapiens
taaggcaaagaaccatagtaat

SEQ ID NO: 6908381 - DNA, 22 bp, Homo sapiens
tttaattttcctggtaggcctg

SEQ ID NO: 6908382 - DNA, 20 bp, Homo sapiens
cctggctttgcagcatgaga

SEQ ID NO: 6908383 - DNA, 22 bp, Homo sapiens
ttaaggaaatcttggtgtcaca

SEQ ID NO: 6908384 - DNA, 22 bp, Homo sapiens
ttttctccagggaacaaggtga

SEQ ID NO: 6908385 - DNA, 22 bp, Homo sapiens
acatttctcttgatgtctctat

SEQ ID NO: 6908386 - DNA, 22 bp, Homo sapiens
aggtcaggtatcagcaggtatt

SEQ ID NO: 6908387 - DNA, 22 bp, Homo sapiens
ttctagtttccattttaagaca

SEQ ID NO: 6908388 - DNA, 21 bp, Homo sapiens
ttatgtctctttggtgactgg

SEQ ID NO: 6908389 - DNA, 22 bp, Homo sapiens
gaactttgcgcagttcccgggg

SEQ ID NO: 6908390 - DNA, 22 bp, Homo sapiens
tgcattaggctaatatgggaga

SEQ ID NO: 6908391 - DNA, 22 bp, Homo sapiens
gctggtgtgtgaacctagggac

SEQ ID NO: 6908392 - DNA, 22 bp, Homo sapiens
ttctctggatgtttctcagtca

SEQ ID NO: 6908393 - DNA, 22 bp, Homo sapiens
cgggcagtgtggctccagagtc

SEQ ID NO: 6908394 - DNA, 22 bp, Homo sapiens
gagcagctccagccgcatgact

SEQ ID NO: 6908395 - DNA, 22 bp, Homo sapiens
ggcacctgtagttattttgttt

SEQ ID NO: 6908396 - DNA, 22 bp, Homo sapiens
ggcgaggccgggacaggctgga

SEQ ID NO: 6908397 - DNA, 22 bp, Homo sapiens
caggaagtgctcgctgtgggga

SEQ ID NO: 6908398 - DNA, 22 bp, Homo sapiens
aggcccagcttgaagtgggaag

SEQ ID NO: 6908399 - DNA, 22 bp, Homo sapiens
cacaggcacccctgactgctca

SEQ ID NO: 6908400 - DNA, 23 bp, Homo sapiens
ggagacaaggtaccacgttaaca

SEQ ID NO: 6908401 - DNA, 22 bp, Homo sapiens
acttggctgggagagttgaaga

SEQ ID NO: 6908402 - DNA, 22 bp, Homo sapiens
aggtggcagcaggagatgtgga

SEQ ID NO: 6908403 - DNA, 22 bp, Homo sapiens
ctggctgcagtagcaagagact

SEQ ID NO: 6908404 - DNA, 22 bp, Homo sapiens
cctggctgagcctccaggaaga

SEQ ID NO: 6908405 - DNA, 22 bp, Homo sapiens
ccagttctgagatgaatatcca

SEQ ID NO: 6908406 - DNA, 22 bp, Homo sapiens
gcgaaaaatgtgtaaatatgtt

SEQ ID NO: 6908407 - DNA, 23 bp, Homo sapiens
tggtctcagcctgtgagagctga

SEQ ID NO: 6908408 - DNA, 22 bp, Homo sapiens
cctgctccatgctcaccatcag

SEQ ID NO: 6908409 - DNA, 22 bp, Homo sapiens
agacaactgcagagcaaagaat

SEQ ID NO: 6908410 - DNA, 22 bp, Homo sapiens
tggagtgaagggttggcacggt

SEQ ID NO: 6908411 - DNA, 22 bp, Homo sapiens
tccaagatgtcggtcctgtcca

SEQ ID NO: 6908412 - DNA, 22 bp, Homo sapiens
taggccactctcctttgtctca

SEQ ID NO: 6908413 - DNA, 22 bp, Homo sapiens
tgaagtccctgacatttagaaa

SEQ ID NO: 6908414 - DNA, 22 bp, Homo sapiens
aagcatttcaggtagagatatt

SEQ ID NO: 6908415 - DNA, 22 bp, Homo sapiens
tgttacagggataaatgaggta

SEQ ID NO: 6908416 - DNA, 22 bp, Homo sapiens
agtgtgcatggtggaggcttgc

SEQ ID NO: 6908417 - DNA, 22 bp, Homo sapiens
aagagaggggttgcatggaaat

SEQ ID NO: 6908418 - DNA, 22 bp, Homo sapiens
caggcacttctgctgcttgtct

SEQ ID NO: 6908419 - DNA, 22 bp, Homo sapiens
ttcatgtgccagagctgaaaat

SEQ ID NO: 6908420 - DNA, 22 bp, Homo sapiens
ctgctgtgttcctcctgcatct

SEQ ID NO: 6908421 - DNA, 22 bp, Homo sapiens
ctggagctgttttttcaggaaa

SEQ ID NO: 6908422 - DNA, 22 bp, Homo sapiens
gaggaccacagatgagcctgca

SEQ ID NO: 6908423 - DNA, 22 bp, Homo sapiens
cccagagagcacaggtggtggg

SEQ ID NO: 6908424 - DNA, 22 bp, Homo sapiens
ttgctttgttactgcagtttcc

SEQ ID NO: 6908425 - DNA, 22 bp, Homo sapiens
tttcacataaatattatgccta

SEQ ID NO: 6908426 - DNA, 22 bp, Homo sapiens
gactggatacccttttctgcat

SEQ ID NO: 6908427 - DNA, 15 bp, Homo sapiens
aagaatctgaagctt

SEQ ID NO: 6908428 - DNA, 22 bp, Homo sapiens
taggacataagtattctaactt

SEQ ID NO: 6908429 - DNA, 22 bp, Homo sapiens
cattatctgccattgacaccat

SEQ ID NO: 6908430 - DNA, 22 bp, Homo sapiens
cctggctgctttcactatggag

SEQ ID NO: 6908431 - DNA, 22 bp, Homo sapiens
ggaggcctaaggtacagtttgc

SEQ ID NO: 6908432 - DNA, 22 bp, Homo sapiens
gaactttattccagaagaaagc

SEQ ID NO: 6908433 - DNA, 22 bp, Homo sapiens
ggtcttttcacagtggtttgag

SEQ ID NO: 6908434 - DNA, 22 bp, Homo sapiens
tgccaagttacacaatcagaaa

SEQ ID NO: 6908435 - DNA, 18 bp, Homo sapiens
taatccatatgctttgcc

SEQ ID NO: 6908436 - DNA, 22 bp, Homo sapiens
gcactggtcttcccagcgaact

SEQ ID NO: 6908437 - DNA, 22 bp, Homo sapiens
aaggcaattggcttgtataaga

SEQ ID NO: 6908438 - DNA, 22 bp, Homo sapiens
aagcagtatggtatttaagtca

SEQ ID NO: 6908439 - DNA, 22 bp, Homo sapiens
caagatcacacaggtaacaagt

SEQ ID NO: 6908440 - DNA, 22 bp, Homo sapiens
agctttgatagtacaggggctt

SEQ ID NO: 6908441 - DNA, 22 bp, Homo sapiens
ttgtgcattgcagcagtgcttt

SEQ ID NO: 6908442 - DNA, 22 bp, Homo sapiens
ggagcagagctgggcttggctg

SEQ ID NO: 6908443 - DNA, 22 bp, Homo sapiens
ctcttcctacagtctgctatgc

SEQ ID NO: 6908444 - DNA, 22 bp, Homo sapiens
tggctcagggtccccaaatggt

SEQ ID NO: 6908445 - DNA, 22 bp, Homo sapiens
ttccggaaggttctctagaatt

SEQ ID NO: 6908446 - DNA, 22 bp, Homo sapiens
tctgtggcctccttccacttac

SEQ ID NO: 6908447 - DNA, 22 bp, Homo sapiens
acacatttgcataatacctcat

SEQ ID NO: 6908448 - DNA, 22 bp, Homo sapiens
aaagccaggcagccaagccagt

SEQ ID NO: 6908449 - DNA, 22 bp, Homo sapiens
gggctgacagtttcccctgaaa

SEQ ID NO: 6908450 - DNA, 22 bp, Homo sapiens
agatgcaatgctgaatttgagt

SEQ ID NO: 6908451 - DNA, 23 bp, Homo sapiens
cagaacagtaaaagatgccatgg

SEQ ID NO: 6908452 - DNA, 22 bp, Homo sapiens
cagtctgtttctgagaaacaga

SEQ ID NO: 6908453 - DNA, 22 bp, Homo sapiens
aaagcccatgtggaagtacagg

SEQ ID NO: 6908454 - DNA, 23 bp, Homo sapiens
tgggccggattgtgaaggacgtg

SEQ ID NO: 6908455 - DNA, 22 bp, Homo sapiens
aactctttttttaagtgtagcc

SEQ ID NO: 6908456 - DNA, 22 bp, Homo sapiens
gaaccgctttggagtcagctat

SEQ ID NO: 6908457 - DNA, 18 bp, Homo sapiens
tcaggctctctggctaga

SEQ ID NO: 6908458 - DNA, 22 bp, Homo sapiens
tgtaagaatcagtctttaatgt

SEQ ID NO: 6908459 - DNA, 19 bp, Homo sapiens
ggctgtctcggcccagcca

SEQ ID NO: 6908460 - DNA, 22 bp, Homo sapiens
ccctccaccaagcagggcgcca

SEQ ID NO: 6908461 - DNA, 22 bp, Homo sapiens
ccccacaggtgtctgaggcagg

SEQ ID NO: 6908462 - DNA, 22 bp, Homo sapiens
tagaaattcaatgctctgagta

SEQ ID NO: 6908463 - DNA, 22 bp, Homo sapiens
gcatctcttacccacgagccag

SEQ ID NO: 6908464 - DNA, 22 bp, Homo sapiens
aaacaggcgcttactaagaaaa

SEQ ID NO: 6908465 - DNA, 22 bp, Homo sapiens
tcccaattaacaggtatcaggc

SEQ ID NO: 6908466 - DNA, 22 bp, Homo sapiens
actctgaggaatgtacaggacc

SEQ ID NO: 6908467 - DNA, 22 bp, Homo sapiens
gtctgcttttgttttactggta

SEQ ID NO: 6908468 - DNA, 17 bp, Homo sapiens
cttgttttccactggga

SEQ ID NO: 6908469 - DNA, 22 bp, Homo sapiens
tgacagcaataattttatcttc

SEQ ID NO: 6908470 - DNA, 22 bp, Homo sapiens
tatttggtatcagtgacagctg

SEQ ID NO: 6908471 - DNA, 22 bp, Homo sapiens
cagcatggacaggggtggcgtt

SEQ ID NO: 6908472 - DNA, 22 bp, Homo sapiens
gagagaaaggataacagctcaa

SEQ ID NO: 6908473 - DNA, 22 bp, Homo sapiens
aggagtgttgcttcagggaagc

SEQ ID NO: 6908474 - DNA, 22 bp, Homo sapiens
tgagatgctgctgtaacaaata

SEQ ID NO: 6908475 - DNA, 22 bp, Homo sapiens
gctgaagtggcgtgatcagaat

SEQ ID NO: 6908476 - DNA, 22 bp, Homo sapiens
tggtcctggggtgcaggctgac

SEQ ID NO: 6908477 - DNA, 22 bp, Homo sapiens
cccaaaggtttggtagatatga

SEQ ID NO: 6908478 - DNA, 21 bp, Homo sapiens
gcacatgctgtgtgtttctct

SEQ ID NO: 6908479 - DNA, 22 bp, Homo sapiens
tacactgctgggcagtgaatga

SEQ ID NO: 6908480 - DNA, 21 bp, Homo sapiens
cctcttgatttttagctctgg

SEQ ID NO: 6908481 - DNA, 22 bp, Homo sapiens
cggtggccaacaagaggccggg

SEQ ID NO: 6908482 - DNA, 22 bp, Homo sapiens
tacaaatgcctgacacacagat

SEQ ID NO: 6908483 - DNA, 19 bp, Homo sapiens
tatggcaggccgaggcact

SEQ ID NO: 6908484 - DNA, 22 bp, Homo sapiens
caggatggtcttcatttggctc

SEQ ID NO: 6908485 - DNA, 22 bp, Homo sapiens
atcagagctgcattttagagcc

SEQ ID NO: 6908486 - DNA, 22 bp, Homo sapiens
atccttgaacttagacactagg

SEQ ID NO: 6908487 - DNA, 22 bp, Homo sapiens
ctgggctgcggtggtaggttgt

SEQ ID NO: 6908488 - DNA, 22 bp, Homo sapiens
tgtgcatgcacatatatgttgc

SEQ ID NO: 6908489 - DNA, 22 bp, Homo sapiens
tatgctgagtatataaaacaga

SEQ ID NO: 6908490 - DNA, 20 bp, Homo sapiens
gaacatttggccatactgag

SEQ ID NO: 6908491 - DNA, 22 bp, Homo sapiens
gagggtcccgagccctgtcaga

SEQ ID NO: 6908492 - DNA, 22 bp, Homo sapiens
ttggcacagtaatctctcttca

SEQ ID NO: 6908493 - DNA, 22 bp, Homo sapiens
cctgtctgcggaggagtggaag

SEQ ID NO: 6908494 - DNA, 18 bp, Homo sapiens
aaaggctgaatatagaag

SEQ ID NO: 6908495 - DNA, 22 bp, Homo sapiens
taccaaagatacataaatgtga

SEQ ID NO: 6908496 - DNA, 22 bp, Homo sapiens
ttggcttcttcgcacagcagta

SEQ ID NO: 6908497 - DNA, 22 bp, Homo sapiens
caaactggctatgggaatcttg

SEQ ID NO: 6908498 - DNA, 19 bp, Homo sapiens
cctgctgaagtgatgcagc

SEQ ID NO: 6908499 - DNA, 22 bp, Homo sapiens
ttggagagaggctgctcaggct

SEQ ID NO: 6908500 - DNA, 16 bp, Homo sapiens
gcagagctcagggact

SEQ ID NO: 6908501 - DNA, 21 bp, Homo sapiens
tatcaagatgttatggttgaa

SEQ ID NO: 6908502 - DNA, 22 bp, Homo sapiens
tgaagacaagtgtgctggtgtt

SEQ ID NO: 6908503 - DNA, 22 bp, Homo sapiens
cctgaccaacgtggtgaaaccc

SEQ ID NO: 6908504 - DNA, 22 bp, Homo sapiens
agcagtccaactgaggtggcat

SEQ ID NO: 6908505 - DNA, 22 bp, Homo sapiens
ttcacagtgttgtgccttttgt

SEQ ID NO: 6908506 - DNA, 22 bp, Homo sapiens
gccccctcaaagaggaagctct

SEQ ID NO: 6908507 - DNA, 23 bp, Homo sapiens
atctaatccctactttatttccc

SEQ ID NO: 6908508 - DNA, 22 bp, Homo sapiens
ttgtggctgtcgagaattgagg

SEQ ID NO: 6908509 - DNA, 22 bp, Homo sapiens
tcacatctaattcggttaggtt

SEQ ID NO: 6908510 - DNA, 17 bp, Homo sapiens
tcacatcacacaagcaa

SEQ ID NO: 6908511 - DNA, 22 bp, Homo sapiens
tttggggccagccccatgtctg

SEQ ID NO: 6908512 - DNA, 22 bp, Homo sapiens
ctgctccccagcctgcgccttt

SEQ ID NO: 6908513 - DNA, 22 bp, Homo sapiens
gaacttgttgtaagaaaatatg

SEQ ID NO: 6908514 - DNA, 22 bp, Homo sapiens
ttcataggagagaagaaagtgt

SEQ ID NO: 6908515 - DNA, 22 bp, Homo sapiens
tctgtccagaataccctggcct

SEQ ID NO: 6908516 - DNA, 22 bp, Homo sapiens
gtatatcagacactcatatgta

SEQ ID NO: 6908517 - DNA, 22 bp, Homo sapiens
agtgacagtctgatttctcaaa

SEQ ID NO: 6908518 - DNA, 22 bp, Homo sapiens
gggagctggttcctgccctcca

SEQ ID NO: 6908519 - DNA, 22 bp, Homo sapiens
tctcttggaaagcttgcccact

SEQ ID NO: 6908520 - DNA, 22 bp, Homo sapiens
atggtttacttcatccaatcta

SEQ ID NO: 6908521 - DNA, 22 bp, Homo sapiens
aaaatccacaacgctcatttca

SEQ ID NO: 6908522 - DNA, 22 bp, Homo sapiens
gcttggcatacacttagtgcgt

SEQ ID NO: 6908523 - DNA, 22 bp, Homo sapiens
agtctccttggcctcaatgcct

SEQ ID NO: 6908524 - DNA, 22 bp, Homo sapiens
agcagaggtttgttggaaacct

SEQ ID NO: 6908525 - DNA, 22 bp, Homo sapiens
tactttttagcacagtgtgtgc

SEQ ID NO: 6908526 - DNA, 22 bp, Homo sapiens
agccagtttgcttgtaataaca

SEQ ID NO: 6908527 - DNA, 22 bp, Homo sapiens
tgaccaaaggtggtttatttgg

SEQ ID NO: 6908528 - DNA, 22 bp, Homo sapiens
ctgccaggactgacgtcttcag

SEQ ID NO: 6908529 - DNA, 22 bp, Homo sapiens
atctatatcatggggtaaggta

SEQ ID NO: 6908530 - DNA, 22 bp, Homo sapiens
atttgcttcatagatctgtgga

SEQ ID NO: 6908531 - DNA, 23 bp, Homo sapiens
agcagccctgggacctggcctgc

SEQ ID NO: 6908532 - DNA, 22 bp, Homo sapiens
agctgctctgggaaacagaagt

SEQ ID NO: 6908533 - DNA, 22 bp, Homo sapiens
tcctggcacccttgggttggag

SEQ ID NO: 6908534 - DNA, 22 bp, Homo sapiens
gtctccagcccactctagatat

SEQ ID NO: 6908535 - DNA, 23 bp, Homo sapiens
tggtccctgagagctggggaggg

SEQ ID NO: 6908536 - DNA, 22 bp, Homo sapiens
gcattacaggctgtaagatgca

SEQ ID NO: 6908537 - DNA, 22 bp, Homo sapiens
ccagggaagaataggtgtggtt

SEQ ID NO: 6908538 - DNA, 22 bp, Homo sapiens
tttttgattcctagtctaggca

SEQ ID NO: 6908539 - DNA, 22 bp, Homo sapiens
tagagcccatgtacccgctatt

SEQ ID NO: 6908540 - DNA, 22 bp, Homo sapiens
agcagtcaggcctcagagccgt

SEQ ID NO: 6908541 - DNA, 22 bp, Homo sapiens
tctcaagctagtgtttatagta

SEQ ID NO: 6908542 - DNA, 21 bp, Homo sapiens
aaggaatgaatggatggatga

SEQ ID NO: 6908543 - DNA, 22 bp, Homo sapiens
ttaatctcttagcaaattaatg

SEQ ID NO: 6908544 - DNA, 22 bp, Homo sapiens
aatgtaaaatatcttgtacttg

SEQ ID NO: 6908545 - DNA, 21 bp, Homo sapiens
aggcattataaatttcacctg

SEQ ID NO: 6908546 - DNA, 22 bp, Homo sapiens
tgtctgaggaagtcagcccttt

SEQ ID NO: 6908547 - DNA, 22 bp, Homo sapiens
ttctccccaactccatcaacac

SEQ ID NO: 6908548 - DNA, 22 bp, Homo sapiens
atacatagtaccacatttgaca

SEQ ID NO: 6908549 - DNA, 22 bp, Homo sapiens
atgttcttggatgttgtgtata

SEQ ID NO: 6908550 - DNA, 22 bp, Homo sapiens
tccagaaaaagtaatttatttg

SEQ ID NO: 6908551 - DNA, 22 bp, Homo sapiens
atgtggttttggattattcatg

SEQ ID NO: 6908552 - DNA, 22 bp, Homo sapiens
ggtgtcagactttgcatatcct

SEQ ID NO: 6908553 - DNA, 20 bp, Homo sapiens
gccaataaactgttagcagg

SEQ ID NO: 6908554 - DNA, 22 bp, Homo sapiens
catgtctactgaggctttatgg

SEQ ID NO: 6908555 - DNA, 22 bp, Homo sapiens
atgtggcaccgatctttagcca

SEQ ID NO: 6908556 - DNA, 22 bp, Homo sapiens
tccttacaacttgttatttttc

SEQ ID NO: 6908557 - DNA, 22 bp, Homo sapiens
tgtatttctgctttctctagta

SEQ ID NO: 6908558 - DNA, 22 bp, Homo sapiens
atgatttctatataaacttaaa

SEQ ID NO: 6908559 - DNA, 22 bp, Homo sapiens
ggagataatccagggagggact

SEQ ID NO: 6908560 - DNA, 17 bp, Homo sapiens
tcagggaatgaggttgt

SEQ ID NO: 6908561 - DNA, 22 bp, Homo sapiens
ggaattctgaattaaggaggct

SEQ ID NO: 6908562 - DNA, 22 bp, Homo sapiens
caggcccatctgctcccaggct

SEQ ID NO: 6908563 - DNA, 22 bp, Homo sapiens
cccaggctcccaggtgggacaa

SEQ ID NO: 6908564 - DNA, 19 bp, Homo sapiens
agagtctgtgctcttccta

SEQ ID NO: 6908565 - DNA, 22 bp, Homo sapiens
tgcagtcctggtgaggggacat

SEQ ID NO: 6908566 - DNA, 22 bp, Homo sapiens
tctttctgaatatttgacctca

SEQ ID NO: 6908567 - DNA, 18 bp, Homo sapiens
cagggctgtggggtcact

SEQ ID NO: 6908568 - DNA, 22 bp, Homo sapiens
tctaggtagagtggaccttgct

SEQ ID NO: 6908569 - DNA, 22 bp, Homo sapiens
aaatgatgctcacagattagtg

SEQ ID NO: 6908570 - DNA, 22 bp, Homo sapiens
cggagcctgcttgttgcagctg

SEQ ID NO: 6908571 - DNA, 22 bp, Homo sapiens
tttatacttcataatgtctatt

SEQ ID NO: 6908572 - DNA, 21 bp, Homo sapiens
attattataaagaccacaggg

SEQ ID NO: 6908573 - DNA, 20 bp, Homo sapiens
ctggagtctaggagtactgg

SEQ ID NO: 6908574 - DNA, 22 bp, Homo sapiens
cccagggaggcccaggctctgc

SEQ ID NO: 6908575 - DNA, 22 bp, Homo sapiens
aggaagaaacctactagagttt

SEQ ID NO: 6908576 - DNA, 22 bp, Homo sapiens
cctctggctcacagcaccaact

SEQ ID NO: 6908577 - DNA, 22 bp, Homo sapiens
tctccaggaaagacactggact

SEQ ID NO: 6908578 - DNA, 22 bp, Homo sapiens
cagaagggcagcactgggaagg

SEQ ID NO: 6908579 - DNA, 21 bp, Homo sapiens
acatgtacacatgtatgcaca

SEQ ID NO: 6908580 - DNA, 22 bp, Homo sapiens
tctgggagcagatgatggtata

SEQ ID NO: 6908581 - DNA, 22 bp, Homo sapiens
tacagtttccaagggcttgaag

SEQ ID NO: 6908582 - DNA, 22 bp, Homo sapiens
gagcatctgatgagattggatt

SEQ ID NO: 6908583 - DNA, 22 bp, Homo sapiens
aaaggtttatttaatcagggag

SEQ ID NO: 6908584 - DNA, 22 bp, Homo sapiens
gttcagtttgacaacctttata

SEQ ID NO: 6908585 - DNA, 22 bp, Homo sapiens
tacattgagaaccactgcttag

SEQ ID NO: 6908586 - DNA, 22 bp, Homo sapiens
tttacacgtcacattagcggag

SEQ ID NO: 6908587 - DNA, 22 bp, Homo sapiens
agcactatgtaattagtaagta

SEQ ID NO: 6908588 - DNA, 19 bp, Homo sapiens
gtcttggctctcaaccatc

SEQ ID NO: 6908589 - DNA, 22 bp, Homo sapiens
tgctgtgttaaatacaagcatg

SEQ ID NO: 6908590 - DNA, 20 bp, Homo sapiens
cattggcattcacagaagct

SEQ ID NO: 6908591 - DNA, 22 bp, Homo sapiens
ttacttgaaagcctttgattta

SEQ ID NO: 6908592 - DNA, 22 bp, Homo sapiens
attccaggcagaccagagagat

SEQ ID NO: 6908593 - DNA, 22 bp, Homo sapiens
gagctctatgtggctggcatgt

SEQ ID NO: 6908594 - DNA, 22 bp, Homo sapiens
agaatgaagatgacttcggaga

SEQ ID NO: 6908595 - DNA, 22 bp, Homo sapiens
ttcagaataatgtgttagagaa

SEQ ID NO: 6908596 - DNA, 22 bp, Homo sapiens
tattcagagtgtagcaaataga

SEQ ID NO: 6908597 - DNA, 22 bp, Homo sapiens
cagtggtatttgagagaatgga

SEQ ID NO: 6908598 - DNA, 22 bp, Homo sapiens
tccaggagtcctgggagtgatt

SEQ ID NO: 6908599 - DNA, 22 bp, Homo sapiens
tgagtcttctgcctaaagaagt

SEQ ID NO: 6908600 - DNA, 22 bp, Homo sapiens
gagttctgttacgtgtcaccaa

SEQ ID NO: 6908601 - DNA, 22 bp, Homo sapiens
ctggccagtgactgctcacccg

SEQ ID NO: 6908602 - DNA, 22 bp, Homo sapiens
gtggcagtcggaagtcaggaga

SEQ ID NO: 6908603 - DNA, 22 bp, Homo sapiens
tctatttgttctcaggatcatc

SEQ ID NO: 6908604 - DNA, 22 bp, Homo sapiens
gtcaacaagtagttttcttcca

SEQ ID NO: 6908605 - DNA, 22 bp, Homo sapiens
cttattcttgtcttattgtgct

SEQ ID NO: 6908606 - DNA, 22 bp, Homo sapiens
taatactagtgaatagcaggat

SEQ ID NO: 6908607 - DNA, 22 bp, Homo sapiens
taaccatattcacactatgccc

SEQ ID NO: 6908608 - DNA, 22 bp, Homo sapiens
caatctggtgaagcagaaaaat

SEQ ID NO: 6908609 - DNA, 22 bp, Homo sapiens
cctgccagcccgcgttcatgcc

SEQ ID NO: 6908610 - DNA, 22 bp, Homo sapiens
ttatttactggatggccttggg

SEQ ID NO: 6908611 - DNA, 22 bp, Homo sapiens
tatctgtcgggagtcttccgga

SEQ ID NO: 6908612 - DNA, 22 bp, Homo sapiens
tgcaccacccgtgggaggactg

SEQ ID NO: 6908613 - DNA, 22 bp, Homo sapiens
gaagcaattaagtttgtgatct

SEQ ID NO: 6908614 - DNA, 22 bp, Homo sapiens
ggcacctgtctgctcacagtga

SEQ ID NO: 6908615 - DNA, 23 bp, Homo sapiens
gctctttgttcatgtggatgcct

SEQ ID NO: 6908616 - DNA, 22 bp, Homo sapiens
tccctgcaggtggggtggccag

SEQ ID NO: 6908617 - DNA, 22 bp, Homo sapiens
cttctagatttttgtaattgtt

SEQ ID NO: 6908618 - DNA, 22 bp, Homo sapiens
ggtttcaaagtggacagttagt

SEQ ID NO: 6908619 - DNA, 22 bp, Homo sapiens
attaggctctttgtgctagtta

SEQ ID NO: 6908620 - DNA, 22 bp, Homo sapiens
tgtaggaaagttgtgagtctgg

SEQ ID NO: 6908621 - DNA, 22 bp, Homo sapiens
tcttgtaggtactggtttgctg

SEQ ID NO: 6908622 - DNA, 22 bp, Homo sapiens
cctagcagggagaggatacctg

SEQ ID NO: 6908623 - DNA, 22 bp, Homo sapiens
attgttttattaaatgagccct

SEQ ID NO: 6908624 - DNA, 22 bp, Homo sapiens
gctgtggctttctgtttctgtt

SEQ ID NO: 6908625 - DNA, 22 bp, Homo sapiens
tctctgtctcccgtgtgtccgg

SEQ ID NO: 6908626 - DNA, 22 bp, Homo sapiens
caggccggggcggcgccatctt

SEQ ID NO: 6908627 - DNA, 19 bp, Homo sapiens
taacttgtagatatgaagt

SEQ ID NO: 6908628 - DNA, 22 bp, Homo sapiens
tttctgtacacccactattcat

SEQ ID NO: 6908629 - DNA, 22 bp, Homo sapiens
ctcaagaggatatgtccagaaa

SEQ ID NO: 6908630 - DNA, 22 bp, Homo sapiens
ggtagcgttatcaatttgagtg

SEQ ID NO: 6908631 - DNA, 22 bp, Homo sapiens
gactgaggtaagtgaaataagc

SEQ ID NO: 6908632 - DNA, 22 bp, Homo sapiens
ccagtgatttagtacaatgtag

SEQ ID NO: 6908633 - DNA, 22 bp, Homo sapiens
tcgggggcttgaggatcaaatg

SEQ ID NO: 6908634 - DNA, 22 bp, Homo sapiens
atgtaaacaaggttattgtcca

SEQ ID NO: 6908635 - DNA, 22 bp, Homo sapiens
tatctaagagagtcaatattta

SEQ ID NO: 6908636 - DNA, 22 bp, Homo sapiens
gtgattctgtgtgtaaatttta

SEQ ID NO: 6908637 - DNA, 22 bp, Homo sapiens
tgttacaatattatcaactgag

SEQ ID NO: 6908638 - DNA, 22 bp, Homo sapiens
atttcctatttcttgtccccta

SEQ ID NO: 6908639 - DNA, 22 bp, Homo sapiens
gaagataactttaaaaagtggc

SEQ ID NO: 6908640 - DNA, 22 bp, Homo sapiens
tttagcaagatgccctggcttt

SEQ ID NO: 6908641 - DNA, 22 bp, Homo sapiens
tggcttatcacattgtccatgg

SEQ ID NO: 6908642 - DNA, 22 bp, Homo sapiens
agttctgggccctgggttgctt

SEQ ID NO: 6908643 - DNA, 22 bp, Homo sapiens
tgttagacataattgggagtat

SEQ ID NO: 6908644 - DNA, 22 bp, Homo sapiens
gttgaaatttgtgataatttag

SEQ ID NO: 6908645 - DNA, 22 bp, Homo sapiens
gacaaggtgataatagcttctg

SEQ ID NO: 6908646 - DNA, 23 bp, Homo sapiens
aacacattgctaattacattcaa

SEQ ID NO: 6908647 - DNA, 22 bp, Homo sapiens
ttgggcaggtgaagagagggct

SEQ ID NO: 6908648 - DNA, 22 bp, Homo sapiens
ctcttccatattactcagggta

SEQ ID NO: 6908649 - DNA, 19 bp, Homo sapiens
gccagcagaatgatgaggc

SEQ ID NO: 6908650 - DNA, 22 bp, Homo sapiens
tctgtcactgagctcaggattc

SEQ ID NO: 6908651 - DNA, 22 bp, Homo sapiens
agcaatgttggcctatatacct

SEQ ID NO: 6908652 - DNA, 22 bp, Homo sapiens
gggcatgcttccttgcttgctt

SEQ ID NO: 6908653 - DNA, 22 bp, Homo sapiens
cggggcgctgggatcccgcccg

SEQ ID NO: 6908654 - DNA, 22 bp, Homo sapiens
tgcaggccagggtagggactag

SEQ ID NO: 6908655 - DNA, 22 bp, Homo sapiens
agccagcacggatttcccagga

SEQ ID NO: 6908656 - DNA, 20 bp, Homo sapiens
gggctctgcatccatcagcc

SEQ ID NO: 6908657 - DNA, 22 bp, Homo sapiens
aaaggctttgagaagtcctgca

SEQ ID NO: 6908658 - DNA, 22 bp, Homo sapiens
aagtgacagtttacaattctta

SEQ ID NO: 6908659 - DNA, 22 bp, Homo sapiens
gctgggccctgggtgccctagc

SEQ ID NO: 6908660 - DNA, 22 bp, Homo sapiens
gggacagtggctgtgtcagttt

SEQ ID NO: 6908661 - DNA, 22 bp, Homo sapiens
aaagcaatagtaatggtaatag

SEQ ID NO: 6908662 - DNA, 22 bp, Homo sapiens
ggagacaatggaggccaaaaga

SEQ ID NO: 6908663 - DNA, 22 bp, Homo sapiens
tgggacttgcccatttctcctt

SEQ ID NO: 6908664 - DNA, 22 bp, Homo sapiens
ttaccatgggcctgaatggagc

SEQ ID NO: 6908665 - DNA, 22 bp, Homo sapiens
tgtgcctcaccctgctcttggc

SEQ ID NO: 6908666 - DNA, 22 bp, Homo sapiens
agagccttgctctaaatttctc

SEQ ID NO: 6908667 - DNA, 22 bp, Homo sapiens
tttataacatttcttacctgtg

SEQ ID NO: 6908668 - DNA, 22 bp, Homo sapiens
atcccaagctctacaagtgatt

SEQ ID NO: 6908669 - DNA, 22 bp, Homo sapiens
tggacaggctcctaggggttcc

SEQ ID NO: 6908670 - DNA, 22 bp, Homo sapiens
catttacctttaattaaaacac

SEQ ID NO: 6908671 - DNA, 22 bp, Homo sapiens
atctcaggaggaccctgatgct

SEQ ID NO: 6908672 - DNA, 22 bp, Homo sapiens
tcagctatgttaatagccttct

SEQ ID NO: 6908673 - DNA, 22 bp, Homo sapiens
ggtttgaacagctttggagaag

SEQ ID NO: 6908674 - DNA, 22 bp, Homo sapiens
ctggccctatgagcctcctgat

SEQ ID NO: 6908675 - DNA, 20 bp, Homo sapiens
acagataccagggacatggg

SEQ ID NO: 6908676 - DNA, 17 bp, Homo sapiens
tttgagctggaccctgg

SEQ ID NO: 6908677 - DNA, 22 bp, Homo sapiens
aaaatgtaaagcttgagtgtag

SEQ ID NO: 6908678 - DNA, 22 bp, Homo sapiens
aaatacaggagtttggacttct

SEQ ID NO: 6908679 - DNA, 22 bp, Homo sapiens
aaggctcaattaactaagaagt

SEQ ID NO: 6908680 - DNA, 22 bp, Homo sapiens
tcactggggccatgtgagggac

SEQ ID NO: 6908681 - DNA, 22 bp, Homo sapiens
cttctgtgttttactatatgta

SEQ ID NO: 6908682 - DNA, 22 bp, Homo sapiens
agtttgacaaagtaaaatgaca

SEQ ID NO: 6908683 - DNA, 22 bp, Homo sapiens
ggactggtctgagagggattca

SEQ ID NO: 6908684 - DNA, 22 bp, Homo sapiens
ttccatcacatcactgaagaca

SEQ ID NO: 6908685 - DNA, 22 bp, Homo sapiens
ctctggctgcctctcaggcctg

SEQ ID NO: 6908686 - DNA, 22 bp, Homo sapiens
aatatttgcatcattagctatt

SEQ ID NO: 6908687 - DNA, 22 bp, Homo sapiens
tttaaaaggcagcttcttttgt

SEQ ID NO: 6908688 - DNA, 22 bp, Homo sapiens
ctggctgtcttggaggaaggag

SEQ ID NO: 6908689 - DNA, 22 bp, Homo sapiens
ttaaacaccacagcagtcccta

SEQ ID NO: 6908690 - DNA, 22 bp, Homo sapiens
gggtgggaacaggatgccagga

SEQ ID NO: 6908691 - DNA, 22 bp, Homo sapiens
caggcagcctgagggatctggg

SEQ ID NO: 6908692 - DNA, 22 bp, Homo sapiens
ccaacatttctcggtgctctgt

SEQ ID NO: 6908693 - DNA, 22 bp, Homo sapiens
cacacatggttccgcaggatgc

SEQ ID NO: 6908694 - DNA, 22 bp, Homo sapiens
aaatgtccattgaatggatgag

SEQ ID NO: 6908695 - DNA, 22 bp, Homo sapiens
gaagatttgaaacacatagaca

SEQ ID NO: 6908696 - DNA, 22 bp, Homo sapiens
attctgatgcctgggtactgcc

SEQ ID NO: 6908697 - DNA, 22 bp, Homo sapiens
agcaggtgagcacagccaggct

SEQ ID NO: 6908698 - DNA, 22 bp, Homo sapiens
tttcagataaatatgggactaa

SEQ ID NO: 6908699 - DNA, 22 bp, Homo sapiens
ggaagctctgtggcttggagtc

SEQ ID NO: 6908700 - DNA, 22 bp, Homo sapiens
cagctgtctttgcacagtttag

SEQ ID NO: 6908701 - DNA, 22 bp, Homo sapiens
ccaggagctggcatgtggagag

SEQ ID NO: 6908702 - DNA, 22 bp, Homo sapiens
agggctcaatggtgggcatgta

SEQ ID NO: 6908703 - DNA, 22 bp, Homo sapiens
gcaggaacagtttatctctggc

SEQ ID NO: 6908704 - DNA, 22 bp, Homo sapiens
tggctgttggagctggaagatg

SEQ ID NO: 6908705 - DNA, 22 bp, Homo sapiens
tgcagagtagctataccatttt

SEQ ID NO: 6908706 - DNA, 22 bp, Homo sapiens
ttaagaggagatcatactggag

SEQ ID NO: 6908707 - DNA, 22 bp, Homo sapiens
gagacttagagctccttgaggg

SEQ ID NO: 6908708 - DNA, 22 bp, Homo sapiens
tagctttgccatctgtcacata

SEQ ID NO: 6908709 - DNA, 22 bp, Homo sapiens
tgaaaacttgacaagtgaggta

SEQ ID NO: 6908710 - DNA, 22 bp, Homo sapiens
caggtggtgcctccaggctggt

SEQ ID NO: 6908711 - DNA, 22 bp, Homo sapiens
ttgtatttatattgaatagctt

SEQ ID NO: 6908712 - DNA, 23 bp, Homo sapiens
agcctcttttctcctgccctgca

SEQ ID NO: 6908713 - DNA, 22 bp, Homo sapiens
taggacagtttactttggttac

SEQ ID NO: 6908714 - DNA, 22 bp, Homo sapiens
gctgattattacatgtctgtgg

SEQ ID NO: 6908715 - DNA, 22 bp, Homo sapiens
atgcagcttccatattttgctg

SEQ ID NO: 6908716 - DNA, 22 bp, Homo sapiens
attgaaaggcaaagtaggaagc

SEQ ID NO: 6908717 - DNA, 21 bp, Homo sapiens
tgctctggtgttttatttaac

SEQ ID NO: 6908718 - DNA, 22 bp, Homo sapiens
gatggggtccttgacctggcca

SEQ ID NO: 6908719 - DNA, 22 bp, Homo sapiens
tctttacaatctaagcatagtt

SEQ ID NO: 6908720 - DNA, 22 bp, Homo sapiens
cacaatttgtttgctcttagtc

SEQ ID NO: 6908721 - DNA, 22 bp, Homo sapiens
agaggcttacaaagattgatga

SEQ ID NO: 6908722 - DNA, 22 bp, Homo sapiens
agaagtactggcagaagattgg

SEQ ID NO: 6908723 - DNA, 22 bp, Homo sapiens
aatccttatataatgccttcca

SEQ ID NO: 6908724 - DNA, 22 bp, Homo sapiens
atttatgacagaagatatgctg

SEQ ID NO: 6908725 - DNA, 22 bp, Homo sapiens
cagtgtcttatttgtagctcag

SEQ ID NO: 6908726 - DNA, 22 bp, Homo sapiens
gtcaatgctttagtttctggta

SEQ ID NO: 6908727 - DNA, 22 bp, Homo sapiens
ctgaaaatgttagtgatacgaa

SEQ ID NO: 6908728 - DNA, 19 bp, Homo sapiens
ggggtgctagggagggatc

SEQ ID NO: 6908729 - DNA, 22 bp, Homo sapiens
gacagggaggagcagagcttct

SEQ ID NO: 6908730 - DNA, 22 bp, Homo sapiens
agcagagcccttccatggcctt

SEQ ID NO: 6908731 - DNA, 22 bp, Homo sapiens
gtgcagctgaaggctggccagc

SEQ ID NO: 6908732 - DNA, 22 bp, Homo sapiens
ataggcatcacctaggagcttg

SEQ ID NO: 6908733 - DNA, 18 bp, Homo sapiens
tcagcttttgaaaaccaa

SEQ ID NO: 6908734 - DNA, 22 bp, Homo sapiens
tctgcctggcctggagggcaca

SEQ ID NO: 6908735 - DNA, 22 bp, Homo sapiens
cagagtatttctctttggggag

SEQ ID NO: 6908736 - DNA, 22 bp, Homo sapiens
tttgtgcacattgcttttctat

SEQ ID NO: 6908737 - DNA, 22 bp, Homo sapiens
taggatttaggctttaacatct

SEQ ID NO: 6908738 - DNA, 22 bp, Homo sapiens
aagtaatctggaatttggtttt

SEQ ID NO: 6908739 - DNA, 22 bp, Homo sapiens
aacttttcataagggcaaattt

SEQ ID NO: 6908740 - DNA, 22 bp, Homo sapiens
tgctgtgacagagtctcatgga

SEQ ID NO: 6908741 - DNA, 18 bp, Homo sapiens
gctgagcaaattcctccc

SEQ ID NO: 6908742 - DNA, 22 bp, Homo sapiens
cattagcacatgacggaaagca

SEQ ID NO: 6908743 - DNA, 22 bp, Homo sapiens
gaatacatctgaaggctatgaa

SEQ ID NO: 6908744 - DNA, 22 bp, Homo sapiens
ctcctggccctgagctcccagg

SEQ ID NO: 6908745 - DNA, 22 bp, Homo sapiens
ctggaggctggcttcccctggc

SEQ ID NO: 6908746 - DNA, 22 bp, Homo sapiens
ctttatggtaagtatagatgac

SEQ ID NO: 6908747 - DNA, 22 bp, Homo sapiens
agatgtggttattctcttcctt

SEQ ID NO: 6908748 - DNA, 22 bp, Homo sapiens
gctctgagctcagcgtcagagt

SEQ ID NO: 6908749 - DNA, 22 bp, Homo sapiens
caaattccattcatgctccctt

SEQ ID NO: 6908750 - DNA, 22 bp, Homo sapiens
tttagcattactaaaatgaaaa

SEQ ID NO: 6908751 - DNA, 22 bp, Homo sapiens
gttgttgctatgttattgttat

SEQ ID NO: 6908752 - DNA, 22 bp, Homo sapiens
tccaagatggttggtgtggtgg

SEQ ID NO: 6908753 - DNA, 22 bp, Homo sapiens
aggagctagccaggcatatgca

SEQ ID NO: 6908754 - DNA, 22 bp, Homo sapiens
atttcctatcctggtcttaaaa

SEQ ID NO: 6908755 - DNA, 22 bp, Homo sapiens
gatatactgtctgtattacata

SEQ ID NO: 6908756 - DNA, 22 bp, Homo sapiens
tgttaatcaacaacaaacagtg

SEQ ID NO: 6908757 - DNA, 22 bp, Homo sapiens
cactggggaaaacaggcttctt

SEQ ID NO: 6908758 - DNA, 22 bp, Homo sapiens
tggagctcaaaggcctgtggga

SEQ ID NO: 6908759 - DNA, 22 bp, Homo sapiens
tgtccctaaagaaacagacatt

SEQ ID NO: 6908760 - DNA, 22 bp, Homo sapiens
actttgccatgttgtatgacta

SEQ ID NO: 6908761 - DNA, 22 bp, Homo sapiens
gacagctggcagtggaaaggtg

SEQ ID NO: 6908762 - DNA, 21 bp, Homo sapiens
taaaactgtaactttgtcctg

SEQ ID NO: 6908763 - DNA, 22 bp, Homo sapiens
attcagcaaacatttattatct

SEQ ID NO: 6908764 - DNA, 20 bp, Homo sapiens
gcctgtgtcttctctgctgt

SEQ ID NO: 6908765 - DNA, 22 bp, Homo sapiens
tgtattttcagagtggcatttc

SEQ ID NO: 6908766 - DNA, 22 bp, Homo sapiens
gtggcgagtgcagcagatgcag

SEQ ID NO: 6908767 - DNA, 22 bp, Homo sapiens
ccagcagaggggcggagtgcag

SEQ ID NO: 6908768 - DNA, 22 bp, Homo sapiens
tcaggaagaaagaagggagtgt

SEQ ID NO: 6908769 - DNA, 22 bp, Homo sapiens
tgattccatggtcaattccagg

SEQ ID NO: 6908770 - DNA, 22 bp, Homo sapiens
gccttgagctgcacggccaggt

SEQ ID NO: 6908771 - DNA, 22 bp, Homo sapiens
gaagtgtgcacatcttacaagt

SEQ ID NO: 6908772 - DNA, 22 bp, Homo sapiens
taacaaggcaatttgtgatcct

SEQ ID NO: 6908773 - DNA, 22 bp, Homo sapiens
ccacagtgatccctgcctgcga

SEQ ID NO: 6908774 - DNA, 22 bp, Homo sapiens
catcaagagtcttactatcagt

SEQ ID NO: 6908775 - DNA, 22 bp, Homo sapiens
gttacaagtgagatttaggaga

SEQ ID NO: 6908776 - DNA, 22 bp, Homo sapiens
gttcagcttacaaaatacacct

SEQ ID NO: 6908777 - DNA, 22 bp, Homo sapiens
aggggtgacacatatcagtgca

SEQ ID NO: 6908778 - DNA, 22 bp, Homo sapiens
cactgttcatcaaaactgctct

SEQ ID NO: 6908779 - DNA, 22 bp, Homo sapiens
tgccaagtttctctcagggact

SEQ ID NO: 6908780 - DNA, 22 bp, Homo sapiens
agtagatagagtaagataccga

SEQ ID NO: 6908781 - DNA, 23 bp, Homo sapiens
gggtccagagacaggcatgggtg

SEQ ID NO: 6908782 - DNA, 20 bp, Homo sapiens
ctcttagtactgttcctggt

SEQ ID NO: 6908783 - DNA, 22 bp, Homo sapiens
gtgaacctctgaaaggcagtga

SEQ ID NO: 6908784 - DNA, 23 bp, Homo sapiens
tctgtcacctatggctgctcttc

SEQ ID NO: 6908785 - DNA, 22 bp, Homo sapiens
tgtctgtcggatgcaatttgta

SEQ ID NO: 6908786 - DNA, 22 bp, Homo sapiens
tctgaggacaaactgcatgctg

SEQ ID NO: 6908787 - DNA, 22 bp, Homo sapiens
ccaggctagaaactgaggcaca

SEQ ID NO: 6908788 - DNA, 22 bp, Homo sapiens
ctgcaaatgcctcggtgtgcgg

SEQ ID NO: 6908789 - DNA, 18 bp, Homo sapiens
tttgtacccttttcctag

SEQ ID NO: 6908790 - DNA, 19 bp, Homo sapiens
ttcaactgagccagtctgg

SEQ ID NO: 6908791 - DNA, 22 bp, Homo sapiens
aagttacacattttcattgtaa

SEQ ID NO: 6908792 - DNA, 22 bp, Homo sapiens
ctctccaggagagcactttgag

SEQ ID NO: 6908793 - DNA, 22 bp, Homo sapiens
gtcatggtgctcatcattggtg

SEQ ID NO: 6908794 - DNA, 22 bp, Homo sapiens
atggctttggtgtgaccctggg

SEQ ID NO: 6908795 - DNA, 22 bp, Homo sapiens
atctggagcagggccacaaggc

SEQ ID NO: 6908796 - DNA, 22 bp, Homo sapiens
gctcaggcatgtatgtggttgc

SEQ ID NO: 6908797 - DNA, 22 bp, Homo sapiens
gttacctgaacaagatgttaat

SEQ ID NO: 6908798 - DNA, 22 bp, Homo sapiens
taccagaatcattttatgttgg

SEQ ID NO: 6908799 - DNA, 22 bp, Homo sapiens
agggatgtgcagcatccagaca

SEQ ID NO: 6908800 - DNA, 22 bp, Homo sapiens
tgcagcccttccttcctctggg

SEQ ID NO: 6908801 - DNA, 22 bp, Homo sapiens
ccagaggttactttgccttgga

SEQ ID NO: 6908802 - DNA, 22 bp, Homo sapiens
cacgggctgtttccatgcaaaa

SEQ ID NO: 6908803 - DNA, 22 bp, Homo sapiens
tgcagaggctggctcgccgggt

SEQ ID NO: 6908804 - DNA, 22 bp, Homo sapiens
agctgaaattctttgtcctcag

SEQ ID NO: 6908805 - DNA, 22 bp, Homo sapiens
aggagggagcttaagccaggca

SEQ ID NO: 6908806 - DNA, 22 bp, Homo sapiens
cttggaacaaattaaacaatac

SEQ ID NO: 6908807 - DNA, 22 bp, Homo sapiens
aagtcaatttatgttctcagac

SEQ ID NO: 6908808 - DNA, 22 bp, Homo sapiens
aaagaacaatgtggaatctcct

SEQ ID NO: 6908809 - DNA, 22 bp, Homo sapiens
atgctggtctgcagagttggga

SEQ ID NO: 6908810 - DNA, 22 bp, Homo sapiens
tatagcaagcaggacagtctca

SEQ ID NO: 6908811 - DNA, 22 bp, Homo sapiens
cccagaattattctcttctcct

SEQ ID NO: 6908812 - DNA, 22 bp, Homo sapiens
ttccactctatgatagaagggt

SEQ ID NO: 6908813 - DNA, 22 bp, Homo sapiens
atgtatatgtgaaagatgttta

SEQ ID NO: 6908814 - DNA, 22 bp, Homo sapiens
agcgggctcaagtggccagcag

SEQ ID NO: 6908815 - DNA, 22 bp, Homo sapiens
cgggtcccctcgggaggctgct

SEQ ID NO: 6908816 - DNA, 22 bp, Homo sapiens
cccgactagctgggattacagg

SEQ ID NO: 6908817 - DNA, 22 bp, Homo sapiens
gctgattttgagaagcacagtc

SEQ ID NO: 6908818 - DNA, 18 bp, Homo sapiens
acagcaggtttcattctt

SEQ ID NO: 6908819 - DNA, 22 bp, Homo sapiens
tgtatgtaaaggtcttcatgtt

SEQ ID NO: 6908820 - DNA, 22 bp, Homo sapiens
gcagtcaaagattggaccaatt

SEQ ID NO: 6908821 - DNA, 22 bp, Homo sapiens
ggggagaattacatggcgtgga

SEQ ID NO: 6908822 - DNA, 22 bp, Homo sapiens
attagaatgacagaaatgaggc

SEQ ID NO: 6908823 - DNA, 22 bp, Homo sapiens
cttacattgtcttagttttcaa

SEQ ID NO: 6908824 - DNA, 22 bp, Homo sapiens
ttggggcagagaggatacggca

SEQ ID NO: 6908825 - DNA, 22 bp, Homo sapiens
ctgactgagaactcatgagtta

SEQ ID NO: 6908826 - DNA, 22 bp, Homo sapiens
ggctctgaacatggggaggagt

SEQ ID NO: 6908827 - DNA, 22 bp, Homo sapiens
gatgtctttttccaggctcttt

SEQ ID NO: 6908828 - DNA, 22 bp, Homo sapiens
tcattcattctttctgaatata

SEQ ID NO: 6908829 - DNA, 22 bp, Homo sapiens
catgcataggaaatgttttttg

SEQ ID NO: 6908830 - DNA, 22 bp, Homo sapiens
ttgggagcttggccgagatgta

SEQ ID NO: 6908831 - DNA, 22 bp, Homo sapiens
tggaaaggacagttgctgatag

SEQ ID NO: 6908832 - DNA, 22 bp, Homo sapiens
acaaaggcatagtgaatgtttt

SEQ ID NO: 6908833 - DNA, 22 bp, Homo sapiens
atggcctggggattcctgagca

SEQ ID NO: 6908834 - DNA, 22 bp, Homo sapiens
cagagcccctcagctctctccc

SEQ ID NO: 6908835 - DNA, 22 bp, Homo sapiens
gctacaggagctgtcacatgct

SEQ ID NO: 6908836 - DNA, 22 bp, Homo sapiens
caacagtattgtgggccaggta

SEQ ID NO: 6908837 - DNA, 22 bp, Homo sapiens
cttatggaagaaacctcagaga

SEQ ID NO: 6908838 - DNA, 20 bp, Homo sapiens
tctctatgaagtcaacagga

SEQ ID NO: 6908839 - DNA, 17 bp, Homo sapiens
tgtgcatagaataatga

SEQ ID NO: 6908840 - DNA, 15 bp, Homo sapiens
gcatgtgtaataggc

SEQ ID NO: 6908841 - DNA, 22 bp, Homo sapiens
atgtgtgcaatgctattttggc

SEQ ID NO: 6908842 - DNA, 22 bp, Homo sapiens
agtgtaaagctgtatatgtgcc

SEQ ID NO: 6908843 - DNA, 22 bp, Homo sapiens
tacccagcccatgcctacctca

SEQ ID NO: 6908844 - DNA, 22 bp, Homo sapiens
ggtggataggtacatggacttt

SEQ ID NO: 6908845 - DNA, 22 bp, Homo sapiens
agtacactggcaaatgtggtgg

SEQ ID NO: 6908846 - DNA, 22 bp, Homo sapiens
tctggtcactgtccaattctat

SEQ ID NO: 6908847 - DNA, 22 bp, Homo sapiens
ctatacagagcatccttaactt

SEQ ID NO: 6908848 - DNA, 22 bp, Homo sapiens
aatgcacacatttggtactgaa

SEQ ID NO: 6908849 - DNA, 22 bp, Homo sapiens
tggggaagacagcagacactgt

SEQ ID NO: 6908850 - DNA, 22 bp, Homo sapiens
cctgagaggccctctcactgtc

SEQ ID NO: 6908851 - DNA, 22 bp, Homo sapiens
tccaggagaaaactgacggtgg

SEQ ID NO: 6908852 - DNA, 22 bp, Homo sapiens
ccctggagggcagacagatgcc

SEQ ID NO: 6908853 - DNA, 22 bp, Homo sapiens
gccatggcccataccaggtgca

SEQ ID NO: 6908854 - DNA, 22 bp, Homo sapiens
tttccctacttgtaactggaaa

SEQ ID NO: 6908855 - DNA, 22 bp, Homo sapiens
tcccacacagcccgctcaccgg

SEQ ID NO: 6908856 - DNA, 20 bp, Homo sapiens
aggcttgtgctttgtcactc

SEQ ID NO: 6908857 - DNA, 22 bp, Homo sapiens
actggctgaagtttactttttg

SEQ ID NO: 6908858 - DNA, 22 bp, Homo sapiens
tgctgaattaaactctatgtgg

SEQ ID NO: 6908859 - DNA, 22 bp, Homo sapiens
atgatttccagttgttgctaag

SEQ ID NO: 6908860 - DNA, 22 bp, Homo sapiens
aaatcccttgctctctcagacc

SEQ ID NO: 6908861 - DNA, 22 bp, Homo sapiens
atttggcacactgggttctcgt

SEQ ID NO: 6908862 - DNA, 22 bp, Homo sapiens
gttctgcagggatccagctggg

SEQ ID NO: 6908863 - DNA, 22 bp, Homo sapiens
tgtctgccctcaacccagaggc

SEQ ID NO: 6908864 - DNA, 22 bp, Homo sapiens
atatttcatggggttccatact

SEQ ID NO: 6908865 - DNA, 22 bp, Homo sapiens
tctgctggccttagcaggtcta

SEQ ID NO: 6908866 - DNA, 22 bp, Homo sapiens
agggtgggctagactcttcccc

SEQ ID NO: 6908867 - DNA, 22 bp, Homo sapiens
tctgcaaactggctcttactgc

SEQ ID NO: 6908868 - DNA, 22 bp, Homo sapiens
gatgtgtccttttctccatcca

SEQ ID NO: 6908869 - DNA, 22 bp, Homo sapiens
gacttgggggaagatgtggctg

SEQ ID NO: 6908870 - DNA, 22 bp, Homo sapiens
acatttttactgggcatctgca

SEQ ID NO: 6908871 - DNA, 22 bp, Homo sapiens
tgcaggacttcaggactctgag

SEQ ID NO: 6908872 - DNA, 23 bp, Homo sapiens
aggagccagccctgttctcagta

SEQ ID NO: 6908873 - DNA, 22 bp, Homo sapiens
tatagatcttgctatttaagga

SEQ ID NO: 6908874 - DNA, 23 bp, Homo sapiens
tagccagtcattccagcaaggcc

SEQ ID NO: 6908875 - DNA, 22 bp, Homo sapiens
tcctgaagaacgaagtcatgta

SEQ ID NO: 6908876 - DNA, 22 bp, Homo sapiens
atgagctgtgggattccagagg

SEQ ID NO: 6908877 - DNA, 18 bp, Homo sapiens
aagatgtttaatgggaag

SEQ ID NO: 6908878 - DNA, 22 bp, Homo sapiens
agcggctgtcggccagccggag

SEQ ID NO: 6908879 - DNA, 22 bp, Homo sapiens
accaatataagtataggtaagt

SEQ ID NO: 6908880 - DNA, 19 bp, Homo sapiens
gccatcccaagcattttgg

SEQ ID NO: 6908881 - DNA, 22 bp, Homo sapiens
atgctgattcctgggctccacc

SEQ ID NO: 6908882 - DNA, 22 bp, Homo sapiens
cctgttctgtagtgagtttgag

SEQ ID NO: 6908883 - DNA, 22 bp, Homo sapiens
tacttgttcatgaggtagtaaa

SEQ ID NO: 6908884 - DNA, 21 bp, Homo sapiens
tacagtgaggtgttaggatgt

SEQ ID NO: 6908885 - DNA, 19 bp, Homo sapiens
tctctggggacactttcac

SEQ ID NO: 6908886 - DNA, 22 bp, Homo sapiens
cacttgggacaaagcttctgct

SEQ ID NO: 6908887 - DNA, 22 bp, Homo sapiens
aaagtatctgaccgattataaa

SEQ ID NO: 6908888 - DNA, 22 bp, Homo sapiens
ttaagttttaaagctagagtct

SEQ ID NO: 6908889 - DNA, 19 bp, Homo sapiens
agcagggacatggaacttt

SEQ ID NO: 6908890 - DNA, 22 bp, Homo sapiens
gggcccagtaccctctgccaag

SEQ ID NO: 6908891 - DNA, 22 bp, Homo sapiens
tcacagaagtgtgtttcaggag

SEQ ID NO: 6908892 - DNA, 22 bp, Homo sapiens
agattttagtgtagaggacttg

SEQ ID NO: 6908893 - DNA, 22 bp, Homo sapiens
atttgtatcttctaatattatc

SEQ ID NO: 6908894 - DNA, 22 bp, Homo sapiens
ttgacagttgcaatggtgatct

SEQ ID NO: 6908895 - DNA, 22 bp, Homo sapiens
atggaccagagcctcattctgt

SEQ ID NO: 6908896 - DNA, 22 bp, Homo sapiens
ttaggcatagttttgataaata

SEQ ID NO: 6908897 - DNA, 22 bp, Homo sapiens
aattgcccgcacattgagaggt

SEQ ID NO: 6908898 - DNA, 22 bp, Homo sapiens
ctcactgcaagctctgcctccc

SEQ ID NO: 6908899 - DNA, 22 bp, Homo sapiens
ctgtgccctttgtcctcgtctc

SEQ ID NO: 6908900 - DNA, 20 bp, Homo sapiens
actggatctggctggagctg

SEQ ID NO: 6908901 - DNA, 22 bp, Homo sapiens
tgagacagtcaccaggcaggcc

SEQ ID NO: 6908902 - DNA, 22 bp, Homo sapiens
tgaaacaattagaatgtaatga

SEQ ID NO: 6908903 - DNA, 22 bp, Homo sapiens
aacagcgtctttccagctgttc

SEQ ID NO: 6908904 - DNA, 22 bp, Homo sapiens
cagcatctttataaaaagtaaa

SEQ ID NO: 6908905 - DNA, 22 bp, Homo sapiens
gtattagctaggttacctgggt

SEQ ID NO: 6908906 - DNA, 22 bp, Homo sapiens
ttcattcccttatattagcatt

SEQ ID NO: 6908907 - DNA, 22 bp, Homo sapiens
gtctgactcataagatctcttg

SEQ ID NO: 6908908 - DNA, 22 bp, Homo sapiens
gttgggcttatgtaattttaag

SEQ ID NO: 6908909 - DNA, 19 bp, Homo sapiens
gggcatggatgagcttacc

SEQ ID NO: 6908910 - DNA, 22 bp, Homo sapiens
gtcctggcctctgggggtatgg

SEQ ID NO: 6908911 - DNA, 22 bp, Homo sapiens
caatcccatcaccatctgctct

SEQ ID NO: 6908912 - DNA, 22 bp, Homo sapiens
atttccaggtaacctgttgagt

SEQ ID NO: 6908913 - DNA, 22 bp, Homo sapiens
tgcatactgaacagcatgctaa

SEQ ID NO: 6908914 - DNA, 16 bp, Homo sapiens
aagccagttcagcatt

SEQ ID NO: 6908915 - DNA, 23 bp, Homo sapiens
gaaagtcaatatggtagctttga

SEQ ID NO: 6908916 - DNA, 22 bp, Homo sapiens
ctccttggggtaaattgatgtg

SEQ ID NO: 6908917 - DNA, 22 bp, Homo sapiens
tggaggagaccgcattttattt

SEQ ID NO: 6908918 - DNA, 22 bp, Homo sapiens
tctggaattgctgtgtgagttc

SEQ ID NO: 6908919 - DNA, 22 bp, Homo sapiens
atgtgtgtgatgggcgccgcca

SEQ ID NO: 6908920 - DNA, 22 bp, Homo sapiens
aggcagctttaactggtagtag

SEQ ID NO: 6908921 - DNA, 23 bp, Homo sapiens
atgaaagttcttaaaatgtcatg

SEQ ID NO: 6908922 - DNA, 22 bp, Homo sapiens
gaatgaattcagcacatggaat

SEQ ID NO: 6908923 - DNA, 22 bp, Homo sapiens
actttatcaggaatcacacagc

SEQ ID NO: 6908924 - DNA, 17 bp, Homo sapiens
cctgaaggcacttccag

SEQ ID NO: 6908925 - DNA, 22 bp, Homo sapiens
tgtctacagttctgtgtatgag

SEQ ID NO: 6908926 - DNA, 22 bp, Homo sapiens
ggacgcagccgagggagcaggg

SEQ ID NO: 6908927 - DNA, 22 bp, Homo sapiens
gatcattgaacaggcactggag

SEQ ID NO: 6908928 - DNA, 22 bp, Homo sapiens
taacttagaagtttaattgtat

SEQ ID NO: 6908929 - DNA, 22 bp, Homo sapiens
ctgctctgctgatcagtgtctc

SEQ ID NO: 6908930 - DNA, 21 bp, Homo sapiens
ccctaactctaaaggatccat

SEQ ID NO: 6908931 - DNA, 22 bp, Homo sapiens
agtgcaaatatctacgcggtga

SEQ ID NO: 6908932 - DNA, 22 bp, Homo sapiens
gggaagggacttgtttaaggtc

SEQ ID NO: 6908933 - DNA, 22 bp, Homo sapiens
tttggaaatgaccccgtctaag

SEQ ID NO: 6908934 - DNA, 22 bp, Homo sapiens
gaaataattctgtgtctgaaca

SEQ ID NO: 6908935 - DNA, 22 bp, Homo sapiens
ctttttcattggctttaggaca

SEQ ID NO: 6908936 - DNA, 22 bp, Homo sapiens
ctgagggccgggacccagtttc

SEQ ID NO: 6908937 - DNA, 22 bp, Homo sapiens
tggtgagaattggttggattta

SEQ ID NO: 6908938 - DNA, 22 bp, Homo sapiens
tttatgtttgacaatgatctgg

SEQ ID NO: 6908939 - DNA, 22 bp, Homo sapiens
gcaataaaatgtaatgattggg

SEQ ID NO: 6908940 - DNA, 21 bp, Homo sapiens
tctagaatcctgtataagact

SEQ ID NO: 6908941 - DNA, 22 bp, Homo sapiens
agctggaaaatccaagaccttg

SEQ ID NO: 6908942 - DNA, 22 bp, Homo sapiens
agctggtggaagggagcccaaa

SEQ ID NO: 6908943 - DNA, 22 bp, Homo sapiens
tagtttctgcctcggaagctga

SEQ ID NO: 6908944 - DNA, 22 bp, Homo sapiens
tcatgcacatgtgtcaccatca

SEQ ID NO: 6908945 - DNA, 22 bp, Homo sapiens
gtggaccaaggtggaagataaa

SEQ ID NO: 6908946 - DNA, 22 bp, Homo sapiens
tgccttttaccttgtaattctg

SEQ ID NO: 6908947 - DNA, 23 bp, Homo sapiens
tattttcctggcaacaggggaac

SEQ ID NO: 6908948 - DNA, 22 bp, Homo sapiens
agatgaagactcaggagcaggt

SEQ ID NO: 6908949 - DNA, 22 bp, Homo sapiens
tgtgtcctttctaatgcccaga

SEQ ID NO: 6908950 - DNA, 22 bp, Homo sapiens
atttggtgcctgggaaatctct

SEQ ID NO: 6908951 - DNA, 19 bp, Homo sapiens
agcaggcaggtggcccagg

SEQ ID NO: 6908952 - DNA, 22 bp, Homo sapiens
tgctggaagggtagtattaact

SEQ ID NO: 6908953 - DNA, 22 bp, Homo sapiens
gagcacagaatcttcccatgca

SEQ ID NO: 6908954 - DNA, 17 bp, Homo sapiens
acagtgagaagtcatct

SEQ ID NO: 6908955 - DNA, 22 bp, Homo sapiens
aggccacaagaaaatgcttcat

SEQ ID NO: 6908956 - DNA, 22 bp, Homo sapiens
cagaagcagaacactagattta

SEQ ID NO: 6908957 - DNA, 22 bp, Homo sapiens
agctcaagctacacacagagtc

SEQ ID NO: 6908958 - DNA, 22 bp, Homo sapiens
ggaccagagaagtgagcacctg

SEQ ID NO: 6908959 - DNA, 22 bp, Homo sapiens
agctgccttaaattactttgtg

SEQ ID NO: 6908960 - DNA, 22 bp, Homo sapiens
gtccaggccatggtggacacag

SEQ ID NO: 6908961 - DNA, 23 bp, Homo sapiens
tttgtgaaagtgttgagaggaga

SEQ ID NO: 6908962 - DNA, 22 bp, Homo sapiens
atgcatttgacgggatatattt

SEQ ID NO: 6908963 - DNA, 21 bp, Homo sapiens
ccagctccaggaccttggatc

SEQ ID NO: 6908964 - DNA, 22 bp, Homo sapiens
cagcaccatttgcagcctcttt

SEQ ID NO: 6908965 - DNA, 22 bp, Homo sapiens
tacagtagctactcaataacta

SEQ ID NO: 6908966 - DNA, 22 bp, Homo sapiens
ttcattcttgtctttgtatagt

SEQ ID NO: 6908967 - DNA, 18 bp, Homo sapiens
tggtgaagggtggaggag

SEQ ID NO: 6908968 - DNA, 22 bp, Homo sapiens
agaagagaaatagtgccactgt

SEQ ID NO: 6908969 - DNA, 22 bp, Homo sapiens
aaaggccaggttggctggtatt

SEQ ID NO: 6908970 - DNA, 22 bp, Homo sapiens
tgggtgcaggatgagtgctggc

SEQ ID NO: 6908971 - DNA, 20 bp, Homo sapiens
ctgccatgattgatagagtg

SEQ ID NO: 6908972 - DNA, 22 bp, Homo sapiens
ccagtgtctagcagatgacagg

SEQ ID NO: 6908973 - DNA, 22 bp, Homo sapiens
ctcaagagatataaaaatgtgg

SEQ ID NO: 6908974 - DNA, 22 bp, Homo sapiens
gaggtggaggggaaaaatagat

SEQ ID NO: 6908975 - DNA, 19 bp, Homo sapiens
tcgtggggaggtgggcagc

SEQ ID NO: 6908976 - DNA, 22 bp, Homo sapiens
ctattaggtatgcagcctattt

SEQ ID NO: 6908977 - DNA, 22 bp, Homo sapiens
cagctctgttgccctggaaacg

SEQ ID NO: 6908978 - DNA, 22 bp, Homo sapiens
attctggccttggctctgtcac

SEQ ID NO: 6908979 - DNA, 22 bp, Homo sapiens
tctaattgcaattctcagagat

SEQ ID NO: 6908980 - DNA, 22 bp, Homo sapiens
gcagagctcatgcctgcacctc

SEQ ID NO: 6908981 - DNA, 20 bp, Homo sapiens
gcagctgaaagtatgacacc

SEQ ID NO: 6908982 - DNA, 22 bp, Homo sapiens
taacaaagtaccatagattggg

SEQ ID NO: 6908983 - DNA, 21 bp, Homo sapiens
ttctcctaggctgaggcggga

SEQ ID NO: 6908984 - DNA, 22 bp, Homo sapiens
tggaggccgaattagagcgttg

SEQ ID NO: 6908985 - DNA, 22 bp, Homo sapiens
atcagtatattccttggtcttt

SEQ ID NO: 6908986 - DNA, 22 bp, Homo sapiens
agagcagcgtttgtggaacact

SEQ ID NO: 6908987 - DNA, 22 bp, Homo sapiens
tcaggcttcttctgagcaggga

SEQ ID NO: 6908988 - DNA, 22 bp, Homo sapiens
tcaggatggtgtggaggaaata

SEQ ID NO: 6908989 - DNA, 22 bp, Homo sapiens
tgtcaggagggtccagagaaaa

SEQ ID NO: 6908990 - DNA, 21 bp, Homo sapiens
tattcaccgtaagaggagttc

SEQ ID NO: 6908991 - DNA, 22 bp, Homo sapiens
ctggctctttcagccgctggag

SEQ ID NO: 6908992 - DNA, 22 bp, Homo sapiens
ttggaagttgatttaaaaagga

SEQ ID NO: 6908993 - DNA, 22 bp, Homo sapiens
tcaatcaaagccagatgtcctt

SEQ ID NO: 6908994 - DNA, 22 bp, Homo sapiens
cctgggagtgtgccatctctgt

SEQ ID NO: 6908995 - DNA, 22 bp, Homo sapiens
attctaggcttgaaacatgaag

SEQ ID NO: 6908996 - DNA, 22 bp, Homo sapiens
cttagtttaggtaaacccagca

SEQ ID NO: 6908997 - DNA, 22 bp, Homo sapiens
tatcagaaggaagtgcctttaa

SEQ ID NO: 6908998 - DNA, 22 bp, Homo sapiens
tgctggcatactctctttgttg

SEQ ID NO: 6908999 - DNA, 22 bp, Homo sapiens
tatgtagacttcattgtttact

SEQ ID NO: 6909000 - DNA, 22 bp, Homo sapiens
aggtttataggaaatttgttcc

SEQ ID NO: 6909001 - DNA, 22 bp, Homo sapiens
tacagcagagtgggatgcatct

SEQ ID NO: 6909002 - DNA, 22 bp, Homo sapiens
ttaggcatatgaaatagaatgt

SEQ ID NO: 6909003 - DNA, 22 bp, Homo sapiens
tgatttcctggctttggagttc

SEQ ID NO: 6909004 - DNA, 22 bp, Homo sapiens
caagttcattgtagcattattg

SEQ ID NO: 6909005 - DNA, 22 bp, Homo sapiens
attgtctcttaaatgtggaaat

SEQ ID NO: 6909006 - DNA, 18 bp, Homo sapiens
gatatataggaggaaagt

SEQ ID NO: 6909007 - DNA, 22 bp, Homo sapiens
gacagtctgggcacacatgaaa

SEQ ID NO: 6909008 - DNA, 22 bp, Homo sapiens
tctgtgtcccttctaatttcag

SEQ ID NO: 6909009 - DNA, 19 bp, Homo sapiens
gcacaccctgcaccaccat

SEQ ID NO: 6909010 - DNA, 22 bp, Homo sapiens
ttctatgccatgttcagctact

SEQ ID NO: 6909011 - DNA, 22 bp, Homo sapiens
ccttaaactttatcttgtgaga

SEQ ID NO: 6909012 - DNA, 22 bp, Homo sapiens
ctccagtctagtagagcctgct

SEQ ID NO: 6909013 - DNA, 20 bp, Homo sapiens
cagagcagtgcccaggcggc

SEQ ID NO: 6909014 - DNA, 22 bp, Homo sapiens
gaaggttctgtgtacactactt

SEQ ID NO: 6909015 - DNA, 22 bp, Homo sapiens
ccagctctcagcgggagactca

SEQ ID NO: 6909016 - DNA, 22 bp, Homo sapiens
aaatgacagttctctctgagta

SEQ ID NO: 6909017 - DNA, 22 bp, Homo sapiens
ttggaaaccaggctttgagacg

SEQ ID NO: 6909018 - DNA, 22 bp, Homo sapiens
ttgtctgtaaagacggccacca

SEQ ID NO: 6909019 - DNA, 23 bp, Homo sapiens
aacttttagagtttaacagtgtt

SEQ ID NO: 6909020 - DNA, 22 bp, Homo sapiens
cacttcaaggaatatctagaaa

SEQ ID NO: 6909021 - DNA, 22 bp, Homo sapiens
acagagctcccagccatctcct

SEQ ID NO: 6909022 - DNA, 22 bp, Homo sapiens
agcaagattttccttgaatgtt

SEQ ID NO: 6909023 - DNA, 22 bp, Homo sapiens
gctgggaagaacaggagagaat

SEQ ID NO: 6909024 - DNA, 22 bp, Homo sapiens
ggcgctcagtgttgccccagag

SEQ ID NO: 6909025 - DNA, 21 bp, Homo sapiens
accttagagagaaagccatca

SEQ ID NO: 6909026 - DNA, 22 bp, Homo sapiens
tgcctgtggaaaggctggtgct

SEQ ID NO: 6909027 - DNA, 22 bp, Homo sapiens
ttgccaggagctcatctgaggg

SEQ ID NO: 6909028 - DNA, 22 bp, Homo sapiens
tgtcctctaattggcctcttgc

SEQ ID NO: 6909029 - DNA, 22 bp, Homo sapiens
agcttcctacaaccatctcaga

SEQ ID NO: 6909030 - DNA, 22 bp, Homo sapiens
gatatacataggtttctatgca

SEQ ID NO: 6909031 - DNA, 22 bp, Homo sapiens
catgctttctgtccaaatgtta

SEQ ID NO: 6909032 - DNA, 22 bp, Homo sapiens
ctagccataggaagacacagaa

SEQ ID NO: 6909033 - DNA, 22 bp, Homo sapiens
agcagcatatcagagaaagtca

SEQ ID NO: 6909034 - DNA, 22 bp, Homo sapiens
gggaaacttctgctaaaaccag

SEQ ID NO: 6909035 - DNA, 22 bp, Homo sapiens
tttagtctaataaaagtggagt

SEQ ID NO: 6909036 - DNA, 22 bp, Homo sapiens
atgctctggagtacgtgaaatt

SEQ ID NO: 6909037 - DNA, 22 bp, Homo sapiens
tgcatcattaaggtacagttgg

SEQ ID NO: 6909038 - DNA, 22 bp, Homo sapiens
gctctgtcattttgcagacact

SEQ ID NO: 6909039 - DNA, 22 bp, Homo sapiens
taatatatttctgctaagctca

SEQ ID NO: 6909040 - DNA, 22 bp, Homo sapiens
accttcaactcaaagtgtccca

SEQ ID NO: 6909041 - DNA, 22 bp, Homo sapiens
tgaattcataggacacagggtg

SEQ ID NO: 6909042 - DNA, 18 bp, Homo sapiens
ctagatgagcttggcaag

SEQ ID NO: 6909043 - DNA, 22 bp, Homo sapiens
tacagagacccacaagagactg

SEQ ID NO: 6909044 - DNA, 22 bp, Homo sapiens
cagaggtggggagtatttcaag

SEQ ID NO: 6909045 - DNA, 22 bp, Homo sapiens
actgctattgatgtcacacttt

SEQ ID NO: 6909046 - DNA, 22 bp, Homo sapiens
gagggatggtgtgagaggctca

SEQ ID NO: 6909047 - DNA, 22 bp, Homo sapiens
gtcattgcagtggcaaatcaca

SEQ ID NO: 6909048 - DNA, 22 bp, Homo sapiens
atacatgtgccgcgttggtgtg

SEQ ID NO: 6909049 - DNA, 22 bp, Homo sapiens
tcacgagaggcacagaatagag

SEQ ID NO: 6909050 - DNA, 22 bp, Homo sapiens
tttgaggaagatcggagggaaa

SEQ ID NO: 6909051 - DNA, 22 bp, Homo sapiens
aaacacacctttggaactgtga

SEQ ID NO: 6909052 - DNA, 23 bp, Homo sapiens
tgctccaggtacagaactccagg

SEQ ID NO: 6909053 - DNA, 22 bp, Homo sapiens
cctcatgttgctcgcatctgca

SEQ ID NO: 6909054 - DNA, 22 bp, Homo sapiens
tgctaagctgaggaagatgaga

SEQ ID NO: 6909055 - DNA, 22 bp, Homo sapiens
tcagtgtgtagtaaattgtagg

SEQ ID NO: 6909056 - DNA, 22 bp, Homo sapiens
aacagacttagagcatcccaat

SEQ ID NO: 6909057 - DNA, 22 bp, Homo sapiens
caggcaggagaggaggatttct

SEQ ID NO: 6909058 - DNA, 22 bp, Homo sapiens
aagaggtaaccatagcaaccac

SEQ ID NO: 6909059 - DNA, 22 bp, Homo sapiens
gctgccagaagaggaggggtta

SEQ ID NO: 6909060 - DNA, 22 bp, Homo sapiens
aggcagtctatctctggagcct

SEQ ID NO: 6909061 - DNA, 22 bp, Homo sapiens
aaataatgttaggcctttgctc

SEQ ID NO: 6909062 - DNA, 22 bp, Homo sapiens
gtctgtattcctgtcggcagcc

SEQ ID NO: 6909063 - DNA, 22 bp, Homo sapiens
ttcagtgacatcatactggtat

SEQ ID NO: 6909064 - DNA, 22 bp, Homo sapiens
ctgcagtatgagctacccaggt

SEQ ID NO: 6909065 - DNA, 21 bp, Homo sapiens
aatctgcttccctgtgacttg

SEQ ID NO: 6909066 - DNA, 22 bp, Homo sapiens
tttgaaagcaggtgtgggaggg

SEQ ID NO: 6909067 - DNA, 16 bp, Homo sapiens
tgggacctgtggccaa

SEQ ID NO: 6909068 - DNA, 22 bp, Homo sapiens
agtgcagctaagtggctctgtg

SEQ ID NO: 6909069 - DNA, 22 bp, Homo sapiens
ctccaggcccacgtcgaggagg

SEQ ID NO: 6909070 - DNA, 22 bp, Homo sapiens
agcatgaaaacatgaaacagca

SEQ ID NO: 6909071 - DNA, 22 bp, Homo sapiens
tacagttaccctggaaagaaat

SEQ ID NO: 6909072 - DNA, 22 bp, Homo sapiens
agccctggtttgcagcatttgc

SEQ ID NO: 6909073 - DNA, 22 bp, Homo sapiens
gatttctcatttgtggattgaa

SEQ ID NO: 6909074 - DNA, 22 bp, Homo sapiens
taatgtcagcatagtttatttt

SEQ ID NO: 6909075 - DNA, 22 bp, Homo sapiens
tgcgagtatttttaggcagatt

SEQ ID NO: 6909076 - DNA, 22 bp, Homo sapiens
ttccagagtccatgttggctca

SEQ ID NO: 6909077 - DNA, 22 bp, Homo sapiens
ctgaagatgttctttttggttc

SEQ ID NO: 6909078 - DNA, 22 bp, Homo sapiens
acttgtttcaactgtactctcc

SEQ ID NO: 6909079 - DNA, 19 bp, Homo sapiens
taccatccaagctggtttg

SEQ ID NO: 6909080 - DNA, 22 bp, Homo sapiens
gagttagctgtgagtctcatat

SEQ ID NO: 6909081 - DNA, 22 bp, Homo sapiens
cacagtcccgtgcttaccatgt

SEQ ID NO: 6909082 - DNA, 22 bp, Homo sapiens
tgacaagagacccctccgcagg

SEQ ID NO: 6909083 - DNA, 22 bp, Homo sapiens
cagggagaggcctctgttgccc

SEQ ID NO: 6909084 - DNA, 22 bp, Homo sapiens
agctctgacaaggattttctgc

SEQ ID NO: 6909085 - DNA, 22 bp, Homo sapiens
ccaggtgcctccagtcacagtg

SEQ ID NO: 6909086 - DNA, 22 bp, Homo sapiens
ggctgctcggcagctcctgagc

SEQ ID NO: 6909087 - DNA, 22 bp, Homo sapiens
agaaggccaagaagaagcctat

SEQ ID NO: 6909088 - DNA, 22 bp, Homo sapiens
cacagaataattcacatggctc

SEQ ID NO: 6909089 - DNA, 22 bp, Homo sapiens
ttgaggtcttcaggatcaggct

SEQ ID NO: 6909090 - DNA, 22 bp, Homo sapiens
tttcttaaatatttgcaggaca

SEQ ID NO: 6909091 - DNA, 22 bp, Homo sapiens
aatgggctgaatttcatgaaat

SEQ ID NO: 6909092 - DNA, 22 bp, Homo sapiens
ctccctgcttgtttcccttcag

SEQ ID NO: 6909093 - DNA, 22 bp, Homo sapiens
aaggtcacttttattcctgaga

SEQ ID NO: 6909094 - DNA, 22 bp, Homo sapiens
ggcactttgcctttatgcactg

SEQ ID NO: 6909095 - DNA, 22 bp, Homo sapiens
ataactgagtgagcagcgactc

SEQ ID NO: 6909096 - DNA, 19 bp, Homo sapiens
tagacttttccagcaggca

SEQ ID NO: 6909097 - DNA, 22 bp, Homo sapiens
tccagagagccacggacagggg

SEQ ID NO: 6909098 - DNA, 22 bp, Homo sapiens
cttttcttactcccgcaaggca

SEQ ID NO: 6909099 - DNA, 22 bp, Homo sapiens
ccttctgataactgtgaaattg

SEQ ID NO: 6909100 - DNA, 22 bp, Homo sapiens
atgtgaggaagaaagaggtaag

SEQ ID NO: 6909101 - DNA, 22 bp, Homo sapiens
gtgcctccatcagtgcctccaa

SEQ ID NO: 6909102 - DNA, 22 bp, Homo sapiens
ctgttacccagcaaccccagca

SEQ ID NO: 6909103 - DNA, 22 bp, Homo sapiens
atccagtgagtgcagctgttgt

SEQ ID NO: 6909104 - DNA, 22 bp, Homo sapiens
ggtgtccttgcagaaggcggcg

SEQ ID NO: 6909105 - DNA, 23 bp, Homo sapiens
tatgtatgtatgtttgtatggaa

SEQ ID NO: 6909106 - DNA, 22 bp, Homo sapiens
ctgggtgtagatggaagtttgg

SEQ ID NO: 6909107 - DNA, 22 bp, Homo sapiens
ttgattagtgaaacatgcctag

SEQ ID NO: 6909108 - DNA, 22 bp, Homo sapiens
agaagccaattctgtgtgagtc

SEQ ID NO: 6909109 - DNA, 22 bp, Homo sapiens
ataagatataaatccacagagt

SEQ ID NO: 6909110 - DNA, 21 bp, Homo sapiens
agttcctgcttcattgtcttt

SEQ ID NO: 6909111 - DNA, 21 bp, Homo sapiens
ttcattcatggcataatatag

SEQ ID NO: 6909112 - DNA, 22 bp, Homo sapiens
tcgcatttgttaaagcatgttg

SEQ ID NO: 6909113 - DNA, 22 bp, Homo sapiens
acagaattgaagctgagtaaat

SEQ ID NO: 6909114 - DNA, 22 bp, Homo sapiens
gtctactttttaatcttggcag

SEQ ID NO: 6909115 - DNA, 22 bp, Homo sapiens
gtggctagaaaaatatgggtgc

SEQ ID NO: 6909116 - DNA, 22 bp, Homo sapiens
ctggtgtaccttggctcaggca

SEQ ID NO: 6909117 - DNA, 22 bp, Homo sapiens
gctgtgataaatgcagatgtca

SEQ ID NO: 6909118 - DNA, 21 bp, Homo sapiens
agctgctccagggagctcagg

SEQ ID NO: 6909119 - DNA, 22 bp, Homo sapiens
agacccttgcatgaattaattc

SEQ ID NO: 6909120 - DNA, 22 bp, Homo sapiens
agtggccagtgaaggcggcagc

SEQ ID NO: 6909121 - DNA, 22 bp, Homo sapiens
cagcacctggcacaggagggcc

SEQ ID NO: 6909122 - DNA, 22 bp, Homo sapiens
agcctccatctcccatctgtga

SEQ ID NO: 6909123 - DNA, 22 bp, Homo sapiens
ggggtggcctgtaggcagcatg

SEQ ID NO: 6909124 - DNA, 22 bp, Homo sapiens
tctggcttcagtagggttcact

SEQ ID NO: 6909125 - DNA, 22 bp, Homo sapiens
ttcaccccaaattcccagtgga

SEQ ID NO: 6909126 - DNA, 22 bp, Homo sapiens
agtgtggccaatgaggatgggc

SEQ ID NO: 6909127 - DNA, 22 bp, Homo sapiens
cacatgtgtatatgtgaggggg

SEQ ID NO: 6909128 - DNA, 22 bp, Homo sapiens
gaggaaaataacaactaagggc

SEQ ID NO: 6909129 - DNA, 23 bp, Homo sapiens
tcaaactgttatattgccagagt

SEQ ID NO: 6909130 - DNA, 22 bp, Homo sapiens
aacttggctaccagcgttaaat

SEQ ID NO: 6909131 - DNA, 22 bp, Homo sapiens
atgaagactaatgtgaatggga

SEQ ID NO: 6909132 - DNA, 22 bp, Homo sapiens
gcagtcccatatctttaacata

SEQ ID NO: 6909133 - DNA, 22 bp, Homo sapiens
ctgcccaggaaggagaggatgg

SEQ ID NO: 6909134 - DNA, 22 bp, Homo sapiens
ttacattcaaggaactcattct

SEQ ID NO: 6909135 - DNA, 22 bp, Homo sapiens
ggaaacagcaaattatggcaat

SEQ ID NO: 6909136 - DNA, 22 bp, Homo sapiens
caggaagcatctggctagctaa

SEQ ID NO: 6909137 - DNA, 22 bp, Homo sapiens
gacaggaatgtgtggatgcgga

SEQ ID NO: 6909138 - DNA, 22 bp, Homo sapiens
gtctaaacacaatgcaagaagt

SEQ ID NO: 6909139 - DNA, 22 bp, Homo sapiens
aggctgtgtttcccctggagct

SEQ ID NO: 6909140 - DNA, 22 bp, Homo sapiens
ctggctttctgcaaatctccat

SEQ ID NO: 6909141 - DNA, 22 bp, Homo sapiens
agtatgaagattataatttttc

SEQ ID NO: 6909142 - DNA, 22 bp, Homo sapiens
tctaagttttaattggcaatgt

SEQ ID NO: 6909143 - DNA, 22 bp, Homo sapiens
tgccattatgacaattgaggaa

SEQ ID NO: 6909144 - DNA, 22 bp, Homo sapiens
tcctgccttagagcaaggaaaa

SEQ ID NO: 6909145 - DNA, 22 bp, Homo sapiens
tgcaattagcgtattagtttat

SEQ ID NO: 6909146 - DNA, 21 bp, Homo sapiens
ggcagaagtagcatggacggg

SEQ ID NO: 6909147 - DNA, 22 bp, Homo sapiens
gccatctgcgcggtgtccagct

SEQ ID NO: 6909148 - DNA, 22 bp, Homo sapiens
gaataactgctatctttctggc

SEQ ID NO: 6909149 - DNA, 22 bp, Homo sapiens
tctccacaagtgttgagagtac

SEQ ID NO: 6909150 - DNA, 22 bp, Homo sapiens
agggagaggagcgtttcacatc

SEQ ID NO: 6909151 - DNA, 20 bp, Homo sapiens
atgcatatatgtggtgtctg

SEQ ID NO: 6909152 - DNA, 22 bp, Homo sapiens
tagtggaggtggtctgtgaact

SEQ ID NO: 6909153 - DNA, 22 bp, Homo sapiens
tgtgccaggggccgcttgcctt

SEQ ID NO: 6909154 - DNA, 22 bp, Homo sapiens
tttcagagcctgcaatcccaat

SEQ ID NO: 6909155 - DNA, 22 bp, Homo sapiens
ctcagggaggtcctgtgctgaa

SEQ ID NO: 6909156 - DNA, 22 bp, Homo sapiens
ttggaatatatgtttcctgtta

SEQ ID NO: 6909157 - DNA, 22 bp, Homo sapiens
cacatgccttcctcaggcctct

SEQ ID NO: 6909158 - DNA, 22 bp, Homo sapiens
gagcttggcagtgtcactaggg

SEQ ID NO: 6909159 - DNA, 22 bp, Homo sapiens
ttgtggttgactaaatttgtaa

SEQ ID NO: 6909160 - DNA, 22 bp, Homo sapiens
gcagacagccagactgcactgg

SEQ ID NO: 6909161 - DNA, 22 bp, Homo sapiens
ctctccctggccagctgtgcag

SEQ ID NO: 6909162 - DNA, 22 bp, Homo sapiens
tgtaaagtccaagatcaaagag

SEQ ID NO: 6909163 - DNA, 22 bp, Homo sapiens
ttgcttggcaggcttccagtct

SEQ ID NO: 6909164 - DNA, 22 bp, Homo sapiens
tgtgttccttcgtcttcccttc

SEQ ID NO: 6909165 - DNA, 22 bp, Homo sapiens
ggcagcaagagaggttcagctt

SEQ ID NO: 6909166 - DNA, 22 bp, Homo sapiens
tccctccaggcagctgggtact

SEQ ID NO: 6909167 - DNA, 21 bp, Homo sapiens
attctcaggcccatcctcagg

SEQ ID NO: 6909168 - DNA, 22 bp, Homo sapiens
caggcttcttttctttccagac

SEQ ID NO: 6909169 - DNA, 17 bp, Homo sapiens
agcctgccccatgctgc

SEQ ID NO: 6909170 - DNA, 22 bp, Homo sapiens
tgtcagttcagtgattacaaaa

SEQ ID NO: 6909171 - DNA, 22 bp, Homo sapiens
gtgcagttcttgtaacatgctg

SEQ ID NO: 6909172 - DNA, 22 bp, Homo sapiens
gcctggggtcccttgttggcac

SEQ ID NO: 6909173 - DNA, 22 bp, Homo sapiens
gtaggaattggctttggatgtg

SEQ ID NO: 6909174 - DNA, 20 bp, Homo sapiens
tttctgggtactctccctct

SEQ ID NO: 6909175 - DNA, 22 bp, Homo sapiens
acagtgatttctgcaagggctc

SEQ ID NO: 6909176 - DNA, 18 bp, Homo sapiens
ggcctcagcctggccgga

SEQ ID NO: 6909177 - DNA, 22 bp, Homo sapiens
cagcccagagatgttatctagt

SEQ ID NO: 6909178 - DNA, 18 bp, Homo sapiens
aagggctggcctttggag

SEQ ID NO: 6909179 - DNA, 22 bp, Homo sapiens
aatctggagagtcatctctgac

SEQ ID NO: 6909180 - DNA, 20 bp, Homo sapiens
acaattgtccctgtctgtca

SEQ ID NO: 6909181 - DNA, 22 bp, Homo sapiens
ctctggtcctgacaaagacaga

SEQ ID NO: 6909182 - DNA, 22 bp, Homo sapiens
atcatgtcttcagctatttgta

SEQ ID NO: 6909183 - DNA, 22 bp, Homo sapiens
gctgcctgccttgcctggagga

SEQ ID NO: 6909184 - DNA, 21 bp, Homo sapiens
ccagcccagctgtgtcccagc

SEQ ID NO: 6909185 - DNA, 22 bp, Homo sapiens
gtcatgtgaaatttggcaggcc

SEQ ID NO: 6909186 - DNA, 22 bp, Homo sapiens
gttcccattgccctagcttgta

SEQ ID NO: 6909187 - DNA, 22 bp, Homo sapiens
tcagtttatttcttgttccaca

SEQ ID NO: 6909188 - DNA, 22 bp, Homo sapiens
tttctaaaatagattttatggt

SEQ ID NO: 6909189 - DNA, 22 bp, Homo sapiens
tgttgtcaggtacaaaatatat

SEQ ID NO: 6909190 - DNA, 22 bp, Homo sapiens
tgtctgcagtgccacagtggga

SEQ ID NO: 6909191 - DNA, 22 bp, Homo sapiens
tgctttaacataagatatcttt

SEQ ID NO: 6909192 - DNA, 19 bp, Homo sapiens
gagcacagcggcatttggt

SEQ ID NO: 6909193 - DNA, 22 bp, Homo sapiens
cctgagagtgagggcctcctta

SEQ ID NO: 6909194 - DNA, 22 bp, Homo sapiens
ccaaggacgtacaggagataat

SEQ ID NO: 6909195 - DNA, 22 bp, Homo sapiens
gttaaagaagaatagttccttt

SEQ ID NO: 6909196 - DNA, 22 bp, Homo sapiens
gcttgggagagggtccccagga

SEQ ID NO: 6909197 - DNA, 22 bp, Homo sapiens
ccccttccaggaagcagaatcg

SEQ ID NO: 6909198 - DNA, 22 bp, Homo sapiens
aactcacagctgtttggattag

SEQ ID NO: 6909199 - DNA, 22 bp, Homo sapiens
ctggaagggggacagccacaca

SEQ ID NO: 6909200 - DNA, 22 bp, Homo sapiens
tttaatctcccactctcagcct

SEQ ID NO: 6909201 - DNA, 22 bp, Homo sapiens
cttctgggtgtggagtgaggac

SEQ ID NO: 6909202 - DNA, 22 bp, Homo sapiens
gccagctgtaggtggtgggttg

SEQ ID NO: 6909203 - DNA, 22 bp, Homo sapiens
ttgagggagatgttgacttcag

SEQ ID NO: 6909204 - DNA, 22 bp, Homo sapiens
agtatttggcctctacagtctc

SEQ ID NO: 6909205 - DNA, 21 bp, Homo sapiens
tgattccctaatcccagcacc

SEQ ID NO: 6909206 - DNA, 22 bp, Homo sapiens
tacacagaggctgatgtcttag

SEQ ID NO: 6909207 - DNA, 22 bp, Homo sapiens
ctggaaggtggatggcgaggcc

SEQ ID NO: 6909208 - DNA, 22 bp, Homo sapiens
actgtactcaagcctgggcaat

SEQ ID NO: 6909209 - DNA, 22 bp, Homo sapiens
gtaaaattgcaattacttttgc

SEQ ID NO: 6909210 - DNA, 22 bp, Homo sapiens
atgggtttccctctgaaattat

SEQ ID NO: 6909211 - DNA, 22 bp, Homo sapiens
tgtcaagccccagctgtcacgc

SEQ ID NO: 6909212 - DNA, 22 bp, Homo sapiens
ggaaccttattcacgccattta

SEQ ID NO: 6909213 - DNA, 22 bp, Homo sapiens
tcacatcacatgacagtaggcc

SEQ ID NO: 6909214 - DNA, 22 bp, Homo sapiens
tttctctgttctctaactgtaa

SEQ ID NO: 6909215 - DNA, 22 bp, Homo sapiens
aacctgagatactggtctttat

SEQ ID NO: 6909216 - DNA, 23 bp, Homo sapiens
ccaggctctttcacctgctattc

SEQ ID NO: 6909217 - DNA, 22 bp, Homo sapiens
cttttcaaacgctgatgtcagt

SEQ ID NO: 6909218 - DNA, 22 bp, Homo sapiens
tgcccaggctggagtgcagtgg

SEQ ID NO: 6909219 - DNA, 22 bp, Homo sapiens
aaattgtagagatcgctttgtg

SEQ ID NO: 6909220 - DNA, 22 bp, Homo sapiens
agtgggtactgggcaggcagag

SEQ ID NO: 6909221 - DNA, 22 bp, Homo sapiens
tctttgaagtatcttaaatggt

SEQ ID NO: 6909222 - DNA, 22 bp, Homo sapiens
ctgctgtgcttgtggccacccg

SEQ ID NO: 6909223 - DNA, 22 bp, Homo sapiens
taatgaggggaaccatctgtag

SEQ ID NO: 6909224 - DNA, 23 bp, Homo sapiens
tgtacacttggtcaaggtactta

SEQ ID NO: 6909225 - DNA, 22 bp, Homo sapiens
tttatgttcctcttgagctttc

SEQ ID NO: 6909226 - DNA, 22 bp, Homo sapiens
gagacagtgtccatccaggggc

SEQ ID NO: 6909227 - DNA, 22 bp, Homo sapiens
gggcagagactcagaaacagaa

SEQ ID NO: 6909228 - DNA, 22 bp, Homo sapiens
gtcagggcacagtgacagctcc

SEQ ID NO: 6909229 - DNA, 22 bp, Homo sapiens
tctgttcatgtctttttaagtg

SEQ ID NO: 6909230 - DNA, 22 bp, Homo sapiens
gacagttttgctgaaattgagc

SEQ ID NO: 6909231 - DNA, 22 bp, Homo sapiens
aggaagctcctggagagccagt

SEQ ID NO: 6909232 - DNA, 22 bp, Homo sapiens
agctgtgtgcccatggtggagg

SEQ ID NO: 6909233 - DNA, 20 bp, Homo sapiens
agctcctttgtgtccaggat

SEQ ID NO: 6909234 - DNA, 22 bp, Homo sapiens
agtgcatagctgcgaagcattt

SEQ ID NO: 6909235 - DNA, 22 bp, Homo sapiens
caggaggtacatagattcagat

SEQ ID NO: 6909236 - DNA, 22 bp, Homo sapiens
ggcagcccaccagcccacgtct

SEQ ID NO: 6909237 - DNA, 22 bp, Homo sapiens
gctgtttcggcctcctggggaa

SEQ ID NO: 6909238 - DNA, 22 bp, Homo sapiens
atgctgaggtgtgtttaattta

SEQ ID NO: 6909239 - DNA, 22 bp, Homo sapiens
tcccactcactgtctctgacac

SEQ ID NO: 6909240 - DNA, 22 bp, Homo sapiens
tttgcaaatacagaggtcttgc

SEQ ID NO: 6909241 - DNA, 22 bp, Homo sapiens
acagaactgcagacagtgccaa

SEQ ID NO: 6909242 - DNA, 22 bp, Homo sapiens
ggggcgccccgagggtgcgcac

SEQ ID NO: 6909243 - DNA, 22 bp, Homo sapiens
tgagattcagggatgcagagca

SEQ ID NO: 6909244 - DNA, 22 bp, Homo sapiens
ctggctctgagcccacctccag

SEQ ID NO: 6909245 - DNA, 22 bp, Homo sapiens
atgctctaagcttagtgaggca

SEQ ID NO: 6909246 - DNA, 19 bp, Homo sapiens
gatttctacaaatgtcaga

SEQ ID NO: 6909247 - DNA, 22 bp, Homo sapiens
atgctgaggttgttgtcctatt

SEQ ID NO: 6909248 - DNA, 22 bp, Homo sapiens
gaggtgtcatttagttaatcag

SEQ ID NO: 6909249 - DNA, 22 bp, Homo sapiens
aattaggagaaaactgttgtct

SEQ ID NO: 6909250 - DNA, 22 bp, Homo sapiens
tttaatttgtatttctagaggg

SEQ ID NO: 6909251 - DNA, 22 bp, Homo sapiens
tctgagccaaaataaacagcat

SEQ ID NO: 6909252 - DNA, 22 bp, Homo sapiens
aatggagacttcaaaatggatt

SEQ ID NO: 6909253 - DNA, 22 bp, Homo sapiens
aatgtgttagtattgatttgtc

SEQ ID NO: 6909254 - DNA, 22 bp, Homo sapiens
ttgatgttgctcttaacagtat

SEQ ID NO: 6909255 - DNA, 22 bp, Homo sapiens
agtacttagaaagttaatataa

SEQ ID NO: 6909256 - DNA, 22 bp, Homo sapiens
tacagaaagggatgattgatct

SEQ ID NO: 6909257 - DNA, 22 bp, Homo sapiens
tagctgttgaaggtggtggtgc

SEQ ID NO: 6909258 - DNA, 22 bp, Homo sapiens
ctccctctcaccggagccctgg

SEQ ID NO: 6909259 - DNA, 22 bp, Homo sapiens
aacactgagaactgttggtggt

SEQ ID NO: 6909260 - DNA, 22 bp, Homo sapiens
caggtggctgagctgacctttg

SEQ ID NO: 6909261 - DNA, 17 bp, Homo sapiens
tactatgagaaagtagg

SEQ ID NO: 6909262 - DNA, 22 bp, Homo sapiens
agaaggaaggaagcattctgtt

SEQ ID NO: 6909263 - DNA, 22 bp, Homo sapiens
ctccaaatataatcacattgga

SEQ ID NO: 6909264 - DNA, 21 bp, Homo sapiens
gtttgcagttgagtccttccc

SEQ ID NO: 6909265 - DNA, 22 bp, Homo sapiens
atcctgtctatgagtagataat

SEQ ID NO: 6909266 - DNA, 22 bp, Homo sapiens
aggcttgtcagaatggattaga

SEQ ID NO: 6909267 - DNA, 22 bp, Homo sapiens
aacagtaatgtggtgttgggtt

SEQ ID NO: 6909268 - DNA, 22 bp, Homo sapiens
tgcagcttcactcctgaagcca

SEQ ID NO: 6909269 - DNA, 21 bp, Homo sapiens
tcgacctgctgggctcgggct

SEQ ID NO: 6909270 - DNA, 22 bp, Homo sapiens
aaagactaaccagttgtcaaaa

SEQ ID NO: 6909271 - DNA, 22 bp, Homo sapiens
acattctgggtgatgttcttca

SEQ ID NO: 6909272 - DNA, 22 bp, Homo sapiens
tatttgtgtgggtatctatata

SEQ ID NO: 6909273 - DNA, 22 bp, Homo sapiens
ttcacagtgccagggggcaggc

SEQ ID NO: 6909274 - DNA, 22 bp, Homo sapiens
tggggccagagctgcagggagc

SEQ ID NO: 6909275 - DNA, 22 bp, Homo sapiens
tagctgtcaccagaaatggcca

SEQ ID NO: 6909276 - DNA, 22 bp, Homo sapiens
gccacaggtcggctagagggtc

SEQ ID NO: 6909277 - DNA, 22 bp, Homo sapiens
tcgccagggatgctgtaaggaa

SEQ ID NO: 6909278 - DNA, 22 bp, Homo sapiens
aagatttcagagtttgggggaa

SEQ ID NO: 6909279 - DNA, 22 bp, Homo sapiens
actgaataaggtgaatgctctg

SEQ ID NO: 6909280 - DNA, 22 bp, Homo sapiens
tttcagtggaccacagtttgat

SEQ ID NO: 6909281 - DNA, 21 bp, Homo sapiens
agtaagggaggaaagaaattg

SEQ ID NO: 6909282 - DNA, 22 bp, Homo sapiens
atgagtgtgaagttagctcagt

SEQ ID NO: 6909283 - DNA, 22 bp, Homo sapiens
acacatctcaggggacactctc

SEQ ID NO: 6909284 - DNA, 22 bp, Homo sapiens
atagatcaattctgcttccaca

SEQ ID NO: 6909285 - DNA, 22 bp, Homo sapiens
tgtctctgctttccttgcaggg

SEQ ID NO: 6909286 - DNA, 20 bp, Homo sapiens
gtgcccagttggtgacagac

SEQ ID NO: 6909287 - DNA, 22 bp, Homo sapiens
atgcatgatgaacttgctttca

SEQ ID NO: 6909288 - DNA, 22 bp, Homo sapiens
gctttggtgatacttgctggct

SEQ ID NO: 6909289 - DNA, 20 bp, Homo sapiens
gatgcgcagccctggagggc

SEQ ID NO: 6909290 - DNA, 22 bp, Homo sapiens
gctgtgtgctaggatatgtttt

SEQ ID NO: 6909291 - DNA, 22 bp, Homo sapiens
gggaatgttgactgagagcagg

SEQ ID NO: 6909292 - DNA, 22 bp, Homo sapiens
ccaggctttgtaccaggctttc

SEQ ID NO: 6909293 - DNA, 22 bp, Homo sapiens
acagataatacattgtgctaca

SEQ ID NO: 6909294 - DNA, 22 bp, Homo sapiens
caggcttcagggaacgcagtct

SEQ ID NO: 6909295 - DNA, 22 bp, Homo sapiens
tccctccagaatggtgaggaag

SEQ ID NO: 6909296 - DNA, 22 bp, Homo sapiens
gttcttttggtagagtgtgcat

SEQ ID NO: 6909297 - DNA, 22 bp, Homo sapiens
acatttgtgattatctagggct

SEQ ID NO: 6909298 - DNA, 22 bp, Homo sapiens
gtgccctgtgaactgtaaggaa

SEQ ID NO: 6909299 - DNA, 22 bp, Homo sapiens
gacccaggcctggggcttaagg

SEQ ID NO: 6909300 - DNA, 22 bp, Homo sapiens
cttgtccccagcaggttggttt

SEQ ID NO: 6909301 - DNA, 22 bp, Homo sapiens
ggacaaatttttgtgatgtgct

SEQ ID NO: 6909302 - DNA, 22 bp, Homo sapiens
ctgcagagcataaatctgaata

SEQ ID NO: 6909303 - DNA, 22 bp, Homo sapiens
gatgatgacagtgattagactg

SEQ ID NO: 6909304 - DNA, 22 bp, Homo sapiens
tcaaggaggtgcttggcttcac

SEQ ID NO: 6909305 - DNA, 22 bp, Homo sapiens
catcttggatgacataactgtg

SEQ ID NO: 6909306 - DNA, 22 bp, Homo sapiens
aatatagatttactcaagagaa

SEQ ID NO: 6909307 - DNA, 22 bp, Homo sapiens
tatgagatactacagattgtga

SEQ ID NO: 6909308 - DNA, 22 bp, Homo sapiens
ggaagctaagataatttaagta

SEQ ID NO: 6909309 - DNA, 22 bp, Homo sapiens
tgtcagttctggttggctccca

SEQ ID NO: 6909310 - DNA, 22 bp, Homo sapiens
tgttggtaaatagcttagcaat

SEQ ID NO: 6909311 - DNA, 22 bp, Homo sapiens
acatttctagttgttcatctcc

SEQ ID NO: 6909312 - DNA, 22 bp, Homo sapiens
tctttagccagtatcataatga

SEQ ID NO: 6909313 - DNA, 22 bp, Homo sapiens
tacaaagtagaaattcagtaaa

SEQ ID NO: 6909314 - DNA, 22 bp, Homo sapiens
attcagtgtttgcagcaacttt

SEQ ID NO: 6909315 - DNA, 22 bp, Homo sapiens
ggtctctgttgcctccatcaag

SEQ ID NO: 6909316 - DNA, 22 bp, Homo sapiens
gactctgggctgagccagggcc

SEQ ID NO: 6909317 - DNA, 23 bp, Homo sapiens
ttgggaaatagttaagacatgag

SEQ ID NO: 6909318 - DNA, 22 bp, Homo sapiens
tggacaggtgcacacagcagcc

SEQ ID NO: 6909319 - DNA, 22 bp, Homo sapiens
tagagtgtcataacagtgccca

SEQ ID NO: 6909320 - DNA, 22 bp, Homo sapiens
gtcccagaggacagggtcacat

SEQ ID NO: 6909321 - DNA, 22 bp, Homo sapiens
aggaagctggttacgaagggat

SEQ ID NO: 6909322 - DNA, 22 bp, Homo sapiens
actgcaatctggatcctagaag

SEQ ID NO: 6909323 - DNA, 22 bp, Homo sapiens
gggcttcagctggggatggagc

SEQ ID NO: 6909324 - DNA, 22 bp, Homo sapiens
ggagacatattccagagctggg

SEQ ID NO: 6909325 - DNA, 22 bp, Homo sapiens
atttcctgacttccattgaggc

SEQ ID NO: 6909326 - DNA, 22 bp, Homo sapiens
aggtctgactctttgccacata

SEQ ID NO: 6909327 - DNA, 22 bp, Homo sapiens
gtccaaataagttgcaaaatag

SEQ ID NO: 6909328 - DNA, 22 bp, Homo sapiens
cccagcagttgttggtgcacat

SEQ ID NO: 6909329 - DNA, 22 bp, Homo sapiens
caggcacaagaagcaaatgtta

SEQ ID NO: 6909330 - DNA, 22 bp, Homo sapiens
tggtctttgagagaagttgatt

SEQ ID NO: 6909331 - DNA, 18 bp, Homo sapiens
tgattctgtgatgtggtc

SEQ ID NO: 6909332 - DNA, 22 bp, Homo sapiens
agtcatctgacctcttctcaga

SEQ ID NO: 6909333 - DNA, 22 bp, Homo sapiens
atagatgtctgacacagagaaa

SEQ ID NO: 6909334 - DNA, 22 bp, Homo sapiens
gtgtggcacctcctttccagct

SEQ ID NO: 6909335 - DNA, 17 bp, Homo sapiens
ctcagagttgctttgtc

SEQ ID NO: 6909336 - DNA, 22 bp, Homo sapiens
atgaaacaagggtattttctct

SEQ ID NO: 6909337 - DNA, 22 bp, Homo sapiens
aggccttatctccaaatacagt

SEQ ID NO: 6909338 - DNA, 22 bp, Homo sapiens
gacaagctcccggtggccctcc

SEQ ID NO: 6909339 - DNA, 22 bp, Homo sapiens
ctcagaagaacaaaggctctac

SEQ ID NO: 6909340 - DNA, 22 bp, Homo sapiens
cctctgatgggcacagggtggc

SEQ ID NO: 6909341 - DNA, 22 bp, Homo sapiens
agctatttctcttattatatcc

SEQ ID NO: 6909342 - DNA, 23 bp, Homo sapiens
tgccctcccaatgcttcggtcac

SEQ ID NO: 6909343 - DNA, 22 bp, Homo sapiens
caggtgggtgtatgaatgcaaa

SEQ ID NO: 6909344 - DNA, 20 bp, Homo sapiens
tctgcggaaagggagggtgg

SEQ ID NO: 6909345 - DNA, 22 bp, Homo sapiens
tttattgtttagaagggggctg

SEQ ID NO: 6909346 - DNA, 22 bp, Homo sapiens
acacatctccagaagtgggctg

SEQ ID NO: 6909347 - DNA, 22 bp, Homo sapiens
ttttcaggtacatcacatactg

SEQ ID NO: 6909348 - DNA, 22 bp, Homo sapiens
cactcagggtacaatggagggc

SEQ ID NO: 6909349 - DNA, 22 bp, Homo sapiens
agacagttgatatactataaaa

SEQ ID NO: 6909350 - DNA, 22 bp, Homo sapiens
cctcctgggttcaagcgattct

SEQ ID NO: 6909351 - DNA, 22 bp, Homo sapiens
gagctgaacgggaattccccga

SEQ ID NO: 6909352 - DNA, 22 bp, Homo sapiens
atagtcaaccttgtaattagcc

SEQ ID NO: 6909353 - DNA, 22 bp, Homo sapiens
aaggctatgtgttaaggcagat

SEQ ID NO: 6909354 - DNA, 22 bp, Homo sapiens
gaagtgcctcggtgtccaaggc

SEQ ID NO: 6909355 - DNA, 21 bp, Homo sapiens
aatacagaaatgagtagttgc

SEQ ID NO: 6909356 - DNA, 22 bp, Homo sapiens
atgctttttaaacttaattgga

SEQ ID NO: 6909357 - DNA, 19 bp, Homo sapiens
gaacaatttgttagctctc

SEQ ID NO: 6909358 - DNA, 17 bp, Homo sapiens
tagcatttatcttcctt

SEQ ID NO: 6909359 - DNA, 22 bp, Homo sapiens
tcttatgggaaagatgtaatta

SEQ ID NO: 6909360 - DNA, 23 bp, Homo sapiens
acaagtgtttccaatatggctgg

SEQ ID NO: 6909361 - DNA, 22 bp, Homo sapiens
ctttcaggagaggattataaca

SEQ ID NO: 6909362 - DNA, 22 bp, Homo sapiens
acccagtgacatcctttacctg

SEQ ID NO: 6909363 - DNA, 22 bp, Homo sapiens
aggaggtggctgaacttgaggg

SEQ ID NO: 6909364 - DNA, 22 bp, Homo sapiens
tgcagggatgctagaggtaaga

SEQ ID NO: 6909365 - DNA, 22 bp, Homo sapiens
tagcaaaagccacgattacttt

SEQ ID NO: 6909366 - DNA, 22 bp, Homo sapiens
ggcacacaggcagatggagtgt

SEQ ID NO: 6909367 - DNA, 22 bp, Homo sapiens
gaggtgtcactattttgcttat

SEQ ID NO: 6909368 - DNA, 22 bp, Homo sapiens
cttgttattggaaatgtcatgc

SEQ ID NO: 6909369 - DNA, 22 bp, Homo sapiens
ttcctgtgcttaattctcactg

SEQ ID NO: 6909370 - DNA, 22 bp, Homo sapiens
tggagggaacaaaggagtccca

SEQ ID NO: 6909371 - DNA, 22 bp, Homo sapiens
tttgaagtcagacactgctttg

SEQ ID NO: 6909372 - DNA, 22 bp, Homo sapiens
gcagagtgaaagaatatattaa

SEQ ID NO: 6909373 - DNA, 22 bp, Homo sapiens
ctgcacagggatatggggagct

SEQ ID NO: 6909374 - DNA, 22 bp, Homo sapiens
accagtggatgaatgctggacc

SEQ ID NO: 6909375 - DNA, 22 bp, Homo sapiens
ggagatgggggattttacagcg

SEQ ID NO: 6909376 - DNA, 22 bp, Homo sapiens
agtcaaccggtattagtctgtt

SEQ ID NO: 6909377 - DNA, 22 bp, Homo sapiens
ctgtgcctgcaggccacatcaa

SEQ ID NO: 6909378 - DNA, 21 bp, Homo sapiens
tgcagccattcagccctatgc

SEQ ID NO: 6909379 - DNA, 22 bp, Homo sapiens
agacatggttgagaataaagtg

SEQ ID NO: 6909380 - DNA, 22 bp, Homo sapiens
ctcatgtgcaaaagtccaaatt

SEQ ID NO: 6909381 - DNA, 22 bp, Homo sapiens
acgcagtttgtggacatttttt

SEQ ID NO: 6909382 - DNA, 17 bp, Homo sapiens
gatggggctgacatcag

SEQ ID NO: 6909383 - DNA, 22 bp, Homo sapiens
atatggctcttccaaactgaga

SEQ ID NO: 6909384 - DNA, 23 bp, Homo sapiens
tctaaaattcatcatttacgttc

SEQ ID NO: 6909385 - DNA, 22 bp, Homo sapiens
tgcagcccctatcgcggacagg

SEQ ID NO: 6909386 - DNA, 22 bp, Homo sapiens
ttgtgctaagtgctatgaaggc

SEQ ID NO: 6909387 - DNA, 22 bp, Homo sapiens
cctggcactgaccaggcactga

SEQ ID NO: 6909388 - DNA, 22 bp, Homo sapiens
acagacagtaaatagtgtggct

SEQ ID NO: 6909389 - DNA, 22 bp, Homo sapiens
tttgataatacacaagagaaag

SEQ ID NO: 6909390 - DNA, 22 bp, Homo sapiens
agctaggccatttgttcagtga

SEQ ID NO: 6909391 - DNA, 22 bp, Homo sapiens
ttccctgcaacctttccctggg

SEQ ID NO: 6909392 - DNA, 22 bp, Homo sapiens
gccagctgagaaatcattgata

SEQ ID NO: 6909393 - DNA, 22 bp, Homo sapiens
cctggctggtggcagcgacaag

SEQ ID NO: 6909394 - DNA, 22 bp, Homo sapiens
catgcttaaaaatgcagagagt

SEQ ID NO: 6909395 - DNA, 22 bp, Homo sapiens
ggggagcaatagttgaggtgtg

SEQ ID NO: 6909396 - DNA, 22 bp, Homo sapiens
tctcaggctgtgtgtggaggac

SEQ ID NO: 6909397 - DNA, 22 bp, Homo sapiens
gccaagctggatgaagaggttg

SEQ ID NO: 6909398 - DNA, 22 bp, Homo sapiens
atgaggcaatcatggtccagtt

SEQ ID NO: 6909399 - DNA, 22 bp, Homo sapiens
atgcaaatcttaagtatgtgtg

SEQ ID NO: 6909400 - DNA, 22 bp, Homo sapiens
gccctcagctcctggacacatg

SEQ ID NO: 6909401 - DNA, 22 bp, Homo sapiens
atgtccttcttgagggcttgtt

SEQ ID NO: 6909402 - DNA, 22 bp, Homo sapiens
tgaattcctaatctaaactaag

SEQ ID NO: 6909403 - DNA, 22 bp, Homo sapiens
cctcaggcaggaaactgtcccg

SEQ ID NO: 6909404 - DNA, 22 bp, Homo sapiens
tgaggctcagagcacctgctcc

SEQ ID NO: 6909405 - DNA, 22 bp, Homo sapiens
ttccttgattagtacatgaagg

SEQ ID NO: 6909406 - DNA, 22 bp, Homo sapiens
gcaggagtcactgacttggtcc

SEQ ID NO: 6909407 - DNA, 22 bp, Homo sapiens
tttacatgtccttcaagagcag

SEQ ID NO: 6909408 - DNA, 22 bp, Homo sapiens
caggctgcctggaagaggactg

SEQ ID NO: 6909409 - DNA, 20 bp, Homo sapiens
ctgtgctttggaacctggaa

SEQ ID NO: 6909410 - DNA, 22 bp, Homo sapiens
aggtgattagcttgaaatcctt

SEQ ID NO: 6909411 - DNA, 22 bp, Homo sapiens
aggcctcacacaacagatgcat

SEQ ID NO: 6909412 - DNA, 22 bp, Homo sapiens
agtaactcatgtaaacctcaca

SEQ ID NO: 6909413 - DNA, 22 bp, Homo sapiens
tggcacatccacagaatctgga

SEQ ID NO: 6909414 - DNA, 22 bp, Homo sapiens
gtctccagaggttacatcctgt

SEQ ID NO: 6909415 - DNA, 22 bp, Homo sapiens
gtgtccagcgtggaatgagggt

SEQ ID NO: 6909416 - DNA, 22 bp, Homo sapiens
tttgaacttctccattctgatg

SEQ ID NO: 6909417 - DNA, 19 bp, Homo sapiens
ggacatttgagttgtttat

SEQ ID NO: 6909418 - DNA, 22 bp, Homo sapiens
gtctgccctgcagacatgcctc

SEQ ID NO: 6909419 - DNA, 22 bp, Homo sapiens
accgcagtgacgtgggacttcc

SEQ ID NO: 6909420 - DNA, 22 bp, Homo sapiens
gaatgagtagagtataaacaaa

SEQ ID NO: 6909421 - DNA, 22 bp, Homo sapiens
gcctggtgataagcagtgacct

SEQ ID NO: 6909422 - DNA, 22 bp, Homo sapiens
ccagagtccctgttctcggcct

SEQ ID NO: 6909423 - DNA, 22 bp, Homo sapiens
tctcatcacacagccagtatgt

SEQ ID NO: 6909424 - DNA, 22 bp, Homo sapiens
gtcctgggggcagctgtgtcca

SEQ ID NO: 6909425 - DNA, 22 bp, Homo sapiens
atatgagagtaaatgccgatct

SEQ ID NO: 6909426 - DNA, 22 bp, Homo sapiens
ggaggggctcctgttcgccccc

SEQ ID NO: 6909427 - DNA, 22 bp, Homo sapiens
atgtgcaaagggacttgcacat

SEQ ID NO: 6909428 - DNA, 22 bp, Homo sapiens
cgtccttacagagggtcacagc

SEQ ID NO: 6909429 - DNA, 22 bp, Homo sapiens
ctctgagttgaggcaggagagt

SEQ ID NO: 6909430 - DNA, 22 bp, Homo sapiens
taaatcagcctttgctatttta

SEQ ID NO: 6909431 - DNA, 22 bp, Homo sapiens
ctggagagaaatgacaaagcta

SEQ ID NO: 6909432 - DNA, 22 bp, Homo sapiens
gccagatttacagatttgccct

SEQ ID NO: 6909433 - DNA, 22 bp, Homo sapiens
tttgcaaattagccaccctgtt

SEQ ID NO: 6909434 - DNA, 22 bp, Homo sapiens
atggaacatgaattaatatggt

SEQ ID NO: 6909435 - DNA, 22 bp, Homo sapiens
agtcatctcaggtagcatttac

SEQ ID NO: 6909436 - DNA, 22 bp, Homo sapiens
tacacagatatgtgatcaatca

SEQ ID NO: 6909437 - DNA, 22 bp, Homo sapiens
aagcatttggcatgaaactctt

SEQ ID NO: 6909438 - DNA, 22 bp, Homo sapiens
ccatttacattgtactctgtga

SEQ ID NO: 6909439 - DNA, 22 bp, Homo sapiens
tgttgctcttttttaggtgagt

SEQ ID NO: 6909440 - DNA, 22 bp, Homo sapiens
acagagttgtgtttgtacaacg

SEQ ID NO: 6909441 - DNA, 22 bp, Homo sapiens
gggctgagtgacctcaggccaa

SEQ ID NO: 6909442 - DNA, 22 bp, Homo sapiens
atttctgtagtccacattcttt

SEQ ID NO: 6909443 - DNA, 22 bp, Homo sapiens
attctggaagcaagcttttaaa

SEQ ID NO: 6909444 - DNA, 22 bp, Homo sapiens
ctgaatccattcatgcaagata

SEQ ID NO: 6909445 - DNA, 22 bp, Homo sapiens
acagtgtaatatgggagtcagt

SEQ ID NO: 6909446 - DNA, 20 bp, Homo sapiens
gcaactagggagacacagct

SEQ ID NO: 6909447 - DNA, 22 bp, Homo sapiens
ccactgaggcctgggcccaggg

SEQ ID NO: 6909448 - DNA, 23 bp, Homo sapiens
aggcagcaggttgtccagggtga

SEQ ID NO: 6909449 - DNA, 22 bp, Homo sapiens
agctcccattatcttctgaaac

SEQ ID NO: 6909450 - DNA, 22 bp, Homo sapiens
gcccaggagttcaaggctgcag

SEQ ID NO: 6909451 - DNA, 20 bp, Homo sapiens
cacaggaaagctactcagtt

SEQ ID NO: 6909452 - DNA, 21 bp, Homo sapiens
tgagtttcagaggggaaggaa

SEQ ID NO: 6909453 - DNA, 23 bp, Homo sapiens
ccactggagaaagtggcaggtgg

SEQ ID NO: 6909454 - DNA, 22 bp, Homo sapiens
gtgcctggggttgagctatgaa

SEQ ID NO: 6909455 - DNA, 22 bp, Homo sapiens
tctggctcccagcctgctctca

SEQ ID NO: 6909456 - DNA, 20 bp, Homo sapiens
agtatgtatatgtaacgtgt

SEQ ID NO: 6909457 - DNA, 22 bp, Homo sapiens
acctccctgggttatcggggca

SEQ ID NO: 6909458 - DNA, 22 bp, Homo sapiens
atgtttgttgaacatctactgc

SEQ ID NO: 6909459 - DNA, 22 bp, Homo sapiens
gaggtgggatgtgtgtgctact

SEQ ID NO: 6909460 - DNA, 20 bp, Homo sapiens
tgccttttatacctttaaac

SEQ ID NO: 6909461 - DNA, 22 bp, Homo sapiens
gtggtttaggggaaagaactgt

SEQ ID NO: 6909462 - DNA, 22 bp, Homo sapiens
ccaagaggggcagagggctgca

SEQ ID NO: 6909463 - DNA, 23 bp, Homo sapiens
cccagcgctgagccctgcaggca

SEQ ID NO: 6909464 - DNA, 22 bp, Homo sapiens
gggtccagtttcatctgaggtt

SEQ ID NO: 6909465 - DNA, 22 bp, Homo sapiens
taaagtgcatgcggggccagat

SEQ ID NO: 6909466 - DNA, 22 bp, Homo sapiens
tatgaagtagagcagagatgcc

SEQ ID NO: 6909467 - DNA, 22 bp, Homo sapiens
gaacaaagacatggaggaggat

SEQ ID NO: 6909468 - DNA, 22 bp, Homo sapiens
aacttggcttgcatggctgaaa

SEQ ID NO: 6909469 - DNA, 22 bp, Homo sapiens
acagggagccccagcatttcca

SEQ ID NO: 6909470 - DNA, 17 bp, Homo sapiens
ggcaaggttccttttca

SEQ ID NO: 6909471 - DNA, 18 bp, Homo sapiens
tgctacccagttcagggt

SEQ ID NO: 6909472 - DNA, 22 bp, Homo sapiens
caatattcagtggaaaagccat

SEQ ID NO: 6909473 - DNA, 22 bp, Homo sapiens
ataaacacttctagggcacaca

SEQ ID NO: 6909474 - DNA, 22 bp, Homo sapiens
ttaggtttaagtgactggaatc

SEQ ID NO: 6909475 - DNA, 22 bp, Homo sapiens
ctgcctctataggagtccacca

SEQ ID NO: 6909476 - DNA, 22 bp, Homo sapiens
gcagacacatccactcctacag

SEQ ID NO: 6909477 - DNA, 22 bp, Homo sapiens
gcatttcagagaaaatctgctt

SEQ ID NO: 6909478 - DNA, 22 bp, Homo sapiens
ttctctcccatgaagcttctat

SEQ ID NO: 6909479 - DNA, 22 bp, Homo sapiens
aagcctggactatcgcgtgtgc

SEQ ID NO: 6909480 - DNA, 22 bp, Homo sapiens
ctagctgtgtaaaccgagctgc

SEQ ID NO: 6909481 - DNA, 22 bp, Homo sapiens
aatcctggaatacaagagtgaa

SEQ ID NO: 6909482 - DNA, 22 bp, Homo sapiens
agatgtgactgggcaagttact

SEQ ID NO: 6909483 - DNA, 22 bp, Homo sapiens
gctctgagtgagactagattta

SEQ ID NO: 6909484 - DNA, 22 bp, Homo sapiens
tttcctaggctctagagttcta

SEQ ID NO: 6909485 - DNA, 22 bp, Homo sapiens
gagcaaacatcagtgatgtctg

SEQ ID NO: 6909486 - DNA, 22 bp, Homo sapiens
aactttggtcagagaaattgtg

SEQ ID NO: 6909487 - DNA, 22 bp, Homo sapiens
ctgtggctgcctcacctacagg

SEQ ID NO: 6909488 - DNA, 22 bp, Homo sapiens
tggcaatgtaaattgaactaga

SEQ ID NO: 6909489 - DNA, 22 bp, Homo sapiens
gacacagggacgtgctctgcct

SEQ ID NO: 6909490 - DNA, 22 bp, Homo sapiens
catgccaggactctggaggctt

SEQ ID NO: 6909491 - DNA, 22 bp, Homo sapiens
ggttcacaggtcctgggagcag

SEQ ID NO: 6909492 - DNA, 22 bp, Homo sapiens
tgtaaataattcctaggctttt

SEQ ID NO: 6909493 - DNA, 22 bp, Homo sapiens
aaaacactgcaaagctgattgg

SEQ ID NO: 6909494 - DNA, 22 bp, Homo sapiens
agtgtcatttccacgacattca

SEQ ID NO: 6909495 - DNA, 22 bp, Homo sapiens
accagctggtcacctgggcact

SEQ ID NO: 6909496 - DNA, 22 bp, Homo sapiens
agcaggagcccttatcaccagg

SEQ ID NO: 6909497 - DNA, 22 bp, Homo sapiens
tatacaggaactgttggctccc

SEQ ID NO: 6909498 - DNA, 23 bp, Homo sapiens
tggagccaaacatcacatgcctg

SEQ ID NO: 6909499 - DNA, 22 bp, Homo sapiens
accagagggcaaaccccagtgt

SEQ ID NO: 6909500 - DNA, 22 bp, Homo sapiens
ggacactttgagttgaaggggt

SEQ ID NO: 6909501 - DNA, 22 bp, Homo sapiens
gaagctctcaaactctcccctt

SEQ ID NO: 6909502 - DNA, 22 bp, Homo sapiens
ctgttaagcaacatgagtaagt

SEQ ID NO: 6909503 - DNA, 22 bp, Homo sapiens
actcttcagggcagtgagcggg

SEQ ID NO: 6909504 - DNA, 22 bp, Homo sapiens
gacagtgtgaacatctaatagt

SEQ ID NO: 6909505 - DNA, 15 bp, Homo sapiens
gagtggctggtgaaa

SEQ ID NO: 6909506 - DNA, 22 bp, Homo sapiens
cagtgtgaggaattagtgtcca

SEQ ID NO: 6909507 - DNA, 22 bp, Homo sapiens
agtgtggctgcgtagggctctc

SEQ ID NO: 6909508 - DNA, 22 bp, Homo sapiens
tttccttgcctcctgtccttct

SEQ ID NO: 6909509 - DNA, 22 bp, Homo sapiens
agggtcaacaggagtcaagatg

SEQ ID NO: 6909510 - DNA, 22 bp, Homo sapiens
gtatttcagttcctcttgtgac

SEQ ID NO: 6909511 - DNA, 22 bp, Homo sapiens
aaagagtttggagacaagatca

SEQ ID NO: 6909512 - DNA, 22 bp, Homo sapiens
tattgtattaaggattcaagta

SEQ ID NO: 6909513 - DNA, 22 bp, Homo sapiens
ctgagggaggagaattgcttga

SEQ ID NO: 6909514 - DNA, 22 bp, Homo sapiens
tccctcagacagatgtgttcct

SEQ ID NO: 6909515 - DNA, 22 bp, Homo sapiens
aatcagtcattagctctgacct

SEQ ID NO: 6909516 - DNA, 22 bp, Homo sapiens
gagggctgaagtgttttatgag

SEQ ID NO: 6909517 - DNA, 22 bp, Homo sapiens
ttcctgcctacatgccttatgc

SEQ ID NO: 6909518 - DNA, 22 bp, Homo sapiens
atacacatttgctagagatggg

SEQ ID NO: 6909519 - DNA, 22 bp, Homo sapiens
gatgtttatatctaacttaagt

SEQ ID NO: 6909520 - DNA, 22 bp, Homo sapiens
tgtgtgccagatacaagcactg

SEQ ID NO: 6909521 - DNA, 22 bp, Homo sapiens
gaaggctggctcagctttccag

SEQ ID NO: 6909522 - DNA, 22 bp, Homo sapiens
ccagccctgccagagagagctg

SEQ ID NO: 6909523 - DNA, 22 bp, Homo sapiens
gtgaatcagctcacgaaaatgg

SEQ ID NO: 6909524 - DNA, 21 bp, Homo sapiens
cctggcactggcctgctgagc

SEQ ID NO: 6909525 - DNA, 22 bp, Homo sapiens
aagaggttgtacctaaagtgtt

SEQ ID NO: 6909526 - DNA, 22 bp, Homo sapiens
gcagattgtggggttcaggttt

SEQ ID NO: 6909527 - DNA, 22 bp, Homo sapiens
agggcacctgttttagcttggt

SEQ ID NO: 6909528 - DNA, 22 bp, Homo sapiens
tgtggctgtggatgctttccag

SEQ ID NO: 6909529 - DNA, 21 bp, Homo sapiens
tgaggtagccagtgagatgga

SEQ ID NO: 6909530 - DNA, 22 bp, Homo sapiens
tcattgagtaatactgtagtgt

SEQ ID NO: 6909531 - DNA, 22 bp, Homo sapiens
tgagaccttggactccatcctt

SEQ ID NO: 6909532 - DNA, 22 bp, Homo sapiens
tctttcgggggagttccggaca

SEQ ID NO: 6909533 - DNA, 22 bp, Homo sapiens
aatgcaaagctctttaatcctt

SEQ ID NO: 6909534 - DNA, 22 bp, Homo sapiens
tgagctgtagcagatgctgttg

SEQ ID NO: 6909535 - DNA, 23 bp, Homo sapiens
acagcttcctactttgctgctgc

SEQ ID NO: 6909536 - DNA, 22 bp, Homo sapiens
gacatttagaagtctaatggcc

SEQ ID NO: 6909537 - DNA, 22 bp, Homo sapiens
gtgtccagcctgcacagggtgc

SEQ ID NO: 6909538 - DNA, 22 bp, Homo sapiens
tctgtcttctgtagctaataat

SEQ ID NO: 6909539 - DNA, 22 bp, Homo sapiens
gattacattctccttgtattag

SEQ ID NO: 6909540 - DNA, 19 bp, Homo sapiens
ggtcctcagcagagcatgc

SEQ ID NO: 6909541 - DNA, 22 bp, Homo sapiens
tccctggaacagagagacaacg

SEQ ID NO: 6909542 - DNA, 20 bp, Homo sapiens
tcttggctgtgtgaggacac

SEQ ID NO: 6909543 - DNA, 22 bp, Homo sapiens
agcgtgtggagaactaagcaga

SEQ ID NO: 6909544 - DNA, 22 bp, Homo sapiens
aggtgggcaatgaggcctgagt

SEQ ID NO: 6909545 - DNA, 22 bp, Homo sapiens
tctagaatgttccaccttgttt

SEQ ID NO: 6909546 - DNA, 22 bp, Homo sapiens
tcacatgccttttactctgcac

SEQ ID NO: 6909547 - DNA, 20 bp, Homo sapiens
agcacctgtgtagaagcatc

SEQ ID NO: 6909548 - DNA, 16 bp, Homo sapiens
gccctctgcataagga

SEQ ID NO: 6909549 - DNA, 22 bp, Homo sapiens
gtcttcaacaataactaccact

SEQ ID NO: 6909550 - DNA, 22 bp, Homo sapiens
gccctaggcttttgtgactgcc

SEQ ID NO: 6909551 - DNA, 22 bp, Homo sapiens
ctgggcctgtcagggctttttg

SEQ ID NO: 6909552 - DNA, 22 bp, Homo sapiens
aatggctgccagggcaggaggt

SEQ ID NO: 6909553 - DNA, 22 bp, Homo sapiens
agctagtatttcattgaggatt

SEQ ID NO: 6909554 - DNA, 22 bp, Homo sapiens
tggctcagagcagggactctgg

SEQ ID NO: 6909555 - DNA, 22 bp, Homo sapiens
ctcatgtaagagagcattagtt

SEQ ID NO: 6909556 - DNA, 21 bp, Homo sapiens
atgccaaacttcttctgccct

SEQ ID NO: 6909557 - DNA, 22 bp, Homo sapiens
caggtggctaacggcctcatag

SEQ ID NO: 6909558 - DNA, 22 bp, Homo sapiens
acagtgttatttctgagtaatg

SEQ ID NO: 6909559 - DNA, 21 bp, Homo sapiens
taatataggttcacaactagt

SEQ ID NO: 6909560 - DNA, 22 bp, Homo sapiens
acatgcactggttgaggggttt

SEQ ID NO: 6909561 - DNA, 22 bp, Homo sapiens
ctgcacatgtccctaagtgtca

SEQ ID NO: 6909562 - DNA, 22 bp, Homo sapiens
caggaggaaagttccactcaac

SEQ ID NO: 6909563 - DNA, 22 bp, Homo sapiens
agctttatcttcacctgggaat

SEQ ID NO: 6909564 - DNA, 22 bp, Homo sapiens
tcatgggtgctccaggtggctg

SEQ ID NO: 6909565 - DNA, 22 bp, Homo sapiens
ctgattattactttccaggcgg

SEQ ID NO: 6909566 - DNA, 22 bp, Homo sapiens
ttcaccatcattaacttcatgt

SEQ ID NO: 6909567 - DNA, 22 bp, Homo sapiens
ctgggaacgtgcttagctgact

SEQ ID NO: 6909568 - DNA, 22 bp, Homo sapiens
gtacaacaggattgatgtacca

SEQ ID NO: 6909569 - DNA, 22 bp, Homo sapiens
tttaggataactccagttttcc

SEQ ID NO: 6909570 - DNA, 22 bp, Homo sapiens
cctttggtaacattccaacctt

SEQ ID NO: 6909571 - DNA, 22 bp, Homo sapiens
atttctgtttgctactataagt

SEQ ID NO: 6909572 - DNA, 20 bp, Homo sapiens
ggtgagacaggcttctgcac

SEQ ID NO: 6909573 - DNA, 22 bp, Homo sapiens
ccattccttcatcaaaaggcct

SEQ ID NO: 6909574 - DNA, 22 bp, Homo sapiens
tacagtaccctgatgaactaaa

SEQ ID NO: 6909575 - DNA, 22 bp, Homo sapiens
taagtaatttgtgcagagatac

SEQ ID NO: 6909576 - DNA, 22 bp, Homo sapiens
tgcatggaaaagctaggcagcc

SEQ ID NO: 6909577 - DNA, 22 bp, Homo sapiens
agaatacatcaatctattttct

SEQ ID NO: 6909578 - DNA, 22 bp, Homo sapiens
tgtgctgagtgatcccattcct

SEQ ID NO: 6909579 - DNA, 17 bp, Homo sapiens
agaaaagagaccagcag

SEQ ID NO: 6909580 - DNA, 22 bp, Homo sapiens
cttctgtgctaaatgcaaaacc

SEQ ID NO: 6909581 - DNA, 22 bp, Homo sapiens
ccaaagtccatagtttacatta

SEQ ID NO: 6909582 - DNA, 22 bp, Homo sapiens
gaaacatattaatccagtgaaa

SEQ ID NO: 6909583 - DNA, 22 bp, Homo sapiens
gcctgggacccttagctcttgg

SEQ ID NO: 6909584 - DNA, 22 bp, Homo sapiens
tttcattataaaaagttggctt

SEQ ID NO: 6909585 - DNA, 22 bp, Homo sapiens
tgctgatctatcacctctgaga

SEQ ID NO: 6909586 - DNA, 22 bp, Homo sapiens
ccatagaactctgaggccagag

SEQ ID NO: 6909587 - DNA, 22 bp, Homo sapiens
gttctttaacctagtctcattt

SEQ ID NO: 6909588 - DNA, 22 bp, Homo sapiens
gtggctgcatcggggtgaccag

SEQ ID NO: 6909589 - DNA, 22 bp, Homo sapiens
atcaaagagcttgacaatccta

SEQ ID NO: 6909590 - DNA, 22 bp, Homo sapiens
gcacatgcctgcatatccgtgt

SEQ ID NO: 6909591 - DNA, 22 bp, Homo sapiens
atacacgtgtgtgtacatgcac

SEQ ID NO: 6909592 - DNA, 22 bp, Homo sapiens
agtagcaatggctctgagctat

SEQ ID NO: 6909593 - DNA, 22 bp, Homo sapiens
aaggcttggagtaagcttggct

SEQ ID NO: 6909594 - DNA, 22 bp, Homo sapiens
ttaccattttataagttaaagt

SEQ ID NO: 6909595 - DNA, 22 bp, Homo sapiens
acctgaaaccaacttgtgtact

SEQ ID NO: 6909596 - DNA, 22 bp, Homo sapiens
gtaccagtctctgtgggcacct

SEQ ID NO: 6909597 - DNA, 22 bp, Homo sapiens
acccttttgcctttaattcatg

SEQ ID NO: 6909598 - DNA, 22 bp, Homo sapiens
cttgggctgtgccttaaattct

SEQ ID NO: 6909599 - DNA, 22 bp, Homo sapiens
aactccagactactaatttagt

SEQ ID NO: 6909600 - DNA, 22 bp, Homo sapiens
aattttaatcagtggtgctgag

SEQ ID NO: 6909601 - DNA, 22 bp, Homo sapiens
acagtgggacagtgacggggga

SEQ ID NO: 6909602 - DNA, 22 bp, Homo sapiens
tggcccaaggttacatggctag

SEQ ID NO: 6909603 - DNA, 22 bp, Homo sapiens
ggaaagatttgtcacatgaatg

SEQ ID NO: 6909604 - DNA, 22 bp, Homo sapiens
tcctgggactttcaaggctagg

SEQ ID NO: 6909605 - DNA, 23 bp, Homo sapiens
tcttcatgcccaggccttggtgc

SEQ ID NO: 6909606 - DNA, 22 bp, Homo sapiens
caagggacagttatgagaccct

SEQ ID NO: 6909607 - DNA, 18 bp, Homo sapiens
agtgtcagctgcagctca

SEQ ID NO: 6909608 - DNA, 22 bp, Homo sapiens
gtgcagccatttgcatgcttcc

SEQ ID NO: 6909609 - DNA, 22 bp, Homo sapiens
aatgtataaccataggaaattt

SEQ ID NO: 6909610 - DNA, 21 bp, Homo sapiens
gagcgccgctcacctcccctg

SEQ ID NO: 6909611 - DNA, 23 bp, Homo sapiens
agctaacagatcgacaaagtata

SEQ ID NO: 6909612 - DNA, 22 bp, Homo sapiens
cataacacctgatggcaatgat

SEQ ID NO: 6909613 - DNA, 22 bp, Homo sapiens
cttgtattcttgtacctttcaa

SEQ ID NO: 6909614 - DNA, 22 bp, Homo sapiens
aagtatttctggcctgtgaaag

SEQ ID NO: 6909615 - DNA, 22 bp, Homo sapiens
cttgtttgattattgcctgagg

SEQ ID NO: 6909616 - DNA, 22 bp, Homo sapiens
tttactgttcaacttgcaagta

SEQ ID NO: 6909617 - DNA, 21 bp, Homo sapiens
gtacaagctcaccaagtggac

SEQ ID NO: 6909618 - DNA, 22 bp, Homo sapiens
tacagttactttgaaaattgat

SEQ ID NO: 6909619 - DNA, 21 bp, Homo sapiens
tccgggaggtggaggctgcag

SEQ ID NO: 6909620 - DNA, 22 bp, Homo sapiens
aatgtagttgactgtgctgtag

SEQ ID NO: 6909621 - DNA, 22 bp, Homo sapiens
tcacactctgcgggtgaccttt

SEQ ID NO: 6909622 - DNA, 22 bp, Homo sapiens
tcacctgttcaacagcaataat

SEQ ID NO: 6909623 - DNA, 22 bp, Homo sapiens
tcagagaagtaaggtggggtgc

SEQ ID NO: 6909624 - DNA, 22 bp, Homo sapiens
aaaagagcaaacatgtaatagt

SEQ ID NO: 6909625 - DNA, 22 bp, Homo sapiens
cttattcagcaagtttgggtac

SEQ ID NO: 6909626 - DNA, 22 bp, Homo sapiens
gtgtgtttcagaagccaggtgt

SEQ ID NO: 6909627 - DNA, 22 bp, Homo sapiens
ttcatgatagtattttttgtga

SEQ ID NO: 6909628 - DNA, 22 bp, Homo sapiens
ggggggctgttctggacaggaa

SEQ ID NO: 6909629 - DNA, 21 bp, Homo sapiens
attacagcagtggccaaatgc

SEQ ID NO: 6909630 - DNA, 22 bp, Homo sapiens
ctgctgtcccagcctcctcaca

SEQ ID NO: 6909631 - DNA, 22 bp, Homo sapiens
aataaacttccactgtgttttt

SEQ ID NO: 6909632 - DNA, 22 bp, Homo sapiens
tgattgactttagaatagcact

SEQ ID NO: 6909633 - DNA, 22 bp, Homo sapiens
ggctgagcggactggggtccct

SEQ ID NO: 6909634 - DNA, 23 bp, Homo sapiens
tgtttctagaatcattgatgtct

SEQ ID NO: 6909635 - DNA, 22 bp, Homo sapiens
aggggaaggccagcctgtagag

SEQ ID NO: 6909636 - DNA, 22 bp, Homo sapiens
ttagttgcctcagtgggcactt

SEQ ID NO: 6909637 - DNA, 22 bp, Homo sapiens
tactcgaaatcagagagaataa

SEQ ID NO: 6909638 - DNA, 22 bp, Homo sapiens
gaaacttgcctgaagtcaacca

SEQ ID NO: 6909639 - DNA, 22 bp, Homo sapiens
atttgcttatctccacagttgt

SEQ ID NO: 6909640 - DNA, 22 bp, Homo sapiens
agtatgaacctgggttctggat

SEQ ID NO: 6909641 - DNA, 22 bp, Homo sapiens
tatgttgtggcctgaataactg

SEQ ID NO: 6909642 - DNA, 22 bp, Homo sapiens
gaggctagagcaggggctcaat

SEQ ID NO: 6909643 - DNA, 22 bp, Homo sapiens
tgagagaaacgttccttacatc

SEQ ID NO: 6909644 - DNA, 18 bp, Homo sapiens
ttatttgttacagcacat

SEQ ID NO: 6909645 - DNA, 22 bp, Homo sapiens
tgagtactcttctcactacacc

SEQ ID NO: 6909646 - DNA, 22 bp, Homo sapiens
ccattctgtccagaggaggaag

SEQ ID NO: 6909647 - DNA, 19 bp, Homo sapiens
aaggcagaagttggatatg

SEQ ID NO: 6909648 - DNA, 22 bp, Homo sapiens
cggcagagccctgagtcagcct

SEQ ID NO: 6909649 - DNA, 22 bp, Homo sapiens
ttgaaagacattatttatatat

SEQ ID NO: 6909650 - DNA, 22 bp, Homo sapiens
gtcagttattcaattggtttaa

SEQ ID NO: 6909651 - DNA, 22 bp, Homo sapiens
ccagcatctaacgctcctggga

SEQ ID NO: 6909652 - DNA, 22 bp, Homo sapiens
ctggaggtaagaggccctgggc

SEQ ID NO: 6909653 - DNA, 22 bp, Homo sapiens
cagtgcttttaaaacaacatca

SEQ ID NO: 6909654 - DNA, 22 bp, Homo sapiens
tccttagccggagcagctcatc

SEQ ID NO: 6909655 - DNA, 22 bp, Homo sapiens
tctttgcaaaatacaacaatgg

SEQ ID NO: 6909656 - DNA, 22 bp, Homo sapiens
tgtagggagaagagaggcacct

SEQ ID NO: 6909657 - DNA, 22 bp, Homo sapiens
aaccactggctctaacattttg

SEQ ID NO: 6909658 - DNA, 22 bp, Homo sapiens
ctgaactatgtaaaagtaagct

SEQ ID NO: 6909659 - DNA, 22 bp, Homo sapiens
ctcaggatgcaggtcacaggac

SEQ ID NO: 6909660 - DNA, 22 bp, Homo sapiens
taaatttacccaaggaacatgt

SEQ ID NO: 6909661 - DNA, 22 bp, Homo sapiens
actgggactgtatgtgctggac

SEQ ID NO: 6909662 - DNA, 22 bp, Homo sapiens
agctggctttatggttggctaa

SEQ ID NO: 6909663 - DNA, 22 bp, Homo sapiens
cttggctccttcacagggagat

SEQ ID NO: 6909664 - DNA, 22 bp, Homo sapiens
tttggcaatatctgaattatag

SEQ ID NO: 6909665 - DNA, 22 bp, Homo sapiens
tgtcactttttataggtgttga

SEQ ID NO: 6909666 - DNA, 22 bp, Homo sapiens
ccaggcttttctcatggagtca

SEQ ID NO: 6909667 - DNA, 22 bp, Homo sapiens
caggctcggaagtgctggcttt

SEQ ID NO: 6909668 - DNA, 20 bp, Homo sapiens
ttctagtttggagttattaa

SEQ ID NO: 6909669 - DNA, 17 bp, Homo sapiens
gactttggagtttcata

SEQ ID NO: 6909670 - DNA, 22 bp, Homo sapiens
tagccacatgcagactttcatg

SEQ ID NO: 6909671 - DNA, 22 bp, Homo sapiens
acaggatggccagctgatattg

SEQ ID NO: 6909672 - DNA, 22 bp, Homo sapiens
taagtttaaccctctgggacta

SEQ ID NO: 6909673 - DNA, 22 bp, Homo sapiens
actctttgtctgttgccgctta

SEQ ID NO: 6909674 - DNA, 22 bp, Homo sapiens
ttctatacaaagatttctcaca

SEQ ID NO: 6909675 - DNA, 22 bp, Homo sapiens
aagatgttaggaaagttagggt

SEQ ID NO: 6909676 - DNA, 22 bp, Homo sapiens
tgggcagttgctcctcagaccc

SEQ ID NO: 6909677 - DNA, 22 bp, Homo sapiens
gctgccaggccctggggctatg

SEQ ID NO: 6909678 - DNA, 22 bp, Homo sapiens
tattaaattatggatttaggag

SEQ ID NO: 6909679 - DNA, 22 bp, Homo sapiens
tttactgttttatattgtccag

SEQ ID NO: 6909680 - DNA, 22 bp, Homo sapiens
attcaaggtttattcagtttag

SEQ ID NO: 6909681 - DNA, 20 bp, Homo sapiens
aattttactgtcctatagag

SEQ ID NO: 6909682 - DNA, 22 bp, Homo sapiens
ggcgttgctctccccaggctca

SEQ ID NO: 6909683 - DNA, 22 bp, Homo sapiens
agagtggcctggcctggggcat

SEQ ID NO: 6909684 - DNA, 22 bp, Homo sapiens
ttgtttctccagtctaggaaaa

SEQ ID NO: 6909685 - DNA, 22 bp, Homo sapiens
tgttcaaatgatcttcttaaat

SEQ ID NO: 6909686 - DNA, 22 bp, Homo sapiens
tgcagaatttagggaggcagca

SEQ ID NO: 6909687 - DNA, 22 bp, Homo sapiens
aagctgtcaggaggttaccttt

SEQ ID NO: 6909688 - DNA, 22 bp, Homo sapiens
ccaggcctctggctgcttagtc

SEQ ID NO: 6909689 - DNA, 22 bp, Homo sapiens
gctcagagcactcagactcagc

SEQ ID NO: 6909690 - DNA, 22 bp, Homo sapiens
aatcaagagttgtgtaatattt

SEQ ID NO: 6909691 - DNA, 22 bp, Homo sapiens
tggcacatagtaggtgctcaat

SEQ ID NO: 6909692 - DNA, 17 bp, Homo sapiens
ggcaggtgacagacacc

SEQ ID NO: 6909693 - DNA, 22 bp, Homo sapiens
aaagctctctgaacaccagacc

SEQ ID NO: 6909694 - DNA, 22 bp, Homo sapiens
acatttggcatcttgtaacact

SEQ ID NO: 6909695 - DNA, 22 bp, Homo sapiens
atagcaccatgactaaacaatt

SEQ ID NO: 6909696 - DNA, 18 bp, Homo sapiens
ctgtgggctggtgcatga

SEQ ID NO: 6909697 - DNA, 22 bp, Homo sapiens
gcccaggaagtgactcagatgt

SEQ ID NO: 6909698 - DNA, 22 bp, Homo sapiens
tatactctgaaaacaatagtag

SEQ ID NO: 6909699 - DNA, 22 bp, Homo sapiens
atgaagatggttcaactggcct

SEQ ID NO: 6909700 - DNA, 22 bp, Homo sapiens
cagcttgcacacatattagacg

SEQ ID NO: 6909701 - DNA, 22 bp, Homo sapiens
atctcaaatgattacaccaagc

SEQ ID NO: 6909702 - DNA, 22 bp, Homo sapiens
tcccagagaaagtcaaggtctt

SEQ ID NO: 6909703 - DNA, 17 bp, Homo sapiens
atgttaatttcacattt

SEQ ID NO: 6909704 - DNA, 22 bp, Homo sapiens
gtgtaatttctaggtaatttga

SEQ ID NO: 6909705 - DNA, 22 bp, Homo sapiens
aatttcagatgtcataaatata

SEQ ID NO: 6909706 - DNA, 22 bp, Homo sapiens
tcctagcttgtcagttctctaa

SEQ ID NO: 6909707 - DNA, 22 bp, Homo sapiens
aacactgtaacagcatcatttt

SEQ ID NO: 6909708 - DNA, 22 bp, Homo sapiens
gcgtcttttagattttacatct

SEQ ID NO: 6909709 - DNA, 22 bp, Homo sapiens
tgatgtgatagaaaggtagtgg

SEQ ID NO: 6909710 - DNA, 22 bp, Homo sapiens
ctgccctgtctttttctgatga

SEQ ID NO: 6909711 - DNA, 21 bp, Homo sapiens
gtcagtgctgaaacaccttcc

SEQ ID NO: 6909712 - DNA, 22 bp, Homo sapiens
aacccatgttggaagcttatca

SEQ ID NO: 6909713 - DNA, 20 bp, Homo sapiens
tgacatctgttgaggaggaa

SEQ ID NO: 6909714 - DNA, 22 bp, Homo sapiens
tcactaatgagctaaggaaaag

SEQ ID NO: 6909715 - DNA, 22 bp, Homo sapiens
ctgcccattcaaccagctacag

SEQ ID NO: 6909716 - DNA, 22 bp, Homo sapiens
gcaaggctgtgcactttgcatt

SEQ ID NO: 6909717 - DNA, 22 bp, Homo sapiens
tgatcagtaaccaatcacatca

SEQ ID NO: 6909718 - DNA, 22 bp, Homo sapiens
tatccatattaagatgcctctg

SEQ ID NO: 6909719 - DNA, 22 bp, Homo sapiens
aatgatgccctggagttttgca

SEQ ID NO: 6909720 - DNA, 22 bp, Homo sapiens
cagctattttctcattaaggat

SEQ ID NO: 6909721 - DNA, 22 bp, Homo sapiens
ttccaagacacctttagtcact

SEQ ID NO: 6909722 - DNA, 22 bp, Homo sapiens
ggctggtcctttctctgtccta

SEQ ID NO: 6909723 - DNA, 22 bp, Homo sapiens
agctggtatgaacaggatagga

SEQ ID NO: 6909724 - DNA, 22 bp, Homo sapiens
gctggtgtctaacctggctctt

SEQ ID NO: 6909725 - DNA, 22 bp, Homo sapiens
attcagcttcaatgtcttcacc

SEQ ID NO: 6909726 - DNA, 22 bp, Homo sapiens
agaaatgggccttgggacacaa

SEQ ID NO: 6909727 - DNA, 22 bp, Homo sapiens
ctgagagatcaagccacaggat

SEQ ID NO: 6909728 - DNA, 22 bp, Homo sapiens
attggttaactctgtgtgtcaa

SEQ ID NO: 6909729 - DNA, 22 bp, Homo sapiens
ctctggggttaagcttccatgg

SEQ ID NO: 6909730 - DNA, 22 bp, Homo sapiens
gctaaagtttccgtctttcatt

SEQ ID NO: 6909731 - DNA, 22 bp, Homo sapiens
ttagtagaatgttatagcaatt

SEQ ID NO: 6909732 - DNA, 22 bp, Homo sapiens
gagttacatggacattctctcc

SEQ ID NO: 6909733 - DNA, 21 bp, Homo sapiens
aaagcatcacgaacatttggg

SEQ ID NO: 6909734 - DNA, 22 bp, Homo sapiens
atgccaaattctactttcagca

SEQ ID NO: 6909735 - DNA, 22 bp, Homo sapiens
agtactttagcataaagcagtt

SEQ ID NO: 6909736 - DNA, 22 bp, Homo sapiens
ttcctaaaagctgagtagagaa

SEQ ID NO: 6909737 - DNA, 22 bp, Homo sapiens
tgtgtcatctgtgttacataat

SEQ ID NO: 6909738 - DNA, 22 bp, Homo sapiens
tactctgccactaggagttctg

SEQ ID NO: 6909739 - DNA, 22 bp, Homo sapiens
cccccagtctgaacagcagctg

SEQ ID NO: 6909740 - DNA, 22 bp, Homo sapiens
aggagctgggctgctgctggga

SEQ ID NO: 6909741 - DNA, 22 bp, Homo sapiens
gctgtgagcactgctgggtgga

SEQ ID NO: 6909742 - DNA, 23 bp, Homo sapiens
gcttttaaacctgtgactgccgc

SEQ ID NO: 6909743 - DNA, 22 bp, Homo sapiens
tggtatcgtgttggcactcagt

SEQ ID NO: 6909744 - DNA, 22 bp, Homo sapiens
ctgcagctggagcatcttctca

SEQ ID NO: 6909745 - DNA, 22 bp, Homo sapiens
ttcaaacacagacagcagcatg

SEQ ID NO: 6909746 - DNA, 22 bp, Homo sapiens
aaagtgcctgactcatagttag

SEQ ID NO: 6909747 - DNA, 23 bp, Homo sapiens
ccctggaacttcactcatgcaca

SEQ ID NO: 6909748 - DNA, 23 bp, Homo sapiens
tgtattgaaggtgtagtttgtag

SEQ ID NO: 6909749 - DNA, 22 bp, Homo sapiens
gcagatggcgcagtggaagttc

SEQ ID NO: 6909750 - DNA, 22 bp, Homo sapiens
acaagaattatttctagttaac

SEQ ID NO: 6909751 - DNA, 22 bp, Homo sapiens
gggctctagaggacagcctgct

SEQ ID NO: 6909752 - DNA, 22 bp, Homo sapiens
tcgaaggaacctcaattttcgt

SEQ ID NO: 6909753 - DNA, 20 bp, Homo sapiens
tcagtgattatctctgagtg

SEQ ID NO: 6909754 - DNA, 22 bp, Homo sapiens
tggggaaactatttccttgtcc

SEQ ID NO: 6909755 - DNA, 22 bp, Homo sapiens
tgagactcagcacttgtgtgtc

SEQ ID NO: 6909756 - DNA, 22 bp, Homo sapiens
tgaaaaggagccttaggtaggt

SEQ ID NO: 6909757 - DNA, 22 bp, Homo sapiens
ttgaaatcttccacagcccaag

SEQ ID NO: 6909758 - DNA, 22 bp, Homo sapiens
tatctgttcttagctatagatg

SEQ ID NO: 6909759 - DNA, 22 bp, Homo sapiens
taaattcagtgagtaatttctg

SEQ ID NO: 6909760 - DNA, 22 bp, Homo sapiens
ttctgcacattttagcaaagta

SEQ ID NO: 6909761 - DNA, 22 bp, Homo sapiens
gagctgagcttaactccttgaa

SEQ ID NO: 6909762 - DNA, 22 bp, Homo sapiens
caccccatgtgcaggaagctgg

SEQ ID NO: 6909763 - DNA, 22 bp, Homo sapiens
ggcctcagagaaggctgtgcgg

SEQ ID NO: 6909764 - DNA, 22 bp, Homo sapiens
gtccctggaaaagagctggtga

SEQ ID NO: 6909765 - DNA, 22 bp, Homo sapiens
acattgaagggaatgcaaagat

SEQ ID NO: 6909766 - DNA, 22 bp, Homo sapiens
aactctctctggctcccagcaa

SEQ ID NO: 6909767 - DNA, 22 bp, Homo sapiens
gttgaactatgttttatctgac

SEQ ID NO: 6909768 - DNA, 22 bp, Homo sapiens
acaactttgtagcaattccacg

SEQ ID NO: 6909769 - DNA, 22 bp, Homo sapiens
gcacagctatgagctgaattgt

SEQ ID NO: 6909770 - DNA, 22 bp, Homo sapiens
ttgtggctgtgcaccgctgcct

SEQ ID NO: 6909771 - DNA, 22 bp, Homo sapiens
aggtgggtcctggctctgccat

SEQ ID NO: 6909772 - DNA, 22 bp, Homo sapiens
atcctcagagaacgaacacaat

SEQ ID NO: 6909773 - DNA, 22 bp, Homo sapiens
tgctggagggggtaccactcaa

SEQ ID NO: 6909774 - DNA, 22 bp, Homo sapiens
ggcagatggaatgagctgtcta

SEQ ID NO: 6909775 - DNA, 22 bp, Homo sapiens
tggcttacatgcctttctatct

SEQ ID NO: 6909776 - DNA, 22 bp, Homo sapiens
ctgtcacactaaaacaagaagt

SEQ ID NO: 6909777 - DNA, 22 bp, Homo sapiens
ctcctgagctgcagccttgtgt

SEQ ID NO: 6909778 - DNA, 22 bp, Homo sapiens
ctctctagaggcccaccttgag

SEQ ID NO: 6909779 - DNA, 22 bp, Homo sapiens
tattccagttcaccttttcatc

SEQ ID NO: 6909780 - DNA, 22 bp, Homo sapiens
agtcatcatggaaaatgttgtt

SEQ ID NO: 6909781 - DNA, 22 bp, Homo sapiens
aggaaaaaagtctgtgattata

SEQ ID NO: 6909782 - DNA, 22 bp, Homo sapiens
tcagctcttccccccagccagg

SEQ ID NO: 6909783 - DNA, 22 bp, Homo sapiens
gtacacacaatctctggtcagt

SEQ ID NO: 6909784 - DNA, 23 bp, Homo sapiens
ttgtacctaattactagttccag

SEQ ID NO: 6909785 - DNA, 22 bp, Homo sapiens
agtgtcacaaacctgccttgta

SEQ ID NO: 6909786 - DNA, 22 bp, Homo sapiens
tgtagggagagggagttgcacc

SEQ ID NO: 6909787 - DNA, 22 bp, Homo sapiens
tccctcctggtgatgatgcaaa

SEQ ID NO: 6909788 - DNA, 22 bp, Homo sapiens
ggagcgtgcactccaggccctt

SEQ ID NO: 6909789 - DNA, 22 bp, Homo sapiens
tctgcctttcacacagacggcc

SEQ ID NO: 6909790 - DNA, 22 bp, Homo sapiens
cctgggaggctgtgggtctgct

SEQ ID NO: 6909791 - DNA, 22 bp, Homo sapiens
ctctctgtgctcacaagggcag

SEQ ID NO: 6909792 - DNA, 22 bp, Homo sapiens
ctagtctgtgtgggaccagggc

SEQ ID NO: 6909793 - DNA, 22 bp, Homo sapiens
gatgtatatacctggtgtggaa

SEQ ID NO: 6909794 - DNA, 18 bp, Homo sapiens
tgaggcccgcagaggtgg

SEQ ID NO: 6909795 - DNA, 22 bp, Homo sapiens
tattgacaatttgtgaaactat

SEQ ID NO: 6909796 - DNA, 22 bp, Homo sapiens
tctgggcttggattggctctgc

SEQ ID NO: 6909797 - DNA, 22 bp, Homo sapiens
tcagtcatgaccatggggtgga

SEQ ID NO: 6909798 - DNA, 22 bp, Homo sapiens
ctgtcccatccttactctaccc

SEQ ID NO: 6909799 - DNA, 22 bp, Homo sapiens
cacacattggttttactccttt

SEQ ID NO: 6909800 - DNA, 22 bp, Homo sapiens
tggctcttgcttacgaaggtta

SEQ ID NO: 6909801 - DNA, 22 bp, Homo sapiens
cctgtctgtttcattccttgtt

SEQ ID NO: 6909802 - DNA, 22 bp, Homo sapiens
tcaagttcacagtctggtcgct

SEQ ID NO: 6909803 - DNA, 22 bp, Homo sapiens
agagccagagacctgggttcac

SEQ ID NO: 6909804 - DNA, 22 bp, Homo sapiens
aggccctggtcaggtctggctg

SEQ ID NO: 6909805 - DNA, 22 bp, Homo sapiens
tggcgcgctcgctctcgctgag

SEQ ID NO: 6909806 - DNA, 22 bp, Homo sapiens
ccctgaggatagggcaggaccc

SEQ ID NO: 6909807 - DNA, 22 bp, Homo sapiens
tttcccaagaaaaataattgga

SEQ ID NO: 6909808 - DNA, 22 bp, Homo sapiens
ttgtatatattcttaaagatgt

SEQ ID NO: 6909809 - DNA, 22 bp, Homo sapiens
attctgatcattcaagatgtca

SEQ ID NO: 6909810 - DNA, 22 bp, Homo sapiens
tcagctgtgtatcccagggcct

SEQ ID NO: 6909811 - DNA, 22 bp, Homo sapiens
gtgtcctgggggacttcaggtt

SEQ ID NO: 6909812 - DNA, 22 bp, Homo sapiens
taactgtttttgaaatatatct

SEQ ID NO: 6909813 - DNA, 22 bp, Homo sapiens
ctgttgtttgctagtgtactct

SEQ ID NO: 6909814 - DNA, 22 bp, Homo sapiens
tcaaatgagtgactcacacagg

SEQ ID NO: 6909815 - DNA, 22 bp, Homo sapiens
ctggctgtttcaaatgtataga

SEQ ID NO: 6909816 - DNA, 22 bp, Homo sapiens
ttctgagagagcctctcatgtt

SEQ ID NO: 6909817 - DNA, 22 bp, Homo sapiens
tcaggaagtataatcagattca

SEQ ID NO: 6909818 - DNA, 22 bp, Homo sapiens
gggactccataagcacatggat

SEQ ID NO: 6909819 - DNA, 22 bp, Homo sapiens
tgctggctcctcgaggcttcgt

SEQ ID NO: 6909820 - DNA, 22 bp, Homo sapiens
gtgtctggaacgggtggtactc

SEQ ID NO: 6909821 - DNA, 17 bp, Homo sapiens
agtgtcagaagacagtt

SEQ ID NO: 6909822 - DNA, 22 bp, Homo sapiens
gctctgcctttgtcttacacgg

SEQ ID NO: 6909823 - DNA, 22 bp, Homo sapiens
tgtgggccaggaggcctcagtg

SEQ ID NO: 6909824 - DNA, 22 bp, Homo sapiens
acagggctgaggctggcttctt

SEQ ID NO: 6909825 - DNA, 22 bp, Homo sapiens
agctgccatggcctgaatttac

SEQ ID NO: 6909826 - DNA, 22 bp, Homo sapiens
agtggctaataacagctaaaca

SEQ ID NO: 6909827 - DNA, 23 bp, Homo sapiens
atttacaggttaaatgaaatcag

SEQ ID NO: 6909828 - DNA, 22 bp, Homo sapiens
acattctttgagttttgttaaa

SEQ ID NO: 6909829 - DNA, 22 bp, Homo sapiens
tcagggtttggggctacagcca

SEQ ID NO: 6909830 - DNA, 22 bp, Homo sapiens
cacagtaagaaatgaagaggta

SEQ ID NO: 6909831 - DNA, 20 bp, Homo sapiens
gtggtcacacctgagtgggt

SEQ ID NO: 6909832 - DNA, 22 bp, Homo sapiens
aggccccccttgctggtttgct

SEQ ID NO: 6909833 - DNA, 22 bp, Homo sapiens
gccctctcttctgcagcctcca

SEQ ID NO: 6909834 - DNA, 22 bp, Homo sapiens
aggaatcagaattcttagaatt

SEQ ID NO: 6909835 - DNA, 22 bp, Homo sapiens
acagtgcttggcacacagtaat

SEQ ID NO: 6909836 - DNA, 23 bp, Homo sapiens
attgccaggatgctgaagcttac

SEQ ID NO: 6909837 - DNA, 22 bp, Homo sapiens
tctcactagtaggcctctgatg

SEQ ID NO: 6909838 - DNA, 22 bp, Homo sapiens
agtgcactgagctaggagtgga

SEQ ID NO: 6909839 - DNA, 22 bp, Homo sapiens
atctcatctgggggaccatttt

SEQ ID NO: 6909840 - DNA, 22 bp, Homo sapiens
taactaactagtgttcaaaata

SEQ ID NO: 6909841 - DNA, 22 bp, Homo sapiens
agggatgcccagataattggta

SEQ ID NO: 6909842 - DNA, 22 bp, Homo sapiens
ggaggttctgatttgtcacaac

SEQ ID NO: 6909843 - DNA, 22 bp, Homo sapiens
acagcaggttttaactttgaag

SEQ ID NO: 6909844 - DNA, 22 bp, Homo sapiens
agtcagatgatgtgaggagtgg

SEQ ID NO: 6909845 - DNA, 22 bp, Homo sapiens
gtatttcctatagtgagggcct

SEQ ID NO: 6909846 - DNA, 22 bp, Homo sapiens
caggcactggggatgctgggat

SEQ ID NO: 6909847 - DNA, 22 bp, Homo sapiens
actgaggaacatatataagatg

SEQ ID NO: 6909848 - DNA, 22 bp, Homo sapiens
gtaaatgtgttttatggtcgcc

SEQ ID NO: 6909849 - DNA, 22 bp, Homo sapiens
tgtaaagacgcttatagcttgc

SEQ ID NO: 6909850 - DNA, 17 bp, Homo sapiens
tgacagacatcatgagc

SEQ ID NO: 6909851 - DNA, 22 bp, Homo sapiens
gaagtctcatttggtgtcagtt

SEQ ID NO: 6909852 - DNA, 22 bp, Homo sapiens
tgcagctgaccagcaagtcctg

SEQ ID NO: 6909853 - DNA, 22 bp, Homo sapiens
ctggccttttgtttctggagaa

SEQ ID NO: 6909854 - DNA, 22 bp, Homo sapiens
aaaagtaattgcagtttttgcc

SEQ ID NO: 6909855 - DNA, 22 bp, Homo sapiens
agggttgcaggggccatgccca

SEQ ID NO: 6909856 - DNA, 22 bp, Homo sapiens
atgaggtaggacatcaggaaat

SEQ ID NO: 6909857 - DNA, 22 bp, Homo sapiens
aatcttcactaaaatggacaag

SEQ ID NO: 6909858 - DNA, 22 bp, Homo sapiens
agaatatcgtagcatattatct

SEQ ID NO: 6909859 - DNA, 19 bp, Homo sapiens
ctgtccttggctgcactgt

SEQ ID NO: 6909860 - DNA, 22 bp, Homo sapiens
aacatgtctttagagaaacatt

SEQ ID NO: 6909861 - DNA, 22 bp, Homo sapiens
tttagagtctaatggtgaagat

SEQ ID NO: 6909862 - DNA, 22 bp, Homo sapiens
ttggccaagtggttaatctcca

SEQ ID NO: 6909863 - DNA, 22 bp, Homo sapiens
ctgtacatatgtctccagagtg

SEQ ID NO: 6909864 - DNA, 22 bp, Homo sapiens
agtggttttgaaagaggaagac

SEQ ID NO: 6909865 - DNA, 22 bp, Homo sapiens
atttggaaggagctgcacagca

SEQ ID NO: 6909866 - DNA, 22 bp, Homo sapiens
agaggcggaggttgcagtgagc

SEQ ID NO: 6909867 - DNA, 22 bp, Homo sapiens
cagtgggattgggattggaacc

SEQ ID NO: 6909868 - DNA, 22 bp, Homo sapiens
tgcattccacagtagtattttg

SEQ ID NO: 6909869 - DNA, 22 bp, Homo sapiens
tggctcagtcatggatgagtaa

SEQ ID NO: 6909870 - DNA, 22 bp, Homo sapiens
caggcactcattcagagaggtg

SEQ ID NO: 6909871 - DNA, 22 bp, Homo sapiens
tgatgagggaactggttcatac

SEQ ID NO: 6909872 - DNA, 22 bp, Homo sapiens
ccactgaggttttgtggttatg

SEQ ID NO: 6909873 - DNA, 22 bp, Homo sapiens
tgcactgaatagtagactgtac

SEQ ID NO: 6909874 - DNA, 22 bp, Homo sapiens
tctgaggctgaatggactccgt

SEQ ID NO: 6909875 - DNA, 22 bp, Homo sapiens
acctctgccactttctaactct

SEQ ID NO: 6909876 - DNA, 20 bp, Homo sapiens
attgtgcagcccttggcaga

SEQ ID NO: 6909877 - DNA, 22 bp, Homo sapiens
gtggcaggttccgtagacagca

SEQ ID NO: 6909878 - DNA, 22 bp, Homo sapiens
gaactgtggggtggtagcagga

SEQ ID NO: 6909879 - DNA, 22 bp, Homo sapiens
tgcacactgctgctccaggagg

SEQ ID NO: 6909880 - DNA, 22 bp, Homo sapiens
ttggattcagtcttgcagattc

SEQ ID NO: 6909881 - DNA, 22 bp, Homo sapiens
tgtacaagttgcctgctatctc

SEQ ID NO: 6909882 - DNA, 22 bp, Homo sapiens
ggctagggaaaatgattggata

SEQ ID NO: 6909883 - DNA, 22 bp, Homo sapiens
aagctaagattacagatttggg

SEQ ID NO: 6909884 - DNA, 22 bp, Homo sapiens
attgagaatgcaatctactatg

SEQ ID NO: 6909885 - DNA, 22 bp, Homo sapiens
gcagttctacttatccatagac

SEQ ID NO: 6909886 - DNA, 22 bp, Homo sapiens
tggcatgtctgagggaggtttg

SEQ ID NO: 6909887 - DNA, 22 bp, Homo sapiens
gagctgaagtttccatttgtac

SEQ ID NO: 6909888 - DNA, 19 bp, Homo sapiens
ctgcactaggcctgtgctc

SEQ ID NO: 6909889 - DNA, 22 bp, Homo sapiens
gcactgggaatgctgatgggct

SEQ ID NO: 6909890 - DNA, 22 bp, Homo sapiens
ctgagcagatgttgcccagaag

SEQ ID NO: 6909891 - DNA, 21 bp, Homo sapiens
tatacagtaattaagtggtat

SEQ ID NO: 6909892 - DNA, 22 bp, Homo sapiens
cttcttcatctgtaaaacttgg

SEQ ID NO: 6909893 - DNA, 22 bp, Homo sapiens
ttaacatttagtgtacccctgt

SEQ ID NO: 6909894 - DNA, 22 bp, Homo sapiens
gcacaggctccggaggagagct

SEQ ID NO: 6909895 - DNA, 22 bp, Homo sapiens
gtgcatgtgtgcgtacatgctt

SEQ ID NO: 6909896 - DNA, 22 bp, Homo sapiens
tctccaggtgactctgatgtat

SEQ ID NO: 6909897 - DNA, 22 bp, Homo sapiens
atcataggtataagtaaattag

SEQ ID NO: 6909898 - DNA, 22 bp, Homo sapiens
gacttctattaatacctctact

SEQ ID NO: 6909899 - DNA, 20 bp, Homo sapiens
aggagctctgtgctgggaag

SEQ ID NO: 6909900 - DNA, 22 bp, Homo sapiens
tagaatctgcctgcagcaaaga

SEQ ID NO: 6909901 - DNA, 22 bp, Homo sapiens
gtgaaggtgtgtccactgcggc

SEQ ID NO: 6909902 - DNA, 22 bp, Homo sapiens
attatttgagttcctctctacc

SEQ ID NO: 6909903 - DNA, 22 bp, Homo sapiens
agactttagaatcagatagcct

SEQ ID NO: 6909904 - DNA, 22 bp, Homo sapiens
tcctctgctgttctggttcttt

SEQ ID NO: 6909905 - DNA, 22 bp, Homo sapiens
actttcatgttcatttggaacc

SEQ ID NO: 6909906 - DNA, 22 bp, Homo sapiens
ttgacactaagatttccaaaca

SEQ ID NO: 6909907 - DNA, 22 bp, Homo sapiens
ttcatgtttcctcttgtgctgc

SEQ ID NO: 6909908 - DNA, 22 bp, Homo sapiens
gaggcaaggccgcacgtctcag

SEQ ID NO: 6909909 - DNA, 23 bp, Homo sapiens
tcacagtatctctggagccatag

SEQ ID NO: 6909910 - DNA, 22 bp, Homo sapiens
tttgtgcagtggttaagaccat

SEQ ID NO: 6909911 - DNA, 22 bp, Homo sapiens
gcagatgcaagggtactggggc

SEQ ID NO: 6909912 - DNA, 22 bp, Homo sapiens
gggccacaggccttgcccgcag

SEQ ID NO: 6909913 - DNA, 22 bp, Homo sapiens
ctgttggacttttcaaggtctg

SEQ ID NO: 6909914 - DNA, 22 bp, Homo sapiens
tgttcctggggacctgccttcc

SEQ ID NO: 6909915 - DNA, 22 bp, Homo sapiens
atcaggatgggtttggcttagg

SEQ ID NO: 6909916 - DNA, 22 bp, Homo sapiens
gactagtcatttgcattccgtc

SEQ ID NO: 6909917 - DNA, 22 bp, Homo sapiens
taggtgtcttgtgtatggtaca

SEQ ID NO: 6909918 - DNA, 22 bp, Homo sapiens
caaaagtaattgtggtttttgc

SEQ ID NO: 6909919 - DNA, 22 bp, Homo sapiens
atcacgtggtttgagagtacgc

SEQ ID NO: 6909920 - DNA, 22 bp, Homo sapiens
tcagccagtgccttgatcttgc

SEQ ID NO: 6909921 - DNA, 22 bp, Homo sapiens
gcaggtgggggagaagttgtga

SEQ ID NO: 6909922 - DNA, 22 bp, Homo sapiens
caatgtttcttgtaaccagtga

SEQ ID NO: 6909923 - DNA, 22 bp, Homo sapiens
gttcccacccctgagctccgat

SEQ ID NO: 6909924 - DNA, 23 bp, Homo sapiens
ttaatcagatgagttgaaagaga

SEQ ID NO: 6909925 - DNA, 22 bp, Homo sapiens
gtaaactatgggctttggagga

SEQ ID NO: 6909926 - DNA, 22 bp, Homo sapiens
ccttaaaagaactatctcttct

SEQ ID NO: 6909927 - DNA, 22 bp, Homo sapiens
tctcacagcattatccagggca

SEQ ID NO: 6909928 - DNA, 22 bp, Homo sapiens
tgcaaactgggacactattcaa

SEQ ID NO: 6909929 - DNA, 22 bp, Homo sapiens
cttctgaaacccccagtgtggg

SEQ ID NO: 6909930 - DNA, 22 bp, Homo sapiens
aagatgcggttgaccatggtgt

SEQ ID NO: 6909931 - DNA, 22 bp, Homo sapiens
tttgtgaagggaacagaagtgt

SEQ ID NO: 6909932 - DNA, 22 bp, Homo sapiens
tgagtctccagcgaagtaggat

SEQ ID NO: 6909933 - DNA, 22 bp, Homo sapiens
tctcagagtttttttccaggac

SEQ ID NO: 6909934 - DNA, 22 bp, Homo sapiens
gcaaacatttggtctagtgtgt

SEQ ID NO: 6909935 - DNA, 22 bp, Homo sapiens
aactctgtgtaggaaccaggtc

SEQ ID NO: 6909936 - DNA, 20 bp, Homo sapiens
ctaagaggaggactaggttt

SEQ ID NO: 6909937 - DNA, 22 bp, Homo sapiens
gctgctgtgttggccactgctt

SEQ ID NO: 6909938 - DNA, 22 bp, Homo sapiens
atttactggaaaaactatgagc

SEQ ID NO: 6909939 - DNA, 22 bp, Homo sapiens
gcttccaaatctgttcaaaatg

SEQ ID NO: 6909940 - DNA, 22 bp, Homo sapiens
gagggccctggcttcttgctgg

SEQ ID NO: 6909941 - DNA, 17 bp, Homo sapiens
acaacagaaatgtattc

SEQ ID NO: 6909942 - DNA, 22 bp, Homo sapiens
cttcccatataactaatttctg

SEQ ID NO: 6909943 - DNA, 22 bp, Homo sapiens
cgtggctggtggacctgagggc

SEQ ID NO: 6909944 - DNA, 22 bp, Homo sapiens
tacatatgagttcgttctatgc

SEQ ID NO: 6909945 - DNA, 22 bp, Homo sapiens
taagtcctagctttggtaggaa

SEQ ID NO: 6909946 - DNA, 22 bp, Homo sapiens
gtgtatgtgtttatagggaggt

SEQ ID NO: 6909947 - DNA, 22 bp, Homo sapiens
tgcgggttggtggcatatgcag

SEQ ID NO: 6909948 - DNA, 22 bp, Homo sapiens
accaggggtgtcaacagcattt

SEQ ID NO: 6909949 - DNA, 22 bp, Homo sapiens
ttccaaggagtgaacttcaaat

SEQ ID NO: 6909950 - DNA, 22 bp, Homo sapiens
gtagtagctgtgaaagtctgct

SEQ ID NO: 6909951 - DNA, 22 bp, Homo sapiens
actgccgtgcatcagaagctga

SEQ ID NO: 6909952 - DNA, 22 bp, Homo sapiens
cttcccgcagccctagcgctct

SEQ ID NO: 6909953 - DNA, 22 bp, Homo sapiens
atttgattgtgtctgagacgat

SEQ ID NO: 6909954 - DNA, 22 bp, Homo sapiens
acctgcagccacttctctcctt

SEQ ID NO: 6909955 - DNA, 22 bp, Homo sapiens
tggagcagaaatttgaagccat

SEQ ID NO: 6909956 - DNA, 22 bp, Homo sapiens
ggcaggctcttggccttatgag

SEQ ID NO: 6909957 - DNA, 22 bp, Homo sapiens
agatatgtccctgtctaatatt

SEQ ID NO: 6909958 - DNA, 22 bp, Homo sapiens
tcttataatgttgaagggttgg

SEQ ID NO: 6909959 - DNA, 22 bp, Homo sapiens
aagggctagctgcatatatatt

SEQ ID NO: 6909960 - DNA, 22 bp, Homo sapiens
agccactttagataccatctta

SEQ ID NO: 6909961 - DNA, 22 bp, Homo sapiens
agctttattcatgatttcaggg

SEQ ID NO: 6909962 - DNA, 22 bp, Homo sapiens
ccctttcctgaagaatattttt

SEQ ID NO: 6909963 - DNA, 22 bp, Homo sapiens
aagctcaggctggacctggctt

SEQ ID NO: 6909964 - DNA, 18 bp, Homo sapiens
tcatgtctcacaggtgat

SEQ ID NO: 6909965 - DNA, 20 bp, Homo sapiens
agtgtatgaacagatgcggg

SEQ ID NO: 6909966 - DNA, 22 bp, Homo sapiens
cctcagagtttaagatgtcaga

SEQ ID NO: 6909967 - DNA, 22 bp, Homo sapiens
ggtgcaagtggctagggaccag

SEQ ID NO: 6909968 - DNA, 22 bp, Homo sapiens
ttcttttaatgtctggctttca

SEQ ID NO: 6909969 - DNA, 22 bp, Homo sapiens
ttacatattgtctattgttcaa

SEQ ID NO: 6909970 - DNA, 22 bp, Homo sapiens
acagcactttacttctcagtga

SEQ ID NO: 6909971 - DNA, 20 bp, Homo sapiens
gtaaagcattcttggcatac

SEQ ID NO: 6909972 - DNA, 22 bp, Homo sapiens
agggggctccttggtgtgcaga

SEQ ID NO: 6909973 - DNA, 22 bp, Homo sapiens
tatgaaatttctagttctgctt

SEQ ID NO: 6909974 - DNA, 22 bp, Homo sapiens
tgcccagggataagcctagaga

SEQ ID NO: 6909975 - DNA, 22 bp, Homo sapiens
ggaggcggaggctgcagtgagc

SEQ ID NO: 6909976 - DNA, 22 bp, Homo sapiens
tgaccctcttccccatgcgctc

SEQ ID NO: 6909977 - DNA, 23 bp, Homo sapiens
tttagcatgaagcagctggagaa

SEQ ID NO: 6909978 - DNA, 22 bp, Homo sapiens
agacactgagcattttcctagc

SEQ ID NO: 6909979 - DNA, 22 bp, Homo sapiens
ggaatccacgaatgtgcatttc

SEQ ID NO: 6909980 - DNA, 22 bp, Homo sapiens
gagtagaaagtaaagtacgaat

SEQ ID NO: 6909981 - DNA, 22 bp, Homo sapiens
agctatgttcctcgatgctcag

SEQ ID NO: 6909982 - DNA, 20 bp, Homo sapiens
gcctgaatgcttaactggag

SEQ ID NO: 6909983 - DNA, 22 bp, Homo sapiens
atacttgtgagtttccaacaat

SEQ ID NO: 6909984 - DNA, 22 bp, Homo sapiens
tacagtaaagctgctatgaatt

SEQ ID NO: 6909985 - DNA, 22 bp, Homo sapiens
tgcacccagggggatcaggaat

SEQ ID NO: 6909986 - DNA, 22 bp, Homo sapiens
acatttgacatttagtatcagc

SEQ ID NO: 6909987 - DNA, 22 bp, Homo sapiens
caaggcaggtctgaggaggttg

SEQ ID NO: 6909988 - DNA, 22 bp, Homo sapiens
aatgctttaattgcatgtagtg

SEQ ID NO: 6909989 - DNA, 22 bp, Homo sapiens
cagttcagctagaagaaacaaa

SEQ ID NO: 6909990 - DNA, 22 bp, Homo sapiens
atatgcttacactacaagatga

SEQ ID NO: 6909991 - DNA, 22 bp, Homo sapiens
ctggcaggaagaggaaaggtca

SEQ ID NO: 6909992 - DNA, 22 bp, Homo sapiens
actagtcatttaggtgatatta

SEQ ID NO: 6909993 - DNA, 22 bp, Homo sapiens
ccaagtcctctaccattcctgg

SEQ ID NO: 6909994 - DNA, 22 bp, Homo sapiens
tctgacttgcatcttaaaggag

SEQ ID NO: 6909995 - DNA, 22 bp, Homo sapiens
aggagtttcctttagtttctgg

SEQ ID NO: 6909996 - DNA, 22 bp, Homo sapiens
tgtcagggatttaaagacacaa

SEQ ID NO: 6909997 - DNA, 22 bp, Homo sapiens
ttgaggtacaaacatgaggttt

SEQ ID NO: 6909998 - DNA, 20 bp, Homo sapiens
gtacttcaggtgtggtctga

SEQ ID NO: 6909999 - DNA, 22 bp, Homo sapiens
ggcagggtggcagaggctcaga

SEQ ID NO: 6910000 - DNA, 19 bp, Homo sapiens
aaaggtagtaacctctgat

SEQ ID NO: 6910001 - DNA, 22 bp, Homo sapiens
cagcaggctgcgattgctcatt

SEQ ID NO: 6910002 - DNA, 22 bp, Homo sapiens
tagaggctactagaggcacctg

SEQ ID NO: 6910003 - DNA, 22 bp, Homo sapiens
catggcaataggaatgatgtga

SEQ ID NO: 6910004 - DNA, 22 bp, Homo sapiens
caagattactatccactgctgg

SEQ ID NO: 6910005 - DNA, 22 bp, Homo sapiens
ctagatcacactggttggctgc

SEQ ID NO: 6910006 - DNA, 22 bp, Homo sapiens
attcttcatcagagatgcacta

SEQ ID NO: 6910007 - DNA, 22 bp, Homo sapiens
tcactttagaggaaacattgag

SEQ ID NO: 6910008 - DNA, 22 bp, Homo sapiens
ggtcaggtttttaggagtgacc

SEQ ID NO: 6910009 - DNA, 22 bp, Homo sapiens
tatgaagctctcactgtgtgtc

SEQ ID NO: 6910010 - DNA, 22 bp, Homo sapiens
gcttctcttaatgcctggcttt

SEQ ID NO: 6910011 - DNA, 22 bp, Homo sapiens
atgaatgctgaattatgaactg

SEQ ID NO: 6910012 - DNA, 22 bp, Homo sapiens
aggtgagtcctgggcacaggta

SEQ ID NO: 6910013 - DNA, 22 bp, Homo sapiens
gcccacctaacctgctcacctt

SEQ ID NO: 6910014 - DNA, 22 bp, Homo sapiens
gtcatctcacagcagggctagt

SEQ ID NO: 6910015 - DNA, 22 bp, Homo sapiens
gagactgcattgtccaagggtt

SEQ ID NO: 6910016 - DNA, 22 bp, Homo sapiens
tgaacacagcatattttgttac

SEQ ID NO: 6910017 - DNA, 22 bp, Homo sapiens
gcatgcaactcccagttctgcc

SEQ ID NO: 6910018 - DNA, 22 bp, Homo sapiens
agcttgtagaaggccacgagca

SEQ ID NO: 6910019 - DNA, 22 bp, Homo sapiens
ccagggatgctttcccaggact

SEQ ID NO: 6910020 - DNA, 22 bp, Homo sapiens
tggccatttactctgtaagagt

SEQ ID NO: 6910021 - DNA, 22 bp, Homo sapiens
acagttcagacaagtgttccat

SEQ ID NO: 6910022 - DNA, 22 bp, Homo sapiens
tccacagataaaaacagaggtt

SEQ ID NO: 6910023 - DNA, 20 bp, Homo sapiens
tcagaccctacattcctcag

SEQ ID NO: 6910024 - DNA, 20 bp, Homo sapiens
actctacccctgttatcgca

SEQ ID NO: 6910025 - DNA, 22 bp, Homo sapiens
aaatagacacttggacagacaa

SEQ ID NO: 6910026 - DNA, 22 bp, Homo sapiens
gctccctgttctcagccatgat

SEQ ID NO: 6910027 - DNA, 22 bp, Homo sapiens
ttaaagtttgcctatgtgttgt

SEQ ID NO: 6910028 - DNA, 22 bp, Homo sapiens
gtgaggatgcagatgagggcct

SEQ ID NO: 6910029 - DNA, 22 bp, Homo sapiens
ggcaggctgcttgggtcatgtc

SEQ ID NO: 6910030 - DNA, 22 bp, Homo sapiens
caaagctgatactcagcaagta

SEQ ID NO: 6910031 - DNA, 22 bp, Homo sapiens
taaggctagcaagatgagaata

SEQ ID NO: 6910032 - DNA, 22 bp, Homo sapiens
tttccatattctgcgtctgcca

SEQ ID NO: 6910033 - DNA, 22 bp, Homo sapiens
agagggcaagtgtagtccagta

SEQ ID NO: 6910034 - DNA, 22 bp, Homo sapiens
aatgacataagtgcagatgcta

SEQ ID NO: 6910035 - DNA, 22 bp, Homo sapiens
tattccatttgggtcaggatga

SEQ ID NO: 6910036 - DNA, 22 bp, Homo sapiens
agggcttgctgatttaaagagc

SEQ ID NO: 6910037 - DNA, 22 bp, Homo sapiens
tttgcaaaccggagctctgcaa

SEQ ID NO: 6910038 - DNA, 22 bp, Homo sapiens
ggctgttgacagacataggttt

SEQ ID NO: 6910039 - DNA, 22 bp, Homo sapiens
tggcttctgggacttgtgagca

SEQ ID NO: 6910040 - DNA, 22 bp, Homo sapiens
gttcagtggggccttgggggac

SEQ ID NO: 6910041 - DNA, 22 bp, Homo sapiens
ctcaggattctcgacactcaca

SEQ ID NO: 6910042 - DNA, 22 bp, Homo sapiens
aaatggcaatcagcagaagcta

SEQ ID NO: 6910043 - DNA, 22 bp, Homo sapiens
agttagcatctcctccagtcta

SEQ ID NO: 6910044 - DNA, 22 bp, Homo sapiens
tcatttccctcctacaaagagg

SEQ ID NO: 6910045 - DNA, 22 bp, Homo sapiens
gtgtcctgggctggtagagctg

SEQ ID NO: 6910046 - DNA, 22 bp, Homo sapiens
ggctcctgggagatagaggtca

SEQ ID NO: 6910047 - DNA, 22 bp, Homo sapiens
gagacagagatcttgctgagtc

SEQ ID NO: 6910048 - DNA, 22 bp, Homo sapiens
aatgttatttctgcatagtagt

SEQ ID NO: 6910049 - DNA, 22 bp, Homo sapiens
gcagggaaggggacggaaccag

SEQ ID NO: 6910050 - DNA, 22 bp, Homo sapiens
tgcttccctcacttcacctggc

SEQ ID NO: 6910051 - DNA, 22 bp, Homo sapiens
aagctgttggcagatagctctg

SEQ ID NO: 6910052 - DNA, 18 bp, Homo sapiens
cccggctaatttttggta

SEQ ID NO: 6910053 - DNA, 22 bp, Homo sapiens
gcaagtacaaacgcatcggctg

SEQ ID NO: 6910054 - DNA, 22 bp, Homo sapiens
cagttctttgtggggagttctc

SEQ ID NO: 6910055 - DNA, 22 bp, Homo sapiens
gaggcccaatgcttccctcctt

SEQ ID NO: 6910056 - DNA, 22 bp, Homo sapiens
cctcagaagactttagggaaga

SEQ ID NO: 6910057 - DNA, 22 bp, Homo sapiens
ctgtacataaaggaataggtgt

SEQ ID NO: 6910058 - DNA, 23 bp, Homo sapiens
cccaggtagccctctagagcctg

SEQ ID NO: 6910059 - DNA, 22 bp, Homo sapiens
agtcaggatatgccttgtgggc

SEQ ID NO: 6910060 - DNA, 22 bp, Homo sapiens
ggaaacttgttattgtattttc

SEQ ID NO: 6910061 - DNA, 22 bp, Homo sapiens
acacaggaagcaatttcagagc

SEQ ID NO: 6910062 - DNA, 22 bp, Homo sapiens
tgaaagttattactgatgatgt

SEQ ID NO: 6910063 - DNA, 22 bp, Homo sapiens
attctgtgtgtactgagatggg

SEQ ID NO: 6910064 - DNA, 22 bp, Homo sapiens
gtgcagttcccaaggtcacaca

SEQ ID NO: 6910065 - DNA, 22 bp, Homo sapiens
ctcagcccagcccaggaccagg

SEQ ID NO: 6910066 - DNA, 22 bp, Homo sapiens
aaaggactcagactgaagggag

SEQ ID NO: 6910067 - DNA, 22 bp, Homo sapiens
tctttggaagtcaggggcatgg

SEQ ID NO: 6910068 - DNA, 22 bp, Homo sapiens
caatgcccctgagggctgcacc

SEQ ID NO: 6910069 - DNA, 22 bp, Homo sapiens
aagtgttacagaaacaaatgaa

SEQ ID NO: 6910070 - DNA, 22 bp, Homo sapiens
tctttggcatcagggccagcta

SEQ ID NO: 6910071 - DNA, 22 bp, Homo sapiens
ggaaacatattctgatgtgcat

SEQ ID NO: 6910072 - DNA, 22 bp, Homo sapiens
aatctgtcagaatttctaagtt

SEQ ID NO: 6910073 - DNA, 22 bp, Homo sapiens
tgagattctgtatttctgacag

SEQ ID NO: 6910074 - DNA, 22 bp, Homo sapiens
gaagcctgaacatttttgtcag

SEQ ID NO: 6910075 - DNA, 22 bp, Homo sapiens
tagcgcaactgcagagaagtag

SEQ ID NO: 6910076 - DNA, 22 bp, Homo sapiens
tggtgctggtgccacgcccctt

SEQ ID NO: 6910077 - DNA, 22 bp, Homo sapiens
tcacagtactgtgactattgac

SEQ ID NO: 6910078 - DNA, 22 bp, Homo sapiens
ctgttgctaagtagtgcaggta

SEQ ID NO: 6910079 - DNA, 22 bp, Homo sapiens
gtaatgaatagatggtggcagg

SEQ ID NO: 6910080 - DNA, 22 bp, Homo sapiens
caagacatgcaattgccacttt

SEQ ID NO: 6910081 - DNA, 20 bp, Homo sapiens
tgcctgggaaggcgtggagg

SEQ ID NO: 6910082 - DNA, 22 bp, Homo sapiens
aaacatgctatgttttggataa

SEQ ID NO: 6910083 - DNA, 22 bp, Homo sapiens
tacaggtagggtctatgttaga

SEQ ID NO: 6910084 - DNA, 21 bp, Homo sapiens
tctgggcccatgctgcctcac

SEQ ID NO: 6910085 - DNA, 22 bp, Homo sapiens
cacagtttcaataattattctt

SEQ ID NO: 6910086 - DNA, 22 bp, Homo sapiens
ctcatcaccacatataacaaag

SEQ ID NO: 6910087 - DNA, 20 bp, Homo sapiens
tggtgagagcacctgatggg

SEQ ID NO: 6910088 - DNA, 22 bp, Homo sapiens
gaactttatcaaaagttgttta

SEQ ID NO: 6910089 - DNA, 22 bp, Homo sapiens
tccaggaaagcactgggctggg

SEQ ID NO: 6910090 - DNA, 22 bp, Homo sapiens
acagtgagcggtagtgattgct

SEQ ID NO: 6910091 - DNA, 22 bp, Homo sapiens
ttcatcaccttggtagcactcc

SEQ ID NO: 6910092 - DNA, 22 bp, Homo sapiens
aagcctaggcctactctggttt

SEQ ID NO: 6910093 - DNA, 22 bp, Homo sapiens
aagtctctggttgcttgcatgg

SEQ ID NO: 6910094 - DNA, 22 bp, Homo sapiens
ctgttgaaaatttctcagatgg

SEQ ID NO: 6910095 - DNA, 17 bp, Homo sapiens
agtcatattgtgcagtt

SEQ ID NO: 6910096 - DNA, 22 bp, Homo sapiens
acaaagccagattctggagcac

SEQ ID NO: 6910097 - DNA, 22 bp, Homo sapiens
ttacatgtttatgggggtacat

SEQ ID NO: 6910098 - DNA, 22 bp, Homo sapiens
cagcatttatcttgtagcagga

SEQ ID NO: 6910099 - DNA, 22 bp, Homo sapiens
ttgttagatatttcttagaaga

SEQ ID NO: 6910100 - DNA, 22 bp, Homo sapiens
tcctggtctacactgcattggg

SEQ ID NO: 6910101 - DNA, 22 bp, Homo sapiens
gtgaatactgtatctcaggaca

SEQ ID NO: 6910102 - DNA, 23 bp, Homo sapiens
tagaatgtcattcaatgatatgg

SEQ ID NO: 6910103 - DNA, 22 bp, Homo sapiens
tcttgcatgatattctgtattt

SEQ ID NO: 6910104 - DNA, 22 bp, Homo sapiens
gctgaggtggaggaaggagacc

SEQ ID NO: 6910105 - DNA, 22 bp, Homo sapiens
agagtcagaaagcagacagggg

SEQ ID NO: 6910106 - DNA, 22 bp, Homo sapiens
gttatgatggccctttcctggt

SEQ ID NO: 6910107 - DNA, 22 bp, Homo sapiens
gctcagttatccgtgtgtgact

SEQ ID NO: 6910108 - DNA, 22 bp, Homo sapiens
tgctactcaattcacctgccac

SEQ ID NO: 6910109 - DNA, 22 bp, Homo sapiens
gagtctttgtatttacttccca

SEQ ID NO: 6910110 - DNA, 22 bp, Homo sapiens
cccttcagtgctaggctgcctg

SEQ ID NO: 6910111 - DNA, 22 bp, Homo sapiens
cctggcagacagcactgaagct

SEQ ID NO: 6910112 - DNA, 22 bp, Homo sapiens
tgagtataaaacatatacatca

SEQ ID NO: 6910113 - DNA, 22 bp, Homo sapiens
aattcacatccgaccaggtcaa

SEQ ID NO: 6910114 - DNA, 22 bp, Homo sapiens
taagactgtgagctcagagact

SEQ ID NO: 6910115 - DNA, 22 bp, Homo sapiens
tggcacttgtcacctgctttca

SEQ ID NO: 6910116 - DNA, 22 bp, Homo sapiens
actgaggtttttagtgttaaat

SEQ ID NO: 6910117 - DNA, 21 bp, Homo sapiens
tctgacaatctcatttcaaac

SEQ ID NO: 6910118 - DNA, 19 bp, Homo sapiens
atctggacttatcctatat

SEQ ID NO: 6910119 - DNA, 22 bp, Homo sapiens
gccagtgggacccgctgtgggc

SEQ ID NO: 6910120 - DNA, 19 bp, Homo sapiens
ctgctcagagcagctccag

SEQ ID NO: 6910121 - DNA, 22 bp, Homo sapiens
caccatcagcagcaggtgtcaa

SEQ ID NO: 6910122 - DNA, 22 bp, Homo sapiens
tctcagtgctatccatattcca

SEQ ID NO: 6910123 - DNA, 22 bp, Homo sapiens
ttgtctttcccagcttctagag

SEQ ID NO: 6910124 - DNA, 22 bp, Homo sapiens
tcactgtatgtctttttttgat

SEQ ID NO: 6910125 - DNA, 22 bp, Homo sapiens
gcatttatttctttactgcatc

SEQ ID NO: 6910126 - DNA, 16 bp, Homo sapiens
agcaaaagtaggtgtt

SEQ ID NO: 6910127 - DNA, 22 bp, Homo sapiens
gttctacagttcctattactta

SEQ ID NO: 6910128 - DNA, 22 bp, Homo sapiens
ggcgccagcactgcagcgcctc

SEQ ID NO: 6910129 - DNA, 22 bp, Homo sapiens
cctgacaggagaagcgcagcat

SEQ ID NO: 6910130 - DNA, 21 bp, Homo sapiens
gcaagccaccactgctgccac

SEQ ID NO: 6910131 - DNA, 22 bp, Homo sapiens
actcctcagtcaaatagttggt

SEQ ID NO: 6910132 - DNA, 22 bp, Homo sapiens
aggaaactgatgttttttacaa

SEQ ID NO: 6910133 - DNA, 22 bp, Homo sapiens
aggaagaaaactaattagatgg

SEQ ID NO: 6910134 - DNA, 22 bp, Homo sapiens
gttccccttgtgttgttgccca

SEQ ID NO: 6910135 - DNA, 22 bp, Homo sapiens
tgtctttatgcacactgacttg

SEQ ID NO: 6910136 - DNA, 22 bp, Homo sapiens
agaatcttcagatgatttgtca

SEQ ID NO: 6910137 - DNA, 22 bp, Homo sapiens
tagctgttcccagctctgtgta

SEQ ID NO: 6910138 - DNA, 22 bp, Homo sapiens
tagcataatttgtagaaaatca

SEQ ID NO: 6910139 - DNA, 22 bp, Homo sapiens
tgtacatacatagatatacaca

SEQ ID NO: 6910140 - DNA, 22 bp, Homo sapiens
tctggagtatgtccctggtgaa

SEQ ID NO: 6910141 - DNA, 22 bp, Homo sapiens
gcaggctgtggtatgttgggca

SEQ ID NO: 6910142 - DNA, 22 bp, Homo sapiens
gtggtcattgcttgaaagatca

SEQ ID NO: 6910143 - DNA, 22 bp, Homo sapiens
ggtggggttttaggctgctgca

SEQ ID NO: 6910144 - DNA, 22 bp, Homo sapiens
agcaggctgagcacccaggggg

SEQ ID NO: 6910145 - DNA, 22 bp, Homo sapiens
agcttcatgcctaaagacagcg

SEQ ID NO: 6910146 - DNA, 22 bp, Homo sapiens
aaagctgccctacacggaagca

SEQ ID NO: 6910147 - DNA, 22 bp, Homo sapiens
tgcagggctaagtcagagcctg

SEQ ID NO: 6910148 - DNA, 22 bp, Homo sapiens
tcttggaatctccatagagtga

SEQ ID NO: 6910149 - DNA, 15 bp, Homo sapiens
attcacattgcttca

SEQ ID NO: 6910150 - DNA, 22 bp, Homo sapiens
aggaggcaggaagtctatggga

SEQ ID NO: 6910151 - DNA, 22 bp, Homo sapiens
gtagggatgaggccctcattcc

SEQ ID NO: 6910152 - DNA, 22 bp, Homo sapiens
tgttggaaggcaagcagcaatt

SEQ ID NO: 6910153 - DNA, 22 bp, Homo sapiens
cagcctgtggcagaggtctaat

SEQ ID NO: 6910154 - DNA, 22 bp, Homo sapiens
tacaagtgtgcaccaccatgtc

SEQ ID NO: 6910155 - DNA, 22 bp, Homo sapiens
ccaggaggcagaggttgtagtg

SEQ ID NO: 6910156 - DNA, 22 bp, Homo sapiens
attgagcacaaacgttactaga

SEQ ID NO: 6910157 - DNA, 21 bp, Homo sapiens
agcctgaatcccaccagttca

SEQ ID NO: 6910158 - DNA, 22 bp, Homo sapiens
aagagcatgtaattggatttct

SEQ ID NO: 6910159 - DNA, 22 bp, Homo sapiens
ggactgaggcccacttgaggga

SEQ ID NO: 6910160 - DNA, 21 bp, Homo sapiens
agagcaagttaaggcattaat

SEQ ID NO: 6910161 - DNA, 22 bp, Homo sapiens
gggaatgtacagaggacacagg

SEQ ID NO: 6910162 - DNA, 19 bp, Homo sapiens
tcaatgtctggccaatggt

SEQ ID NO: 6910163 - DNA, 23 bp, Homo sapiens
agttctttccaatgtcctcctct

SEQ ID NO: 6910164 - DNA, 22 bp, Homo sapiens
gaagatttaagcacaatagtct

SEQ ID NO: 6910165 - DNA, 22 bp, Homo sapiens
acagtcctgttgtcaaagcaat

SEQ ID NO: 6910166 - DNA, 22 bp, Homo sapiens
gccttggagatcactgctcatg

SEQ ID NO: 6910167 - DNA, 22 bp, Homo sapiens
gccctctggggcacacagagga

SEQ ID NO: 6910168 - DNA, 22 bp, Homo sapiens
tttcattttggttatgccataa

SEQ ID NO: 6910169 - DNA, 22 bp, Homo sapiens
ttgcattgggagtgaggagacc

SEQ ID NO: 6910170 - DNA, 22 bp, Homo sapiens
tcccagagctctggaggttgga

SEQ ID NO: 6910171 - DNA, 22 bp, Homo sapiens
acatgtggtcaatctgtgtagg

SEQ ID NO: 6910172 - DNA, 21 bp, Homo sapiens
gggctctcctgaggccatgaa

SEQ ID NO: 6910173 - DNA, 22 bp, Homo sapiens
tccaggaggcagggctgtgccc

SEQ ID NO: 6910174 - DNA, 22 bp, Homo sapiens
gtctgtcatacggcttatgtaa

SEQ ID NO: 6910175 - DNA, 22 bp, Homo sapiens
cgaggccatgcatgctgaggac

SEQ ID NO: 6910176 - DNA, 22 bp, Homo sapiens
ggcccagcccgagtcagccttc

SEQ ID NO: 6910177 - DNA, 21 bp, Homo sapiens
tgaggccaatagcccctggac

SEQ ID NO: 6910178 - DNA, 22 bp, Homo sapiens
ctgaccacaggcctctaacagc

SEQ ID NO: 6910179 - DNA, 20 bp, Homo sapiens
aaatgtataggacccttcta

SEQ ID NO: 6910180 - DNA, 22 bp, Homo sapiens
gtcagagcccccagcggcgcgg

SEQ ID NO: 6910181 - DNA, 22 bp, Homo sapiens
aaagaactcagagaggatttta

SEQ ID NO: 6910182 - DNA, 22 bp, Homo sapiens
tcatcttaggtgatgagacagt

SEQ ID NO: 6910183 - DNA, 22 bp, Homo sapiens
ccatgtgttgattctctgcaga

SEQ ID NO: 6910184 - DNA, 22 bp, Homo sapiens
ataaacagctccatttagtgcc

SEQ ID NO: 6910185 - DNA, 22 bp, Homo sapiens
atgcagggtctccgtgtgacga

SEQ ID NO: 6910186 - DNA, 22 bp, Homo sapiens
tcagtgtgaggtcttccacccg

SEQ ID NO: 6910187 - DNA, 22 bp, Homo sapiens
ctgtaaccactccacctgcggc

SEQ ID NO: 6910188 - DNA, 22 bp, Homo sapiens
ttcattgactggttcgttaagt

SEQ ID NO: 6910189 - DNA, 22 bp, Homo sapiens
tatgctaagataaacagagtta

SEQ ID NO: 6910190 - DNA, 22 bp, Homo sapiens
tggcctggaagagaggtcgagg

SEQ ID NO: 6910191 - DNA, 22 bp, Homo sapiens
agggaaattaatgtgagcaatg

SEQ ID NO: 6910192 - DNA, 22 bp, Homo sapiens
tgattcacgtaataagaaaaag

SEQ ID NO: 6910193 - DNA, 22 bp, Homo sapiens
ggtcagggtataatcaagtgag

SEQ ID NO: 6910194 - DNA, 22 bp, Homo sapiens
tttctctgagttgttacaaaac

SEQ ID NO: 6910195 - DNA, 22 bp, Homo sapiens
atgagaggtttcgtcagaggaa

SEQ ID NO: 6910196 - DNA, 22 bp, Homo sapiens
gtgaggtacaattttataccct

SEQ ID NO: 6910197 - DNA, 20 bp, Homo sapiens
tccttctgaggtgaggagga

SEQ ID NO: 6910198 - DNA, 22 bp, Homo sapiens
actcagaggaaagttgagattg

SEQ ID NO: 6910199 - DNA, 22 bp, Homo sapiens
attgactccttcaatgatgaca

SEQ ID NO: 6910200 - DNA, 22 bp, Homo sapiens
cctgggctcaggcttgggcagc

SEQ ID NO: 6910201 - DNA, 22 bp, Homo sapiens
aaattcagtttctgtcctggga

SEQ ID NO: 6910202 - DNA, 22 bp, Homo sapiens
atagatcaatatttagaaactt

SEQ ID NO: 6910203 - DNA, 22 bp, Homo sapiens
tgaaacagaagatgttcatgtg

SEQ ID NO: 6910204 - DNA, 22 bp, Homo sapiens
gcatgcatttccattctcacat

SEQ ID NO: 6910205 - DNA, 22 bp, Homo sapiens
ccattcactgaacaaggctaaa

SEQ ID NO: 6910206 - DNA, 22 bp, Homo sapiens
tagtgtacatgtagacaccctt

SEQ ID NO: 6910207 - DNA, 22 bp, Homo sapiens
aaggcagcagtgcacgactgat

SEQ ID NO: 6910208 - DNA, 22 bp, Homo sapiens
tgctcagttaagcagaggaaat

SEQ ID NO: 6910209 - DNA, 22 bp, Homo sapiens
agaataaactgctttagggcag

SEQ ID NO: 6910210 - DNA, 22 bp, Homo sapiens
aggctggagtgcaatggcgtga

SEQ ID NO: 6910211 - DNA, 22 bp, Homo sapiens
tccaaggcatagacacagtgcc

SEQ ID NO: 6910212 - DNA, 22 bp, Homo sapiens
tttgaccttggtacaggtttac

SEQ ID NO: 6910213 - DNA, 22 bp, Homo sapiens
tgtctttgttattgtggacagg

SEQ ID NO: 6910214 - DNA, 22 bp, Homo sapiens
agtcacagttctgctgtctgag

SEQ ID NO: 6910215 - DNA, 22 bp, Homo sapiens
cagcttctgtctgattagcaag

SEQ ID NO: 6910216 - DNA, 22 bp, Homo sapiens
tgattcaattatctgatgcttt

SEQ ID NO: 6910217 - DNA, 22 bp, Homo sapiens
ggtccttggcgaatcattccag

SEQ ID NO: 6910218 - DNA, 22 bp, Homo sapiens
gccatgaggctccgagaagtca

SEQ ID NO: 6910219 - DNA, 22 bp, Homo sapiens
gcctggagctcatgtgggcatt

SEQ ID NO: 6910220 - DNA, 22 bp, Homo sapiens
atctgtctgagtgcttaggacc

SEQ ID NO: 6910221 - DNA, 21 bp, Homo sapiens
aagctcttctcagggtcacct

SEQ ID NO: 6910222 - DNA, 22 bp, Homo sapiens
aaaagctagtcaatgatgtatt

SEQ ID NO: 6910223 - DNA, 22 bp, Homo sapiens
ctggcagcatttttttcagaag

SEQ ID NO: 6910224 - DNA, 22 bp, Homo sapiens
gcctgtggggctgaggctgcct

SEQ ID NO: 6910225 - DNA, 19 bp, Homo sapiens
gtgagcttcttgtaagagg

SEQ ID NO: 6910226 - DNA, 22 bp, Homo sapiens
ccattgtagtatctgttttagt

SEQ ID NO: 6910227 - DNA, 22 bp, Homo sapiens
cccaggtctcctgcttcccagg

SEQ ID NO: 6910228 - DNA, 22 bp, Homo sapiens
tgcatttgacatttagtggggt

SEQ ID NO: 6910229 - DNA, 22 bp, Homo sapiens
tccaaatttaccttacagatat

SEQ ID NO: 6910230 - DNA, 22 bp, Homo sapiens
tttctagagataactcaaccat

SEQ ID NO: 6910231 - DNA, 22 bp, Homo sapiens
ggcagtgtttatgggtaacaca

SEQ ID NO: 6910232 - DNA, 20 bp, Homo sapiens
agctcttaagaagaagatga

SEQ ID NO: 6910233 - DNA, 22 bp, Homo sapiens
aacagcaagggcggggtcaaga

SEQ ID NO: 6910234 - DNA, 22 bp, Homo sapiens
aagccctcattagccatagccc

SEQ ID NO: 6910235 - DNA, 22 bp, Homo sapiens
caagatgaatgatgaagtgtgt

SEQ ID NO: 6910236 - DNA, 22 bp, Homo sapiens
tgctgctcaatgagatgccatc

SEQ ID NO: 6910237 - DNA, 22 bp, Homo sapiens
aggagcagaatttaatgtgcag

SEQ ID NO: 6910238 - DNA, 23 bp, Homo sapiens
acatgatacacaattagcaaacc

SEQ ID NO: 6910239 - DNA, 22 bp, Homo sapiens
agtcttagattttattttggtc

SEQ ID NO: 6910240 - DNA, 22 bp, Homo sapiens
gcctgaaggagtcagagagggc

SEQ ID NO: 6910241 - DNA, 22 bp, Homo sapiens
agaagtttccagtctagtaagg

SEQ ID NO: 6910242 - DNA, 22 bp, Homo sapiens
gccttcaggtgctgccaggcta

SEQ ID NO: 6910243 - DNA, 22 bp, Homo sapiens
attgaaacctgctcaggctctc

SEQ ID NO: 6910244 - DNA, 22 bp, Homo sapiens
ccctggagctgcttgcatgttg

SEQ ID NO: 6910245 - DNA, 22 bp, Homo sapiens
aggtgtgcaggatgaacccctc

SEQ ID NO: 6910246 - DNA, 22 bp, Homo sapiens
tcacttcttcagctttccttga

SEQ ID NO: 6910247 - DNA, 22 bp, Homo sapiens
atggcagtggaatgggatgagt

SEQ ID NO: 6910248 - DNA, 22 bp, Homo sapiens
ttcctaacaagtctatctttga

SEQ ID NO: 6910249 - DNA, 22 bp, Homo sapiens
tgtgtgtctggaagctcaggga

SEQ ID NO: 6910250 - DNA, 22 bp, Homo sapiens
gacatttaatagtattgtggga

SEQ ID NO: 6910251 - DNA, 22 bp, Homo sapiens
caggcaggtgcagattcctctt

SEQ ID NO: 6910252 - DNA, 22 bp, Homo sapiens
tggccctgacaggtcctgggca

SEQ ID NO: 6910253 - DNA, 22 bp, Homo sapiens
tgtgcccgtttataaatatttg

SEQ ID NO: 6910254 - DNA, 22 bp, Homo sapiens
ctcctcagggctggttacatgg

SEQ ID NO: 6910255 - DNA, 22 bp, Homo sapiens
cagaggccttcaatactcattt

SEQ ID NO: 6910256 - DNA, 22 bp, Homo sapiens
atctgcatgtatctctctgcat

SEQ ID NO: 6910257 - DNA, 22 bp, Homo sapiens
aaggtccagtggaaactagagt

SEQ ID NO: 6910258 - DNA, 22 bp, Homo sapiens
taaagtccttgaaccggatgta

SEQ ID NO: 6910259 - DNA, 22 bp, Homo sapiens
agctagttcagagagatatgta

SEQ ID NO: 6910260 - DNA, 21 bp, Homo sapiens
gcagcaaatgacaacagtgag

SEQ ID NO: 6910261 - DNA, 22 bp, Homo sapiens
accaccttatatgatgggtact

SEQ ID NO: 6910262 - DNA, 22 bp, Homo sapiens
gtttgttcatggctgatgcttg

SEQ ID NO: 6910263 - DNA, 20 bp, Homo sapiens
gcacttggctgctgcttctc

SEQ ID NO: 6910264 - DNA, 22 bp, Homo sapiens
ctcagactggagccccaaggac

SEQ ID NO: 6910265 - DNA, 20 bp, Homo sapiens
gatacacagcttcactgttg

SEQ ID NO: 6910266 - DNA, 22 bp, Homo sapiens
cagttacacaccattgtgaaca

SEQ ID NO: 6910267 - DNA, 22 bp, Homo sapiens
agagatgggcgggggcttctgc

SEQ ID NO: 6910268 - DNA, 22 bp, Homo sapiens
gccgggtgcagcgggcccgcca

SEQ ID NO: 6910269 - DNA, 22 bp, Homo sapiens
ctgcagagagtaactgaaatat

SEQ ID NO: 6910270 - DNA, 23 bp, Homo sapiens
ccttctgttaaccatctgggggg

SEQ ID NO: 6910271 - DNA, 22 bp, Homo sapiens
tgaggcttagagaagatgggat

SEQ ID NO: 6910272 - DNA, 22 bp, Homo sapiens
tcagctgcgacaggggcctgag

SEQ ID NO: 6910273 - DNA, 22 bp, Homo sapiens
tccttccttcctgaaattttag

SEQ ID NO: 6910274 - DNA, 20 bp, Homo sapiens
cctgaagagtttctctttct

SEQ ID NO: 6910275 - DNA, 22 bp, Homo sapiens
atgggccacacacgattgggtg

SEQ ID NO: 6910276 - DNA, 22 bp, Homo sapiens
ttagatgttcactctatccccc

SEQ ID NO: 6910277 - DNA, 22 bp, Homo sapiens
ctgctgtgttagcaggtttagt

SEQ ID NO: 6910278 - DNA, 22 bp, Homo sapiens
acctactgctccacagtgacta

SEQ ID NO: 6910279 - DNA, 22 bp, Homo sapiens
gaggggtcttttgttgtcaggg

SEQ ID NO: 6910280 - DNA, 22 bp, Homo sapiens
cccaggcttcccaatcagaagg

SEQ ID NO: 6910281 - DNA, 22 bp, Homo sapiens
gctatttccaaagctgctgttc

SEQ ID NO: 6910282 - DNA, 22 bp, Homo sapiens
agctatgtataaataggccact

SEQ ID NO: 6910283 - DNA, 22 bp, Homo sapiens
tcagtctttccctccctcagtt

SEQ ID NO: 6910284 - DNA, 22 bp, Homo sapiens
aacattgttttgcacaactctt

SEQ ID NO: 6910285 - DNA, 22 bp, Homo sapiens
acatgagattagctcacccact

SEQ ID NO: 6910286 - DNA, 22 bp, Homo sapiens
gaaggcaagtgagccaagagaa

SEQ ID NO: 6910287 - DNA, 22 bp, Homo sapiens
gtctatttgggatcatgatatg

SEQ ID NO: 6910288 - DNA, 22 bp, Homo sapiens
tggccctgctggccaaaggcta

SEQ ID NO: 6910289 - DNA, 22 bp, Homo sapiens
gggcaggtgccagctccctgtc

SEQ ID NO: 6910290 - DNA, 22 bp, Homo sapiens
tgctgcactcaccaacagataa

SEQ ID NO: 6910291 - DNA, 22 bp, Homo sapiens
aatacaagatttatagttgttt

SEQ ID NO: 6910292 - DNA, 22 bp, Homo sapiens
tctgaagagaatgctgctgaac

SEQ ID NO: 6910293 - DNA, 22 bp, Homo sapiens
cttcagctaggatccctgcagc

SEQ ID NO: 6910294 - DNA, 22 bp, Homo sapiens
ggcaagatccaaggggctagga

SEQ ID NO: 6910295 - DNA, 20 bp, Homo sapiens
atagaagtattatgtaatgt

SEQ ID NO: 6910296 - DNA, 22 bp, Homo sapiens
gaaaatacaaatagccttgaaa

SEQ ID NO: 6910297 - DNA, 22 bp, Homo sapiens
gctgccacgaggtttccttatc

SEQ ID NO: 6910298 - DNA, 22 bp, Homo sapiens
acagtagatggctcagagacag

SEQ ID NO: 6910299 - DNA, 22 bp, Homo sapiens
aaggactgctaggaagccgtgt

SEQ ID NO: 6910300 - DNA, 22 bp, Homo sapiens
cactgcccaggacctgccaccc

SEQ ID NO: 6910301 - DNA, 22 bp, Homo sapiens
ttgccctgcgttaccatctctt

SEQ ID NO: 6910302 - DNA, 19 bp, Homo sapiens
atgcacacattgaagagga

SEQ ID NO: 6910303 - DNA, 22 bp, Homo sapiens
tttattacaccaggttaactca

SEQ ID NO: 6910304 - DNA, 22 bp, Homo sapiens
ctgtggtcactgttggggaatg

SEQ ID NO: 6910305 - DNA, 22 bp, Homo sapiens
tatttaagatgtgtcataaaga

SEQ ID NO: 6910306 - DNA, 22 bp, Homo sapiens
gtttacttagatgctcatgcag

SEQ ID NO: 6910307 - DNA, 22 bp, Homo sapiens
gctatctttctgcaccataatt

SEQ ID NO: 6910308 - DNA, 22 bp, Homo sapiens
gtgtgcctgacatgatggttaa

SEQ ID NO: 6910309 - DNA, 22 bp, Homo sapiens
acaaatgcttagttcaccaaaa

SEQ ID NO: 6910310 - DNA, 22 bp, Homo sapiens
acgtttgttgatggattactag

SEQ ID NO: 6910311 - DNA, 22 bp, Homo sapiens
cttcttcctgctgcagcctcca

SEQ ID NO: 6910312 - DNA, 22 bp, Homo sapiens
acatgcttcatattataaccaa

SEQ ID NO: 6910313 - DNA, 22 bp, Homo sapiens
tggtggccaattcacagggctc

SEQ ID NO: 6910314 - DNA, 22 bp, Homo sapiens
cgaggagtgtgaaggcttgtcg

SEQ ID NO: 6910315 - DNA, 22 bp, Homo sapiens
tcagtgtctcatatgaggtttc

SEQ ID NO: 6910316 - DNA, 22 bp, Homo sapiens
atgctctagacatactggctat

SEQ ID NO: 6910317 - DNA, 22 bp, Homo sapiens
ggcagtccccatttggtgtttt

SEQ ID NO: 6910318 - DNA, 22 bp, Homo sapiens
cacaaaccttctgcagcctgta

SEQ ID NO: 6910319 - DNA, 22 bp, Homo sapiens
atgcaagattcagcaggaagat

SEQ ID NO: 6910320 - DNA, 22 bp, Homo sapiens
tgggcagaggcagcagaaacct

SEQ ID NO: 6910321 - DNA, 19 bp, Homo sapiens
taatgcacttaacacatgg

SEQ ID NO: 6910322 - DNA, 22 bp, Homo sapiens
atgtggatcacaggggtgtgtc

SEQ ID NO: 6910323 - DNA, 19 bp, Homo sapiens
attcagtgtctctgacttc

SEQ ID NO: 6910324 - DNA, 22 bp, Homo sapiens
ggtattcacaatatttaaagag

SEQ ID NO: 6910325 - DNA, 22 bp, Homo sapiens
acagtagttggttgttttggga

SEQ ID NO: 6910326 - DNA, 22 bp, Homo sapiens
tcccagcctcctgacagttttg

SEQ ID NO: 6910327 - DNA, 19 bp, Homo sapiens
gaggcgaggcgtgcaggag

SEQ ID NO: 6910328 - DNA, 22 bp, Homo sapiens
agtgacattaaggattcttcaa

SEQ ID NO: 6910329 - DNA, 22 bp, Homo sapiens
tagacaaaagggggcagatatg

SEQ ID NO: 6910330 - DNA, 20 bp, Homo sapiens
cctgtgcttatcacttgctg

SEQ ID NO: 6910331 - DNA, 22 bp, Homo sapiens
cagttaactgattttataaagt

SEQ ID NO: 6910332 - DNA, 22 bp, Homo sapiens
gcgcacgtcagaaaggctttta

SEQ ID NO: 6910333 - DNA, 22 bp, Homo sapiens
ttctctagttttgacgaggatt

SEQ ID NO: 6910334 - DNA, 22 bp, Homo sapiens
gatgctgataattcatgagaag

SEQ ID NO: 6910335 - DNA, 22 bp, Homo sapiens
ggaggggcagccatggaactcc

SEQ ID NO: 6910336 - DNA, 19 bp, Homo sapiens
gatagctgatgaccatcat

SEQ ID NO: 6910337 - DNA, 22 bp, Homo sapiens
caggaggagcattagcgtctca

SEQ ID NO: 6910338 - DNA, 22 bp, Homo sapiens
tgggccagtttctcattgaaat

SEQ ID NO: 6910339 - DNA, 22 bp, Homo sapiens
gtaacaaaggataacttggttt

SEQ ID NO: 6910340 - DNA, 22 bp, Homo sapiens
atcagcaagattgtgtcttgta

SEQ ID NO: 6910341 - DNA, 22 bp, Homo sapiens
ttaatttatacataatcacagg

SEQ ID NO: 6910342 - DNA, 22 bp, Homo sapiens
tgatgcaattagattgtaattt

SEQ ID NO: 6910343 - DNA, 22 bp, Homo sapiens
ccaggagggaggagttcctgag

SEQ ID NO: 6910344 - DNA, 22 bp, Homo sapiens
tcagcaagcagggggatgttca

SEQ ID NO: 6910345 - DNA, 22 bp, Homo sapiens
ctttaccagattccattgcaag

SEQ ID NO: 6910346 - DNA, 22 bp, Homo sapiens
cagagccatccaggtgcctgtt

SEQ ID NO: 6910347 - DNA, 22 bp, Homo sapiens
taatcctgtcttgaccatcagg

SEQ ID NO: 6910348 - DNA, 21 bp, Homo sapiens
gtatcacatttgcatgcttat

SEQ ID NO: 6910349 - DNA, 22 bp, Homo sapiens
cctgggcattctttgagttctc

SEQ ID NO: 6910350 - DNA, 22 bp, Homo sapiens
atctgttcttgtgtcagtaatt

SEQ ID NO: 6910351 - DNA, 22 bp, Homo sapiens
ttcctcaggactgttgacttcc

SEQ ID NO: 6910352 - DNA, 23 bp, Homo sapiens
tggaatgagctgggaagctgagc

SEQ ID NO: 6910353 - DNA, 22 bp, Homo sapiens
tactgtaaaagacaggcttcct

SEQ ID NO: 6910354 - DNA, 22 bp, Homo sapiens
gtggctctcgccagcctgcggg

SEQ ID NO: 6910355 - DNA, 22 bp, Homo sapiens
ttgtggggcaacagcaggtgaa

SEQ ID NO: 6910356 - DNA, 21 bp, Homo sapiens
gctgtgcaggtgcccctgctc

SEQ ID NO: 6910357 - DNA, 22 bp, Homo sapiens
ccaggcagcctgctccattctg

SEQ ID NO: 6910358 - DNA, 22 bp, Homo sapiens
ccaggctctgcaaaatcaggct

SEQ ID NO: 6910359 - DNA, 22 bp, Homo sapiens
cccagtgtctccaacatcagat

SEQ ID NO: 6910360 - DNA, 22 bp, Homo sapiens
atagttgagatcagattcaact

SEQ ID NO: 6910361 - DNA, 22 bp, Homo sapiens
attggttagagtaacacctatt

SEQ ID NO: 6910362 - DNA, 22 bp, Homo sapiens
cctgtctggaacatggcctgtt

SEQ ID NO: 6910363 - DNA, 17 bp, Homo sapiens
tggaataaatttccccc

SEQ ID NO: 6910364 - DNA, 21 bp, Homo sapiens
tcccaagctgctggctcagct

SEQ ID NO: 6910365 - DNA, 22 bp, Homo sapiens
cttcacagtaaatccagaagaa

SEQ ID NO: 6910366 - DNA, 22 bp, Homo sapiens
agctcattgcaacctccgcctc

SEQ ID NO: 6910367 - DNA, 22 bp, Homo sapiens
gtgcaggagcaggagccatgtc

SEQ ID NO: 6910368 - DNA, 22 bp, Homo sapiens
tcaggaatccagacagggcaca

SEQ ID NO: 6910369 - DNA, 19 bp, Homo sapiens
gtacaagaatgactgagca

SEQ ID NO: 6910370 - DNA, 22 bp, Homo sapiens
tctgtgctgcaggagtctgcat

SEQ ID NO: 6910371 - DNA, 22 bp, Homo sapiens
ccaagagctacagatatgaaat

SEQ ID NO: 6910372 - DNA, 22 bp, Homo sapiens
agtgactctgtgaaaggcagaa

SEQ ID NO: 6910373 - DNA, 22 bp, Homo sapiens
cagagcagagtgattgttctgg

SEQ ID NO: 6910374 - DNA, 22 bp, Homo sapiens
atattgggcagggaagccagtg

SEQ ID NO: 6910375 - DNA, 22 bp, Homo sapiens
gggagccttgggagtgccagcc

SEQ ID NO: 6910376 - DNA, 22 bp, Homo sapiens
atccaaatcatgtcagaagaac

SEQ ID NO: 6910377 - DNA, 22 bp, Homo sapiens
caaaggttatgaaccacttgta

SEQ ID NO: 6910378 - DNA, 22 bp, Homo sapiens
tcaggaggctcaagacctggca

SEQ ID NO: 6910379 - DNA, 22 bp, Homo sapiens
aggtagctagtcctttaagtta

SEQ ID NO: 6910380 - DNA, 22 bp, Homo sapiens
gcagtgttaaacaactgctgct

SEQ ID NO: 6910381 - DNA, 18 bp, Homo sapiens
gcaacagatcaacagaaa

SEQ ID NO: 6910382 - DNA, 22 bp, Homo sapiens
aggatctgttgaataaatttga

SEQ ID NO: 6910383 - DNA, 22 bp, Homo sapiens
tgctggcttatttagtaaatgt

SEQ ID NO: 6910384 - DNA, 18 bp, Homo sapiens
ggcgggtgttttattcac

SEQ ID NO: 6910385 - DNA, 20 bp, Homo sapiens
aggtggcccattatagtgga

SEQ ID NO: 6910386 - DNA, 22 bp, Homo sapiens
ttgtttgtcataatatcattac

SEQ ID NO: 6910387 - DNA, 22 bp, Homo sapiens
aatttcttcagctctaaaatgg

SEQ ID NO: 6910388 - DNA, 22 bp, Homo sapiens
aatgaagaaatggacatcttta

SEQ ID NO: 6910389 - DNA, 22 bp, Homo sapiens
aggcacttcatgggttcaagga

SEQ ID NO: 6910390 - DNA, 22 bp, Homo sapiens
tctataccaggggcctgcagtg

SEQ ID NO: 6910391 - DNA, 22 bp, Homo sapiens
actttgaaagccttggccccgg

SEQ ID NO: 6910392 - DNA, 22 bp, Homo sapiens
gttgcagatactgaagcacagg

SEQ ID NO: 6910393 - DNA, 22 bp, Homo sapiens
ttctttccttgcctcagtgaag

SEQ ID NO: 6910394 - DNA, 22 bp, Homo sapiens
gaaattaagcaggggtctgtgg

SEQ ID NO: 6910395 - DNA, 22 bp, Homo sapiens
tttttgtgtgagcagggtgtta

SEQ ID NO: 6910396 - DNA, 22 bp, Homo sapiens
attttcctctggtttccccaga

SEQ ID NO: 6910397 - DNA, 21 bp, Homo sapiens
ggttaaaagacacatctgttt

SEQ ID NO: 6910398 - DNA, 22 bp, Homo sapiens
ttgaataaatgagcagtgaatt

SEQ ID NO: 6910399 - DNA, 22 bp, Homo sapiens
aagcacatctcaaacttcatct

SEQ ID NO: 6910400 - DNA, 22 bp, Homo sapiens
cctttatgagatcctggggtga

SEQ ID NO: 6910401 - DNA, 22 bp, Homo sapiens
aaatgcaaggccatgtgaagga

SEQ ID NO: 6910402 - DNA, 22 bp, Homo sapiens
tccatccattttctttgctgtt

SEQ ID NO: 6910403 - DNA, 22 bp, Homo sapiens
ttttgagatggtgtctcgctcc

SEQ ID NO: 6910404 - DNA, 22 bp, Homo sapiens
aagggccatcttggactcccca

SEQ ID NO: 6910405 - DNA, 22 bp, Homo sapiens
gggatgcagactacagggctta

SEQ ID NO: 6910406 - DNA, 22 bp, Homo sapiens
ctacaaaagtaattgtggtttt

SEQ ID NO: 6910407 - DNA, 22 bp, Homo sapiens
tacactgaagtgtcttggtata

SEQ ID NO: 6910408 - DNA, 22 bp, Homo sapiens
tgaagtacccgtttttattgca

SEQ ID NO: 6910409 - DNA, 22 bp, Homo sapiens
ctgtggctccagtgaaccaatg

SEQ ID NO: 6910410 - DNA, 19 bp, Homo sapiens
agaggcaagggtggaagta

SEQ ID NO: 6910411 - DNA, 22 bp, Homo sapiens
ctgagagttaagagatggggct

SEQ ID NO: 6910412 - DNA, 22 bp, Homo sapiens
tgctggaggcagtggaggtgcc

SEQ ID NO: 6910413 - DNA, 22 bp, Homo sapiens
aaataacttatgatcgtctggc

SEQ ID NO: 6910414 - DNA, 22 bp, Homo sapiens
gaaagcacagttctgaccatgt

SEQ ID NO: 6910415 - DNA, 20 bp, Homo sapiens
tcggctggacactgtgcact

SEQ ID NO: 6910416 - DNA, 22 bp, Homo sapiens
aatgctttgactatatctataa

SEQ ID NO: 6910417 - DNA, 22 bp, Homo sapiens
ctgcctgtgccaccgcctcatt

SEQ ID NO: 6910418 - DNA, 22 bp, Homo sapiens
tgctgagaggaaagaatgcaca

SEQ ID NO: 6910419 - DNA, 22 bp, Homo sapiens
ccttggctgtgctgccctttgc

SEQ ID NO: 6910420 - DNA, 22 bp, Homo sapiens
gatccttacagttttgactcat

SEQ ID NO: 6910421 - DNA, 22 bp, Homo sapiens
tgtgtcctcatgaggtttgcag

SEQ ID NO: 6910422 - DNA, 22 bp, Homo sapiens
gtttctgtgttagatgagtctt

SEQ ID NO: 6910423 - DNA, 22 bp, Homo sapiens
ttcaatgtttcttatcaagttg

SEQ ID NO: 6910424 - DNA, 22 bp, Homo sapiens
ccatagcaagaggagcagaaat

SEQ ID NO: 6910425 - DNA, 19 bp, Homo sapiens
gctcagcagacccagtgct

SEQ ID NO: 6910426 - DNA, 22 bp, Homo sapiens
tctttgcaggccaaattgttaa

SEQ ID NO: 6910427 - DNA, 19 bp, Homo sapiens
tttctagtttcagcttgtc

SEQ ID NO: 6910428 - DNA, 22 bp, Homo sapiens
taacattcctcaaagttttcag

SEQ ID NO: 6910429 - DNA, 22 bp, Homo sapiens
cttctatgaggagagacatgca

SEQ ID NO: 6910430 - DNA, 22 bp, Homo sapiens
accagggcagccgaggtgtgtc

SEQ ID NO: 6910431 - DNA, 22 bp, Homo sapiens
gaagatttggattccatgtcac

SEQ ID NO: 6910432 - DNA, 22 bp, Homo sapiens
aaggcagtggttgtgatactgt

SEQ ID NO: 6910433 - DNA, 22 bp, Homo sapiens
ctgagagtcagtggagtggtgt

SEQ ID NO: 6910434 - DNA, 22 bp, Homo sapiens
tgcagtccctggcccactttaa

SEQ ID NO: 6910435 - DNA, 22 bp, Homo sapiens
agcagccaaggtaacctgtgct

SEQ ID NO: 6910436 - DNA, 22 bp, Homo sapiens
agctgactctggcctctggtcc

SEQ ID NO: 6910437 - DNA, 22 bp, Homo sapiens
gttcttcaggctgagcagagag

SEQ ID NO: 6910438 - DNA, 22 bp, Homo sapiens
ctggagaagtactgagacattt

SEQ ID NO: 6910439 - DNA, 22 bp, Homo sapiens
acaaatgttggatttgtcttcc

SEQ ID NO: 6910440 - DNA, 22 bp, Homo sapiens
ctgctttaactctgggaagcca

SEQ ID NO: 6910441 - DNA, 21 bp, Homo sapiens
agcagctttggttgaagcaga

SEQ ID NO: 6910442 - DNA, 22 bp, Homo sapiens
gcctgagaaggacacagcaggt

SEQ ID NO: 6910443 - DNA, 22 bp, Homo sapiens
atagaatttgcactaaatctgc

SEQ ID NO: 6910444 - DNA, 22 bp, Homo sapiens
taagcacacaatatctggagag

SEQ ID NO: 6910445 - DNA, 22 bp, Homo sapiens
atcaggtgtggtccaatcagca

SEQ ID NO: 6910446 - DNA, 22 bp, Homo sapiens
ttcaattctgatgaaggcaata

SEQ ID NO: 6910447 - DNA, 22 bp, Homo sapiens
atacatgaggctcatttatgtc

SEQ ID NO: 6910448 - DNA, 22 bp, Homo sapiens
aacttctgcttttacaggcagt

SEQ ID NO: 6910449 - DNA, 22 bp, Homo sapiens
gtctgcctctttctttctgggt

SEQ ID NO: 6910450 - DNA, 22 bp, Homo sapiens
cagagacattaagtgccatgat

SEQ ID NO: 6910451 - DNA, 16 bp, Homo sapiens
ctgtggctcccaggtt

SEQ ID NO: 6910452 - DNA, 22 bp, Homo sapiens
actgcactcctgcctgggtaac

SEQ ID NO: 6910453 - DNA, 22 bp, Homo sapiens
aggaccaccggtccatccaccc

SEQ ID NO: 6910454 - DNA, 22 bp, Homo sapiens
agtgaagaggaagtggggcaca

SEQ ID NO: 6910455 - DNA, 22 bp, Homo sapiens
agcaggagggttttgtagagtc

SEQ ID NO: 6910456 - DNA, 20 bp, Homo sapiens
tccagcatataaactcctct

SEQ ID NO: 6910457 - DNA, 22 bp, Homo sapiens
atgtagtatttggaaatgtaaa

SEQ ID NO: 6910458 - DNA, 22 bp, Homo sapiens
cactgttttattccaacatagg

SEQ ID NO: 6910459 - DNA, 22 bp, Homo sapiens
ctgatgagcccaggtgaccatg

SEQ ID NO: 6910460 - DNA, 21 bp, Homo sapiens
aattttgaaggaagattaagg

SEQ ID NO: 6910461 - DNA, 22 bp, Homo sapiens
tcagcccaggaatgagccttct

SEQ ID NO: 6910462 - DNA, 22 bp, Homo sapiens
tgcctaagtctgcagtcacttg

SEQ ID NO: 6910463 - DNA, 23 bp, Homo sapiens
tctgggaattggctgtccacagg

SEQ ID NO: 6910464 - DNA, 22 bp, Homo sapiens
gaggcccaaggactctgtcccg

SEQ ID NO: 6910465 - DNA, 22 bp, Homo sapiens
gactgctttggtttgtaaatgt

SEQ ID NO: 6910466 - DNA, 22 bp, Homo sapiens
cgaggcagggaagctgcaaaag

SEQ ID NO: 6910467 - DNA, 22 bp, Homo sapiens
acacttggctctgagtcactac

SEQ ID NO: 6910468 - DNA, 22 bp, Homo sapiens
tcatggacgtcaccatggtcct

SEQ ID NO: 6910469 - DNA, 22 bp, Homo sapiens
aataatgtgatagataagggaa

SEQ ID NO: 6910470 - DNA, 22 bp, Homo sapiens
ttgtccagaacatcggggttgc

SEQ ID NO: 6910471 - DNA, 22 bp, Homo sapiens
aaagtaagaccaagtgatcatt

SEQ ID NO: 6910472 - DNA, 22 bp, Homo sapiens
agtgtattacagaactgacatt

SEQ ID NO: 6910473 - DNA, 22 bp, Homo sapiens
acatagaacttcccagtgagca

SEQ ID NO: 6910474 - DNA, 23 bp, Homo sapiens
ttacagcttcagcagctaacccc

SEQ ID NO: 6910475 - DNA, 22 bp, Homo sapiens
tttgctcagttctctgtatttt

SEQ ID NO: 6910476 - DNA, 23 bp, Homo sapiens
tgggccactatagaaatctctca

SEQ ID NO: 6910477 - DNA, 22 bp, Homo sapiens
tcagtgtttgtggcaaatgtta

SEQ ID NO: 6910478 - DNA, 22 bp, Homo sapiens
agctgctgtcctaggcactgta

SEQ ID NO: 6910479 - DNA, 22 bp, Homo sapiens
ttgggcaaagtgtttctggagc

SEQ ID NO: 6910480 - DNA, 23 bp, Homo sapiens
tgtctccatctcattacttgggg

SEQ ID NO: 6910481 - DNA, 21 bp, Homo sapiens
agagaagggactcttccagtc

SEQ ID NO: 6910482 - DNA, 22 bp, Homo sapiens
aggaacacatctttgtagcagg

SEQ ID NO: 6910483 - DNA, 22 bp, Homo sapiens
actgggattacaggtgggagtc

SEQ ID NO: 6910484 - DNA, 22 bp, Homo sapiens
actggagctgagagcatgggta

SEQ ID NO: 6910485 - DNA, 22 bp, Homo sapiens
tgagcagagatgactgggcatt

SEQ ID NO: 6910486 - DNA, 21 bp, Homo sapiens
tttctcataaaatactcatta

SEQ ID NO: 6910487 - DNA, 22 bp, Homo sapiens
ctgcactgaagaaaggagctct

SEQ ID NO: 6910488 - DNA, 22 bp, Homo sapiens
acacttgataggtcaaatcagt

SEQ ID NO: 6910489 - DNA, 22 bp, Homo sapiens
ctgacacactgagcatttgata

SEQ ID NO: 6910490 - DNA, 22 bp, Homo sapiens
tgattatattaactatgttcct

SEQ ID NO: 6910491 - DNA, 22 bp, Homo sapiens
ctgactctcctgagatggggag

SEQ ID NO: 6910492 - DNA, 22 bp, Homo sapiens
cagagctgcagattgaaggcat

SEQ ID NO: 6910493 - DNA, 17 bp, Homo sapiens
ttgagtctggggtctac

SEQ ID NO: 6910494 - DNA, 22 bp, Homo sapiens
aggatgggcctgggatatgctt

SEQ ID NO: 6910495 - DNA, 22 bp, Homo sapiens
actgccctggagacagcagagt

SEQ ID NO: 6910496 - DNA, 22 bp, Homo sapiens
gctgggaagagatgcacatgat

SEQ ID NO: 6910497 - DNA, 22 bp, Homo sapiens
attcatttagagggattaagca

SEQ ID NO: 6910498 - DNA, 22 bp, Homo sapiens
tctttaatgtactttctttcac

SEQ ID NO: 6910499 - DNA, 22 bp, Homo sapiens
ggtgagcttgctgctagaggct

SEQ ID NO: 6910500 - DNA, 22 bp, Homo sapiens
ttgaagattctttttgttagta

SEQ ID NO: 6910501 - DNA, 22 bp, Homo sapiens
gcctcctgagtagctgggattg

SEQ ID NO: 6910502 - DNA, 22 bp, Homo sapiens
gctgcaggagattttgagagtc

SEQ ID NO: 6910503 - DNA, 22 bp, Homo sapiens
aaggccactgaagaaatcacaa

SEQ ID NO: 6910504 - DNA, 22 bp, Homo sapiens
cagttgtcctttgtaccaagtt

SEQ ID NO: 6910505 - DNA, 22 bp, Homo sapiens
tacacatctggtgtgactgcca

SEQ ID NO: 6910506 - DNA, 22 bp, Homo sapiens
tcgcgggttgcacatggccatc

SEQ ID NO: 6910507 - DNA, 22 bp, Homo sapiens
gattctgatctatagtgttata

SEQ ID NO: 6910508 - DNA, 22 bp, Homo sapiens
taagttcttttctatgtaatat

SEQ ID NO: 6910509 - DNA, 22 bp, Homo sapiens
cttctttaccaagagatagagt

SEQ ID NO: 6910510 - DNA, 22 bp, Homo sapiens
attcaactagtgattgtgttat

SEQ ID NO: 6910511 - DNA, 22 bp, Homo sapiens
agcagggctttgtctctgtgaa

SEQ ID NO: 6910512 - DNA, 22 bp, Homo sapiens
ttagataaattaagactttaca

SEQ ID NO: 6910513 - DNA, 20 bp, Homo sapiens
gctgtctggattagaagcct

SEQ ID NO: 6910514 - DNA, 22 bp, Homo sapiens
tgcttacctctggctgttttcc

SEQ ID NO: 6910515 - DNA, 22 bp, Homo sapiens
aaggaagatgaaagtactgcta

SEQ ID NO: 6910516 - DNA, 22 bp, Homo sapiens
agtgtctgtgatgaggtcagga

SEQ ID NO: 6910517 - DNA, 21 bp, Homo sapiens
actgagggccagagaggacct

SEQ ID NO: 6910518 - DNA, 22 bp, Homo sapiens
tcctacactcaaggcatggagg

SEQ ID NO: 6910519 - DNA, 22 bp, Homo sapiens
ctgcctgcactgcctggctcca

SEQ ID NO: 6910520 - DNA, 22 bp, Homo sapiens
gtggccttttcaagtagggtat

SEQ ID NO: 6910521 - DNA, 22 bp, Homo sapiens
gagctctttcctgcccatactg

SEQ ID NO: 6910522 - DNA, 19 bp, Homo sapiens
gttgatgtttccccatctt

SEQ ID NO: 6910523 - DNA, 22 bp, Homo sapiens
caaggctgatcattttcccata

SEQ ID NO: 6910524 - DNA, 19 bp, Homo sapiens
tagaacctggatttcagga

SEQ ID NO: 6910525 - DNA, 22 bp, Homo sapiens
atttgctttcaggtataaaagg

SEQ ID NO: 6910526 - DNA, 22 bp, Homo sapiens
gccagggctgtgcaggtttgtt

SEQ ID NO: 6910527 - DNA, 22 bp, Homo sapiens
cgaggtatagggagggtatctc

SEQ ID NO: 6910528 - DNA, 22 bp, Homo sapiens
tagatactcagaaatgctttca

SEQ ID NO: 6910529 - DNA, 22 bp, Homo sapiens
aagaattggtcacatgctacaa

SEQ ID NO: 6910530 - DNA, 22 bp, Homo sapiens
agtctatattgtgaaagtaaaa

SEQ ID NO: 6910531 - DNA, 22 bp, Homo sapiens
acactttgctacatttcatatt

SEQ ID NO: 6910532 - DNA, 22 bp, Homo sapiens
gcacagacccaccatctatagt

SEQ ID NO: 6910533 - DNA, 22 bp, Homo sapiens
tttcctaagatagatacttcag

SEQ ID NO: 6910534 - DNA, 22 bp, Homo sapiens
tgcagggccgctggaggtcatg

SEQ ID NO: 6910535 - DNA, 22 bp, Homo sapiens
ctttaattgtagctcccataat

SEQ ID NO: 6910536 - DNA, 22 bp, Homo sapiens
ttaaagattctgaggctgatta

SEQ ID NO: 6910537 - DNA, 20 bp, Homo sapiens
aatcactttgtacaggaagc

SEQ ID NO: 6910538 - DNA, 22 bp, Homo sapiens
ggtgacagccgcttgccctgta

SEQ ID NO: 6910539 - DNA, 22 bp, Homo sapiens
ggtggtctgcgcagcccagggt

SEQ ID NO: 6910540 - DNA, 22 bp, Homo sapiens
aaagccaagctgggaaggcagg

SEQ ID NO: 6910541 - DNA, 23 bp, Homo sapiens
agatttaatgttatattctgggc

SEQ ID NO: 6910542 - DNA, 22 bp, Homo sapiens
acaggagtggagaggtgcctct

SEQ ID NO: 6910543 - DNA, 22 bp, Homo sapiens
ggcattgtggtgtgtgcttcct

SEQ ID NO: 6910544 - DNA, 22 bp, Homo sapiens
aaagtgttaacactggctactt

SEQ ID NO: 6910545 - DNA, 22 bp, Homo sapiens
aagcagagcaagcgtatttatt

SEQ ID NO: 6910546 - DNA, 21 bp, Homo sapiens
tgacagtgtggcatggaaggt

SEQ ID NO: 6910547 - DNA, 23 bp, Homo sapiens
tctgccagtgtgtgccaggagcc

SEQ ID NO: 6910548 - DNA, 22 bp, Homo sapiens
atcagaatgcagccagcagtta

SEQ ID NO: 6910549 - DNA, 22 bp, Homo sapiens
tccagccgccggccctgcaggt

SEQ ID NO: 6910550 - DNA, 22 bp, Homo sapiens
ttctaactcaaagcttctttca

SEQ ID NO: 6910551 - DNA, 22 bp, Homo sapiens
caaaactatcaggctcaaagct

SEQ ID NO: 6910552 - DNA, 22 bp, Homo sapiens
tcaagtattattacagatgtag

SEQ ID NO: 6910553 - DNA, 22 bp, Homo sapiens
cacagagaactgtgggagtgtg

SEQ ID NO: 6910554 - DNA, 22 bp, Homo sapiens
tctctgtggcaagcatgctgct

SEQ ID NO: 6910555 - DNA, 22 bp, Homo sapiens
acttggctttagtagtaactga

SEQ ID NO: 6910556 - DNA, 22 bp, Homo sapiens
tgagcccagagatctgagctat

SEQ ID NO: 6910557 - DNA, 20 bp, Homo sapiens
gtaccagatataagtggaat

SEQ ID NO: 6910558 - DNA, 22 bp, Homo sapiens
gagtggggggtccgtctcagtg

SEQ ID NO: 6910559 - DNA, 22 bp, Homo sapiens
tacacatacaccaatgtggtca

SEQ ID NO: 6910560 - DNA, 22 bp, Homo sapiens
agtgtggagcatcgagggcaga

SEQ ID NO: 6910561 - DNA, 22 bp, Homo sapiens
tctgtcatttcattcatatgaa

SEQ ID NO: 6910562 - DNA, 22 bp, Homo sapiens
atcattaacactaaggcgctga

SEQ ID NO: 6910563 - DNA, 22 bp, Homo sapiens
actgggctggttagttttacta

SEQ ID NO: 6910564 - DNA, 22 bp, Homo sapiens
ctgggaagaatccaagggccct

SEQ ID NO: 6910565 - DNA, 22 bp, Homo sapiens
gttctttaagtggagaaggaaa

SEQ ID NO: 6910566 - DNA, 22 bp, Homo sapiens
tctttgaagttgaagtagttgg

SEQ ID NO: 6910567 - DNA, 22 bp, Homo sapiens
tccaggaatctgtgcctagccc

SEQ ID NO: 6910568 - DNA, 22 bp, Homo sapiens
tgttcttgagcctttagaccta

SEQ ID NO: 6910569 - DNA, 22 bp, Homo sapiens
gccactgttccaccatcttgat

SEQ ID NO: 6910570 - DNA, 22 bp, Homo sapiens
aatactgtctttcacagatatt

SEQ ID NO: 6910571 - DNA, 22 bp, Homo sapiens
cagctgacatggtatttgtgcc

SEQ ID NO: 6910572 - DNA, 22 bp, Homo sapiens
tggtccatgttcccagaagaca

SEQ ID NO: 6910573 - DNA, 22 bp, Homo sapiens
aggcttctggggcaccgagcga

SEQ ID NO: 6910574 - DNA, 22 bp, Homo sapiens
cagggcttcgtgtctcagtgct

SEQ ID NO: 6910575 - DNA, 22 bp, Homo sapiens
ccttcaggtcatatatgtcaga

SEQ ID NO: 6910576 - DNA, 22 bp, Homo sapiens
gtccagagggctgcaggatgct

SEQ ID NO: 6910577 - DNA, 22 bp, Homo sapiens
ttctagttccctctggaatgta

SEQ ID NO: 6910578 - DNA, 22 bp, Homo sapiens
aagcccaatgtacaaataactc

SEQ ID NO: 6910579 - DNA, 22 bp, Homo sapiens
tagaagcagcaggactcatggt

SEQ ID NO: 6910580 - DNA, 22 bp, Homo sapiens
aaaatttccaccatctttgtgt

SEQ ID NO: 6910581 - DNA, 22 bp, Homo sapiens
tagcacctgtgcacaccaggca

SEQ ID NO: 6910582 - DNA, 22 bp, Homo sapiens
cagtgggtaaataagtgggtaa

SEQ ID NO: 6910583 - DNA, 22 bp, Homo sapiens
tcccagtggtcttgaaacaggg

SEQ ID NO: 6910584 - DNA, 22 bp, Homo sapiens
tactgctgaatggtgctgggca

SEQ ID NO: 6910585 - DNA, 22 bp, Homo sapiens
ggctcatgtatgaaagggtgtg

SEQ ID NO: 6910586 - DNA, 22 bp, Homo sapiens
ctttgaaacctgctctgcagaa

SEQ ID NO: 6910587 - DNA, 22 bp, Homo sapiens
taccctggagcaagtttcctca

SEQ ID NO: 6910588 - DNA, 22 bp, Homo sapiens
aggttatttttgcttagaaaga

SEQ ID NO: 6910589 - DNA, 22 bp, Homo sapiens
ttggctgtgcagatcttgccta

SEQ ID NO: 6910590 - DNA, 22 bp, Homo sapiens
ttaaaggctgatcttaatatta

SEQ ID NO: 6910591 - DNA, 19 bp, Homo sapiens
tttcacaaagagagcgtga

SEQ ID NO: 6910592 - DNA, 22 bp, Homo sapiens
accctccacaccagtcttattt

SEQ ID NO: 6910593 - DNA, 22 bp, Homo sapiens
tcatctccatacggtctcgcag

SEQ ID NO: 6910594 - DNA, 23 bp, Homo sapiens
ttcattcaaaaggaaaagtcatg

SEQ ID NO: 6910595 - DNA, 22 bp, Homo sapiens
tgaggcctacccccctgtgttt

SEQ ID NO: 6910596 - DNA, 22 bp, Homo sapiens
ttgggataagacagggacaggg

SEQ ID NO: 6910597 - DNA, 22 bp, Homo sapiens
tctgtagtttacagtatttcag

SEQ ID NO: 6910598 - DNA, 22 bp, Homo sapiens
tagatttgtgcaagaagggatt

SEQ ID NO: 6910599 - DNA, 22 bp, Homo sapiens
aaatagtttagctctcatttca

SEQ ID NO: 6910600 - DNA, 22 bp, Homo sapiens
ttgttcttccatcatccctcag

SEQ ID NO: 6910601 - DNA, 22 bp, Homo sapiens
tgagtccagatgggccagcagg

SEQ ID NO: 6910602 - DNA, 22 bp, Homo sapiens
gggccactcagattgtcccctt

SEQ ID NO: 6910603 - DNA, 22 bp, Homo sapiens
tccatccggctgacatccgcag

SEQ ID NO: 6910604 - DNA, 22 bp, Homo sapiens
tgctgagggctgttaaggaagc

SEQ ID NO: 6910605 - DNA, 22 bp, Homo sapiens
tcacagacccttgctgagctct

SEQ ID NO: 6910606 - DNA, 20 bp, Homo sapiens
tggcctctgagatgccacgg

SEQ ID NO: 6910607 - DNA, 22 bp, Homo sapiens
ccagtgcccagctgcccaggca

SEQ ID NO: 6910608 - DNA, 22 bp, Homo sapiens
gaggggctctttaatagtaaca

SEQ ID NO: 6910609 - DNA, 22 bp, Homo sapiens
aggaagtcagaatgctggggag

SEQ ID NO: 6910610 - DNA, 22 bp, Homo sapiens
gagtgagggcagcaggggctgc

SEQ ID NO: 6910611 - DNA, 22 bp, Homo sapiens
agctcacagcctagcactgtga

SEQ ID NO: 6910612 - DNA, 22 bp, Homo sapiens
cacccagagcctgagagggata

SEQ ID NO: 6910613 - DNA, 22 bp, Homo sapiens
aaacaaacataggtttgaaagt

SEQ ID NO: 6910614 - DNA, 22 bp, Homo sapiens
atgtcctggtctagcttccggg

SEQ ID NO: 6910615 - DNA, 22 bp, Homo sapiens
gttagtagcatttcatgacatg

SEQ ID NO: 6910616 - DNA, 22 bp, Homo sapiens
gtgttactgggaggacggaggt

SEQ ID NO: 6910617 - DNA, 22 bp, Homo sapiens
ctctctgagtgagggacaagct

SEQ ID NO: 6910618 - DNA, 22 bp, Homo sapiens
agaggagctgggaggccctcgt

SEQ ID NO: 6910619 - DNA, 21 bp, Homo sapiens
actgggctagcctgacttctg

SEQ ID NO: 6910620 - DNA, 22 bp, Homo sapiens
gtacagaaatggggccccaggt

SEQ ID NO: 6910621 - DNA, 22 bp, Homo sapiens
tggcaggcggaggttgcagtga

SEQ ID NO: 6910622 - DNA, 21 bp, Homo sapiens
gctgcagggcccagggcaccc

SEQ ID NO: 6910623 - DNA, 22 bp, Homo sapiens
agagccagttgttaagcactta

SEQ ID NO: 6910624 - DNA, 22 bp, Homo sapiens
atcaggaagccagtctaatgga

SEQ ID NO: 6910625 - DNA, 22 bp, Homo sapiens
tgttcatattcctgtccgctga

SEQ ID NO: 6910626 - DNA, 22 bp, Homo sapiens
ttccagggttaatttatatggt

SEQ ID NO: 6910627 - DNA, 22 bp, Homo sapiens
cgcccacgaagtaggtggcatt

SEQ ID NO: 6910628 - DNA, 22 bp, Homo sapiens
tgaatagttatgttatatggca

SEQ ID NO: 6910629 - DNA, 22 bp, Homo sapiens
tggaagacaatttgaaaacatt

SEQ ID NO: 6910630 - DNA, 18 bp, Homo sapiens
tcaatctctgatggtgtt

SEQ ID NO: 6910631 - DNA, 22 bp, Homo sapiens
tctgggagacgtgtgttgtcag

SEQ ID NO: 6910632 - DNA, 22 bp, Homo sapiens
tgacctgcgtaggtggtttctg

SEQ ID NO: 6910633 - DNA, 22 bp, Homo sapiens
agtgaattctaaatgctaaaga

SEQ ID NO: 6910634 - DNA, 22 bp, Homo sapiens
tttcagatgcaattaattttca

SEQ ID NO: 6910635 - DNA, 22 bp, Homo sapiens
aagcaaagagataaccttttgg

SEQ ID NO: 6910636 - DNA, 22 bp, Homo sapiens
atgcatgcatgagtgtgtacct

SEQ ID NO: 6910637 - DNA, 22 bp, Homo sapiens
atcctcagacctcagcaaagcc

SEQ ID NO: 6910638 - DNA, 22 bp, Homo sapiens
agcagctggcagcttcttctct

SEQ ID NO: 6910639 - DNA, 22 bp, Homo sapiens
aagtgcctgacctagcctggag

SEQ ID NO: 6910640 - DNA, 22 bp, Homo sapiens
gcctgaagtttcatgcctctat

SEQ ID NO: 6910641 - DNA, 22 bp, Homo sapiens
aaacccatggctgatatcacta

SEQ ID NO: 6910642 - DNA, 22 bp, Homo sapiens
ggaatgctcagttcttggtgct

SEQ ID NO: 6910643 - DNA, 22 bp, Homo sapiens
gtgcaactaaaaccattgatca

SEQ ID NO: 6910644 - DNA, 20 bp, Homo sapiens
gctgggaacaggattgaatc

SEQ ID NO: 6910645 - DNA, 22 bp, Homo sapiens
aacaaggcacaagctggctgtt

SEQ ID NO: 6910646 - DNA, 22 bp, Homo sapiens
aacccacaagcagctgtagccc

SEQ ID NO: 6910647 - DNA, 22 bp, Homo sapiens
ataaggcacacatagatagggt

SEQ ID NO: 6910648 - DNA, 22 bp, Homo sapiens
ctggcagtcacggccatgtgct

SEQ ID NO: 6910649 - DNA, 22 bp, Homo sapiens
acaactggctttttagcttgtt

SEQ ID NO: 6910650 - DNA, 18 bp, Homo sapiens
taccaaaggctttctttt

SEQ ID NO: 6910651 - DNA, 22 bp, Homo sapiens
agtggtctgggctaaatgaggt

SEQ ID NO: 6910652 - DNA, 22 bp, Homo sapiens
ctgtccattttcgtgcctcctt

SEQ ID NO: 6910653 - DNA, 22 bp, Homo sapiens
cagcagcatcaggtctgtggtt

SEQ ID NO: 6910654 - DNA, 22 bp, Homo sapiens
ttttgtatgagaagtgctttac

SEQ ID NO: 6910655 - DNA, 22 bp, Homo sapiens
aaaggctcatgaaccaggctcg

SEQ ID NO: 6910656 - DNA, 22 bp, Homo sapiens
agaaatctatgttttggttaga

SEQ ID NO: 6910657 - DNA, 22 bp, Homo sapiens
tggaatgtggataagggtgtct

SEQ ID NO: 6910658 - DNA, 18 bp, Homo sapiens
ggaaaccacagggttctg

SEQ ID NO: 6910659 - DNA, 22 bp, Homo sapiens
ctacaagtatgggggctccaaa

SEQ ID NO: 6910660 - DNA, 22 bp, Homo sapiens
tgagcctgcctgcaggtgtgct

SEQ ID NO: 6910661 - DNA, 22 bp, Homo sapiens
ggagctgctccttcagccaagt

SEQ ID NO: 6910662 - DNA, 22 bp, Homo sapiens
ctgtgcacttctctttatttgt

SEQ ID NO: 6910663 - DNA, 22 bp, Homo sapiens
gtgcgtggttctagatcctgtc

SEQ ID NO: 6910664 - DNA, 22 bp, Homo sapiens
taggcattattttaccacggtc

SEQ ID NO: 6910665 - DNA, 19 bp, Homo sapiens
ttgaggggccaggggagat

SEQ ID NO: 6910666 - DNA, 22 bp, Homo sapiens
cctcctagaggaaccccagggc

SEQ ID NO: 6910667 - DNA, 19 bp, Homo sapiens
ctccaagttaagagggagg

SEQ ID NO: 6910668 - DNA, 22 bp, Homo sapiens
gaatctcaaattaagaatttta

SEQ ID NO: 6910669 - DNA, 22 bp, Homo sapiens
ggcagagagttctccacctctc

SEQ ID NO: 6910670 - DNA, 22 bp, Homo sapiens
aagggatgcaggaaagaaggtt

SEQ ID NO: 6910671 - DNA, 23 bp, Homo sapiens
cctgtggcaagtagatgagatga

SEQ ID NO: 6910672 - DNA, 22 bp, Homo sapiens
gccaggaggggagagtgtgtca

SEQ ID NO: 6910673 - DNA, 22 bp, Homo sapiens
tagtttcagattgctttcatat

SEQ ID NO: 6910674 - DNA, 22 bp, Homo sapiens
gcagttagtgaagcagcttaga

SEQ ID NO: 6910675 - DNA, 22 bp, Homo sapiens
cagatgtcgaaggatgtgaccg

SEQ ID NO: 6910676 - DNA, 22 bp, Homo sapiens
catgagaaggttttggcatata

SEQ ID NO: 6910677 - DNA, 22 bp, Homo sapiens
ttcctgggtggtcctggtagag

SEQ ID NO: 6910678 - DNA, 22 bp, Homo sapiens
acagctttgtgttaatgggaag

SEQ ID NO: 6910679 - DNA, 22 bp, Homo sapiens
aagttctttcatatcttaatta

SEQ ID NO: 6910680 - DNA, 22 bp, Homo sapiens
agttctggcccagggtttcttg

SEQ ID NO: 6910681 - DNA, 22 bp, Homo sapiens
atcagagatggctccagtgctc

SEQ ID NO: 6910682 - DNA, 22 bp, Homo sapiens
actttggttcacagctgttcat

SEQ ID NO: 6910683 - DNA, 22 bp, Homo sapiens
gctggcctcctgctagatggaa

SEQ ID NO: 6910684 - DNA, 22 bp, Homo sapiens
cctgcacagccggacccctgct

SEQ ID NO: 6910685 - DNA, 22 bp, Homo sapiens
caggtagaggctgccatcagct

SEQ ID NO: 6910686 - DNA, 22 bp, Homo sapiens
agcatcctgcctctcctcccaa

SEQ ID NO: 6910687 - DNA, 22 bp, Homo sapiens
tgatctgagagcagatcaccat

SEQ ID NO: 6910688 - DNA, 22 bp, Homo sapiens
tgagacaacagcttgtgctgct

SEQ ID NO: 6910689 - DNA, 21 bp, Homo sapiens
tctgcacagccccgcaggagg

SEQ ID NO: 6910690 - DNA, 22 bp, Homo sapiens
ttcaagtaggccagctgcatgg

SEQ ID NO: 6910691 - DNA, 22 bp, Homo sapiens
tctgcaggatcagagccagagg

SEQ ID NO: 6910692 - DNA, 22 bp, Homo sapiens
tatttattctttgtactgcctt

SEQ ID NO: 6910693 - DNA, 22 bp, Homo sapiens
gcaaagactgcaattacttttg

SEQ ID NO: 6910694 - DNA, 22 bp, Homo sapiens
aggattgtatacctaagtgtta

SEQ ID NO: 6910695 - DNA, 22 bp, Homo sapiens
attgtctgaatccaaagctctg

SEQ ID NO: 6910696 - DNA, 22 bp, Homo sapiens
tactgaatatgttttcaagtct

SEQ ID NO: 6910697 - DNA, 22 bp, Homo sapiens
agaagtgccgaaaggaagacag

SEQ ID NO: 6910698 - DNA, 23 bp, Homo sapiens
agcaggtaggttgaaattttcct

SEQ ID NO: 6910699 - DNA, 22 bp, Homo sapiens
gacagctgggaggatgacataa

SEQ ID NO: 6910700 - DNA, 22 bp, Homo sapiens
atggaacaggctcagagatgct

SEQ ID NO: 6910701 - DNA, 19 bp, Homo sapiens
ataactacattggctcagt

SEQ ID NO: 6910702 - DNA, 21 bp, Homo sapiens
acaatgtcaaggtcagacatt

SEQ ID NO: 6910703 - DNA, 20 bp, Homo sapiens
ctcagtgtggcctgagtgtt

SEQ ID NO: 6910704 - DNA, 22 bp, Homo sapiens
cagcatttagaatttgaagtgt

SEQ ID NO: 6910705 - DNA, 23 bp, Homo sapiens
aattggacttgctgtcaaacttc

SEQ ID NO: 6910706 - DNA, 17 bp, Homo sapiens
cagaggagctttggggg

SEQ ID NO: 6910707 - DNA, 22 bp, Homo sapiens
ggtgaataagctgaacacttgg

SEQ ID NO: 6910708 - DNA, 22 bp, Homo sapiens
tgggccctgacttcaagcatcc

SEQ ID NO: 6910709 - DNA, 22 bp, Homo sapiens
gtataaaggcacaggttttctg

SEQ ID NO: 6910710 - DNA, 22 bp, Homo sapiens
gggcttctcttatgctaactgg

SEQ ID NO: 6910711 - DNA, 22 bp, Homo sapiens
ggaaggaaagcagcttggccct

SEQ ID NO: 6910712 - DNA, 22 bp, Homo sapiens
ttaaggaagagacttttgcgtt

SEQ ID NO: 6910713 - DNA, 22 bp, Homo sapiens
ttcacataatgatacaaagctt

SEQ ID NO: 6910714 - DNA, 22 bp, Homo sapiens
ttggccttactctcctacactg

SEQ ID NO: 6910715 - DNA, 22 bp, Homo sapiens
gtcctggtagggctctgtgtct

SEQ ID NO: 6910716 - DNA, 21 bp, Homo sapiens
aagagctcttttgttatggtc

SEQ ID NO: 6910717 - DNA, 22 bp, Homo sapiens
gctttagaaatatcactgtgga

SEQ ID NO: 6910718 - DNA, 22 bp, Homo sapiens
agcagagacctggttttgttga

SEQ ID NO: 6910719 - DNA, 22 bp, Homo sapiens
tcatttgttcatctgctcttct

SEQ ID NO: 6910720 - DNA, 22 bp, Homo sapiens
tatgagataaatggtgccccct

SEQ ID NO: 6910721 - DNA, 22 bp, Homo sapiens
gggtcctggaatctgcatttta

SEQ ID NO: 6910722 - DNA, 22 bp, Homo sapiens
ctagaagtttgggtccattaag

SEQ ID NO: 6910723 - DNA, 20 bp, Homo sapiens
tgggcacagctttggagggc

SEQ ID NO: 6910724 - DNA, 22 bp, Homo sapiens
caaagcaggcttgtcaaattgc

SEQ ID NO: 6910725 - DNA, 22 bp, Homo sapiens
tggatgtctcagcttgagctgc

SEQ ID NO: 6910726 - DNA, 22 bp, Homo sapiens
agaattagtcacaattatagga

SEQ ID NO: 6910727 - DNA, 22 bp, Homo sapiens
gagaaatgctagcttaggaatc

SEQ ID NO: 6910728 - DNA, 22 bp, Homo sapiens
tccaggggtgatttttgacttg

SEQ ID NO: 6910729 - DNA, 22 bp, Homo sapiens
aatgtggccacttttttctggg

SEQ ID NO: 6910730 - DNA, 22 bp, Homo sapiens
gagtctctttgccagtcctaag

SEQ ID NO: 6910731 - DNA, 22 bp, Homo sapiens
aaacagtcttgtgggcttggag

SEQ ID NO: 6910732 - DNA, 22 bp, Homo sapiens
tgaggatggggagatggtgtct

SEQ ID NO: 6910733 - DNA, 22 bp, Homo sapiens
attctctgtagatggcttgaga

SEQ ID NO: 6910734 - DNA, 22 bp, Homo sapiens
accagggttgagtcagctgcgt

SEQ ID NO: 6910735 - DNA, 22 bp, Homo sapiens
tggccttgggcaggtggcctgc

SEQ ID NO: 6910736 - DNA, 22 bp, Homo sapiens
gagacattcttaggaacaatgt

SEQ ID NO: 6910737 - DNA, 22 bp, Homo sapiens
tcaagctcattcctctaacctc

SEQ ID NO: 6910738 - DNA, 22 bp, Homo sapiens
ggagaagggtatgtgtggcgga

SEQ ID NO: 6910739 - DNA, 22 bp, Homo sapiens
cattaacaattgtttatgctgt

SEQ ID NO: 6910740 - DNA, 23 bp, Homo sapiens
tgtgaaatttgaggtcagtgctt

SEQ ID NO: 6910741 - DNA, 22 bp, Homo sapiens
gaggcctgggagaactgttttt

SEQ ID NO: 6910742 - DNA, 22 bp, Homo sapiens
aaacaagtttgtagactagcca

SEQ ID NO: 6910743 - DNA, 22 bp, Homo sapiens
caagattaccaaggaccagcgg

SEQ ID NO: 6910744 - DNA, 22 bp, Homo sapiens
tattataatttagggcttggat

SEQ ID NO: 6910745 - DNA, 22 bp, Homo sapiens
acaggcttcattacttcagcgt

SEQ ID NO: 6910746 - DNA, 22 bp, Homo sapiens
aggcagagaaaaaccagatatg

SEQ ID NO: 6910747 - DNA, 22 bp, Homo sapiens
cagttttccatgactcagagag

SEQ ID NO: 6910748 - DNA, 22 bp, Homo sapiens
ccgtggctggactggcattcag

SEQ ID NO: 6910749 - DNA, 22 bp, Homo sapiens
tggatacagaagccttggctgt

SEQ ID NO: 6910750 - DNA, 22 bp, Homo sapiens
tccaccagcttcttcaccagct

SEQ ID NO: 6910751 - DNA, 22 bp, Homo sapiens
ttctgtgtgggtagctcctgtt

SEQ ID NO: 6910752 - DNA, 22 bp, Homo sapiens
tctctgagttctcctccagccc

SEQ ID NO: 6910753 - DNA, 22 bp, Homo sapiens
acatgtcttgtggctttgatct

SEQ ID NO: 6910754 - DNA, 22 bp, Homo sapiens
tctgcaccctgacctctgtttc

SEQ ID NO: 6910755 - DNA, 22 bp, Homo sapiens
tcatggggtgacagaagggagg

SEQ ID NO: 6910756 - DNA, 22 bp, Homo sapiens
ggggctctaggtaaagcaacat

SEQ ID NO: 6910757 - DNA, 23 bp, Homo sapiens
aggttcccccgccaggaccctgc

SEQ ID NO: 6910758 - DNA, 22 bp, Homo sapiens
ctggtagatgccctgctctgta

SEQ ID NO: 6910759 - DNA, 22 bp, Homo sapiens
ctcagggctctgcatgcacacg

SEQ ID NO: 6910760 - DNA, 18 bp, Homo sapiens
tacatctatatagtgttt

SEQ ID NO: 6910761 - DNA, 22 bp, Homo sapiens
acattcctgaatgggcacattt

SEQ ID NO: 6910762 - DNA, 22 bp, Homo sapiens
gtgttgacacagccatcttgtc

SEQ ID NO: 6910763 - DNA, 22 bp, Homo sapiens
tctgtcaggagattggcagctg

SEQ ID NO: 6910764 - DNA, 22 bp, Homo sapiens
ctgccagacacgttatgctcat

SEQ ID NO: 6910765 - DNA, 22 bp, Homo sapiens
atgcaagggttgcctttccagc

SEQ ID NO: 6910766 - DNA, 22 bp, Homo sapiens
ctcctggcagttccccttgtca

SEQ ID NO: 6910767 - DNA, 21 bp, Homo sapiens
atgtcctggctaccagcgcag

SEQ ID NO: 6910768 - DNA, 22 bp, Homo sapiens
aaatggtgagggaattgaacag

SEQ ID NO: 6910769 - DNA, 22 bp, Homo sapiens
tggttttcaacaagggcagcga

SEQ ID NO: 6910770 - DNA, 22 bp, Homo sapiens
ccctcctctccctaagagtcac

SEQ ID NO: 6910771 - DNA, 19 bp, Homo sapiens
ctttcatgtggttcttctt

SEQ ID NO: 6910772 - DNA, 22 bp, Homo sapiens
tctgagtgagggtgtgagatat

SEQ ID NO: 6910773 - DNA, 22 bp, Homo sapiens
tgcaatactcatcattggagat

SEQ ID NO: 6910774 - DNA, 22 bp, Homo sapiens
ttacaaactccagtgagtgagc

SEQ ID NO: 6910775 - DNA, 22 bp, Homo sapiens
tcagtacacttcagtatttgtg

SEQ ID NO: 6910776 - DNA, 20 bp, Homo sapiens
atgcagcattgttgtggcaa

SEQ ID NO: 6910777 - DNA, 22 bp, Homo sapiens
tttcagagggcagatctggggc

SEQ ID NO: 6910778 - DNA, 23 bp, Homo sapiens
tttagtgatctcgtgtttttagc

SEQ ID NO: 6910779 - DNA, 22 bp, Homo sapiens
ctgcactgtgtaacagataact

SEQ ID NO: 6910780 - DNA, 22 bp, Homo sapiens
caacataacaaattggctgggc

SEQ ID NO: 6910781 - DNA, 22 bp, Homo sapiens
gtatcttgactccatgcctcag

SEQ ID NO: 6910782 - DNA, 22 bp, Homo sapiens
aaaagaggaactcttatatact

SEQ ID NO: 6910783 - DNA, 22 bp, Homo sapiens
aacccaggctggagtgcagtgg

SEQ ID NO: 6910784 - DNA, 22 bp, Homo sapiens
tcatttttgtctccggtttgtg

SEQ ID NO: 6910785 - DNA, 22 bp, Homo sapiens
cacacactggagcaaggagatg

SEQ ID NO: 6910786 - DNA, 22 bp, Homo sapiens
gggtggcagctgttgccaaggt

SEQ ID NO: 6910787 - DNA, 22 bp, Homo sapiens
gatcaacatgtatttaagagtt

SEQ ID NO: 6910788 - DNA, 22 bp, Homo sapiens
tgagggctgtctgaagcttggg

SEQ ID NO: 6910789 - DNA, 22 bp, Homo sapiens
ttgatgagttatccatttgact

SEQ ID NO: 6910790 - DNA, 22 bp, Homo sapiens
cctctgcatctggctgctgcag

SEQ ID NO: 6910791 - DNA, 22 bp, Homo sapiens
gtgagaggttcctgttagaact

SEQ ID NO: 6910792 - DNA, 22 bp, Homo sapiens
cactccagcctcagtgacagag

SEQ ID NO: 6910793 - DNA, 22 bp, Homo sapiens
atcataaagtgctatctgattg

SEQ ID NO: 6910794 - DNA, 22 bp, Homo sapiens
ttcacattccgcggctattttc

SEQ ID NO: 6910795 - DNA, 22 bp, Homo sapiens
actaagcaccatgcctgttggg

SEQ ID NO: 6910796 - DNA, 19 bp, Homo sapiens
gctgtctgatgctgaggtc

SEQ ID NO: 6910797 - DNA, 18 bp, Homo sapiens
ggagaagaacagatgtgg

SEQ ID NO: 6910798 - DNA, 19 bp, Homo sapiens
tgcagagggtaggaaggcc

SEQ ID NO: 6910799 - DNA, 22 bp, Homo sapiens
aagggagacccaccgtcctgga

SEQ ID NO: 6910800 - DNA, 23 bp, Homo sapiens
ttatcaggacatgctgtctcagg

SEQ ID NO: 6910801 - DNA, 22 bp, Homo sapiens
acaatgtcaaaataggaaacat

SEQ ID NO: 6910802 - DNA, 22 bp, Homo sapiens
aggaaaggcctttgcatttggt

SEQ ID NO: 6910803 - DNA, 22 bp, Homo sapiens
gctgtttcctacatggtgttat

SEQ ID NO: 6910804 - DNA, 22 bp, Homo sapiens
tggaggcagccgtgaaccacct

SEQ ID NO: 6910805 - DNA, 22 bp, Homo sapiens
gctgagggctggtcacatttgt

SEQ ID NO: 6910806 - DNA, 22 bp, Homo sapiens
gattgctgccagcgtgtccgtg

SEQ ID NO: 6910807 - DNA, 22 bp, Homo sapiens
tatcagaacacatgttttgcag

SEQ ID NO: 6910808 - DNA, 22 bp, Homo sapiens
caacctctttgggccttggttt

SEQ ID NO: 6910809 - DNA, 22 bp, Homo sapiens
gattctttgacagggtgttggg

SEQ ID NO: 6910810 - DNA, 22 bp, Homo sapiens
atctttcagggccatttgtatt

SEQ ID NO: 6910811 - DNA, 22 bp, Homo sapiens
tgaacagttactttgtagaaga

SEQ ID NO: 6910812 - DNA, 22 bp, Homo sapiens
acctctcagggccttggtttcc

SEQ ID NO: 6910813 - DNA, 22 bp, Homo sapiens
ggtgacagccgcttggcgctag

SEQ ID NO: 6910814 - DNA, 22 bp, Homo sapiens
cagcccagaactcacgtctcca

SEQ ID NO: 6910815 - DNA, 22 bp, Homo sapiens
tagcagcacctttctaatctga

SEQ ID NO: 6910816 - DNA, 22 bp, Homo sapiens
tgaggccacttccccacagccc

SEQ ID NO: 6910817 - DNA, 22 bp, Homo sapiens
cctggctaggagagctgggctc

SEQ ID NO: 6910818 - DNA, 22 bp, Homo sapiens
agctatagctggatcttaagtg

SEQ ID NO: 6910819 - DNA, 22 bp, Homo sapiens
agtggcttccttcataagcttt

SEQ ID NO: 6910820 - DNA, 22 bp, Homo sapiens
agtggtgcaaactggggcagct

SEQ ID NO: 6910821 - DNA, 22 bp, Homo sapiens
acctacatgttccacatagttg

SEQ ID NO: 6910822 - DNA, 22 bp, Homo sapiens
ttctagtcctagaaactacatg

SEQ ID NO: 6910823 - DNA, 22 bp, Homo sapiens
aagactataccatcttagttac

SEQ ID NO: 6910824 - DNA, 22 bp, Homo sapiens
gctcctgtccttagccccagag

SEQ ID NO: 6910825 - DNA, 21 bp, Homo sapiens
attcatgcagatgtgggtgaa

SEQ ID NO: 6910826 - DNA, 19 bp, Homo sapiens
gtggcctcggagcgcgcgg

SEQ ID NO: 6910827 - DNA, 22 bp, Homo sapiens
taatggcattgattacatgaaa

SEQ ID NO: 6910828 - DNA, 22 bp, Homo sapiens
catgacatcctgaagctgcaca

SEQ ID NO: 6910829 - DNA, 22 bp, Homo sapiens
taaagccacttcattctagtct

SEQ ID NO: 6910830 - DNA, 22 bp, Homo sapiens
catttgatgactcaactcataa

SEQ ID NO: 6910831 - DNA, 22 bp, Homo sapiens
ttggttcattgcaggcgccggg

SEQ ID NO: 6910832 - DNA, 22 bp, Homo sapiens
tctggctgattccctgggactg

SEQ ID NO: 6910833 - DNA, 22 bp, Homo sapiens
tctgggaacacacgtcacttca

SEQ ID NO: 6910834 - DNA, 22 bp, Homo sapiens
ttccagttcagatgcaacaggg

SEQ ID NO: 6910835 - DNA, 22 bp, Homo sapiens
gaagcccagtgtcttcttttct

SEQ ID NO: 6910836 - DNA, 22 bp, Homo sapiens
agtaagatcttgaaatttaaga

SEQ ID NO: 6910837 - DNA, 22 bp, Homo sapiens
ccgggccgccccgcgtttctta

SEQ ID NO: 6910838 - DNA, 22 bp, Homo sapiens
ctggaatgtctgctcaatgttt

SEQ ID NO: 6910839 - DNA, 22 bp, Homo sapiens
aactgctgacaagtgaccagtg

SEQ ID NO: 6910840 - DNA, 22 bp, Homo sapiens
tgcctttaaccagtctagacag

SEQ ID NO: 6910841 - DNA, 22 bp, Homo sapiens
aggcaggaaccctgtgtgcgcc

SEQ ID NO: 6910842 - DNA, 22 bp, Homo sapiens
tttgaagacatttgaatacttt

SEQ ID NO: 6910843 - DNA, 23 bp, Homo sapiens
gggtttccttctggctcctcctt

SEQ ID NO: 6910844 - DNA, 22 bp, Homo sapiens
cagagacagggcagggagtgtg

SEQ ID NO: 6910845 - DNA, 22 bp, Homo sapiens
ctgtataacatcttttgtttcc

SEQ ID NO: 6910846 - DNA, 22 bp, Homo sapiens
tgaaacttgctaattgcacgta

SEQ ID NO: 6910847 - DNA, 22 bp, Homo sapiens
agtatctatttcacatatggtt

SEQ ID NO: 6910848 - DNA, 22 bp, Homo sapiens
cagggggtgcaggccctgtgac

SEQ ID NO: 6910849 - DNA, 22 bp, Homo sapiens
tggctttgaaatccagtcatta

SEQ ID NO: 6910850 - DNA, 22 bp, Homo sapiens
gcgcgctctctccagcctcccc

SEQ ID NO: 6910851 - DNA, 17 bp, Homo sapiens
ttacagcagcaatagag

SEQ ID NO: 6910852 - DNA, 22 bp, Homo sapiens
actggctttgggttgccgcaga

SEQ ID NO: 6910853 - DNA, 22 bp, Homo sapiens
gagctagagtttgtagggtaga

SEQ ID NO: 6910854 - DNA, 15 bp, Homo sapiens
ctctggtttttcttc

SEQ ID NO: 6910855 - DNA, 22 bp, Homo sapiens
ggagaggttatccgtgttatgt

SEQ ID NO: 6910856 - DNA, 22 bp, Homo sapiens
cctccccacagcccaggagact

SEQ ID NO: 6910857 - DNA, 20 bp, Homo sapiens
acaatacaggttgtgtctga

SEQ ID NO: 6910858 - DNA, 22 bp, Homo sapiens
gaaaggagtgaatatttgtgac

SEQ ID NO: 6910859 - DNA, 22 bp, Homo sapiens
acttctcttcataggtggcaat

SEQ ID NO: 6910860 - DNA, 18 bp, Homo sapiens
gagccctgagtctgcaca

SEQ ID NO: 6910861 - DNA, 19 bp, Homo sapiens
gcaggcttgggtctcccca

SEQ ID NO: 6910862 - DNA, 22 bp, Homo sapiens
acatttcgtgctctgttttgtt

SEQ ID NO: 6910863 - DNA, 22 bp, Homo sapiens
tggaatcacctgttggtttgca

SEQ ID NO: 6910864 - DNA, 20 bp, Homo sapiens
tattccaagggtagagaaaa

SEQ ID NO: 6910865 - DNA, 22 bp, Homo sapiens
agtcctggcatataggtcctca

SEQ ID NO: 6910866 - DNA, 22 bp, Homo sapiens
tggtacaagatgttctaactga

SEQ ID NO: 6910867 - DNA, 17 bp, Homo sapiens
tgcttaattttgactgg

SEQ ID NO: 6910868 - DNA, 21 bp, Homo sapiens
agaataatggtatcatttgct

SEQ ID NO: 6910869 - DNA, 22 bp, Homo sapiens
agatactaagcatttccagcac

SEQ ID NO: 6910870 - DNA, 22 bp, Homo sapiens
ctgtgctgaacaattctgcatt

SEQ ID NO: 6910871 - DNA, 22 bp, Homo sapiens
gacttctcccaaccatcagagg

SEQ ID NO: 6910872 - DNA, 22 bp, Homo sapiens
tctaaacacgtctctttgaata

SEQ ID NO: 6910873 - DNA, 22 bp, Homo sapiens
cagtttctgggcgttcacaggt

SEQ ID NO: 6910874 - DNA, 22 bp, Homo sapiens
ttcgggcatgtgtgctgtgaaa

SEQ ID NO: 6910875 - DNA, 22 bp, Homo sapiens
tgctgcagtcacacggctatct

SEQ ID NO: 6910876 - DNA, 23 bp, Homo sapiens
ccagtggcgtaaactagaggata

SEQ ID NO: 6910877 - DNA, 22 bp, Homo sapiens
cagcaagacagtttcctaagtg

SEQ ID NO: 6910878 - DNA, 22 bp, Homo sapiens
tggaccagctcctcgggagacg

SEQ ID NO: 6910879 - DNA, 22 bp, Homo sapiens
tattccagtatgtctggtgtcc

SEQ ID NO: 6910880 - DNA, 22 bp, Homo sapiens
tccagctgctagctagatgcaa

SEQ ID NO: 6910881 - DNA, 22 bp, Homo sapiens
tctgttagagaggtagttcttg

SEQ ID NO: 6910882 - DNA, 22 bp, Homo sapiens
tcccaagccctggatgcctcag

SEQ ID NO: 6910883 - DNA, 22 bp, Homo sapiens
ggtcacgtgaccgcacctgcct

SEQ ID NO: 6910884 - DNA, 22 bp, Homo sapiens
gtgccctggtccccagcatata

SEQ ID NO: 6910885 - DNA, 22 bp, Homo sapiens
gaggagcccccactgggctcac

SEQ ID NO: 6910886 - DNA, 22 bp, Homo sapiens
agtttacagttctcatcgcaac

SEQ ID NO: 6910887 - DNA, 22 bp, Homo sapiens
ggtacatcattaattgcatgtt

SEQ ID NO: 6910888 - DNA, 22 bp, Homo sapiens
tcaagcaattctcctgcctcag

SEQ ID NO: 6910889 - DNA, 22 bp, Homo sapiens
tcttccttaaatgtttggtaga

SEQ ID NO: 6910890 - DNA, 22 bp, Homo sapiens
ttcctcagcacaaagccaagat

SEQ ID NO: 6910891 - DNA, 22 bp, Homo sapiens
agatgctgattgaatagatttc

SEQ ID NO: 6910892 - DNA, 22 bp, Homo sapiens
tttgggaaataaacctagagga

SEQ ID NO: 6910893 - DNA, 22 bp, Homo sapiens
tagctgtgacgtatctctatgg

SEQ ID NO: 6910894 - DNA, 22 bp, Homo sapiens
gtatacagatacttagacgtgc

SEQ ID NO: 6910895 - DNA, 22 bp, Homo sapiens
atctacagtgcacaggacagcc

SEQ ID NO: 6910896 - DNA, 23 bp, Homo sapiens
caacttttggctacatgcttagc

SEQ ID NO: 6910897 - DNA, 22 bp, Homo sapiens
gggatcagttaaggagagtttt

SEQ ID NO: 6910898 - DNA, 22 bp, Homo sapiens
tattgatgcagagccaaattgc

SEQ ID NO: 6910899 - DNA, 22 bp, Homo sapiens
ttggctgcattttgggttcgtt

SEQ ID NO: 6910900 - DNA, 22 bp, Homo sapiens
gtggatggccctgcacacaggt

SEQ ID NO: 6910901 - DNA, 22 bp, Homo sapiens
gcttggctgtgagctttgctgt

SEQ ID NO: 6910902 - DNA, 22 bp, Homo sapiens
tcctgtgttacccttgcagtga

SEQ ID NO: 6910903 - DNA, 22 bp, Homo sapiens
cagcatctggatttcctccact

SEQ ID NO: 6910904 - DNA, 22 bp, Homo sapiens
caaatgtaatggcaggttttgc

SEQ ID NO: 6910905 - DNA, 21 bp, Homo sapiens
agctgccaccctagcttctga

SEQ ID NO: 6910906 - DNA, 22 bp, Homo sapiens
cagctgttgtgatccatttacg

SEQ ID NO: 6910907 - DNA, 22 bp, Homo sapiens
gaacatttggatttgtaaattt

SEQ ID NO: 6910908 - DNA, 18 bp, Homo sapiens
cagctcttctccagtaac

SEQ ID NO: 6910909 - DNA, 22 bp, Homo sapiens
aggaagctctctgcttttaaga

SEQ ID NO: 6910910 - DNA, 22 bp, Homo sapiens
tgaggcagatatttattgggtt

SEQ ID NO: 6910911 - DNA, 22 bp, Homo sapiens
cattgagagtgacttggacaat

SEQ ID NO: 6910912 - DNA, 22 bp, Homo sapiens
ttggcttcttttctagacagaa

SEQ ID NO: 6910913 - DNA, 22 bp, Homo sapiens
tctttatctggctcagagacac

SEQ ID NO: 6910914 - DNA, 22 bp, Homo sapiens
cttcagtatcctccacatgtta

SEQ ID NO: 6910915 - DNA, 22 bp, Homo sapiens
ttgccagggtcaggatgagatc

SEQ ID NO: 6910916 - DNA, 22 bp, Homo sapiens
tctcttgatgttcccagacagc

SEQ ID NO: 6910917 - DNA, 22 bp, Homo sapiens
gctctgtatcttacaacagggt

SEQ ID NO: 6910918 - DNA, 22 bp, Homo sapiens
tgagtgaattcaagtaaagggc

SEQ ID NO: 6910919 - DNA, 22 bp, Homo sapiens
gtgtgcgcgctcataggtgtgt

SEQ ID NO: 6910920 - DNA, 21 bp, Homo sapiens
aggctgctctttcttgtggta

SEQ ID NO: 6910921 - DNA, 22 bp, Homo sapiens
taatgttacactgcatggttca

SEQ ID NO: 6910922 - DNA, 22 bp, Homo sapiens
atggctccatcctgttgctagt

SEQ ID NO: 6910923 - DNA, 22 bp, Homo sapiens
aatccctccccaggcaagtcct

SEQ ID NO: 6910924 - DNA, 22 bp, Homo sapiens
tgtggcattgaataaccttgga

SEQ ID NO: 6910925 - DNA, 22 bp, Homo sapiens
tcttgtcatgcccttggtaact

SEQ ID NO: 6910926 - DNA, 22 bp, Homo sapiens
tcctaattgcttcatgtgttgt

SEQ ID NO: 6910927 - DNA, 22 bp, Homo sapiens
tgaggccttagtaaccctgcac

SEQ ID NO: 6910928 - DNA, 22 bp, Homo sapiens
caggagccagaggcggatggag

SEQ ID NO: 6910929 - DNA, 22 bp, Homo sapiens
tgtcattgttctgtttgttcct

SEQ ID NO: 6910930 - DNA, 22 bp, Homo sapiens
atgcaagaaacagagacgctga

SEQ ID NO: 6910931 - DNA, 22 bp, Homo sapiens
ctcccaggggagtcatctgctt

SEQ ID NO: 6910932 - DNA, 22 bp, Homo sapiens
agctgcatttcagctgtgacct

SEQ ID NO: 6910933 - DNA, 22 bp, Homo sapiens
tgagcagagttgtttctcctga

SEQ ID NO: 6910934 - DNA, 22 bp, Homo sapiens
aaacatgatattgaggctgggc

SEQ ID NO: 6910935 - DNA, 22 bp, Homo sapiens
ttatccactttagtttcagtat

SEQ ID NO: 6910936 - DNA, 22 bp, Homo sapiens
ctaactttgtcatcttcccttt

SEQ ID NO: 6910937 - DNA, 22 bp, Homo sapiens
agtgacagggaaaatgacactg

SEQ ID NO: 6910938 - DNA, 22 bp, Homo sapiens
ccagggaggagcatttcatggt

SEQ ID NO: 6910939 - DNA, 22 bp, Homo sapiens
cttaagaagcaagtctcagcaa

SEQ ID NO: 6910940 - DNA, 20 bp, Homo sapiens
tctaaccacctagccctgat

SEQ ID NO: 6910941 - DNA, 18 bp, Homo sapiens
tagcaaagatgtggattg

SEQ ID NO: 6910942 - DNA, 22 bp, Homo sapiens
tgatgaggacccatcacctggt

SEQ ID NO: 6910943 - DNA, 22 bp, Homo sapiens
gtgggcaggccctaggcgattt

SEQ ID NO: 6910944 - DNA, 22 bp, Homo sapiens
ctctccaggcgaggtcctactg

SEQ ID NO: 6910945 - DNA, 22 bp, Homo sapiens
agtcagagaatgttttcatgga

SEQ ID NO: 6910946 - DNA, 22 bp, Homo sapiens
gaagaacgtcttataaattcac

SEQ ID NO: 6910947 - DNA, 19 bp, Homo sapiens
ggtgtgccaaatgggaatg

SEQ ID NO: 6910948 - DNA, 22 bp, Homo sapiens
tgcatggttatatactactagt

SEQ ID NO: 6910949 - DNA, 22 bp, Homo sapiens
acccatttgtccagcaaagata

SEQ ID NO: 6910950 - DNA, 22 bp, Homo sapiens
gggagactagtgctatgttttc

SEQ ID NO: 6910951 - DNA, 22 bp, Homo sapiens
ttacagtgttacttgatgtcca

SEQ ID NO: 6910952 - DNA, 22 bp, Homo sapiens
agtgacaacatcaattggggct

SEQ ID NO: 6910953 - DNA, 22 bp, Homo sapiens
cacccaggacaaaatatggaat

SEQ ID NO: 6910954 - DNA, 22 bp, Homo sapiens
aacagctattcactactatggg

SEQ ID NO: 6910955 - DNA, 22 bp, Homo sapiens
gaaggacccacgaagtcactgg

SEQ ID NO: 6910956 - DNA, 22 bp, Homo sapiens
catcagtcagtctcttcagtat

SEQ ID NO: 6910957 - DNA, 20 bp, Homo sapiens
agatggtgggctggaacacc

SEQ ID NO: 6910958 - DNA, 22 bp, Homo sapiens
tacttggattaataatttgttt

SEQ ID NO: 6910959 - DNA, 22 bp, Homo sapiens
tgtgccaagactatattgtgct

SEQ ID NO: 6910960 - DNA, 22 bp, Homo sapiens
ctctggctgtttgcagctcaag

SEQ ID NO: 6910961 - DNA, 22 bp, Homo sapiens
agatcaaggacatgaagaggct

SEQ ID NO: 6910962 - DNA, 19 bp, Homo sapiens
tctgaatgggatgagttgg

SEQ ID NO: 6910963 - DNA, 22 bp, Homo sapiens
tgagcttatacatgtgaagtca

SEQ ID NO: 6910964 - DNA, 22 bp, Homo sapiens
tacaccagcttgcctgggctct

SEQ ID NO: 6910965 - DNA, 22 bp, Homo sapiens
ctgtgggctgaaagtgctcccg

SEQ ID NO: 6910966 - DNA, 22 bp, Homo sapiens
ggcctgtgtcctccttgccctg

SEQ ID NO: 6910967 - DNA, 22 bp, Homo sapiens
tgagaacagttggaagcagtca

SEQ ID NO: 6910968 - DNA, 22 bp, Homo sapiens
gcacattgttactcttactgtg

SEQ ID NO: 6910969 - DNA, 22 bp, Homo sapiens
gacaagttgtggagaagagggt

SEQ ID NO: 6910970 - DNA, 23 bp, Homo sapiens
tcctgtgaagccatgtttgttgt

SEQ ID NO: 6910971 - DNA, 22 bp, Homo sapiens
agtttccaaaaggagacaggga

SEQ ID NO: 6910972 - DNA, 23 bp, Homo sapiens
atagaccattgtctcacacttca

SEQ ID NO: 6910973 - DNA, 22 bp, Homo sapiens
aatgccattttaggcatgtcct

SEQ ID NO: 6910974 - DNA, 22 bp, Homo sapiens
actgttaaagtaattaattgtc

SEQ ID NO: 6910975 - DNA, 22 bp, Homo sapiens
tccttctgaaaaatgcacacga

SEQ ID NO: 6910976 - DNA, 22 bp, Homo sapiens
cctcagagaaatgtctattcaa

SEQ ID NO: 6910977 - DNA, 22 bp, Homo sapiens
cagggtcaggctgctagaagct

SEQ ID NO: 6910978 - DNA, 17 bp, Homo sapiens
ggagacagggtctttaa

SEQ ID NO: 6910979 - DNA, 22 bp, Homo sapiens
ctgtctggaatttaagataaag

SEQ ID NO: 6910980 - DNA, 22 bp, Homo sapiens
aggaggcccctcctgggttgct

SEQ ID NO: 6910981 - DNA, 22 bp, Homo sapiens
acttgtgtaacacagaaagaac

SEQ ID NO: 6910982 - DNA, 22 bp, Homo sapiens
agtggcgtcctaggaaaggagg

SEQ ID NO: 6910983 - DNA, 22 bp, Homo sapiens
cttgatgatgacgtcggtgatg

SEQ ID NO: 6910984 - DNA, 23 bp, Homo sapiens
tccagtgtgtgcagattaagtgc

SEQ ID NO: 6910985 - DNA, 22 bp, Homo sapiens
gtgttcttgccaaggccaacat

SEQ ID NO: 6910986 - DNA, 22 bp, Homo sapiens
acagtccagcctagtatgtata

SEQ ID NO: 6910987 - DNA, 22 bp, Homo sapiens
agggtcctgggtgcagttgctt

SEQ ID NO: 6910988 - DNA, 22 bp, Homo sapiens
aacagcagggatgacatggcca

SEQ ID NO: 6910989 - DNA, 22 bp, Homo sapiens
gtctctgggttaagcagtgcat

SEQ ID NO: 6910990 - DNA, 22 bp, Homo sapiens
attgacaagtgagctgggctgc

SEQ ID NO: 6910991 - DNA, 19 bp, Homo sapiens
tctctggcagttcagagca

SEQ ID NO: 6910992 - DNA, 22 bp, Homo sapiens
gactgcttttctagtctaaaat

SEQ ID NO: 6910993 - DNA, 22 bp, Homo sapiens
cctatgtttaactttttgagga

SEQ ID NO: 6910994 - DNA, 23 bp, Homo sapiens
ctgcatatggaggttagcaactc

SEQ ID NO: 6910995 - DNA, 23 bp, Homo sapiens
gtcagtgctttagttcaggatgg

SEQ ID NO: 6910996 - DNA, 22 bp, Homo sapiens
agaatcagatgaagactcctgc

SEQ ID NO: 6910997 - DNA, 22 bp, Homo sapiens
ttaacaaaaatatcaggcatca

SEQ ID NO: 6910998 - DNA, 22 bp, Homo sapiens
aacaagatgttttgatatatgt

SEQ ID NO: 6910999 - DNA, 22 bp, Homo sapiens
tcagataccattgaatttgttg

SEQ ID NO: 6911000 - DNA, 22 bp, Homo sapiens
agcagtctggaacaagatatga

SEQ ID NO: 6911001 - DNA, 22 bp, Homo sapiens
agtgacacacctgttagcattg

SEQ ID NO: 6911002 - DNA, 22 bp, Homo sapiens
agcagcatattgtgtcttcata

SEQ ID NO: 6911003 - DNA, 22 bp, Homo sapiens
tgaagattttgtagctttcagc

SEQ ID NO: 6911004 - DNA, 22 bp, Homo sapiens
caccctcaagcagtggcacgtg

SEQ ID NO: 6911005 - DNA, 21 bp, Homo sapiens
ggccagtggccttgactttcc

SEQ ID NO: 6911006 - DNA, 22 bp, Homo sapiens
taacctgctgtgctggtcagtc

SEQ ID NO: 6911007 - DNA, 22 bp, Homo sapiens
ctgtggctttgtgtctattgta

SEQ ID NO: 6911008 - DNA, 22 bp, Homo sapiens
ttaatcacagatattaaacatg

SEQ ID NO: 6911009 - DNA, 20 bp, Homo sapiens
gagtatatttcttcctttgc

SEQ ID NO: 6911010 - DNA, 22 bp, Homo sapiens
cctcaggaaccacattgctgct

SEQ ID NO: 6911011 - DNA, 22 bp, Homo sapiens
gagaggttcctccctgctttac

SEQ ID NO: 6911012 - DNA, 22 bp, Homo sapiens
ctcctggttcctgtcttaaata

SEQ ID NO: 6911013 - DNA, 22 bp, Homo sapiens
aaatcagttcacgttctgaggt

SEQ ID NO: 6911014 - DNA, 22 bp, Homo sapiens
gggccgtagaccacgtccgggc

SEQ ID NO: 6911015 - DNA, 22 bp, Homo sapiens
gaagccctaatacacagtacct

SEQ ID NO: 6911016 - DNA, 22 bp, Homo sapiens
tctatttaccaaatgtagttcc

SEQ ID NO: 6911017 - DNA, 22 bp, Homo sapiens
gtgcactttgggagtctcagtg

SEQ ID NO: 6911018 - DNA, 22 bp, Homo sapiens
acctttatgattcacaatgtat

SEQ ID NO: 6911019 - DNA, 22 bp, Homo sapiens
gtggctcagttaacttccatgt

SEQ ID NO: 6911020 - DNA, 22 bp, Homo sapiens
tcacattgccattagttcagtt

SEQ ID NO: 6911021 - DNA, 22 bp, Homo sapiens
taactgttgtgcgggtctctgg

SEQ ID NO: 6911022 - DNA, 22 bp, Homo sapiens
tgtggatgaataaagtgcagac

SEQ ID NO: 6911023 - DNA, 23 bp, Homo sapiens
tggctcagggtctcttatgaagt

SEQ ID NO: 6911024 - DNA, 22 bp, Homo sapiens
agttaaagaaagataattcgcc

SEQ ID NO: 6911025 - DNA, 22 bp, Homo sapiens
ttcatatttgaaacagaagtta

SEQ ID NO: 6911026 - DNA, 20 bp, Homo sapiens
aggcttgtgaagtatggcac

SEQ ID NO: 6911027 - DNA, 22 bp, Homo sapiens
gagcttggggcatatggtgcta

SEQ ID NO: 6911028 - DNA, 22 bp, Homo sapiens
atgtatgcatagtgagtaaatg

SEQ ID NO: 6911029 - DNA, 22 bp, Homo sapiens
atggtcagggcaccctggcccc

SEQ ID NO: 6911030 - DNA, 22 bp, Homo sapiens
aagcccttttcaagatacaaca

SEQ ID NO: 6911031 - DNA, 22 bp, Homo sapiens
ttcatggatcatgccttttgtg

SEQ ID NO: 6911032 - DNA, 22 bp, Homo sapiens
gagatgatctctttcagctctg

SEQ ID NO: 6911033 - DNA, 22 bp, Homo sapiens
ggacttctggggactgtagatt

SEQ ID NO: 6911034 - DNA, 22 bp, Homo sapiens
gagaagttcattactctgccca

SEQ ID NO: 6911035 - DNA, 22 bp, Homo sapiens
tcacagtactccccaaagtttc

SEQ ID NO: 6911036 - DNA, 20 bp, Homo sapiens
ctttgcaggagaacagagaa

SEQ ID NO: 6911037 - DNA, 20 bp, Homo sapiens
gaggagtcttgtagaaaatg

SEQ ID NO: 6911038 - DNA, 22 bp, Homo sapiens
tgctgaggacacctagccttct

SEQ ID NO: 6911039 - DNA, 22 bp, Homo sapiens
tttctgatttgacttgaagtat

SEQ ID NO: 6911040 - DNA, 22 bp, Homo sapiens
tagcatctcaacctcctgaaag

SEQ ID NO: 6911041 - DNA, 22 bp, Homo sapiens
ttaggtattttgttatgtcagc

SEQ ID NO: 6911042 - DNA, 22 bp, Homo sapiens
agagaatttgagacttgcccaa

SEQ ID NO: 6911043 - DNA, 22 bp, Homo sapiens
tcccatttcttgcatccttgct

SEQ ID NO: 6911044 - DNA, 22 bp, Homo sapiens
gaggtacatgaggatacacagg

SEQ ID NO: 6911045 - DNA, 22 bp, Homo sapiens
agctacaaatgtatgtgctgat

SEQ ID NO: 6911046 - DNA, 22 bp, Homo sapiens
ctcatttactactcatgtgacc

SEQ ID NO: 6911047 - DNA, 22 bp, Homo sapiens
gggctctctttttggcctgccc

SEQ ID NO: 6911048 - DNA, 22 bp, Homo sapiens
attgtgcaccaccttgtggcag

SEQ ID NO: 6911049 - DNA, 22 bp, Homo sapiens
acacaggaagtcagcactgatg

SEQ ID NO: 6911050 - DNA, 22 bp, Homo sapiens
acatacatgtaaaggaaattat

SEQ ID NO: 6911051 - DNA, 22 bp, Homo sapiens
caggaagcacagtgaggagacc

SEQ ID NO: 6911052 - DNA, 22 bp, Homo sapiens
gtcttcttttcagtctgcttgt

SEQ ID NO: 6911053 - DNA, 22 bp, Homo sapiens
cattagattggtgcaaaaataa

SEQ ID NO: 6911054 - DNA, 22 bp, Homo sapiens
actcacttcttttactataaaa

SEQ ID NO: 6911055 - DNA, 21 bp, Homo sapiens
tgcctgcattctatcagacca

SEQ ID NO: 6911056 - DNA, 22 bp, Homo sapiens
ttttgcagaatgggaaggtagt

SEQ ID NO: 6911057 - DNA, 22 bp, Homo sapiens
agtgtgagccctggagtggtgc

SEQ ID NO: 6911058 - DNA, 19 bp, Homo sapiens
gaggggaggaattgacaag

SEQ ID NO: 6911059 - DNA, 22 bp, Homo sapiens
tctctgaagctgttgtagtctc

SEQ ID NO: 6911060 - DNA, 20 bp, Homo sapiens
ctctgcccccagactgacag

SEQ ID NO: 6911061 - DNA, 22 bp, Homo sapiens
gattagaaatgttaccatacag

SEQ ID NO: 6911062 - DNA, 22 bp, Homo sapiens
tttctataaaaagtgctaggat

SEQ ID NO: 6911063 - DNA, 22 bp, Homo sapiens
cctgaggacagtgtgaccatgg

SEQ ID NO: 6911064 - DNA, 22 bp, Homo sapiens
gccctggcctcctggaacaggc

SEQ ID NO: 6911065 - DNA, 22 bp, Homo sapiens
tagatacaggctctctgagcct

SEQ ID NO: 6911066 - DNA, 22 bp, Homo sapiens
gtagtcttggattttaaaaagt

SEQ ID NO: 6911067 - DNA, 21 bp, Homo sapiens
tcagtggctcctggtgacgtc

SEQ ID NO: 6911068 - DNA, 22 bp, Homo sapiens
gggcagcagaggatcccttaat

SEQ ID NO: 6911069 - DNA, 22 bp, Homo sapiens
gagacactcaacaaagatatga

SEQ ID NO: 6911070 - DNA, 22 bp, Homo sapiens
gcttttcctgactttccattag

SEQ ID NO: 6911071 - DNA, 22 bp, Homo sapiens
catggcttaccccaggagcagc

SEQ ID NO: 6911072 - DNA, 22 bp, Homo sapiens
agtggcttatctgggacagcta

SEQ ID NO: 6911073 - DNA, 22 bp, Homo sapiens
gctgattttgtcacatagcaag

SEQ ID NO: 6911074 - DNA, 22 bp, Homo sapiens
tgtcttatgctgcatagactat

SEQ ID NO: 6911075 - DNA, 22 bp, Homo sapiens
ctggctggtcatgtcatgagcc

SEQ ID NO: 6911076 - DNA, 22 bp, Homo sapiens
caggtgttgatgtttattgagt

SEQ ID NO: 6911077 - DNA, 22 bp, Homo sapiens
tttcaaaggttttgtcatgtct

SEQ ID NO: 6911078 - DNA, 22 bp, Homo sapiens
aagtttattaattgacttgtgc

SEQ ID NO: 6911079 - DNA, 22 bp, Homo sapiens
tactttctagctctccccagtt

SEQ ID NO: 6911080 - DNA, 22 bp, Homo sapiens
tgcagaaagtcacattcccttt

SEQ ID NO: 6911081 - DNA, 22 bp, Homo sapiens
tccctggcacaagaaggctgtc

SEQ ID NO: 6911082 - DNA, 22 bp, Homo sapiens
cctggtgagctgggtgcacggc

SEQ ID NO: 6911083 - DNA, 22 bp, Homo sapiens
caggagtgtcgggtcactaggt

SEQ ID NO: 6911084 - DNA, 18 bp, Homo sapiens
tgctggcaactactattg

SEQ ID NO: 6911085 - DNA, 22 bp, Homo sapiens
attttcaaaacatctgctgtgt

SEQ ID NO: 6911086 - DNA, 22 bp, Homo sapiens
aagtggtaggaagagagcactg

SEQ ID NO: 6911087 - DNA, 22 bp, Homo sapiens
tgtttttttatatacctgaagt

SEQ ID NO: 6911088 - DNA, 22 bp, Homo sapiens
aagggctgctgtagaagcagag

SEQ ID NO: 6911089 - DNA, 22 bp, Homo sapiens
gctggagatgctatgcagaggg

SEQ ID NO: 6911090 - DNA, 22 bp, Homo sapiens
aagccagggatggaatgatagg

SEQ ID NO: 6911091 - DNA, 22 bp, Homo sapiens
atctccgccatcgcgaacgcct

SEQ ID NO: 6911092 - DNA, 22 bp, Homo sapiens
gcaggccttggcaatgagcctg

SEQ ID NO: 6911093 - DNA, 22 bp, Homo sapiens
ttaggaaagtctcttggctggg

SEQ ID NO: 6911094 - DNA, 23 bp, Homo sapiens
gtggattccacaggagctgcccc

SEQ ID NO: 6911095 - DNA, 22 bp, Homo sapiens
atgcacaacagacgaatggaag

SEQ ID NO: 6911096 - DNA, 22 bp, Homo sapiens
gctggctgtgattttgccaaca

SEQ ID NO: 6911097 - DNA, 18 bp, Homo sapiens
gcacttcacccagctagt

SEQ ID NO: 6911098 - DNA, 22 bp, Homo sapiens
atctggctcattcagggaacgg

SEQ ID NO: 6911099 - DNA, 22 bp, Homo sapiens
gtccttcagctttatctgaaca

SEQ ID NO: 6911100 - DNA, 22 bp, Homo sapiens
tttaaatgtgttcttagtagct

SEQ ID NO: 6911101 - DNA, 22 bp, Homo sapiens
atcatccaagcgtagttcttct

SEQ ID NO: 6911102 - DNA, 22 bp, Homo sapiens
gtgaaggattggagggcatctt

SEQ ID NO: 6911103 - DNA, 22 bp, Homo sapiens
ccttctggagggtgtacgagag

SEQ ID NO: 6911104 - DNA, 22 bp, Homo sapiens
ttcttgggtgtgaccagtctga

SEQ ID NO: 6911105 - DNA, 22 bp, Homo sapiens
tgaaatcatgaacaaggtaggt

SEQ ID NO: 6911106 - DNA, 22 bp, Homo sapiens
agaacgaatgcttcagctctag

SEQ ID NO: 6911107 - DNA, 22 bp, Homo sapiens
tctgagaagtcctgtatttcta

SEQ ID NO: 6911108 - DNA, 22 bp, Homo sapiens
tcagaggccaaactgagcaggg

SEQ ID NO: 6911109 - DNA, 22 bp, Homo sapiens
gcctgtttccctgacgcttaca

SEQ ID NO: 6911110 - DNA, 22 bp, Homo sapiens
caaggaggaagatgcaggggac

SEQ ID NO: 6911111 - DNA, 22 bp, Homo sapiens
tgcagcattagtacaagtctca

SEQ ID NO: 6911112 - DNA, 17 bp, Homo sapiens
cagccctgccgttccca

SEQ ID NO: 6911113 - DNA, 22 bp, Homo sapiens
ctggaagactcaatggcctgcc

SEQ ID NO: 6911114 - DNA, 22 bp, Homo sapiens
caaatgcagattcaggagttct

SEQ ID NO: 6911115 - DNA, 22 bp, Homo sapiens
ataaagttctgctggcatatat

SEQ ID NO: 6911116 - DNA, 22 bp, Homo sapiens
cactaggagacaaggcaaacca

SEQ ID NO: 6911117 - DNA, 22 bp, Homo sapiens
cgagaaatgagaaacccatttt

SEQ ID NO: 6911118 - DNA, 22 bp, Homo sapiens
tcccagtgctgctaaagaggta

SEQ ID NO: 6911119 - DNA, 22 bp, Homo sapiens
tatccagggagttttagggctt

SEQ ID NO: 6911120 - DNA, 22 bp, Homo sapiens
aaggccttctaccaaggctggg

SEQ ID NO: 6911121 - DNA, 22 bp, Homo sapiens
ttgtgaatgcttaatatgtttc

SEQ ID NO: 6911122 - DNA, 22 bp, Homo sapiens
acttccaacttcagtcctgagc

SEQ ID NO: 6911123 - DNA, 22 bp, Homo sapiens
agagtgctttctgtttcctgta

SEQ ID NO: 6911124 - DNA, 22 bp, Homo sapiens
atctgttcttcaaaatattaca

SEQ ID NO: 6911125 - DNA, 22 bp, Homo sapiens
ggacaaagcctggtggcaggtg

SEQ ID NO: 6911126 - DNA, 22 bp, Homo sapiens
attcaaaccccatagacaactt

SEQ ID NO: 6911127 - DNA, 23 bp, Homo sapiens
ctggggctttcaaatctgggcag

SEQ ID NO: 6911128 - DNA, 22 bp, Homo sapiens
aagaacttgggctgagtgaaag

SEQ ID NO: 6911129 - DNA, 22 bp, Homo sapiens
taaagcaggtgctcagtgacca

SEQ ID NO: 6911130 - DNA, 22 bp, Homo sapiens
taaagggtaggttttactgtaa

SEQ ID NO: 6911131 - DNA, 18 bp, Homo sapiens
taagtcatttgaaatgcc

SEQ ID NO: 6911132 - DNA, 22 bp, Homo sapiens
taaacaagctggactgataagt

SEQ ID NO: 6911133 - DNA, 22 bp, Homo sapiens
ttttcctctgagctttgaataa

SEQ ID NO: 6911134 - DNA, 22 bp, Homo sapiens
cagtgcatgaaacaatatgcag

SEQ ID NO: 6911135 - DNA, 22 bp, Homo sapiens
cattaataaacatttcagaaga

SEQ ID NO: 6911136 - DNA, 22 bp, Homo sapiens
caggcctggagtgcaatggcac

SEQ ID NO: 6911137 - DNA, 22 bp, Homo sapiens
cagtaataaagctaagtatttc

SEQ ID NO: 6911138 - DNA, 22 bp, Homo sapiens
tattagggaactgcaagactaa

SEQ ID NO: 6911139 - DNA, 20 bp, Homo sapiens
ctgtttgctatcatgagctg

SEQ ID NO: 6911140 - DNA, 15 bp, Homo sapiens
gagcaggaaacttgg

SEQ ID NO: 6911141 - DNA, 22 bp, Homo sapiens
tcaggaggcggaggttgcagtg

SEQ ID NO: 6911142 - DNA, 22 bp, Homo sapiens
taatgccacggcagggaacagc

SEQ ID NO: 6911143 - DNA, 22 bp, Homo sapiens
agactccaaatgaaagaggggg

SEQ ID NO: 6911144 - DNA, 22 bp, Homo sapiens
gtgctgaactataaaaagcttt

SEQ ID NO: 6911145 - DNA, 22 bp, Homo sapiens
ttcacaggtgactggggataac

SEQ ID NO: 6911146 - DNA, 22 bp, Homo sapiens
tgcaagaggttggattttaaga

SEQ ID NO: 6911147 - DNA, 22 bp, Homo sapiens
tgtctccatagagtagcttgat

SEQ ID NO: 6911148 - DNA, 22 bp, Homo sapiens
gtgcctctgaccggagaccagg

SEQ ID NO: 6911149 - DNA, 20 bp, Homo sapiens
tcctgctgaccttcacaagc

SEQ ID NO: 6911150 - DNA, 22 bp, Homo sapiens
tggtggcagcaggagggcccct

SEQ ID NO: 6911151 - DNA, 23 bp, Homo sapiens
actctgtaggctgtccatgtgca

SEQ ID NO: 6911152 - DNA, 22 bp, Homo sapiens
tgaagaaacagaccaagaggat

SEQ ID NO: 6911153 - DNA, 22 bp, Homo sapiens
gagcaagattttataagttgtg

SEQ ID NO: 6911154 - DNA, 22 bp, Homo sapiens
ctctgtttttcaatagttcttg

SEQ ID NO: 6911155 - DNA, 22 bp, Homo sapiens
caagttgtgaatgacagacttc

SEQ ID NO: 6911156 - DNA, 22 bp, Homo sapiens
ttatgacatatgagtacaagta

SEQ ID NO: 6911157 - DNA, 22 bp, Homo sapiens
tggaagtgcttgccgactgaca

SEQ ID NO: 6911158 - DNA, 22 bp, Homo sapiens
aagctggacattgtagggggga

SEQ ID NO: 6911159 - DNA, 22 bp, Homo sapiens
gatgattgttgctgcccaatga

SEQ ID NO: 6911160 - DNA, 22 bp, Homo sapiens
taatttaatttcatgccagcct

SEQ ID NO: 6911161 - DNA, 22 bp, Homo sapiens
aggcccagactcagcggggcgg

SEQ ID NO: 6911162 - DNA, 22 bp, Homo sapiens
tgtgtctcatttcctcctgctg

SEQ ID NO: 6911163 - DNA, 22 bp, Homo sapiens
tgaacacaaatattttggggtt

SEQ ID NO: 6911164 - DNA, 22 bp, Homo sapiens
aagcaggcattccagagacaat

SEQ ID NO: 6911165 - DNA, 22 bp, Homo sapiens
agtatgcaaattatttcattgt

SEQ ID NO: 6911166 - DNA, 22 bp, Homo sapiens
gtttgaaatgtctgcaagggaa

SEQ ID NO: 6911167 - DNA, 22 bp, Homo sapiens
acaagtttttgatagactagaa

SEQ ID NO: 6911168 - DNA, 20 bp, Homo sapiens
ggcagcgggttcgggcgcag

SEQ ID NO: 6911169 - DNA, 22 bp, Homo sapiens
attaacagtttatgatgtgcct

SEQ ID NO: 6911170 - DNA, 22 bp, Homo sapiens
gaaatatttctcttgagcccct

SEQ ID NO: 6911171 - DNA, 22 bp, Homo sapiens
aagtatttggaatggcattttt

SEQ ID NO: 6911172 - DNA, 22 bp, Homo sapiens
tgcctgggttcccaccccaaag

SEQ ID NO: 6911173 - DNA, 23 bp, Homo sapiens
tggcatttctatactggcaagtg

SEQ ID NO: 6911174 - DNA, 22 bp, Homo sapiens
gatcacagtattttagatgtgt

SEQ ID NO: 6911175 - DNA, 22 bp, Homo sapiens
aaatccaggtccatgtggggta

SEQ ID NO: 6911176 - DNA, 22 bp, Homo sapiens
taggcagattccatattttggc

SEQ ID NO: 6911177 - DNA, 22 bp, Homo sapiens
ataatagcattaggtttatgca

SEQ ID NO: 6911178 - DNA, 22 bp, Homo sapiens
cttgaagtttgcttagattcct

SEQ ID NO: 6911179 - DNA, 22 bp, Homo sapiens
agtaatgcttctagaactattt

SEQ ID NO: 6911180 - DNA, 22 bp, Homo sapiens
atgcaactgagatggcctctgg

SEQ ID NO: 6911181 - DNA, 22 bp, Homo sapiens
aattcagtgtctggcactgctg

SEQ ID NO: 6911182 - DNA, 22 bp, Homo sapiens
ccaggaatgaaatgtagataaa

SEQ ID NO: 6911183 - DNA, 22 bp, Homo sapiens
ttccaaagaaattgaccaagac

SEQ ID NO: 6911184 - DNA, 22 bp, Homo sapiens
ttcaacatatgaattttgggtg

SEQ ID NO: 6911185 - DNA, 22 bp, Homo sapiens
gatttcccagcaaaagctggtt

SEQ ID NO: 6911186 - DNA, 22 bp, Homo sapiens
gacagtaaatgcagtctagcac

SEQ ID NO: 6911187 - DNA, 22 bp, Homo sapiens
ttcacagtggccctctctgagt

SEQ ID NO: 6911188 - DNA, 22 bp, Homo sapiens
ggcagtcccagcccagaggcgc

SEQ ID NO: 6911189 - DNA, 22 bp, Homo sapiens
tacacgtgtgtgtatgtacata

SEQ ID NO: 6911190 - DNA, 22 bp, Homo sapiens
gctggctgcagattttagaggt

SEQ ID NO: 6911191 - DNA, 20 bp, Homo sapiens
actgtctggggacctcatta

SEQ ID NO: 6911192 - DNA, 22 bp, Homo sapiens
acatacatatgtttaaatgcat

SEQ ID NO: 6911193 - DNA, 22 bp, Homo sapiens
tcaggaaggagctggcctgcca

SEQ ID NO: 6911194 - DNA, 22 bp, Homo sapiens
tggcacacagagaagacacttg

SEQ ID NO: 6911195 - DNA, 22 bp, Homo sapiens
aattagttcacgtcctgtgctt

SEQ ID NO: 6911196 - DNA, 22 bp, Homo sapiens
aggaatgtagtttgagtagaaa

SEQ ID NO: 6911197 - DNA, 22 bp, Homo sapiens
acatgcatatacttaaatatgt

SEQ ID NO: 6911198 - DNA, 22 bp, Homo sapiens
tttacagcactgaagccagggg

SEQ ID NO: 6911199 - DNA, 22 bp, Homo sapiens
agctcttttgtgagcatttggc

SEQ ID NO: 6911200 - DNA, 22 bp, Homo sapiens
gagcttccactctagaaggagt

SEQ ID NO: 6911201 - DNA, 22 bp, Homo sapiens
ccactgtaaccattatcaccat

SEQ ID NO: 6911202 - DNA, 22 bp, Homo sapiens
aactgacagcaggaaccattcc

SEQ ID NO: 6911203 - DNA, 22 bp, Homo sapiens
tttaattgcatttaaagatgga

SEQ ID NO: 6911204 - DNA, 22 bp, Homo sapiens
attaagagttacaaatagagta

SEQ ID NO: 6911205 - DNA, 18 bp, Homo sapiens
ggattctggggacctggg

SEQ ID NO: 6911206 - DNA, 22 bp, Homo sapiens
aggtggggttcagtctcagccg

SEQ ID NO: 6911207 - DNA, 22 bp, Homo sapiens
atcttgcactcctttctcctag

SEQ ID NO: 6911208 - DNA, 21 bp, Homo sapiens
caggaaaagcggaagtctagc

SEQ ID NO: 6911209 - DNA, 22 bp, Homo sapiens
ctcctctgcccaaatttgtata

SEQ ID NO: 6911210 - DNA, 22 bp, Homo sapiens
accccgccgtgacgtcacgcct

SEQ ID NO: 6911211 - DNA, 22 bp, Homo sapiens
atacacactgctatcctttttt

SEQ ID NO: 6911212 - DNA, 22 bp, Homo sapiens
tggggagaagcaatagactcta

SEQ ID NO: 6911213 - DNA, 22 bp, Homo sapiens
ggtctgaatcactgtgcctatc

SEQ ID NO: 6911214 - DNA, 22 bp, Homo sapiens
gaaatcacttttttcatagttg

SEQ ID NO: 6911215 - DNA, 22 bp, Homo sapiens
agccacagtctgatgcctgaga

SEQ ID NO: 6911216 - DNA, 22 bp, Homo sapiens
aaatctcagcccttattttaga

SEQ ID NO: 6911217 - DNA, 22 bp, Homo sapiens
tcagcagatgggttgtgttggc

SEQ ID NO: 6911218 - DNA, 22 bp, Homo sapiens
aagctgccaccagcccagggca

SEQ ID NO: 6911219 - DNA, 21 bp, Homo sapiens
gcctgctgcctgtggccggtc

SEQ ID NO: 6911220 - DNA, 22 bp, Homo sapiens
tgtctatacctgatacagagtt

SEQ ID NO: 6911221 - DNA, 22 bp, Homo sapiens
gcatttcttcctggtgtgagcc

SEQ ID NO: 6911222 - DNA, 22 bp, Homo sapiens
taagaggatatttggccagaag

SEQ ID NO: 6911223 - DNA, 22 bp, Homo sapiens
tcatgctgaggatgctgtgaag

SEQ ID NO: 6911224 - DNA, 23 bp, Homo sapiens
tttatagcagcatgatttataat

SEQ ID NO: 6911225 - DNA, 22 bp, Homo sapiens
ctggctttctgacatgttactg

SEQ ID NO: 6911226 - DNA, 22 bp, Homo sapiens
gaagatgtgggcccactccaga

SEQ ID NO: 6911227 - DNA, 22 bp, Homo sapiens
agaacatttgtcgatcaatttg

SEQ ID NO: 6911228 - DNA, 22 bp, Homo sapiens
ggcctgcacagaggtggctcta

SEQ ID NO: 6911229 - DNA, 22 bp, Homo sapiens
accagaggaagggaatctcaag

SEQ ID NO: 6911230 - DNA, 22 bp, Homo sapiens
ctgtggcaaatgatacctccca

SEQ ID NO: 6911231 - DNA, 22 bp, Homo sapiens
aggctaagaccctcctggggcc

SEQ ID NO: 6911232 - DNA, 22 bp, Homo sapiens
tcttgggctgagagatggggta

SEQ ID NO: 6911233 - DNA, 22 bp, Homo sapiens
gagggtggctcctccctgggcc

SEQ ID NO: 6911234 - DNA, 22 bp, Homo sapiens
aacttagtgtaatgcagtacag

SEQ ID NO: 6911235 - DNA, 22 bp, Homo sapiens
atgaacatcctaggaggcattt

SEQ ID NO: 6911236 - DNA, 21 bp, Homo sapiens
agggccagatcaccaaggagc

SEQ ID NO: 6911237 - DNA, 22 bp, Homo sapiens
gggctccaaaatctatgtcttc

SEQ ID NO: 6911238 - DNA, 22 bp, Homo sapiens
aggggctggagttcgaggttac

SEQ ID NO: 6911239 - DNA, 22 bp, Homo sapiens
taggaacagtttcaggatgttt

SEQ ID NO: 6911240 - DNA, 22 bp, Homo sapiens
tctgcacagagacccttgccag

SEQ ID NO: 6911241 - DNA, 22 bp, Homo sapiens
gggtaggctctgcaggctgggt

SEQ ID NO: 6911242 - DNA, 22 bp, Homo sapiens
cagattttgatgaatgtggaaa

SEQ ID NO: 6911243 - DNA, 22 bp, Homo sapiens
tcacagaatctctgataagtct

SEQ ID NO: 6911244 - DNA, 22 bp, Homo sapiens
attgcactccagcctgggcgac

SEQ ID NO: 6911245 - DNA, 22 bp, Homo sapiens
gtggtccatcatgcagagctcc

SEQ ID NO: 6911246 - DNA, 22 bp, Homo sapiens
ggagggcagagtcccctgctga

SEQ ID NO: 6911247 - DNA, 22 bp, Homo sapiens
cagagagggagcagtagtctct

SEQ ID NO: 6911248 - DNA, 22 bp, Homo sapiens
gtgtatgagcctccagctgggc

SEQ ID NO: 6911249 - DNA, 22 bp, Homo sapiens
ctttgaaaatgtggttaagggt

SEQ ID NO: 6911250 - DNA, 22 bp, Homo sapiens
tcctgccatttgctttttctcc

SEQ ID NO: 6911251 - DNA, 16 bp, Homo sapiens
gtctcttccctgctga

SEQ ID NO: 6911252 - DNA, 22 bp, Homo sapiens
tattactgaggttttatggagt

SEQ ID NO: 6911253 - DNA, 22 bp, Homo sapiens
agtagtcacttctattaatggc

SEQ ID NO: 6911254 - DNA, 22 bp, Homo sapiens
aatttcaatgcactcatggttg

SEQ ID NO: 6911255 - DNA, 22 bp, Homo sapiens
tccagtccagggaatggctgat

SEQ ID NO: 6911256 - DNA, 22 bp, Homo sapiens
caatggaagaatctgacctgca

SEQ ID NO: 6911257 - DNA, 22 bp, Homo sapiens
ctcttcagttgttgcatattct

SEQ ID NO: 6911258 - DNA, 22 bp, Homo sapiens
cctgcattgctcttctgttcct

SEQ ID NO: 6911259 - DNA, 21 bp, Homo sapiens
cctacagatggatatatattc

SEQ ID NO: 6911260 - DNA, 22 bp, Homo sapiens
aagtcacacagttaacatgagg

SEQ ID NO: 6911261 - DNA, 22 bp, Homo sapiens
aagcaggcatgggaggccatcc

SEQ ID NO: 6911262 - DNA, 22 bp, Homo sapiens
acttacccacccctgggttgag

SEQ ID NO: 6911263 - DNA, 22 bp, Homo sapiens
atttatgatagctgcattaaag

SEQ ID NO: 6911264 - DNA, 22 bp, Homo sapiens
agacctggtttatcaccagcat

SEQ ID NO: 6911265 - DNA, 22 bp, Homo sapiens
gttatttaactttgtagcatgg

SEQ ID NO: 6911266 - DNA, 22 bp, Homo sapiens
gggcagtgttgctctcaaagtc

SEQ ID NO: 6911267 - DNA, 21 bp, Homo sapiens
gggccttgagtgtgcggtggg

SEQ ID NO: 6911268 - DNA, 22 bp, Homo sapiens
tctaagctagtggctcatgtga

SEQ ID NO: 6911269 - DNA, 22 bp, Homo sapiens
gtgagagctgctccagatctct

SEQ ID NO: 6911270 - DNA, 22 bp, Homo sapiens
atagaatttgtacttgtagaac

SEQ ID NO: 6911271 - DNA, 22 bp, Homo sapiens
ccttcacactttcacttggata

SEQ ID NO: 6911272 - DNA, 22 bp, Homo sapiens
gttatgtatcttgattgggtgg

SEQ ID NO: 6911273 - DNA, 22 bp, Homo sapiens
agagggacaataagataaaatg

SEQ ID NO: 6911274 - DNA, 22 bp, Homo sapiens
tcaacactatccaggcaatctt

SEQ ID NO: 6911275 - DNA, 22 bp, Homo sapiens
agatacatttgtgtgcatgtat

SEQ ID NO: 6911276 - DNA, 22 bp, Homo sapiens
ttgattgaattttgaaaatcta

SEQ ID NO: 6911277 - DNA, 22 bp, Homo sapiens
ttagagtcaaaatggcatgtta

SEQ ID NO: 6911278 - DNA, 22 bp, Homo sapiens
ggtttcacaatttagagcagtg

SEQ ID NO: 6911279 - DNA, 22 bp, Homo sapiens
agaatgcatctaaaagcagaga

SEQ ID NO: 6911280 - DNA, 22 bp, Homo sapiens
tcagttctgaagttctgcctcc

SEQ ID NO: 6911281 - DNA, 22 bp, Homo sapiens
aataaatgtttgttggatgttt

SEQ ID NO: 6911282 - DNA, 22 bp, Homo sapiens
cttcagagtgcagaagattggg

SEQ ID NO: 6911283 - DNA, 22 bp, Homo sapiens
gcctagagaaaaagcctctgca

SEQ ID NO: 6911284 - DNA, 17 bp, Homo sapiens
atctgcatttctaatga

SEQ ID NO: 6911285 - DNA, 22 bp, Homo sapiens
ctcttcatgtgtttaattttta

SEQ ID NO: 6911286 - DNA, 19 bp, Homo sapiens
tgctcactctcagtccctc

SEQ ID NO: 6911287 - DNA, 22 bp, Homo sapiens
atgcaccacatcacttctgctc

SEQ ID NO: 6911288 - DNA, 22 bp, Homo sapiens
catgtcacaattcttaatggga

SEQ ID NO: 6911289 - DNA, 22 bp, Homo sapiens
cagtctggctcagcacaaaggg

SEQ ID NO: 6911290 - DNA, 22 bp, Homo sapiens
tttctcatttagagtggcaggg

SEQ ID NO: 6911291 - DNA, 22 bp, Homo sapiens
gtattcaagcgagcagatgtct

SEQ ID NO: 6911292 - DNA, 23 bp, Homo sapiens
ttctgtcttgctgtcagctttct

SEQ ID NO: 6911293 - DNA, 22 bp, Homo sapiens
aaacagaaatttcctcatgctc

SEQ ID NO: 6911294 - DNA, 20 bp, Homo sapiens
actatgaagttagccctcca

SEQ ID NO: 6911295 - DNA, 22 bp, Homo sapiens
ctctccaggggaacattgttcc

SEQ ID NO: 6911296 - DNA, 22 bp, Homo sapiens
ctcttgaagcaggggccagttc

SEQ ID NO: 6911297 - DNA, 22 bp, Homo sapiens
actttactccccaacataaatg

SEQ ID NO: 6911298 - DNA, 22 bp, Homo sapiens
acctttcctggctgaccgagga

SEQ ID NO: 6911299 - DNA, 22 bp, Homo sapiens
atgaaggacaacaggggagcag

SEQ ID NO: 6911300 - DNA, 22 bp, Homo sapiens
ccagaagcttcaaggagattct

SEQ ID NO: 6911301 - DNA, 22 bp, Homo sapiens
ctgaccagtccttagcacctgg

SEQ ID NO: 6911302 - DNA, 22 bp, Homo sapiens
gatgtgaggactcatgtggagg

SEQ ID NO: 6911303 - DNA, 22 bp, Homo sapiens
ttataacattataaagtggaga

SEQ ID NO: 6911304 - DNA, 22 bp, Homo sapiens
cagagacagcaagttgatttcc

SEQ ID NO: 6911305 - DNA, 22 bp, Homo sapiens
taggttcatgaaattttcagga

SEQ ID NO: 6911306 - DNA, 22 bp, Homo sapiens
cacatacatgcacacctaaata

SEQ ID NO: 6911307 - DNA, 22 bp, Homo sapiens
atcttcaaagcacatcgtttgt

SEQ ID NO: 6911308 - DNA, 22 bp, Homo sapiens
gctgaaattggaacctgggcct

SEQ ID NO: 6911309 - DNA, 22 bp, Homo sapiens
cccaggacccttcaatggctcc

SEQ ID NO: 6911310 - DNA, 22 bp, Homo sapiens
gcttcctggaacaactgttgct

SEQ ID NO: 6911311 - DNA, 22 bp, Homo sapiens
aggcactgcttctaagtaggaa

SEQ ID NO: 6911312 - DNA, 22 bp, Homo sapiens
gtggatggattttgaggaatgg

SEQ ID NO: 6911313 - DNA, 22 bp, Homo sapiens
tgcacagagggaggcataaaat

SEQ ID NO: 6911314 - DNA, 22 bp, Homo sapiens
ggggcagatggaacagagcaca

SEQ ID NO: 6911315 - DNA, 22 bp, Homo sapiens
ctgaggagacagaagccaaata

SEQ ID NO: 6911316 - DNA, 22 bp, Homo sapiens
cactgcccttacatgccctgca

SEQ ID NO: 6911317 - DNA, 22 bp, Homo sapiens
gtgtgtctttataagaagaggg

SEQ ID NO: 6911318 - DNA, 22 bp, Homo sapiens
actgggaatctcaggaacatgg

SEQ ID NO: 6911319 - DNA, 22 bp, Homo sapiens
cacagctgttttctccaggcag

SEQ ID NO: 6911320 - DNA, 23 bp, Homo sapiens
ttgtttttagaggtggcatgaga

SEQ ID NO: 6911321 - DNA, 22 bp, Homo sapiens
agtatcaatcaccctttgaagt

SEQ ID NO: 6911322 - DNA, 22 bp, Homo sapiens
aggctacagatacagaggctac

SEQ ID NO: 6911323 - DNA, 19 bp, Homo sapiens
tcatgtctctcatctgtga

SEQ ID NO: 6911324 - DNA, 22 bp, Homo sapiens
ttttttccaacttaagacttca

SEQ ID NO: 6911325 - DNA, 22 bp, Homo sapiens
aaggcccagcctggagcttgtt

SEQ ID NO: 6911326 - DNA, 20 bp, Homo sapiens
tgctgctttgccactagttg

SEQ ID NO: 6911327 - DNA, 22 bp, Homo sapiens
tggcagcagaacatgaaaccca

SEQ ID NO: 6911328 - DNA, 22 bp, Homo sapiens
caggaagagaacatggaggctg

SEQ ID NO: 6911329 - DNA, 22 bp, Homo sapiens
gcagtcctagggtgctctgcag

SEQ ID NO: 6911330 - DNA, 20 bp, Homo sapiens
atgttttataaaagaacggg

SEQ ID NO: 6911331 - DNA, 22 bp, Homo sapiens
accactttggtatttcaatttt

SEQ ID NO: 6911332 - DNA, 22 bp, Homo sapiens
gcatccattcactcaacttaga

SEQ ID NO: 6911333 - DNA, 22 bp, Homo sapiens
acttcatgtactgttcaaggcc

SEQ ID NO: 6911334 - DNA, 22 bp, Homo sapiens
tgcaagagattcaaaccataaa

SEQ ID NO: 6911335 - DNA, 22 bp, Homo sapiens
gctcccagtctgatggaggaga

SEQ ID NO: 6911336 - DNA, 22 bp, Homo sapiens
tgcaactcaggaaatgtcattt

SEQ ID NO: 6911337 - DNA, 22 bp, Homo sapiens
tgctattttagacatactttgt

SEQ ID NO: 6911338 - DNA, 22 bp, Homo sapiens
ccactgtcagaggggctgtgcc

SEQ ID NO: 6911339 - DNA, 22 bp, Homo sapiens
ttggcagtgtcactagggagcc

SEQ ID NO: 6911340 - DNA, 22 bp, Homo sapiens
agcttgtctttcaaaggagttt

SEQ ID NO: 6911341 - DNA, 22 bp, Homo sapiens
gctgccctaatatcacatgtta

SEQ ID NO: 6911342 - DNA, 22 bp, Homo sapiens
tcttcgggaatcggtgcatttc

SEQ ID NO: 6911343 - DNA, 22 bp, Homo sapiens
aagggcttagatttagaacatg

SEQ ID NO: 6911344 - DNA, 22 bp, Homo sapiens
ttgctttaaggtatctggagaa

SEQ ID NO: 6911345 - DNA, 22 bp, Homo sapiens
gggctggagcctggcggtggtt

SEQ ID NO: 6911346 - DNA, 22 bp, Homo sapiens
ggtcctgcgtctggctcgcccg

SEQ ID NO: 6911347 - DNA, 22 bp, Homo sapiens
attgccttgtcagatttctttt

SEQ ID NO: 6911348 - DNA, 22 bp, Homo sapiens
ttagctgctgagataattatat

SEQ ID NO: 6911349 - DNA, 22 bp, Homo sapiens
atgcatatgcatctgtgtacat

SEQ ID NO: 6911350 - DNA, 22 bp, Homo sapiens
tgctccagtgcctgccccacag

SEQ ID NO: 6911351 - DNA, 22 bp, Homo sapiens
tccagtggaaattgtgttcatt

SEQ ID NO: 6911352 - DNA, 22 bp, Homo sapiens
acagtgacaacccaggataaat

SEQ ID NO: 6911353 - DNA, 22 bp, Homo sapiens
tcaggagcagggtctgttacca

SEQ ID NO: 6911354 - DNA, 22 bp, Homo sapiens
caggtgctgtgaatcttcataa

SEQ ID NO: 6911355 - DNA, 20 bp, Homo sapiens
gcaaggcacagtgaggaggg

SEQ ID NO: 6911356 - DNA, 22 bp, Homo sapiens
tgttcagaacaaaggtaaatga

SEQ ID NO: 6911357 - DNA, 22 bp, Homo sapiens
tagctgggagtgtctgatgggt

SEQ ID NO: 6911358 - DNA, 21 bp, Homo sapiens
tgttcagaccaacttggactg

SEQ ID NO: 6911359 - DNA, 22 bp, Homo sapiens
aagtaaacattgagagacaaga

SEQ ID NO: 6911360 - DNA, 22 bp, Homo sapiens
ctgaggcactggtaatgggcat

SEQ ID NO: 6911361 - DNA, 22 bp, Homo sapiens
agggaatggatgatggcaggtt

SEQ ID NO: 6911362 - DNA, 22 bp, Homo sapiens
gctctgtgagtattggccctgg

SEQ ID NO: 6911363 - DNA, 22 bp, Homo sapiens
agggctggctccgttaccttga

SEQ ID NO: 6911364 - DNA, 22 bp, Homo sapiens
tgattgcacacctgcactcaag

SEQ ID NO: 6911365 - DNA, 22 bp, Homo sapiens
gactggtttctagcctcatagt

SEQ ID NO: 6911366 - DNA, 22 bp, Homo sapiens
atatgaaaagaagtcaccattg

SEQ ID NO: 6911367 - DNA, 22 bp, Homo sapiens
aaatatcattctggtgcacaga

SEQ ID NO: 6911368 - DNA, 22 bp, Homo sapiens
tcagaagttgataaagtagttg

SEQ ID NO: 6911369 - DNA, 22 bp, Homo sapiens
gaagggtgtgtgtgagggacac

SEQ ID NO: 6911370 - DNA, 22 bp, Homo sapiens
gctagggctcttgtccttgctc

SEQ ID NO: 6911371 - DNA, 22 bp, Homo sapiens
aggtaacactacttagtatact

SEQ ID NO: 6911372 - DNA, 22 bp, Homo sapiens
ttagacatgatggtgcagagag

SEQ ID NO: 6911373 - DNA, 22 bp, Homo sapiens
catcagtctagattctagtacc

SEQ ID NO: 6911374 - DNA, 22 bp, Homo sapiens
aggtcacagggttgaagtactt

SEQ ID NO: 6911375 - DNA, 22 bp, Homo sapiens
tcttaaagccaagcataaacca

SEQ ID NO: 6911376 - DNA, 22 bp, Homo sapiens
ttctggaagccatgggaacagg

SEQ ID NO: 6911377 - DNA, 22 bp, Homo sapiens
taaggaaacaacttgtattttt

SEQ ID NO: 6911378 - DNA, 22 bp, Homo sapiens
tgtaatgagtcacttaccttaa

SEQ ID NO: 6911379 - DNA, 22 bp, Homo sapiens
tgaactctctcaagtgacagaa

SEQ ID NO: 6911380 - DNA, 22 bp, Homo sapiens
ttctgccagctcagagctctag

SEQ ID NO: 6911381 - DNA, 22 bp, Homo sapiens
ccagtgctcattcaagtcctta

SEQ ID NO: 6911382 - DNA, 22 bp, Homo sapiens
tttggaatggtgctgtacagat

SEQ ID NO: 6911383 - DNA, 21 bp, Homo sapiens
tctaaatgtccagcaatagaa

SEQ ID NO: 6911384 - DNA, 22 bp, Homo sapiens
ttgctggcaatttagagatttc

SEQ ID NO: 6911385 - DNA, 22 bp, Homo sapiens
tgggtccttgctggcttcaaag

SEQ ID NO: 6911386 - DNA, 22 bp, Homo sapiens
aagagtttctttattaaccttt

SEQ ID NO: 6911387 - DNA, 22 bp, Homo sapiens
caatgtgtgtgtttttctcaac

SEQ ID NO: 6911388 - DNA, 22 bp, Homo sapiens
atttgcttttactatgttaaaa

SEQ ID NO: 6911389 - DNA, 22 bp, Homo sapiens
tgtacttattttatgtcagcac

SEQ ID NO: 6911390 - DNA, 22 bp, Homo sapiens
gcaggagtcccagaaggttttg

SEQ ID NO: 6911391 - DNA, 22 bp, Homo sapiens
tgcagcctcacgcatccgcatt

SEQ ID NO: 6911392 - DNA, 22 bp, Homo sapiens
tgaatagagcttggcactagaa

SEQ ID NO: 6911393 - DNA, 22 bp, Homo sapiens
ttaggaatttatcacagactgg

SEQ ID NO: 6911394 - DNA, 23 bp, Homo sapiens
tggcaattcctgagctctgagaa

SEQ ID NO: 6911395 - DNA, 22 bp, Homo sapiens
taacaaagtaccatagactgga

SEQ ID NO: 6911396 - DNA, 22 bp, Homo sapiens
tggaaactgtggtatttcttta

SEQ ID NO: 6911397 - DNA, 22 bp, Homo sapiens
atgctcattttattgagaatga

SEQ ID NO: 6911398 - DNA, 22 bp, Homo sapiens
tctggctttctcagcatggcat

SEQ ID NO: 6911399 - DNA, 22 bp, Homo sapiens
ttcttggcacagatgagattct

SEQ ID NO: 6911400 - DNA, 22 bp, Homo sapiens
ggattttgttcctagctttaaa

SEQ ID NO: 6911401 - DNA, 22 bp, Homo sapiens
aactgcttgtaaataatgttga

SEQ ID NO: 6911402 - DNA, 22 bp, Homo sapiens
tctaattttaggcatttgttca

SEQ ID NO: 6911403 - DNA, 22 bp, Homo sapiens
cccagacataacagcagagagg

SEQ ID NO: 6911404 - DNA, 19 bp, Homo sapiens
gcctcggatggagagcagg

SEQ ID NO: 6911405 - DNA, 23 bp, Homo sapiens
ttattgcatccaaatgcattcct

SEQ ID NO: 6911406 - DNA, 22 bp, Homo sapiens
gctgttagagaattagagtggg

SEQ ID NO: 6911407 - DNA, 22 bp, Homo sapiens
accattgatataactcagtctc

SEQ ID NO: 6911408 - DNA, 22 bp, Homo sapiens
agctgcaacatctgcttgtccc

SEQ ID NO: 6911409 - DNA, 22 bp, Homo sapiens
aacccaggagccggaggttgtg

SEQ ID NO: 6911410 - DNA, 22 bp, Homo sapiens
taggctgaaaggagaggtgaag

SEQ ID NO: 6911411 - DNA, 22 bp, Homo sapiens
atcctagaatcagcccttgctg

SEQ ID NO: 6911412 - DNA, 22 bp, Homo sapiens
tacaaaggcttaaagagatttc

SEQ ID NO: 6911413 - DNA, 17 bp, Homo sapiens
aatactgcttatccagg

SEQ ID NO: 6911414 - DNA, 22 bp, Homo sapiens
tttcaggatcaaatgaaatcgt

SEQ ID NO: 6911415 - DNA, 22 bp, Homo sapiens
tgtttcatgaaacatgtttagg

SEQ ID NO: 6911416 - DNA, 22 bp, Homo sapiens
tcagttaacaactatttattga

SEQ ID NO: 6911417 - DNA, 22 bp, Homo sapiens
ataaagtctaccgtattaaaga

SEQ ID NO: 6911418 - DNA, 22 bp, Homo sapiens
tgtccagcggcctggctgctga

SEQ ID NO: 6911419 - DNA, 22 bp, Homo sapiens
caaagtgctgggattagtgctg

SEQ ID NO: 6911420 - DNA, 22 bp, Homo sapiens
caaatgaaggtggtgggtcatt

SEQ ID NO: 6911421 - DNA, 22 bp, Homo sapiens
gcagctggttaatgggagaatt

SEQ ID NO: 6911422 - DNA, 22 bp, Homo sapiens
tctttgaaagctgttctagagt

SEQ ID NO: 6911423 - DNA, 22 bp, Homo sapiens
cagagctgagtcttcaaggttg

SEQ ID NO: 6911424 - DNA, 22 bp, Homo sapiens
tagctaaaccagtatgtgaagg

SEQ ID NO: 6911425 - DNA, 19 bp, Homo sapiens
tccccagcacctctgagtc

SEQ ID NO: 6911426 - DNA, 22 bp, Homo sapiens
tgttggtttaaaatgctgattt

SEQ ID NO: 6911427 - DNA, 22 bp, Homo sapiens
atgacagccttgggtacgagag

SEQ ID NO: 6911428 - DNA, 22 bp, Homo sapiens
ttgagcatcttatagaaagagc

SEQ ID NO: 6911429 - DNA, 23 bp, Homo sapiens
acagatcatctcgaaacaactat

SEQ ID NO: 6911430 - DNA, 22 bp, Homo sapiens
tttgtgtggcgttggccggcgg

SEQ ID NO: 6911431 - DNA, 22 bp, Homo sapiens
ttagctttggattgcatttagt

SEQ ID NO: 6911432 - DNA, 22 bp, Homo sapiens
gtggccccagggccctgtctgg

SEQ ID NO: 6911433 - DNA, 22 bp, Homo sapiens
ccagggttgctgtatggcactt

SEQ ID NO: 6911434 - DNA, 22 bp, Homo sapiens
ttcataaacaactgatggtaat

SEQ ID NO: 6911435 - DNA, 23 bp, Homo sapiens
tcctgctgaaagctccagctggc

SEQ ID NO: 6911436 - DNA, 22 bp, Homo sapiens
ggaagctctgcctagatttcag

SEQ ID NO: 6911437 - DNA, 21 bp, Homo sapiens
gaagagagtcctcatcctgag

SEQ ID NO: 6911438 - DNA, 22 bp, Homo sapiens
atgcttccactgttctgctctc

SEQ ID NO: 6911439 - DNA, 22 bp, Homo sapiens
aactcactttgtggcttctgaa

SEQ ID NO: 6911440 - DNA, 22 bp, Homo sapiens
gccacttgtgtaagcgcctgtc

SEQ ID NO: 6911441 - DNA, 22 bp, Homo sapiens
tgctcctgagtgtgcaggagat

SEQ ID NO: 6911442 - DNA, 22 bp, Homo sapiens
tgtaactaagcacattatctaa

SEQ ID NO: 6911443 - DNA, 22 bp, Homo sapiens
ctctgtatagaaaggaaacatt

SEQ ID NO: 6911444 - DNA, 22 bp, Homo sapiens
caagggggcaggatcacacttg

SEQ ID NO: 6911445 - DNA, 22 bp, Homo sapiens
tgctgaagttactagagactat

SEQ ID NO: 6911446 - DNA, 22 bp, Homo sapiens
atgggatgaacttgatctgctt

SEQ ID NO: 6911447 - DNA, 20 bp, Homo sapiens
aggtgtcctgtagcttgagt

SEQ ID NO: 6911448 - DNA, 22 bp, Homo sapiens
tctggcttgagaggtaattatt

SEQ ID NO: 6911449 - DNA, 22 bp, Homo sapiens
taaaggctcgtattgttgtgtg

SEQ ID NO: 6911450 - DNA, 23 bp, Homo sapiens
aggctttaatctgatattcagat

SEQ ID NO: 6911451 - DNA, 22 bp, Homo sapiens
atttggtcccagggagtcctac

SEQ ID NO: 6911452 - DNA, 22 bp, Homo sapiens
cgatgctggaatgacagctgct

SEQ ID NO: 6911453 - DNA, 23 bp, Homo sapiens
tgtaaattttgtagtcacatttt

SEQ ID NO: 6911454 - DNA, 23 bp, Homo sapiens
agagttgtatcctatgtgcttct

SEQ ID NO: 6911455 - DNA, 22 bp, Homo sapiens
attgacagtggtgttctgggga

SEQ ID NO: 6911456 - DNA, 22 bp, Homo sapiens
gctctttactgtgagggtggtc

SEQ ID NO: 6911457 - DNA, 22 bp, Homo sapiens
gcaggtgtggagtggggtgagc

SEQ ID NO: 6911458 - DNA, 22 bp, Homo sapiens
aggctctgcagtccatcccgtg

SEQ ID NO: 6911459 - DNA, 22 bp, Homo sapiens
tccacccccagacagctggtga

SEQ ID NO: 6911460 - DNA, 22 bp, Homo sapiens
ttaaagtgttaactgaagctta

SEQ ID NO: 6911461 - DNA, 22 bp, Homo sapiens
attcctcaaaggtagcccatta

SEQ ID NO: 6911462 - DNA, 22 bp, Homo sapiens
atttagcaagcaggcaaattca

SEQ ID NO: 6911463 - DNA, 22 bp, Homo sapiens
gagaagggggctcgagtgtcct

SEQ ID NO: 6911464 - DNA, 22 bp, Homo sapiens
aagaaccaaaatgaagctaggt

SEQ ID NO: 6911465 - DNA, 22 bp, Homo sapiens
tcttcatgtatttgacaaccat

SEQ ID NO: 6911466 - DNA, 23 bp, Homo sapiens
ggcaccaacctctgctccctctt

SEQ ID NO: 6911467 - DNA, 22 bp, Homo sapiens
acactctgtgaggcatgtaatg

SEQ ID NO: 6911468 - DNA, 23 bp, Homo sapiens
ggacagggccctgccctatggcc

SEQ ID NO: 6911469 - DNA, 18 bp, Homo sapiens
cttgctgagggcctcatt

SEQ ID NO: 6911470 - DNA, 19 bp, Homo sapiens
gccacattcttccaggtgt

SEQ ID NO: 6911471 - DNA, 22 bp, Homo sapiens
gcacagacaccattaaatattt

SEQ ID NO: 6911472 - DNA, 22 bp, Homo sapiens
tggtcctggggatctgcagtga

SEQ ID NO: 6911473 - DNA, 22 bp, Homo sapiens
taataattggctaaccctggga

SEQ ID NO: 6911474 - DNA, 22 bp, Homo sapiens
ctgccagcaagctaccctggca

SEQ ID NO: 6911475 - DNA, 22 bp, Homo sapiens
tctcttcttgtgttttcctgcc

SEQ ID NO: 6911476 - DNA, 22 bp, Homo sapiens
taggattttaacccacctctga

SEQ ID NO: 6911477 - DNA, 17 bp, Homo sapiens
tcagctcagagcacctg

SEQ ID NO: 6911478 - DNA, 22 bp, Homo sapiens
agcggctgctccgcaggctggc

SEQ ID NO: 6911479 - DNA, 22 bp, Homo sapiens
tcaggcttccaacaatgatgtt

SEQ ID NO: 6911480 - DNA, 22 bp, Homo sapiens
gcagtaaataattttgtgtata

SEQ ID NO: 6911481 - DNA, 22 bp, Homo sapiens
tcccaagtagatgggaatacag

SEQ ID NO: 6911482 - DNA, 22 bp, Homo sapiens
aggagctgcagattctgccttg

SEQ ID NO: 6911483 - DNA, 22 bp, Homo sapiens
gctggaggatggactggaagaa

SEQ ID NO: 6911484 - DNA, 22 bp, Homo sapiens
gggctcagagcatttgggttgg

SEQ ID NO: 6911485 - DNA, 22 bp, Homo sapiens
gtgctttaataagatttcactt

SEQ ID NO: 6911486 - DNA, 22 bp, Homo sapiens
acaagatgtgtttatacaagct

SEQ ID NO: 6911487 - DNA, 22 bp, Homo sapiens
tgtgcaacatgagacagaacag

SEQ ID NO: 6911488 - DNA, 22 bp, Homo sapiens
ctaattttcccaaggccttcta

SEQ ID NO: 6911489 - DNA, 22 bp, Homo sapiens
agcctttaaggaaaatgaataa

SEQ ID NO: 6911490 - DNA, 22 bp, Homo sapiens
taaatgttactttcctttcaca

SEQ ID NO: 6911491 - DNA, 22 bp, Homo sapiens
ggtgttgcagttgaagactggt

SEQ ID NO: 6911492 - DNA, 22 bp, Homo sapiens
agcacctgcacagtggaggaaa

SEQ ID NO: 6911493 - DNA, 22 bp, Homo sapiens
tttagcttcttcagcttgttca

SEQ ID NO: 6911494 - DNA, 22 bp, Homo sapiens
taatttgaatctcgctatttta

SEQ ID NO: 6911495 - DNA, 22 bp, Homo sapiens
cagctccagccgactgtaagaa

SEQ ID NO: 6911496 - DNA, 22 bp, Homo sapiens
tatgctttaaccctcttatatt

SEQ ID NO: 6911497 - DNA, 22 bp, Homo sapiens
tcagggctgtggttccttttct

SEQ ID NO: 6911498 - DNA, 22 bp, Homo sapiens
ctgcttatggagatgagtaaga

SEQ ID NO: 6911499 - DNA, 22 bp, Homo sapiens
gtggagaggagcagctacctca

SEQ ID NO: 6911500 - DNA, 22 bp, Homo sapiens
ccttcaagttcctggtccctgg

SEQ ID NO: 6911501 - DNA, 20 bp, Homo sapiens
tctaattaaaattgtctagt

SEQ ID NO: 6911502 - DNA, 22 bp, Homo sapiens
ttttagaagtgcctatcctatg

SEQ ID NO: 6911503 - DNA, 20 bp, Homo sapiens
aaacacagcctctctttaca

SEQ ID NO: 6911504 - DNA, 22 bp, Homo sapiens
cagcatctcgtggctggataga

SEQ ID NO: 6911505 - DNA, 22 bp, Homo sapiens
gctgctgtgaattttttaaatg

SEQ ID NO: 6911506 - DNA, 22 bp, Homo sapiens
atgcaggagttggaaaaaatga

SEQ ID NO: 6911507 - DNA, 22 bp, Homo sapiens
gacaggtgaaacagcaaggtaa

SEQ ID NO: 6911508 - DNA, 22 bp, Homo sapiens
tccaaggagcagatccagagga

SEQ ID NO: 6911509 - DNA, 22 bp, Homo sapiens
aagatgttgcattagaatacct

SEQ ID NO: 6911510 - DNA, 22 bp, Homo sapiens
tcatttatattgtattctgtag

SEQ ID NO: 6911511 - DNA, 22 bp, Homo sapiens
gtgcctggagctaatgtgtata

SEQ ID NO: 6911512 - DNA, 22 bp, Homo sapiens
gccttgcaggaaggagggacag

SEQ ID NO: 6911513 - DNA, 22 bp, Homo sapiens
acagcagggggagctgttggac

SEQ ID NO: 6911514 - DNA, 22 bp, Homo sapiens
actgtaatattttaagatgtct

SEQ ID NO: 6911515 - DNA, 21 bp, Homo sapiens
gcacagcatgagtgttggcat

SEQ ID NO: 6911516 - DNA, 22 bp, Homo sapiens
tgcattggtcttaatcttcagg

SEQ ID NO: 6911517 - DNA, 22 bp, Homo sapiens
tatgcaaatgactggtatgttt

SEQ ID NO: 6911518 - DNA, 21 bp, Homo sapiens
tggccctggccacggctgcca

SEQ ID NO: 6911519 - DNA, 22 bp, Homo sapiens
tgcattatgcttgtgctgtata

SEQ ID NO: 6911520 - DNA, 22 bp, Homo sapiens
ggagtgcagtggctattaaccg

SEQ ID NO: 6911521 - DNA, 22 bp, Homo sapiens
gggcagatcacctgaggtcagg

SEQ ID NO: 6911522 - DNA, 22 bp, Homo sapiens
actaagttgtagtcacacatcc

SEQ ID NO: 6911523 - DNA, 22 bp, Homo sapiens
acattgtttctgaccatgatga

SEQ ID NO: 6911524 - DNA, 22 bp, Homo sapiens
cagctgttcttgggacagacag

SEQ ID NO: 6911525 - DNA, 22 bp, Homo sapiens
cctgctgtcagtggggcaggca

SEQ ID NO: 6911526 - DNA, 23 bp, Homo sapiens
tttagtcagttgacagccatata

SEQ ID NO: 6911527 - DNA, 22 bp, Homo sapiens
acagatattatggtttctcctt

SEQ ID NO: 6911528 - DNA, 22 bp, Homo sapiens
taactggaagtataattatcaa

SEQ ID NO: 6911529 - DNA, 22 bp, Homo sapiens
attcctgactgctagtcattca

SEQ ID NO: 6911530 - DNA, 20 bp, Homo sapiens
tggaataagttaagttgttt

SEQ ID NO: 6911531 - DNA, 23 bp, Homo sapiens
aaactgcatctctgagcctcagc

SEQ ID NO: 6911532 - DNA, 22 bp, Homo sapiens
tatgaactctggagtctgagtg

SEQ ID NO: 6911533 - DNA, 19 bp, Homo sapiens
gaatgcagaagagagtgga

SEQ ID NO: 6911534 - DNA, 17 bp, Homo sapiens
tccagagcacagagctc

SEQ ID NO: 6911535 - DNA, 22 bp, Homo sapiens
gctgctacaacagaataccata

SEQ ID NO: 6911536 - DNA, 22 bp, Homo sapiens
tgaatatgtgactttgatttca

SEQ ID NO: 6911537 - DNA, 22 bp, Homo sapiens
gtacacactatttaaagtgttt

SEQ ID NO: 6911538 - DNA, 22 bp, Homo sapiens
ttctgataacaaacaccaattt

SEQ ID NO: 6911539 - DNA, 22 bp, Homo sapiens
ctcctgtggtcaagggtgggac

SEQ ID NO: 6911540 - DNA, 22 bp, Homo sapiens
cagaatttcagtgatgttttct

SEQ ID NO: 6911541 - DNA, 22 bp, Homo sapiens
gagcacatgtggagagtctggg

SEQ ID NO: 6911542 - DNA, 22 bp, Homo sapiens
gttgaaacttagttgaaattta

SEQ ID NO: 6911543 - DNA, 22 bp, Homo sapiens
ttacaatgagacgttcttatct

SEQ ID NO: 6911544 - DNA, 22 bp, Homo sapiens
aaggtgtcaggcttgggaaagt

SEQ ID NO: 6911545 - DNA, 22 bp, Homo sapiens
ttctacctcctagaaaatctgg

SEQ ID NO: 6911546 - DNA, 22 bp, Homo sapiens
ctattcaacttgactgtttcac

SEQ ID NO: 6911547 - DNA, 22 bp, Homo sapiens
ttcctggcttttgggctaattc

SEQ ID NO: 6911548 - DNA, 22 bp, Homo sapiens
gtgctgctgccagcaggatcct

SEQ ID NO: 6911549 - DNA, 22 bp, Homo sapiens
ctgaggtacaagaaaggcacct

SEQ ID NO: 6911550 - DNA, 22 bp, Homo sapiens
taagaaggtaatacatttttgc

SEQ ID NO: 6911551 - DNA, 22 bp, Homo sapiens
agctgttagttattgaagatgt

SEQ ID NO: 6911552 - DNA, 22 bp, Homo sapiens
tggtgaagtcagcggagcccgg

SEQ ID NO: 6911553 - DNA, 22 bp, Homo sapiens
ccatagtgaattgtctcagacg

SEQ ID NO: 6911554 - DNA, 22 bp, Homo sapiens
tgggaaagtctttatttctctt

SEQ ID NO: 6911555 - DNA, 22 bp, Homo sapiens
atggccctggcccagaccccac

SEQ ID NO: 6911556 - DNA, 22 bp, Homo sapiens
actgcacagtcccagaggatgc

SEQ ID NO: 6911557 - DNA, 21 bp, Homo sapiens
tggttaaagttgtgtcatccc

SEQ ID NO: 6911558 - DNA, 22 bp, Homo sapiens
cagagcactgcttggaggattt

SEQ ID NO: 6911559 - DNA, 22 bp, Homo sapiens
acccagagcccttagcacagac

SEQ ID NO: 6911560 - DNA, 22 bp, Homo sapiens
tatacatgttttacataagtga

SEQ ID NO: 6911561 - DNA, 22 bp, Homo sapiens
tagcaacaatggaagtaacttc

SEQ ID NO: 6911562 - DNA, 22 bp, Homo sapiens
tcttccttgccttgcttcatca

SEQ ID NO: 6911563 - DNA, 22 bp, Homo sapiens
tgtcattggtgatctgatgcct

SEQ ID NO: 6911564 - DNA, 22 bp, Homo sapiens
tctgttcatgaaatatcttttt

SEQ ID NO: 6911565 - DNA, 22 bp, Homo sapiens
tccagtttggttctgttctcca

SEQ ID NO: 6911566 - DNA, 22 bp, Homo sapiens
caggcccagggagggagaccaa

SEQ ID NO: 6911567 - DNA, 22 bp, Homo sapiens
tcccaggagcaccttttgagcc

SEQ ID NO: 6911568 - DNA, 22 bp, Homo sapiens
catcttgccctacacatttatc

SEQ ID NO: 6911569 - DNA, 22 bp, Homo sapiens
atacaggtggggtggtctatga

SEQ ID NO: 6911570 - DNA, 22 bp, Homo sapiens
tgcagggtggtttgaagggtct

SEQ ID NO: 6911571 - DNA, 22 bp, Homo sapiens
gaggcagcagaacatggaagag

SEQ ID NO: 6911572 - DNA, 20 bp, Homo sapiens
tgctgaggcctgaggcctgg

SEQ ID NO: 6911573 - DNA, 22 bp, Homo sapiens
agaccagttacattagaacttc

SEQ ID NO: 6911574 - DNA, 23 bp, Homo sapiens
ctcaccaagcgccgccgctgtgt

SEQ ID NO: 6911575 - DNA, 20 bp, Homo sapiens
tgttgctctctcctgagttt

SEQ ID NO: 6911576 - DNA, 22 bp, Homo sapiens
tgtctggtttgaagtccatgat

SEQ ID NO: 6911577 - DNA, 22 bp, Homo sapiens
ctgggaggcagaggttgtagtg

SEQ ID NO: 6911578 - DNA, 22 bp, Homo sapiens
ccgggaggcagaggttgcagtg

SEQ ID NO: 6911579 - DNA, 22 bp, Homo sapiens
tgcaggtggtacttctttttct

SEQ ID NO: 6911580 - DNA, 22 bp, Homo sapiens
tcaccaccagaagagctattct

SEQ ID NO: 6911581 - DNA, 22 bp, Homo sapiens
tgctgtgacccaaaaaagacct

SEQ ID NO: 6911582 - DNA, 17 bp, Homo sapiens
ttttggtgaccttggcc

SEQ ID NO: 6911583 - DNA, 22 bp, Homo sapiens
gtctgtggcaggggagaagttt

SEQ ID NO: 6911584 - DNA, 22 bp, Homo sapiens
taggtagggaccaccttgggga

SEQ ID NO: 6911585 - DNA, 23 bp, Homo sapiens
tctgggctgcttaaggatcaagg

SEQ ID NO: 6911586 - DNA, 22 bp, Homo sapiens
agccagctgcctttcacatctg

SEQ ID NO: 6911587 - DNA, 22 bp, Homo sapiens
ataattcatgggcctttcacct

SEQ ID NO: 6911588 - DNA, 22 bp, Homo sapiens
aggggtcagcccttttgtcagc

SEQ ID NO: 6911589 - DNA, 22 bp, Homo sapiens
gagctccagggaacagcagcta

SEQ ID NO: 6911590 - DNA, 20 bp, Homo sapiens
tctttgtgtcagatggacag

SEQ ID NO: 6911591 - DNA, 22 bp, Homo sapiens
attgttcaatgtaataattttg

SEQ ID NO: 6911592 - DNA, 22 bp, Homo sapiens
cattttccacaggcctatttcc

SEQ ID NO: 6911593 - DNA, 22 bp, Homo sapiens
caagccatattttgaagaatga

SEQ ID NO: 6911594 - DNA, 22 bp, Homo sapiens
tacacattagtgaggtattttg

SEQ ID NO: 6911595 - DNA, 22 bp, Homo sapiens
tccacagattaaaaacatactt

SEQ ID NO: 6911596 - DNA, 22 bp, Homo sapiens
ttccttctccagaacttctagg

SEQ ID NO: 6911597 - DNA, 22 bp, Homo sapiens
ctgcatatgatagatgccttgc

SEQ ID NO: 6911598 - DNA, 22 bp, Homo sapiens
ttagatgaacagtcacttcccc

SEQ ID NO: 6911599 - DNA, 19 bp, Homo sapiens
acatggctctccagtctgg

SEQ ID NO: 6911600 - DNA, 22 bp, Homo sapiens
gctcagagttaattggatgggt

SEQ ID NO: 6911601 - DNA, 22 bp, Homo sapiens
ctgcccaaatccttcttcctct

SEQ ID NO: 6911602 - DNA, 22 bp, Homo sapiens
agcagacaggtaggaggataaa

SEQ ID NO: 6911603 - DNA, 22 bp, Homo sapiens
agagccaggcaggcaatgttga

SEQ ID NO: 6911604 - DNA, 22 bp, Homo sapiens
gctgtggaaatgcctaacatga

SEQ ID NO: 6911605 - DNA, 22 bp, Homo sapiens
gatgatttctccattcccttct

SEQ ID NO: 6911606 - DNA, 22 bp, Homo sapiens
agcaggctccaggctggccatc

SEQ ID NO: 6911607 - DNA, 22 bp, Homo sapiens
tcgttaatcagcaccagaattc

SEQ ID NO: 6911608 - DNA, 22 bp, Homo sapiens
ctgcatcaggccaattaagaat

SEQ ID NO: 6911609 - DNA, 17 bp, Homo sapiens
ggtgagacctcccactc

SEQ ID NO: 6911610 - DNA, 22 bp, Homo sapiens
attatggagaaatatgtacagg

SEQ ID NO: 6911611 - DNA, 22 bp, Homo sapiens
tcattgttaattgtatgatctg

SEQ ID NO: 6911612 - DNA, 22 bp, Homo sapiens
atcatcatctaaattgtgtcgc

SEQ ID NO: 6911613 - DNA, 22 bp, Homo sapiens
ccaaagaaacccaagctcaggg

SEQ ID NO: 6911614 - DNA, 22 bp, Homo sapiens
agtgacagtatttgttgccaat

SEQ ID NO: 6911615 - DNA, 22 bp, Homo sapiens
aactgttgcttgtaatatgtgc

SEQ ID NO: 6911616 - DNA, 22 bp, Homo sapiens
ttgcagagcagtaggaatatag

SEQ ID NO: 6911617 - DNA, 23 bp, Homo sapiens
gccatggctgccccacaggcctc

SEQ ID NO: 6911618 - DNA, 22 bp, Homo sapiens
ttacaagatctttgaaggcaag

SEQ ID NO: 6911619 - DNA, 22 bp, Homo sapiens
gtccccgccgtcgctcaggctg

SEQ ID NO: 6911620 - DNA, 22 bp, Homo sapiens
agtgtgggccacgcagctgagc

SEQ ID NO: 6911621 - DNA, 22 bp, Homo sapiens
acatgcagtgagtagttctcca

SEQ ID NO: 6911622 - DNA, 22 bp, Homo sapiens
tggacaaatgatttctaccttt

SEQ ID NO: 6911623 - DNA, 22 bp, Homo sapiens
tctacaaagccattcaggatct

SEQ ID NO: 6911624 - DNA, 22 bp, Homo sapiens
acacaacagaagagcaattgca

SEQ ID NO: 6911625 - DNA, 22 bp, Homo sapiens
ccagtgtggactctctcctttg

SEQ ID NO: 6911626 - DNA, 22 bp, Homo sapiens
gccagtcttcatattcatggtg

SEQ ID NO: 6911627 - DNA, 22 bp, Homo sapiens
cagagccttcctagcagactct

SEQ ID NO: 6911628 - DNA, 22 bp, Homo sapiens
agaatctgcatttttaataaca

SEQ ID NO: 6911629 - DNA, 22 bp, Homo sapiens
tgcagtgtttccagatattgtc

SEQ ID NO: 6911630 - DNA, 22 bp, Homo sapiens
ctatattctggaatgtccattt

SEQ ID NO: 6911631 - DNA, 22 bp, Homo sapiens
ctggagggctgcagcgaggctg

SEQ ID NO: 6911632 - DNA, 22 bp, Homo sapiens
tctgagaggtgaattcagcaaa

SEQ ID NO: 6911633 - DNA, 19 bp, Homo sapiens
atgattgtctatggaggaa

SEQ ID NO: 6911634 - DNA, 20 bp, Homo sapiens
agtgccagggcaggtgagag

SEQ ID NO: 6911635 - DNA, 22 bp, Homo sapiens
tgaagctagcaggaagagcagg

SEQ ID NO: 6911636 - DNA, 22 bp, Homo sapiens
attgatggtgcttatagtcatg

SEQ ID NO: 6911637 - DNA, 22 bp, Homo sapiens
tgaggccaggatcccaggctct

SEQ ID NO: 6911638 - DNA, 22 bp, Homo sapiens
ttctgcagctgtctcgcaggca

SEQ ID NO: 6911639 - DNA, 22 bp, Homo sapiens
tcctggcagggtggcagcgggt

SEQ ID NO: 6911640 - DNA, 22 bp, Homo sapiens
atcatacagaacctgagcactt

SEQ ID NO: 6911641 - DNA, 22 bp, Homo sapiens
tgtcatgccaccgtttcccaga

SEQ ID NO: 6911642 - DNA, 22 bp, Homo sapiens
acacagaggaaagtgtgaaggg

SEQ ID NO: 6911643 - DNA, 22 bp, Homo sapiens
cggtaaggtctgagacaacacc

SEQ ID NO: 6911644 - DNA, 22 bp, Homo sapiens
ctgtccatattcaaggggtagg

SEQ ID NO: 6911645 - DNA, 22 bp, Homo sapiens
ttcatttttaccgcgtgtcaaa

SEQ ID NO: 6911646 - DNA, 16 bp, Homo sapiens
cagttttaaggcccaa

SEQ ID NO: 6911647 - DNA, 22 bp, Homo sapiens
tctgcctagaaacagtgtttgc

SEQ ID NO: 6911648 - DNA, 22 bp, Homo sapiens
aaagtgtaggcttcaaagaggg

SEQ ID NO: 6911649 - DNA, 23 bp, Homo sapiens
cttgttataagaagactgtctgg

SEQ ID NO: 6911650 - DNA, 22 bp, Homo sapiens
tgacattggttgcaaggtactc

SEQ ID NO: 6911651 - DNA, 22 bp, Homo sapiens
agtgatcaatgcttgtcattgt

SEQ ID NO: 6911652 - DNA, 22 bp, Homo sapiens
ttaattagtagaggcatttagt

SEQ ID NO: 6911653 - DNA, 22 bp, Homo sapiens
tggcacttccatttctttagtg

SEQ ID NO: 6911654 - DNA, 22 bp, Homo sapiens
ggctgtggcagctggaagtggt

SEQ ID NO: 6911655 - DNA, 22 bp, Homo sapiens
atgacctgagacagcgctctgt

SEQ ID NO: 6911656 - DNA, 22 bp, Homo sapiens
agatggcaggccctgtgggggt

SEQ ID NO: 6911657 - DNA, 22 bp, Homo sapiens
tgcaagaaacatattccacaag

SEQ ID NO: 6911658 - DNA, 22 bp, Homo sapiens
aaggctgtttgagcactggagc

SEQ ID NO: 6911659 - DNA, 22 bp, Homo sapiens
gcacgctctcaggccagggcat

SEQ ID NO: 6911660 - DNA, 22 bp, Homo sapiens
cagctgttcattgttgccaccc

SEQ ID NO: 6911661 - DNA, 19 bp, Homo sapiens
tagggctggccgggcggtg

SEQ ID NO: 6911662 - DNA, 22 bp, Homo sapiens
gttctgaggcaaaggcagcagc

SEQ ID NO: 6911663 - DNA, 22 bp, Homo sapiens
taaggaatagtgctatgaaaaa

SEQ ID NO: 6911664 - DNA, 22 bp, Homo sapiens
taagttctctgaaatgaaaaag

SEQ ID NO: 6911665 - DNA, 16 bp, Homo sapiens
ctggctggaagcctgg

SEQ ID NO: 6911666 - DNA, 22 bp, Homo sapiens
tgtggccagggggccatgtccc

SEQ ID NO: 6911667 - DNA, 22 bp, Homo sapiens
cgctttggagtccctgctttac

SEQ ID NO: 6911668 - DNA, 19 bp, Homo sapiens
cgtctgagtcacgggggtg

SEQ ID NO: 6911669 - DNA, 22 bp, Homo sapiens
taaaggctcagggaaccagatc

SEQ ID NO: 6911670 - DNA, 22 bp, Homo sapiens
gcattcaggaaccggaagggta

SEQ ID NO: 6911671 - DNA, 22 bp, Homo sapiens
agttcaaactctataagaactt

SEQ ID NO: 6911672 - DNA, 22 bp, Homo sapiens
ttgcttcctctagtttcttgaa

SEQ ID NO: 6911673 - DNA, 21 bp, Homo sapiens
ctgctgctggggtctgggcag

SEQ ID NO: 6911674 - DNA, 22 bp, Homo sapiens
gaaaatagttcatcacaatgat

SEQ ID NO: 6911675 - DNA, 22 bp, Homo sapiens
acacccaggaataaggactggg

SEQ ID NO: 6911676 - DNA, 22 bp, Homo sapiens
tgtagatacacacatatagtgg

SEQ ID NO: 6911677 - DNA, 22 bp, Homo sapiens
gcaagtgagaggcatcattaga

SEQ ID NO: 6911678 - DNA, 22 bp, Homo sapiens
gagatgaatgtaaacaaaggca

SEQ ID NO: 6911679 - DNA, 22 bp, Homo sapiens
ctctgagaactcaggattctga

SEQ ID NO: 6911680 - DNA, 22 bp, Homo sapiens
catttcctgtctggaggtcaaa

SEQ ID NO: 6911681 - DNA, 22 bp, Homo sapiens
gaaagtacagattcctggccag

SEQ ID NO: 6911682 - DNA, 22 bp, Homo sapiens
tttctgtatttaaaagatctgg

SEQ ID NO: 6911683 - DNA, 22 bp, Homo sapiens
gaaatgttttacaaggcatact

SEQ ID NO: 6911684 - DNA, 22 bp, Homo sapiens
gccccttgggaattcctccact

SEQ ID NO: 6911685 - DNA, 22 bp, Homo sapiens
caggataaatagtaaatgtaag

SEQ ID NO: 6911686 - DNA, 22 bp, Homo sapiens
attagcaacatggtgaatatgt

SEQ ID NO: 6911687 - DNA, 21 bp, Homo sapiens
tgctttctaaaaatactattg

SEQ ID NO: 6911688 - DNA, 22 bp, Homo sapiens
gtctgcccttggctcagccata

SEQ ID NO: 6911689 - DNA, 22 bp, Homo sapiens
aggcttccgagtagctgggact

SEQ ID NO: 6911690 - DNA, 21 bp, Homo sapiens
tctataatatgcaggtcatca

SEQ ID NO: 6911691 - DNA, 22 bp, Homo sapiens
agttacaactgtttgaatgtca

SEQ ID NO: 6911692 - DNA, 22 bp, Homo sapiens
ctggggagtgaaattcttaaat

SEQ ID NO: 6911693 - DNA, 23 bp, Homo sapiens
agtgttccagttggttgagagtg

SEQ ID NO: 6911694 - DNA, 21 bp, Homo sapiens
tcccagggtcttatgggatgt

SEQ ID NO: 6911695 - DNA, 21 bp, Homo sapiens
gacaggtgattcagagcaggg

SEQ ID NO: 6911696 - DNA, 22 bp, Homo sapiens
agctatgggtgtgggttccatt

SEQ ID NO: 6911697 - DNA, 22 bp, Homo sapiens
tcttgccctcaacaagagcatg

SEQ ID NO: 6911698 - DNA, 22 bp, Homo sapiens
agggcctggaactggagaccac

SEQ ID NO: 6911699 - DNA, 22 bp, Homo sapiens
aacaagatagagctcttgcctt

SEQ ID NO: 6911700 - DNA, 22 bp, Homo sapiens
tttgacaacgttgttgtgagga

SEQ ID NO: 6911701 - DNA, 22 bp, Homo sapiens
tccaagtcttccttcccaaacc

SEQ ID NO: 6911702 - DNA, 22 bp, Homo sapiens
tcctggatatttgcttaaggtt

SEQ ID NO: 6911703 - DNA, 22 bp, Homo sapiens
tttgcagtctggcctgctttgg

SEQ ID NO: 6911704 - DNA, 22 bp, Homo sapiens
taccttttgcttattatgacac

SEQ ID NO: 6911705 - DNA, 22 bp, Homo sapiens
tgtgaggatggagttctacagg

SEQ ID NO: 6911706 - DNA, 22 bp, Homo sapiens
tctttgttggagtccaaggata

SEQ ID NO: 6911707 - DNA, 22 bp, Homo sapiens
gcaaagaaagccaaggtctaac

SEQ ID NO: 6911708 - DNA, 22 bp, Homo sapiens
tgctgagtacactaaagaacat

SEQ ID NO: 6911709 - DNA, 22 bp, Homo sapiens
agtgcagcatgctggggaggct

SEQ ID NO: 6911710 - DNA, 22 bp, Homo sapiens
tcaggcttggtgctccagtgcc

SEQ ID NO: 6911711 - DNA, 22 bp, Homo sapiens
aaatctaggccgggtgcggtgg

SEQ ID NO: 6911712 - DNA, 22 bp, Homo sapiens
cgtgtctgggatagcagaagta

SEQ ID NO: 6911713 - DNA, 22 bp, Homo sapiens
aggcagctagagagtgaaactg

SEQ ID NO: 6911714 - DNA, 22 bp, Homo sapiens
tagaaacagaatatgagtgaga

SEQ ID NO: 6911715 - DNA, 21 bp, Homo sapiens
ttgccagatcacagtggctct

SEQ ID NO: 6911716 - DNA, 22 bp, Homo sapiens
aatgcttttgctgtcattgctt

SEQ ID NO: 6911717 - DNA, 22 bp, Homo sapiens
attaaagaaacccagcatgtga

SEQ ID NO: 6911718 - DNA, 22 bp, Homo sapiens
gtagcagagctgagagtggaac

SEQ ID NO: 6911719 - DNA, 22 bp, Homo sapiens
ttactaaggactctaagttcta

SEQ ID NO: 6911720 - DNA, 22 bp, Homo sapiens
atacaggtgtacacacatgcaa

SEQ ID NO: 6911721 - DNA, 20 bp, Homo sapiens
aaagatactttttgtaatgg

SEQ ID NO: 6911722 - DNA, 22 bp, Homo sapiens
tagcaagtatgatactccatga

SEQ ID NO: 6911723 - DNA, 22 bp, Homo sapiens
ggcctgcttactgattgttgtt

SEQ ID NO: 6911724 - DNA, 22 bp, Homo sapiens
cagggtgctgcaccatccctca

SEQ ID NO: 6911725 - DNA, 22 bp, Homo sapiens
catttcacagtatattcaaaat

SEQ ID NO: 6911726 - DNA, 22 bp, Homo sapiens
ttggagtaggtttcgtgccgct

SEQ ID NO: 6911727 - DNA, 22 bp, Homo sapiens
cattgctgccactggatatttc

SEQ ID NO: 6911728 - DNA, 22 bp, Homo sapiens
ggtctagatgaaattaaatgtt

SEQ ID NO: 6911729 - DNA, 22 bp, Homo sapiens
atacccaggcttatgttggtca

SEQ ID NO: 6911730 - DNA, 22 bp, Homo sapiens
ttctgacctcaggtgatccgtc

SEQ ID NO: 6911731 - DNA, 22 bp, Homo sapiens
ggtctcttccagctttatcact

SEQ ID NO: 6911732 - DNA, 22 bp, Homo sapiens
ttatagtgattaaaattgctca

SEQ ID NO: 6911733 - DNA, 22 bp, Homo sapiens
atgaatgattttatgtaaatga

SEQ ID NO: 6911734 - DNA, 22 bp, Homo sapiens
gagccagaaaagctgcctgact

SEQ ID NO: 6911735 - DNA, 22 bp, Homo sapiens
actttcttaggctgtataaatg

SEQ ID NO: 6911736 - DNA, 22 bp, Homo sapiens
attctagaatttaaatttgcca

SEQ ID NO: 6911737 - DNA, 22 bp, Homo sapiens
ttagcaaagaagatgtgagttt

SEQ ID NO: 6911738 - DNA, 22 bp, Homo sapiens
gtgccagggggcactgaacaga

SEQ ID NO: 6911739 - DNA, 22 bp, Homo sapiens
ctctgtggaagaagaaagaagg

SEQ ID NO: 6911740 - DNA, 22 bp, Homo sapiens
atatctggggactgaatttaga

SEQ ID NO: 6911741 - DNA, 22 bp, Homo sapiens
aggagctgatgattctttgatc

SEQ ID NO: 6911742 - DNA, 22 bp, Homo sapiens
ggtgaaatgtagtcttgtgaga

SEQ ID NO: 6911743 - DNA, 22 bp, Homo sapiens
attccctgaaattgtgctttca

SEQ ID NO: 6911744 - DNA, 22 bp, Homo sapiens
tacaaagtgacaagctctgctg

SEQ ID NO: 6911745 - DNA, 22 bp, Homo sapiens
actcctgggtgcatttctgatt

SEQ ID NO: 6911746 - DNA, 21 bp, Homo sapiens
gcctgtgtaaattgagtttcc

SEQ ID NO: 6911747 - DNA, 22 bp, Homo sapiens
gcagtgttgactatggtatgag

SEQ ID NO: 6911748 - DNA, 20 bp, Homo sapiens
gtcctgggagccacagcaca

SEQ ID NO: 6911749 - DNA, 22 bp, Homo sapiens
gggctgtgtgcagtacgggtcc

SEQ ID NO: 6911750 - DNA, 22 bp, Homo sapiens
tttaattatgttaagccactga

SEQ ID NO: 6911751 - DNA, 22 bp, Homo sapiens
ggcagtgagaggtctcctggtc

SEQ ID NO: 6911752 - DNA, 22 bp, Homo sapiens
gtgaagtcaagaatgcaatttg

SEQ ID NO: 6911753 - DNA, 18 bp, Homo sapiens
cactggaagattagggtc

SEQ ID NO: 6911754 - DNA, 19 bp, Homo sapiens
tccagatgatatggattac

SEQ ID NO: 6911755 - DNA, 22 bp, Homo sapiens
tccacaagatgataaagagagg

SEQ ID NO: 6911756 - DNA, 22 bp, Homo sapiens
tttgctatttttctgtgcagct

SEQ ID NO: 6911757 - DNA, 21 bp, Homo sapiens
ctgtcgcaggtcgccccaccc

SEQ ID NO: 6911758 - DNA, 22 bp, Homo sapiens
atgaagcaacagccctcctatt

SEQ ID NO: 6911759 - DNA, 22 bp, Homo sapiens
gtggtcttactggagggactct

SEQ ID NO: 6911760 - DNA, 22 bp, Homo sapiens
tatattacatagtgtttgagat

SEQ ID NO: 6911761 - DNA, 22 bp, Homo sapiens
aggctgtggcattaaacgtttg

SEQ ID NO: 6911762 - DNA, 22 bp, Homo sapiens
tagttctttgacggtgctttga

SEQ ID NO: 6911763 - DNA, 22 bp, Homo sapiens
cctgggtggcagaggttgcagt

SEQ ID NO: 6911764 - DNA, 22 bp, Homo sapiens
atttagaaccccttccaacctg

SEQ ID NO: 6911765 - DNA, 22 bp, Homo sapiens
ctcaaggccagttcttctgact

SEQ ID NO: 6911766 - DNA, 22 bp, Homo sapiens
tactttttatgataagaactga

SEQ ID NO: 6911767 - DNA, 22 bp, Homo sapiens
gagattataagatagagtcatt

SEQ ID NO: 6911768 - DNA, 22 bp, Homo sapiens
agatatgtgcgtcttagattga

SEQ ID NO: 6911769 - DNA, 22 bp, Homo sapiens
tggctgagtaagttgtgatatg

SEQ ID NO: 6911770 - DNA, 22 bp, Homo sapiens
tgtggcccagatgagtgtgcta

SEQ ID NO: 6911771 - DNA, 22 bp, Homo sapiens
agcagagcgcctgctcagaggg

SEQ ID NO: 6911772 - DNA, 22 bp, Homo sapiens
tcataaattctggtgctgtgag

SEQ ID NO: 6911773 - DNA, 22 bp, Homo sapiens
gagtttaacacttggagaaaag

SEQ ID NO: 6911774 - DNA, 22 bp, Homo sapiens
tagacagttaaactactggtgg

SEQ ID NO: 6911775 - DNA, 22 bp, Homo sapiens
tcctagaatatttgtggaggtt

SEQ ID NO: 6911776 - DNA, 22 bp, Homo sapiens
gggcatgcaggactgtggcaga

SEQ ID NO: 6911777 - DNA, 22 bp, Homo sapiens
gcctgagtgcatctgcagacat

SEQ ID NO: 6911778 - DNA, 22 bp, Homo sapiens
catcaaatgccatatatggttg

SEQ ID NO: 6911779 - DNA, 22 bp, Homo sapiens
tcatgatttttctttacagttg

SEQ ID NO: 6911780 - DNA, 22 bp, Homo sapiens
aggcattaagttgataatcata

SEQ ID NO: 6911781 - DNA, 22 bp, Homo sapiens
ttatgagatatttatactgctg

SEQ ID NO: 6911782 - DNA, 22 bp, Homo sapiens
tagaagttatgataataatagt

SEQ ID NO: 6911783 - DNA, 22 bp, Homo sapiens
catgtaaaaaattaggtcatct

SEQ ID NO: 6911784 - DNA, 22 bp, Homo sapiens
taccacagtttatctattcagc

SEQ ID NO: 6911785 - DNA, 19 bp, Homo sapiens
agtccatgaatggaggatg

SEQ ID NO: 6911786 - DNA, 22 bp, Homo sapiens
ttacttgaagcttgcttgatgg

SEQ ID NO: 6911787 - DNA, 22 bp, Homo sapiens
gctagggagacttgtgtcatca

SEQ ID NO: 6911788 - DNA, 22 bp, Homo sapiens
acactctgctctgagcttcagg

SEQ ID NO: 6911789 - DNA, 22 bp, Homo sapiens
atgtagtgccctttgtcatcta

SEQ ID NO: 6911790 - DNA, 22 bp, Homo sapiens
attgtattagcacaatacaatt

SEQ ID NO: 6911791 - DNA, 22 bp, Homo sapiens
tggccacagcctctgccagttc

SEQ ID NO: 6911792 - DNA, 22 bp, Homo sapiens
tgttctctaagccacccatttt

SEQ ID NO: 6911793 - DNA, 22 bp, Homo sapiens
aactgtgtgttttgctattagt

SEQ ID NO: 6911794 - DNA, 22 bp, Homo sapiens
acagttgagtgtctctaggaag

SEQ ID NO: 6911795 - DNA, 22 bp, Homo sapiens
agctgaggccacgagtgaaggg

SEQ ID NO: 6911796 - DNA, 22 bp, Homo sapiens
ctgttctgaactgcctgcatgc

SEQ ID NO: 6911797 - DNA, 22 bp, Homo sapiens
ttttggaatttatacagtaatg

SEQ ID NO: 6911798 - DNA, 22 bp, Homo sapiens
tggctgcctgatcgagcaggtg

SEQ ID NO: 6911799 - DNA, 22 bp, Homo sapiens
cacatataccagccgcggtacg

SEQ ID NO: 6911800 - DNA, 22 bp, Homo sapiens
cagtagtgttgctgagtgtcag

SEQ ID NO: 6911801 - DNA, 22 bp, Homo sapiens
tgtctcgggagaaaggagtggg

SEQ ID NO: 6911802 - DNA, 22 bp, Homo sapiens
agaaatgaagcaggagttatta

SEQ ID NO: 6911803 - DNA, 22 bp, Homo sapiens
aggactcctgctgggaatggct

SEQ ID NO: 6911804 - DNA, 21 bp, Homo sapiens
tgatttccagaaaattggccc

SEQ ID NO: 6911805 - DNA, 22 bp, Homo sapiens
ccacactttgagatgactagga

SEQ ID NO: 6911806 - DNA, 22 bp, Homo sapiens
atgaatgacatctgattccata

SEQ ID NO: 6911807 - DNA, 22 bp, Homo sapiens
tcagtctctggggcttctgttt

SEQ ID NO: 6911808 - DNA, 22 bp, Homo sapiens
tgtggctggtctccgagcgtcg

SEQ ID NO: 6911809 - DNA, 22 bp, Homo sapiens
ctatagatgtcattttacatcc

SEQ ID NO: 6911810 - DNA, 22 bp, Homo sapiens
aaaggctatgagatagaagata

SEQ ID NO: 6911811 - DNA, 22 bp, Homo sapiens
agagagcttccattctagtgat

SEQ ID NO: 6911812 - DNA, 22 bp, Homo sapiens
gagaggcatggaacagattctt

SEQ ID NO: 6911813 - DNA, 22 bp, Homo sapiens
tgtaagattctaagagttaatg

SEQ ID NO: 6911814 - DNA, 22 bp, Homo sapiens
tacacatacattgcttacaagg

SEQ ID NO: 6911815 - DNA, 21 bp, Homo sapiens
agctgaaaagttgtttacaag

SEQ ID NO: 6911816 - DNA, 22 bp, Homo sapiens
agttcatggaagattcaatgga

SEQ ID NO: 6911817 - DNA, 22 bp, Homo sapiens
gctctgctgacagctgggacag

SEQ ID NO: 6911818 - DNA, 22 bp, Homo sapiens
agtcactttgctactctgcctt

SEQ ID NO: 6911819 - DNA, 22 bp, Homo sapiens
caggactgtatccttggagaaa

SEQ ID NO: 6911820 - DNA, 22 bp, Homo sapiens
ttaactgagaggatctgagtag

SEQ ID NO: 6911821 - DNA, 22 bp, Homo sapiens
tacctttaaggagatttgacaa

SEQ ID NO: 6911822 - DNA, 21 bp, Homo sapiens
tcagataccagactcaagggg

SEQ ID NO: 6911823 - DNA, 22 bp, Homo sapiens
agtaggatgctttatatgaaag

SEQ ID NO: 6911824 - DNA, 22 bp, Homo sapiens
atttgggaattatttgcctaat

SEQ ID NO: 6911825 - DNA, 22 bp, Homo sapiens
aaggctggtggattatgaggtc

SEQ ID NO: 6911826 - DNA, 22 bp, Homo sapiens
ctccagtggcaagtccgggcgg

SEQ ID NO: 6911827 - DNA, 22 bp, Homo sapiens
tgtcaggttcagtgattttact

SEQ ID NO: 6911828 - DNA, 22 bp, Homo sapiens
ctgccagccaggccaggtaggc

SEQ ID NO: 6911829 - DNA, 22 bp, Homo sapiens
atgtgtttaccaggggaacatg

SEQ ID NO: 6911830 - DNA, 22 bp, Homo sapiens
aggagccaagatgctgtctggc

SEQ ID NO: 6911831 - DNA, 22 bp, Homo sapiens
tggagtaagtatgccttggtgg

SEQ ID NO: 6911832 - DNA, 22 bp, Homo sapiens
ggaggatgagctacgaggagct

SEQ ID NO: 6911833 - DNA, 22 bp, Homo sapiens
gagcacagtccttttgttaaaa

SEQ ID NO: 6911834 - DNA, 22 bp, Homo sapiens
attaagctggtccagacaagtt

SEQ ID NO: 6911835 - DNA, 22 bp, Homo sapiens
gagtgcaatgtagacatcaggg

SEQ ID NO: 6911836 - DNA, 22 bp, Homo sapiens
acatctgtcctctgcagagctc

SEQ ID NO: 6911837 - DNA, 22 bp, Homo sapiens
ggccaggctggttccttgacct

SEQ ID NO: 6911838 - DNA, 22 bp, Homo sapiens
taatatatacctttgttaggaa

SEQ ID NO: 6911839 - DNA, 22 bp, Homo sapiens
cagggctttcccttgtagaaat

SEQ ID NO: 6911840 - DNA, 22 bp, Homo sapiens
catgcatgtttactacagtgac

SEQ ID NO: 6911841 - DNA, 22 bp, Homo sapiens
acatgcatggacatgtatatat

SEQ ID NO: 6911842 - DNA, 22 bp, Homo sapiens
ttccaggccagaatggtcacat

SEQ ID NO: 6911843 - DNA, 22 bp, Homo sapiens
tggctggctagaatggaaatgt

SEQ ID NO: 6911844 - DNA, 22 bp, Homo sapiens
gggagcactaaggcagtcgctt

SEQ ID NO: 6911845 - DNA, 22 bp, Homo sapiens
gcctgctcccagttggcgcctc

SEQ ID NO: 6911846 - DNA, 22 bp, Homo sapiens
gcagttatgtatgtgtttgaga

SEQ ID NO: 6911847 - DNA, 22 bp, Homo sapiens
catcaggataagttccaggtgg

SEQ ID NO: 6911848 - DNA, 22 bp, Homo sapiens
gctgatggaattgtaaaatagt

SEQ ID NO: 6911849 - DNA, 22 bp, Homo sapiens
gtcaggaaaaattgataatttt

SEQ ID NO: 6911850 - DNA, 22 bp, Homo sapiens
ctgggaactgtactgccttgaa

SEQ ID NO: 6911851 - DNA, 22 bp, Homo sapiens
atatacacatttgcttatgtgt

SEQ ID NO: 6911852 - DNA, 22 bp, Homo sapiens
tggaaactgcagttcccgggga

SEQ ID NO: 6911853 - DNA, 22 bp, Homo sapiens
ttgtgtattttttgatactaac

SEQ ID NO: 6911854 - DNA, 22 bp, Homo sapiens
agccaaatacaaactggggtgg

SEQ ID NO: 6911855 - DNA, 22 bp, Homo sapiens
agtgtggtcgggagcgcggggc

SEQ ID NO: 6911856 - DNA, 22 bp, Homo sapiens
tttctcctgctagaacaaggag

SEQ ID NO: 6911857 - DNA, 22 bp, Homo sapiens
ttcataggcagcactggctcct

SEQ ID NO: 6911858 - DNA, 22 bp, Homo sapiens
gcagactgtacactggactttg

SEQ ID NO: 6911859 - DNA, 22 bp, Homo sapiens
tttgacaacagcaaatgtcaca

SEQ ID NO: 6911860 - DNA, 22 bp, Homo sapiens
tcagaaaggccacatggtgcag

SEQ ID NO: 6911861 - DNA, 21 bp, Homo sapiens
tctctgtggcctaccctctac

SEQ ID NO: 6911862 - DNA, 21 bp, Homo sapiens
acagcagcaatctgtctttcc

SEQ ID NO: 6911863 - DNA, 22 bp, Homo sapiens
tatgaagctttgaaaagcttac

SEQ ID NO: 6911864 - DNA, 22 bp, Homo sapiens
cccactgtggaagaaaggggag

SEQ ID NO: 6911865 - DNA, 22 bp, Homo sapiens
gtctcagttactctccctggta

SEQ ID NO: 6911866 - DNA, 22 bp, Homo sapiens
agggctgctcctccttcaggcc

SEQ ID NO: 6911867 - DNA, 22 bp, Homo sapiens
tgttggcagtgctacagtcagt

SEQ ID NO: 6911868 - DNA, 22 bp, Homo sapiens
tatctagaaacagagttttact

SEQ ID NO: 6911869 - DNA, 22 bp, Homo sapiens
agcttctctggtcttctgccaa

SEQ ID NO: 6911870 - DNA, 22 bp, Homo sapiens
ccaaagtttttatagttagcat

SEQ ID NO: 6911871 - DNA, 20 bp, Homo sapiens
gccagtaccattctgccact

SEQ ID NO: 6911872 - DNA, 22 bp, Homo sapiens
aaggcaatgtaaattacagctt

SEQ ID NO: 6911873 - DNA, 22 bp, Homo sapiens
ctggaggtctacagtggtagct

SEQ ID NO: 6911874 - DNA, 22 bp, Homo sapiens
atgcattgctcaacagaataca

SEQ ID NO: 6911875 - DNA, 22 bp, Homo sapiens
gggcttgctgatttgggcagga

SEQ ID NO: 6911876 - DNA, 22 bp, Homo sapiens
agtccagtcttgttggcacggt

SEQ ID NO: 6911877 - DNA, 22 bp, Homo sapiens
gtttttctgtgagcggtaaagg

SEQ ID NO: 6911878 - DNA, 22 bp, Homo sapiens
tagcattccatcactcagcacc

SEQ ID NO: 6911879 - DNA, 22 bp, Homo sapiens
ccaggaaggtatgggaagaaaa

SEQ ID NO: 6911880 - DNA, 22 bp, Homo sapiens
tcctttggcaagctctgctctt

SEQ ID NO: 6911881 - DNA, 22 bp, Homo sapiens
agccaactccagcccctgcagc

SEQ ID NO: 6911882 - DNA, 22 bp, Homo sapiens
ttcaaggtaagtatgagaaagc

SEQ ID NO: 6911883 - DNA, 22 bp, Homo sapiens
ctgggaggcactattcaggagg

SEQ ID NO: 6911884 - DNA, 22 bp, Homo sapiens
atgtgtgctacaggtgtgggaa

SEQ ID NO: 6911885 - DNA, 22 bp, Homo sapiens
tgcatattgtccttgatattat

SEQ ID NO: 6911886 - DNA, 22 bp, Homo sapiens
aggatgtgggttttcacattgt

SEQ ID NO: 6911887 - DNA, 22 bp, Homo sapiens
aaaggtgttgccttggagacct

SEQ ID NO: 6911888 - DNA, 18 bp, Homo sapiens
ttattcttccaggccacc

SEQ ID NO: 6911889 - DNA, 22 bp, Homo sapiens
gcagcagcaggcgctcggccgt

SEQ ID NO: 6911890 - DNA, 22 bp, Homo sapiens
ctatggctagatgtatcaggtg

SEQ ID NO: 6911891 - DNA, 22 bp, Homo sapiens
acatgcactgctcagggttccg

SEQ ID NO: 6911892 - DNA, 22 bp, Homo sapiens
aggctttggaatcagagttctg

SEQ ID NO: 6911893 - DNA, 22 bp, Homo sapiens
tgagctgcaagaaaatttcagt

SEQ ID NO: 6911894 - DNA, 16 bp, Homo sapiens
acctccagtcaagggt

SEQ ID NO: 6911895 - DNA, 22 bp, Homo sapiens
ttcagaccttaaattcttctgt

SEQ ID NO: 6911896 - DNA, 22 bp, Homo sapiens
ttatctgaaacttttgggacca

SEQ ID NO: 6911897 - DNA, 22 bp, Homo sapiens
actgaacatatgcaagaccatt

SEQ ID NO: 6911898 - DNA, 22 bp, Homo sapiens
tgaggtcctgcatgttgaggtc

SEQ ID NO: 6911899 - DNA, 22 bp, Homo sapiens
tatgcagtgagcactatttata

SEQ ID NO: 6911900 - DNA, 17 bp, Homo sapiens
gagtgctggtggagctc

SEQ ID NO: 6911901 - DNA, 22 bp, Homo sapiens
aggaagccactgaatgaaagtt

SEQ ID NO: 6911902 - DNA, 22 bp, Homo sapiens
gatgcgggcccgctccactgcc

SEQ ID NO: 6911903 - DNA, 22 bp, Homo sapiens
actgcttacttctagaactctt

SEQ ID NO: 6911904 - DNA, 22 bp, Homo sapiens
cagaagagatgaaatagtatta

SEQ ID NO: 6911905 - DNA, 22 bp, Homo sapiens
tcttgctgtgtattgcatctcc

SEQ ID NO: 6911906 - DNA, 22 bp, Homo sapiens
actctgccacataaaggtagat

SEQ ID NO: 6911907 - DNA, 22 bp, Homo sapiens
agagtttaacacaagaaaagtt

SEQ ID NO: 6911908 - DNA, 22 bp, Homo sapiens
agtcatttctgcttccatggct

SEQ ID NO: 6911909 - DNA, 22 bp, Homo sapiens
cggccgcgtccagggccgccag

SEQ ID NO: 6911910 - DNA, 22 bp, Homo sapiens
cctgtgatgctcttcctcatct

SEQ ID NO: 6911911 - DNA, 22 bp, Homo sapiens
gggtcattctgaaaatgtaaac

SEQ ID NO: 6911912 - DNA, 22 bp, Homo sapiens
ctgggaatgagcaggtggctcc

SEQ ID NO: 6911913 - DNA, 22 bp, Homo sapiens
atcttgaaggttctaccataca

SEQ ID NO: 6911914 - DNA, 22 bp, Homo sapiens
acatggcacccagatctcaaaa

SEQ ID NO: 6911915 - DNA, 22 bp, Homo sapiens
taggggtgaggccaggcatcag

SEQ ID NO: 6911916 - DNA, 20 bp, Homo sapiens
gcagtcccatttctgagcct

SEQ ID NO: 6911917 - DNA, 22 bp, Homo sapiens
ggctctggtgccctggctccca

SEQ ID NO: 6911918 - DNA, 22 bp, Homo sapiens
aatatgcattaactgtgtacat

SEQ ID NO: 6911919 - DNA, 22 bp, Homo sapiens
ctagtccactgtcctgcctcca

SEQ ID NO: 6911920 - DNA, 22 bp, Homo sapiens
ttcaaactctgagtagttctgc

SEQ ID NO: 6911921 - DNA, 23 bp, Homo sapiens
tgtaggcagtacagttgtaaatg

SEQ ID NO: 6911922 - DNA, 22 bp, Homo sapiens
atctctatctttattgaaatct

SEQ ID NO: 6911923 - DNA, 22 bp, Homo sapiens
agtcatatattttgtttgtgca

SEQ ID NO: 6911924 - DNA, 22 bp, Homo sapiens
ccaagcagaaccattcaggcac

SEQ ID NO: 6911925 - DNA, 22 bp, Homo sapiens
cttgtacatcactggcagatgg

SEQ ID NO: 6911926 - DNA, 22 bp, Homo sapiens
tgtgggatggttttgccagaat

SEQ ID NO: 6911927 - DNA, 20 bp, Homo sapiens
cagtttatctttccggagct

SEQ ID NO: 6911928 - DNA, 22 bp, Homo sapiens
ttcagctagcatctcacttggt

SEQ ID NO: 6911929 - DNA, 22 bp, Homo sapiens
gaaatctccaatcttttcttta

SEQ ID NO: 6911930 - DNA, 22 bp, Homo sapiens
cataccctgtgccagagaaaac

SEQ ID NO: 6911931 - DNA, 22 bp, Homo sapiens
agggcgggctcatcacatgctc

SEQ ID NO: 6911932 - DNA, 22 bp, Homo sapiens
atcctttatctttcctaggaat

SEQ ID NO: 6911933 - DNA, 22 bp, Homo sapiens
aaggccctgtctccaaatacag

SEQ ID NO: 6911934 - DNA, 22 bp, Homo sapiens
ttcaatgtctatgtacatttta

SEQ ID NO: 6911935 - DNA, 22 bp, Homo sapiens
agtgttactcagttttgtccag

SEQ ID NO: 6911936 - DNA, 22 bp, Homo sapiens
ccctggaggaaaatctgaggct

SEQ ID NO: 6911937 - DNA, 22 bp, Homo sapiens
cactgtcttttgtgaagacaat

SEQ ID NO: 6911938 - DNA, 22 bp, Homo sapiens
cagctggttgaagaggagctgg

SEQ ID NO: 6911939 - DNA, 22 bp, Homo sapiens
acgaatcattcacggacaacac

SEQ ID NO: 6911940 - DNA, 23 bp, Homo sapiens
taaattacctttccagtgcaggg

SEQ ID NO: 6911941 - DNA, 22 bp, Homo sapiens
tggaaatacttgccataaaact

SEQ ID NO: 6911942 - DNA, 22 bp, Homo sapiens
tagcctatcttcactaagagca

SEQ ID NO: 6911943 - DNA, 19 bp, Homo sapiens
cctcatcttggtgtgtgca

SEQ ID NO: 6911944 - DNA, 22 bp, Homo sapiens
cagctcctgaggactgctggga

SEQ ID NO: 6911945 - DNA, 23 bp, Homo sapiens
tccaggagaattccagggcccgg

SEQ ID NO: 6911946 - DNA, 22 bp, Homo sapiens
tccacccctgggaatgtcaata

SEQ ID NO: 6911947 - DNA, 22 bp, Homo sapiens
gcttggctgcctttggatgttg

SEQ ID NO: 6911948 - DNA, 22 bp, Homo sapiens
tcactgtagcctcaacctttca

SEQ ID NO: 6911949 - DNA, 22 bp, Homo sapiens
agcctctcaaagaaaccctgta

SEQ ID NO: 6911950 - DNA, 22 bp, Homo sapiens
atgttcatccatgtcgtagcag

SEQ ID NO: 6911951 - DNA, 22 bp, Homo sapiens
gttctccctgtcccctgagctt

SEQ ID NO: 6911952 - DNA, 22 bp, Homo sapiens
tctgtccatctcttgggagtga

SEQ ID NO: 6911953 - DNA, 22 bp, Homo sapiens
ggacaattcagtgatttgggga

SEQ ID NO: 6911954 - DNA, 22 bp, Homo sapiens
accaaggaagagattctcagtt

SEQ ID NO: 6911955 - DNA, 22 bp, Homo sapiens
atagataatgtgtagcagtgat

SEQ ID NO: 6911956 - DNA, 22 bp, Homo sapiens
gctcccagctggagcctcaaca

SEQ ID NO: 6911957 - DNA, 22 bp, Homo sapiens
tgacttaagctgttctttagat

SEQ ID NO: 6911958 - DNA, 22 bp, Homo sapiens
aggaagctcggagagggcaaat

SEQ ID NO: 6911959 - DNA, 22 bp, Homo sapiens
ctctccttgaggcttggacttc

SEQ ID NO: 6911960 - DNA, 22 bp, Homo sapiens
gacacttgtgctgtttctgagc

SEQ ID NO: 6911961 - DNA, 22 bp, Homo sapiens
tcctcctgtctaccagttcctg

SEQ ID NO: 6911962 - DNA, 22 bp, Homo sapiens
atggcttgtctatgagtgctct

SEQ ID NO: 6911963 - DNA, 22 bp, Homo sapiens
atgtacatgtgaatttaggcaa

SEQ ID NO: 6911964 - DNA, 19 bp, Homo sapiens
tcttccagtcacataacaa

SEQ ID NO: 6911965 - DNA, 22 bp, Homo sapiens
agctcaagtgcaagcattctat

SEQ ID NO: 6911966 - DNA, 22 bp, Homo sapiens
tctcatctgccatttgcaggag

SEQ ID NO: 6911967 - DNA, 22 bp, Homo sapiens
tttacactcctggaaatgatat

SEQ ID NO: 6911968 - DNA, 22 bp, Homo sapiens
ccatttgaaatgaatgttttta

SEQ ID NO: 6911969 - DNA, 22 bp, Homo sapiens
acagtcaatcagaacagcatgt

SEQ ID NO: 6911970 - DNA, 22 bp, Homo sapiens
ttggaggataaggatattgatt

SEQ ID NO: 6911971 - DNA, 22 bp, Homo sapiens
tgtgaaatgaagataattcttg

SEQ ID NO: 6911972 - DNA, 22 bp, Homo sapiens
tgcagggattatgtaggggttg

SEQ ID NO: 6911973 - DNA, 19 bp, Homo sapiens
aggcatgcccctgagtcca

SEQ ID NO: 6911974 - DNA, 22 bp, Homo sapiens
agatgacacaccatttttactt

SEQ ID NO: 6911975 - DNA, 22 bp, Homo sapiens
gtccagtggtcaattatctgga

SEQ ID NO: 6911976 - DNA, 22 bp, Homo sapiens
tgggcctggacaaggccactag

SEQ ID NO: 6911977 - DNA, 23 bp, Homo sapiens
agtcttcattgtatttccagacc

SEQ ID NO: 6911978 - DNA, 22 bp, Homo sapiens
atgatatacttcctagaacagt

SEQ ID NO: 6911979 - DNA, 22 bp, Homo sapiens
ctggccctaggcaaacacagat

SEQ ID NO: 6911980 - DNA, 22 bp, Homo sapiens
tcctcacagggcaggaaggagg

SEQ ID NO: 6911981 - DNA, 22 bp, Homo sapiens
tgtgtatttctggaacagacta

SEQ ID NO: 6911982 - DNA, 22 bp, Homo sapiens
taagatgaggtaggtaagactt

SEQ ID NO: 6911983 - DNA, 22 bp, Homo sapiens
atcatgtctatcttagtcacca

SEQ ID NO: 6911984 - DNA, 22 bp, Homo sapiens
accagtctaggcaatgggggct

SEQ ID NO: 6911985 - DNA, 22 bp, Homo sapiens
atgtcgcctgaagcggaggctc

SEQ ID NO: 6911986 - DNA, 19 bp, Homo sapiens
tcaccgcatgaaatgaagc

SEQ ID NO: 6911987 - DNA, 22 bp, Homo sapiens
gcggggacagaaggcggttctc

SEQ ID NO: 6911988 - DNA, 22 bp, Homo sapiens
gaactcattagcctgctttcag

SEQ ID NO: 6911989 - DNA, 22 bp, Homo sapiens
tgaccacacttgatcactctga

SEQ ID NO: 6911990 - DNA, 21 bp, Homo sapiens
actggcttgtatttggtaagc

SEQ ID NO: 6911991 - DNA, 22 bp, Homo sapiens
tgagggccgaggagctgtgggt

SEQ ID NO: 6911992 - DNA, 22 bp, Homo sapiens
ctgctgtttggtgagtgagaaa

SEQ ID NO: 6911993 - DNA, 22 bp, Homo sapiens
ccctgagagcagggtctttctc

SEQ ID NO: 6911994 - DNA, 22 bp, Homo sapiens
actacagtaagggaggcagcat

SEQ ID NO: 6911995 - DNA, 22 bp, Homo sapiens
gttcacagggatccttgttgaa

SEQ ID NO: 6911996 - DNA, 22 bp, Homo sapiens
cttccccaaccccgactgtgtg

SEQ ID NO: 6911997 - DNA, 22 bp, Homo sapiens
tggcatgggccagggagagctg

SEQ ID NO: 6911998 - DNA, 20 bp, Homo sapiens
ttcagaggtgaagttgtggt

SEQ ID NO: 6911999 - DNA, 22 bp, Homo sapiens
tgtttccatggtgacagcagct

SEQ ID NO: 6912000 - DNA, 19 bp, Homo sapiens
aattcgcctcccaggccgc

SEQ ID NO: 6912001 - DNA, 22 bp, Homo sapiens
gtgagggaggtagatttcatca

SEQ ID NO: 6912002 - DNA, 22 bp, Homo sapiens
tctctgtgtgggagatcttttt

SEQ ID NO: 6912003 - DNA, 22 bp, Homo sapiens
gaataacagcaagtttgcaggc

SEQ ID NO: 6912004 - DNA, 20 bp, Homo sapiens
ttggcggctattatgaataa

SEQ ID NO: 6912005 - DNA, 22 bp, Homo sapiens
aagtcttagcaactatcgcttt

SEQ ID NO: 6912006 - DNA, 22 bp, Homo sapiens
aacagaatagttgatgtacagt

SEQ ID NO: 6912007 - DNA, 22 bp, Homo sapiens
ttgggaaagaatgagaaggtga

SEQ ID NO: 6912008 - DNA, 22 bp, Homo sapiens
ccaagcaaggctaattcacttg

SEQ ID NO: 6912009 - DNA, 22 bp, Homo sapiens
ccccagcactctgactcttacc

SEQ ID NO: 6912010 - DNA, 22 bp, Homo sapiens
caaggctgcaaaactacatggg

SEQ ID NO: 6912011 - DNA, 19 bp, Homo sapiens
ctggtgcttgagtgagtca

SEQ ID NO: 6912012 - DNA, 22 bp, Homo sapiens
agaaacaaggtgtaggttgacc

SEQ ID NO: 6912013 - DNA, 22 bp, Homo sapiens
gatcattggcctttctgcagtg

SEQ ID NO: 6912014 - DNA, 22 bp, Homo sapiens
aggcagctgaggtctggcgccc

SEQ ID NO: 6912015 - DNA, 22 bp, Homo sapiens
tgggaagtaggacagtgcagtt

SEQ ID NO: 6912016 - DNA, 22 bp, Homo sapiens
agctcctggatgaggcttatgt

SEQ ID NO: 6912017 - DNA, 19 bp, Homo sapiens
tttgccacttctacctacc

SEQ ID NO: 6912018 - DNA, 23 bp, Homo sapiens
gctgataatgcattctgtttaat

SEQ ID NO: 6912019 - DNA, 22 bp, Homo sapiens
cctccaggctgaatatctagaa

SEQ ID NO: 6912020 - DNA, 22 bp, Homo sapiens
ggatcacacatgcactgtttga

SEQ ID NO: 6912021 - DNA, 22 bp, Homo sapiens
tacttcaacaccatatggtcct

SEQ ID NO: 6912022 - DNA, 22 bp, Homo sapiens
agtctcttaaagacagtgttga

SEQ ID NO: 6912023 - DNA, 22 bp, Homo sapiens
acacttcaaagggtgacttgat

SEQ ID NO: 6912024 - DNA, 22 bp, Homo sapiens
tccaggcaaaaggaactgcttg

SEQ ID NO: 6912025 - DNA, 22 bp, Homo sapiens
ctgtcctgaggcaggtggcctg

SEQ ID NO: 6912026 - DNA, 20 bp, Homo sapiens
aaggcagagtgggttggagc

SEQ ID NO: 6912027 - DNA, 22 bp, Homo sapiens
aaggcttgttgtcacgctcttg

SEQ ID NO: 6912028 - DNA, 22 bp, Homo sapiens
tgctcatcaacatgatgatcat

SEQ ID NO: 6912029 - DNA, 22 bp, Homo sapiens
attgtacaggttggaggaagtg

SEQ ID NO: 6912030 - DNA, 22 bp, Homo sapiens
taccatttcattctttcctcat

SEQ ID NO: 6912031 - DNA, 22 bp, Homo sapiens
gaatctggaagtgggcagtagg

SEQ ID NO: 6912032 - DNA, 22 bp, Homo sapiens
taggtcagaacaagcagtatcg

SEQ ID NO: 6912033 - DNA, 22 bp, Homo sapiens
tgcccaagtgtttggctgagtc

SEQ ID NO: 6912034 - DNA, 22 bp, Homo sapiens
atatagcacttgttttgcatgt

SEQ ID NO: 6912035 - DNA, 22 bp, Homo sapiens
actggagttgggtcaagattct

SEQ ID NO: 6912036 - DNA, 22 bp, Homo sapiens
tcttcagataaagggagagtat

SEQ ID NO: 6912037 - DNA, 22 bp, Homo sapiens
cacagagatggccagggcacat

SEQ ID NO: 6912038 - DNA, 22 bp, Homo sapiens
gaacgcactttgtaaactgtaa

SEQ ID NO: 6912039 - DNA, 22 bp, Homo sapiens
actgtattttgtactttcgtgt

SEQ ID NO: 6912040 - DNA, 22 bp, Homo sapiens
gctgaggcctcagaaggctgag

SEQ ID NO: 6912041 - DNA, 22 bp, Homo sapiens
gacattgagtatttcttttctc

SEQ ID NO: 6912042 - DNA, 18 bp, Homo sapiens
ggcttccctactcacttc

SEQ ID NO: 6912043 - DNA, 22 bp, Homo sapiens
ggccctccctgagccaggtggg

SEQ ID NO: 6912044 - DNA, 22 bp, Homo sapiens
aactgcttagtgatggatgacc

SEQ ID NO: 6912045 - DNA, 22 bp, Homo sapiens
taagcccacatttttctgaaga

SEQ ID NO: 6912046 - DNA, 22 bp, Homo sapiens
gaggtagtgagttaaacagatg

SEQ ID NO: 6912047 - DNA, 22 bp, Homo sapiens
aggcagttctcgtgtgtgtccc

SEQ ID NO: 6912048 - DNA, 22 bp, Homo sapiens
taggacaggtgaggggctgtgg

SEQ ID NO: 6912049 - DNA, 22 bp, Homo sapiens
tggaagccaaggtcagaaggag

SEQ ID NO: 6912050 - DNA, 22 bp, Homo sapiens
tatgtataaatgcatgtgtgga

SEQ ID NO: 6912051 - DNA, 22 bp, Homo sapiens
gcctgtttgtttgcaaaggagc

SEQ ID NO: 6912052 - DNA, 22 bp, Homo sapiens
ttggcccacagtaccatgctgt

SEQ ID NO: 6912053 - DNA, 21 bp, Homo sapiens
ggctgtggagccatgactcac

SEQ ID NO: 6912054 - DNA, 19 bp, Homo sapiens
gtacagtctgtgggtttgg

SEQ ID NO: 6912055 - DNA, 22 bp, Homo sapiens
tcagaaatacaaaacacttact

SEQ ID NO: 6912056 - DNA, 21 bp, Homo sapiens
gtgggatacaattacggcagg

SEQ ID NO: 6912057 - DNA, 22 bp, Homo sapiens
gcttttggccagatggggaaac

SEQ ID NO: 6912058 - DNA, 22 bp, Homo sapiens
ctttcctgaaatctcttctgca

SEQ ID NO: 6912059 - DNA, 22 bp, Homo sapiens
gactaggggcagcgtgggagct

SEQ ID NO: 6912060 - DNA, 20 bp, Homo sapiens
aagcttcacttcatttgatc

SEQ ID NO: 6912061 - DNA, 22 bp, Homo sapiens
ccttgtggatcatcaggtaggc

SEQ ID NO: 6912062 - DNA, 22 bp, Homo sapiens
gggatgtcactgtgcctggcac

SEQ ID NO: 6912063 - DNA, 22 bp, Homo sapiens
tgctgggcatttatgcagatgg

SEQ ID NO: 6912064 - DNA, 22 bp, Homo sapiens
gcttccagaccccagtccctca

SEQ ID NO: 6912065 - DNA, 22 bp, Homo sapiens
agggccagcactcctggcagga

SEQ ID NO: 6912066 - DNA, 20 bp, Homo sapiens
tttggcactgagtggtataa

SEQ ID NO: 6912067 - DNA, 21 bp, Homo sapiens
tgccattttaaccaagtgtgc

SEQ ID NO: 6912068 - DNA, 22 bp, Homo sapiens
gctgcctgaaatgttgcctagc

SEQ ID NO: 6912069 - DNA, 19 bp, Homo sapiens
ttgaacactttcttcaagg

SEQ ID NO: 6912070 - DNA, 22 bp, Homo sapiens
tgtcttatggcatgtccactgg

SEQ ID NO: 6912071 - DNA, 21 bp, Homo sapiens
tcctccctgagctgtggggga

SEQ ID NO: 6912072 - DNA, 18 bp, Homo sapiens
cattccaagttctacctc

SEQ ID NO: 6912073 - DNA, 22 bp, Homo sapiens
ctgggccttgccttgcccacag

SEQ ID NO: 6912074 - DNA, 22 bp, Homo sapiens
tctatttaggagaccctggttc

SEQ ID NO: 6912075 - DNA, 22 bp, Homo sapiens
tctatttctgggtttgtgtggt

SEQ ID NO: 6912076 - DNA, 22 bp, Homo sapiens
agcctggaccaggggcctcaga

SEQ ID NO: 6912077 - DNA, 22 bp, Homo sapiens
ataaagtcatttcaaaagttga

SEQ ID NO: 6912078 - DNA, 22 bp, Homo sapiens
aggatgagaagattggaatctt

SEQ ID NO: 6912079 - DNA, 22 bp, Homo sapiens
tgaacagtggttcatgtcacgg

SEQ ID NO: 6912080 - DNA, 22 bp, Homo sapiens
cttcctgttgtatttgtgagcc

SEQ ID NO: 6912081 - DNA, 18 bp, Homo sapiens
ttgctcactctccttccc

SEQ ID NO: 6912082 - DNA, 22 bp, Homo sapiens
accactggggcaagtcttcaaa

SEQ ID NO: 6912083 - DNA, 22 bp, Homo sapiens
aattagagatcagttctttgac

SEQ ID NO: 6912084 - DNA, 22 bp, Homo sapiens
atgtgtatctaaggtgttctat

SEQ ID NO: 6912085 - DNA, 22 bp, Homo sapiens
aatgaaatctgctgggtaaaga

SEQ ID NO: 6912086 - DNA, 18 bp, Homo sapiens
tgagcccttatctttggc

SEQ ID NO: 6912087 - DNA, 22 bp, Homo sapiens
tgctctcctgctcctcagccca

SEQ ID NO: 6912088 - DNA, 22 bp, Homo sapiens
ggctcagcttggtgcgcagaaa

SEQ ID NO: 6912089 - DNA, 22 bp, Homo sapiens
taagttcaatgaactcagttct

SEQ ID NO: 6912090 - DNA, 22 bp, Homo sapiens
gtctaaacctcaaatcagtgtc

SEQ ID NO: 6912091 - DNA, 22 bp, Homo sapiens
agcaaggaaagtaggcacggaa

SEQ ID NO: 6912092 - DNA, 22 bp, Homo sapiens
tagattaagatgccagttttga

SEQ ID NO: 6912093 - DNA, 22 bp, Homo sapiens
tttcctgcacccgctgatgcca

SEQ ID NO: 6912094 - DNA, 22 bp, Homo sapiens
agcaaggctcttaatgcccaaa

SEQ ID NO: 6912095 - DNA, 22 bp, Homo sapiens
gacagctgcctctgtgtagatc

SEQ ID NO: 6912096 - DNA, 20 bp, Homo sapiens
aacagctctcgacttatctt

SEQ ID NO: 6912097 - DNA, 18 bp, Homo sapiens
ggccagctcctgaggcag

SEQ ID NO: 6912098 - DNA, 22 bp, Homo sapiens
ttaggctctctgcaactaagta

SEQ ID NO: 6912099 - DNA, 22 bp, Homo sapiens
taacaatggagttttgagaaag

SEQ ID NO: 6912100 - DNA, 22 bp, Homo sapiens
aagtgtataacgacctacagga

SEQ ID NO: 6912101 - DNA, 22 bp, Homo sapiens
gacagcagaaaacttttgtgct

SEQ ID NO: 6912102 - DNA, 22 bp, Homo sapiens
tgaatacaggaaaatatactga

SEQ ID NO: 6912103 - DNA, 22 bp, Homo sapiens
tttcttagggactgtaaaatag

SEQ ID NO: 6912104 - DNA, 22 bp, Homo sapiens
ggcaacattctccagatccttt

SEQ ID NO: 6912105 - DNA, 22 bp, Homo sapiens
actttatgctaaactttactct

SEQ ID NO: 6912106 - DNA, 22 bp, Homo sapiens
gcttgcatattggaaagactca

SEQ ID NO: 6912107 - DNA, 22 bp, Homo sapiens
catgatgttaggcaggatacta

SEQ ID NO: 6912108 - DNA, 22 bp, Homo sapiens
ggatcaggctgaagctaggact

SEQ ID NO: 6912109 - DNA, 22 bp, Homo sapiens
tccaaccaaaaatgacaatgtg

SEQ ID NO: 6912110 - DNA, 22 bp, Homo sapiens
atggctccttctgtgcagtttt

SEQ ID NO: 6912111 - DNA, 22 bp, Homo sapiens
ttaatccaataacaaggttcaa

SEQ ID NO: 6912112 - DNA, 22 bp, Homo sapiens
ttcaaactatgacttcagctac

SEQ ID NO: 6912113 - DNA, 22 bp, Homo sapiens
agaacacacgtcagagtttcct

SEQ ID NO: 6912114 - DNA, 22 bp, Homo sapiens
tctctgccaccatgagatgggc

SEQ ID NO: 6912115 - DNA, 21 bp, Homo sapiens
atgtcctttgctctcccacat

SEQ ID NO: 6912116 - DNA, 22 bp, Homo sapiens
tgctgtgttcaccaatatgtgt

SEQ ID NO: 6912117 - DNA, 22 bp, Homo sapiens
ctaaggaatcctaaaacagctg

SEQ ID NO: 6912118 - DNA, 22 bp, Homo sapiens
ttcctccagcctggagcacttc

SEQ ID NO: 6912119 - DNA, 22 bp, Homo sapiens
gctgaggaaaggctggaaggga

SEQ ID NO: 6912120 - DNA, 22 bp, Homo sapiens
tgtgactgaagtgtctagacct

SEQ ID NO: 6912121 - DNA, 22 bp, Homo sapiens
caatagtaaattacggaggaga

SEQ ID NO: 6912122 - DNA, 22 bp, Homo sapiens
tgtacatagaaaggatacagct

SEQ ID NO: 6912123 - DNA, 20 bp, Homo sapiens
cggcctcacggtggcggtgc

SEQ ID NO: 6912124 - DNA, 22 bp, Homo sapiens
ctcactgtctgtactagctgat

SEQ ID NO: 6912125 - DNA, 22 bp, Homo sapiens
aagtaagtggctattagctgtg

SEQ ID NO: 6912126 - DNA, 22 bp, Homo sapiens
gtggccatctttggccctgact

SEQ ID NO: 6912127 - DNA, 22 bp, Homo sapiens
gcctgttctgccctgagagcct

SEQ ID NO: 6912128 - DNA, 22 bp, Homo sapiens
atatgacagcggattcacatat

SEQ ID NO: 6912129 - DNA, 22 bp, Homo sapiens
agagagctctgatgggaggtga

SEQ ID NO: 6912130 - DNA, 22 bp, Homo sapiens
gctgagagaaaagtgaggttct

SEQ ID NO: 6912131 - DNA, 22 bp, Homo sapiens
agtttatagcccagattcatgg

SEQ ID NO: 6912132 - DNA, 22 bp, Homo sapiens
gtcaataagtttgtaactggat

SEQ ID NO: 6912133 - DNA, 22 bp, Homo sapiens
tcatggaaggatgccctgcaag

SEQ ID NO: 6912134 - DNA, 22 bp, Homo sapiens
cgggcaaggcgagactaggccc

SEQ ID NO: 6912135 - DNA, 22 bp, Homo sapiens
agtgttatttttcaaaggccct

SEQ ID NO: 6912136 - DNA, 20 bp, Homo sapiens
cccagaagcttaacagagca

SEQ ID NO: 6912137 - DNA, 22 bp, Homo sapiens
atgacatgacctggtagagaca

SEQ ID NO: 6912138 - DNA, 22 bp, Homo sapiens
tgctttgtgacagattagtttt

SEQ ID NO: 6912139 - DNA, 22 bp, Homo sapiens
tagcaatgctctatgatgaaaa

SEQ ID NO: 6912140 - DNA, 17 bp, Homo sapiens
cttctagaggtcaccca

SEQ ID NO: 6912141 - DNA, 22 bp, Homo sapiens
gacagatgtgggtgacagcagc

SEQ ID NO: 6912142 - DNA, 22 bp, Homo sapiens
gtctacagtgaatgggtcctaa

SEQ ID NO: 6912143 - DNA, 22 bp, Homo sapiens
aagcacatctcctgtgcagaac

SEQ ID NO: 6912144 - DNA, 22 bp, Homo sapiens
ggtaataaaattgtgtcaaaca

SEQ ID NO: 6912145 - DNA, 22 bp, Homo sapiens
tgagagacacactgtgcatgta

SEQ ID NO: 6912146 - DNA, 22 bp, Homo sapiens
ctttcagaagccggaagggcag

SEQ ID NO: 6912147 - DNA, 22 bp, Homo sapiens
ttgcttgcataatgctggcatg

SEQ ID NO: 6912148 - DNA, 22 bp, Homo sapiens
tcctgctagagaataacagcac

SEQ ID NO: 6912149 - DNA, 23 bp, Homo sapiens
tgttggtggcggtaattttgtcc

SEQ ID NO: 6912150 - DNA, 22 bp, Homo sapiens
ggctcttctggttgtcacattt

SEQ ID NO: 6912151 - DNA, 22 bp, Homo sapiens
acttccagctaggttctgctaa

SEQ ID NO: 6912152 - DNA, 22 bp, Homo sapiens
tacaatagggcttttgtttatg

SEQ ID NO: 6912153 - DNA, 22 bp, Homo sapiens
tctagaaaaacaaagtatctga

SEQ ID NO: 6912154 - DNA, 22 bp, Homo sapiens
tactgaaactcttgtaaatatc

SEQ ID NO: 6912155 - DNA, 21 bp, Homo sapiens
ttttacagatgaggggaaggg

SEQ ID NO: 6912156 - DNA, 22 bp, Homo sapiens
cgtcagtttactgttgccatgg

SEQ ID NO: 6912157 - DNA, 22 bp, Homo sapiens
tgaggcttgtctcagatggggg

SEQ ID NO: 6912158 - DNA, 21 bp, Homo sapiens
catcaactcttgtgctcacac

SEQ ID NO: 6912159 - DNA, 22 bp, Homo sapiens
attacagaaagcaatattgagt

SEQ ID NO: 6912160 - DNA, 22 bp, Homo sapiens
ggggggcgccatggtctcttgg

SEQ ID NO: 6912161 - DNA, 22 bp, Homo sapiens
ggtcaacttagataagatggag

SEQ ID NO: 6912162 - DNA, 22 bp, Homo sapiens
tttacaacataggccccaagaa

SEQ ID NO: 6912163 - DNA, 16 bp, Homo sapiens
gaagaaggaaaactac

SEQ ID NO: 6912164 - DNA, 22 bp, Homo sapiens
tacactaagaacaaagatctgt

SEQ ID NO: 6912165 - DNA, 22 bp, Homo sapiens
aggtgggacccgtggggtgcga

SEQ ID NO: 6912166 - DNA, 22 bp, Homo sapiens
ctctttgtaaagaagtggtagg

SEQ ID NO: 6912167 - DNA, 22 bp, Homo sapiens
tgtagcacgttagtgttagagc

SEQ ID NO: 6912168 - DNA, 20 bp, Homo sapiens
gctttaagccaaaatgtgaa

SEQ ID NO: 6912169 - DNA, 22 bp, Homo sapiens
tcaggggcagccggggaagcca

SEQ ID NO: 6912170 - DNA, 22 bp, Homo sapiens
acaaagtaggcagtgggctgga

SEQ ID NO: 6912171 - DNA, 22 bp, Homo sapiens
taaccatattttccattaagtt

SEQ ID NO: 6912172 - DNA, 21 bp, Homo sapiens
cctggttggcgtagctcagtc

SEQ ID NO: 6912173 - DNA, 22 bp, Homo sapiens
attgagatctgcatcataagct

SEQ ID NO: 6912174 - DNA, 20 bp, Homo sapiens
tcctaagctctggcagtctt

SEQ ID NO: 6912175 - DNA, 22 bp, Homo sapiens
atcttttttgtcttggtcactg

SEQ ID NO: 6912176 - DNA, 22 bp, Homo sapiens
tgaattgagataggatcagtct

SEQ ID NO: 6912177 - DNA, 22 bp, Homo sapiens
tgacacactgccaggcgctcgg

SEQ ID NO: 6912178 - DNA, 22 bp, Homo sapiens
ctgtgtctccttggtgggatat

SEQ ID NO: 6912179 - DNA, 22 bp, Homo sapiens
ctctggagttagtgatctgggc

SEQ ID NO: 6912180 - DNA, 22 bp, Homo sapiens
ttccaggatagctttcaggaat

SEQ ID NO: 6912181 - DNA, 22 bp, Homo sapiens
gctgtcaccaaagcaggcactg

SEQ ID NO: 6912182 - DNA, 22 bp, Homo sapiens
gatcagtgaactatactgcctc

SEQ ID NO: 6912183 - DNA, 22 bp, Homo sapiens
tcatttaaaatgtaccaggatt

SEQ ID NO: 6912184 - DNA, 22 bp, Homo sapiens
tgccgcagtgcggggagggccc

SEQ ID NO: 6912185 - DNA, 22 bp, Homo sapiens
tgagaacaatgagtcaggggct

SEQ ID NO: 6912186 - DNA, 19 bp, Homo sapiens
tggcagtgtggcttccaga

SEQ ID NO: 6912187 - DNA, 22 bp, Homo sapiens
gagctgaagatgtcagaaccgt

SEQ ID NO: 6912188 - DNA, 22 bp, Homo sapiens
ttccaagtgctgaggacagtag

SEQ ID NO: 6912189 - DNA, 22 bp, Homo sapiens
gaactctttatcaaaatgcgtt

SEQ ID NO: 6912190 - DNA, 20 bp, Homo sapiens
ccagctctgtggttagatac

SEQ ID NO: 6912191 - DNA, 22 bp, Homo sapiens
agtggggccgcggtcctgccct

SEQ ID NO: 6912192 - DNA, 22 bp, Homo sapiens
cctagcagaagctgcaatgcct

SEQ ID NO: 6912193 - DNA, 23 bp, Homo sapiens
taaagcaaagtcaagtgcactcc

SEQ ID NO: 6912194 - DNA, 22 bp, Homo sapiens
cctgtacagtgaatgaatgtga

SEQ ID NO: 6912195 - DNA, 22 bp, Homo sapiens
gccctgtgcttggatggcagat

SEQ ID NO: 6912196 - DNA, 21 bp, Homo sapiens
gctctgtgaaatttcaccagg

SEQ ID NO: 6912197 - DNA, 22 bp, Homo sapiens
aaagcagcagaaagctggcccc

SEQ ID NO: 6912198 - DNA, 22 bp, Homo sapiens
aagaatctgttgattccccact

SEQ ID NO: 6912199 - DNA, 22 bp, Homo sapiens
tcaggttcagactagtcccagt

SEQ ID NO: 6912200 - DNA, 22 bp, Homo sapiens
ccagggtgaggaggctcccacg

SEQ ID NO: 6912201 - DNA, 22 bp, Homo sapiens
atgccactgcactccagcctag

SEQ ID NO: 6912202 - DNA, 22 bp, Homo sapiens
tcagaggtggcaggggtgtcca

SEQ ID NO: 6912203 - DNA, 22 bp, Homo sapiens
gtgcttggaccaggtcatcttc

SEQ ID NO: 6912204 - DNA, 22 bp, Homo sapiens
atgccctgtggttcatgtgaga

SEQ ID NO: 6912205 - DNA, 22 bp, Homo sapiens
aatacttgtcagatgaataaga

SEQ ID NO: 6912206 - DNA, 22 bp, Homo sapiens
tgcctggctgaggtgacaggtt

SEQ ID NO: 6912207 - DNA, 22 bp, Homo sapiens
gtgctgggggtttctgtaggtc

SEQ ID NO: 6912208 - DNA, 22 bp, Homo sapiens
tcaagcaagtgtttggtgtaaa

SEQ ID NO: 6912209 - DNA, 22 bp, Homo sapiens
tgccagtgggtgtgcagagact

SEQ ID NO: 6912210 - DNA, 22 bp, Homo sapiens
tggcagattttgaagacagaga

SEQ ID NO: 6912211 - DNA, 22 bp, Homo sapiens
acattcctgccataaatttttt

SEQ ID NO: 6912212 - DNA, 22 bp, Homo sapiens
cacagctacctgcatgcctgct

SEQ ID NO: 6912213 - DNA, 22 bp, Homo sapiens
ggtctgtcttcccaatcgtggc

SEQ ID NO: 6912214 - DNA, 21 bp, Homo sapiens
cttgacatagcctgtcagctt

SEQ ID NO: 6912215 - DNA, 22 bp, Homo sapiens
tcctgccaaagcatgtactggg

SEQ ID NO: 6912216 - DNA, 21 bp, Homo sapiens
tatacagaggggaacaggaga

SEQ ID NO: 6912217 - DNA, 22 bp, Homo sapiens
gtcaactttaagatgatctttt

SEQ ID NO: 6912218 - DNA, 22 bp, Homo sapiens
tgagctgtatattgttttaata

SEQ ID NO: 6912219 - DNA, 19 bp, Homo sapiens
gtctagaacattgtaggtg

SEQ ID NO: 6912220 - DNA, 22 bp, Homo sapiens
actatttgtaaagagcaaacgg

SEQ ID NO: 6912221 - DNA, 22 bp, Homo sapiens
tgaccaatactgtggatgccag

SEQ ID NO: 6912222 - DNA, 22 bp, Homo sapiens
aggcaggtcacatgcttggcga

SEQ ID NO: 6912223 - DNA, 23 bp, Homo sapiens
ttaacaggatctcgggcaagagg

SEQ ID NO: 6912224 - DNA, 22 bp, Homo sapiens
gctcagtggtattcggaaactg

SEQ ID NO: 6912225 - DNA, 22 bp, Homo sapiens
aggaaatgctgatgctcctgga

SEQ ID NO: 6912226 - DNA, 22 bp, Homo sapiens
actgccaggccttgttagttga

SEQ ID NO: 6912227 - DNA, 18 bp, Homo sapiens
ccatttggatagtgaagc

SEQ ID NO: 6912228 - DNA, 22 bp, Homo sapiens
aggtccagagttgagatacaga

SEQ ID NO: 6912229 - DNA, 22 bp, Homo sapiens
atcccaggggttgtatcttccc

SEQ ID NO: 6912230 - DNA, 22 bp, Homo sapiens
tctgtgtctcaatcccatgctg

SEQ ID NO: 6912231 - DNA, 22 bp, Homo sapiens
acattgcagatgtgtttaatgt

SEQ ID NO: 6912232 - DNA, 22 bp, Homo sapiens
agtgctccaaaggttggtcatt

SEQ ID NO: 6912233 - DNA, 23 bp, Homo sapiens
tggctagctgaagaggtatgggt

SEQ ID NO: 6912234 - DNA, 22 bp, Homo sapiens
agctccagagtctgaactattc

SEQ ID NO: 6912235 - DNA, 22 bp, Homo sapiens
aaaggcatgattaattctgtgt

SEQ ID NO: 6912236 - DNA, 22 bp, Homo sapiens
tacaggaagttacagactatga

SEQ ID NO: 6912237 - DNA, 22 bp, Homo sapiens
ttggaatatcatgcagaataaa

SEQ ID NO: 6912238 - DNA, 22 bp, Homo sapiens
aaatgcagattcttaggcccca

SEQ ID NO: 6912239 - DNA, 22 bp, Homo sapiens
tcattttttgcatacctgtgtc

SEQ ID NO: 6912240 - DNA, 22 bp, Homo sapiens
agtgctgttaggttaatatagt

SEQ ID NO: 6912241 - DNA, 22 bp, Homo sapiens
cacgtttgcatagctgatgttg

SEQ ID NO: 6912242 - DNA, 22 bp, Homo sapiens
tccctgtggaagactgccagag

SEQ ID NO: 6912243 - DNA, 22 bp, Homo sapiens
tgcagaagctgcaggtcagtgg

SEQ ID NO: 6912244 - DNA, 22 bp, Homo sapiens
caacatttcaaggtctttagga

SEQ ID NO: 6912245 - DNA, 22 bp, Homo sapiens
ttgggagatggggagataatat

SEQ ID NO: 6912246 - DNA, 22 bp, Homo sapiens
acagcctgctgcctgcttcttg

SEQ ID NO: 6912247 - DNA, 22 bp, Homo sapiens
aaggacaggctaacctgacatt

SEQ ID NO: 6912248 - DNA, 20 bp, Homo sapiens
agcaagaacgttctgaggga

SEQ ID NO: 6912249 - DNA, 22 bp, Homo sapiens
atttacacttggtttactagag

SEQ ID NO: 6912250 - DNA, 22 bp, Homo sapiens
ctgtcatcacagttgagcagcc

SEQ ID NO: 6912251 - DNA, 22 bp, Homo sapiens
aaatgcagattcctaggcccca

SEQ ID NO: 6912252 - DNA, 22 bp, Homo sapiens
atagcacctcctcagggaagtc

SEQ ID NO: 6912253 - DNA, 20 bp, Homo sapiens
ttagaagtggctatttcctc

SEQ ID NO: 6912254 - DNA, 22 bp, Homo sapiens
tcactgttaataaatagcaaag

SEQ ID NO: 6912255 - DNA, 22 bp, Homo sapiens
cgtgatttatggtctggtggcg

SEQ ID NO: 6912256 - DNA, 22 bp, Homo sapiens
gcaataaataacatggaagaca

SEQ ID NO: 6912257 - DNA, 21 bp, Homo sapiens
taaataataagttgctgagat

SEQ ID NO: 6912258 - DNA, 22 bp, Homo sapiens
tactgtgtgaccctgggtaggt

SEQ ID NO: 6912259 - DNA, 22 bp, Homo sapiens
gaagcacagaatggttaacatg

SEQ ID NO: 6912260 - DNA, 23 bp, Homo sapiens
tccagcagagccttccaggaggg

SEQ ID NO: 6912261 - DNA, 22 bp, Homo sapiens
gggtatatactgttgttatcac

SEQ ID NO: 6912262 - DNA, 22 bp, Homo sapiens
tagatacatacattttaaaatg

SEQ ID NO: 6912263 - DNA, 22 bp, Homo sapiens
tgtgaatacagcatgtgcttct

SEQ ID NO: 6912264 - DNA, 18 bp, Homo sapiens
aggagcggctgcggctgc

SEQ ID NO: 6912265 - DNA, 22 bp, Homo sapiens
ctggtcccagaggcaagagatg

SEQ ID NO: 6912266 - DNA, 22 bp, Homo sapiens
ataaggttttcttttgttccct

SEQ ID NO: 6912267 - DNA, 20 bp, Homo sapiens
tagggagatatgctcttttc

SEQ ID NO: 6912268 - DNA, 22 bp, Homo sapiens
ctcaccatggatcttccatttc

SEQ ID NO: 6912269 - DNA, 22 bp, Homo sapiens
ttccctggaggagtagtgaaat

SEQ ID NO: 6912270 - DNA, 22 bp, Homo sapiens
ctggccgccgtcccaacctcga

SEQ ID NO: 6912271 - DNA, 22 bp, Homo sapiens
tctaggtagcgatacagcagca

SEQ ID NO: 6912272 - DNA, 22 bp, Homo sapiens
tactctggtgttagtctttgca

SEQ ID NO: 6912273 - DNA, 22 bp, Homo sapiens
ccctggttcaggtttctctgaa

SEQ ID NO: 6912274 - DNA, 22 bp, Homo sapiens
ttctggctgaaagtttatttga

SEQ ID NO: 6912275 - DNA, 22 bp, Homo sapiens
ctggcaggcagacttctgcaag

SEQ ID NO: 6912276 - DNA, 22 bp, Homo sapiens
atgcatatgtacttgcatatgt

SEQ ID NO: 6912277 - DNA, 22 bp, Homo sapiens
ctcagcctgtgaagagcagagg

SEQ ID NO: 6912278 - DNA, 22 bp, Homo sapiens
gcatgaggtttgggctctgtga

SEQ ID NO: 6912279 - DNA, 22 bp, Homo sapiens
ccagtgcttccaggaatacggt

SEQ ID NO: 6912280 - DNA, 22 bp, Homo sapiens
tcagaacatttaaaaagtggtt

SEQ ID NO: 6912281 - DNA, 22 bp, Homo sapiens
atatggcttttctgtagtagtt

SEQ ID NO: 6912282 - DNA, 22 bp, Homo sapiens
aaggcagagtctatcttggaag

SEQ ID NO: 6912283 - DNA, 22 bp, Homo sapiens
cagcttctcagaaagctgaggt

SEQ ID NO: 6912284 - DNA, 21 bp, Homo sapiens
ctaagcaaggagcaggggtag

SEQ ID NO: 6912285 - DNA, 22 bp, Homo sapiens
aggctttggggcattctgtgtt

SEQ ID NO: 6912286 - DNA, 22 bp, Homo sapiens
agcagcattatgatatatctta

SEQ ID NO: 6912287 - DNA, 22 bp, Homo sapiens
ggggtaggtcatagcccctcta

SEQ ID NO: 6912288 - DNA, 22 bp, Homo sapiens
cacggtggcccacaggtgcaag

SEQ ID NO: 6912289 - DNA, 22 bp, Homo sapiens
tcactttgaattccttgatttt

SEQ ID NO: 6912290 - DNA, 22 bp, Homo sapiens
tcagaagttgaaggctcttttt

SEQ ID NO: 6912291 - DNA, 20 bp, Homo sapiens
gaatcttactacattctctc

SEQ ID NO: 6912292 - DNA, 22 bp, Homo sapiens
agtctgagttactggcaaatac

SEQ ID NO: 6912293 - DNA, 23 bp, Homo sapiens
ggagcctggcatatgagacgcat

SEQ ID NO: 6912294 - DNA, 22 bp, Homo sapiens
attttccagcctttctagaact

SEQ ID NO: 6912295 - DNA, 22 bp, Homo sapiens
ttcaggatcactaaaccctcca

SEQ ID NO: 6912296 - DNA, 22 bp, Homo sapiens
atgtgtcttctaagccaagcct

SEQ ID NO: 6912297 - DNA, 18 bp, Homo sapiens
gctgaaattctaaacaaa

SEQ ID NO: 6912298 - DNA, 19 bp, Homo sapiens
ggcagctggacgctgttca

SEQ ID NO: 6912299 - DNA, 22 bp, Homo sapiens
taggaagcactcatttaaagga

SEQ ID NO: 6912300 - DNA, 22 bp, Homo sapiens
ctcagagggaggactgggctgg

SEQ ID NO: 6912301 - DNA, 22 bp, Homo sapiens
agcaggagctgtgggaagatgg

SEQ ID NO: 6912302 - DNA, 22 bp, Homo sapiens
tatggataggtttcaagaatgc

SEQ ID NO: 6912303 - DNA, 22 bp, Homo sapiens
ttgctctgattaggtggaaaca

SEQ ID NO: 6912304 - DNA, 22 bp, Homo sapiens
gcccatgggctccagacctggg

SEQ ID NO: 6912305 - DNA, 22 bp, Homo sapiens
gatctttgcaaactttgtcact

SEQ ID NO: 6912306 - DNA, 22 bp, Homo sapiens
tcatttgtaccattttttaaga

SEQ ID NO: 6912307 - DNA, 22 bp, Homo sapiens
atggaatttggactggaagtcc

SEQ ID NO: 6912308 - DNA, 22 bp, Homo sapiens
gtgttctgggatgattgtagtg

SEQ ID NO: 6912309 - DNA, 22 bp, Homo sapiens
tacagagactttatggcacaaa

SEQ ID NO: 6912310 - DNA, 22 bp, Homo sapiens
gagttattaatggctgagtttg

SEQ ID NO: 6912311 - DNA, 22 bp, Homo sapiens
ggctggcaagtcagtgctgatg

SEQ ID NO: 6912312 - DNA, 22 bp, Homo sapiens
tagggatggaaacccgttttct

SEQ ID NO: 6912313 - DNA, 22 bp, Homo sapiens
attcaaacaggccaattgacct

SEQ ID NO: 6912314 - DNA, 22 bp, Homo sapiens
acagttaatatgtgacagaact

SEQ ID NO: 6912315 - DNA, 22 bp, Homo sapiens
ttgaagagtagaaaatgcaaat

SEQ ID NO: 6912316 - DNA, 22 bp, Homo sapiens
tttgttcacatgtcatgtacaa

SEQ ID NO: 6912317 - DNA, 22 bp, Homo sapiens
tggctctgccacctttccctaa

SEQ ID NO: 6912318 - DNA, 22 bp, Homo sapiens
atctatactacaaatggctggt

SEQ ID NO: 6912319 - DNA, 22 bp, Homo sapiens
tccagtggcttcctggaaaaaa

SEQ ID NO: 6912320 - DNA, 22 bp, Homo sapiens
gcaggagttaggcgtcgtggat

SEQ ID NO: 6912321 - DNA, 22 bp, Homo sapiens
tccctccataacagaggtgagc

SEQ ID NO: 6912322 - DNA, 19 bp, Homo sapiens
tatgcatatgttttcccag

SEQ ID NO: 6912323 - DNA, 22 bp, Homo sapiens
tagataaaagggcaaagggcat

SEQ ID NO: 6912324 - DNA, 22 bp, Homo sapiens
agcacagctggaaaataaatca

SEQ ID NO: 6912325 - DNA, 22 bp, Homo sapiens
gtgggtggatcatgaggtcagg

SEQ ID NO: 6912326 - DNA, 22 bp, Homo sapiens
gggctctggtgctattgacgaa

SEQ ID NO: 6912327 - DNA, 22 bp, Homo sapiens
actcactgcactttgaaatgtg

SEQ ID NO: 6912328 - DNA, 22 bp, Homo sapiens
aggcttcctcgtgccttagata

SEQ ID NO: 6912329 - DNA, 22 bp, Homo sapiens
actgggccaggggctttggagc

SEQ ID NO: 6912330 - DNA, 22 bp, Homo sapiens
aaggtctatggagaagactgag

SEQ ID NO: 6912331 - DNA, 19 bp, Homo sapiens
ttcccaggaaaggggtgca

SEQ ID NO: 6912332 - DNA, 22 bp, Homo sapiens
acttaggcttggttcagctaga

SEQ ID NO: 6912333 - DNA, 22 bp, Homo sapiens
ttggttacagactcttctctaa

SEQ ID NO: 6912334 - DNA, 19 bp, Homo sapiens
tctctcaattgcttcaatt

SEQ ID NO: 6912335 - DNA, 22 bp, Homo sapiens
taccaaaaagtgagccccagag

SEQ ID NO: 6912336 - DNA, 22 bp, Homo sapiens
tcaggaggcgtctcgctggggc

SEQ ID NO: 6912337 - DNA, 22 bp, Homo sapiens
agttttctgttctacaatttga

SEQ ID NO: 6912338 - DNA, 22 bp, Homo sapiens
acagacctgattcaagtcttga

SEQ ID NO: 6912339 - DNA, 22 bp, Homo sapiens
atggctgcctagaggtgagatg

SEQ ID NO: 6912340 - DNA, 23 bp, Homo sapiens
tgcaaattaggccgggactcagc

SEQ ID NO: 6912341 - DNA, 19 bp, Homo sapiens
aatcagaaatatcgaggcc

SEQ ID NO: 6912342 - DNA, 23 bp, Homo sapiens
ctactgccttgcacaggctagat

SEQ ID NO: 6912343 - DNA, 22 bp, Homo sapiens
ttctctggggactgtctctatt

SEQ ID NO: 6912344 - DNA, 22 bp, Homo sapiens
atttggctaccatgaggatggg

SEQ ID NO: 6912345 - DNA, 22 bp, Homo sapiens
ttgaagtcagttcatattttta

SEQ ID NO: 6912346 - DNA, 22 bp, Homo sapiens
tagtttatgattttttggaagg

SEQ ID NO: 6912347 - DNA, 22 bp, Homo sapiens
acacattaacctttgaaattct

SEQ ID NO: 6912348 - DNA, 23 bp, Homo sapiens
atggacagaatgtttgtgttccc

SEQ ID NO: 6912349 - DNA, 22 bp, Homo sapiens
gctgtgtttgacagtagcagac

SEQ ID NO: 6912350 - DNA, 22 bp, Homo sapiens
tcaacacttgctggtttcctct

SEQ ID NO: 6912351 - DNA, 22 bp, Homo sapiens
atgacaagggttgacacatgtc

SEQ ID NO: 6912352 - DNA, 22 bp, Homo sapiens
cattgtttgtaaaattccagta

SEQ ID NO: 6912353 - DNA, 23 bp, Homo sapiens
tggtcctggttgaggtgggcccc

SEQ ID NO: 6912354 - DNA, 22 bp, Homo sapiens
tgcagagttgctttgatagtcc

SEQ ID NO: 6912355 - DNA, 22 bp, Homo sapiens
aaatagctgtatttaccctgta

SEQ ID NO: 6912356 - DNA, 22 bp, Homo sapiens
agatgttccagccaatgggaat

SEQ ID NO: 6912357 - DNA, 23 bp, Homo sapiens
ctctggttagatatcatatgctg

SEQ ID NO: 6912358 - DNA, 22 bp, Homo sapiens
tggctcagaactacttctagtt

SEQ ID NO: 6912359 - DNA, 22 bp, Homo sapiens
catgctcacttttatactgtaa

SEQ ID NO: 6912360 - DNA, 22 bp, Homo sapiens
agggttctgccagtgtcttgag

SEQ ID NO: 6912361 - DNA, 20 bp, Homo sapiens
tgactctgcaaccgtctctc

SEQ ID NO: 6912362 - DNA, 22 bp, Homo sapiens
catttcaaaagaattgccagaa

SEQ ID NO: 6912363 - DNA, 22 bp, Homo sapiens
aggccacagagagtgcatgtgc

SEQ ID NO: 6912364 - DNA, 22 bp, Homo sapiens
aagtttgtggttatacttgatt

SEQ ID NO: 6912365 - DNA, 22 bp, Homo sapiens
cacactagtctatccattagct

SEQ ID NO: 6912366 - DNA, 22 bp, Homo sapiens
agcgcccaggggcagggctctc

SEQ ID NO: 6912367 - DNA, 22 bp, Homo sapiens
gctgcctttagggggtgctcag

SEQ ID NO: 6912368 - DNA, 22 bp, Homo sapiens
ctggagagaatgttcattgcag

SEQ ID NO: 6912369 - DNA, 22 bp, Homo sapiens
tgaagtgagtagtgtctagggg

SEQ ID NO: 6912370 - DNA, 22 bp, Homo sapiens
atgcatttttgagtatgaatga

SEQ ID NO: 6912371 - DNA, 22 bp, Homo sapiens
tgtcgattcagctcttcagaga

SEQ ID NO: 6912372 - DNA, 22 bp, Homo sapiens
ctggggaacgcagcgagcagcg

SEQ ID NO: 6912373 - DNA, 22 bp, Homo sapiens
ggcctttgcgtccacgccgctt

SEQ ID NO: 6912374 - DNA, 22 bp, Homo sapiens
gactgagggatagaggtgcttc

SEQ ID NO: 6912375 - DNA, 22 bp, Homo sapiens
gtggagcataacacactagcct

SEQ ID NO: 6912376 - DNA, 22 bp, Homo sapiens
tttctaatatcacttccagctg

SEQ ID NO: 6912377 - DNA, 22 bp, Homo sapiens
tctaaacattatgatagtagag

SEQ ID NO: 6912378 - DNA, 22 bp, Homo sapiens
acaatgtagttgtcatgagaca

SEQ ID NO: 6912379 - DNA, 21 bp, Homo sapiens
aacagttctctttgaaggtgt

SEQ ID NO: 6912380 - DNA, 22 bp, Homo sapiens
gtgggctgcccttgaggtcagc

SEQ ID NO: 6912381 - DNA, 22 bp, Homo sapiens
agtgtgagtaattcagggaggg

SEQ ID NO: 6912382 - DNA, 22 bp, Homo sapiens
atcatgtaccctaaaaatggaa

SEQ ID NO: 6912383 - DNA, 22 bp, Homo sapiens
agtggcacaattttgactcccc

SEQ ID NO: 6912384 - DNA, 22 bp, Homo sapiens
agtggcctggagccccgcctgg

SEQ ID NO: 6912385 - DNA, 22 bp, Homo sapiens
tttcactgtgttggtcaggccg

SEQ ID NO: 6912386 - DNA, 22 bp, Homo sapiens
atgccctgtgactctcctggac

SEQ ID NO: 6912387 - DNA, 22 bp, Homo sapiens
ctggagatactgctctccatat

SEQ ID NO: 6912388 - DNA, 22 bp, Homo sapiens
tctccccaaccatggcactcac

SEQ ID NO: 6912389 - DNA, 22 bp, Homo sapiens
agtgcaatgcagtagttcagca

SEQ ID NO: 6912390 - DNA, 22 bp, Homo sapiens
ctactgccattgtctctgccat

SEQ ID NO: 6912391 - DNA, 22 bp, Homo sapiens
tgggggtcctcctctgcttaag

SEQ ID NO: 6912392 - DNA, 22 bp, Homo sapiens
tctaaactgcgagcatgccccc

SEQ ID NO: 6912393 - DNA, 22 bp, Homo sapiens
catttccttcctgctgctcctc

SEQ ID NO: 6912394 - DNA, 22 bp, Homo sapiens
agcaggacaatatgggatcagg

SEQ ID NO: 6912395 - DNA, 22 bp, Homo sapiens
tagctttaatgagttggtaaga

SEQ ID NO: 6912396 - DNA, 22 bp, Homo sapiens
agcttcccacactctagtttcc

SEQ ID NO: 6912397 - DNA, 22 bp, Homo sapiens
aatttgtggccacattgtggaa

SEQ ID NO: 6912398 - DNA, 22 bp, Homo sapiens
cactgggacctaggactgagct

SEQ ID NO: 6912399 - DNA, 22 bp, Homo sapiens
cccttcagggttaagtagaggg

SEQ ID NO: 6912400 - DNA, 22 bp, Homo sapiens
gcttcagactgtgcttctgttg

SEQ ID NO: 6912401 - DNA, 22 bp, Homo sapiens
gcatttggaattgtgtatagaa

SEQ ID NO: 6912402 - DNA, 22 bp, Homo sapiens
tcctgtccacagccctgacctc

SEQ ID NO: 6912403 - DNA, 22 bp, Homo sapiens
gtggcaaggagcatgaaaagtc

SEQ ID NO: 6912404 - DNA, 22 bp, Homo sapiens
ggctgtggagctgcagagttgg

SEQ ID NO: 6912405 - DNA, 22 bp, Homo sapiens
tctcaggactcctctggccata

SEQ ID NO: 6912406 - DNA, 21 bp, Homo sapiens
tttaggaagtttaaggcaggt

SEQ ID NO: 6912407 - DNA, 20 bp, Homo sapiens
acagtagaagggatttcaaa

SEQ ID NO: 6912408 - DNA, 21 bp, Homo sapiens
acagcatgtttgtgtgtttgc

SEQ ID NO: 6912409 - DNA, 22 bp, Homo sapiens
taaggtaactgcttttggctga

SEQ ID NO: 6912410 - DNA, 22 bp, Homo sapiens
acattagagaagcttggagatg

SEQ ID NO: 6912411 - DNA, 22 bp, Homo sapiens
gtgccacttacctgggaggagt

SEQ ID NO: 6912412 - DNA, 22 bp, Homo sapiens
tgtcccatggacacaacttctt

SEQ ID NO: 6912413 - DNA, 22 bp, Homo sapiens
gcaccaggaggcccttctcatc

SEQ ID NO: 6912414 - DNA, 22 bp, Homo sapiens
ggtttccaagtggttgaaaagt

SEQ ID NO: 6912415 - DNA, 22 bp, Homo sapiens
aattcctgtcttaacagttctg

SEQ ID NO: 6912416 - DNA, 22 bp, Homo sapiens
cagggcaaagtcttctagaacc

SEQ ID NO: 6912417 - DNA, 22 bp, Homo sapiens
cagctttccagagacctgcccc

SEQ ID NO: 6912418 - DNA, 22 bp, Homo sapiens
ctcagtgtgagtgagaagtgca

SEQ ID NO: 6912419 - DNA, 19 bp, Homo sapiens
tataggaagtgtggttaag

SEQ ID NO: 6912420 - DNA, 22 bp, Homo sapiens
aaccaaagaaaactgtggtgag

SEQ ID NO: 6912421 - DNA, 22 bp, Homo sapiens
acactgtgatcttgagaaaggt

SEQ ID NO: 6912422 - DNA, 22 bp, Homo sapiens
atttgagcacctagataccctg

SEQ ID NO: 6912423 - DNA, 22 bp, Homo sapiens
ctgcatcttagtcaaaatctgt

SEQ ID NO: 6912424 - DNA, 17 bp, Homo sapiens
aggaatacagatcttca

SEQ ID NO: 6912425 - DNA, 22 bp, Homo sapiens
tttggaagggaaagaaagtact

SEQ ID NO: 6912426 - DNA, 22 bp, Homo sapiens
caggtggggagagtgtggagca

SEQ ID NO: 6912427 - DNA, 22 bp, Homo sapiens
agcagcattaagggaactgcag

SEQ ID NO: 6912428 - DNA, 22 bp, Homo sapiens
ggtgccttcctgccagccgcaa

SEQ ID NO: 6912429 - DNA, 22 bp, Homo sapiens
ggagatgacacaatttatttat

SEQ ID NO: 6912430 - DNA, 22 bp, Homo sapiens
tggatctggttccctgagcctt

SEQ ID NO: 6912431 - DNA, 22 bp, Homo sapiens
aagtatgtgatacatgttaatt

SEQ ID NO: 6912432 - DNA, 22 bp, Homo sapiens
cctttgttctgtgtatctttgt

SEQ ID NO: 6912433 - DNA, 22 bp, Homo sapiens
cctgagatttgtaatttttgta

SEQ ID NO: 6912434 - DNA, 21 bp, Homo sapiens
atgcatgttacagtatatgcc

SEQ ID NO: 6912435 - DNA, 22 bp, Homo sapiens
ggagagaactgacctgaaagga

SEQ ID NO: 6912436 - DNA, 22 bp, Homo sapiens
tgtttgaataacttggatatat

SEQ ID NO: 6912437 - DNA, 22 bp, Homo sapiens
gagtgcttgcatatttattgtc

SEQ ID NO: 6912438 - DNA, 22 bp, Homo sapiens
ttctttgcccttaatgaaataa

SEQ ID NO: 6912439 - DNA, 22 bp, Homo sapiens
gcctctgcatgctcagcaccca

SEQ ID NO: 6912440 - DNA, 22 bp, Homo sapiens
aactgcagttacttttgcacca

SEQ ID NO: 6912441 - DNA, 22 bp, Homo sapiens
tgacagcagcatagtgagcaat

SEQ ID NO: 6912442 - DNA, 22 bp, Homo sapiens
actccaggatgtagaatcagag

SEQ ID NO: 6912443 - DNA, 22 bp, Homo sapiens
agagatctgtgcttactacaag

SEQ ID NO: 6912444 - DNA, 22 bp, Homo sapiens
agctaaatgttgcttaaaattt

SEQ ID NO: 6912445 - DNA, 22 bp, Homo sapiens
ctgaggtagaggaaatgtagct

SEQ ID NO: 6912446 - DNA, 22 bp, Homo sapiens
taggtccacagatttggtttct

SEQ ID NO: 6912447 - DNA, 19 bp, Homo sapiens
ggaagccctaaaggaccta

SEQ ID NO: 6912448 - DNA, 22 bp, Homo sapiens
cctggcatgtcctcctggcatg

SEQ ID NO: 6912449 - DNA, 23 bp, Homo sapiens
aggtggtcttgtggatgctgcaa

SEQ ID NO: 6912450 - DNA, 22 bp, Homo sapiens
caggtctgtttccatcagtgct

SEQ ID NO: 6912451 - DNA, 22 bp, Homo sapiens
tgacttttggacctcactgtcc

SEQ ID NO: 6912452 - DNA, 22 bp, Homo sapiens
ggccgtcagccccgatttgcca

SEQ ID NO: 6912453 - DNA, 22 bp, Homo sapiens
ccagctgcggtctcccaaagtt

SEQ ID NO: 6912454 - DNA, 22 bp, Homo sapiens
tttaggatctctcttgttacat

SEQ ID NO: 6912455 - DNA, 22 bp, Homo sapiens
gtgctcctcacagtgtggccct

SEQ ID NO: 6912456 - DNA, 22 bp, Homo sapiens
ttcctcagaccctcattgtgag

SEQ ID NO: 6912457 - DNA, 22 bp, Homo sapiens
gccaccatgtctggctgagttt

SEQ ID NO: 6912458 - DNA, 22 bp, Homo sapiens
tattgctttctcagacgtttag

SEQ ID NO: 6912459 - DNA, 22 bp, Homo sapiens
ggactaaactattgacatagtg

SEQ ID NO: 6912460 - DNA, 22 bp, Homo sapiens
gctcttgtcagagaggccagct

SEQ ID NO: 6912461 - DNA, 22 bp, Homo sapiens
gtcagctgtctccccagagtgg

SEQ ID NO: 6912462 - DNA, 22 bp, Homo sapiens
aacagtactggacaaggagtca

SEQ ID NO: 6912463 - DNA, 22 bp, Homo sapiens
tccaatattcattaaaatgcag

SEQ ID NO: 6912464 - DNA, 22 bp, Homo sapiens
agacatttcctgtgaacctact

SEQ ID NO: 6912465 - DNA, 22 bp, Homo sapiens
gtagtacatcgttatgtaatat

SEQ ID NO: 6912466 - DNA, 22 bp, Homo sapiens
agctcagcgggcttctggtaag

SEQ ID NO: 6912467 - DNA, 22 bp, Homo sapiens
caggctggagtgcagtggcgcc

SEQ ID NO: 6912468 - DNA, 22 bp, Homo sapiens
aggggtcttgaggactccagca

SEQ ID NO: 6912469 - DNA, 22 bp, Homo sapiens
tcctcatctttcaggatttagc

SEQ ID NO: 6912470 - DNA, 22 bp, Homo sapiens
aactgcagttacctttgcacca

SEQ ID NO: 6912471 - DNA, 22 bp, Homo sapiens
atcagagctagtacttgcaggt

SEQ ID NO: 6912472 - DNA, 22 bp, Homo sapiens
gaggatcatttgagcctaggag

SEQ ID NO: 6912473 - DNA, 22 bp, Homo sapiens
taattgctcgagaaataacctc

SEQ ID NO: 6912474 - DNA, 22 bp, Homo sapiens
ggttctgctactctcttgctta

SEQ ID NO: 6912475 - DNA, 22 bp, Homo sapiens
actgcttttagaaatctataga

SEQ ID NO: 6912476 - DNA, 22 bp, Homo sapiens
ctcaccagacatggaacctgtc

SEQ ID NO: 6912477 - DNA, 22 bp, Homo sapiens
atgtgtaccccttggttcagtg

SEQ ID NO: 6912478 - DNA, 22 bp, Homo sapiens
tccttacactggggaaggtgta

SEQ ID NO: 6912479 - DNA, 22 bp, Homo sapiens
agtaaagcattgtcttcagagt

SEQ ID NO: 6912480 - DNA, 22 bp, Homo sapiens
ttggctgcaatcacagggactc

SEQ ID NO: 6912481 - DNA, 22 bp, Homo sapiens
tggatttcagcaagggtgggtg

SEQ ID NO: 6912482 - DNA, 22 bp, Homo sapiens
tacaaaagtaattacggttttt

SEQ ID NO: 6912483 - DNA, 22 bp, Homo sapiens
gcagctccctggctgcaaatga

SEQ ID NO: 6912484 - DNA, 22 bp, Homo sapiens
ttccagcttagagcatcatgtt

SEQ ID NO: 6912485 - DNA, 22 bp, Homo sapiens
ggctgctttatcggctgctgaa

SEQ ID NO: 6912486 - DNA, 22 bp, Homo sapiens
tacagaactgaagtagtgaaaa

SEQ ID NO: 6912487 - DNA, 22 bp, Homo sapiens
ctcacatacctgttttcccttt

SEQ ID NO: 6912488 - DNA, 22 bp, Homo sapiens
actaacttctgagaaccaattg

SEQ ID NO: 6912489 - DNA, 22 bp, Homo sapiens
tcatgcagtttgaagttcaggg

SEQ ID NO: 6912490 - DNA, 22 bp, Homo sapiens
aagatgaaaatttactgtgatg

SEQ ID NO: 6912491 - DNA, 16 bp, Homo sapiens
gccccaatgattctga

SEQ ID NO: 6912492 - DNA, 22 bp, Homo sapiens
gcacagactgtatcttaatcat

SEQ ID NO: 6912493 - DNA, 22 bp, Homo sapiens
atgacaacctgtgagctggtat

SEQ ID NO: 6912494 - DNA, 22 bp, Homo sapiens
attcagattcctaggtttcatt

SEQ ID NO: 6912495 - DNA, 22 bp, Homo sapiens
tattaggtagattttactgatt

SEQ ID NO: 6912496 - DNA, 22 bp, Homo sapiens
catctgtgccgggtgtttgtca

SEQ ID NO: 6912497 - DNA, 19 bp, Homo sapiens
ggcagaaggtgtaggggga

SEQ ID NO: 6912498 - DNA, 22 bp, Homo sapiens
actgacaccaccaatatgttca

SEQ ID NO: 6912499 - DNA, 22 bp, Homo sapiens
actgccagtcattccacaattt

SEQ ID NO: 6912500 - DNA, 22 bp, Homo sapiens
ttcttcccagccagcacagccc

SEQ ID NO: 6912501 - DNA, 22 bp, Homo sapiens
cagaaatgtactgacatgcagt

SEQ ID NO: 6912502 - DNA, 22 bp, Homo sapiens
ggtttccaccttgctatgagaa

SEQ ID NO: 6912503 - DNA, 22 bp, Homo sapiens
acagtctgagaattactgctct

SEQ ID NO: 6912504 - DNA, 22 bp, Homo sapiens
aagtggtttgattcagtttatg

SEQ ID NO: 6912505 - DNA, 18 bp, Homo sapiens
cgtttttccgggattgca

SEQ ID NO: 6912506 - DNA, 22 bp, Homo sapiens
cccagagtggagggtgcagaat

SEQ ID NO: 6912507 - DNA, 19 bp, Homo sapiens
gattttgctgaaacccaca

SEQ ID NO: 6912508 - DNA, 22 bp, Homo sapiens
ggggtggccaaggactctgacc

SEQ ID NO: 6912509 - DNA, 22 bp, Homo sapiens
gtgccctggatgactttggtct

SEQ ID NO: 6912510 - DNA, 21 bp, Homo sapiens
tagtgtcttaagagccttgca

SEQ ID NO: 6912511 - DNA, 22 bp, Homo sapiens
ctggctgtgaaatggcagtgtc

SEQ ID NO: 6912512 - DNA, 20 bp, Homo sapiens
aatttactcacagaatgaat

SEQ ID NO: 6912513 - DNA, 22 bp, Homo sapiens
atcttgaaaagcagcatggcct

SEQ ID NO: 6912514 - DNA, 22 bp, Homo sapiens
ttcctccctgcccacattgtgc

SEQ ID NO: 6912515 - DNA, 22 bp, Homo sapiens
tggaatgaatttggcttcctcc

SEQ ID NO: 6912516 - DNA, 22 bp, Homo sapiens
agtgctcataaaaatgtgaaac

SEQ ID NO: 6912517 - DNA, 20 bp, Homo sapiens
ctgcttgggcccctctggcc

SEQ ID NO: 6912518 - DNA, 22 bp, Homo sapiens
ttcagtatgctgaatgattttt

SEQ ID NO: 6912519 - DNA, 22 bp, Homo sapiens
cactggcaaagcctgttcctta

SEQ ID NO: 6912520 - DNA, 22 bp, Homo sapiens
ttgagcacttgagcagttgatg

SEQ ID NO: 6912521 - DNA, 22 bp, Homo sapiens
tgctagaagatagctagaagat

SEQ ID NO: 6912522 - DNA, 22 bp, Homo sapiens
ccagggatgcagaggttgcagt

SEQ ID NO: 6912523 - DNA, 22 bp, Homo sapiens
actgcctgtgtcccttcagtgc

SEQ ID NO: 6912524 - DNA, 21 bp, Homo sapiens
tcctccttcaagtcctggcct

SEQ ID NO: 6912525 - DNA, 22 bp, Homo sapiens
tttcacatggtactgcctgttt

SEQ ID NO: 6912526 - DNA, 22 bp, Homo sapiens
ctgaattactgaaggtcaactt

SEQ ID NO: 6912527 - DNA, 22 bp, Homo sapiens
ctcagtggagagcggtcctggg

SEQ ID NO: 6912528 - DNA, 22 bp, Homo sapiens
gtgcgtgaggcccctgagcgaa

SEQ ID NO: 6912529 - DNA, 22 bp, Homo sapiens
gggtcaggaagaattctgccaa

SEQ ID NO: 6912530 - DNA, 22 bp, Homo sapiens
atgaggctctcaggggagctgt

SEQ ID NO: 6912531 - DNA, 22 bp, Homo sapiens
tctgagcagctttgttttgtgt

SEQ ID NO: 6912532 - DNA, 17 bp, Homo sapiens
tgctgtagctctaaagc

SEQ ID NO: 6912533 - DNA, 22 bp, Homo sapiens
tgcagagtaacgatcacatata

SEQ ID NO: 6912534 - DNA, 22 bp, Homo sapiens
gcctggcactcactgaagaggc

SEQ ID NO: 6912535 - DNA, 22 bp, Homo sapiens
attttcatgactaccttaaata

SEQ ID NO: 6912536 - DNA, 22 bp, Homo sapiens
ggctcctgggcgtcttcgaaca

SEQ ID NO: 6912537 - DNA, 22 bp, Homo sapiens
aaggctttaaataaccgtaaag

SEQ ID NO: 6912538 - DNA, 17 bp, Homo sapiens
aggcaggagattggaga

SEQ ID NO: 6912539 - DNA, 22 bp, Homo sapiens
gcctttggagatgtcataggat

SEQ ID NO: 6912540 - DNA, 21 bp, Homo sapiens
cctgagggtggttgtgaagat

SEQ ID NO: 6912541 - DNA, 22 bp, Homo sapiens
aggtcaaggctgcagtgagctg

SEQ ID NO: 6912542 - DNA, 22 bp, Homo sapiens
aagcaaggcccagagcatcagc

SEQ ID NO: 6912543 - DNA, 21 bp, Homo sapiens
cctgtaccactgtaagatgcc

SEQ ID NO: 6912544 - DNA, 22 bp, Homo sapiens
tcacacagtggtaaaaccctga

SEQ ID NO: 6912545 - DNA, 22 bp, Homo sapiens
agaggattgttactgattagct

SEQ ID NO: 6912546 - DNA, 22 bp, Homo sapiens
tcaaggcctatcctcatttgta

SEQ ID NO: 6912547 - DNA, 22 bp, Homo sapiens
aactagtaaaagcaacagtata

SEQ ID NO: 6912548 - DNA, 22 bp, Homo sapiens
agccttgggcaatttggacact

SEQ ID NO: 6912549 - DNA, 22 bp, Homo sapiens
aggagcctgagtcacagtgcct

SEQ ID NO: 6912550 - DNA, 22 bp, Homo sapiens
aggtggtcactaactgccaaga

SEQ ID NO: 6912551 - DNA, 22 bp, Homo sapiens
aggctctgccaattccttcctc

SEQ ID NO: 6912552 - DNA, 22 bp, Homo sapiens
gttaccctttctgcaggacttg

SEQ ID NO: 6912553 - DNA, 21 bp, Homo sapiens
cagaatccagtctcttattac

SEQ ID NO: 6912554 - DNA, 22 bp, Homo sapiens
cccctccctgacctggttgggc

SEQ ID NO: 6912555 - DNA, 22 bp, Homo sapiens
taagattatttggaggccaaga

SEQ ID NO: 6912556 - DNA, 22 bp, Homo sapiens
tgagcacctggaccagattctg

SEQ ID NO: 6912557 - DNA, 22 bp, Homo sapiens
ccagtgcgagcctgtgctggcc

SEQ ID NO: 6912558 - DNA, 22 bp, Homo sapiens
tcacattttcttaggaaactta

SEQ ID NO: 6912559 - DNA, 22 bp, Homo sapiens
gaagattaaatgaagtgacctg

SEQ ID NO: 6912560 - DNA, 22 bp, Homo sapiens
tctctctgccaactcacagcca

SEQ ID NO: 6912561 - DNA, 22 bp, Homo sapiens
attccacttgattttaggggaa

SEQ ID NO: 6912562 - DNA, 23 bp, Homo sapiens
aaagtacttaatctgcaaaccac

SEQ ID NO: 6912563 - DNA, 22 bp, Homo sapiens
tatgtgacatatctcagtttga

SEQ ID NO: 6912564 - DNA, 22 bp, Homo sapiens
ctggctgctggcctgaggatgc

SEQ ID NO: 6912565 - DNA, 22 bp, Homo sapiens
catggaacaaggaagatgtttg

SEQ ID NO: 6912566 - DNA, 18 bp, Homo sapiens
gaattgtgctaaggtgat

SEQ ID NO: 6912567 - DNA, 22 bp, Homo sapiens
tctagaatactgtgacatgcca

SEQ ID NO: 6912568 - DNA, 22 bp, Homo sapiens
tgtcatccaagagtttccagca

SEQ ID NO: 6912569 - DNA, 22 bp, Homo sapiens
gctcccacctttgctatcagta

SEQ ID NO: 6912570 - DNA, 22 bp, Homo sapiens
cccttgggcttcagccctaccg

SEQ ID NO: 6912571 - DNA, 22 bp, Homo sapiens
tagcaaagaccaaagctagttg

SEQ ID NO: 6912572 - DNA, 22 bp, Homo sapiens
actcaagtggccttgatggctt

SEQ ID NO: 6912573 - DNA, 22 bp, Homo sapiens
gctgacccctacaggttgtgtt

SEQ ID NO: 6912574 - DNA, 21 bp, Homo sapiens
gtcctgtagctgtctggtctt

SEQ ID NO: 6912575 - DNA, 22 bp, Homo sapiens
tagtgattctgtgagcctttac

SEQ ID NO: 6912576 - DNA, 22 bp, Homo sapiens
gactgtacttgagagaggaact

SEQ ID NO: 6912577 - DNA, 21 bp, Homo sapiens
tcttgtgtgggaaacaatttg

SEQ ID NO: 6912578 - DNA, 22 bp, Homo sapiens
ctgtggctctccaatggaggga

SEQ ID NO: 6912579 - DNA, 22 bp, Homo sapiens
gtcccagatgtctggaactccc

SEQ ID NO: 6912580 - DNA, 22 bp, Homo sapiens
ctctgaggtcagggcccggcaa

SEQ ID NO: 6912581 - DNA, 19 bp, Homo sapiens
tcaaagtctgagtcacttt

SEQ ID NO: 6912582 - DNA, 22 bp, Homo sapiens
acaaatatggtactcggagaaa

SEQ ID NO: 6912583 - DNA, 22 bp, Homo sapiens
atgaccagactctcagtggggt

SEQ ID NO: 6912584 - DNA, 20 bp, Homo sapiens
gacaacagagtaccaggaag

SEQ ID NO: 6912585 - DNA, 22 bp, Homo sapiens
gattaatagacacaaccaagct

SEQ ID NO: 6912586 - DNA, 22 bp, Homo sapiens
tgtaacatcactaccatgtggt

SEQ ID NO: 6912587 - DNA, 20 bp, Homo sapiens
acacagtgacaggaaagaga

SEQ ID NO: 6912588 - DNA, 22 bp, Homo sapiens
gcttccggagccaaaaggcccc

SEQ ID NO: 6912589 - DNA, 22 bp, Homo sapiens
gggctgggcatggtgttccctc

SEQ ID NO: 6912590 - DNA, 23 bp, Homo sapiens
tgttgtgactggatgctttgtcc

SEQ ID NO: 6912591 - DNA, 22 bp, Homo sapiens
ctctctggcccatcctgttgcc

SEQ ID NO: 6912592 - DNA, 22 bp, Homo sapiens
gcagagatgatgataagcctgc

SEQ ID NO: 6912593 - DNA, 22 bp, Homo sapiens
gccactgtgttgatctagcctg

SEQ ID NO: 6912594 - DNA, 22 bp, Homo sapiens
ctctctggcttggcacggagat

SEQ ID NO: 6912595 - DNA, 22 bp, Homo sapiens
ctccattgttcgcgcagctgca

SEQ ID NO: 6912596 - DNA, 22 bp, Homo sapiens
tcctgggcagaatgggatggct

SEQ ID NO: 6912597 - DNA, 22 bp, Homo sapiens
cggaggggatacattttctgaa

SEQ ID NO: 6912598 - DNA, 21 bp, Homo sapiens
aacttgtatttctccttattc

SEQ ID NO: 6912599 - DNA, 22 bp, Homo sapiens
gttattagtaagactcgcacat

SEQ ID NO: 6912600 - DNA, 22 bp, Homo sapiens
tccctcacctagtctttgactc

SEQ ID NO: 6912601 - DNA, 22 bp, Homo sapiens
tcttctagtaggccaagaagct

SEQ ID NO: 6912602 - DNA, 22 bp, Homo sapiens
tttgccacattctatacatttg

SEQ ID NO: 6912603 - DNA, 22 bp, Homo sapiens
agaagagccactgttgacggca

SEQ ID NO: 6912604 - DNA, 22 bp, Homo sapiens
aacagcttgagactggatatgc

SEQ ID NO: 6912605 - DNA, 22 bp, Homo sapiens
atgttcaaacaagttaatgcca

SEQ ID NO: 6912606 - DNA, 22 bp, Homo sapiens
tgcagagtagtgaggggacaga

SEQ ID NO: 6912607 - DNA, 22 bp, Homo sapiens
tgcccctctcctgtgatccaag

SEQ ID NO: 6912608 - DNA, 22 bp, Homo sapiens
atggatgggatattgcttgcca

SEQ ID NO: 6912609 - DNA, 22 bp, Homo sapiens
aagtttctgggcaagacaaggc

SEQ ID NO: 6912610 - DNA, 20 bp, Homo sapiens
atacagtaggtgctcaatat

SEQ ID NO: 6912611 - DNA, 22 bp, Homo sapiens
aaaaacctttcccatactaaga

SEQ ID NO: 6912612 - DNA, 22 bp, Homo sapiens
tgactgtacctctaacacctga

SEQ ID NO: 6912613 - DNA, 23 bp, Homo sapiens
tgaagttcattctcactgatgta

SEQ ID NO: 6912614 - DNA, 22 bp, Homo sapiens
tgtaaagcaactgatctgctcc

SEQ ID NO: 6912615 - DNA, 21 bp, Homo sapiens
ctctggtcctgtctggcaggc

SEQ ID NO: 6912616 - DNA, 22 bp, Homo sapiens
atctgtaaagataatcatatgt

SEQ ID NO: 6912617 - DNA, 18 bp, Homo sapiens
tcatttgttttgcatgaa

SEQ ID NO: 6912618 - DNA, 22 bp, Homo sapiens
gacatagctcagagctcagcac

SEQ ID NO: 6912619 - DNA, 22 bp, Homo sapiens
tgtccaggagtaaaaagacctg

SEQ ID NO: 6912620 - DNA, 22 bp, Homo sapiens
cagagagcttagtgtgctgcat

SEQ ID NO: 6912621 - DNA, 22 bp, Homo sapiens
gtgaggaagtggtcaggcatcc

SEQ ID NO: 6912622 - DNA, 23 bp, Homo sapiens
aatgctggaaattcaggcatgat

SEQ ID NO: 6912623 - DNA, 22 bp, Homo sapiens
ttgggctgatctgtggaagaag

SEQ ID NO: 6912624 - DNA, 19 bp, Homo sapiens
attagtagctagtgcctgg

SEQ ID NO: 6912625 - DNA, 22 bp, Homo sapiens
ggggtagggtgattgtgaagta

SEQ ID NO: 6912626 - DNA, 22 bp, Homo sapiens
cagtaacagtgatcacctgtgg

SEQ ID NO: 6912627 - DNA, 22 bp, Homo sapiens
ttgttggtgaatagggtggaat

SEQ ID NO: 6912628 - DNA, 22 bp, Homo sapiens
tttgagcttgcatgagccttga

SEQ ID NO: 6912629 - DNA, 19 bp, Homo sapiens
ggagtttccaatgggtaaa

SEQ ID NO: 6912630 - DNA, 22 bp, Homo sapiens
ctgcctccaggctcaccttgac

SEQ ID NO: 6912631 - DNA, 22 bp, Homo sapiens
gttagcttgagcatttgccatg

SEQ ID NO: 6912632 - DNA, 22 bp, Homo sapiens
atgaggtaatagggcagtgggg

SEQ ID NO: 6912633 - DNA, 21 bp, Homo sapiens
agcattcaaaagatgccataa

SEQ ID NO: 6912634 - DNA, 22 bp, Homo sapiens
tagtgatttaatggcaagagga

SEQ ID NO: 6912635 - DNA, 22 bp, Homo sapiens
cctggctcaggcacgcatggct

SEQ ID NO: 6912636 - DNA, 22 bp, Homo sapiens
ttcaagatgtcttcacaatagt

SEQ ID NO: 6912637 - DNA, 22 bp, Homo sapiens
tgaatgatgaggggagaataat

SEQ ID NO: 6912638 - DNA, 22 bp, Homo sapiens
gctctgactggtgggccacagt

SEQ ID NO: 6912639 - DNA, 18 bp, Homo sapiens
tgagaaccatgttcattc

SEQ ID NO: 6912640 - DNA, 20 bp, Homo sapiens
agaggaggattattttattc

SEQ ID NO: 6912641 - DNA, 22 bp, Homo sapiens
gaggagtgccagccgtggagtc

SEQ ID NO: 6912642 - DNA, 18 bp, Homo sapiens
aagtccatgggtttggga

SEQ ID NO: 6912643 - DNA, 22 bp, Homo sapiens
ccaggcgtggcttcagcagccc

SEQ ID NO: 6912644 - DNA, 22 bp, Homo sapiens
tgcagtggtgtccaggtgtact

SEQ ID NO: 6912645 - DNA, 22 bp, Homo sapiens
aaccagagaaatggagtgataa

SEQ ID NO: 6912646 - DNA, 22 bp, Homo sapiens
ggcaaggtactctagagcacat

SEQ ID NO: 6912647 - DNA, 22 bp, Homo sapiens
tgcatgcaacaattcttctata

SEQ ID NO: 6912648 - DNA, 19 bp, Homo sapiens
acagtcagggaataaagac

SEQ ID NO: 6912649 - DNA, 22 bp, Homo sapiens
tgtggaatattagattaggttg

SEQ ID NO: 6912650 - DNA, 22 bp, Homo sapiens
cttagggagaatgcctctgcag

SEQ ID NO: 6912651 - DNA, 22 bp, Homo sapiens
ctggttattttgtttggcagag

SEQ ID NO: 6912652 - DNA, 22 bp, Homo sapiens
tgtgctccaacaatttatattc

SEQ ID NO: 6912653 - DNA, 18 bp, Homo sapiens
caggagcaggagttgaac

SEQ ID NO: 6912654 - DNA, 22 bp, Homo sapiens
gactgaaagcttggaatgttcc

SEQ ID NO: 6912655 - DNA, 22 bp, Homo sapiens
gcagcccaatggactgagacag

SEQ ID NO: 6912656 - DNA, 22 bp, Homo sapiens
cccactgctgctctccatggca

SEQ ID NO: 6912657 - DNA, 22 bp, Homo sapiens
aaactgcactttattttgtcaa

SEQ ID NO: 6912658 - DNA, 22 bp, Homo sapiens
atagttttgctgtcaggtccta

SEQ ID NO: 6912659 - DNA, 22 bp, Homo sapiens
tggaacactgtggatgagaaga

SEQ ID NO: 6912660 - DNA, 22 bp, Homo sapiens
gcgcaggagccgcggagggccg

SEQ ID NO: 6912661 - DNA, 22 bp, Homo sapiens
atgagctagaaaaccatgtgga

SEQ ID NO: 6912662 - DNA, 22 bp, Homo sapiens
tgagctgcttcttataatgtgt

SEQ ID NO: 6912663 - DNA, 22 bp, Homo sapiens
tctgggaggtactgggaggtgt

SEQ ID NO: 6912664 - DNA, 21 bp, Homo sapiens
tctagaagaggttgagaatat

SEQ ID NO: 6912665 - DNA, 22 bp, Homo sapiens
aaccacagacccagactagaga

SEQ ID NO: 6912666 - DNA, 22 bp, Homo sapiens
catcagtgtggcagttcactgt

SEQ ID NO: 6912667 - DNA, 19 bp, Homo sapiens
agctggagattggagggca

SEQ ID NO: 6912668 - DNA, 23 bp, Homo sapiens
aggtggagctgtgcagccggggc

SEQ ID NO: 6912669 - DNA, 19 bp, Homo sapiens
atcacctggtgtttccttg

SEQ ID NO: 6912670 - DNA, 22 bp, Homo sapiens
tcaaaccatataatcggttaca

SEQ ID NO: 6912671 - DNA, 22 bp, Homo sapiens
gggcaggtgtgcagagctgttg

SEQ ID NO: 6912672 - DNA, 22 bp, Homo sapiens
agtggcagagccaagtagagcc

SEQ ID NO: 6912673 - DNA, 18 bp, Homo sapiens
atgccctgttgacttcag

SEQ ID NO: 6912674 - DNA, 22 bp, Homo sapiens
gggctaggcttggccagcactg

SEQ ID NO: 6912675 - DNA, 22 bp, Homo sapiens
agggttgcttgagcccaggagt

SEQ ID NO: 6912676 - DNA, 22 bp, Homo sapiens
atgaaatattctttggtaagaa

SEQ ID NO: 6912677 - DNA, 22 bp, Homo sapiens
tctggagtctgagatctgagga

SEQ ID NO: 6912678 - DNA, 22 bp, Homo sapiens
tgtcccctgcccagggatggga

SEQ ID NO: 6912679 - DNA, 22 bp, Homo sapiens
cagccagggtcaggcagcttct

SEQ ID NO: 6912680 - DNA, 22 bp, Homo sapiens
ctcagactggtgggtaaaacct

SEQ ID NO: 6912681 - DNA, 22 bp, Homo sapiens
gtctcagttttccaaactgtca

SEQ ID NO: 6912682 - DNA, 22 bp, Homo sapiens
atcctggcaagcagaggagaac

SEQ ID NO: 6912683 - DNA, 22 bp, Homo sapiens
cttaattactgtccaatatgca

SEQ ID NO: 6912684 - DNA, 22 bp, Homo sapiens
agaacaaaattagaggagtgca

SEQ ID NO: 6912685 - DNA, 22 bp, Homo sapiens
gctggtggtaaggaggaaaaag

SEQ ID NO: 6912686 - DNA, 22 bp, Homo sapiens
gtgttacaaatcacctgtgctg

SEQ ID NO: 6912687 - DNA, 22 bp, Homo sapiens
atcaggatagtggttacctggg

SEQ ID NO: 6912688 - DNA, 22 bp, Homo sapiens
ttctccaagatgaagctgtgta

SEQ ID NO: 6912689 - DNA, 22 bp, Homo sapiens
atgatcaagaattttgtattcc

SEQ ID NO: 6912690 - DNA, 22 bp, Homo sapiens
ctgccttctttcaagggtaagc

SEQ ID NO: 6912691 - DNA, 20 bp, Homo sapiens
gaggctgaagtgtttttgct

SEQ ID NO: 6912692 - DNA, 22 bp, Homo sapiens
cacagaaatattgtgtcccttg

SEQ ID NO: 6912693 - DNA, 22 bp, Homo sapiens
agagtgggacacgggcgctgtc

SEQ ID NO: 6912694 - DNA, 21 bp, Homo sapiens
agagaagaggactttctcaca

SEQ ID NO: 6912695 - DNA, 22 bp, Homo sapiens
attagcacataagaggtatagg

SEQ ID NO: 6912696 - DNA, 18 bp, Homo sapiens
cacatttacctggctccc

SEQ ID NO: 6912697 - DNA, 22 bp, Homo sapiens
agccagaaccactggaacggtg

SEQ ID NO: 6912698 - DNA, 22 bp, Homo sapiens
atcacattacaaaggactccag

SEQ ID NO: 6912699 - DNA, 18 bp, Homo sapiens
atcacagagggggagtct

SEQ ID NO: 6912700 - DNA, 22 bp, Homo sapiens
ccacagtttaggaagtcactct

SEQ ID NO: 6912701 - DNA, 22 bp, Homo sapiens
acttatcgtagggaatttacta

SEQ ID NO: 6912702 - DNA, 20 bp, Homo sapiens
actaaggtggtagcagcagg

SEQ ID NO: 6912703 - DNA, 22 bp, Homo sapiens
catccagcccacgataaagagg

SEQ ID NO: 6912704 - DNA, 22 bp, Homo sapiens
agagcacaggtgctggagccca

SEQ ID NO: 6912705 - DNA, 16 bp, Homo sapiens
gcgcctcctcggcctc

SEQ ID NO: 6912706 - DNA, 22 bp, Homo sapiens
gagtagcagccacagaggaccc

SEQ ID NO: 6912707 - DNA, 22 bp, Homo sapiens
tacaaagtgaaataattctgag

SEQ ID NO: 6912708 - DNA, 22 bp, Homo sapiens
accttgcagtggaggtttagtg

SEQ ID NO: 6912709 - DNA, 22 bp, Homo sapiens
tatcaaggcatggaaaatgcta

SEQ ID NO: 6912710 - DNA, 22 bp, Homo sapiens
actgaagcacatttgccatgaa

SEQ ID NO: 6912711 - DNA, 22 bp, Homo sapiens
gtgctggctggggcatcaggca

SEQ ID NO: 6912712 - DNA, 22 bp, Homo sapiens
tagggagctctggcagaaggaa

SEQ ID NO: 6912713 - DNA, 23 bp, Homo sapiens
tctgtgctacaaatcgcgtctgt

SEQ ID NO: 6912714 - DNA, 22 bp, Homo sapiens
ctgtctgggtctacatcctctg

SEQ ID NO: 6912715 - DNA, 22 bp, Homo sapiens
caaaagtaattatggtttttgc

SEQ ID NO: 6912716 - DNA, 22 bp, Homo sapiens
tcagatttgtcctactaggcac

SEQ ID NO: 6912717 - DNA, 22 bp, Homo sapiens
gggcagtgtctgcaaatgaaca

SEQ ID NO: 6912718 - DNA, 22 bp, Homo sapiens
agcaatcaccacctctatattt

SEQ ID NO: 6912719 - DNA, 17 bp, Homo sapiens
aattgcttgtactccca

SEQ ID NO: 6912720 - DNA, 22 bp, Homo sapiens
cagttgatgggactcatgtggg

SEQ ID NO: 6912721 - DNA, 22 bp, Homo sapiens
agtgaggcaaagtgagaggcag

SEQ ID NO: 6912722 - DNA, 22 bp, Homo sapiens
tactgtactgcagttctgcaaa

SEQ ID NO: 6912723 - DNA, 22 bp, Homo sapiens
actgctttagacctagagctct

SEQ ID NO: 6912724 - DNA, 22 bp, Homo sapiens
tgtctctgtgcatttgtgcttc

SEQ ID NO: 6912725 - DNA, 22 bp, Homo sapiens
gtcatcatttttagcatatggg

SEQ ID NO: 6912726 - DNA, 22 bp, Homo sapiens
atggacaatgccaatacagttt

SEQ ID NO: 6912727 - DNA, 22 bp, Homo sapiens
ctctctgatgtcaggtcgctga

SEQ ID NO: 6912728 - DNA, 22 bp, Homo sapiens
ccgcagggaaagccccaggaag

SEQ ID NO: 6912729 - DNA, 22 bp, Homo sapiens
cccagctgtggcagaggccggg

SEQ ID NO: 6912730 - DNA, 22 bp, Homo sapiens
agataacatgttgcagattctg

SEQ ID NO: 6912731 - DNA, 17 bp, Homo sapiens
ctattgggccatttctt

SEQ ID NO: 6912732 - DNA, 22 bp, Homo sapiens
tgagcaccatctgtttgtgtgc

SEQ ID NO: 6912733 - DNA, 22 bp, Homo sapiens
atcagcagaccattttccaaat

SEQ ID NO: 6912734 - DNA, 22 bp, Homo sapiens
ctagggactgggaccttagtta

SEQ ID NO: 6912735 - DNA, 22 bp, Homo sapiens
gtgcccaggggccagctgccgg

SEQ ID NO: 6912736 - DNA, 22 bp, Homo sapiens
cagtccgccggcctcacccctg

SEQ ID NO: 6912737 - DNA, 21 bp, Homo sapiens
gggagggatggaaatgatgtt

SEQ ID NO: 6912738 - DNA, 22 bp, Homo sapiens
atctctccttatgaagcattat

SEQ ID NO: 6912739 - DNA, 18 bp, Homo sapiens
tggaatcattgtcaccat

SEQ ID NO: 6912740 - DNA, 22 bp, Homo sapiens
aacttccttctagttcatatgt

SEQ ID NO: 6912741 - DNA, 22 bp, Homo sapiens
tggtcctagccagggctctgct

SEQ ID NO: 6912742 - DNA, 22 bp, Homo sapiens
actcactcttaatcagactccc

SEQ ID NO: 6912743 - DNA, 22 bp, Homo sapiens
tgtttctaggtcaataattttt

SEQ ID NO: 6912744 - DNA, 22 bp, Homo sapiens
ccaaattctgtgttcaaactca

SEQ ID NO: 6912745 - DNA, 22 bp, Homo sapiens
tcatgtgacaggcactgttctg

SEQ ID NO: 6912746 - DNA, 22 bp, Homo sapiens
attcagtaggtgtgaacttatt

SEQ ID NO: 6912747 - DNA, 22 bp, Homo sapiens
ttctggagcttggcttgtatgt

SEQ ID NO: 6912748 - DNA, 22 bp, Homo sapiens
atgtttctataaagaagtttgg

SEQ ID NO: 6912749 - DNA, 22 bp, Homo sapiens
tcaatgcaatcattggacaagt

SEQ ID NO: 6912750 - DNA, 22 bp, Homo sapiens
gcaatgtctgcaatgggtgtgg

SEQ ID NO: 6912751 - DNA, 22 bp, Homo sapiens
tagatatttctactgtggatta

SEQ ID NO: 6912752 - DNA, 22 bp, Homo sapiens
tggaacaaacatggtgatggct

SEQ ID NO: 6912753 - DNA, 22 bp, Homo sapiens
gggtctgagggccttaccactc

SEQ ID NO: 6912754 - DNA, 22 bp, Homo sapiens
gcttcagacctgaaaggaaaaa

SEQ ID NO: 6912755 - DNA, 22 bp, Homo sapiens
tttcccaagaccatagatggaa

SEQ ID NO: 6912756 - DNA, 22 bp, Homo sapiens
agcactgattttgttgcactta

SEQ ID NO: 6912757 - DNA, 22 bp, Homo sapiens
gagtaccacttccctacacttt

SEQ ID NO: 6912758 - DNA, 22 bp, Homo sapiens
gcagtaggagtttccagggtgg

SEQ ID NO: 6912759 - DNA, 22 bp, Homo sapiens
aacaaatcttaaagtaattcaa

SEQ ID NO: 6912760 - DNA, 21 bp, Homo sapiens
tcatatctgctttgctgtctg

SEQ ID NO: 6912761 - DNA, 22 bp, Homo sapiens
tctcatgtattgccctggtgtg

SEQ ID NO: 6912762 - DNA, 22 bp, Homo sapiens
tctgtggcatgaggaaataggc

SEQ ID NO: 6912763 - DNA, 22 bp, Homo sapiens
tcctgctgccatttcaagtgct

SEQ ID NO: 6912764 - DNA, 22 bp, Homo sapiens
ccagcttggaatatgccattgt

SEQ ID NO: 6912765 - DNA, 22 bp, Homo sapiens
gaggccagactgccttttatga

SEQ ID NO: 6912766 - DNA, 22 bp, Homo sapiens
acacatcctgaccaagttcagg

SEQ ID NO: 6912767 - DNA, 22 bp, Homo sapiens
aagtttcatttctggatgctga

SEQ ID NO: 6912768 - DNA, 20 bp, Homo sapiens
caggccagaggtttgatggc

SEQ ID NO: 6912769 - DNA, 22 bp, Homo sapiens
tagggtggttagaaggagtatg

SEQ ID NO: 6912770 - DNA, 22 bp, Homo sapiens
gagcaatacatggcatgaaatt

SEQ ID NO: 6912771 - DNA, 21 bp, Homo sapiens
agaagccatgtggtggagaac

SEQ ID NO: 6912772 - DNA, 22 bp, Homo sapiens
tatagtgtgaggtaagggtcca

SEQ ID NO: 6912773 - DNA, 22 bp, Homo sapiens
agagtttaccactatttttggt

SEQ ID NO: 6912774 - DNA, 19 bp, Homo sapiens
tctcacaagcaacattgtt

SEQ ID NO: 6912775 - DNA, 22 bp, Homo sapiens
tattggcagcatgagctcctgg

SEQ ID NO: 6912776 - DNA, 22 bp, Homo sapiens
ttaatcaagagtggggactgtg

SEQ ID NO: 6912777 - DNA, 22 bp, Homo sapiens
ccaggtcctgttttcaccacag

SEQ ID NO: 6912778 - DNA, 22 bp, Homo sapiens
cctccctttgttgcaagggaaa

SEQ ID NO: 6912779 - DNA, 22 bp, Homo sapiens
ggagaggagattgtggcatttt

SEQ ID NO: 6912780 - DNA, 22 bp, Homo sapiens
aggtgcagtgaaggaaaaggaa

SEQ ID NO: 6912781 - DNA, 22 bp, Homo sapiens
ctggtccttgacgcgtgggagg

SEQ ID NO: 6912782 - DNA, 22 bp, Homo sapiens
ttgtatttgggtagtatagaga

SEQ ID NO: 6912783 - DNA, 22 bp, Homo sapiens
cattggaaaatgcatgcttttt

SEQ ID NO: 6912784 - DNA, 22 bp, Homo sapiens
aaatgcatatcaaagacttgaa

SEQ ID NO: 6912785 - DNA, 21 bp, Homo sapiens
agctgggtgctaatgacaact

SEQ ID NO: 6912786 - DNA, 22 bp, Homo sapiens
gtccttgaggaaacagatgtga

SEQ ID NO: 6912787 - DNA, 22 bp, Homo sapiens
agtaaattgtaccccagtggcc

SEQ ID NO: 6912788 - DNA, 22 bp, Homo sapiens
agctggtaaaggggaaagcaga

SEQ ID NO: 6912789 - DNA, 22 bp, Homo sapiens
ggcaggctggctttgttccagg

SEQ ID NO: 6912790 - DNA, 23 bp, Homo sapiens
cttctctgagctaggaatgctct

SEQ ID NO: 6912791 - DNA, 22 bp, Homo sapiens
ctggggtaggaggcagctgtgc

SEQ ID NO: 6912792 - DNA, 22 bp, Homo sapiens
gaagaatcaagcagtaatttgt

SEQ ID NO: 6912793 - DNA, 22 bp, Homo sapiens
tctaggggcaatgtgcaaggac

SEQ ID NO: 6912794 - DNA, 21 bp, Homo sapiens
tcactgaggttaaatagggtt

SEQ ID NO: 6912795 - DNA, 22 bp, Homo sapiens
cctggggctctgcacagagcag

SEQ ID NO: 6912796 - DNA, 22 bp, Homo sapiens
taggctcattttttaagtggtt

SEQ ID NO: 6912797 - DNA, 22 bp, Homo sapiens
atccacatttaggtctctaaaa

SEQ ID NO: 6912798 - DNA, 22 bp, Homo sapiens
ttcttaagtatttcagagactg

SEQ ID NO: 6912799 - DNA, 23 bp, Homo sapiens
tctcacagcgatctaggaagagg

SEQ ID NO: 6912800 - DNA, 22 bp, Homo sapiens
gtctgtgcagttactagctggt

SEQ ID NO: 6912801 - DNA, 22 bp, Homo sapiens
aggcagtgcagagtcctcttct

SEQ ID NO: 6912802 - DNA, 22 bp, Homo sapiens
gcgggtgatcacctgaggtcag

SEQ ID NO: 6912803 - DNA, 22 bp, Homo sapiens
aacactctgagtatagaccact

SEQ ID NO: 6912804 - DNA, 22 bp, Homo sapiens
gtttgaaagtggcaagtccttg

SEQ ID NO: 6912805 - DNA, 22 bp, Homo sapiens
tcctccagcttctcttttgggg

SEQ ID NO: 6912806 - DNA, 22 bp, Homo sapiens
gtccactctctgccgtgcctgt

SEQ ID NO: 6912807 - DNA, 22 bp, Homo sapiens
tgctttgtgtacacaagaatca

SEQ ID NO: 6912808 - DNA, 22 bp, Homo sapiens
ggactgaggacatgtgaggcat

SEQ ID NO: 6912809 - DNA, 22 bp, Homo sapiens
ctgattgtcagctgagctgaag

SEQ ID NO: 6912810 - DNA, 22 bp, Homo sapiens
agatggtcaaggatactgttca

SEQ ID NO: 6912811 - DNA, 22 bp, Homo sapiens
cctgtgtgtctgtcactgcaca

SEQ ID NO: 6912812 - DNA, 22 bp, Homo sapiens
cttcctgaatcttccatgtata

SEQ ID NO: 6912813 - DNA, 22 bp, Homo sapiens
taggaaacaaagtaatgcaact

SEQ ID NO: 6912814 - DNA, 22 bp, Homo sapiens
tagaggtgagacttcagtgaca

SEQ ID NO: 6912815 - DNA, 22 bp, Homo sapiens
agctggcattgcagggagctgc

SEQ ID NO: 6912816 - DNA, 22 bp, Homo sapiens
cttggctgaactccaggatgca

SEQ ID NO: 6912817 - DNA, 22 bp, Homo sapiens
gtgtccagtcatagcccagggc

SEQ ID NO: 6912818 - DNA, 22 bp, Homo sapiens
caggccagagtccaactccaga

SEQ ID NO: 6912819 - DNA, 22 bp, Homo sapiens
ttacatgggccatttagacatg

SEQ ID NO: 6912820 - DNA, 22 bp, Homo sapiens
agcaataagggatcctctataa

SEQ ID NO: 6912821 - DNA, 22 bp, Homo sapiens
cacaagtggctggggaaaggga

SEQ ID NO: 6912822 - DNA, 22 bp, Homo sapiens
ctcagtctcttgggctgtgaag

SEQ ID NO: 6912823 - DNA, 22 bp, Homo sapiens
gtcttattaaattgaaccctca

SEQ ID NO: 6912824 - DNA, 22 bp, Homo sapiens
ctgtaaacttctggaggtcaag

SEQ ID NO: 6912825 - DNA, 22 bp, Homo sapiens
aaaagtaattgcagttttgcca

SEQ ID NO: 6912826 - DNA, 22 bp, Homo sapiens
gcattgtcctgcttctgagtgt

SEQ ID NO: 6912827 - DNA, 19 bp, Homo sapiens
ggtgtttcttcattttcca

SEQ ID NO: 6912828 - DNA, 22 bp, Homo sapiens
acagtacaagcatgatacataa

SEQ ID NO: 6912829 - DNA, 22 bp, Homo sapiens
gggcaaagtggtggaggcagtt

SEQ ID NO: 6912830 - DNA, 22 bp, Homo sapiens
tattctctgcagctgaatgttt

SEQ ID NO: 6912831 - DNA, 22 bp, Homo sapiens
actccttactaaaaggaacata

SEQ ID NO: 6912832 - DNA, 22 bp, Homo sapiens
aggccagctatgactctgctcc

SEQ ID NO: 6912833 - DNA, 20 bp, Homo sapiens
ttctccaaaggagacactag

SEQ ID NO: 6912834 - DNA, 22 bp, Homo sapiens
agatcagaaagccaatatcata

SEQ ID NO: 6912835 - DNA, 22 bp, Homo sapiens
gccttgaactcatgtatattga

SEQ ID NO: 6912836 - DNA, 22 bp, Homo sapiens
gggagctgccttagaccggagg

SEQ ID NO: 6912837 - DNA, 22 bp, Homo sapiens
gatacacaagtggaaggagacg

SEQ ID NO: 6912838 - DNA, 22 bp, Homo sapiens
cgtgcatgtaagtttaccgtca

SEQ ID NO: 6912839 - DNA, 22 bp, Homo sapiens
agcagcagatccaaaaaatgtg

SEQ ID NO: 6912840 - DNA, 22 bp, Homo sapiens
ggcagtgtccttgcagctctac

SEQ ID NO: 6912841 - DNA, 22 bp, Homo sapiens
acccatgtgctcttttgtaccc

SEQ ID NO: 6912842 - DNA, 22 bp, Homo sapiens
ttggccaaccagaacggaggtc

SEQ ID NO: 6912843 - DNA, 22 bp, Homo sapiens
ggcttctcagcacactgtccac

SEQ ID NO: 6912844 - DNA, 22 bp, Homo sapiens
aagtcactgtgaaaggtgaagc

SEQ ID NO: 6912845 - DNA, 22 bp, Homo sapiens
tccaggagggattgggctgtgg

SEQ ID NO: 6912846 - DNA, 22 bp, Homo sapiens
actctgggttctttcacttgac

SEQ ID NO: 6912847 - DNA, 22 bp, Homo sapiens
caggcactgtgctagatccttg

SEQ ID NO: 6912848 - DNA, 22 bp, Homo sapiens
cctgggtgacccgtgagcgtcc

SEQ ID NO: 6912849 - DNA, 22 bp, Homo sapiens
tattaataaatatgtaggggcc

SEQ ID NO: 6912850 - DNA, 21 bp, Homo sapiens
gtcaggagccgtcttacattc

SEQ ID NO: 6912851 - DNA, 22 bp, Homo sapiens
agattgggattagagatctgta

SEQ ID NO: 6912852 - DNA, 18 bp, Homo sapiens
gaagtgaagtgactcaat

SEQ ID NO: 6912853 - DNA, 22 bp, Homo sapiens
atttcatggcagactttaaccc

SEQ ID NO: 6912854 - DNA, 22 bp, Homo sapiens
aaattggatgcacatttagaaa

SEQ ID NO: 6912855 - DNA, 22 bp, Homo sapiens
atgctgttattctaatgtgtga

SEQ ID NO: 6912856 - DNA, 22 bp, Homo sapiens
atttcagtagaaaatcttgatt

SEQ ID NO: 6912857 - DNA, 22 bp, Homo sapiens
atgttatagttataaaatgagg

SEQ ID NO: 6912858 - DNA, 22 bp, Homo sapiens
cagctttcatcagtgacactca

SEQ ID NO: 6912859 - DNA, 22 bp, Homo sapiens
actgccaggtaagtgctcctgc

SEQ ID NO: 6912860 - DNA, 22 bp, Homo sapiens
agctctcaagataagaaagaac

SEQ ID NO: 6912861 - DNA, 22 bp, Homo sapiens
ttgagaggctgttgacattctg

SEQ ID NO: 6912862 - DNA, 22 bp, Homo sapiens
tacagtgtatgtatttgtaggt

SEQ ID NO: 6912863 - DNA, 22 bp, Homo sapiens
gagtcaagtccagtgaggctga

SEQ ID NO: 6912864 - DNA, 22 bp, Homo sapiens
tgcatgtttgtaggttcttcta

SEQ ID NO: 6912865 - DNA, 22 bp, Homo sapiens
ccatgccttcctttccctggaa

SEQ ID NO: 6912866 - DNA, 22 bp, Homo sapiens
tgaataaattgagagcgaatgt

SEQ ID NO: 6912867 - DNA, 22 bp, Homo sapiens
tgtcacataatttatctgtagg

SEQ ID NO: 6912868 - DNA, 22 bp, Homo sapiens
tatggctgttacagctgggaga

SEQ ID NO: 6912869 - DNA, 22 bp, Homo sapiens
ttacacactctgccctgctgtt

SEQ ID NO: 6912870 - DNA, 22 bp, Homo sapiens
ggctggcttgcggagtcacaga

SEQ ID NO: 6912871 - DNA, 22 bp, Homo sapiens
catgggctctctgagctccagg

SEQ ID NO: 6912872 - DNA, 22 bp, Homo sapiens
attgtaagaggtttggctgtgt

SEQ ID NO: 6912873 - DNA, 22 bp, Homo sapiens
tcagaattgtggagaaagggga

SEQ ID NO: 6912874 - DNA, 22 bp, Homo sapiens
acagttaattgttgttgggtgt

SEQ ID NO: 6912875 - DNA, 22 bp, Homo sapiens
tttctgctttcagagtgagaca

SEQ ID NO: 6912876 - DNA, 22 bp, Homo sapiens
ttgcatttgacaaattatttaa

SEQ ID NO: 6912877 - DNA, 22 bp, Homo sapiens
tctgaccaggctggctcagggc

SEQ ID NO: 6912878 - DNA, 22 bp, Homo sapiens
gggaaagacttattttgacttc

SEQ ID NO: 6912879 - DNA, 19 bp, Homo sapiens
cagcagccagggggcccct

SEQ ID NO: 6912880 - DNA, 22 bp, Homo sapiens
ctgtggccttggaccagcatct

SEQ ID NO: 6912881 - DNA, 22 bp, Homo sapiens
cagctgtggggagcttgggcca

SEQ ID NO: 6912882 - DNA, 22 bp, Homo sapiens
ttagacaggatgtatgaaagct

SEQ ID NO: 6912883 - DNA, 22 bp, Homo sapiens
agtagataccagttctttgact

SEQ ID NO: 6912884 - DNA, 22 bp, Homo sapiens
tctgggatagggccagaacatg

SEQ ID NO: 6912885 - DNA, 22 bp, Homo sapiens
aacagctagaattctactggct

SEQ ID NO: 6912886 - DNA, 22 bp, Homo sapiens
tgataaacttagaaagaatgtt

SEQ ID NO: 6912887 - DNA, 22 bp, Homo sapiens
gtggtcagttaaggttgaaacg

SEQ ID NO: 6912888 - DNA, 22 bp, Homo sapiens
taatagaaaggtattttttgca

SEQ ID NO: 6912889 - DNA, 22 bp, Homo sapiens
gtcaggatctcccagtacatat

SEQ ID NO: 6912890 - DNA, 21 bp, Homo sapiens
ccctggttccactgtcaccgc

SEQ ID NO: 6912891 - DNA, 23 bp, Homo sapiens
aggctgcagaagaatagggtcat

SEQ ID NO: 6912892 - DNA, 22 bp, Homo sapiens
agagtcaaggtggcatttagct

SEQ ID NO: 6912893 - DNA, 22 bp, Homo sapiens
gtgctgctcacatctggaggta

SEQ ID NO: 6912894 - DNA, 22 bp, Homo sapiens
tagtcctaaaattcagctatat

SEQ ID NO: 6912895 - DNA, 22 bp, Homo sapiens
cattcataagactttgctcttg

SEQ ID NO: 6912896 - DNA, 22 bp, Homo sapiens
attcatagctcagtacagactc

SEQ ID NO: 6912897 - DNA, 22 bp, Homo sapiens
tcatctgttatgggagtttttg

SEQ ID NO: 6912898 - DNA, 22 bp, Homo sapiens
aagggctctctgcattgaaatt

SEQ ID NO: 6912899 - DNA, 22 bp, Homo sapiens
gagactgtcacttgggacctgt

SEQ ID NO: 6912900 - DNA, 22 bp, Homo sapiens
caggctgagctctggcctgggc

SEQ ID NO: 6912901 - DNA, 22 bp, Homo sapiens
tagctattcacttgttgatgga

SEQ ID NO: 6912902 - DNA, 22 bp, Homo sapiens
cacctgttgtttattcatctct

SEQ ID NO: 6912903 - DNA, 22 bp, Homo sapiens
ccaaagcaagtcacatgatcaa

SEQ ID NO: 6912904 - DNA, 22 bp, Homo sapiens
agtaacagcatctccactggaa

SEQ ID NO: 6912905 - DNA, 22 bp, Homo sapiens
caccaggctggagtgcagtggc

SEQ ID NO: 6912906 - DNA, 22 bp, Homo sapiens
tatagtgtctctagatcaaaga

SEQ ID NO: 6912907 - DNA, 22 bp, Homo sapiens
tcctggctcttctgagttttct

SEQ ID NO: 6912908 - DNA, 22 bp, Homo sapiens
gctgctcctgagtcccgcgcgc

SEQ ID NO: 6912909 - DNA, 22 bp, Homo sapiens
gggcaggatgcagtttcagaga

SEQ ID NO: 6912910 - DNA, 22 bp, Homo sapiens
tcaattctggtcctcaggaact

SEQ ID NO: 6912911 - DNA, 22 bp, Homo sapiens
taaagtcatctttaaacatgcc

SEQ ID NO: 6912912 - DNA, 22 bp, Homo sapiens
ctgccagaaggttcctgctgca

SEQ ID NO: 6912913 - DNA, 22 bp, Homo sapiens
cctccaggctggttatcagctg

SEQ ID NO: 6912914 - DNA, 22 bp, Homo sapiens
acaggtttgctgctgttttagg

SEQ ID NO: 6912915 - DNA, 22 bp, Homo sapiens
agtgggggcagagcctctctcg

SEQ ID NO: 6912916 - DNA, 22 bp, Homo sapiens
tgcctggatctgaggacccatt

SEQ ID NO: 6912917 - DNA, 22 bp, Homo sapiens
aaatgcctctgctgtacacaat

SEQ ID NO: 6912918 - DNA, 22 bp, Homo sapiens
tctgctggttccgaattaggcc

SEQ ID NO: 6912919 - DNA, 22 bp, Homo sapiens
tggcccaggtgcacccagaggc

SEQ ID NO: 6912920 - DNA, 22 bp, Homo sapiens
tggtataaaaatttgtgaatgt

SEQ ID NO: 6912921 - DNA, 22 bp, Homo sapiens
cctctgtacagcctctttattg

SEQ ID NO: 6912922 - DNA, 22 bp, Homo sapiens
ttaatggttagtaatggttatt

SEQ ID NO: 6912923 - DNA, 22 bp, Homo sapiens
tgtgatgtcagtggtatcaaag

SEQ ID NO: 6912924 - DNA, 22 bp, Homo sapiens
cctctccttgcacccgtcccgc

SEQ ID NO: 6912925 - DNA, 22 bp, Homo sapiens
gagtctctagtctggtcctggc

SEQ ID NO: 6912926 - DNA, 22 bp, Homo sapiens
aacactgtcttatacttcaatg

SEQ ID NO: 6912927 - DNA, 22 bp, Homo sapiens
ttgcttcctcgaggccagcgtg

SEQ ID NO: 6912928 - DNA, 22 bp, Homo sapiens
tcctgacttcagggggaggtga

SEQ ID NO: 6912929 - DNA, 22 bp, Homo sapiens
tggctctggagctggcggctga

SEQ ID NO: 6912930 - DNA, 22 bp, Homo sapiens
tgtggcagagtaaggacccagt

SEQ ID NO: 6912931 - DNA, 22 bp, Homo sapiens
cgctggaaattgccgttggctt

SEQ ID NO: 6912932 - DNA, 22 bp, Homo sapiens
taggccattgatttttataagt

SEQ ID NO: 6912933 - DNA, 22 bp, Homo sapiens
gacaaagcctaagaagtattta

SEQ ID NO: 6912934 - DNA, 22 bp, Homo sapiens
ctgtctgtcaccaaaacagact

SEQ ID NO: 6912935 - DNA, 22 bp, Homo sapiens
agatccagtggtgaacaaaaga

SEQ ID NO: 6912936 - DNA, 22 bp, Homo sapiens
gagctgtcctaccaggagtcct

SEQ ID NO: 6912937 - DNA, 22 bp, Homo sapiens
tgagataaggaagtaattagga

SEQ ID NO: 6912938 - DNA, 22 bp, Homo sapiens
ggcttctttcagagtgaataga

SEQ ID NO: 6912939 - DNA, 22 bp, Homo sapiens
ctctctctttagaagcgtctgg

SEQ ID NO: 6912940 - DNA, 22 bp, Homo sapiens
gtatgcatcgactcaagtctga

SEQ ID NO: 6912941 - DNA, 22 bp, Homo sapiens
ttgaaacattctcctattgatt

SEQ ID NO: 6912942 - DNA, 22 bp, Homo sapiens
tgcctgtgtcacagtgatgttt

SEQ ID NO: 6912943 - DNA, 22 bp, Homo sapiens
tagatgaaagagggcctgtgag

SEQ ID NO: 6912944 - DNA, 22 bp, Homo sapiens
aagtagcaaggaagattatgat

SEQ ID NO: 6912945 - DNA, 21 bp, Homo sapiens
aggcccagagtcttgggggga

SEQ ID NO: 6912946 - DNA, 18 bp, Homo sapiens
gtctaggaggtcacaagg

SEQ ID NO: 6912947 - DNA, 22 bp, Homo sapiens
cacctggaccctgggaggaggg

SEQ ID NO: 6912948 - DNA, 22 bp, Homo sapiens
accagagatggggcttctctgt

SEQ ID NO: 6912949 - DNA, 22 bp, Homo sapiens
ggctctggggggaagtctgttg

SEQ ID NO: 6912950 - DNA, 22 bp, Homo sapiens
tggtctgatttttcatctgttg

SEQ ID NO: 6912951 - DNA, 22 bp, Homo sapiens
tcaaggttgccaggaaggaaga

SEQ ID NO: 6912952 - DNA, 22 bp, Homo sapiens
aggtaactggctaactgaacga

SEQ ID NO: 6912953 - DNA, 22 bp, Homo sapiens
cccaggactcttcactgcagcc

SEQ ID NO: 6912954 - DNA, 22 bp, Homo sapiens
ctctggccccagtggccccttg

SEQ ID NO: 6912955 - DNA, 22 bp, Homo sapiens
cccatccctgattttcactcgt

SEQ ID NO: 6912956 - DNA, 22 bp, Homo sapiens
cctcttctaggacgtccttgtg

SEQ ID NO: 6912957 - DNA, 22 bp, Homo sapiens
agcttgcctcttaatcacctca

SEQ ID NO: 6912958 - DNA, 19 bp, Homo sapiens
accttgggcaagtgccttc

SEQ ID NO: 6912959 - DNA, 22 bp, Homo sapiens
acccacacctccgtatatcact

SEQ ID NO: 6912960 - DNA, 22 bp, Homo sapiens
tttgacaggactaacatatggc

SEQ ID NO: 6912961 - DNA, 22 bp, Homo sapiens
tttcagagatgtctagcctatt

SEQ ID NO: 6912962 - DNA, 22 bp, Homo sapiens
cctggctcctacgggtattttg

SEQ ID NO: 6912963 - DNA, 23 bp, Homo sapiens
aagatccattcaaattatgtatc

SEQ ID NO: 6912964 - DNA, 22 bp, Homo sapiens
tcaaggagcccacagtctaatg

SEQ ID NO: 6912965 - DNA, 22 bp, Homo sapiens
agagaatccccagacagagtta

SEQ ID NO: 6912966 - DNA, 19 bp, Homo sapiens
ttaaagtgcgagaagtctt

SEQ ID NO: 6912967 - DNA, 22 bp, Homo sapiens
atgaggaagtctgataatggta

SEQ ID NO: 6912968 - DNA, 22 bp, Homo sapiens
actcagctaaactcagtctatg

SEQ ID NO: 6912969 - DNA, 22 bp, Homo sapiens
tccaggaatttcccctttcctg

SEQ ID NO: 6912970 - DNA, 22 bp, Homo sapiens
cattatctgagagtgtcctaca

SEQ ID NO: 6912971 - DNA, 22 bp, Homo sapiens
tgcaaaaagagcgaggagccct

SEQ ID NO: 6912972 - DNA, 22 bp, Homo sapiens
agccttcagtaagggcttagca

SEQ ID NO: 6912973 - DNA, 22 bp, Homo sapiens
atcagcttaattctcaacaggt

SEQ ID NO: 6912974 - DNA, 21 bp, Homo sapiens
ggagggcagcccagactggct

SEQ ID NO: 6912975 - DNA, 22 bp, Homo sapiens
ctgggcatcatggtgcgggcac

SEQ ID NO: 6912976 - DNA, 22 bp, Homo sapiens
gagggggacgtatcctggtatg

SEQ ID NO: 6912977 - DNA, 22 bp, Homo sapiens
cagtcattttatttgaaaatta

SEQ ID NO: 6912978 - DNA, 22 bp, Homo sapiens
caagttctactgggacatcagt

SEQ ID NO: 6912979 - DNA, 22 bp, Homo sapiens
cctcagggtctctcacagcacc

SEQ ID NO: 6912980 - DNA, 23 bp, Homo sapiens
atccctagaagggaaatatagtg

SEQ ID NO: 6912981 - DNA, 22 bp, Homo sapiens
ggggtctgggttgctcggcctt

SEQ ID NO: 6912982 - DNA, 23 bp, Homo sapiens
ttctgcatgtttcagagctggga

SEQ ID NO: 6912983 - DNA, 22 bp, Homo sapiens
aggctaggccttgccctggaac

SEQ ID NO: 6912984 - DNA, 22 bp, Homo sapiens
cctggttgagggaggtgtggac

SEQ ID NO: 6912985 - DNA, 22 bp, Homo sapiens
atttcccactcaggccgcggcg

SEQ ID NO: 6912986 - DNA, 22 bp, Homo sapiens
tctttaaagttggagcttgcaa

SEQ ID NO: 6912987 - DNA, 22 bp, Homo sapiens
ctttggtctcttctaaagaatg

SEQ ID NO: 6912988 - DNA, 22 bp, Homo sapiens
ccagcaccttgatcttggagtt

SEQ ID NO: 6912989 - DNA, 22 bp, Homo sapiens
ctgattctttgaagatgcaccc

SEQ ID NO: 6912990 - DNA, 22 bp, Homo sapiens
tttcagaagtcacagttgactg

SEQ ID NO: 6912991 - DNA, 22 bp, Homo sapiens
taatgataagagaggttctggc

SEQ ID NO: 6912992 - DNA, 21 bp, Homo sapiens
aaagtgttcagaccagttctg

SEQ ID NO: 6912993 - DNA, 22 bp, Homo sapiens
agtccaggcgggtatagaggct

SEQ ID NO: 6912994 - DNA, 22 bp, Homo sapiens
actgccttgattgccagtttcc

SEQ ID NO: 6912995 - DNA, 21 bp, Homo sapiens
gcagccagccgagaccatgcc

SEQ ID NO: 6912996 - DNA, 22 bp, Homo sapiens
atatggatgagataatgagcca

SEQ ID NO: 6912997 - DNA, 22 bp, Homo sapiens
ctgctgtgttgccagtgtcacc

SEQ ID NO: 6912998 - DNA, 22 bp, Homo sapiens
atctgggcctgttccctcacct

SEQ ID NO: 6912999 - DNA, 22 bp, Homo sapiens
aggtgtggcttgaagtctctat

SEQ ID NO: 6913000 - DNA, 22 bp, Homo sapiens
ttctgttacctttgtgagtttc

SEQ ID NO: 6913001 - DNA, 20 bp, Homo sapiens
gagtgctttggcttgctctc

SEQ ID NO: 6913002 - DNA, 22 bp, Homo sapiens
tgactacctgttacaggtgagg

SEQ ID NO: 6913003 - DNA, 22 bp, Homo sapiens
tattctgcttcccgtggcacaa

SEQ ID NO: 6913004 - DNA, 23 bp, Homo sapiens
atgtcctgtgatgcttaatgacc

SEQ ID NO: 6913005 - DNA, 22 bp, Homo sapiens
gtctgtccaggagattcagtct

SEQ ID NO: 6913006 - DNA, 22 bp, Homo sapiens
ctgctgcattcctctttatgag

SEQ ID NO: 6913007 - DNA, 22 bp, Homo sapiens
caggtgaccctcagtgtggact

SEQ ID NO: 6913008 - DNA, 22 bp, Homo sapiens
gggatatagagaaggactggct

SEQ ID NO: 6913009 - DNA, 22 bp, Homo sapiens
aggaggccctagagctctagag

SEQ ID NO: 6913010 - DNA, 22 bp, Homo sapiens
aaggtctaaagctactgagttg

SEQ ID NO: 6913011 - DNA, 22 bp, Homo sapiens
acccaggatgataatgttcaca

SEQ ID NO: 6913012 - DNA, 22 bp, Homo sapiens
tgaggccagccacagccaccct

SEQ ID NO: 6913013 - DNA, 22 bp, Homo sapiens
tttatctgagctgatagatagt

SEQ ID NO: 6913014 - DNA, 22 bp, Homo sapiens
acttcagccaagaaaactcagt

SEQ ID NO: 6913015 - DNA, 22 bp, Homo sapiens
tcaggctacttcctttgaggct

SEQ ID NO: 6913016 - DNA, 22 bp, Homo sapiens
tcacagtgacttacagagattg

SEQ ID NO: 6913017 - DNA, 22 bp, Homo sapiens
cagtgtggcttagggaataggc

SEQ ID NO: 6913018 - DNA, 22 bp, Homo sapiens
ttgaggtctggcagtagcgttg

SEQ ID NO: 6913019 - DNA, 22 bp, Homo sapiens
ttgaggcacacacaggttgcat

SEQ ID NO: 6913020 - DNA, 22 bp, Homo sapiens
tggtatcaaacaattaattaga

SEQ ID NO: 6913021 - DNA, 22 bp, Homo sapiens
acagctggagtgttggtgaggt

SEQ ID NO: 6913022 - DNA, 22 bp, Homo sapiens
cctggcacagagcggtggtcac

SEQ ID NO: 6913023 - DNA, 22 bp, Homo sapiens
tggtttgtttgttcatgtaaaa

SEQ ID NO: 6913024 - DNA, 22 bp, Homo sapiens
tctggactaatattctggctgc

SEQ ID NO: 6913025 - DNA, 22 bp, Homo sapiens
tagaaagtggttgagagtttag

SEQ ID NO: 6913026 - DNA, 23 bp, Homo sapiens
accagctgccctgaactttgtgc

SEQ ID NO: 6913027 - DNA, 22 bp, Homo sapiens
gccagagtcttctgaccctgtg

SEQ ID NO: 6913028 - DNA, 22 bp, Homo sapiens
tgatatgtttggatttaggttt

SEQ ID NO: 6913029 - DNA, 22 bp, Homo sapiens
gagggctgataaatgcgcatgg

SEQ ID NO: 6913030 - DNA, 22 bp, Homo sapiens
tgctggtaccgcgcctccgcca

SEQ ID NO: 6913031 - DNA, 22 bp, Homo sapiens
tgggctcatggcccagcactgg

SEQ ID NO: 6913032 - DNA, 21 bp, Homo sapiens
gacaaacatttcatagcttta

SEQ ID NO: 6913033 - DNA, 22 bp, Homo sapiens
gaggaagaagggattagaactc

SEQ ID NO: 6913034 - DNA, 22 bp, Homo sapiens
gctttctaatctatttccttac

SEQ ID NO: 6913035 - DNA, 23 bp, Homo sapiens
tcagtagtgcaactttaaggcag

SEQ ID NO: 6913036 - DNA, 22 bp, Homo sapiens
tcacttaaaaattctagttatg

SEQ ID NO: 6913037 - DNA, 23 bp, Homo sapiens
ctggttcatagtcaagagattga

SEQ ID NO: 6913038 - DNA, 22 bp, Homo sapiens
ttgtaaatagtagtaagatgcc

SEQ ID NO: 6913039 - DNA, 19 bp, Homo sapiens
tctctctgtacattagata

SEQ ID NO: 6913040 - DNA, 22 bp, Homo sapiens
tcttggctgtaccattgactag

SEQ ID NO: 6913041 - DNA, 22 bp, Homo sapiens
gctccaggcgagctggaccaga

SEQ ID NO: 6913042 - DNA, 20 bp, Homo sapiens
gcaaggctccaaggggtgtg

SEQ ID NO: 6913043 - DNA, 22 bp, Homo sapiens
gaaatgtcatagtcttcaagcc

SEQ ID NO: 6913044 - DNA, 22 bp, Homo sapiens
aagcaacagaaacattctaata

SEQ ID NO: 6913045 - DNA, 22 bp, Homo sapiens
ctgaggtgtgctttcaatgggt

SEQ ID NO: 6913046 - DNA, 22 bp, Homo sapiens
agagcagagtggctgtagcttg

SEQ ID NO: 6913047 - DNA, 22 bp, Homo sapiens
tgtgtatacgagtatgaatatg

SEQ ID NO: 6913048 - DNA, 20 bp, Homo sapiens
tgagccaggctaggaagggc

SEQ ID NO: 6913049 - DNA, 22 bp, Homo sapiens
gttaggaagacaggagtgggtt

SEQ ID NO: 6913050 - DNA, 22 bp, Homo sapiens
gcatgagactagctcatgagca

SEQ ID NO: 6913051 - DNA, 22 bp, Homo sapiens
cagttgaggactcacctttgaa

SEQ ID NO: 6913052 - DNA, 22 bp, Homo sapiens
cagtccagagtaccccaagaag

SEQ ID NO: 6913053 - DNA, 22 bp, Homo sapiens
cagtggttggtagatacttgag

SEQ ID NO: 6913054 - DNA, 22 bp, Homo sapiens
ttctggcatctgggggaggcct

SEQ ID NO: 6913055 - DNA, 22 bp, Homo sapiens
tcaggtgacctgagccactatg

SEQ ID NO: 6913056 - DNA, 22 bp, Homo sapiens
tgcaagaaggcaataaactctt

SEQ ID NO: 6913057 - DNA, 22 bp, Homo sapiens
agtcagagtctattgctgtggt

SEQ ID NO: 6913058 - DNA, 23 bp, Homo sapiens
gggagccatgggtggtcatggag

SEQ ID NO: 6913059 - DNA, 22 bp, Homo sapiens
aaggacatttacaaggatttct

SEQ ID NO: 6913060 - DNA, 22 bp, Homo sapiens
agagtgtaccaaatatcctaca

SEQ ID NO: 6913061 - DNA, 22 bp, Homo sapiens
gcagctttctacttcctacagc

SEQ ID NO: 6913062 - DNA, 22 bp, Homo sapiens
tggctaggctggtgtcaagctc

SEQ ID NO: 6913063 - DNA, 22 bp, Homo sapiens
gacagacaggggttctcctgga

SEQ ID NO: 6913064 - DNA, 22 bp, Homo sapiens
acaagtctttttcatgtcttct

SEQ ID NO: 6913065 - DNA, 22 bp, Homo sapiens
agtcagtcaaaatataaattgt

SEQ ID NO: 6913066 - DNA, 22 bp, Homo sapiens
cccaatttcttcctcatttgcc

SEQ ID NO: 6913067 - DNA, 22 bp, Homo sapiens
agggtgcctgctgcaggttcag

SEQ ID NO: 6913068 - DNA, 17 bp, Homo sapiens
tctttcctgccatgctc

SEQ ID NO: 6913069 - DNA, 17 bp, Homo sapiens
gtgcctgttgtcctgga

SEQ ID NO: 6913070 - DNA, 22 bp, Homo sapiens
ctcagcaacacggcctattaag

SEQ ID NO: 6913071 - DNA, 22 bp, Homo sapiens
agaggcttgacaatatgattgg

SEQ ID NO: 6913072 - DNA, 22 bp, Homo sapiens
gtctggagggtgggtagagacc

SEQ ID NO: 6913073 - DNA, 22 bp, Homo sapiens
catccatcacaagtttgttcat

SEQ ID NO: 6913074 - DNA, 22 bp, Homo sapiens
cacagccatgtcctcattcttc

SEQ ID NO: 6913075 - DNA, 21 bp, Homo sapiens
ccagctctgcctccagttggt

SEQ ID NO: 6913076 - DNA, 22 bp, Homo sapiens
cctcagcagacacgcttctcac

SEQ ID NO: 6913077 - DNA, 22 bp, Homo sapiens
ctggcactcataggccagttca

SEQ ID NO: 6913078 - DNA, 22 bp, Homo sapiens
tcctgaattcctctttgcatcc

SEQ ID NO: 6913079 - DNA, 22 bp, Homo sapiens
tactaaaccctcgatggatctt

SEQ ID NO: 6913080 - DNA, 22 bp, Homo sapiens
ggaaagagcccagcagtgcttg

SEQ ID NO: 6913081 - DNA, 22 bp, Homo sapiens
aatggcacaagagtaaactgtt

SEQ ID NO: 6913082 - DNA, 22 bp, Homo sapiens
ctgacctgttacactagggctg

SEQ ID NO: 6913083 - DNA, 22 bp, Homo sapiens
taagtgatttataaggagatat

SEQ ID NO: 6913084 - DNA, 22 bp, Homo sapiens
agggacacactccagtgttatt

SEQ ID NO: 6913085 - DNA, 22 bp, Homo sapiens
atgtctgctttccttttaatca

SEQ ID NO: 6913086 - DNA, 22 bp, Homo sapiens
caaagcaggaagaatattgaaa

SEQ ID NO: 6913087 - DNA, 22 bp, Homo sapiens
agttctcaaggttaggaaaagt

SEQ ID NO: 6913088 - DNA, 22 bp, Homo sapiens
ggtgttggtctacaccagcact

SEQ ID NO: 6913089 - DNA, 22 bp, Homo sapiens
ctgttggatgtgacactgttag

SEQ ID NO: 6913090 - DNA, 22 bp, Homo sapiens
gcacatgaggctgtctttgtct

SEQ ID NO: 6913091 - DNA, 22 bp, Homo sapiens
catgtgtggagggcatgcatgg

SEQ ID NO: 6913092 - DNA, 22 bp, Homo sapiens
ttcctatagaaagctgtgtaga

SEQ ID NO: 6913093 - DNA, 22 bp, Homo sapiens
actttacaagcttatagcctag

SEQ ID NO: 6913094 - DNA, 22 bp, Homo sapiens
acaaaagaataagatgagtcat

SEQ ID NO: 6913095 - DNA, 22 bp, Homo sapiens
tagcttgcctctggctgcacgg

SEQ ID NO: 6913096 - DNA, 22 bp, Homo sapiens
ctggcagctgcccgagatgccc

SEQ ID NO: 6913097 - DNA, 22 bp, Homo sapiens
ttccagaaaactctgcctggta

SEQ ID NO: 6913098 - DNA, 22 bp, Homo sapiens
aggggcacttctcaggctgtgg

SEQ ID NO: 6913099 - DNA, 22 bp, Homo sapiens
tgcagcagaagtgttcttctct

SEQ ID NO: 6913100 - DNA, 22 bp, Homo sapiens
tgattctgtgaattagttgggt

SEQ ID NO: 6913101 - DNA, 22 bp, Homo sapiens
gcaggtaagagaggctggcttc

SEQ ID NO: 6913102 - DNA, 20 bp, Homo sapiens
atggccttcctctctgtcca

SEQ ID NO: 6913103 - DNA, 22 bp, Homo sapiens
tgggatatctgtcagcagcttc

SEQ ID NO: 6913104 - DNA, 22 bp, Homo sapiens
aggattttgctttataaaagcc

SEQ ID NO: 6913105 - DNA, 22 bp, Homo sapiens
gaagctgtgttgatggcatgga

SEQ ID NO: 6913106 - DNA, 22 bp, Homo sapiens
ggttaaacactttggaagtggc

SEQ ID NO: 6913107 - DNA, 22 bp, Homo sapiens
tctttggatggaaattggagtc

SEQ ID NO: 6913108 - DNA, 22 bp, Homo sapiens
gctctctgcctttctcaatgac

SEQ ID NO: 6913109 - DNA, 22 bp, Homo sapiens
ccacagggcctttcctgctggc

SEQ ID NO: 6913110 - DNA, 22 bp, Homo sapiens
tcagaaatagtctttaaaatga

SEQ ID NO: 6913111 - DNA, 22 bp, Homo sapiens
atgaggccagaccactctgcat

SEQ ID NO: 6913112 - DNA, 22 bp, Homo sapiens
tctctggcactcccttatggct

SEQ ID NO: 6913113 - DNA, 22 bp, Homo sapiens
tgactcaagagcctgactcatc

SEQ ID NO: 6913114 - DNA, 22 bp, Homo sapiens
aaccagctttgatacgcattat

SEQ ID NO: 6913115 - DNA, 22 bp, Homo sapiens
gacacttgacatccagcagcaa

SEQ ID NO: 6913116 - DNA, 22 bp, Homo sapiens
atgaagcagttaaggtgcatga

SEQ ID NO: 6913117 - DNA, 21 bp, Homo sapiens
tttgcacttccctgatggtta

SEQ ID NO: 6913118 - DNA, 22 bp, Homo sapiens
gcagagggtcctgtgccagcag

SEQ ID NO: 6913119 - DNA, 22 bp, Homo sapiens
ctggtgctgggcagggctcagg

SEQ ID NO: 6913120 - DNA, 19 bp, Homo sapiens
gtcaataaaagttaggggt

SEQ ID NO: 6913121 - DNA, 22 bp, Homo sapiens
agctgatgccatgtggaacagt

SEQ ID NO: 6913122 - DNA, 22 bp, Homo sapiens
gatagtcacctcccttaacttt

SEQ ID NO: 6913123 - DNA, 22 bp, Homo sapiens
attatgcatttgttagtattaa

SEQ ID NO: 6913124 - DNA, 22 bp, Homo sapiens
tcttttctagcaaatccaggag

SEQ ID NO: 6913125 - DNA, 22 bp, Homo sapiens
tggtggccttgatggcatctgc

SEQ ID NO: 6913126 - DNA, 22 bp, Homo sapiens
attggtcataaattgagtgatt

SEQ ID NO: 6913127 - DNA, 22 bp, Homo sapiens
gattaattcaggatcaggaaat

SEQ ID NO: 6913128 - DNA, 22 bp, Homo sapiens
gtggtgagattgctggatcaaa

SEQ ID NO: 6913129 - DNA, 22 bp, Homo sapiens
acacatgtttacagtcttcagt

SEQ ID NO: 6913130 - DNA, 22 bp, Homo sapiens
gatgcatgtatggagtgagggt

SEQ ID NO: 6913131 - DNA, 22 bp, Homo sapiens
agacagcatttctagcaccagg

SEQ ID NO: 6913132 - DNA, 22 bp, Homo sapiens
agatgtaccaggtattacagga

SEQ ID NO: 6913133 - DNA, 22 bp, Homo sapiens
atcaggaaagagtggaactctg

SEQ ID NO: 6913134 - DNA, 22 bp, Homo sapiens
cccaggcagtgtgtgcatgcgt

SEQ ID NO: 6913135 - DNA, 22 bp, Homo sapiens
gcttcatacaatggtatatgca

SEQ ID NO: 6913136 - DNA, 22 bp, Homo sapiens
agtcacttgattctcctgagct

SEQ ID NO: 6913137 - DNA, 22 bp, Homo sapiens
ggtcctggaagtgtaagtggca

SEQ ID NO: 6913138 - DNA, 22 bp, Homo sapiens
tattagcaacgtaacctctgaa

SEQ ID NO: 6913139 - DNA, 22 bp, Homo sapiens
tacctaatagtttgagtgtgga

SEQ ID NO: 6913140 - DNA, 21 bp, Homo sapiens
atgggcagaggcagagaggct

SEQ ID NO: 6913141 - DNA, 22 bp, Homo sapiens
ttgctttaggatttaagtggca

SEQ ID NO: 6913142 - DNA, 22 bp, Homo sapiens
ttttatatggcacattggttgg

SEQ ID NO: 6913143 - DNA, 22 bp, Homo sapiens
agctgcaaccttagctataggc

SEQ ID NO: 6913144 - DNA, 22 bp, Homo sapiens
tccagccattcattatgacacc

SEQ ID NO: 6913145 - DNA, 16 bp, Homo sapiens
ccacctgcagctctca

SEQ ID NO: 6913146 - DNA, 22 bp, Homo sapiens
ttcattggtactaggacaggac

SEQ ID NO: 6913147 - DNA, 22 bp, Homo sapiens
aggtctctgcagaaagtaagtc

SEQ ID NO: 6913148 - DNA, 22 bp, Homo sapiens
catagacattcagcactcacta

SEQ ID NO: 6913149 - DNA, 22 bp, Homo sapiens
agttcaatagaaaaatatatta

SEQ ID NO: 6913150 - DNA, 22 bp, Homo sapiens
gctctggggcccagggatcaca

SEQ ID NO: 6913151 - DNA, 23 bp, Homo sapiens
cagccctgaaatcgaggtgacac

SEQ ID NO: 6913152 - DNA, 22 bp, Homo sapiens
ggctgcctcccaggagaatctg

SEQ ID NO: 6913153 - DNA, 22 bp, Homo sapiens
aagcagcctcatttgtggtaag

SEQ ID NO: 6913154 - DNA, 22 bp, Homo sapiens
gggcactgtggggcccatgctg

SEQ ID NO: 6913155 - DNA, 22 bp, Homo sapiens
ctgcctagaaaaccaggctcct

SEQ ID NO: 6913156 - DNA, 22 bp, Homo sapiens
cgctgctctgcagactcccgga

SEQ ID NO: 6913157 - DNA, 22 bp, Homo sapiens
tgcattattcttttttggtagg

SEQ ID NO: 6913158 - DNA, 22 bp, Homo sapiens
tatatactatgcgattcctgcc

SEQ ID NO: 6913159 - DNA, 17 bp, Homo sapiens
aggcatggtctggggtg

SEQ ID NO: 6913160 - DNA, 22 bp, Homo sapiens
cttcctgcattgtgccagagtt

SEQ ID NO: 6913161 - DNA, 22 bp, Homo sapiens
gcttccttggtcctggtctaag

SEQ ID NO: 6913162 - DNA, 22 bp, Homo sapiens
gcatccctctgaggggccaggc

SEQ ID NO: 6913163 - DNA, 22 bp, Homo sapiens
acatgcatggggtaatggtatt

SEQ ID NO: 6913164 - DNA, 22 bp, Homo sapiens
taccagcctctgttgggggtgg

SEQ ID NO: 6913165 - DNA, 22 bp, Homo sapiens
cccggaaaggcgattatccctc

SEQ ID NO: 6913166 - DNA, 22 bp, Homo sapiens
gtctttcttaaacaacagaaca

SEQ ID NO: 6913167 - DNA, 22 bp, Homo sapiens
tttggaaaatattgaactggtt

SEQ ID NO: 6913168 - DNA, 22 bp, Homo sapiens
ctacagataatggcccagaaca

SEQ ID NO: 6913169 - DNA, 22 bp, Homo sapiens
aataaagaatggatgagatcgt

SEQ ID NO: 6913170 - DNA, 22 bp, Homo sapiens
tccctcatctcacatgtgtgtg

SEQ ID NO: 6913171 - DNA, 22 bp, Homo sapiens
gctggccttgaggtgtctttat

SEQ ID NO: 6913172 - DNA, 22 bp, Homo sapiens
agaccccatacctcagcaggta

SEQ ID NO: 6913173 - DNA, 22 bp, Homo sapiens
ttgatgagaccattgccgcgtc

SEQ ID NO: 6913174 - DNA, 21 bp, Homo sapiens
catcacaggatgattttttca

SEQ ID NO: 6913175 - DNA, 22 bp, Homo sapiens
aggcaaatctcagttggcctct

SEQ ID NO: 6913176 - DNA, 20 bp, Homo sapiens
tccagtggcctgaatctgga

SEQ ID NO: 6913177 - DNA, 22 bp, Homo sapiens
ctgccccacaggcttggtaggg

SEQ ID NO: 6913178 - DNA, 22 bp, Homo sapiens
tgcataggtgccaagtgggctt

SEQ ID NO: 6913179 - DNA, 17 bp, Homo sapiens
tctgagaatgctggagg

SEQ ID NO: 6913180 - DNA, 22 bp, Homo sapiens
agaagccagccttgcctccttt

SEQ ID NO: 6913181 - DNA, 22 bp, Homo sapiens
acacattttctaacagggatca

SEQ ID NO: 6913182 - DNA, 22 bp, Homo sapiens
gtcatcatcaggcagatgctgc

SEQ ID NO: 6913183 - DNA, 22 bp, Homo sapiens
tttagagaccctctgctatttt

SEQ ID NO: 6913184 - DNA, 22 bp, Homo sapiens
tccctgctcagctcacctggca

SEQ ID NO: 6913185 - DNA, 22 bp, Homo sapiens
gaggtatttgatcctctgcagt

SEQ ID NO: 6913186 - DNA, 22 bp, Homo sapiens
aggctgacaagttcgtctaaag

SEQ ID NO: 6913187 - DNA, 22 bp, Homo sapiens
tactgaggcaatagataacggc

SEQ ID NO: 6913188 - DNA, 22 bp, Homo sapiens
cagggtctgatggtcctcactt

SEQ ID NO: 6913189 - DNA, 22 bp, Homo sapiens
tgtaaatgaaacagctaaatcc

SEQ ID NO: 6913190 - DNA, 22 bp, Homo sapiens
cttgactcttgcttcccatgga

SEQ ID NO: 6913191 - DNA, 22 bp, Homo sapiens
tagcaggttactattttaatat

SEQ ID NO: 6913192 - DNA, 22 bp, Homo sapiens
ttctcagaattgactgggagca

SEQ ID NO: 6913193 - DNA, 22 bp, Homo sapiens
tcagaggcctatgtctacaact

SEQ ID NO: 6913194 - DNA, 22 bp, Homo sapiens
aggtcaagtttagatagagtta

SEQ ID NO: 6913195 - DNA, 22 bp, Homo sapiens
ggccactgctgctctggtggag

SEQ ID NO: 6913196 - DNA, 21 bp, Homo sapiens
gccttcactcccagagtttgt

SEQ ID NO: 6913197 - DNA, 22 bp, Homo sapiens
ctttgtagctgcttctgattta

SEQ ID NO: 6913198 - DNA, 22 bp, Homo sapiens
cttgtccagatgtttgttaggt

SEQ ID NO: 6913199 - DNA, 22 bp, Homo sapiens
ttagagctacggcctttaaaaa

SEQ ID NO: 6913200 - DNA, 22 bp, Homo sapiens
ctgtatgtagaatagctgacaa

SEQ ID NO: 6913201 - DNA, 22 bp, Homo sapiens
acaaattatagaaaattgagct

SEQ ID NO: 6913202 - DNA, 22 bp, Homo sapiens
agatattaatcgtacataaggt

SEQ ID NO: 6913203 - DNA, 22 bp, Homo sapiens
gtttcctctgctggttttcatt

SEQ ID NO: 6913204 - DNA, 21 bp, Homo sapiens
ctgtgctttttaagtgtgatg

SEQ ID NO: 6913205 - DNA, 20 bp, Homo sapiens
tggagccagggacctgttct

SEQ ID NO: 6913206 - DNA, 23 bp, Homo sapiens
gcctggagaaaagctgcagttca

SEQ ID NO: 6913207 - DNA, 22 bp, Homo sapiens
tgggggtgccctatgaggaagc

SEQ ID NO: 6913208 - DNA, 22 bp, Homo sapiens
ggcagctcacctctggtccagg

SEQ ID NO: 6913209 - DNA, 22 bp, Homo sapiens
tctataaattatgcagtctcag

SEQ ID NO: 6913210 - DNA, 22 bp, Homo sapiens
atgacttctgcaaggtcatttg

SEQ ID NO: 6913211 - DNA, 22 bp, Homo sapiens
gattgctgtgcgccccaggtgt

SEQ ID NO: 6913212 - DNA, 22 bp, Homo sapiens
atctcattttggtttctactta

SEQ ID NO: 6913213 - DNA, 22 bp, Homo sapiens
gatttctagttcattatctatt

SEQ ID NO: 6913214 - DNA, 22 bp, Homo sapiens
tgaacagactgacctctgacct

SEQ ID NO: 6913215 - DNA, 21 bp, Homo sapiens
gtctcacaaggtggcttacgt

SEQ ID NO: 6913216 - DNA, 22 bp, Homo sapiens
ctgaataatattccattatgag

SEQ ID NO: 6913217 - DNA, 22 bp, Homo sapiens
gtgacagctccttggttagatg

SEQ ID NO: 6913218 - DNA, 22 bp, Homo sapiens
tgaaggctttttaaagcatttg

SEQ ID NO: 6913219 - DNA, 22 bp, Homo sapiens
ctgctcttcacactacacccgt

SEQ ID NO: 6913220 - DNA, 22 bp, Homo sapiens
tagcccatgatggtggaaggca

SEQ ID NO: 6913221 - DNA, 22 bp, Homo sapiens
atgtatgttcaagcaatgatta

SEQ ID NO: 6913222 - DNA, 22 bp, Homo sapiens
ccccttccttcctcagacagcc

SEQ ID NO: 6913223 - DNA, 22 bp, Homo sapiens
cagggcagtaacgggaacatct

SEQ ID NO: 6913224 - DNA, 22 bp, Homo sapiens
agtgagtggatgtaggaattgg

SEQ ID NO: 6913225 - DNA, 22 bp, Homo sapiens
gcctataaagctttttgagcaa

SEQ ID NO: 6913226 - DNA, 22 bp, Homo sapiens
tcattgcttcaggacctaccat

SEQ ID NO: 6913227 - DNA, 22 bp, Homo sapiens
tctgcctttgtggtcgggagaa

SEQ ID NO: 6913228 - DNA, 22 bp, Homo sapiens
aagtgccatcatagcatggctg

SEQ ID NO: 6913229 - DNA, 22 bp, Homo sapiens
caaatcatggctctagcttaca

SEQ ID NO: 6913230 - DNA, 22 bp, Homo sapiens
cagttaaacgatgatggggtca

SEQ ID NO: 6913231 - DNA, 22 bp, Homo sapiens
gcagcttgaagctcggaggagc

SEQ ID NO: 6913232 - DNA, 16 bp, Homo sapiens
ctgtccagcatctgcc

SEQ ID NO: 6913233 - DNA, 22 bp, Homo sapiens
tcagtgtgaattcattttagat

SEQ ID NO: 6913234 - DNA, 22 bp, Homo sapiens
gcttgcatagctctgtcctgtt

SEQ ID NO: 6913235 - DNA, 22 bp, Homo sapiens
gtggcaagatgactactcactg

SEQ ID NO: 6913236 - DNA, 22 bp, Homo sapiens
agtcaggacacagcatgaacat

SEQ ID NO: 6913237 - DNA, 22 bp, Homo sapiens
ataattgatgaggctttggaca

SEQ ID NO: 6913238 - DNA, 22 bp, Homo sapiens
gggaagctgaagctagagaaaa

SEQ ID NO: 6913239 - DNA, 22 bp, Homo sapiens
ctgacttttccaaataatactt

SEQ ID NO: 6913240 - DNA, 22 bp, Homo sapiens
aattaacagagggcttattact

SEQ ID NO: 6913241 - DNA, 22 bp, Homo sapiens
taggtaggtgtcataatccatg

SEQ ID NO: 6913242 - DNA, 22 bp, Homo sapiens
tgagcagagcaataggactctc

SEQ ID NO: 6913243 - DNA, 22 bp, Homo sapiens
aacatcagaagtagaagactca

SEQ ID NO: 6913244 - DNA, 22 bp, Homo sapiens
cagcttcttagtctttccttgt

SEQ ID NO: 6913245 - DNA, 22 bp, Homo sapiens
gatgaaatccagatcacaggtg

SEQ ID NO: 6913246 - DNA, 22 bp, Homo sapiens
catgaaatttgaagtacagcaa

SEQ ID NO: 6913247 - DNA, 22 bp, Homo sapiens
aggcagccaatcagaggctgac

SEQ ID NO: 6913248 - DNA, 22 bp, Homo sapiens
atgttacagggagagaaggcca

SEQ ID NO: 6913249 - DNA, 22 bp, Homo sapiens
ctcctgtgcatgcatctcccta

SEQ ID NO: 6913250 - DNA, 22 bp, Homo sapiens
tgcaggctgtttggtggatctc

SEQ ID NO: 6913251 - DNA, 22 bp, Homo sapiens
tgtgatggttcactgggcatga

SEQ ID NO: 6913252 - DNA, 22 bp, Homo sapiens
ggggtcggggcatagccactta

SEQ ID NO: 6913253 - DNA, 22 bp, Homo sapiens
ctcagcttggcctggacgtagc

SEQ ID NO: 6913254 - DNA, 22 bp, Homo sapiens
agcaaataattgtctttgaggg

SEQ ID NO: 6913255 - DNA, 22 bp, Homo sapiens
gcagctgctgtggcatcaagct

SEQ ID NO: 6913256 - DNA, 22 bp, Homo sapiens
tgagtcttcttccgggattgct

SEQ ID NO: 6913257 - DNA, 22 bp, Homo sapiens
aagcttcttagaatgcatgtgc

SEQ ID NO: 6913258 - DNA, 22 bp, Homo sapiens
tgttaccaaaatcttgtatatc

SEQ ID NO: 6913259 - DNA, 22 bp, Homo sapiens
agagcaatttcttctccaagtt

SEQ ID NO: 6913260 - DNA, 22 bp, Homo sapiens
atctaagaggatggttggaaat

SEQ ID NO: 6913261 - DNA, 22 bp, Homo sapiens
atctttgggcaatgatgaggga

SEQ ID NO: 6913262 - DNA, 22 bp, Homo sapiens
tagatgctgagcttaagagaat

SEQ ID NO: 6913263 - DNA, 22 bp, Homo sapiens
agtgtttttgggtagggtgagt

SEQ ID NO: 6913264 - DNA, 22 bp, Homo sapiens
ccctggagtagcactgggtcgc

SEQ ID NO: 6913265 - DNA, 22 bp, Homo sapiens
cctgtggtttacgtacagctcc

SEQ ID NO: 6913266 - DNA, 22 bp, Homo sapiens
cagtttaaatgagtgactgcag

SEQ ID NO: 6913267 - DNA, 22 bp, Homo sapiens
gagatctctagcacttcctgta

SEQ ID NO: 6913268 - DNA, 22 bp, Homo sapiens
taagtgagggagctgggacttg

SEQ ID NO: 6913269 - DNA, 23 bp, Homo sapiens
tttgagctctagatggccctccc

SEQ ID NO: 6913270 - DNA, 22 bp, Homo sapiens
cagaaatgtttatgcttttgaa

SEQ ID NO: 6913271 - DNA, 22 bp, Homo sapiens
aacatacgagcagtttatagag

SEQ ID NO: 6913272 - DNA, 23 bp, Homo sapiens
actaaggcttctttaagacagag

SEQ ID NO: 6913273 - DNA, 22 bp, Homo sapiens
atctggtgacacgaggagctgg

SEQ ID NO: 6913274 - DNA, 22 bp, Homo sapiens
tctgggcagtacccctctccta

SEQ ID NO: 6913275 - DNA, 19 bp, Homo sapiens
tagtctctgatgaggcttt

SEQ ID NO: 6913276 - DNA, 22 bp, Homo sapiens
agggcctgtgctgagtagacga

SEQ ID NO: 6913277 - DNA, 22 bp, Homo sapiens
gatttacagatctaagggtcac

SEQ ID NO: 6913278 - DNA, 22 bp, Homo sapiens
aaaagtctgctctcatttcaga

SEQ ID NO: 6913279 - DNA, 22 bp, Homo sapiens
cagggcctccccggcagtcttt

SEQ ID NO: 6913280 - DNA, 22 bp, Homo sapiens
tcagctgtatcttgctgcactt

SEQ ID NO: 6913281 - DNA, 22 bp, Homo sapiens
tccagaggtatgtagagagtat

SEQ ID NO: 6913282 - DNA, 22 bp, Homo sapiens
agccccttgtgggcgcacagca

SEQ ID NO: 6913283 - DNA, 22 bp, Homo sapiens
aggttccatcacctgcagtgga

SEQ ID NO: 6913284 - DNA, 22 bp, Homo sapiens
tattcctgggttccagcccaga

SEQ ID NO: 6913285 - DNA, 22 bp, Homo sapiens
tattgtcacgtcttaattctag

SEQ ID NO: 6913286 - DNA, 22 bp, Homo sapiens
gtaataatactagtcagccttg

SEQ ID NO: 6913287 - DNA, 22 bp, Homo sapiens
ggacatcgagccaatgggaact

SEQ ID NO: 6913288 - DNA, 22 bp, Homo sapiens
attgagtacttagtgtcatata

SEQ ID NO: 6913289 - DNA, 22 bp, Homo sapiens
catcaggaattatcctaattat

SEQ ID NO: 6913290 - DNA, 22 bp, Homo sapiens
aagatgcagcaaactacttttt

SEQ ID NO: 6913291 - DNA, 22 bp, Homo sapiens
tcacccaagaccatcggaagtg

SEQ ID NO: 6913292 - DNA, 22 bp, Homo sapiens
aaagccatctgtattaagtgaa

SEQ ID NO: 6913293 - DNA, 22 bp, Homo sapiens
ctcacatagtaagcagtcagta

SEQ ID NO: 6913294 - DNA, 22 bp, Homo sapiens
gatgaggtgtgtggccactaga

SEQ ID NO: 6913295 - DNA, 22 bp, Homo sapiens
ctaaatgcctttcctacctaac

SEQ ID NO: 6913296 - DNA, 22 bp, Homo sapiens
cgtcatgagaattgagatagat

SEQ ID NO: 6913297 - DNA, 22 bp, Homo sapiens
gccaaagagctgagtacatgta

SEQ ID NO: 6913298 - DNA, 22 bp, Homo sapiens
aaggcatatattctaaacagga

SEQ ID NO: 6913299 - DNA, 22 bp, Homo sapiens
acctggacttgaatcctgactt

SEQ ID NO: 6913300 - DNA, 22 bp, Homo sapiens
agaagttgtaggtttgcatatt

SEQ ID NO: 6913301 - DNA, 22 bp, Homo sapiens
tgcttagaatctggacttgttg

SEQ ID NO: 6913302 - DNA, 22 bp, Homo sapiens
acatttgttcagggctgaggaa

SEQ ID NO: 6913303 - DNA, 22 bp, Homo sapiens
tttgggaacttaattatgtctg

SEQ ID NO: 6913304 - DNA, 22 bp, Homo sapiens
ctgtttattacgtaattaatat

SEQ ID NO: 6913305 - DNA, 22 bp, Homo sapiens
tgggtggattaggatagggtat

SEQ ID NO: 6913306 - DNA, 22 bp, Homo sapiens
tccagccctgcactgattagat

SEQ ID NO: 6913307 - DNA, 17 bp, Homo sapiens
agcagctggcacaggag

SEQ ID NO: 6913308 - DNA, 22 bp, Homo sapiens
agccgtgggcaggcccaggaca

SEQ ID NO: 6913309 - DNA, 22 bp, Homo sapiens
ggagaagggacagactcagctt

SEQ ID NO: 6913310 - DNA, 22 bp, Homo sapiens
attcttctaatatgatcgtgtt

SEQ ID NO: 6913311 - DNA, 22 bp, Homo sapiens
agggcctctctgggcctttcct

SEQ ID NO: 6913312 - DNA, 22 bp, Homo sapiens
aggccaggggtgagcacttctg

SEQ ID NO: 6913313 - DNA, 22 bp, Homo sapiens
gcatggatctaagaggtcaagg

SEQ ID NO: 6913314 - DNA, 22 bp, Homo sapiens
cttacacttcatctcatccagg

SEQ ID NO: 6913315 - DNA, 22 bp, Homo sapiens
ccaatactgaacttaaaagtat

SEQ ID NO: 6913316 - DNA, 22 bp, Homo sapiens
tgagccagagaggttgaggcta

SEQ ID NO: 6913317 - DNA, 22 bp, Homo sapiens
ttggggcacctccccagcattt

SEQ ID NO: 6913318 - DNA, 22 bp, Homo sapiens
ctttcctgagaaaggagaagga

SEQ ID NO: 6913319 - DNA, 22 bp, Homo sapiens
cctgagtaacatggtgagaacc

SEQ ID NO: 6913320 - DNA, 19 bp, Homo sapiens
caccacttctttttgcatc

SEQ ID NO: 6913321 - DNA, 22 bp, Homo sapiens
gtacattttactttgtttgaat

SEQ ID NO: 6913322 - DNA, 22 bp, Homo sapiens
tctaaacagcctcttaccaact

SEQ ID NO: 6913323 - DNA, 19 bp, Homo sapiens
ctccttgccatttcttttc

SEQ ID NO: 6913324 - DNA, 22 bp, Homo sapiens
atactttgctagtatcagtgtg

SEQ ID NO: 6913325 - DNA, 21 bp, Homo sapiens
cacatgcatgcacaggttgta

SEQ ID NO: 6913326 - DNA, 22 bp, Homo sapiens
gtggcactaaatacagcatttc

SEQ ID NO: 6913327 - DNA, 22 bp, Homo sapiens
gacatatgtgtacatggagatt

SEQ ID NO: 6913328 - DNA, 22 bp, Homo sapiens
tcttaaaccacaaaattcagag

SEQ ID NO: 6913329 - DNA, 22 bp, Homo sapiens
gtcctgggcctgctgaggctga

SEQ ID NO: 6913330 - DNA, 19 bp, Homo sapiens
atgtgtgagaagcattata

SEQ ID NO: 6913331 - DNA, 22 bp, Homo sapiens
tcagaagcagaaaataggtggg

SEQ ID NO: 6913332 - DNA, 22 bp, Homo sapiens
tcctgggacaagccgtggaagt

SEQ ID NO: 6913333 - DNA, 21 bp, Homo sapiens
tccaggaatgtctgttcatct

SEQ ID NO: 6913334 - DNA, 21 bp, Homo sapiens
caagtcctttgccaaagtgct

SEQ ID NO: 6913335 - DNA, 22 bp, Homo sapiens
gtactattatatctaaatcact

SEQ ID NO: 6913336 - DNA, 22 bp, Homo sapiens
tgttagctgtgctttagccttc

SEQ ID NO: 6913337 - DNA, 22 bp, Homo sapiens
ttgtcctgattttgcaacttct

SEQ ID NO: 6913338 - DNA, 22 bp, Homo sapiens
gaggcaactggaacactggtca

SEQ ID NO: 6913339 - DNA, 22 bp, Homo sapiens
tgctccaggagcactttccatt

SEQ ID NO: 6913340 - DNA, 22 bp, Homo sapiens
tatcagtggtcacaagatacat

SEQ ID NO: 6913341 - DNA, 22 bp, Homo sapiens
ggatgtttgctagcattcctgg

SEQ ID NO: 6913342 - DNA, 22 bp, Homo sapiens
cctggctctctgcagatcctgg

SEQ ID NO: 6913343 - DNA, 22 bp, Homo sapiens
agagggaaatccaggagtgctt

SEQ ID NO: 6913344 - DNA, 22 bp, Homo sapiens
cagggccaagttggtgcctttt

SEQ ID NO: 6913345 - DNA, 22 bp, Homo sapiens
gatgatgtgtcccaagaagtag

SEQ ID NO: 6913346 - DNA, 22 bp, Homo sapiens
tagttttgattagtattgtctt

SEQ ID NO: 6913347 - DNA, 18 bp, Homo sapiens
actagtgagcaagctagg

SEQ ID NO: 6913348 - DNA, 22 bp, Homo sapiens
ccagctttcatatcatgaggta

SEQ ID NO: 6913349 - DNA, 22 bp, Homo sapiens
ttctgagatacaaaatttactt

SEQ ID NO: 6913350 - DNA, 22 bp, Homo sapiens
cagttgccttatttccttgctg

SEQ ID NO: 6913351 - DNA, 22 bp, Homo sapiens
atgtggctagtccaattaatga

SEQ ID NO: 6913352 - DNA, 22 bp, Homo sapiens
tctggcaggcaatcggctctgg

SEQ ID NO: 6913353 - DNA, 22 bp, Homo sapiens
agtcattaattagtaggaaggt

SEQ ID NO: 6913354 - DNA, 22 bp, Homo sapiens
tttgctgaggtgaggtgaaggt

SEQ ID NO: 6913355 - DNA, 20 bp, Homo sapiens
tccctccctccagctctggg

SEQ ID NO: 6913356 - DNA, 22 bp, Homo sapiens
gagcagctggctgtattggttt

SEQ ID NO: 6913357 - DNA, 22 bp, Homo sapiens
cttgtattctgcctaaccttca

SEQ ID NO: 6913358 - DNA, 22 bp, Homo sapiens
tataatagaagtatgtccagtg

SEQ ID NO: 6913359 - DNA, 22 bp, Homo sapiens
gtgctcaggggcaatcctggga

SEQ ID NO: 6913360 - DNA, 22 bp, Homo sapiens
gtgttaaccagctaaactttgc

SEQ ID NO: 6913361 - DNA, 22 bp, Homo sapiens
tctcccagaagtcctcagtaca

SEQ ID NO: 6913362 - DNA, 22 bp, Homo sapiens
tatgcatatagatgcacacaca

SEQ ID NO: 6913363 - DNA, 22 bp, Homo sapiens
gatactgttagtaaaaggtact

SEQ ID NO: 6913364 - DNA, 22 bp, Homo sapiens
atgacatgaggcatctttggag

SEQ ID NO: 6913365 - DNA, 22 bp, Homo sapiens
atatttgaaattatcacaggaa

SEQ ID NO: 6913366 - DNA, 22 bp, Homo sapiens
aacaagttctaagtgtctactt

SEQ ID NO: 6913367 - DNA, 22 bp, Homo sapiens
ctgccagtctatgctgctcggc

SEQ ID NO: 6913368 - DNA, 22 bp, Homo sapiens
cttcacatttgcgaaggccaaa

SEQ ID NO: 6913369 - DNA, 22 bp, Homo sapiens
agccagacatggctcctgctcc

SEQ ID NO: 6913370 - DNA, 22 bp, Homo sapiens
ctagtgtttattaacataattc

SEQ ID NO: 6913371 - DNA, 22 bp, Homo sapiens
caagagccataattttgagagt

SEQ ID NO: 6913372 - DNA, 22 bp, Homo sapiens
aaatggcaggctctttgctagt

SEQ ID NO: 6913373 - DNA, 22 bp, Homo sapiens
ctgaggtgctagggtccctgct

SEQ ID NO: 6913374 - DNA, 20 bp, Homo sapiens
atggatgaccttggccaggg

SEQ ID NO: 6913375 - DNA, 22 bp, Homo sapiens
ggtgtggctgtgagtttttgat

SEQ ID NO: 6913376 - DNA, 22 bp, Homo sapiens
tgacaaaccctgcaaatagctc

SEQ ID NO: 6913377 - DNA, 22 bp, Homo sapiens
tgggctgctgtctgcacatgct

SEQ ID NO: 6913378 - DNA, 22 bp, Homo sapiens
agacagacatagaaattagtaa

SEQ ID NO: 6913379 - DNA, 22 bp, Homo sapiens
tgccatcacacggaacccgatt

SEQ ID NO: 6913380 - DNA, 22 bp, Homo sapiens
gcccagccacagtcactttcat

SEQ ID NO: 6913381 - DNA, 22 bp, Homo sapiens
gctaggaagaagggtgcttgaa

SEQ ID NO: 6913382 - DNA, 22 bp, Homo sapiens
gagagaatgtacatgctagggg

SEQ ID NO: 6913383 - DNA, 22 bp, Homo sapiens
agtgtcctgtgtcccagactgt

SEQ ID NO: 6913384 - DNA, 22 bp, Homo sapiens
aatgggataattgttcatggga

SEQ ID NO: 6913385 - DNA, 22 bp, Homo sapiens
tcccaggccataaaactcagag

SEQ ID NO: 6913386 - DNA, 22 bp, Homo sapiens
attggcaatagagaataaattg

SEQ ID NO: 6913387 - DNA, 22 bp, Homo sapiens
gtgacatgttatggactggcta

SEQ ID NO: 6913388 - DNA, 22 bp, Homo sapiens
attcggatcatgtgtatgtgtt

SEQ ID NO: 6913389 - DNA, 22 bp, Homo sapiens
ttggcactgaccaaagaagtcc

SEQ ID NO: 6913390 - DNA, 22 bp, Homo sapiens
tctttagctagaaatactctaa

SEQ ID NO: 6913391 - DNA, 22 bp, Homo sapiens
cttttctgtgatgctgacagtc

SEQ ID NO: 6913392 - DNA, 20 bp, Homo sapiens
aacactgtgcgtggtaggtg

SEQ ID NO: 6913393 - DNA, 22 bp, Homo sapiens
gaccccagaggaaggggcgccg

SEQ ID NO: 6913394 - DNA, 22 bp, Homo sapiens
gctggtttccttatctataaag

SEQ ID NO: 6913395 - DNA, 22 bp, Homo sapiens
ggtggacaaatgaatgactgaa

SEQ ID NO: 6913396 - DNA, 22 bp, Homo sapiens
actggagttcatggtaaagtca

SEQ ID NO: 6913397 - DNA, 22 bp, Homo sapiens
tatggatataatcagactggaa

SEQ ID NO: 6913398 - DNA, 22 bp, Homo sapiens
tcctaactgccctgggcaaggt

SEQ ID NO: 6913399 - DNA, 22 bp, Homo sapiens
gtcctcagtaagagggcctctg

SEQ ID NO: 6913400 - DNA, 20 bp, Homo sapiens
ttgtgggggcaatggtatgc

SEQ ID NO: 6913401 - DNA, 22 bp, Homo sapiens
tcagagagttagtgtcttagct

SEQ ID NO: 6913402 - DNA, 22 bp, Homo sapiens
taatgtaaacacagagacagaa

SEQ ID NO: 6913403 - DNA, 22 bp, Homo sapiens
ggttatttttgattctgtggat

SEQ ID NO: 6913404 - DNA, 22 bp, Homo sapiens
attgaagcatggagatgaggca

SEQ ID NO: 6913405 - DNA, 16 bp, Homo sapiens
tgagtgggagaagggg

SEQ ID NO: 6913406 - DNA, 22 bp, Homo sapiens
aaggcatgtgtcctcagagaga

SEQ ID NO: 6913407 - DNA, 22 bp, Homo sapiens
gtcctttcttaaattcctgctt

SEQ ID NO: 6913408 - DNA, 22 bp, Homo sapiens
aacatttaggaaggacctcctc

SEQ ID NO: 6913409 - DNA, 22 bp, Homo sapiens
ggacctgaacataaaacgaggc

SEQ ID NO: 6913410 - DNA, 22 bp, Homo sapiens
tttattggaacacagccatgac

SEQ ID NO: 6913411 - DNA, 22 bp, Homo sapiens
ccatcctgcattgctattcaga

SEQ ID NO: 6913412 - DNA, 22 bp, Homo sapiens
ccaacaccatctgagctccagc

SEQ ID NO: 6913413 - DNA, 19 bp, Homo sapiens
ggcatggtcggaagagctc

SEQ ID NO: 6913414 - DNA, 22 bp, Homo sapiens
ctgtacttctttcagagcaccc

SEQ ID NO: 6913415 - DNA, 22 bp, Homo sapiens
ataggctgagcttctcctttgt

SEQ ID NO: 6913416 - DNA, 22 bp, Homo sapiens
tatggaaataattagacaagtg

SEQ ID NO: 6913417 - DNA, 22 bp, Homo sapiens
gaatgcatgtgaagcaaagaat

SEQ ID NO: 6913418 - DNA, 22 bp, Homo sapiens
cgtggctggggcgactccacgg

SEQ ID NO: 6913419 - DNA, 22 bp, Homo sapiens
aactggtatctcttcagtgtaa

SEQ ID NO: 6913420 - DNA, 22 bp, Homo sapiens
gctgccagcacagttcagctgt

SEQ ID NO: 6913421 - DNA, 22 bp, Homo sapiens
gccaccaggagcccagtccaaa

SEQ ID NO: 6913422 - DNA, 21 bp, Homo sapiens
tcagtgcaattctatggggaa

SEQ ID NO: 6913423 - DNA, 18 bp, Homo sapiens
aggcaggcggatcacaag

SEQ ID NO: 6913424 - DNA, 22 bp, Homo sapiens
aagtgctttttcttgagctgct

SEQ ID NO: 6913425 - DNA, 22 bp, Homo sapiens
gagatttcacccctcttaacct

SEQ ID NO: 6913426 - DNA, 22 bp, Homo sapiens
gccttttttaaactccaagtct

SEQ ID NO: 6913427 - DNA, 22 bp, Homo sapiens
acatccagaggcgtggaaggct

SEQ ID NO: 6913428 - DNA, 22 bp, Homo sapiens
ctgtggaaggacttagcgatac

SEQ ID NO: 6913429 - DNA, 22 bp, Homo sapiens
atgtgtatgagtgtgcttcttt

SEQ ID NO: 6913430 - DNA, 22 bp, Homo sapiens
agcttctttaattcagcatgat

SEQ ID NO: 6913431 - DNA, 22 bp, Homo sapiens
atcacagctcccttatacacag

SEQ ID NO: 6913432 - DNA, 22 bp, Homo sapiens
catagacagatggtaagaagct

SEQ ID NO: 6913433 - DNA, 22 bp, Homo sapiens
tttgaacatgctgcatgataat

SEQ ID NO: 6913434 - DNA, 22 bp, Homo sapiens
cagaggcagaatggagatttgg

SEQ ID NO: 6913435 - DNA, 22 bp, Homo sapiens
tctgtacatgagttgagaatca

SEQ ID NO: 6913436 - DNA, 22 bp, Homo sapiens
gtgcaatggggcaatatcagct

SEQ ID NO: 6913437 - DNA, 22 bp, Homo sapiens
ttcctggcatgaaaaatatcac

SEQ ID NO: 6913438 - DNA, 22 bp, Homo sapiens
cagagcccaagagcaagccatg

SEQ ID NO: 6913439 - DNA, 22 bp, Homo sapiens
cctgcaggctgcaggccagttc

SEQ ID NO: 6913440 - DNA, 21 bp, Homo sapiens
tgcagaggcacaaacaagccc

SEQ ID NO: 6913441 - DNA, 22 bp, Homo sapiens
atgcaggatgcagaggggcccg

SEQ ID NO: 6913442 - DNA, 22 bp, Homo sapiens
atagaccttctacacaggacaa

SEQ ID NO: 6913443 - DNA, 22 bp, Homo sapiens
aatgctgtcttagcatgaaagc

SEQ ID NO: 6913444 - DNA, 22 bp, Homo sapiens
tggctcggccacctgccagcca

SEQ ID NO: 6913445 - DNA, 22 bp, Homo sapiens
atgccagaccatccagttggga

SEQ ID NO: 6913446 - DNA, 22 bp, Homo sapiens
caatcttagtggcttacaaaga

SEQ ID NO: 6913447 - DNA, 22 bp, Homo sapiens
ttccagaggcctgggcacactc

SEQ ID NO: 6913448 - DNA, 23 bp, Homo sapiens
cacatggaatcttcagagtcacc

SEQ ID NO: 6913449 - DNA, 19 bp, Homo sapiens
tgccatttgactgaatgta

SEQ ID NO: 6913450 - DNA, 19 bp, Homo sapiens
aagggtcacaagcagcaga

SEQ ID NO: 6913451 - DNA, 22 bp, Homo sapiens
atctgagactgagtttggattt

SEQ ID NO: 6913452 - DNA, 22 bp, Homo sapiens
ccctgatggcctatctggcagt

SEQ ID NO: 6913453 - DNA, 22 bp, Homo sapiens
ctggaggttgggtccaggccag

SEQ ID NO: 6913454 - DNA, 22 bp, Homo sapiens
catttcaaggaccaccctggga

SEQ ID NO: 6913455 - DNA, 22 bp, Homo sapiens
ttcactgagagacatgaaggtc

SEQ ID NO: 6913456 - DNA, 18 bp, Homo sapiens
acaaaggtctgcaagacc

SEQ ID NO: 6913457 - DNA, 22 bp, Homo sapiens
agatgtgggcaatggaatggag

SEQ ID NO: 6913458 - DNA, 22 bp, Homo sapiens
cagacctacacacgcatgggtt

SEQ ID NO: 6913459 - DNA, 21 bp, Homo sapiens
cctctgtgctaaagggctccc

SEQ ID NO: 6913460 - DNA, 22 bp, Homo sapiens
atgatgtaaatagagcctaggt

SEQ ID NO: 6913461 - DNA, 22 bp, Homo sapiens
ttagtgatcaaaatcaaaattg

SEQ ID NO: 6913462 - DNA, 22 bp, Homo sapiens
gtgaatggttgtgaacatcttt

SEQ ID NO: 6913463 - DNA, 22 bp, Homo sapiens
aagtgtgacactgtgttaatta

SEQ ID NO: 6913464 - DNA, 22 bp, Homo sapiens
tccgtaaagtcttacaatgtct

SEQ ID NO: 6913465 - DNA, 22 bp, Homo sapiens
gatcactacagggtgggtgggg

SEQ ID NO: 6913466 - DNA, 16 bp, Homo sapiens
tcctggggatactgga

SEQ ID NO: 6913467 - DNA, 22 bp, Homo sapiens
gacagggacacagccagtgagg

SEQ ID NO: 6913468 - DNA, 22 bp, Homo sapiens
cagccagagaggaaggaatgca

SEQ ID NO: 6913469 - DNA, 22 bp, Homo sapiens
ctctggacctcagtctactaat

SEQ ID NO: 6913470 - DNA, 22 bp, Homo sapiens
atggcagcccacgatggcaatg

SEQ ID NO: 6913471 - DNA, 22 bp, Homo sapiens
taaagtgtgttttgattacgtc

SEQ ID NO: 6913472 - DNA, 22 bp, Homo sapiens
aacagtattggttgaactcaag

SEQ ID NO: 6913473 - DNA, 22 bp, Homo sapiens
aaactgggattcttcacaaggt

SEQ ID NO: 6913474 - DNA, 22 bp, Homo sapiens
ttacacagttggtaggggcaga

SEQ ID NO: 6913475 - DNA, 22 bp, Homo sapiens
ctgcaaggtcatgactctctgg

SEQ ID NO: 6913476 - DNA, 22 bp, Homo sapiens
cttagcagtttgcctggcacag

SEQ ID NO: 6913477 - DNA, 16 bp, Homo sapiens
gaagcagagggtgttg

SEQ ID NO: 6913478 - DNA, 22 bp, Homo sapiens
attcatctgtacttcaatatct

SEQ ID NO: 6913479 - DNA, 22 bp, Homo sapiens
gtctcagggactgcttctgggg

SEQ ID NO: 6913480 - DNA, 22 bp, Homo sapiens
aaattgtccttttaagaaacag

SEQ ID NO: 6913481 - DNA, 22 bp, Homo sapiens
ttagtgcttggcacacaataca

SEQ ID NO: 6913482 - DNA, 20 bp, Homo sapiens
ggccatgggttgcctgaggt

SEQ ID NO: 6913483 - DNA, 22 bp, Homo sapiens
ctgccaggattctgtgaacccc

SEQ ID NO: 6913484 - DNA, 22 bp, Homo sapiens
aactggtcctcaaattttgatg

SEQ ID NO: 6913485 - DNA, 22 bp, Homo sapiens
gaaatgtcattgccttcagccc

SEQ ID NO: 6913486 - DNA, 19 bp, Homo sapiens
tgcattgagggctgtctca

SEQ ID NO: 6913487 - DNA, 22 bp, Homo sapiens
atgtggttgaagaattacatct

SEQ ID NO: 6913488 - DNA, 22 bp, Homo sapiens
ggtctaggtgtaattgtttact

SEQ ID NO: 6913489 - DNA, 22 bp, Homo sapiens
agctccaggatctgaaagttcg

SEQ ID NO: 6913490 - DNA, 20 bp, Homo sapiens
tgtgagcagatgctgagtga

SEQ ID NO: 6913491 - DNA, 22 bp, Homo sapiens
ttccaggaagacatctcaggaa

SEQ ID NO: 6913492 - DNA, 22 bp, Homo sapiens
tgatgtctgccagggtcctggg

SEQ ID NO: 6913493 - DNA, 22 bp, Homo sapiens
tatggtcatggttgcacaattt

SEQ ID NO: 6913494 - DNA, 22 bp, Homo sapiens
ctcttcttgaaagaggaattca

SEQ ID NO: 6913495 - DNA, 23 bp, Homo sapiens
cctgcccaggaatccggcggcgt

SEQ ID NO: 6913496 - DNA, 22 bp, Homo sapiens
catgcatagaatgaagaggctg

SEQ ID NO: 6913497 - DNA, 22 bp, Homo sapiens
agctcaagagtagttcgagggg

SEQ ID NO: 6913498 - DNA, 22 bp, Homo sapiens
gctagtgagatgcaactgatat

SEQ ID NO: 6913499 - DNA, 22 bp, Homo sapiens
tcaggtggcttggagggggacg

SEQ ID NO: 6913500 - DNA, 22 bp, Homo sapiens
aagctggggactcagaccccat

SEQ ID NO: 6913501 - DNA, 22 bp, Homo sapiens
ctgcatctctgtgccagagggc

SEQ ID NO: 6913502 - DNA, 22 bp, Homo sapiens
gttcagtacctctaaactttgt

SEQ ID NO: 6913503 - DNA, 22 bp, Homo sapiens
ttattagagtgctttgagaaag

SEQ ID NO: 6913504 - DNA, 22 bp, Homo sapiens
acttgaaaagctcagcagtagt

SEQ ID NO: 6913505 - DNA, 21 bp, Homo sapiens
ttctaactgggtgggccttga

SEQ ID NO: 6913506 - DNA, 22 bp, Homo sapiens
agaaactcatcctggagatgac

SEQ ID NO: 6913507 - DNA, 22 bp, Homo sapiens
gaacaggtaatcagtaaaatgt

SEQ ID NO: 6913508 - DNA, 22 bp, Homo sapiens
ttcatagacaggataacaggat

SEQ ID NO: 6913509 - DNA, 23 bp, Homo sapiens
tggtctcacttggtaagatgaag

SEQ ID NO: 6913510 - DNA, 22 bp, Homo sapiens
attgcaccttgggttttgaaag

SEQ ID NO: 6913511 - DNA, 22 bp, Homo sapiens
attgagaagcttgcagattttt

SEQ ID NO: 6913512 - DNA, 22 bp, Homo sapiens
agtcttggttttgacagggaaa

SEQ ID NO: 6913513 - DNA, 22 bp, Homo sapiens
ggtcatacaaggcactggtgat

SEQ ID NO: 6913514 - DNA, 22 bp, Homo sapiens
gagacctcttggtatcgctagg

SEQ ID NO: 6913515 - DNA, 22 bp, Homo sapiens
gggtggctgagaacaggacccc

SEQ ID NO: 6913516 - DNA, 22 bp, Homo sapiens
tgcctacccatggttagacata

SEQ ID NO: 6913517 - DNA, 22 bp, Homo sapiens
tgaacaggtatttattgaacat

SEQ ID NO: 6913518 - DNA, 22 bp, Homo sapiens
tcctcatctgtaccttggggta

SEQ ID NO: 6913519 - DNA, 22 bp, Homo sapiens
ctgggatgatagtgctagtatt

SEQ ID NO: 6913520 - DNA, 22 bp, Homo sapiens
tttgaccttgttggtaggtatt

SEQ ID NO: 6913521 - DNA, 22 bp, Homo sapiens
agcctggaagaacctgaagtct

SEQ ID NO: 6913522 - DNA, 22 bp, Homo sapiens
atacatcttgtcagattcatgt

SEQ ID NO: 6913523 - DNA, 19 bp, Homo sapiens
aaagtgattttttctggca

SEQ ID NO: 6913524 - DNA, 22 bp, Homo sapiens
agatcagatctccttttgcatt

SEQ ID NO: 6913525 - DNA, 22 bp, Homo sapiens
ggtgaggggcgcctctgcccag

SEQ ID NO: 6913526 - DNA, 20 bp, Homo sapiens
tcagcttgggtgaagttcat

SEQ ID NO: 6913527 - DNA, 22 bp, Homo sapiens
ctgggtctggaggccaagggtg

SEQ ID NO: 6913528 - DNA, 22 bp, Homo sapiens
agcagagacatgaaatatgctt

SEQ ID NO: 6913529 - DNA, 22 bp, Homo sapiens
ttatggcatattcctcattgta

SEQ ID NO: 6913530 - DNA, 22 bp, Homo sapiens
tgggataataaatagaggcaga

SEQ ID NO: 6913531 - DNA, 22 bp, Homo sapiens
ttggcagcagagtgtggtgctc

SEQ ID NO: 6913532 - DNA, 22 bp, Homo sapiens
gctgcagctttaggatccagtg

SEQ ID NO: 6913533 - DNA, 22 bp, Homo sapiens
tgctgccaagcccgtgctcctg

SEQ ID NO: 6913534 - DNA, 22 bp, Homo sapiens
ccacatggatagatagggacat

SEQ ID NO: 6913535 - DNA, 22 bp, Homo sapiens
gctgcaggtttgtctagtctgg

SEQ ID NO: 6913536 - DNA, 22 bp, Homo sapiens
tgggctcaaactggaggttgtt

SEQ ID NO: 6913537 - DNA, 22 bp, Homo sapiens
gtgtgccactgcctgaggaccc

SEQ ID NO: 6913538 - DNA, 22 bp, Homo sapiens
aatagactttgtataatttccc

SEQ ID NO: 6913539 - DNA, 22 bp, Homo sapiens
ctgaaagcaaagtaattcttaa

SEQ ID NO: 6913540 - DNA, 22 bp, Homo sapiens
taggctcagtgagtagggagtt

SEQ ID NO: 6913541 - DNA, 22 bp, Homo sapiens
aatagcatgtaagtttaaaaga

SEQ ID NO: 6913542 - DNA, 22 bp, Homo sapiens
agcttctcagcttcagaactgt

SEQ ID NO: 6913543 - DNA, 22 bp, Homo sapiens
ttactactgctttactactggg

SEQ ID NO: 6913544 - DNA, 22 bp, Homo sapiens
tggcttctttctttccatgtgt

SEQ ID NO: 6913545 - DNA, 22 bp, Homo sapiens
cgcctgctctgtttccatgtgg

SEQ ID NO: 6913546 - DNA, 22 bp, Homo sapiens
atgcatgtctgccagttgctta

SEQ ID NO: 6913547 - DNA, 22 bp, Homo sapiens
agcaggaagtcctctcaggaga

SEQ ID NO: 6913548 - DNA, 22 bp, Homo sapiens
gtcacaagggagcctgggcgca

SEQ ID NO: 6913549 - DNA, 22 bp, Homo sapiens
aagagttatagttggtatgtgg

SEQ ID NO: 6913550 - DNA, 22 bp, Homo sapiens
ttcttactagtatgtttcagca

SEQ ID NO: 6913551 - DNA, 22 bp, Homo sapiens
gtgaaggactgaatgaaaatgt

SEQ ID NO: 6913552 - DNA, 22 bp, Homo sapiens
atgtagctgcagatgataatgc

SEQ ID NO: 6913553 - DNA, 22 bp, Homo sapiens
ccagggaagaaagatgaagtgc

SEQ ID NO: 6913554 - DNA, 22 bp, Homo sapiens
tttcagaaccaagagagacatc

SEQ ID NO: 6913555 - DNA, 22 bp, Homo sapiens
gcaaatggagtgaagagctgga

SEQ ID NO: 6913556 - DNA, 22 bp, Homo sapiens
tgtcattatttgaggatagact

SEQ ID NO: 6913557 - DNA, 22 bp, Homo sapiens
tcacaagagtaagttcatgcct

SEQ ID NO: 6913558 - DNA, 22 bp, Homo sapiens
gctagctgggtttcactgtgga

SEQ ID NO: 6913559 - DNA, 22 bp, Homo sapiens
aaggcctgaacatgaggagatg

SEQ ID NO: 6913560 - DNA, 22 bp, Homo sapiens
ttaaaccaccagaagccattat

SEQ ID NO: 6913561 - DNA, 19 bp, Homo sapiens
ctgttgctggggctctctt

SEQ ID NO: 6913562 - DNA, 22 bp, Homo sapiens
atgaagatttataattgccttt

SEQ ID NO: 6913563 - DNA, 23 bp, Homo sapiens
ttctttataaatcaatgggatgt

SEQ ID NO: 6913564 - DNA, 22 bp, Homo sapiens
gagggccaaagagcaagagcct

SEQ ID NO: 6913565 - DNA, 22 bp, Homo sapiens
acttgcagctaccatcattcca

SEQ ID NO: 6913566 - DNA, 23 bp, Homo sapiens
ttcattgattgcaaggagattgg

SEQ ID NO: 6913567 - DNA, 20 bp, Homo sapiens
cagcagccaaacttctattc

SEQ ID NO: 6913568 - DNA, 22 bp, Homo sapiens
accagctcagaagccagaaaga

SEQ ID NO: 6913569 - DNA, 22 bp, Homo sapiens
catcagaatagctctgtggata

SEQ ID NO: 6913570 - DNA, 22 bp, Homo sapiens
ctgggtgccacgggcaccctgg

SEQ ID NO: 6913571 - DNA, 22 bp, Homo sapiens
aaagctcatcattaggaggcta

SEQ ID NO: 6913572 - DNA, 17 bp, Homo sapiens
cctgttgttgcctttgc

SEQ ID NO: 6913573 - DNA, 23 bp, Homo sapiens
tgtaaacatcaccccctggagtt

SEQ ID NO: 6913574 - DNA, 22 bp, Homo sapiens
tgctcagctggtgccagggtcc

SEQ ID NO: 6913575 - DNA, 22 bp, Homo sapiens
tcagtagtggctgtagccaaat

SEQ ID NO: 6913576 - DNA, 22 bp, Homo sapiens
ctgttactcctttggcagatta

SEQ ID NO: 6913577 - DNA, 22 bp, Homo sapiens
aactggtatggtgagaagagag

SEQ ID NO: 6913578 - DNA, 22 bp, Homo sapiens
actgggaaagtgctgcctgcag

SEQ ID NO: 6913579 - DNA, 17 bp, Homo sapiens
tgctggaggcggggtat

SEQ ID NO: 6913580 - DNA, 22 bp, Homo sapiens
cagtgctgttgtaagctcattg

SEQ ID NO: 6913581 - DNA, 22 bp, Homo sapiens
atgaaagtacctgtaatatgtt

SEQ ID NO: 6913582 - DNA, 22 bp, Homo sapiens
tctgcagacttgataaccactg

SEQ ID NO: 6913583 - DNA, 22 bp, Homo sapiens
gctcacaggggcagacgagttg

SEQ ID NO: 6913584 - DNA, 22 bp, Homo sapiens
gtggcagaagagtaggatgggc

SEQ ID NO: 6913585 - DNA, 22 bp, Homo sapiens
gctgccatgttgtgaggacact

SEQ ID NO: 6913586 - DNA, 22 bp, Homo sapiens
taggaagcccttctgccatagt

SEQ ID NO: 6913587 - DNA, 20 bp, Homo sapiens
tgggagatgatctccttgct

SEQ ID NO: 6913588 - DNA, 22 bp, Homo sapiens
accgaaggaaactggaaccgtt

SEQ ID NO: 6913589 - DNA, 22 bp, Homo sapiens
ggcctagaaacaagggggaatt

SEQ ID NO: 6913590 - DNA, 22 bp, Homo sapiens
aaagccacgtggcctggggagc

SEQ ID NO: 6913591 - DNA, 22 bp, Homo sapiens
tagagctgctggactgtaacag

SEQ ID NO: 6913592 - DNA, 22 bp, Homo sapiens
tggatgctggatgaacagatgc

SEQ ID NO: 6913593 - DNA, 22 bp, Homo sapiens
gcattagacccaaggtattttg

SEQ ID NO: 6913594 - DNA, 22 bp, Homo sapiens
agtcccctggcaggagggacgt

SEQ ID NO: 6913595 - DNA, 22 bp, Homo sapiens
tctcacatctgccctgtgctgg

SEQ ID NO: 6913596 - DNA, 22 bp, Homo sapiens
tgaaatgacagtcttaagctct

SEQ ID NO: 6913597 - DNA, 22 bp, Homo sapiens
gttagctttaaacatgatcatt

SEQ ID NO: 6913598 - DNA, 22 bp, Homo sapiens
agcagcatacacatcatgttga

SEQ ID NO: 6913599 - DNA, 22 bp, Homo sapiens
cttcaaagatttgataaagcca

SEQ ID NO: 6913600 - DNA, 16 bp, Homo sapiens
aggctcagaggctgga

SEQ ID NO: 6913601 - DNA, 22 bp, Homo sapiens
cccaaggcatggcatggtggca

SEQ ID NO: 6913602 - DNA, 22 bp, Homo sapiens
tgtgccagaatgtttttataca

SEQ ID NO: 6913603 - DNA, 22 bp, Homo sapiens
ttaatcctcacaacaactttat

SEQ ID NO: 6913604 - DNA, 22 bp, Homo sapiens
taaagcaatgaaagttttgcag

SEQ ID NO: 6913605 - DNA, 22 bp, Homo sapiens
tattttcaccatgtatccctgt

SEQ ID NO: 6913606 - DNA, 22 bp, Homo sapiens
gggtaggagaggtgtctgtgtg

SEQ ID NO: 6913607 - DNA, 22 bp, Homo sapiens
ttctggatgatccatttacaga

SEQ ID NO: 6913608 - DNA, 22 bp, Homo sapiens
atttctgatagtaaaggtcttt

SEQ ID NO: 6913609 - DNA, 22 bp, Homo sapiens
agaagtctggaattcctgcagg

SEQ ID NO: 6913610 - DNA, 23 bp, Homo sapiens
ttgcatgtagcccatgagtaact

SEQ ID NO: 6913611 - DNA, 22 bp, Homo sapiens
gtaagtctctgtgtaagctaat

SEQ ID NO: 6913612 - DNA, 22 bp, Homo sapiens
cagataactgaaatatcatacc

SEQ ID NO: 6913613 - DNA, 22 bp, Homo sapiens
aggagctcttgatgcttgaggg

SEQ ID NO: 6913614 - DNA, 22 bp, Homo sapiens
gcgcaccacctccaggtggccg

SEQ ID NO: 6913615 - DNA, 22 bp, Homo sapiens
caagttttgcatagttctgtat

SEQ ID NO: 6913616 - DNA, 22 bp, Homo sapiens
aagttatttcctcgtgactgaa

SEQ ID NO: 6913617 - DNA, 22 bp, Homo sapiens
ttaaaaggcatcataggtgaat

SEQ ID NO: 6913618 - DNA, 22 bp, Homo sapiens
tgggaagtatcatttggcctgg

SEQ ID NO: 6913619 - DNA, 22 bp, Homo sapiens
ttgtgtccccctttgagagcca

SEQ ID NO: 6913620 - DNA, 22 bp, Homo sapiens
agtgatttcacgcttagggcta

SEQ ID NO: 6913621 - DNA, 22 bp, Homo sapiens
gagctgttttttaaagttagga

SEQ ID NO: 6913622 - DNA, 19 bp, Homo sapiens
tagatactgatgaactcca

SEQ ID NO: 6913623 - DNA, 22 bp, Homo sapiens
atacgccataggctcctcactt

SEQ ID NO: 6913624 - DNA, 22 bp, Homo sapiens
aatgtctgaggctcatctgagg

SEQ ID NO: 6913625 - DNA, 22 bp, Homo sapiens
cagaggaggcggtatacactgc

SEQ ID NO: 6913626 - DNA, 22 bp, Homo sapiens
ctctgagacttagcatctacat

SEQ ID NO: 6913627 - DNA, 22 bp, Homo sapiens
cagcttcttacgagctggtact

SEQ ID NO: 6913628 - DNA, 22 bp, Homo sapiens
ttacaatgcactcacctttaga

SEQ ID NO: 6913629 - DNA, 22 bp, Homo sapiens
aaggtgtgaactgattcattgg

SEQ ID NO: 6913630 - DNA, 22 bp, Homo sapiens
agacggcacctgggcagcttac

SEQ ID NO: 6913631 - DNA, 22 bp, Homo sapiens
tcagcaaaatgtggctagtgct

SEQ ID NO: 6913632 - DNA, 22 bp, Homo sapiens
aggcccagctggacaaactgct

SEQ ID NO: 6913633 - DNA, 22 bp, Homo sapiens
actctgagaactgagattccct

SEQ ID NO: 6913634 - DNA, 22 bp, Homo sapiens
aaacatgctggatttagaatat

SEQ ID NO: 6913635 - DNA, 22 bp, Homo sapiens
caggtctgggttgatggcctgg

SEQ ID NO: 6913636 - DNA, 22 bp, Homo sapiens
aagggctctgggctacgcactg

SEQ ID NO: 6913637 - DNA, 22 bp, Homo sapiens
tgctttgcagtgtctaacagaa

SEQ ID NO: 6913638 - DNA, 22 bp, Homo sapiens
gggaacttgctaaaatacagac

SEQ ID NO: 6913639 - DNA, 22 bp, Homo sapiens
aggttgggatgagtgggtgagc

SEQ ID NO: 6913640 - DNA, 22 bp, Homo sapiens
gcctggctcctaaggactggct

SEQ ID NO: 6913641 - DNA, 22 bp, Homo sapiens
attcaaagcccagtaaacattg

SEQ ID NO: 6913642 - DNA, 22 bp, Homo sapiens
tctagaaaaccaatattacatg

SEQ ID NO: 6913643 - DNA, 22 bp, Homo sapiens
atgcactgtgagagtgaggggt

SEQ ID NO: 6913644 - DNA, 22 bp, Homo sapiens
atgaggtagcttggcccagggg

SEQ ID NO: 6913645 - DNA, 22 bp, Homo sapiens
tcaggcttttcctgcctcctac

SEQ ID NO: 6913646 - DNA, 22 bp, Homo sapiens
aaaaggacaagctttggagtta

SEQ ID NO: 6913647 - DNA, 22 bp, Homo sapiens
gtccagagagatcttctgatag

SEQ ID NO: 6913648 - DNA, 22 bp, Homo sapiens
agagccctttctccaggcacct

SEQ ID NO: 6913649 - DNA, 22 bp, Homo sapiens
taggatatgcatttttatacat

SEQ ID NO: 6913650 - DNA, 22 bp, Homo sapiens
gctctgctctaacattcctgac

SEQ ID NO: 6913651 - DNA, 22 bp, Homo sapiens
attcgcacattaacactcatat

SEQ ID NO: 6913652 - DNA, 19 bp, Homo sapiens
tcccaggaagcaaatgtca

SEQ ID NO: 6913653 - DNA, 19 bp, Homo sapiens
tctgcaagtgtcagaggcg

SEQ ID NO: 6913654 - DNA, 22 bp, Homo sapiens
gaggagctcatgaaagcggtgt

SEQ ID NO: 6913655 - DNA, 22 bp, Homo sapiens
gagaactgattagcatttgcca

SEQ ID NO: 6913656 - DNA, 22 bp, Homo sapiens
atgcaggttaaagtttgagaat

SEQ ID NO: 6913657 - DNA, 22 bp, Homo sapiens
agctgaaccttagtctggagtg

SEQ ID NO: 6913658 - DNA, 22 bp, Homo sapiens
actgatgagtaggcagacaagg

SEQ ID NO: 6913659 - DNA, 22 bp, Homo sapiens
ccttcccatgcagcctgtctga

SEQ ID NO: 6913660 - DNA, 22 bp, Homo sapiens
ttctcagatgattcagataaac

SEQ ID NO: 6913661 - DNA, 20 bp, Homo sapiens
agtggcaaggtctctgctca

SEQ ID NO: 6913662 - DNA, 22 bp, Homo sapiens
ttatacatgtgttttgagatga

SEQ ID NO: 6913663 - DNA, 22 bp, Homo sapiens
attactgagcaacggtcatttc

SEQ ID NO: 6913664 - DNA, 22 bp, Homo sapiens
atcataggatttaggtccatct

SEQ ID NO: 6913665 - DNA, 19 bp, Homo sapiens
tttgcctgtataccctgtg

SEQ ID NO: 6913666 - DNA, 22 bp, Homo sapiens
ggggctgaacctggaggtggtc

SEQ ID NO: 6913667 - DNA, 22 bp, Homo sapiens
tccagaggggcagccctgtgct

SEQ ID NO: 6913668 - DNA, 22 bp, Homo sapiens
tgggaaggcagtcactgtccta

SEQ ID NO: 6913669 - DNA, 22 bp, Homo sapiens
cataacattgagcagcattcct

SEQ ID NO: 6913670 - DNA, 22 bp, Homo sapiens
cagtacttaacttataggagag

SEQ ID NO: 6913671 - DNA, 22 bp, Homo sapiens
tgcaagcaatccaggaaggcta

SEQ ID NO: 6913672 - DNA, 22 bp, Homo sapiens
tgcattatcgtcttgatcctct

SEQ ID NO: 6913673 - DNA, 22 bp, Homo sapiens
acagtctttgcaggagaaagga

SEQ ID NO: 6913674 - DNA, 22 bp, Homo sapiens
tgctgcagtatatatttcttgg

SEQ ID NO: 6913675 - DNA, 22 bp, Homo sapiens
gagaggtgaaatagttgtccgg

SEQ ID NO: 6913676 - DNA, 22 bp, Homo sapiens
aggagtctgttgaaatgtctat

SEQ ID NO: 6913677 - DNA, 22 bp, Homo sapiens
ttgaatctctctgagattcagt

SEQ ID NO: 6913678 - DNA, 22 bp, Homo sapiens
ttacttgatgatgtataaagtc

SEQ ID NO: 6913679 - DNA, 22 bp, Homo sapiens
aagaatttaaactaaccatatg

SEQ ID NO: 6913680 - DNA, 22 bp, Homo sapiens
ttacagcagtgggaaggagtca

SEQ ID NO: 6913681 - DNA, 22 bp, Homo sapiens
tgacactgcatatattgaagtt

SEQ ID NO: 6913682 - DNA, 22 bp, Homo sapiens
atggtgtatgtaaagtctgagg

SEQ ID NO: 6913683 - DNA, 22 bp, Homo sapiens
tggaaggagactgggaagtgtg

SEQ ID NO: 6913684 - DNA, 22 bp, Homo sapiens
atgagacatgacttcaggcctt

SEQ ID NO: 6913685 - DNA, 22 bp, Homo sapiens
tgagcagtcagacaagcatcac

SEQ ID NO: 6913686 - DNA, 22 bp, Homo sapiens
ttacttttctattcgatatgtg

SEQ ID NO: 6913687 - DNA, 22 bp, Homo sapiens
gaggtcttagaagaaaaatcat

SEQ ID NO: 6913688 - DNA, 22 bp, Homo sapiens
gaggaaccaatctgtgatattc

SEQ ID NO: 6913689 - DNA, 18 bp, Homo sapiens
gagagcccagcaggtggt

SEQ ID NO: 6913690 - DNA, 22 bp, Homo sapiens
gcctctgccctcctgggactgc

SEQ ID NO: 6913691 - DNA, 22 bp, Homo sapiens
gcctggagacaaggacaaaggg

SEQ ID NO: 6913692 - DNA, 22 bp, Homo sapiens
tataggaaggcagattttagct

SEQ ID NO: 6913693 - DNA, 22 bp, Homo sapiens
caggggcctggctgtctaggaa

SEQ ID NO: 6913694 - DNA, 22 bp, Homo sapiens
cactctaagaacacaaaggccc

SEQ ID NO: 6913695 - DNA, 22 bp, Homo sapiens
gcctggctaagcagaaggaccc

SEQ ID NO: 6913696 - DNA, 22 bp, Homo sapiens
tctgctctgtggcttcagctaa

SEQ ID NO: 6913697 - DNA, 23 bp, Homo sapiens
agaagcagcttctggagtatcgg

SEQ ID NO: 6913698 - DNA, 22 bp, Homo sapiens
aaggatcatgtatatgtttaag

SEQ ID NO: 6913699 - DNA, 22 bp, Homo sapiens
tgtgtcctgcagacagactcag

SEQ ID NO: 6913700 - DNA, 22 bp, Homo sapiens
gtttctctttgaagcctggctg

SEQ ID NO: 6913701 - DNA, 22 bp, Homo sapiens
ttcatgatggcagcatttatag

SEQ ID NO: 6913702 - DNA, 22 bp, Homo sapiens
tcacagtggagccaccaaggta

SEQ ID NO: 6913703 - DNA, 22 bp, Homo sapiens
tagaacttagcactagacttgt

SEQ ID NO: 6913704 - DNA, 22 bp, Homo sapiens
gcagtctttttcttctagctaa

SEQ ID NO: 6913705 - DNA, 22 bp, Homo sapiens
aggagccaggccccatggggct

SEQ ID NO: 6913706 - DNA, 22 bp, Homo sapiens
tttctgcttctcagaccctgaa

SEQ ID NO: 6913707 - DNA, 22 bp, Homo sapiens
ctcaggtacagatttgtggatt

SEQ ID NO: 6913708 - DNA, 22 bp, Homo sapiens
tgctgagggaggggttttccag

SEQ ID NO: 6913709 - DNA, 22 bp, Homo sapiens
tggcttttgttggtaccacctt

SEQ ID NO: 6913710 - DNA, 22 bp, Homo sapiens
tcagggagatttggggactcaa

SEQ ID NO: 6913711 - DNA, 23 bp, Homo sapiens
ctgccctgatcttgatctattgt

SEQ ID NO: 6913712 - DNA, 22 bp, Homo sapiens
tccagcccacacctgaagctgg

SEQ ID NO: 6913713 - DNA, 22 bp, Homo sapiens
agatgaatccacacatggcaaa

SEQ ID NO: 6913714 - DNA, 17 bp, Homo sapiens
agagagagcatgccacc

SEQ ID NO: 6913715 - DNA, 22 bp, Homo sapiens
ggacaggatgctgaagatgaag

SEQ ID NO: 6913716 - DNA, 19 bp, Homo sapiens
gctgtgcctctctcctgct

SEQ ID NO: 6913717 - DNA, 22 bp, Homo sapiens
aatgaaagaatgaaacagccca

SEQ ID NO: 6913718 - DNA, 22 bp, Homo sapiens
aacatggctgcaatcctagagg

SEQ ID NO: 6913719 - DNA, 22 bp, Homo sapiens
agtgaaaacctaatcatgcagt

SEQ ID NO: 6913720 - DNA, 22 bp, Homo sapiens
ggggctgggatttgaacccagg

SEQ ID NO: 6913721 - DNA, 22 bp, Homo sapiens
gtgccatcgggctcctcctgct

SEQ ID NO: 6913722 - DNA, 22 bp, Homo sapiens
ttttcaagagagtgttctatgt

SEQ ID NO: 6913723 - DNA, 22 bp, Homo sapiens
actcacagtccctgtaggagtg

SEQ ID NO: 6913724 - DNA, 23 bp, Homo sapiens
atggtccagccagctgcacagga

SEQ ID NO: 6913725 - DNA, 22 bp, Homo sapiens
attaatgtctaccagttgtgtg

SEQ ID NO: 6913726 - DNA, 22 bp, Homo sapiens
tgctctagcctgtaaaacatga

SEQ ID NO: 6913727 - DNA, 22 bp, Homo sapiens
aggactaaggaacagctgattc

SEQ ID NO: 6913728 - DNA, 21 bp, Homo sapiens
cagtcctgcaaataattcttt

SEQ ID NO: 6913729 - DNA, 22 bp, Homo sapiens
tctatataacctccacttctac

SEQ ID NO: 6913730 - DNA, 22 bp, Homo sapiens
tgttgagacacagacacaagcc

SEQ ID NO: 6913731 - DNA, 22 bp, Homo sapiens
aaaggaaaataagtagttccat

SEQ ID NO: 6913732 - DNA, 22 bp, Homo sapiens
ctagatccgcaggttttcagtg

SEQ ID NO: 6913733 - DNA, 22 bp, Homo sapiens
tttcattcagcaccctgaggtg

SEQ ID NO: 6913734 - DNA, 22 bp, Homo sapiens
agaaatgcctacgagataggga

SEQ ID NO: 6913735 - DNA, 22 bp, Homo sapiens
ggaggccaaagtgtgggcggct

SEQ ID NO: 6913736 - DNA, 22 bp, Homo sapiens
aatagactttctttttagaaca

SEQ ID NO: 6913737 - DNA, 22 bp, Homo sapiens
gcatgcaggagagaaagacggc

SEQ ID NO: 6913738 - DNA, 22 bp, Homo sapiens
aagctgtagcttttcaaaacgt

SEQ ID NO: 6913739 - DNA, 22 bp, Homo sapiens
ccaggacaagtgtggccatggc

SEQ ID NO: 6913740 - DNA, 22 bp, Homo sapiens
tggccttggagaggcacggccc

SEQ ID NO: 6913741 - DNA, 20 bp, Homo sapiens
cagggcacactgcagcctcg

SEQ ID NO: 6913742 - DNA, 22 bp, Homo sapiens
agtgatggcagtgaataaggct

SEQ ID NO: 6913743 - DNA, 19 bp, Homo sapiens
tgggcctcacaatgctccc

SEQ ID NO: 6913744 - DNA, 22 bp, Homo sapiens
tcacatgctgtgggatctgtat

SEQ ID NO: 6913745 - DNA, 23 bp, Homo sapiens
tgggttaatttattgccagctgc

SEQ ID NO: 6913746 - DNA, 22 bp, Homo sapiens
ttctgaaaattgggtcatactt

SEQ ID NO: 6913747 - DNA, 22 bp, Homo sapiens
gatttcttgacccctgtctcag

SEQ ID NO: 6913748 - DNA, 22 bp, Homo sapiens
gctgctctccatggccgtgagt

SEQ ID NO: 6913749 - DNA, 22 bp, Homo sapiens
tggaacaaaatatttatgtttg

SEQ ID NO: 6913750 - DNA, 22 bp, Homo sapiens
ctgaggcagaaaaagcaagggt

SEQ ID NO: 6913751 - DNA, 22 bp, Homo sapiens
tgagttaagaagtcccaggctg

SEQ ID NO: 6913752 - DNA, 22 bp, Homo sapiens
catatatgtgcagaccacttga

SEQ ID NO: 6913753 - DNA, 20 bp, Homo sapiens
tccaccaggaagggtaggga

SEQ ID NO: 6913754 - DNA, 22 bp, Homo sapiens
gtggggctgagtggagccagaa

SEQ ID NO: 6913755 - DNA, 22 bp, Homo sapiens
gtagacaagcacaggactcaga

SEQ ID NO: 6913756 - DNA, 22 bp, Homo sapiens
tcttttgtgccaagtaatgaat

SEQ ID NO: 6913757 - DNA, 22 bp, Homo sapiens
tcatgcagaggaaggctagttt

SEQ ID NO: 6913758 - DNA, 22 bp, Homo sapiens
tgtttttgttcaatgctaggtc

SEQ ID NO: 6913759 - DNA, 22 bp, Homo sapiens
gctgctgtccttagggagttct

SEQ ID NO: 6913760 - DNA, 22 bp, Homo sapiens
agttaactaaattaagagacaa

SEQ ID NO: 6913761 - DNA, 22 bp, Homo sapiens
tttccaagctgtcttggcccac

SEQ ID NO: 6913762 - DNA, 22 bp, Homo sapiens
aaaaagactagtcgagtgcagt

SEQ ID NO: 6913763 - DNA, 22 bp, Homo sapiens
tgtacttcacctggtccactag

SEQ ID NO: 6913764 - DNA, 21 bp, Homo sapiens
tcattggtcattaagctctgt

SEQ ID NO: 6913765 - DNA, 22 bp, Homo sapiens
ctgccagagatctgggcagagt

SEQ ID NO: 6913766 - DNA, 22 bp, Homo sapiens
ttctacctcagtttcccactta

SEQ ID NO: 6913767 - DNA, 22 bp, Homo sapiens
acagggctatattcctcagagt

SEQ ID NO: 6913768 - DNA, 22 bp, Homo sapiens
tgatgaccgccaacgtttaggt

SEQ ID NO: 6913769 - DNA, 21 bp, Homo sapiens
atttggcaaaggcgatgcaca

SEQ ID NO: 6913770 - DNA, 22 bp, Homo sapiens
agccagatgctattgctggaaa

SEQ ID NO: 6913771 - DNA, 22 bp, Homo sapiens
gcattcagggttcacggtcaac

SEQ ID NO: 6913772 - DNA, 22 bp, Homo sapiens
ttcctaaaagaatacactggat

SEQ ID NO: 6913773 - DNA, 21 bp, Homo sapiens
aaccagaggcagaaaggggaa

SEQ ID NO: 6913774 - DNA, 20 bp, Homo sapiens
tactgttgttgctgttgcca

SEQ ID NO: 6913775 - DNA, 22 bp, Homo sapiens
ggctacagactgcataagggca

SEQ ID NO: 6913776 - DNA, 22 bp, Homo sapiens
tcagggtgaaattgggtcctgg

SEQ ID NO: 6913777 - DNA, 22 bp, Homo sapiens
ttgacttttcttggtcacatga

SEQ ID NO: 6913778 - DNA, 22 bp, Homo sapiens
agatcacagagccaagattcca

SEQ ID NO: 6913779 - DNA, 22 bp, Homo sapiens
ctcagtgggcccatggcgtcct

SEQ ID NO: 6913780 - DNA, 22 bp, Homo sapiens
atttttggctgttgtcagaggt

SEQ ID NO: 6913781 - DNA, 22 bp, Homo sapiens
ctgtctttggtcctgtctgtta

SEQ ID NO: 6913782 - DNA, 22 bp, Homo sapiens
taacttctgcacagaaaatttg

SEQ ID NO: 6913783 - DNA, 23 bp, Homo sapiens
ccagcgctcactcagagcatgtt

SEQ ID NO: 6913784 - DNA, 20 bp, Homo sapiens
gtcagtgtcttcagtagtga

SEQ ID NO: 6913785 - DNA, 22 bp, Homo sapiens
ggtgctgactgaggatggcttg

SEQ ID NO: 6913786 - DNA, 22 bp, Homo sapiens
ggcaggctccaagcatcctatg

SEQ ID NO: 6913787 - DNA, 22 bp, Homo sapiens
cctgagggtcaaggagccctag

SEQ ID NO: 6913788 - DNA, 22 bp, Homo sapiens
tgacccatttgcttttcctgta

SEQ ID NO: 6913789 - DNA, 22 bp, Homo sapiens
ggagcacagccttgccagtacc

SEQ ID NO: 6913790 - DNA, 22 bp, Homo sapiens
atagctgtagaatgtatacaca

SEQ ID NO: 6913791 - DNA, 22 bp, Homo sapiens
tgtcatacatgcttgagctaca

SEQ ID NO: 6913792 - DNA, 22 bp, Homo sapiens
gcctggcgccgggctgcctgtc

SEQ ID NO: 6913793 - DNA, 22 bp, Homo sapiens
gggaatcttccttttttgtaag

SEQ ID NO: 6913794 - DNA, 22 bp, Homo sapiens
catcatgaagatgagaaagcat

SEQ ID NO: 6913795 - DNA, 22 bp, Homo sapiens
aggcctgaggaccttctggagg

SEQ ID NO: 6913796 - DNA, 22 bp, Homo sapiens
agagtctgggcactgggaatgc

SEQ ID NO: 6913797 - DNA, 22 bp, Homo sapiens
tctgggaagtgagatgctgtgt

SEQ ID NO: 6913798 - DNA, 22 bp, Homo sapiens
ccagtcagggcaggagcctggt

SEQ ID NO: 6913799 - DNA, 22 bp, Homo sapiens
gtctcccaatccgggacagcct

SEQ ID NO: 6913800 - DNA, 22 bp, Homo sapiens
gtctgaaagtagggctgatcta

SEQ ID NO: 6913801 - DNA, 22 bp, Homo sapiens
cccttctctttcactcactatt

SEQ ID NO: 6913802 - DNA, 22 bp, Homo sapiens
ctgtttgtctctctcctgaccc

SEQ ID NO: 6913803 - DNA, 22 bp, Homo sapiens
cagcaggcggcccgcgggcccg

SEQ ID NO: 6913804 - DNA, 22 bp, Homo sapiens
aaggctatttcctgtgaatcaa

SEQ ID NO: 6913805 - DNA, 22 bp, Homo sapiens
gggactgtcctctgtgtctgtg

SEQ ID NO: 6913806 - DNA, 22 bp, Homo sapiens
tggccgggaagggacagtgtgg

SEQ ID NO: 6913807 - DNA, 22 bp, Homo sapiens
ccctgtcacaatggatgacatt

SEQ ID NO: 6913808 - DNA, 22 bp, Homo sapiens
agaaatcacttaatgaacgtag

SEQ ID NO: 6913809 - DNA, 22 bp, Homo sapiens
aaggtatagagtttggaaaaat

SEQ ID NO: 6913810 - DNA, 22 bp, Homo sapiens
gacatgggatgagatgaagcat

SEQ ID NO: 6913811 - DNA, 22 bp, Homo sapiens
agtgtttagttaagatttcaaa

SEQ ID NO: 6913812 - DNA, 22 bp, Homo sapiens
actagggaaagttatgttcaca

SEQ ID NO: 6913813 - DNA, 21 bp, Homo sapiens
agatcctggggtctggggagg

SEQ ID NO: 6913814 - DNA, 22 bp, Homo sapiens
gaatacatatcagatgtgtttc

SEQ ID NO: 6913815 - DNA, 22 bp, Homo sapiens
tggcattggtaccaaagctgta

SEQ ID NO: 6913816 - DNA, 22 bp, Homo sapiens
cccagagatcttgtcctttcca

SEQ ID NO: 6913817 - DNA, 22 bp, Homo sapiens
gagacacacccaaggttatgag

SEQ ID NO: 6913818 - DNA, 22 bp, Homo sapiens
ccagcttttcttatcattataa

SEQ ID NO: 6913819 - DNA, 22 bp, Homo sapiens
tgccacaggcaatccctgcacg

SEQ ID NO: 6913820 - DNA, 19 bp, Homo sapiens
tccaaggcatggcccagtg

SEQ ID NO: 6913821 - DNA, 22 bp, Homo sapiens
tgacattttatcaatatcacag

SEQ ID NO: 6913822 - DNA, 23 bp, Homo sapiens
ttctcctgaggaagcagggactg

SEQ ID NO: 6913823 - DNA, 22 bp, Homo sapiens
ttcagtttcaaatcctggatgc

SEQ ID NO: 6913824 - DNA, 22 bp, Homo sapiens
ttggctgaatgaggtcaccttt

SEQ ID NO: 6913825 - DNA, 22 bp, Homo sapiens
attcatgttttcttgcttcaag

SEQ ID NO: 6913826 - DNA, 22 bp, Homo sapiens
cccaggctggcctccgcagtgc

SEQ ID NO: 6913827 - DNA, 20 bp, Homo sapiens
ctgcatcagcggccgcgtct

SEQ ID NO: 6913828 - DNA, 20 bp, Homo sapiens
gagagctggaaataaagtcc

SEQ ID NO: 6913829 - DNA, 22 bp, Homo sapiens
cattggcacaagtagcttcatc

SEQ ID NO: 6913830 - DNA, 22 bp, Homo sapiens
tctgttaggttactggttctgt

SEQ ID NO: 6913831 - DNA, 22 bp, Homo sapiens
catcgccctggggtcctgcctt

SEQ ID NO: 6913832 - DNA, 22 bp, Homo sapiens
ccagggtgagtgtcatgggtta

SEQ ID NO: 6913833 - DNA, 22 bp, Homo sapiens
ccccctggcaggctggcctctc

SEQ ID NO: 6913834 - DNA, 21 bp, Homo sapiens
gagtacctttagtatgttacc

SEQ ID NO: 6913835 - DNA, 20 bp, Homo sapiens
aggcaaggtagatgtctgct

SEQ ID NO: 6913836 - DNA, 22 bp, Homo sapiens
ttgatttcttattaccctagtt

SEQ ID NO: 6913837 - DNA, 22 bp, Homo sapiens
gagccccttctgcagtcaggtt

SEQ ID NO: 6913838 - DNA, 22 bp, Homo sapiens
atacatatgaatgatttggctc

SEQ ID NO: 6913839 - DNA, 23 bp, Homo sapiens
tgtgaattgaggacatcaaaagc

SEQ ID NO: 6913840 - DNA, 22 bp, Homo sapiens
ctataagacagatactgacttt

SEQ ID NO: 6913841 - DNA, 22 bp, Homo sapiens
acagagtcctagctgcaaagaa

SEQ ID NO: 6913842 - DNA, 22 bp, Homo sapiens
gggagcttctggaaggcaggaa

SEQ ID NO: 6913843 - DNA, 22 bp, Homo sapiens
gcaaaactcgcaattacttttg

SEQ ID NO: 6913844 - DNA, 22 bp, Homo sapiens
gtccaaatttttcacatgtaga

SEQ ID NO: 6913845 - DNA, 22 bp, Homo sapiens
gcttgcatgattggagtgggtg

SEQ ID NO: 6913846 - DNA, 22 bp, Homo sapiens
agggtgactttgggcaagttac

SEQ ID NO: 6913847 - DNA, 22 bp, Homo sapiens
cttgctggctggcaacctgggc

SEQ ID NO: 6913848 - DNA, 22 bp, Homo sapiens
tctccaggcctttcccatctta

SEQ ID NO: 6913849 - DNA, 22 bp, Homo sapiens
ccagaaatggccctcaggtgac

SEQ ID NO: 6913850 - DNA, 22 bp, Homo sapiens
tgctatcctggtctaattagaa

SEQ ID NO: 6913851 - DNA, 22 bp, Homo sapiens
aaagactcaattgttccctaat

SEQ ID NO: 6913852 - DNA, 22 bp, Homo sapiens
aaatggaactgttgtgcatttg

SEQ ID NO: 6913853 - DNA, 22 bp, Homo sapiens
tgtctttacttaataaatatac

SEQ ID NO: 6913854 - DNA, 23 bp, Homo sapiens
ttgagctcagtagctctgctggt

SEQ ID NO: 6913855 - DNA, 22 bp, Homo sapiens
taggccttttctcgtttctcca

SEQ ID NO: 6913856 - DNA, 21 bp, Homo sapiens
gccatgtttccttactaagag

SEQ ID NO: 6913857 - DNA, 22 bp, Homo sapiens
acatttgaaattctgaacagat

SEQ ID NO: 6913858 - DNA, 22 bp, Homo sapiens
ctgtggctctctgcagggtccc

SEQ ID NO: 6913859 - DNA, 22 bp, Homo sapiens
attctcatttttatagatgaga

SEQ ID NO: 6913860 - DNA, 22 bp, Homo sapiens
gttcaagtttctgagctttaat

SEQ ID NO: 6913861 - DNA, 22 bp, Homo sapiens
attgcccttgcccattgagagt

SEQ ID NO: 6913862 - DNA, 22 bp, Homo sapiens
tgggtggcagcttcagcatgtt

SEQ ID NO: 6913863 - DNA, 22 bp, Homo sapiens
tgtgaggcgaggccagtgagct

SEQ ID NO: 6913864 - DNA, 22 bp, Homo sapiens
tctcgacagcctggcacagtgg

SEQ ID NO: 6913865 - DNA, 22 bp, Homo sapiens
tctgctgcacaaattcatctct

SEQ ID NO: 6913866 - DNA, 20 bp, Homo sapiens
tcagattaaatgttctgtct

SEQ ID NO: 6913867 - DNA, 20 bp, Homo sapiens
acatgcagtggtcatttcag

SEQ ID NO: 6913868 - DNA, 22 bp, Homo sapiens
tgtccatggatagagctgctcg

SEQ ID NO: 6913869 - DNA, 22 bp, Homo sapiens
aagtgacataccttacatatgt

SEQ ID NO: 6913870 - DNA, 19 bp, Homo sapiens
tgagtgaaggccgtggtgg

SEQ ID NO: 6913871 - DNA, 23 bp, Homo sapiens
tttacagggcactcttatgcagc

SEQ ID NO: 6913872 - DNA, 22 bp, Homo sapiens
gctgcggtgaacttggatggtg

SEQ ID NO: 6913873 - DNA, 22 bp, Homo sapiens
gtttaatcagaggaattataga

SEQ ID NO: 6913874 - DNA, 22 bp, Homo sapiens
gttcttcatcattttagatagg

SEQ ID NO: 6913875 - DNA, 20 bp, Homo sapiens
agaactgttgtttgggtcct

SEQ ID NO: 6913876 - DNA, 22 bp, Homo sapiens
gactacaggccggcatcagaga

SEQ ID NO: 6913877 - DNA, 22 bp, Homo sapiens
agccctgaagctggccatgtcc

SEQ ID NO: 6913878 - DNA, 20 bp, Homo sapiens
gggtcctgacttggtctcct

SEQ ID NO: 6913879 - DNA, 22 bp, Homo sapiens
atgcagttaggtaatagtctca

SEQ ID NO: 6913880 - DNA, 22 bp, Homo sapiens
gtgcatgtcggggtgcatgtca

SEQ ID NO: 6913881 - DNA, 22 bp, Homo sapiens
tgaggtggccgaggagcaggac

SEQ ID NO: 6913882 - DNA, 22 bp, Homo sapiens
ctgcagagtggagcctcggctg

SEQ ID NO: 6913883 - DNA, 22 bp, Homo sapiens
tgtgagttcttattgctcatct

SEQ ID NO: 6913884 - DNA, 22 bp, Homo sapiens
ctctggtcccctgtcaccagtt

SEQ ID NO: 6913885 - DNA, 22 bp, Homo sapiens
ggctctgaaggagacagctgct

SEQ ID NO: 6913886 - DNA, 22 bp, Homo sapiens
gaattgtagagggaacagaagc

SEQ ID NO: 6913887 - DNA, 22 bp, Homo sapiens
tttcaatttccaggctagaatt

SEQ ID NO: 6913888 - DNA, 22 bp, Homo sapiens
tcacagggtgtacatcacctat

SEQ ID NO: 6913889 - DNA, 22 bp, Homo sapiens
tcatttaataatttttgagtag

SEQ ID NO: 6913890 - DNA, 22 bp, Homo sapiens
gtgggtgtgggcttagcccaga

SEQ ID NO: 6913891 - DNA, 22 bp, Homo sapiens
tgcaggcaccattctgcctctc

SEQ ID NO: 6913892 - DNA, 20 bp, Homo sapiens
aagctgtcagaggtggacag

SEQ ID NO: 6913893 - DNA, 22 bp, Homo sapiens
taaggcaaagtgatttcttaaa

SEQ ID NO: 6913894 - DNA, 22 bp, Homo sapiens
tactaggtggtgaatataagta

SEQ ID NO: 6913895 - DNA, 23 bp, Homo sapiens
taagtgattagaatttgctgtca

SEQ ID NO: 6913896 - DNA, 22 bp, Homo sapiens
ctgggtctgtgcccagggacct

SEQ ID NO: 6913897 - DNA, 21 bp, Homo sapiens
agacaatgctgtaaaattcag

SEQ ID NO: 6913898 - DNA, 22 bp, Homo sapiens
cctggctgaaccaatgaagtgg

SEQ ID NO: 6913899 - DNA, 22 bp, Homo sapiens
tctgggctctgcgaagcccttc

SEQ ID NO: 6913900 - DNA, 22 bp, Homo sapiens
tcccaaggtgctcggcaacagg

SEQ ID NO: 6913901 - DNA, 22 bp, Homo sapiens
ctgcaagattggaagatgcaat

SEQ ID NO: 6913902 - DNA, 22 bp, Homo sapiens
ctggggggagctgcgtccagca

SEQ ID NO: 6913903 - DNA, 22 bp, Homo sapiens
cctgcctgattccaggatggct

SEQ ID NO: 6913904 - DNA, 22 bp, Homo sapiens
acccattcctctcctgagggat

SEQ ID NO: 6913905 - DNA, 22 bp, Homo sapiens
cagtcacagtgacaggatgtgg

SEQ ID NO: 6913906 - DNA, 22 bp, Homo sapiens
tctctgggagttgagcagcagc

SEQ ID NO: 6913907 - DNA, 22 bp, Homo sapiens
aggcttgccacttgttagtcta

SEQ ID NO: 6913908 - DNA, 22 bp, Homo sapiens
cagttattttgaggattaaatg

SEQ ID NO: 6913909 - DNA, 22 bp, Homo sapiens
taaagcaggccacatatgtgat

SEQ ID NO: 6913910 - DNA, 22 bp, Homo sapiens
attaaggaacaaagccttttga

SEQ ID NO: 6913911 - DNA, 22 bp, Homo sapiens
gcctttatcttcctgattcaga

SEQ ID NO: 6913912 - DNA, 22 bp, Homo sapiens
tgctcccaaacgacctactgtg

SEQ ID NO: 6913913 - DNA, 22 bp, Homo sapiens
cccacgacttgtctgcatttgg

SEQ ID NO: 6913914 - DNA, 22 bp, Homo sapiens
gccacaggaaagcaccctggag

SEQ ID NO: 6913915 - DNA, 23 bp, Homo sapiens
atataaacaccagatagattgta

SEQ ID NO: 6913916 - DNA, 22 bp, Homo sapiens
gcaggctcagagcagattagca

SEQ ID NO: 6913917 - DNA, 22 bp, Homo sapiens
tccaggaaatcagaagtggtaa

SEQ ID NO: 6913918 - DNA, 22 bp, Homo sapiens
ttcagataaattgttttgtgat

SEQ ID NO: 6913919 - DNA, 22 bp, Homo sapiens
acatgtttacattaggtgatat

SEQ ID NO: 6913920 - DNA, 21 bp, Homo sapiens
aaagacttgcctgaaagtgag

SEQ ID NO: 6913921 - DNA, 21 bp, Homo sapiens
ttgcttatggcactgctttgc

SEQ ID NO: 6913922 - DNA, 22 bp, Homo sapiens
gaaacaggccaggttccaggcc

SEQ ID NO: 6913923 - DNA, 22 bp, Homo sapiens
acctgcccacatatatatgtat

SEQ ID NO: 6913924 - DNA, 22 bp, Homo sapiens
agtgccatgtagtccagcagaa

SEQ ID NO: 6913925 - DNA, 19 bp, Homo sapiens
acagcctgttggtggggct

SEQ ID NO: 6913926 - DNA, 22 bp, Homo sapiens
acttggcttcaaggttaaggtc

SEQ ID NO: 6913927 - DNA, 22 bp, Homo sapiens
ggccagtaagagataggaggca

SEQ ID NO: 6913928 - DNA, 22 bp, Homo sapiens
tagtgcaaaggtcttgcaccag

SEQ ID NO: 6913929 - DNA, 19 bp, Homo sapiens
gcaccctgaggtcatggcc

SEQ ID NO: 6913930 - DNA, 22 bp, Homo sapiens
aaccctctcttattctttgcca

SEQ ID NO: 6913931 - DNA, 22 bp, Homo sapiens
ggcatgcaaaacaactcagaga

SEQ ID NO: 6913932 - DNA, 22 bp, Homo sapiens
gctgctggccccacatgctcca

SEQ ID NO: 6913933 - DNA, 22 bp, Homo sapiens
tgtagatgagtcagggtgcacc

SEQ ID NO: 6913934 - DNA, 15 bp, Homo sapiens
tccaggcattcattc

SEQ ID NO: 6913935 - DNA, 22 bp, Homo sapiens
ctgtgttggcttttctcttgta

SEQ ID NO: 6913936 - DNA, 22 bp, Homo sapiens
tattccagtcctatcctctttt

SEQ ID NO: 6913937 - DNA, 22 bp, Homo sapiens
aaagctgggggccctggtctag

SEQ ID NO: 6913938 - DNA, 22 bp, Homo sapiens
tgcaaagaagggctgaggagca

SEQ ID NO: 6913939 - DNA, 22 bp, Homo sapiens
gcatggcttacagaggctgcag

SEQ ID NO: 6913940 - DNA, 22 bp, Homo sapiens
aggccaaagtgctccttttaga

SEQ ID NO: 6913941 - DNA, 22 bp, Homo sapiens
cccaataaaattcattttcatt

SEQ ID NO: 6913942 - DNA, 22 bp, Homo sapiens
agttcctgaacttcttaatgac

SEQ ID NO: 6913943 - DNA, 22 bp, Homo sapiens
ttagatttatatgtgagaatgg

SEQ ID NO: 6913944 - DNA, 22 bp, Homo sapiens
ctggaacagtgttggagcttga

SEQ ID NO: 6913945 - DNA, 22 bp, Homo sapiens
aatggaacctagttatccacat

SEQ ID NO: 6913946 - DNA, 22 bp, Homo sapiens
tgtcagagagcaggcagtagaa

SEQ ID NO: 6913947 - DNA, 22 bp, Homo sapiens
ctgtgcattgttgagtgtttag

SEQ ID NO: 6913948 - DNA, 22 bp, Homo sapiens
tcagtggtggaagcagcaaacc

SEQ ID NO: 6913949 - DNA, 22 bp, Homo sapiens
tggaagaaaattcaatcgagtt

SEQ ID NO: 6913950 - DNA, 22 bp, Homo sapiens
tctggggtgaggcctggttatc

SEQ ID NO: 6913951 - DNA, 22 bp, Homo sapiens
caggtgaaaaagcaaccatatt

SEQ ID NO: 6913952 - DNA, 19 bp, Homo sapiens
tggctcttgtgggactgca

SEQ ID NO: 6913953 - DNA, 20 bp, Homo sapiens
ggcaggaccccagtggcatc

SEQ ID NO: 6913954 - DNA, 22 bp, Homo sapiens
gacagggtacgggctaggcaca

SEQ ID NO: 6913955 - DNA, 22 bp, Homo sapiens
ggcagacctgtagacatttgcc

SEQ ID NO: 6913956 - DNA, 22 bp, Homo sapiens
gcagggcaatgatcccgagagg

SEQ ID NO: 6913957 - DNA, 23 bp, Homo sapiens
gctgtcgccagagccccacctac

SEQ ID NO: 6913958 - DNA, 22 bp, Homo sapiens
actgaaagataaatcagttagc

SEQ ID NO: 6913959 - DNA, 22 bp, Homo sapiens
agggaacccaactgactgacag

SEQ ID NO: 6913960 - DNA, 22 bp, Homo sapiens
caactgtagggattgagttttc

SEQ ID NO: 6913961 - DNA, 22 bp, Homo sapiens
ctttagttgtctcctcaagggt

SEQ ID NO: 6913962 - DNA, 22 bp, Homo sapiens
gtatttcttgtacttccttgtc

SEQ ID NO: 6913963 - DNA, 22 bp, Homo sapiens
gttcagagtgggaatgatcact

SEQ ID NO: 6913964 - DNA, 22 bp, Homo sapiens
tggcaggtgcctgtaatctcag

SEQ ID NO: 6913965 - DNA, 22 bp, Homo sapiens
ttccatccatatcttgttgagg

SEQ ID NO: 6913966 - DNA, 23 bp, Homo sapiens
agtgctcccaggacctggggcag

SEQ ID NO: 6913967 - DNA, 22 bp, Homo sapiens
aggctccatggttctccctcag

SEQ ID NO: 6913968 - DNA, 22 bp, Homo sapiens
tgagatcatttatttacctttc

SEQ ID NO: 6913969 - DNA, 22 bp, Homo sapiens
gtctggaatatagcaagctctt

SEQ ID NO: 6913970 - DNA, 22 bp, Homo sapiens
cttggagcaacacatgacatct

SEQ ID NO: 6913971 - DNA, 22 bp, Homo sapiens
ggatgcaggaggtcggggagca

SEQ ID NO: 6913972 - DNA, 21 bp, Homo sapiens
tacaatgcacaggagagcctc

SEQ ID NO: 6913973 - DNA, 22 bp, Homo sapiens
attcagaagctattcttagttc

SEQ ID NO: 6913974 - DNA, 22 bp, Homo sapiens
actgtttaaaggcttcctttct

SEQ ID NO: 6913975 - DNA, 22 bp, Homo sapiens
ttcattgagtataggggtatac

SEQ ID NO: 6913976 - DNA, 22 bp, Homo sapiens
cacaggttaggtattatactat

SEQ ID NO: 6913977 - DNA, 22 bp, Homo sapiens
aagacaatttatgttagggtca

SEQ ID NO: 6913978 - DNA, 23 bp, Homo sapiens
ctttgcaaaaacattagtcagtg

SEQ ID NO: 6913979 - DNA, 23 bp, Homo sapiens
gctgccacagggctcaggcaggt

SEQ ID NO: 6913980 - DNA, 22 bp, Homo sapiens
tatcacacgccttgcttcattt

SEQ ID NO: 6913981 - DNA, 22 bp, Homo sapiens
tcatggggtgaattagtatgct

SEQ ID NO: 6913982 - DNA, 22 bp, Homo sapiens
ttcttctaaatgtgcttattaa

SEQ ID NO: 6913983 - DNA, 22 bp, Homo sapiens
cagacatgatgtaagcagaggc

SEQ ID NO: 6913984 - DNA, 22 bp, Homo sapiens
tctctaacctaatgtggaggga

SEQ ID NO: 6913985 - DNA, 22 bp, Homo sapiens
taggagctaaaatattttatat

SEQ ID NO: 6913986 - DNA, 21 bp, Homo sapiens
actgcaaacagcagagactga

SEQ ID NO: 6913987 - DNA, 22 bp, Homo sapiens
ttagtgatgggttgaagttaac

SEQ ID NO: 6913988 - DNA, 22 bp, Homo sapiens
tttctcttgcgatatgctacac

SEQ ID NO: 6913989 - DNA, 22 bp, Homo sapiens
ttattaggaaaaggtcagatgt

SEQ ID NO: 6913990 - DNA, 22 bp, Homo sapiens
tgattctatggaaggcataagg

SEQ ID NO: 6913991 - DNA, 22 bp, Homo sapiens
tagcatctgaactgttgaaaag

SEQ ID NO: 6913992 - DNA, 22 bp, Homo sapiens
ggccccagcagaccctcctctg

SEQ ID NO: 6913993 - DNA, 22 bp, Homo sapiens
tacctcagattgctgccttggg

SEQ ID NO: 6913994 - DNA, 22 bp, Homo sapiens
ttgacacagtcaacttgatttt

SEQ ID NO: 6913995 - DNA, 19 bp, Homo sapiens
agacagagactgaaataga

SEQ ID NO: 6913996 - DNA, 22 bp, Homo sapiens
gtgcaaaaataattgtggtttt

SEQ ID NO: 6913997 - DNA, 22 bp, Homo sapiens
ggctggctggatgaatggatta

SEQ ID NO: 6913998 - DNA, 22 bp, Homo sapiens
acagcaggggtggaataaacgt

SEQ ID NO: 6913999 - DNA, 22 bp, Homo sapiens
ggcacaggagtcacagcatttc

SEQ ID NO: 6914000 - DNA, 22 bp, Homo sapiens
gctcatcccttaggaggaaggc

SEQ ID NO: 6914001 - DNA, 22 bp, Homo sapiens
atgcctgtgctatattctcaca

SEQ ID NO: 6914002 - DNA, 19 bp, Homo sapiens
gactaaataaactctcccc

SEQ ID NO: 6914003 - DNA, 22 bp, Homo sapiens
agagggttgaacctataaacta

SEQ ID NO: 6914004 - DNA, 22 bp, Homo sapiens
ccacagggactgttaaaaccct

SEQ ID NO: 6914005 - DNA, 22 bp, Homo sapiens
taatatgtgttactgacttttt

SEQ ID NO: 6914006 - DNA, 22 bp, Homo sapiens
cacatgaacatgctggaaaagc

SEQ ID NO: 6914007 - DNA, 22 bp, Homo sapiens
cttcagtgtcctctctagtaga

SEQ ID NO: 6914008 - DNA, 17 bp, Homo sapiens
tttggcagtcttttaca

SEQ ID NO: 6914009 - DNA, 22 bp, Homo sapiens
agctaggaaattgaggctgaga

SEQ ID NO: 6914010 - DNA, 22 bp, Homo sapiens
ttactagccatgtgtgagaaga

SEQ ID NO: 6914011 - DNA, 22 bp, Homo sapiens
tagctcctccccatccaggttc

SEQ ID NO: 6914012 - DNA, 22 bp, Homo sapiens
ttggctgagagaggaaaagggc

SEQ ID NO: 6914013 - DNA, 22 bp, Homo sapiens
tggaggtgtccaactcgtgggt

SEQ ID NO: 6914014 - DNA, 22 bp, Homo sapiens
ttggcagaaatgtggctgggag

SEQ ID NO: 6914015 - DNA, 22 bp, Homo sapiens
ctaaaggctcagcattcttttc

SEQ ID NO: 6914016 - DNA, 22 bp, Homo sapiens
ccagcccaaacaagccgccttc

SEQ ID NO: 6914017 - DNA, 22 bp, Homo sapiens
tgctggagtctcttgaccctgg

SEQ ID NO: 6914018 - DNA, 22 bp, Homo sapiens
tggaagacagttgatgggagtt

SEQ ID NO: 6914019 - DNA, 22 bp, Homo sapiens
ggacaggttcagcagtttataa

SEQ ID NO: 6914020 - DNA, 22 bp, Homo sapiens
aagcacagtgccaagttctatt

SEQ ID NO: 6914021 - DNA, 22 bp, Homo sapiens
caacttcaccagggttcctaga

SEQ ID NO: 6914022 - DNA, 21 bp, Homo sapiens
cttgtctgcagtgtttatagc

SEQ ID NO: 6914023 - DNA, 22 bp, Homo sapiens
gtctgcacggggaggatgggct

SEQ ID NO: 6914024 - DNA, 23 bp, Homo sapiens
tggctctgagaggttcagatgct

SEQ ID NO: 6914025 - DNA, 22 bp, Homo sapiens
tattgcatttcccacgttcact

SEQ ID NO: 6914026 - DNA, 20 bp, Homo sapiens
aaatttaggaaattttacgc

SEQ ID NO: 6914027 - DNA, 22 bp, Homo sapiens
acattctctccatgtcttcttt

SEQ ID NO: 6914028 - DNA, 21 bp, Homo sapiens
atggagggaccagggaagcag

SEQ ID NO: 6914029 - DNA, 22 bp, Homo sapiens
acaactccttcttgggtcctgg

SEQ ID NO: 6914030 - DNA, 22 bp, Homo sapiens
gccttcagtaactgagacggaa

SEQ ID NO: 6914031 - DNA, 22 bp, Homo sapiens
atgttttatgttccactcaagg

SEQ ID NO: 6914032 - DNA, 22 bp, Homo sapiens
aataatactgcatgtaaggtgc

SEQ ID NO: 6914033 - DNA, 22 bp, Homo sapiens
actttgccattgcaaatacaca

SEQ ID NO: 6914034 - DNA, 22 bp, Homo sapiens
gttagcaccagtgctcataaca

SEQ ID NO: 6914035 - DNA, 22 bp, Homo sapiens
tgagctgtgattaactctgaga

SEQ ID NO: 6914036 - DNA, 22 bp, Homo sapiens
tgcaggcagctgaaaggtgcct

SEQ ID NO: 6914037 - DNA, 22 bp, Homo sapiens
tactccaggactccatttgaaa

SEQ ID NO: 6914038 - DNA, 22 bp, Homo sapiens
acaagtagtaaattattaggtg

SEQ ID NO: 6914039 - DNA, 22 bp, Homo sapiens
gataaagtagatttgttctaga

SEQ ID NO: 6914040 - DNA, 22 bp, Homo sapiens
tctctcagctttgagacctgct

SEQ ID NO: 6914041 - DNA, 20 bp, Homo sapiens
tttcttgtcggctgttgctg

SEQ ID NO: 6914042 - DNA, 22 bp, Homo sapiens
ggaggcttgatgatcttggata

SEQ ID NO: 6914043 - DNA, 18 bp, Homo sapiens
tgtctcagttctgctatg

SEQ ID NO: 6914044 - DNA, 22 bp, Homo sapiens
ctgtgctgagtgatgtgactta

SEQ ID NO: 6914045 - DNA, 22 bp, Homo sapiens
taaattgctgattttagatgct

SEQ ID NO: 6914046 - DNA, 22 bp, Homo sapiens
tcaagaaaatgacgccaacctt

SEQ ID NO: 6914047 - DNA, 22 bp, Homo sapiens
gctgcagacttctcatctcatt

SEQ ID NO: 6914048 - DNA, 22 bp, Homo sapiens
agtgtacatgtttacagcatct

SEQ ID NO: 6914049 - DNA, 22 bp, Homo sapiens
caggtgggccggggtttgttct

SEQ ID NO: 6914050 - DNA, 22 bp, Homo sapiens
gatgtccatttcaaacctcatt

SEQ ID NO: 6914051 - DNA, 22 bp, Homo sapiens
aggttgaacccccaagacctat

SEQ ID NO: 6914052 - DNA, 22 bp, Homo sapiens
taattatgtatgcaagctcagt

SEQ ID NO: 6914053 - DNA, 22 bp, Homo sapiens
acaaaggtgagcagaagacaca

SEQ ID NO: 6914054 - DNA, 22 bp, Homo sapiens
tctgaatttcccaaggctatct

SEQ ID NO: 6914055 - DNA, 22 bp, Homo sapiens
gaacacctgggtcccctggggc

SEQ ID NO: 6914056 - DNA, 22 bp, Homo sapiens
aacagtatggaagccattagga

SEQ ID NO: 6914057 - DNA, 22 bp, Homo sapiens
tctggatggtcagctcttcctg

SEQ ID NO: 6914058 - DNA, 22 bp, Homo sapiens
ggtgaaggtggaacgcagagca

SEQ ID NO: 6914059 - DNA, 22 bp, Homo sapiens
ggttatcagttcacttatgtaa

SEQ ID NO: 6914060 - DNA, 22 bp, Homo sapiens
tcctgaagtattgtttgagtaa

SEQ ID NO: 6914061 - DNA, 22 bp, Homo sapiens
tttcagaggtatgctgcttatc

SEQ ID NO: 6914062 - DNA, 22 bp, Homo sapiens
tgcggggccctcccgtgcactg

SEQ ID NO: 6914063 - DNA, 22 bp, Homo sapiens
tgacatttcggtgtatgtgatg

SEQ ID NO: 6914064 - DNA, 22 bp, Homo sapiens
ctgcagctgtgagtgctggatg

SEQ ID NO: 6914065 - DNA, 22 bp, Homo sapiens
ggctcttgagaggcacaggttt

SEQ ID NO: 6914066 - DNA, 22 bp, Homo sapiens
tgagagtggttcagctcagaag

SEQ ID NO: 6914067 - DNA, 22 bp, Homo sapiens
ggtctgccacaagatttttgag

SEQ ID NO: 6914068 - DNA, 22 bp, Homo sapiens
ttcttcaattattggaaagaaa

SEQ ID NO: 6914069 - DNA, 22 bp, Homo sapiens
tcactgtatttgctgatgcata

SEQ ID NO: 6914070 - DNA, 19 bp, Homo sapiens
tcagcttctgtgtattgta

SEQ ID NO: 6914071 - DNA, 22 bp, Homo sapiens
gaacctcagtgaaactggaggt

SEQ ID NO: 6914072 - DNA, 22 bp, Homo sapiens
tctgagggggtgtttataagct

SEQ ID NO: 6914073 - DNA, 22 bp, Homo sapiens
attctctttgtataacatcttg

SEQ ID NO: 6914074 - DNA, 22 bp, Homo sapiens
ctcataatgtgactgtatttga

SEQ ID NO: 6914075 - DNA, 22 bp, Homo sapiens
tcacagcaaatgctgcttctca

SEQ ID NO: 6914076 - DNA, 22 bp, Homo sapiens
tatactttcctgcaactttgat

SEQ ID NO: 6914077 - DNA, 21 bp, Homo sapiens
gagaactgaaccagagcagct

SEQ ID NO: 6914078 - DNA, 22 bp, Homo sapiens
ttgcatgcacctaacaaattat

SEQ ID NO: 6914079 - DNA, 23 bp, Homo sapiens
ctgcagccgcgtggggacgtgga

SEQ ID NO: 6914080 - DNA, 22 bp, Homo sapiens
tagcaaactaccacaaactggg

SEQ ID NO: 6914081 - DNA, 22 bp, Homo sapiens
agtccaggcctccctctcctgc

SEQ ID NO: 6914082 - DNA, 22 bp, Homo sapiens
ctgagcagcagggagactggtg

SEQ ID NO: 6914083 - DNA, 22 bp, Homo sapiens
gaggtcataattggtttgtagt

SEQ ID NO: 6914084 - DNA, 22 bp, Homo sapiens
acctgctcaactggcttctcgc

SEQ ID NO: 6914085 - DNA, 22 bp, Homo sapiens
tgcagggaatgcttgcagcatg

SEQ ID NO: 6914086 - DNA, 23 bp, Homo sapiens
tctctgggtgggctgtgtctata

SEQ ID NO: 6914087 - DNA, 22 bp, Homo sapiens
agcaggtcgccgaagatagctc

SEQ ID NO: 6914088 - DNA, 20 bp, Homo sapiens
caccagtcatgagtcaatac

SEQ ID NO: 6914089 - DNA, 20 bp, Homo sapiens
ccttggcttaataataggga

SEQ ID NO: 6914090 - DNA, 20 bp, Homo sapiens
gcagtgctggtgcctctgct

SEQ ID NO: 6914091 - DNA, 22 bp, Homo sapiens
gcgacctcctgcctgagagtct

SEQ ID NO: 6914092 - DNA, 22 bp, Homo sapiens
ctgaagccagtttgctgccctt

SEQ ID NO: 6914093 - DNA, 22 bp, Homo sapiens
tgcagaagtgagtcatgaggaa

SEQ ID NO: 6914094 - DNA, 22 bp, Homo sapiens
gatgtttcccacactgtttccc

SEQ ID NO: 6914095 - DNA, 22 bp, Homo sapiens
ctctgcattttaacagatgatt

SEQ ID NO: 6914096 - DNA, 22 bp, Homo sapiens
tcagtacaaaggtgctctcaag

SEQ ID NO: 6914097 - DNA, 22 bp, Homo sapiens
attggctttgatatctaaaggg

SEQ ID NO: 6914098 - DNA, 22 bp, Homo sapiens
ggccttgggcgagtccctcagt

SEQ ID NO: 6914099 - DNA, 18 bp, Homo sapiens
aaggacacagtccctgct

SEQ ID NO: 6914100 - DNA, 22 bp, Homo sapiens
tttcataacctcaagctacagt

SEQ ID NO: 6914101 - DNA, 22 bp, Homo sapiens
tacatacagagatgctagttaa

SEQ ID NO: 6914102 - DNA, 22 bp, Homo sapiens
ttctccagcacattttctttga

SEQ ID NO: 6914103 - DNA, 22 bp, Homo sapiens
tgtgacataagtagaggcttga

SEQ ID NO: 6914104 - DNA, 22 bp, Homo sapiens
ccaggagttggaggctgcagtg

SEQ ID NO: 6914105 - DNA, 22 bp, Homo sapiens
tgctcctgaacacagccctatg

SEQ ID NO: 6914106 - DNA, 19 bp, Homo sapiens
agcaaatacatcaaaattg

SEQ ID NO: 6914107 - DNA, 22 bp, Homo sapiens
aatgagcttctataatcttgtc

SEQ ID NO: 6914108 - DNA, 22 bp, Homo sapiens
tgaattctttccatgttcccat

SEQ ID NO: 6914109 - DNA, 22 bp, Homo sapiens
agatgtggctgcacccaccgct

SEQ ID NO: 6914110 - DNA, 22 bp, Homo sapiens
agcaggaaggggatgatgggca

SEQ ID NO: 6914111 - DNA, 22 bp, Homo sapiens
tgtgttcatgtcactggaatcc

SEQ ID NO: 6914112 - DNA, 22 bp, Homo sapiens
tttgaacattcaacagacccag

SEQ ID NO: 6914113 - DNA, 22 bp, Homo sapiens
ggaattggtttcaagggaaagt

SEQ ID NO: 6914114 - DNA, 22 bp, Homo sapiens
ggtgtccttagaaagcagacct

SEQ ID NO: 6914115 - DNA, 22 bp, Homo sapiens
gtttatctgcactctcttgtag

SEQ ID NO: 6914116 - DNA, 22 bp, Homo sapiens
tgtccagcttttcccaccaagt

SEQ ID NO: 6914117 - DNA, 22 bp, Homo sapiens
tctcatacgtttccaggtgtca

SEQ ID NO: 6914118 - DNA, 22 bp, Homo sapiens
tgagcctggttgcagtgtctgg

SEQ ID NO: 6914119 - DNA, 22 bp, Homo sapiens
tcaggaagacaatctttggctc

SEQ ID NO: 6914120 - DNA, 22 bp, Homo sapiens
cagcaggcagccatttcactgt

SEQ ID NO: 6914121 - DNA, 22 bp, Homo sapiens
tataggtacttggaaaataagg

SEQ ID NO: 6914122 - DNA, 22 bp, Homo sapiens
caactggtaatctccacggtca

SEQ ID NO: 6914123 - DNA, 22 bp, Homo sapiens
tccccaggagcaatgattcagt

SEQ ID NO: 6914124 - DNA, 22 bp, Homo sapiens
gtatgaaaattgtaaagttctt

SEQ ID NO: 6914125 - DNA, 22 bp, Homo sapiens
agttagagttaatttcctaaca

SEQ ID NO: 6914126 - DNA, 22 bp, Homo sapiens
ctgccagctcaaagcgcagcta

SEQ ID NO: 6914127 - DNA, 22 bp, Homo sapiens
tcgcacctgtcctctgattatg

SEQ ID NO: 6914128 - DNA, 22 bp, Homo sapiens
aggacttccatggatggattgg

SEQ ID NO: 6914129 - DNA, 22 bp, Homo sapiens
tgagctggtcttgagtgtagct

SEQ ID NO: 6914130 - DNA, 22 bp, Homo sapiens
ggcctagttttttctggtaggt

SEQ ID NO: 6914131 - DNA, 22 bp, Homo sapiens
aagatggtgtggtcaaggacca

SEQ ID NO: 6914132 - DNA, 22 bp, Homo sapiens
attactgttggcaaagtcttat

SEQ ID NO: 6914133 - DNA, 22 bp, Homo sapiens
taggccttcggtgtgtgcttgg

SEQ ID NO: 6914134 - DNA, 22 bp, Homo sapiens
tggctcagaaggctgccttcac

SEQ ID NO: 6914135 - DNA, 22 bp, Homo sapiens
atccatcttgatgtaatagcca

SEQ ID NO: 6914136 - DNA, 22 bp, Homo sapiens
tgtcccctttacctccgcagcc

SEQ ID NO: 6914137 - DNA, 22 bp, Homo sapiens
tgcatttcacagactgagaaat

SEQ ID NO: 6914138 - DNA, 22 bp, Homo sapiens
ctgtgtttctaagtaaaggagc

SEQ ID NO: 6914139 - DNA, 22 bp, Homo sapiens
tttgggcattagtaagttaagc

SEQ ID NO: 6914140 - DNA, 22 bp, Homo sapiens
cagctgttcctggttggtggga

SEQ ID NO: 6914141 - DNA, 23 bp, Homo sapiens
aggcagtggtggtaacatgtcaa

SEQ ID NO: 6914142 - DNA, 22 bp, Homo sapiens
aagcaggcatcttggaggtcaa

SEQ ID NO: 6914143 - DNA, 22 bp, Homo sapiens
ttaaagcaaaaactaggatgga

SEQ ID NO: 6914144 - DNA, 19 bp, Homo sapiens
tgtctcagtgtcccttcct

SEQ ID NO: 6914145 - DNA, 22 bp, Homo sapiens
gtacaagttgcctaccttaagt

SEQ ID NO: 6914146 - DNA, 22 bp, Homo sapiens
agctttggttgaggggagtgtg

SEQ ID NO: 6914147 - DNA, 22 bp, Homo sapiens
tttagcaattattaagggttga

SEQ ID NO: 6914148 - DNA, 22 bp, Homo sapiens
gccaatcaggaggctgtacatc

SEQ ID NO: 6914149 - DNA, 17 bp, Homo sapiens
tacagttagaatctgga

SEQ ID NO: 6914150 - DNA, 22 bp, Homo sapiens
atgtatccttttaagaagaaaa

SEQ ID NO: 6914151 - DNA, 22 bp, Homo sapiens
atttgtcaacaggcatttaggt

SEQ ID NO: 6914152 - DNA, 19 bp, Homo sapiens
tccaggggctccacctcct

SEQ ID NO: 6914153 - DNA, 22 bp, Homo sapiens
acgctggtgaaagggtggtttt

SEQ ID NO: 6914154 - DNA, 22 bp, Homo sapiens
agcaggtgtcactttcactcca

SEQ ID NO: 6914155 - DNA, 22 bp, Homo sapiens
gttcaaagctcctggtacagta

SEQ ID NO: 6914156 - DNA, 22 bp, Homo sapiens
actgtactcttatagccatctg

SEQ ID NO: 6914157 - DNA, 22 bp, Homo sapiens
agtttccaaatattgttttagc

SEQ ID NO: 6914158 - DNA, 22 bp, Homo sapiens
ccctcccagatgggcttgaggt

SEQ ID NO: 6914159 - DNA, 22 bp, Homo sapiens
gtcatgcagacagggttgtttt

SEQ ID NO: 6914160 - DNA, 22 bp, Homo sapiens
gtctctgctctagagtctgtga

SEQ ID NO: 6914161 - DNA, 22 bp, Homo sapiens
ctgagggccttggctcctgccc

SEQ ID NO: 6914162 - DNA, 19 bp, Homo sapiens
cactgtggtccttcactgc

SEQ ID NO: 6914163 - DNA, 22 bp, Homo sapiens
tgagctgagtggcaggtctcag

SEQ ID NO: 6914164 - DNA, 22 bp, Homo sapiens
aaggcactagcaagctgcctgg

SEQ ID NO: 6914165 - DNA, 22 bp, Homo sapiens
cagggtgcctcccgctcgccgg

SEQ ID NO: 6914166 - DNA, 22 bp, Homo sapiens
ctgagacacagtggctgaaaag

SEQ ID NO: 6914167 - DNA, 19 bp, Homo sapiens
ctccaaatacttttccctt

SEQ ID NO: 6914168 - DNA, 21 bp, Homo sapiens
gctgtttaacaataaggagtc

SEQ ID NO: 6914169 - DNA, 22 bp, Homo sapiens
ctctgtgggccagagaggcccc

SEQ ID NO: 6914170 - DNA, 16 bp, Homo sapiens
ggtgggaggtgaggtg

SEQ ID NO: 6914171 - DNA, 22 bp, Homo sapiens
ggaagccaggttactgttcaga

SEQ ID NO: 6914172 - DNA, 22 bp, Homo sapiens
agcaatcaaataaatgtcctgg

SEQ ID NO: 6914173 - DNA, 22 bp, Homo sapiens
agtgattttgtcagcttctgca

SEQ ID NO: 6914174 - DNA, 22 bp, Homo sapiens
ggtgtcaaattattgagtttca

SEQ ID NO: 6914175 - DNA, 22 bp, Homo sapiens
ttcacaaagctggagcatttcc

SEQ ID NO: 6914176 - DNA, 22 bp, Homo sapiens
taatttcaaatttcttagcgtg

SEQ ID NO: 6914177 - DNA, 19 bp, Homo sapiens
tctcccatgcctgtgtcta

SEQ ID NO: 6914178 - DNA, 21 bp, Homo sapiens
ccactgctcttccctagggcc

SEQ ID NO: 6914179 - DNA, 22 bp, Homo sapiens
aaagtgcagtaacttgcccaag

SEQ ID NO: 6914180 - DNA, 22 bp, Homo sapiens
ctgtacatctctgaggacagta

SEQ ID NO: 6914181 - DNA, 23 bp, Homo sapiens
acagacattgtacatcttgtttt

SEQ ID NO: 6914182 - DNA, 22 bp, Homo sapiens
gctttctgattgcgaaaacaaa

SEQ ID NO: 6914183 - DNA, 22 bp, Homo sapiens
ggctgtagtcagtgacatggta

SEQ ID NO: 6914184 - DNA, 23 bp, Homo sapiens
atctgttcatctgacacagattc

SEQ ID NO: 6914185 - DNA, 22 bp, Homo sapiens
gcacctgaacgacctgctccag

SEQ ID NO: 6914186 - DNA, 22 bp, Homo sapiens
gcacacagccagctgagggcta

SEQ ID NO: 6914187 - DNA, 22 bp, Homo sapiens
tctgagagcctctagcctaagt

SEQ ID NO: 6914188 - DNA, 21 bp, Homo sapiens
tcggtgaccagctgtccttca

SEQ ID NO: 6914189 - DNA, 22 bp, Homo sapiens
tgaaagtgaatgtcactgttga

SEQ ID NO: 6914190 - DNA, 22 bp, Homo sapiens
ataatctgagctatttcatgag

SEQ ID NO: 6914191 - DNA, 22 bp, Homo sapiens
ctctgttacagccccctgcctc

SEQ ID NO: 6914192 - DNA, 22 bp, Homo sapiens
gcggcaggaagagcgcagcccc

SEQ ID NO: 6914193 - DNA, 22 bp, Homo sapiens
tagctctttattaaggcccaga

SEQ ID NO: 6914194 - DNA, 22 bp, Homo sapiens
gtaattgtcttgaattcacaac

SEQ ID NO: 6914195 - DNA, 21 bp, Homo sapiens
tgctgacatcaggtctgctat

SEQ ID NO: 6914196 - DNA, 22 bp, Homo sapiens
aagatattcaaagatttattag

SEQ ID NO: 6914197 - DNA, 22 bp, Homo sapiens
atcagagattgtagtatgtgca

SEQ ID NO: 6914198 - DNA, 22 bp, Homo sapiens
atcacagtctttttcttaagta

SEQ ID NO: 6914199 - DNA, 22 bp, Homo sapiens
catctggggctgtctgctaatc

SEQ ID NO: 6914200 - DNA, 22 bp, Homo sapiens
cactataatcctgttttagaac

SEQ ID NO: 6914201 - DNA, 22 bp, Homo sapiens
tgcatactgctgggggagctct

SEQ ID NO: 6914202 - DNA, 22 bp, Homo sapiens
atttcctgtaggggcttgcgaa

SEQ ID NO: 6914203 - DNA, 21 bp, Homo sapiens
cacagcagggttcctgggctc

SEQ ID NO: 6914204 - DNA, 19 bp, Homo sapiens
agcacagtttccacatgca

SEQ ID NO: 6914205 - DNA, 22 bp, Homo sapiens
ggagttgttctgcaggagagaa

SEQ ID NO: 6914206 - DNA, 22 bp, Homo sapiens
atgactgttatgggactggaac

SEQ ID NO: 6914207 - DNA, 22 bp, Homo sapiens
ggaccacagcacttggcttgag

SEQ ID NO: 6914208 - DNA, 22 bp, Homo sapiens
ttcttcaaatgctgaaagtcta

SEQ ID NO: 6914209 - DNA, 22 bp, Homo sapiens
gcaaagacccaggtgtctatcc

SEQ ID NO: 6914210 - DNA, 22 bp, Homo sapiens
tgtccctggaactatggctcca

SEQ ID NO: 6914211 - DNA, 22 bp, Homo sapiens
tcctttatcaaggagccttaga

SEQ ID NO: 6914212 - DNA, 22 bp, Homo sapiens
aggccagcctcaggcagggacc

SEQ ID NO: 6914213 - DNA, 22 bp, Homo sapiens
caaagcagtgatccttaaagga

SEQ ID NO: 6914214 - DNA, 22 bp, Homo sapiens
ctggctctctgatttcacattc

SEQ ID NO: 6914215 - DNA, 22 bp, Homo sapiens
attgagcacatgctatgtgcca

SEQ ID NO: 6914216 - DNA, 22 bp, Homo sapiens
ggtcaggtagctctgacaggcc

SEQ ID NO: 6914217 - DNA, 22 bp, Homo sapiens
tcacagtgcacccctcacaggg

SEQ ID NO: 6914218 - DNA, 22 bp, Homo sapiens
ttatgttcccttaagagaacag

SEQ ID NO: 6914219 - DNA, 22 bp, Homo sapiens
cctgaggctctcctgaataatg

SEQ ID NO: 6914220 - DNA, 23 bp, Homo sapiens
tgatgctcagaatgcaggtatag

SEQ ID NO: 6914221 - DNA, 22 bp, Homo sapiens
gcagggctccccaggcccgagg

SEQ ID NO: 6914222 - DNA, 19 bp, Homo sapiens
ttctaggctatgaagcagt

SEQ ID NO: 6914223 - DNA, 22 bp, Homo sapiens
gacaggccccctcaggactgat

SEQ ID NO: 6914224 - DNA, 22 bp, Homo sapiens
agtgcaatgtgtacagaaaaat

SEQ ID NO: 6914225 - DNA, 22 bp, Homo sapiens
gcctttaaagccccgagagccc

SEQ ID NO: 6914226 - DNA, 22 bp, Homo sapiens
gcagctcagggagagggcacca

SEQ ID NO: 6914227 - DNA, 22 bp, Homo sapiens
tttatccaccagggactaggac

SEQ ID NO: 6914228 - DNA, 22 bp, Homo sapiens
tgaggcttccaacatgtgagaa

SEQ ID NO: 6914229 - DNA, 22 bp, Homo sapiens
agaggcttggcctcagttctgt

SEQ ID NO: 6914230 - DNA, 19 bp, Homo sapiens
ttccagttctaatctcttc

SEQ ID NO: 6914231 - DNA, 22 bp, Homo sapiens
gcctcagtctcccgagtagctg

SEQ ID NO: 6914232 - DNA, 22 bp, Homo sapiens
gagccaggtttgaatctcagtc

SEQ ID NO: 6914233 - DNA, 20 bp, Homo sapiens
actagtctaaaagggctgac

SEQ ID NO: 6914234 - DNA, 16 bp, Homo sapiens
agatgggtgggtcact

SEQ ID NO: 6914235 - DNA, 22 bp, Homo sapiens
caggccacaagttgggttcaag

SEQ ID NO: 6914236 - DNA, 22 bp, Homo sapiens
acatgcagagggagggccaggc

SEQ ID NO: 6914237 - DNA, 19 bp, Homo sapiens
atgaatgagctgtgaggtt

SEQ ID NO: 6914238 - DNA, 22 bp, Homo sapiens
agctggcagctctcaggggtac

SEQ ID NO: 6914239 - DNA, 22 bp, Homo sapiens
actttgcaaaaggaaatcacct

SEQ ID NO: 6914240 - DNA, 22 bp, Homo sapiens
tcttgggcatgtgtttgatttc

SEQ ID NO: 6914241 - DNA, 18 bp, Homo sapiens
acttctcatttctctgca

SEQ ID NO: 6914242 - DNA, 22 bp, Homo sapiens
tttccctctcatctctattatt

SEQ ID NO: 6914243 - DNA, 22 bp, Homo sapiens
tcccagctgtgtggaggagatg

SEQ ID NO: 6914244 - DNA, 22 bp, Homo sapiens
aagtctctcacatatctggtcc

SEQ ID NO: 6914245 - DNA, 22 bp, Homo sapiens
tccctgagctgagctcaacagc

SEQ ID NO: 6914246 - DNA, 22 bp, Homo sapiens
catctttgcaccctcaaaacct

SEQ ID NO: 6914247 - DNA, 22 bp, Homo sapiens
tgctctgaggcacatgccatcg

SEQ ID NO: 6914248 - DNA, 22 bp, Homo sapiens
tctgtccattttccattttggc

SEQ ID NO: 6914249 - DNA, 22 bp, Homo sapiens
agtggatggtattgggaccagg

SEQ ID NO: 6914250 - DNA, 22 bp, Homo sapiens
gtcccagggaagaaggcagcac

SEQ ID NO: 6914251 - DNA, 22 bp, Homo sapiens
caagctctttaaacttatgtca

SEQ ID NO: 6914252 - DNA, 22 bp, Homo sapiens
tccctgcttgctctcagccctt

SEQ ID NO: 6914253 - DNA, 22 bp, Homo sapiens
tatgtattctgagtacaagttc

SEQ ID NO: 6914254 - DNA, 22 bp, Homo sapiens
aggcaggtgttaaccctctgag

SEQ ID NO: 6914255 - DNA, 22 bp, Homo sapiens
gtggcagagggtgagctggact

SEQ ID NO: 6914256 - DNA, 22 bp, Homo sapiens
ggaaactgtagtttgctgacat

SEQ ID NO: 6914257 - DNA, 22 bp, Homo sapiens
tctgttagctgtcaaagtgttt

SEQ ID NO: 6914258 - DNA, 22 bp, Homo sapiens
taggaacatgcccttaccttcc

SEQ ID NO: 6914259 - DNA, 22 bp, Homo sapiens
agcccagctgctatgtacctgg

SEQ ID NO: 6914260 - DNA, 22 bp, Homo sapiens
gcctggcaaggccctgttgact

SEQ ID NO: 6914261 - DNA, 22 bp, Homo sapiens
acagccagggacatacaatggt

SEQ ID NO: 6914262 - DNA, 22 bp, Homo sapiens
cagatgaggggcatataacaat

SEQ ID NO: 6914263 - DNA, 22 bp, Homo sapiens
cactgagggagggtttcttctg

SEQ ID NO: 6914264 - DNA, 22 bp, Homo sapiens
cttgcacatggctgctttctcg

SEQ ID NO: 6914265 - DNA, 22 bp, Homo sapiens
cagcctgggctccagagtccct

SEQ ID NO: 6914266 - DNA, 22 bp, Homo sapiens
gccctgggattgggtggaggct

SEQ ID NO: 6914267 - DNA, 22 bp, Homo sapiens
cctacataacactgccaaactg

SEQ ID NO: 6914268 - DNA, 22 bp, Homo sapiens
agccagaggccagcctgcctca

SEQ ID NO: 6914269 - DNA, 22 bp, Homo sapiens
ccccacctgtgcgtctgccgca

SEQ ID NO: 6914270 - DNA, 22 bp, Homo sapiens
agcctgtgagggatgctgcagt

SEQ ID NO: 6914271 - DNA, 22 bp, Homo sapiens
acagatgaaacccagctagttg

SEQ ID NO: 6914272 - DNA, 18 bp, Homo sapiens
tataacctgttttgatgg

SEQ ID NO: 6914273 - DNA, 22 bp, Homo sapiens
gttgcaggaagcacacacatgt

SEQ ID NO: 6914274 - DNA, 22 bp, Homo sapiens
ttacatgtaatctaaaataatt

SEQ ID NO: 6914275 - DNA, 22 bp, Homo sapiens
cgcagggatttcaaggggcctt

SEQ ID NO: 6914276 - DNA, 22 bp, Homo sapiens
cttctgcaataagttttggtcc

SEQ ID NO: 6914277 - DNA, 22 bp, Homo sapiens
acgattgaagaatagtcttaac

SEQ ID NO: 6914278 - DNA, 22 bp, Homo sapiens
ttctgcctggcaggaggactgt

SEQ ID NO: 6914279 - DNA, 22 bp, Homo sapiens
tgggttaggaaggggtatcacc

SEQ ID NO: 6914280 - DNA, 22 bp, Homo sapiens
aagcagagcctgagacagggat

SEQ ID NO: 6914281 - DNA, 22 bp, Homo sapiens
cctggctgtgtgaccttggcaa

SEQ ID NO: 6914282 - DNA, 22 bp, Homo sapiens
gttcaatttcagcatccattga

SEQ ID NO: 6914283 - DNA, 22 bp, Homo sapiens
tatcttcacttatatctttctt

SEQ ID NO: 6914284 - DNA, 22 bp, Homo sapiens
gctgggttttcttccgggccta

SEQ ID NO: 6914285 - DNA, 22 bp, Homo sapiens
tcaggagaaagccaattagagt

SEQ ID NO: 6914286 - DNA, 22 bp, Homo sapiens
agtttcttgaagactgatgttt

SEQ ID NO: 6914287 - DNA, 22 bp, Homo sapiens
ggctagggatctagaccaggac

SEQ ID NO: 6914288 - DNA, 20 bp, Homo sapiens
aatgaatgaacgaatggatg

SEQ ID NO: 6914289 - DNA, 22 bp, Homo sapiens
acatgctacagtgaaggaggaa

SEQ ID NO: 6914290 - DNA, 22 bp, Homo sapiens
tttcctctaaacgcatttgctt

SEQ ID NO: 6914291 - DNA, 22 bp, Homo sapiens
cctctgcctgcacatcatcctg

SEQ ID NO: 6914292 - DNA, 22 bp, Homo sapiens
cacgcacgctgggtggaggcgc

SEQ ID NO: 6914293 - DNA, 22 bp, Homo sapiens
acctgtgacccttctttgcttc

SEQ ID NO: 6914294 - DNA, 20 bp, Homo sapiens
tgccagggccagcagaggct

SEQ ID NO: 6914295 - DNA, 22 bp, Homo sapiens
taaaagttagctaggacaaagt

SEQ ID NO: 6914296 - DNA, 22 bp, Homo sapiens
ggagaccaggtcagagatggtg

SEQ ID NO: 6914297 - DNA, 22 bp, Homo sapiens
ctcatgatgtagcgaatgagaa

SEQ ID NO: 6914298 - DNA, 22 bp, Homo sapiens
aggtaatagggttcagaattat

SEQ ID NO: 6914299 - DNA, 22 bp, Homo sapiens
tctgtctgactaccatgaggca

SEQ ID NO: 6914300 - DNA, 22 bp, Homo sapiens
gcaggaagccttaccaagccca

SEQ ID NO: 6914301 - DNA, 22 bp, Homo sapiens
aacttctcatacaaagaacaag

SEQ ID NO: 6914302 - DNA, 22 bp, Homo sapiens
caggtgtttgtcaattccatcc

SEQ ID NO: 6914303 - DNA, 22 bp, Homo sapiens
tttctgactggtgtataatagg

SEQ ID NO: 6914304 - DNA, 20 bp, Homo sapiens
atgcagctggagttggggtg

SEQ ID NO: 6914305 - DNA, 22 bp, Homo sapiens
cccaggcagcggggtctccttg

SEQ ID NO: 6914306 - DNA, 21 bp, Homo sapiens
actgcctgtctccatagtcta

SEQ ID NO: 6914307 - DNA, 19 bp, Homo sapiens
atgaagccccagggcccgt

SEQ ID NO: 6914308 - DNA, 22 bp, Homo sapiens
atattccagttatatcaaatca

SEQ ID NO: 6914309 - DNA, 22 bp, Homo sapiens
acaggcaacttcaaatctcact

SEQ ID NO: 6914310 - DNA, 22 bp, Homo sapiens
atagcaaactggcagcttgtgg

SEQ ID NO: 6914311 - DNA, 22 bp, Homo sapiens
agggaagtgaatgacagatatc

SEQ ID NO: 6914312 - DNA, 22 bp, Homo sapiens
gaggaaaatgcaacaggaatgc

SEQ ID NO: 6914313 - DNA, 22 bp, Homo sapiens
aagtgtttggggatcattttaa

SEQ ID NO: 6914314 - DNA, 22 bp, Homo sapiens
tcttaacagtgctacagagcag

SEQ ID NO: 6914315 - DNA, 22 bp, Homo sapiens
atttctaaagagggtggtttgg

SEQ ID NO: 6914316 - DNA, 22 bp, Homo sapiens
aggcttcttctctatgtacaag

SEQ ID NO: 6914317 - DNA, 22 bp, Homo sapiens
agattgacaaaacagaagattt

SEQ ID NO: 6914318 - DNA, 22 bp, Homo sapiens
taacctgaacacacaataggga

SEQ ID NO: 6914319 - DNA, 22 bp, Homo sapiens
atgttctgttttgtaattcata

SEQ ID NO: 6914320 - DNA, 22 bp, Homo sapiens
cggctgggttcggctgcaggcc

SEQ ID NO: 6914321 - DNA, 22 bp, Homo sapiens
aggcctcactctcagagcttct

SEQ ID NO: 6914322 - DNA, 23 bp, Homo sapiens
ggactaggcaacagatgggacag

SEQ ID NO: 6914323 - DNA, 23 bp, Homo sapiens
cagcccaaagagagagctacttt

SEQ ID NO: 6914324 - DNA, 22 bp, Homo sapiens
tgccagctgacagcagagacaa

SEQ ID NO: 6914325 - DNA, 22 bp, Homo sapiens
caggtatatgtgcatccataga

SEQ ID NO: 6914326 - DNA, 22 bp, Homo sapiens
ggtgtgggcagatgccctactt

SEQ ID NO: 6914327 - DNA, 22 bp, Homo sapiens
aaacatcttgctctgattggta

SEQ ID NO: 6914328 - DNA, 22 bp, Homo sapiens
aaggctatattcattattctct

SEQ ID NO: 6914329 - DNA, 22 bp, Homo sapiens
ctgttgtcttcattgtcatatc

SEQ ID NO: 6914330 - DNA, 19 bp, Homo sapiens
cgcgccgtcgggtccagcc

SEQ ID NO: 6914331 - DNA, 22 bp, Homo sapiens
caggtcttttctactggtggag

SEQ ID NO: 6914332 - DNA, 22 bp, Homo sapiens
gcagctggggaggtcgtgggga

SEQ ID NO: 6914333 - DNA, 22 bp, Homo sapiens
tgccccagactctgctcacctc

SEQ ID NO: 6914334 - DNA, 22 bp, Homo sapiens
tagtttgcgaaattcctgcctc

SEQ ID NO: 6914335 - DNA, 22 bp, Homo sapiens
cacagtaaccccaggactggga

SEQ ID NO: 6914336 - DNA, 22 bp, Homo sapiens
gagctgaaatatgaagccaatt

SEQ ID NO: 6914337 - DNA, 22 bp, Homo sapiens
cctgtgtggaaggcaggaggcc

SEQ ID NO: 6914338 - DNA, 22 bp, Homo sapiens
gagcacagccaaagtaagaagg

SEQ ID NO: 6914339 - DNA, 22 bp, Homo sapiens
aagaactcaacatagagtggga

SEQ ID NO: 6914340 - DNA, 22 bp, Homo sapiens
tgagcccaggaggcagaggttg

SEQ ID NO: 6914341 - DNA, 22 bp, Homo sapiens
agttgacatccagagacattct

SEQ ID NO: 6914342 - DNA, 22 bp, Homo sapiens
ctggctctgggctaagctccca

SEQ ID NO: 6914343 - DNA, 22 bp, Homo sapiens
tcacagttcaaaccccatatct

SEQ ID NO: 6914344 - DNA, 23 bp, Homo sapiens
aagtacctacacattatttcaga

SEQ ID NO: 6914345 - DNA, 22 bp, Homo sapiens
tgttttaagggtcaactgtcac

SEQ ID NO: 6914346 - DNA, 22 bp, Homo sapiens
ggctctgctggtaagatgcctc

SEQ ID NO: 6914347 - DNA, 22 bp, Homo sapiens
atggtaaattttaccttatgta

SEQ ID NO: 6914348 - DNA, 22 bp, Homo sapiens
tagctttgaagttatttaacag

SEQ ID NO: 6914349 - DNA, 22 bp, Homo sapiens
agtgtgcattcctctcctcagg

SEQ ID NO: 6914350 - DNA, 22 bp, Homo sapiens
aatggcttatgtaatgctgttt

SEQ ID NO: 6914351 - DNA, 22 bp, Homo sapiens
actatgaatccacattgatttt

SEQ ID NO: 6914352 - DNA, 22 bp, Homo sapiens
tcattgaaagtgcctcctcgga

SEQ ID NO: 6914353 - DNA, 22 bp, Homo sapiens
gttctctggagtccctgggccc

SEQ ID NO: 6914354 - DNA, 22 bp, Homo sapiens
tttatccagaatcaggattttt

SEQ ID NO: 6914355 - DNA, 22 bp, Homo sapiens
gctggcccagggtcacctagga

SEQ ID NO: 6914356 - DNA, 22 bp, Homo sapiens
cctccactgcttcccagctttg

SEQ ID NO: 6914357 - DNA, 22 bp, Homo sapiens
tggcttcaaggtgataatttac

SEQ ID NO: 6914358 - DNA, 22 bp, Homo sapiens
ttctggtttaagaaagtgctgg

SEQ ID NO: 6914359 - DNA, 21 bp, Homo sapiens
cagtggttgctgaattagtgg

SEQ ID NO: 6914360 - DNA, 20 bp, Homo sapiens
aagagcctgggtccctcaga

SEQ ID NO: 6914361 - DNA, 22 bp, Homo sapiens
atgttaggcaatctttcttgtt

SEQ ID NO: 6914362 - DNA, 22 bp, Homo sapiens
ttccttgccctctgggatcttg

SEQ ID NO: 6914363 - DNA, 22 bp, Homo sapiens
tatgtagaaaacaaaagttgaa

SEQ ID NO: 6914364 - DNA, 22 bp, Homo sapiens
tcacaggaaccatcagagaaat

SEQ ID NO: 6914365 - DNA, 22 bp, Homo sapiens
gggtgacatagtgatggggcat

SEQ ID NO: 6914366 - DNA, 22 bp, Homo sapiens
tgctcctaaacctcttggaatg

SEQ ID NO: 6914367 - DNA, 22 bp, Homo sapiens
gaagacaagctgagtgttgtcc

SEQ ID NO: 6914368 - DNA, 22 bp, Homo sapiens
aggctgtccaaggtggcgaagt

SEQ ID NO: 6914369 - DNA, 22 bp, Homo sapiens
catgggccatggtgaagccagg

SEQ ID NO: 6914370 - DNA, 20 bp, Homo sapiens
ctgatgttcgtgcttcctgg

SEQ ID NO: 6914371 - DNA, 22 bp, Homo sapiens
ccaggagaagcatctgagtgta

SEQ ID NO: 6914372 - DNA, 20 bp, Homo sapiens
agctgcccctgggcactgcc

SEQ ID NO: 6914373 - DNA, 22 bp, Homo sapiens
ctgagcttggcttatctccagc

SEQ ID NO: 6914374 - DNA, 22 bp, Homo sapiens
tgacagagaggtaagttatgaa

SEQ ID NO: 6914375 - DNA, 22 bp, Homo sapiens
aggaagcgtgggtctggctgga

SEQ ID NO: 6914376 - DNA, 22 bp, Homo sapiens
agccaggacatctctagctgct

SEQ ID NO: 6914377 - DNA, 22 bp, Homo sapiens
actgcatctgaactgtgaatgg

SEQ ID NO: 6914378 - DNA, 22 bp, Homo sapiens
gcagtgcatgtcggaactcatt

SEQ ID NO: 6914379 - DNA, 22 bp, Homo sapiens
ttcaacacaggaacatgatata

SEQ ID NO: 6914380 - DNA, 22 bp, Homo sapiens
agcagcatagatgctatccgag

SEQ ID NO: 6914381 - DNA, 22 bp, Homo sapiens
tacatttgttatagaaatgaag

SEQ ID NO: 6914382 - DNA, 22 bp, Homo sapiens
attagtaaaacattgtatatgt

SEQ ID NO: 6914383 - DNA, 22 bp, Homo sapiens
aaaggaagatgccaggactctg

SEQ ID NO: 6914384 - DNA, 22 bp, Homo sapiens
tcttggcaggcagtggggtaag

SEQ ID NO: 6914385 - DNA, 22 bp, Homo sapiens
gttctttaaactgctgctctgt

SEQ ID NO: 6914386 - DNA, 22 bp, Homo sapiens
ttacaaacaacagacatttatt

SEQ ID NO: 6914387 - DNA, 22 bp, Homo sapiens
tgacccttcccttcagttggct

SEQ ID NO: 6914388 - DNA, 22 bp, Homo sapiens
cgtgatgctcaggaggtcatag

SEQ ID NO: 6914389 - DNA, 22 bp, Homo sapiens
ttttgtatagtcaaagacaaga

SEQ ID NO: 6914390 - DNA, 22 bp, Homo sapiens
gcagggatgctgaggctcagtg

SEQ ID NO: 6914391 - DNA, 22 bp, Homo sapiens
taccaggtctgtgcaggtgtca

SEQ ID NO: 6914392 - DNA, 22 bp, Homo sapiens
tggattgaattaacacctccca

SEQ ID NO: 6914393 - DNA, 22 bp, Homo sapiens
tatttgtcactgcacttgaaat

SEQ ID NO: 6914394 - DNA, 22 bp, Homo sapiens
ccttgggagaaattgcagagtc

SEQ ID NO: 6914395 - DNA, 22 bp, Homo sapiens
ttaggcacttgctttgtgttca

SEQ ID NO: 6914396 - DNA, 22 bp, Homo sapiens
actggcatcccactggtacagg

SEQ ID NO: 6914397 - DNA, 22 bp, Homo sapiens
tgcatgttattgtggcaagaat

SEQ ID NO: 6914398 - DNA, 22 bp, Homo sapiens
agcccccaaaagtgcttatgat

SEQ ID NO: 6914399 - DNA, 22 bp, Homo sapiens
aatctgacttataggctttgtg

SEQ ID NO: 6914400 - DNA, 22 bp, Homo sapiens
ctgcatgtgtttctgctgggtt

SEQ ID NO: 6914401 - DNA, 22 bp, Homo sapiens
tctgcaggactgaggcctgttt

SEQ ID NO: 6914402 - DNA, 22 bp, Homo sapiens
attctttagttggcttcttgcc

SEQ ID NO: 6914403 - DNA, 22 bp, Homo sapiens
aaagagctgatagcatctgttt

SEQ ID NO: 6914404 - DNA, 22 bp, Homo sapiens
tccagtttgcactgtataatag

SEQ ID NO: 6914405 - DNA, 22 bp, Homo sapiens
atttctagcctctgaagtagga

SEQ ID NO: 6914406 - DNA, 22 bp, Homo sapiens
acaggattaataaaaaattgta

SEQ ID NO: 6914407 - DNA, 22 bp, Homo sapiens
gaagcaagtggcctgattcaga

SEQ ID NO: 6914408 - DNA, 22 bp, Homo sapiens
caaggcatgaaaggagtgagtg

SEQ ID NO: 6914409 - DNA, 22 bp, Homo sapiens
ggctcaggacctgggattgcca

SEQ ID NO: 6914410 - DNA, 22 bp, Homo sapiens
tttcatgtgcaattagcaatat

SEQ ID NO: 6914411 - DNA, 22 bp, Homo sapiens
gtgcattattcttacctttctt

SEQ ID NO: 6914412 - DNA, 22 bp, Homo sapiens
tgacatttaatccctaaatatt

SEQ ID NO: 6914413 - DNA, 22 bp, Homo sapiens
aaaaaggttgatccagattagg

SEQ ID NO: 6914414 - DNA, 22 bp, Homo sapiens
agatgctttcctgatatttatg

SEQ ID NO: 6914415 - DNA, 22 bp, Homo sapiens
gtcaggacattttaccatcctg

SEQ ID NO: 6914416 - DNA, 22 bp, Homo sapiens
gtataaacatggagtgcattct

SEQ ID NO: 6914417 - DNA, 17 bp, Homo sapiens
gtggaggtgctctggta

SEQ ID NO: 6914418 - DNA, 22 bp, Homo sapiens
gtgcccaggcccaaggcaccac

SEQ ID NO: 6914419 - DNA, 22 bp, Homo sapiens
agcagcagaaggtttgcaccca

SEQ ID NO: 6914420 - DNA, 22 bp, Homo sapiens
agagcactgctgatttacagtc

SEQ ID NO: 6914421 - DNA, 22 bp, Homo sapiens
gcaggtgtgctgaattacgtga

SEQ ID NO: 6914422 - DNA, 22 bp, Homo sapiens
gagaggaagccttctgtacttg

SEQ ID NO: 6914423 - DNA, 22 bp, Homo sapiens
aggtggagtgtgcagggagagc

SEQ ID NO: 6914424 - DNA, 22 bp, Homo sapiens
gagggcgcttcagagagatgaa

SEQ ID NO: 6914425 - DNA, 22 bp, Homo sapiens
catgcagtgatgcactgcatca

SEQ ID NO: 6914426 - DNA, 22 bp, Homo sapiens
tgttaacttgcaagctgaagaa

SEQ ID NO: 6914427 - DNA, 20 bp, Homo sapiens
ggagctagagctgaaagact

SEQ ID NO: 6914428 - DNA, 22 bp, Homo sapiens
tactgctagatgaaaatgtagg

SEQ ID NO: 6914429 - DNA, 22 bp, Homo sapiens
ccgccctcacgaggtaggtacc

SEQ ID NO: 6914430 - DNA, 22 bp, Homo sapiens
attcttcaccatggataatttg

SEQ ID NO: 6914431 - DNA, 22 bp, Homo sapiens
gaattttattactagtcaactg

SEQ ID NO: 6914432 - DNA, 22 bp, Homo sapiens
caaacattttgagtggtttctg

SEQ ID NO: 6914433 - DNA, 22 bp, Homo sapiens
ctccccttcttgccagatcctt

SEQ ID NO: 6914434 - DNA, 22 bp, Homo sapiens
gaatgcattccacggtagtgat

SEQ ID NO: 6914435 - DNA, 22 bp, Homo sapiens
aactctagggaggcaggaagca

SEQ ID NO: 6914436 - DNA, 22 bp, Homo sapiens
ggcatattcccagacctcatct

SEQ ID NO: 6914437 - DNA, 22 bp, Homo sapiens
cccttctagtccattcttcaca

SEQ ID NO: 6914438 - DNA, 22 bp, Homo sapiens
tggcagggagttgcaggatttc

SEQ ID NO: 6914439 - DNA, 22 bp, Homo sapiens
ggagccagaggctgctgctgtg

SEQ ID NO: 6914440 - DNA, 22 bp, Homo sapiens
tgcccaggattgtgaggtcagg

SEQ ID NO: 6914441 - DNA, 22 bp, Homo sapiens
agcagcctcccagggagcagcc

SEQ ID NO: 6914442 - DNA, 20 bp, Homo sapiens
aggaagctgagatgtagagg

SEQ ID NO: 6914443 - DNA, 22 bp, Homo sapiens
aaaagtctgctttctattatca

SEQ ID NO: 6914444 - DNA, 22 bp, Homo sapiens
tggaatgagtggctaagattca

SEQ ID NO: 6914445 - DNA, 22 bp, Homo sapiens
ctgtacaaaagaaagttcctat

SEQ ID NO: 6914446 - DNA, 23 bp, Homo sapiens
ccagtctctttccaaaatcacat

SEQ ID NO: 6914447 - DNA, 22 bp, Homo sapiens
ctggaatgttctccagcatggc

SEQ ID NO: 6914448 - DNA, 22 bp, Homo sapiens
taacttttacttaccatctgag

SEQ ID NO: 6914449 - DNA, 22 bp, Homo sapiens
tgcacaagtcagagtaacattt

SEQ ID NO: 6914450 - DNA, 22 bp, Homo sapiens
atgaaagtgtttaagtttatgt

SEQ ID NO: 6914451 - DNA, 22 bp, Homo sapiens
gaagacattttatgcatactct

SEQ ID NO: 6914452 - DNA, 22 bp, Homo sapiens
actgaatagaaatgctcatagg

SEQ ID NO: 6914453 - DNA, 22 bp, Homo sapiens
gccacccttatcccatgcttct

SEQ ID NO: 6914454 - DNA, 22 bp, Homo sapiens
ttctgggaggatgggaaatcat

SEQ ID NO: 6914455 - DNA, 22 bp, Homo sapiens
attaccactgcagttttgcatt

SEQ ID NO: 6914456 - DNA, 22 bp, Homo sapiens
cagcccttggctggctccttgc

SEQ ID NO: 6914457 - DNA, 22 bp, Homo sapiens
atgtcacagtgttgctggaagt

SEQ ID NO: 6914458 - DNA, 22 bp, Homo sapiens
ggagacatgcagactgagatac

SEQ ID NO: 6914459 - DNA, 22 bp, Homo sapiens
tttactgaactgctagtacagg

SEQ ID NO: 6914460 - DNA, 22 bp, Homo sapiens
agggccaccagagcagggcagt

SEQ ID NO: 6914461 - DNA, 22 bp, Homo sapiens
acctttttgttctgttctcagc

SEQ ID NO: 6914462 - DNA, 22 bp, Homo sapiens
ctgggagatctcctgagggcag

SEQ ID NO: 6914463 - DNA, 22 bp, Homo sapiens
ctcagcaggtaccacatgatct

SEQ ID NO: 6914464 - DNA, 22 bp, Homo sapiens
tgtcaagtctagttgctggctt

SEQ ID NO: 6914465 - DNA, 22 bp, Homo sapiens
gcttgcagcaggtgcttaggaa

SEQ ID NO: 6914466 - DNA, 22 bp, Homo sapiens
taatgtctccagggttgaccta

SEQ ID NO: 6914467 - DNA, 22 bp, Homo sapiens
ggcaccagggaaggaaggctgg

SEQ ID NO: 6914468 - DNA, 22 bp, Homo sapiens
tgtgaatagtcagcattttgtt

SEQ ID NO: 6914469 - DNA, 19 bp, Homo sapiens
cctgggcctccatcacccc

SEQ ID NO: 6914470 - DNA, 22 bp, Homo sapiens
actttacaggcacttcaagtat

SEQ ID NO: 6914471 - DNA, 22 bp, Homo sapiens
tagaatctgattaccctatgaa

SEQ ID NO: 6914472 - DNA, 22 bp, Homo sapiens
atgtgacttcagtcttcttaca

SEQ ID NO: 6914473 - DNA, 22 bp, Homo sapiens
tgtgatttccagccattaaaaa

SEQ ID NO: 6914474 - DNA, 22 bp, Homo sapiens
ggctgaaaggtgggaggatggc

SEQ ID NO: 6914475 - DNA, 22 bp, Homo sapiens
agatctggaactgaggtttatt

SEQ ID NO: 6914476 - DNA, 22 bp, Homo sapiens
agaatttcctatgagagattcc

SEQ ID NO: 6914477 - DNA, 22 bp, Homo sapiens
ctatttatctatttctgaatga

SEQ ID NO: 6914478 - DNA, 22 bp, Homo sapiens
ggctgcttggacaccttaaatc

SEQ ID NO: 6914479 - DNA, 22 bp, Homo sapiens
gaggatggatccgaccccttcc

SEQ ID NO: 6914480 - DNA, 22 bp, Homo sapiens
ggcattgttctaggtggttgga

SEQ ID NO: 6914481 - DNA, 22 bp, Homo sapiens
cttcttttcatggcttgggaag

SEQ ID NO: 6914482 - DNA, 22 bp, Homo sapiens
tgcatgctttattttcatgtgt

SEQ ID NO: 6914483 - DNA, 22 bp, Homo sapiens
ttgctgattgtagcatgatgat

SEQ ID NO: 6914484 - DNA, 22 bp, Homo sapiens
aggtactgaaaaaatgtttgca

SEQ ID NO: 6914485 - DNA, 22 bp, Homo sapiens
catgtaaagcatccttctaggg

SEQ ID NO: 6914486 - DNA, 22 bp, Homo sapiens
aagtagatagtgctacggagtt

SEQ ID NO: 6914487 - DNA, 22 bp, Homo sapiens
tggtatatgtgttagcacaagt

SEQ ID NO: 6914488 - DNA, 23 bp, Homo sapiens
tgtcatacattctatgggtttgg

SEQ ID NO: 6914489 - DNA, 22 bp, Homo sapiens
cactgcaatctccatctcctgg

SEQ ID NO: 6914490 - DNA, 22 bp, Homo sapiens
tgtcagtgtctatgaagaattt

SEQ ID NO: 6914491 - DNA, 22 bp, Homo sapiens
taaaggttataaaggttagggg

SEQ ID NO: 6914492 - DNA, 22 bp, Homo sapiens
gagtgcaatggcatgatctggg

SEQ ID NO: 6914493 - DNA, 20 bp, Homo sapiens
gcactgaaggttccagggga

SEQ ID NO: 6914494 - DNA, 22 bp, Homo sapiens
agcagagcaaagctcagaaatg

SEQ ID NO: 6914495 - DNA, 22 bp, Homo sapiens
ccccgaggctggagtgcagtgg

SEQ ID NO: 6914496 - DNA, 22 bp, Homo sapiens
atctgtaaatgcaaatgtagct

SEQ ID NO: 6914497 - DNA, 22 bp, Homo sapiens
agtttatgtgtaagacagctgt

SEQ ID NO: 6914498 - DNA, 22 bp, Homo sapiens
agaacttaattgtcacttttct

SEQ ID NO: 6914499 - DNA, 22 bp, Homo sapiens
tcaggtgggacctgctaggaca

SEQ ID NO: 6914500 - DNA, 20 bp, Homo sapiens
tggcaggaggcagcagtgga

SEQ ID NO: 6914501 - DNA, 22 bp, Homo sapiens
tttcacatttgttttaagaagt

SEQ ID NO: 6914502 - DNA, 22 bp, Homo sapiens
gagacagagtgttttttaaggt

SEQ ID NO: 6914503 - DNA, 22 bp, Homo sapiens
ctggctggtagaattgtgacct

SEQ ID NO: 6914504 - DNA, 22 bp, Homo sapiens
agagcccagaaagtatgtcata

SEQ ID NO: 6914505 - DNA, 22 bp, Homo sapiens
gtgctaattgaccatttgatat

SEQ ID NO: 6914506 - DNA, 22 bp, Homo sapiens
gaggggtcctgccttggctgga

SEQ ID NO: 6914507 - DNA, 15 bp, Homo sapiens
tatacagaagttcag

SEQ ID NO: 6914508 - DNA, 18 bp, Homo sapiens
gtgccaggaggcgcagcc

SEQ ID NO: 6914509 - DNA, 22 bp, Homo sapiens
tgcagtacagtataatcttgct

SEQ ID NO: 6914510 - DNA, 22 bp, Homo sapiens
atgaacaataaaatagatcaca

SEQ ID NO: 6914511 - DNA, 22 bp, Homo sapiens
tgtgtccttccagtttttcctg

SEQ ID NO: 6914512 - DNA, 22 bp, Homo sapiens
ctttctcttacccaaggatctg

SEQ ID NO: 6914513 - DNA, 22 bp, Homo sapiens
cagctggcgtggagtgattgca

SEQ ID NO: 6914514 - DNA, 22 bp, Homo sapiens
ttgaaacttttcttggagaaac

SEQ ID NO: 6914515 - DNA, 20 bp, Homo sapiens
ctctgctgcgcatcccactt

SEQ ID NO: 6914516 - DNA, 19 bp, Homo sapiens
gggagacagctctgggctg

SEQ ID NO: 6914517 - DNA, 23 bp, Homo sapiens
tgatctctcttgggaggcaatat

SEQ ID NO: 6914518 - DNA, 22 bp, Homo sapiens
ctgtttatcatgtacatttcca

SEQ ID NO: 6914519 - DNA, 22 bp, Homo sapiens
tgtcactttgccttctggactt

SEQ ID NO: 6914520 - DNA, 22 bp, Homo sapiens
ctggtcagagcaactgctcaca

SEQ ID NO: 6914521 - DNA, 22 bp, Homo sapiens
ggcttgcacacagcctcagttt

SEQ ID NO: 6914522 - DNA, 22 bp, Homo sapiens
tagtcacagtacaggataaaga

SEQ ID NO: 6914523 - DNA, 19 bp, Homo sapiens
tcttgcttcttcatccctc

SEQ ID NO: 6914524 - DNA, 22 bp, Homo sapiens
tgtggtttttcagttgctggag

SEQ ID NO: 6914525 - DNA, 22 bp, Homo sapiens
acagagatggcacagagaaggt

SEQ ID NO: 6914526 - DNA, 22 bp, Homo sapiens
ccctgctgcaggcttcaggagg

SEQ ID NO: 6914527 - DNA, 22 bp, Homo sapiens
caagagctctccactaggttgg

SEQ ID NO: 6914528 - DNA, 22 bp, Homo sapiens
atgcatcttttcaaggtatttc

SEQ ID NO: 6914529 - DNA, 22 bp, Homo sapiens
ttatgtaggataatgaattgcc

SEQ ID NO: 6914530 - DNA, 22 bp, Homo sapiens
tcactgcactaggtaatgccac

SEQ ID NO: 6914531 - DNA, 22 bp, Homo sapiens
tctatgttggtccatattatgg

SEQ ID NO: 6914532 - DNA, 22 bp, Homo sapiens
gaatctagggcctagatcacag

SEQ ID NO: 6914533 - DNA, 22 bp, Homo sapiens
aatcctagaaatttatttgaag

SEQ ID NO: 6914534 - DNA, 22 bp, Homo sapiens
aagccatttgttgtccttcagg

SEQ ID NO: 6914535 - DNA, 22 bp, Homo sapiens
gattttcttgggaaacaatgag

SEQ ID NO: 6914536 - DNA, 22 bp, Homo sapiens
tgttgctcttcatacatcaatg

SEQ ID NO: 6914537 - DNA, 22 bp, Homo sapiens
catagtgtctggtaacatagta

SEQ ID NO: 6914538 - DNA, 22 bp, Homo sapiens
ccacagtttgccagccaggaat

SEQ ID NO: 6914539 - DNA, 22 bp, Homo sapiens
taagtttctccaaagcacagaa

SEQ ID NO: 6914540 - DNA, 22 bp, Homo sapiens
gagagccctgcatggctgatga

SEQ ID NO: 6914541 - DNA, 18 bp, Homo sapiens
tgtcagtttccctttctt

SEQ ID NO: 6914542 - DNA, 22 bp, Homo sapiens
cttggatctcaaggcactcaaa

SEQ ID NO: 6914543 - DNA, 22 bp, Homo sapiens
ggctccctgggtgctcctgctc

SEQ ID NO: 6914544 - DNA, 22 bp, Homo sapiens
tctctctgcagcccgggacact

SEQ ID NO: 6914545 - DNA, 22 bp, Homo sapiens
ttctggctcgattctctgaccg

SEQ ID NO: 6914546 - DNA, 22 bp, Homo sapiens
atgcttccaaggctaagacaag

SEQ ID NO: 6914547 - DNA, 22 bp, Homo sapiens
acatttcactgttcacagcagg

SEQ ID NO: 6914548 - DNA, 22 bp, Homo sapiens
atgtgtattttgtactattggg

SEQ ID NO: 6914549 - DNA, 22 bp, Homo sapiens
cttaagacaggctcaaagatta

SEQ ID NO: 6914550 - DNA, 22 bp, Homo sapiens
agttcccaggtgatgctgatgt

SEQ ID NO: 6914551 - DNA, 22 bp, Homo sapiens
ggctggtggggaaagaggacca

SEQ ID NO: 6914552 - DNA, 22 bp, Homo sapiens
ggagtgagtactggagtagctg

SEQ ID NO: 6914553 - DNA, 22 bp, Homo sapiens
ataatgcacctttgagtatggc

SEQ ID NO: 6914554 - DNA, 22 bp, Homo sapiens
attgttcatgtatgaataaata

SEQ ID NO: 6914555 - DNA, 22 bp, Homo sapiens
aagcaggcgagggcctggagca

SEQ ID NO: 6914556 - DNA, 22 bp, Homo sapiens
tgcttactccaactgtggtcct

SEQ ID NO: 6914557 - DNA, 22 bp, Homo sapiens
gctatttattaaaatagtgaag

SEQ ID NO: 6914558 - DNA, 22 bp, Homo sapiens
ccctggcagagggggcaggtgc

SEQ ID NO: 6914559 - DNA, 22 bp, Homo sapiens
cctgaagatgagggacagctaa

SEQ ID NO: 6914560 - DNA, 22 bp, Homo sapiens
ggtttcaactcagctagtaagg

SEQ ID NO: 6914561 - DNA, 22 bp, Homo sapiens
aggcttcagaaagagtaattgg

SEQ ID NO: 6914562 - DNA, 22 bp, Homo sapiens
agaccagaccagagtttactat

SEQ ID NO: 6914563 - DNA, 22 bp, Homo sapiens
gctgtgtccaggtgggggtgac

SEQ ID NO: 6914564 - DNA, 22 bp, Homo sapiens
aggacccaagcacagttcctgg

SEQ ID NO: 6914565 - DNA, 22 bp, Homo sapiens
taccttgattttgaatccatga

SEQ ID NO: 6914566 - DNA, 21 bp, Homo sapiens
tttcacaaaagtatgtgacaa

SEQ ID NO: 6914567 - DNA, 22 bp, Homo sapiens
acttcatgttgtttacaactta

SEQ ID NO: 6914568 - DNA, 18 bp, Homo sapiens
ttcacctgtcctggcagg

SEQ ID NO: 6914569 - DNA, 22 bp, Homo sapiens
gggatgagagtagggtgtgaaa

SEQ ID NO: 6914570 - DNA, 22 bp, Homo sapiens
ttatctgtgatcctaaatgtct

SEQ ID NO: 6914571 - DNA, 22 bp, Homo sapiens
ttcaacaatgaaagctaaggaa

SEQ ID NO: 6914572 - DNA, 22 bp, Homo sapiens
gttggcatgaggtagtcactgt

SEQ ID NO: 6914573 - DNA, 22 bp, Homo sapiens
atttttatgacaaaccatcctc

SEQ ID NO: 6914574 - DNA, 22 bp, Homo sapiens
gggagtggattatgtggaccca

SEQ ID NO: 6914575 - DNA, 22 bp, Homo sapiens
tcagaagtagctccccttcatt

SEQ ID NO: 6914576 - DNA, 19 bp, Homo sapiens
aactgtaaagatctgtagc

SEQ ID NO: 6914577 - DNA, 22 bp, Homo sapiens
attctcataggagcgtgaacct

SEQ ID NO: 6914578 - DNA, 22 bp, Homo sapiens
ttattgtgtacttcctctgtgc

SEQ ID NO: 6914579 - DNA, 22 bp, Homo sapiens
ttagttatactactgaatggag

SEQ ID NO: 6914580 - DNA, 22 bp, Homo sapiens
tacttgctgttagtattttaca

SEQ ID NO: 6914581 - DNA, 22 bp, Homo sapiens
atccccactgctgctggtgtag

SEQ ID NO: 6914582 - DNA, 22 bp, Homo sapiens
agctcccagctcctttgagaga

SEQ ID NO: 6914583 - DNA, 22 bp, Homo sapiens
tccatacattgaaataccattc

SEQ ID NO: 6914584 - DNA, 22 bp, Homo sapiens
actctgctaaatgtgtaggctc

SEQ ID NO: 6914585 - DNA, 22 bp, Homo sapiens
aaagcttatttgtatgcatgtt

SEQ ID NO: 6914586 - DNA, 22 bp, Homo sapiens
ttctggaaatgaatgctaggaa

SEQ ID NO: 6914587 - DNA, 22 bp, Homo sapiens
cacacaaatattctggaggcaa

SEQ ID NO: 6914588 - DNA, 22 bp, Homo sapiens
tgctccactaagccatcccatt

SEQ ID NO: 6914589 - DNA, 22 bp, Homo sapiens
ccatttcactcttcctgaagga

SEQ ID NO: 6914590 - DNA, 22 bp, Homo sapiens
gctggactagaagcagggctca

SEQ ID NO: 6914591 - DNA, 16 bp, Homo sapiens
tttagcactggcatac

SEQ ID NO: 6914592 - DNA, 22 bp, Homo sapiens
caaggcaatctcatggcttctt

SEQ ID NO: 6914593 - DNA, 23 bp, Homo sapiens
tatgaactgcattgctggtgtgt

SEQ ID NO: 6914594 - DNA, 16 bp, Homo sapiens
attgttttcaattaga

SEQ ID NO: 6914595 - DNA, 22 bp, Homo sapiens
acaaaagtgtaggaattcctta

SEQ ID NO: 6914596 - DNA, 22 bp, Homo sapiens
actttttagtttcctcaaacat

SEQ ID NO: 6914597 - DNA, 22 bp, Homo sapiens
aatgctgtatatcttagctaat

SEQ ID NO: 6914598 - DNA, 22 bp, Homo sapiens
tctgctgtgatttgctacctgt

SEQ ID NO: 6914599 - DNA, 22 bp, Homo sapiens
gacctctgttggacccctgggg

SEQ ID NO: 6914600 - DNA, 19 bp, Homo sapiens
cctgggaggcggaggttgc

SEQ ID NO: 6914601 - DNA, 22 bp, Homo sapiens
cgctgccaggatcccctgccgg

SEQ ID NO: 6914602 - DNA, 22 bp, Homo sapiens
taaactgtgtaatatgatgtct

SEQ ID NO: 6914603 - DNA, 22 bp, Homo sapiens
aactatgttaataagtttcatt

SEQ ID NO: 6914604 - DNA, 22 bp, Homo sapiens
actttaaaaagagccttctaac

SEQ ID NO: 6914605 - DNA, 22 bp, Homo sapiens
cctgtgctggctttattctcag

SEQ ID NO: 6914606 - DNA, 22 bp, Homo sapiens
ctcacactgtgccaaatccttt

SEQ ID NO: 6914607 - DNA, 22 bp, Homo sapiens
tcagtcaaggaaaaatacctcc

SEQ ID NO: 6914608 - DNA, 18 bp, Homo sapiens
ccagtgccaagagtggca

SEQ ID NO: 6914609 - DNA, 22 bp, Homo sapiens
tggtctcttttcagcctgggga

SEQ ID NO: 6914610 - DNA, 22 bp, Homo sapiens
tttcaatgacacaaaagagaaa

SEQ ID NO: 6914611 - DNA, 22 bp, Homo sapiens
aggcctgctgtgtagcctgttg

SEQ ID NO: 6914612 - DNA, 22 bp, Homo sapiens
gtggcactgggtgagtgagtga

SEQ ID NO: 6914613 - DNA, 22 bp, Homo sapiens
cttcattacttgctcgtagcac

SEQ ID NO: 6914614 - DNA, 22 bp, Homo sapiens
ggcccagcacagtgcttggggg

SEQ ID NO: 6914615 - DNA, 22 bp, Homo sapiens
gcactgcctgtgttcagggtaa

SEQ ID NO: 6914616 - DNA, 22 bp, Homo sapiens
tcattcctcaggaagggattta

SEQ ID NO: 6914617 - DNA, 22 bp, Homo sapiens
ggctatgtgtccagcatctttg

SEQ ID NO: 6914618 - DNA, 22 bp, Homo sapiens
tccttctatttgtttatgtggc

SEQ ID NO: 6914619 - DNA, 20 bp, Homo sapiens
cctggctggtggaggaaagg

SEQ ID NO: 6914620 - DNA, 22 bp, Homo sapiens
ctgaattagatgaaaaaggctc

SEQ ID NO: 6914621 - DNA, 20 bp, Homo sapiens
tttcttgtacttggagaagg

SEQ ID NO: 6914622 - DNA, 22 bp, Homo sapiens
agagctctcctagaccgcagag

SEQ ID NO: 6914623 - DNA, 22 bp, Homo sapiens
ctcttctctgcagcctttgaag

SEQ ID NO: 6914624 - DNA, 22 bp, Homo sapiens
gtttcacacatcctgcacatag

SEQ ID NO: 6914625 - DNA, 22 bp, Homo sapiens
ggggcgactgtatcttggggca

SEQ ID NO: 6914626 - DNA, 21 bp, Homo sapiens
gcactcagtcactactcaaga

SEQ ID NO: 6914627 - DNA, 22 bp, Homo sapiens
tgaatagatggtgacagtatga

SEQ ID NO: 6914628 - DNA, 22 bp, Homo sapiens
ccggagtgtctggcctgctggg

SEQ ID NO: 6914629 - DNA, 22 bp, Homo sapiens
tcagcttttaaaaacaagaagt

SEQ ID NO: 6914630 - DNA, 22 bp, Homo sapiens
gagcaggtctttcatggtgcat

SEQ ID NO: 6914631 - DNA, 22 bp, Homo sapiens
aatgtctattaaactgtcataa

SEQ ID NO: 6914632 - DNA, 21 bp, Homo sapiens
tctcttcccatcaggacacta

SEQ ID NO: 6914633 - DNA, 22 bp, Homo sapiens
ctcttcagtaaatgacactgtt

SEQ ID NO: 6914634 - DNA, 22 bp, Homo sapiens
ttcaaacattcaaataaaccgg

SEQ ID NO: 6914635 - DNA, 22 bp, Homo sapiens
agtggccaatatgtcatgctct

SEQ ID NO: 6914636 - DNA, 22 bp, Homo sapiens
agacttaggagctgacatctct

SEQ ID NO: 6914637 - DNA, 22 bp, Homo sapiens
atttagtgtgcctgggaatctg

SEQ ID NO: 6914638 - DNA, 21 bp, Homo sapiens
tctctgagacactctggagcc

SEQ ID NO: 6914639 - DNA, 22 bp, Homo sapiens
tgttaaggagacacatgaaaaa

SEQ ID NO: 6914640 - DNA, 22 bp, Homo sapiens
ccaggaagcctcagatgctgag

SEQ ID NO: 6914641 - DNA, 22 bp, Homo sapiens
tttggtcagataagtcaatgta

SEQ ID NO: 6914642 - DNA, 22 bp, Homo sapiens
gggctcagtcggcaagcccctt

SEQ ID NO: 6914643 - DNA, 22 bp, Homo sapiens
agtgtacatgtacacattagta

SEQ ID NO: 6914644 - DNA, 22 bp, Homo sapiens
ggaggtgacgaaaagaaattgt

SEQ ID NO: 6914645 - DNA, 22 bp, Homo sapiens
gcagagacagactaatgaaaag

SEQ ID NO: 6914646 - DNA, 22 bp, Homo sapiens
ttccctccctggctgccatttc

SEQ ID NO: 6914647 - DNA, 22 bp, Homo sapiens
caggactgaagggcacagggaa

SEQ ID NO: 6914648 - DNA, 22 bp, Homo sapiens
agctctgcctaggttccacgat

SEQ ID NO: 6914649 - DNA, 22 bp, Homo sapiens
cgtgctgggtctgcggggccgt

SEQ ID NO: 6914650 - DNA, 22 bp, Homo sapiens
tacttgtagcaggtggcattta

SEQ ID NO: 6914651 - DNA, 22 bp, Homo sapiens
aggcactttctgtatgctagtt

SEQ ID NO: 6914652 - DNA, 22 bp, Homo sapiens
tcaggcttgggaggcccagggc

SEQ ID NO: 6914653 - DNA, 18 bp, Homo sapiens
cctgccattgattctgag

SEQ ID NO: 6914654 - DNA, 22 bp, Homo sapiens
cattcacaaagctgattgatgg

SEQ ID NO: 6914655 - DNA, 22 bp, Homo sapiens
acagatatttaagagcttttgt

SEQ ID NO: 6914656 - DNA, 22 bp, Homo sapiens
tgaaatgttgccatgaggtctc

SEQ ID NO: 6914657 - DNA, 22 bp, Homo sapiens
tttcaagttgtttatatccaga

SEQ ID NO: 6914658 - DNA, 18 bp, Homo sapiens
ctgcttctgtctgccagt

SEQ ID NO: 6914659 - DNA, 22 bp, Homo sapiens
gcaaatgtttttgagtgtttac

SEQ ID NO: 6914660 - DNA, 20 bp, Homo sapiens
gctgaggagcagtgtggttg

SEQ ID NO: 6914661 - DNA, 18 bp, Homo sapiens
cctgtcacgtccaggcct

SEQ ID NO: 6914662 - DNA, 22 bp, Homo sapiens
actgcacctcagcctgggcgac

SEQ ID NO: 6914663 - DNA, 22 bp, Homo sapiens
agcttgccagtcatatctgttt

SEQ ID NO: 6914664 - DNA, 21 bp, Homo sapiens
tgagctgggagttctgaaaag

SEQ ID NO: 6914665 - DNA, 22 bp, Homo sapiens
agtgaattctccacccagtagg

SEQ ID NO: 6914666 - DNA, 19 bp, Homo sapiens
acttcaaatcttagagaaa

SEQ ID NO: 6914667 - DNA, 22 bp, Homo sapiens
ttgcatgtctgcttctcctcct

SEQ ID NO: 6914668 - DNA, 22 bp, Homo sapiens
catgcatggtcatgctgggact

SEQ ID NO: 6914669 - DNA, 22 bp, Homo sapiens
acggaaaaccctgagcaaactt

SEQ ID NO: 6914670 - DNA, 23 bp, Homo sapiens
tacttggttttgatagaaatcca

SEQ ID NO: 6914671 - DNA, 19 bp, Homo sapiens
gctgaaggcgctcagaagc

SEQ ID NO: 6914672 - DNA, 22 bp, Homo sapiens
cagtggtttccaaacttgttcc

SEQ ID NO: 6914673 - DNA, 22 bp, Homo sapiens
taggtgtcaggcctcctccagc

SEQ ID NO: 6914674 - DNA, 22 bp, Homo sapiens
taacatcttaactggatacttc

SEQ ID NO: 6914675 - DNA, 22 bp, Homo sapiens
aaatcatagcccccatccgatt

SEQ ID NO: 6914676 - DNA, 22 bp, Homo sapiens
aatgagatcagagataactcaa

SEQ ID NO: 6914677 - DNA, 22 bp, Homo sapiens
ggcagctctgctaattgagcct

SEQ ID NO: 6914678 - DNA, 22 bp, Homo sapiens
tgcttgatgagtgtgccaagca

SEQ ID NO: 6914679 - DNA, 22 bp, Homo sapiens
ggctgggagctggacaggccgg

SEQ ID NO: 6914680 - DNA, 22 bp, Homo sapiens
acgacagcacaacagcatcctc

SEQ ID NO: 6914681 - DNA, 22 bp, Homo sapiens
tgatttgcgtctcatttgaaat

SEQ ID NO: 6914682 - DNA, 22 bp, Homo sapiens
ggcagagtgctctgggcagggg

SEQ ID NO: 6914683 - DNA, 22 bp, Homo sapiens
ttacaactttcctgtgtcaaat

SEQ ID NO: 6914684 - DNA, 21 bp, Homo sapiens
tgttcaaacgtacacatttct

SEQ ID NO: 6914685 - DNA, 22 bp, Homo sapiens
caggctgcagtgcagtggctat

SEQ ID NO: 6914686 - DNA, 22 bp, Homo sapiens
atatttggaaagaaaatcattg

SEQ ID NO: 6914687 - DNA, 22 bp, Homo sapiens
aacagtaagagatgttttatct

SEQ ID NO: 6914688 - DNA, 22 bp, Homo sapiens
cattttaaatgatttaagccaa

SEQ ID NO: 6914689 - DNA, 20 bp, Homo sapiens
gaagtgtggagttgggaagc

SEQ ID NO: 6914690 - DNA, 22 bp, Homo sapiens
ggttcagggatgtgggtgatgc

SEQ ID NO: 6914691 - DNA, 22 bp, Homo sapiens
ctgagtgaggggagcttgatgg

SEQ ID NO: 6914692 - DNA, 22 bp, Homo sapiens
tccatccacattaacagatacg

SEQ ID NO: 6914693 - DNA, 22 bp, Homo sapiens
tgagaccatttgacatacagtg

SEQ ID NO: 6914694 - DNA, 21 bp, Homo sapiens
tcctgcaggaggcctgagagg

SEQ ID NO: 6914695 - DNA, 22 bp, Homo sapiens
tgtccctggactccaggagcca

SEQ ID NO: 6914696 - DNA, 22 bp, Homo sapiens
atgaacacaatacgtgcatgca

SEQ ID NO: 6914697 - DNA, 22 bp, Homo sapiens
gaaacctggttctgcgtgaggg

SEQ ID NO: 6914698 - DNA, 20 bp, Homo sapiens
aaccagtacccaagtaggaa

SEQ ID NO: 6914699 - DNA, 19 bp, Homo sapiens
atctgaagtaggtgcagct

SEQ ID NO: 6914700 - DNA, 20 bp, Homo sapiens
ccagaagcactcttcatgtt

SEQ ID NO: 6914701 - DNA, 22 bp, Homo sapiens
tagtgtcaaacagggattagaa

SEQ ID NO: 6914702 - DNA, 22 bp, Homo sapiens
aacaggaaatacttatgaggta

SEQ ID NO: 6914703 - DNA, 22 bp, Homo sapiens
tgccgtgcccatattgtgggtg

SEQ ID NO: 6914704 - DNA, 21 bp, Homo sapiens
gtctgcagaccccttcattgc

SEQ ID NO: 6914705 - DNA, 22 bp, Homo sapiens
aaagttgtgaaaccgaacatgt

SEQ ID NO: 6914706 - DNA, 22 bp, Homo sapiens
ttgcagggaaatagaaataaac

SEQ ID NO: 6914707 - DNA, 22 bp, Homo sapiens
aaagctcttactgtactagtga

SEQ ID NO: 6914708 - DNA, 22 bp, Homo sapiens
ggaggtcatagctgtgcaggta

SEQ ID NO: 6914709 - DNA, 20 bp, Homo sapiens
tgggtgagagtgtttgctct

SEQ ID NO: 6914710 - DNA, 22 bp, Homo sapiens
gcagaatacattttgttttcct

SEQ ID NO: 6914711 - DNA, 22 bp, Homo sapiens
tacaaagtatatttctagctgt

SEQ ID NO: 6914712 - DNA, 22 bp, Homo sapiens
tgctatgtaaagctctgggttt

SEQ ID NO: 6914713 - DNA, 22 bp, Homo sapiens
tttgtgtgcgtctggcctgggg

SEQ ID NO: 6914714 - DNA, 22 bp, Homo sapiens
gtgctctgtggattgagttgaa

SEQ ID NO: 6914715 - DNA, 22 bp, Homo sapiens
agggaagcaatgattattattc

SEQ ID NO: 6914716 - DNA, 22 bp, Homo sapiens
tcccctggtgccacgatctgct

SEQ ID NO: 6914717 - DNA, 23 bp, Homo sapiens
ccagggaaggccatcttcaactg

SEQ ID NO: 6914718 - DNA, 22 bp, Homo sapiens
tggaagaggccagaaagtggga

SEQ ID NO: 6914719 - DNA, 22 bp, Homo sapiens
caactgttataaatcaacagag

SEQ ID NO: 6914720 - DNA, 18 bp, Homo sapiens
ggcagcttgactagcaac

SEQ ID NO: 6914721 - DNA, 22 bp, Homo sapiens
gagagattaccacgcttcctga

SEQ ID NO: 6914722 - DNA, 22 bp, Homo sapiens
ctgggcttagcagctcctggtc

SEQ ID NO: 6914723 - DNA, 22 bp, Homo sapiens
tacaatgttcatagctttggca

SEQ ID NO: 6914724 - DNA, 22 bp, Homo sapiens
tgtgtcctggtgttaattttat

SEQ ID NO: 6914725 - DNA, 22 bp, Homo sapiens
acagaacaacaaggtggaccag

SEQ ID NO: 6914726 - DNA, 20 bp, Homo sapiens
agcacagcgcggtgttcctt

SEQ ID NO: 6914727 - DNA, 22 bp, Homo sapiens
tagtgcagggttttaagcactg

SEQ ID NO: 6914728 - DNA, 22 bp, Homo sapiens
agattcattaggagacattcag

SEQ ID NO: 6914729 - DNA, 21 bp, Homo sapiens
aggttcctgagtcatgcctta

SEQ ID NO: 6914730 - DNA, 22 bp, Homo sapiens
aggcagtggcttttgttgtgtt

SEQ ID NO: 6914731 - DNA, 22 bp, Homo sapiens
cttgccttcttttcctatagaa

SEQ ID NO: 6914732 - DNA, 22 bp, Homo sapiens
gcagctgcaataggcatcaagc

SEQ ID NO: 6914733 - DNA, 22 bp, Homo sapiens
tgtgggaggaacacagccagaa

SEQ ID NO: 6914734 - DNA, 22 bp, Homo sapiens
ttgaacagtcctaagagaccct

SEQ ID NO: 6914735 - DNA, 22 bp, Homo sapiens
atggctttgaagtaatgtaatt

SEQ ID NO: 6914736 - DNA, 22 bp, Homo sapiens
ggaagaggaggagccaggcttt

SEQ ID NO: 6914737 - DNA, 17 bp, Homo sapiens
gagccaccctgtgcgag

SEQ ID NO: 6914738 - DNA, 22 bp, Homo sapiens
tttctgtttagcataaagtggc

SEQ ID NO: 6914739 - DNA, 22 bp, Homo sapiens
tagtatattaattctcacggtt

SEQ ID NO: 6914740 - DNA, 22 bp, Homo sapiens
gtcacatgccagtgcacacagg

SEQ ID NO: 6914741 - DNA, 22 bp, Homo sapiens
gagtcaggatgcaaggggatgg

SEQ ID NO: 6914742 - DNA, 22 bp, Homo sapiens
agtcactttatgagagaaccat

SEQ ID NO: 6914743 - DNA, 22 bp, Homo sapiens
tttgtagacgtcagaagttact

SEQ ID NO: 6914744 - DNA, 22 bp, Homo sapiens
gggattacagatgtgagccatt

SEQ ID NO: 6914745 - DNA, 19 bp, Homo sapiens
caagttctggagattaggg

SEQ ID NO: 6914746 - DNA, 22 bp, Homo sapiens
gtctcccgcccaacaagcaagg

SEQ ID NO: 6914747 - DNA, 22 bp, Homo sapiens
tagcccatgcagctctgtcatt

SEQ ID NO: 6914748 - DNA, 22 bp, Homo sapiens
tcagacagggcttctcaaactt

SEQ ID NO: 6914749 - DNA, 22 bp, Homo sapiens
ggtcccagttgcccaggtcagg

SEQ ID NO: 6914750 - DNA, 22 bp, Homo sapiens
tagagccctcttcactaaagga

SEQ ID NO: 6914751 - DNA, 22 bp, Homo sapiens
tctgtaatcagagtagcagata

SEQ ID NO: 6914752 - DNA, 21 bp, Homo sapiens
tagccatgttccttatggttc

SEQ ID NO: 6914753 - DNA, 20 bp, Homo sapiens
cttaaacacagagatagatt

SEQ ID NO: 6914754 - DNA, 21 bp, Homo sapiens
aaatgaatgtggtagtgcaag

SEQ ID NO: 6914755 - DNA, 22 bp, Homo sapiens
tggacactggggcaggcgggag

SEQ ID NO: 6914756 - DNA, 22 bp, Homo sapiens
acttgggatggtggccagagcg

SEQ ID NO: 6914757 - DNA, 23 bp, Homo sapiens
acatttggccaaaaattatttct

SEQ ID NO: 6914758 - DNA, 22 bp, Homo sapiens
tgaaactgaaaggtatttatag

SEQ ID NO: 6914759 - DNA, 22 bp, Homo sapiens
ttaagatgatgtttcttgttgt

SEQ ID NO: 6914760 - DNA, 22 bp, Homo sapiens
aagtggaaagagtgttgcaagg

SEQ ID NO: 6914761 - DNA, 22 bp, Homo sapiens
ttttgtgaatagtttatctaag

SEQ ID NO: 6914762 - DNA, 22 bp, Homo sapiens
gggaagcagcattgtgctggct

SEQ ID NO: 6914763 - DNA, 22 bp, Homo sapiens
tggctagatggcagaaagctgg

SEQ ID NO: 6914764 - DNA, 22 bp, Homo sapiens
aggagggatagaaaaatacttg

SEQ ID NO: 6914765 - DNA, 22 bp, Homo sapiens
caccacagcatccactagaagg

SEQ ID NO: 6914766 - DNA, 20 bp, Homo sapiens
ctgagcgtctaagaggtgag

SEQ ID NO: 6914767 - DNA, 22 bp, Homo sapiens
agtcattattatttgtcaaagg

SEQ ID NO: 6914768 - DNA, 22 bp, Homo sapiens
atcaccttgcgcagcacggctt

SEQ ID NO: 6914769 - DNA, 22 bp, Homo sapiens
tgggaaggacgtgtcagtggca

SEQ ID NO: 6914770 - DNA, 22 bp, Homo sapiens
tttctacatgtcagtaactgat

SEQ ID NO: 6914771 - DNA, 19 bp, Homo sapiens
ggtgtgtgctggggcctgt

SEQ ID NO: 6914772 - DNA, 22 bp, Homo sapiens
tttaaatgtttaaaactcgtga

SEQ ID NO: 6914773 - DNA, 22 bp, Homo sapiens
ctggaagaccccccaggactca

SEQ ID NO: 6914774 - DNA, 19 bp, Homo sapiens
agcagcagcaccagggatt

SEQ ID NO: 6914775 - DNA, 22 bp, Homo sapiens
ggctatgtggtcatataagata

SEQ ID NO: 6914776 - DNA, 22 bp, Homo sapiens
taggcccctagtgccacgtggc

SEQ ID NO: 6914777 - DNA, 16 bp, Homo sapiens
acagtaaagctggaca

SEQ ID NO: 6914778 - DNA, 22 bp, Homo sapiens
caaattgatctgtctttatgaa

SEQ ID NO: 6914779 - DNA, 22 bp, Homo sapiens
agccagcatcccttcagtctcc

SEQ ID NO: 6914780 - DNA, 22 bp, Homo sapiens
gccaggaaagccactggcatac

SEQ ID NO: 6914781 - DNA, 20 bp, Homo sapiens
gcctggaggcagagataaag

SEQ ID NO: 6914782 - DNA, 22 bp, Homo sapiens
gaccttgtgatccacccgcttt

SEQ ID NO: 6914783 - DNA, 22 bp, Homo sapiens
gcccccagagaatgaggtacga

SEQ ID NO: 6914784 - DNA, 22 bp, Homo sapiens
gagcagctagataaagcccttc

SEQ ID NO: 6914785 - DNA, 22 bp, Homo sapiens
agcctgtctgtctccaaagctg

SEQ ID NO: 6914786 - DNA, 22 bp, Homo sapiens
cattcattctgtaagtaactat

SEQ ID NO: 6914787 - DNA, 22 bp, Homo sapiens
taagaagtgtttgcccagccat

SEQ ID NO: 6914788 - DNA, 22 bp, Homo sapiens
gttgtaaatacagtactgaaac

SEQ ID NO: 6914789 - DNA, 22 bp, Homo sapiens
agagagagaaatgaaatgtgct

SEQ ID NO: 6914790 - DNA, 22 bp, Homo sapiens
aactactaccacagtcaagaca

SEQ ID NO: 6914791 - DNA, 22 bp, Homo sapiens
ctcaggatattgggctggagca

SEQ ID NO: 6914792 - DNA, 22 bp, Homo sapiens
ctatttcagcagaagccggaga

SEQ ID NO: 6914793 - DNA, 22 bp, Homo sapiens
ttcaacagtgatggcctttgta

SEQ ID NO: 6914794 - DNA, 22 bp, Homo sapiens
gtggccaaatcatgtcaaaggc

SEQ ID NO: 6914795 - DNA, 22 bp, Homo sapiens
gtgtgcagcagagacaggactc

SEQ ID NO: 6914796 - DNA, 22 bp, Homo sapiens
cagggagcagcgctggggcctc

SEQ ID NO: 6914797 - DNA, 22 bp, Homo sapiens
gttggttaggtcaggattcaga

SEQ ID NO: 6914798 - DNA, 22 bp, Homo sapiens
tctttacagtcctctgtcaatc

SEQ ID NO: 6914799 - DNA, 23 bp, Homo sapiens
caggaaatgttcttgaagcctga

SEQ ID NO: 6914800 - DNA, 22 bp, Homo sapiens
cgagtgtctgctatgggctgag

SEQ ID NO: 6914801 - DNA, 22 bp, Homo sapiens
atagatcattgatacttgcatc

SEQ ID NO: 6914802 - DNA, 22 bp, Homo sapiens
cacagtggaagtccaggatccc

SEQ ID NO: 6914803 - DNA, 22 bp, Homo sapiens
ttattgctaaggtactaggtgg

SEQ ID NO: 6914804 - DNA, 22 bp, Homo sapiens
acaaattaccatggaatttggg

SEQ ID NO: 6914805 - DNA, 22 bp, Homo sapiens
tgggtgaggatgatgaggcagc

SEQ ID NO: 6914806 - DNA, 22 bp, Homo sapiens
tgattgtccaagagaaaggtct

SEQ ID NO: 6914807 - DNA, 22 bp, Homo sapiens
agcacgttttactaaacctcca

SEQ ID NO: 6914808 - DNA, 22 bp, Homo sapiens
cgcaggcacagagtggacagcg

SEQ ID NO: 6914809 - DNA, 22 bp, Homo sapiens
tcacagaagtgtagtgaggaaa

SEQ ID NO: 6914810 - DNA, 22 bp, Homo sapiens
gttcagtgtttacatgattgtt

SEQ ID NO: 6914811 - DNA, 22 bp, Homo sapiens
agagacatagcacagtttttcg

SEQ ID NO: 6914812 - DNA, 22 bp, Homo sapiens
ttcaacactgtttggctgagta

SEQ ID NO: 6914813 - DNA, 22 bp, Homo sapiens
tcttgcatttcagagttcagag

SEQ ID NO: 6914814 - DNA, 22 bp, Homo sapiens
gttacaaagcacttcaagtgaa

SEQ ID NO: 6914815 - DNA, 22 bp, Homo sapiens
ccactggctgtcagcaggactc

SEQ ID NO: 6914816 - DNA, 22 bp, Homo sapiens
aattgcccatatttgagaatga

SEQ ID NO: 6914817 - DNA, 22 bp, Homo sapiens
atctccagaggagtcatggtct

SEQ ID NO: 6914818 - DNA, 22 bp, Homo sapiens
acattaagaaacgagagagcaa

SEQ ID NO: 6914819 - DNA, 22 bp, Homo sapiens
ctggttaatccataaacagaga

SEQ ID NO: 6914820 - DNA, 21 bp, Homo sapiens
agacagcagtctccaaacccc

SEQ ID NO: 6914821 - DNA, 22 bp, Homo sapiens
agaaacatcattgtttggtatt

SEQ ID NO: 6914822 - DNA, 22 bp, Homo sapiens
atacttgaggtagcaacttaag

SEQ ID NO: 6914823 - DNA, 22 bp, Homo sapiens
ttctctaagagttatatgaatt

SEQ ID NO: 6914824 - DNA, 22 bp, Homo sapiens
agtgataggacatatggatttt

SEQ ID NO: 6914825 - DNA, 22 bp, Homo sapiens
tgacatttttgtacaaagtcag

SEQ ID NO: 6914826 - DNA, 22 bp, Homo sapiens
acagaaagatgatttgaaatgg

SEQ ID NO: 6914827 - DNA, 23 bp, Homo sapiens
agtttttaatggtcatagctgag

SEQ ID NO: 6914828 - DNA, 20 bp, Homo sapiens
acagtcagggaatagaaaaa

SEQ ID NO: 6914829 - DNA, 22 bp, Homo sapiens
agattctcaacaaagagtagca

SEQ ID NO: 6914830 - DNA, 22 bp, Homo sapiens
aggagccaagatggggcaagta

SEQ ID NO: 6914831 - DNA, 22 bp, Homo sapiens
attcaaggtatttaaaacataa

SEQ ID NO: 6914832 - DNA, 22 bp, Homo sapiens
tcttgggcagcttgctcgcccc

SEQ ID NO: 6914833 - DNA, 22 bp, Homo sapiens
agctgaccagcatcttctggag

SEQ ID NO: 6914834 - DNA, 22 bp, Homo sapiens
ctctagaacagtgctgagcctt

SEQ ID NO: 6914835 - DNA, 22 bp, Homo sapiens
catcacattagtctcaagagaa

SEQ ID NO: 6914836 - DNA, 22 bp, Homo sapiens
gccctccacctggtctctctgg

SEQ ID NO: 6914837 - DNA, 22 bp, Homo sapiens
atagggcagtggcatctcttaa

SEQ ID NO: 6914838 - DNA, 22 bp, Homo sapiens
ggcccacaccaggggccacagt

SEQ ID NO: 6914839 - DNA, 22 bp, Homo sapiens
tttggcactataggtaaatttg

SEQ ID NO: 6914840 - DNA, 22 bp, Homo sapiens
gctcagggaatgagaagatgtt

SEQ ID NO: 6914841 - DNA, 22 bp, Homo sapiens
agtctgtgtacctttggccttc

SEQ ID NO: 6914842 - DNA, 22 bp, Homo sapiens
aagcactttagtgagaataagg

SEQ ID NO: 6914843 - DNA, 22 bp, Homo sapiens
tattgctatgagcattgttctt

SEQ ID NO: 6914844 - DNA, 22 bp, Homo sapiens
cctaggcccattaattcccctt

SEQ ID NO: 6914845 - DNA, 23 bp, Homo sapiens
aggaatggctagaagtgtgaccc

SEQ ID NO: 6914846 - DNA, 22 bp, Homo sapiens
atataggttatcatatttgccc

SEQ ID NO: 6914847 - DNA, 22 bp, Homo sapiens
acccaggagacaggttgcagtg

SEQ ID NO: 6914848 - DNA, 22 bp, Homo sapiens
ttgctacttagagtgcagcagc

SEQ ID NO: 6914849 - DNA, 22 bp, Homo sapiens
catgccaggattaggacccagc

SEQ ID NO: 6914850 - DNA, 22 bp, Homo sapiens
attgacaaggaaactataccag

SEQ ID NO: 6914851 - DNA, 22 bp, Homo sapiens
ctaaatgtgactcaccatctca

SEQ ID NO: 6914852 - DNA, 22 bp, Homo sapiens
ggaggtggcctgaaaatgtggc

SEQ ID NO: 6914853 - DNA, 22 bp, Homo sapiens
acctaagctttgcatgataatg

SEQ ID NO: 6914854 - DNA, 22 bp, Homo sapiens
gcaattattatgtgacttttac

SEQ ID NO: 6914855 - DNA, 21 bp, Homo sapiens
ccatgggagctgttaatcctg

SEQ ID NO: 6914856 - DNA, 22 bp, Homo sapiens
attgaagaaacccaaataatgg

SEQ ID NO: 6914857 - DNA, 22 bp, Homo sapiens
ttgtttaagccacccaatctgt

SEQ ID NO: 6914858 - DNA, 22 bp, Homo sapiens
ttccagtgtgcttttatgttag

SEQ ID NO: 6914859 - DNA, 22 bp, Homo sapiens
gagagtgaggcatcaggggcag

SEQ ID NO: 6914860 - DNA, 22 bp, Homo sapiens
tttggtaagtatgaatgcagta

SEQ ID NO: 6914861 - DNA, 19 bp, Homo sapiens
taacaggggaaaatgatca

SEQ ID NO: 6914862 - DNA, 22 bp, Homo sapiens
gcctgcagggcccttgtgggtc

SEQ ID NO: 6914863 - DNA, 22 bp, Homo sapiens
ttactttagggatgttttgctt

SEQ ID NO: 6914864 - DNA, 22 bp, Homo sapiens
caggaaacattcttggtaagga

SEQ ID NO: 6914865 - DNA, 22 bp, Homo sapiens
cacacccaaatttctctctcag

SEQ ID NO: 6914866 - DNA, 22 bp, Homo sapiens
gttctgctgtaatatctctgct

SEQ ID NO: 6914867 - DNA, 22 bp, Homo sapiens
tcaggcctttgaacttggagtg

SEQ ID NO: 6914868 - DNA, 22 bp, Homo sapiens
cttgctgaaggaacttcccaga

SEQ ID NO: 6914869 - DNA, 22 bp, Homo sapiens
tagaggccgaatgctgagctgg

SEQ ID NO: 6914870 - DNA, 22 bp, Homo sapiens
catcatttaattataggggctg

SEQ ID NO: 6914871 - DNA, 22 bp, Homo sapiens
gaccttggagtgctgcatcaca

SEQ ID NO: 6914872 - DNA, 22 bp, Homo sapiens
ggctcttctgtggcagccaagg

SEQ ID NO: 6914873 - DNA, 22 bp, Homo sapiens
tctgctctgggccagctattaa

SEQ ID NO: 6914874 - DNA, 22 bp, Homo sapiens
tacttgagaatagtgaataatg

SEQ ID NO: 6914875 - DNA, 22 bp, Homo sapiens
agaatgctcttcaaaatctagc

SEQ ID NO: 6914876 - DNA, 22 bp, Homo sapiens
ttgaacactaagtttccaggct

SEQ ID NO: 6914877 - DNA, 22 bp, Homo sapiens
ggagctgcaagtgttgagagct

SEQ ID NO: 6914878 - DNA, 22 bp, Homo sapiens
cagagtctctgggaggctgggt

SEQ ID NO: 6914879 - DNA, 22 bp, Homo sapiens
gttatattcaaaatgaggctgt

SEQ ID NO: 6914880 - DNA, 22 bp, Homo sapiens
agttcttcttgttaacacataa

SEQ ID NO: 6914881 - DNA, 22 bp, Homo sapiens
gctcctggcttcactgacatca

SEQ ID NO: 6914882 - DNA, 22 bp, Homo sapiens
agtggtgcccacctgagcctga

SEQ ID NO: 6914883 - DNA, 19 bp, Homo sapiens
gaggtgtctttcctgagta

SEQ ID NO: 6914884 - DNA, 22 bp, Homo sapiens
gaccacactttggaaatcacga

SEQ ID NO: 6914885 - DNA, 22 bp, Homo sapiens
tgaagacacatacaagggaatg

SEQ ID NO: 6914886 - DNA, 22 bp, Homo sapiens
tttggctatttctcccatggtc

SEQ ID NO: 6914887 - DNA, 22 bp, Homo sapiens
ctggagggctggactaaggaaa

SEQ ID NO: 6914888 - DNA, 22 bp, Homo sapiens
gcattcttcctgggctgggggc

SEQ ID NO: 6914889 - DNA, 22 bp, Homo sapiens
ttgccagggccagtgggggtgt

SEQ ID NO: 6914890 - DNA, 22 bp, Homo sapiens
gagccatacaacctataaagtg

SEQ ID NO: 6914891 - DNA, 22 bp, Homo sapiens
aggccctccattgatgtttatt

SEQ ID NO: 6914892 - DNA, 22 bp, Homo sapiens
atggccagatgaaataatagag

SEQ ID NO: 6914893 - DNA, 22 bp, Homo sapiens
tgacaattgttgtgaattcttc

SEQ ID NO: 6914894 - DNA, 22 bp, Homo sapiens
ttaatacactatatgatcacat

SEQ ID NO: 6914895 - DNA, 16 bp, Homo sapiens
gttctctcactgtacc

SEQ ID NO: 6914896 - DNA, 22 bp, Homo sapiens
gttctggaggagagcctggtgt

SEQ ID NO: 6914897 - DNA, 22 bp, Homo sapiens
acctggaagtgggtgctatggc

SEQ ID NO: 6914898 - DNA, 22 bp, Homo sapiens
caagattctagttgaggttcaa

SEQ ID NO: 6914899 - DNA, 22 bp, Homo sapiens
aaagtgcactagaatccagatt

SEQ ID NO: 6914900 - DNA, 22 bp, Homo sapiens
ttccaggcttctctggggcgtc

SEQ ID NO: 6914901 - DNA, 22 bp, Homo sapiens
ggggagtgacgcagggccatag

SEQ ID NO: 6914902 - DNA, 22 bp, Homo sapiens
gttctccttgtggctgcagcag

SEQ ID NO: 6914903 - DNA, 22 bp, Homo sapiens
ccactggaagatgctgaggtca

SEQ ID NO: 6914904 - DNA, 22 bp, Homo sapiens
gtgactgtgagtcgctgtgaca

SEQ ID NO: 6914905 - DNA, 22 bp, Homo sapiens
cagtgtgtggatcctcccagga

SEQ ID NO: 6914906 - DNA, 22 bp, Homo sapiens
tgccagggtgtcaggagagcta

SEQ ID NO: 6914907 - DNA, 22 bp, Homo sapiens
gcatttctgtgcatacacatga

SEQ ID NO: 6914908 - DNA, 22 bp, Homo sapiens
ttagaaaggggtgaatcaatgg

SEQ ID NO: 6914909 - DNA, 22 bp, Homo sapiens
agtcagagaaaacagccctgtg

SEQ ID NO: 6914910 - DNA, 22 bp, Homo sapiens
agaatcaaagagaaatactttg

SEQ ID NO: 6914911 - DNA, 22 bp, Homo sapiens
aggctcctcggggctgacggcg

SEQ ID NO: 6914912 - DNA, 22 bp, Homo sapiens
ttgggccaaatagctatttact

SEQ ID NO: 6914913 - DNA, 22 bp, Homo sapiens
cagttcagactacccacattgt

SEQ ID NO: 6914914 - DNA, 22 bp, Homo sapiens
gaaaggctgggatttagcgctg

SEQ ID NO: 6914915 - DNA, 22 bp, Homo sapiens
accatagttataacaaagtgtt

SEQ ID NO: 6914916 - DNA, 22 bp, Homo sapiens
tagcagtgtgcaaaatctttaa

SEQ ID NO: 6914917 - DNA, 22 bp, Homo sapiens
tttacagctagacatacctgag

SEQ ID NO: 6914918 - DNA, 22 bp, Homo sapiens
aacacaaaaattctcaggggca

SEQ ID NO: 6914919 - DNA, 22 bp, Homo sapiens
attgaaatccctacctcagagg

SEQ ID NO: 6914920 - DNA, 20 bp, Homo sapiens
agagcagcagttggtgaggt

SEQ ID NO: 6914921 - DNA, 20 bp, Homo sapiens
tgctgtcgtgttttctgctt

SEQ ID NO: 6914922 - DNA, 18 bp, Homo sapiens
atttacccagcaacgtgg

SEQ ID NO: 6914923 - DNA, 22 bp, Homo sapiens
caagatttggcaactttgtcat

SEQ ID NO: 6914924 - DNA, 22 bp, Homo sapiens
tttggaatcatagatatattca

SEQ ID NO: 6914925 - DNA, 22 bp, Homo sapiens
gctgtaatattcattctatgaa

SEQ ID NO: 6914926 - DNA, 22 bp, Homo sapiens
cacaggtatatgtgtatatact

SEQ ID NO: 6914927 - DNA, 22 bp, Homo sapiens
ctggaggagcaatatggttagg

SEQ ID NO: 6914928 - DNA, 22 bp, Homo sapiens
tttagcgtagctgacagctaat

SEQ ID NO: 6914929 - DNA, 22 bp, Homo sapiens
tttgctaaataagtgattaagt

SEQ ID NO: 6914930 - DNA, 22 bp, Homo sapiens
cctgggacgactctgtaccctt

SEQ ID NO: 6914931 - DNA, 22 bp, Homo sapiens
gaagacgagatctgtgcctcca

SEQ ID NO: 6914932 - DNA, 22 bp, Homo sapiens
aattccagctaggaaaagcttc

SEQ ID NO: 6914933 - DNA, 22 bp, Homo sapiens
tcttgggagctcctttaacctt

SEQ ID NO: 6914934 - DNA, 22 bp, Homo sapiens
tggattgtaacatagagtaaat

SEQ ID NO: 6914935 - DNA, 22 bp, Homo sapiens
tgacatgtcctgagaagatggc

SEQ ID NO: 6914936 - DNA, 22 bp, Homo sapiens
aatttcacataaggctcattgg

SEQ ID NO: 6914937 - DNA, 22 bp, Homo sapiens
cagagccagaactagaccttgt

SEQ ID NO: 6914938 - DNA, 22 bp, Homo sapiens
gttcttctcttgtaatggaatc

SEQ ID NO: 6914939 - DNA, 22 bp, Homo sapiens
ctggcttttggaggagggtcag

SEQ ID NO: 6914940 - DNA, 22 bp, Homo sapiens
ccctctgaacctggtagcagaa

SEQ ID NO: 6914941 - DNA, 21 bp, Homo sapiens
acacaggagtttcttctttct

SEQ ID NO: 6914942 - DNA, 22 bp, Homo sapiens
tgtgcgcgtgcacgcatacttg

SEQ ID NO: 6914943 - DNA, 23 bp, Homo sapiens
acaggaatttgtgcaccatgaag

SEQ ID NO: 6914944 - DNA, 22 bp, Homo sapiens
ttgcttgcagacttagcaaatt

SEQ ID NO: 6914945 - DNA, 22 bp, Homo sapiens
aaagcagaggttgcagtgagct

SEQ ID NO: 6914946 - DNA, 22 bp, Homo sapiens
cggatatgttttgattgaagga

SEQ ID NO: 6914947 - DNA, 22 bp, Homo sapiens
gattgtacttattgagctaaac

SEQ ID NO: 6914948 - DNA, 22 bp, Homo sapiens
tggctccaccgccgcggagctc

SEQ ID NO: 6914949 - DNA, 22 bp, Homo sapiens
cattctgacagctgaggtcgtg

SEQ ID NO: 6914950 - DNA, 22 bp, Homo sapiens
tcttcatgaaattgattgctta

SEQ ID NO: 6914951 - DNA, 22 bp, Homo sapiens
atgaagctgaaaaaggcatata

SEQ ID NO: 6914952 - DNA, 19 bp, Homo sapiens
ctgcagggatgtgcagagt

SEQ ID NO: 6914953 - DNA, 22 bp, Homo sapiens
ttccacagatgaaaattaagtt

SEQ ID NO: 6914954 - DNA, 22 bp, Homo sapiens
tgctgcctaggaatctgtattt

SEQ ID NO: 6914955 - DNA, 22 bp, Homo sapiens
ggctctgcttgaggccagcctg

SEQ ID NO: 6914956 - DNA, 22 bp, Homo sapiens
ataacaggttgaatccgaatgt

SEQ ID NO: 6914957 - DNA, 21 bp, Homo sapiens
tgtatgcacgcacatgcacac

SEQ ID NO: 6914958 - DNA, 22 bp, Homo sapiens
agcctctcactgtcaccctccc

SEQ ID NO: 6914959 - DNA, 22 bp, Homo sapiens
tatgtttcctgagcttacacca

SEQ ID NO: 6914960 - DNA, 22 bp, Homo sapiens
catcacatcagtgtgaacagtt

SEQ ID NO: 6914961 - DNA, 22 bp, Homo sapiens
gaagtggaagccatcggcagtc

SEQ ID NO: 6914962 - DNA, 22 bp, Homo sapiens
gggcactttgtgcctcactgtg

SEQ ID NO: 6914963 - DNA, 22 bp, Homo sapiens
cctggcacgaagggctgaggtt

SEQ ID NO: 6914964 - DNA, 22 bp, Homo sapiens
aagttctgaagggttctgcaga

SEQ ID NO: 6914965 - DNA, 22 bp, Homo sapiens
gatgcagcagccagcttctgaa

SEQ ID NO: 6914966 - DNA, 22 bp, Homo sapiens
ccctgtccttggctgtgaggct

SEQ ID NO: 6914967 - DNA, 22 bp, Homo sapiens
taatacctactggtcattgcaa

SEQ ID NO: 6914968 - DNA, 20 bp, Homo sapiens
ctgagcccttcctgtgaacc

SEQ ID NO: 6914969 - DNA, 22 bp, Homo sapiens
ctttggcaatgaaacacaagaa

SEQ ID NO: 6914970 - DNA, 22 bp, Homo sapiens
caagtagagttcacttgtcttt

SEQ ID NO: 6914971 - DNA, 19 bp, Homo sapiens
ggttatttgagggttaaga

SEQ ID NO: 6914972 - DNA, 22 bp, Homo sapiens
aggctgggaaatgtagtcttcc

SEQ ID NO: 6914973 - DNA, 22 bp, Homo sapiens
tagatgctattatggcagtgtt

SEQ ID NO: 6914974 - DNA, 22 bp, Homo sapiens
ggctacctgatttaggaaacaa

SEQ ID NO: 6914975 - DNA, 22 bp, Homo sapiens
catctgaatatcccaggcatat

SEQ ID NO: 6914976 - DNA, 22 bp, Homo sapiens
aaatcacttaaatggcttattt

SEQ ID NO: 6914977 - DNA, 22 bp, Homo sapiens
agagtgcagataagagaatgtt

SEQ ID NO: 6914978 - DNA, 22 bp, Homo sapiens
acagtttgccctgacattctcc

SEQ ID NO: 6914979 - DNA, 20 bp, Homo sapiens
taaggcatcaagtttgggta

SEQ ID NO: 6914980 - DNA, 22 bp, Homo sapiens
ctctgggtctccctgaggctaa

SEQ ID NO: 6914981 - DNA, 22 bp, Homo sapiens
gagatggtgttccactgccagt

SEQ ID NO: 6914982 - DNA, 22 bp, Homo sapiens
ttgtacctaaaggtaaatgggc

SEQ ID NO: 6914983 - DNA, 22 bp, Homo sapiens
tccttgagaggacagagccata

SEQ ID NO: 6914984 - DNA, 19 bp, Homo sapiens
ctgtgggtgtgcaagggtg

SEQ ID NO: 6914985 - DNA, 18 bp, Homo sapiens
accacatgatatcttgcc

SEQ ID NO: 6914986 - DNA, 22 bp, Homo sapiens
ccagctctgccaagcgtcagct

SEQ ID NO: 6914987 - DNA, 22 bp, Homo sapiens
aaatccagtgttcaaagtttga

SEQ ID NO: 6914988 - DNA, 22 bp, Homo sapiens
aaagtgcagctgaaaacatcct

SEQ ID NO: 6914989 - DNA, 23 bp, Homo sapiens
tcatctgtaacagcctatgaaat

SEQ ID NO: 6914990 - DNA, 22 bp, Homo sapiens
ttagagatacatttgtagcttg

SEQ ID NO: 6914991 - DNA, 22 bp, Homo sapiens
ttgagaacaggagtgttctttt

SEQ ID NO: 6914992 - DNA, 22 bp, Homo sapiens
tcactttaaactactgtggtct

SEQ ID NO: 6914993 - DNA, 22 bp, Homo sapiens
gcgtccccatcatccagccgta

SEQ ID NO: 6914994 - DNA, 22 bp, Homo sapiens
agtagggaatacattggggtaa

SEQ ID NO: 6914995 - DNA, 22 bp, Homo sapiens
agtaaacactaaaatgactgcg

SEQ ID NO: 6914996 - DNA, 22 bp, Homo sapiens
gctgactgatggacacagcacc

SEQ ID NO: 6914997 - DNA, 22 bp, Homo sapiens
agtccttccggcagatttcact

SEQ ID NO: 6914998 - DNA, 22 bp, Homo sapiens
tccagccacttgcacagttaaa

SEQ ID NO: 6914999 - DNA, 22 bp, Homo sapiens
ccttggcttccttccctctaga

SEQ ID NO: 6915000 - DNA, 22 bp, Homo sapiens
cagctctttttcacacaacatg

SEQ ID NO: 6915001 - DNA, 22 bp, Homo sapiens
atgattcagcccaatttttcta

SEQ ID NO: 6915002 - DNA, 22 bp, Homo sapiens
gttgcagacggggtgcactgaa

SEQ ID NO: 6915003 - DNA, 17 bp, Homo sapiens
agctgacatcaaaactt

SEQ ID NO: 6915004 - DNA, 22 bp, Homo sapiens
gaaaatgtttcctgttatttgc

SEQ ID NO: 6915005 - DNA, 22 bp, Homo sapiens
ttctttctctactagcagagct

SEQ ID NO: 6915006 - DNA, 23 bp, Homo sapiens
ttctggatgttctagtctgagag

SEQ ID NO: 6915007 - DNA, 22 bp, Homo sapiens
ctggcttttcctaaactgggaa

SEQ ID NO: 6915008 - DNA, 22 bp, Homo sapiens
agaatgctccagagctgaaaga

SEQ ID NO: 6915009 - DNA, 21 bp, Homo sapiens
acagcaagccttcacatgagt

SEQ ID NO: 6915010 - DNA, 22 bp, Homo sapiens
atctttgttgctctcatttctg

SEQ ID NO: 6915011 - DNA, 22 bp, Homo sapiens
attgtaaaagtattctaagatt

SEQ ID NO: 6915012 - DNA, 22 bp, Homo sapiens
aggttctggcattgctcagtaa

SEQ ID NO: 6915013 - DNA, 22 bp, Homo sapiens
gcaacttaaggttagaggaaag

SEQ ID NO: 6915014 - DNA, 22 bp, Homo sapiens
cagcagaacagttaaagaaacc

SEQ ID NO: 6915015 - DNA, 22 bp, Homo sapiens
taaggcacgcataagagggggc

SEQ ID NO: 6915016 - DNA, 22 bp, Homo sapiens
tccaccagccaggcccaggctg

SEQ ID NO: 6915017 - DNA, 22 bp, Homo sapiens
taattgtaaagtagtagtacag

SEQ ID NO: 6915018 - DNA, 22 bp, Homo sapiens
aaagattcctttattctccaag

SEQ ID NO: 6915019 - DNA, 22 bp, Homo sapiens
accagctgtgtgacttttaatg

SEQ ID NO: 6915020 - DNA, 22 bp, Homo sapiens
atccacaggtcatgtaatgtgg

SEQ ID NO: 6915021 - DNA, 22 bp, Homo sapiens
attttgaaatacttgaaggaaa

SEQ ID NO: 6915022 - DNA, 22 bp, Homo sapiens
gcattagatatccttgaagtta

SEQ ID NO: 6915023 - DNA, 22 bp, Homo sapiens
gcctcctcttgagggtcaggga

SEQ ID NO: 6915024 - DNA, 22 bp, Homo sapiens
cagcaggacgtccaagtgctat

SEQ ID NO: 6915025 - DNA, 22 bp, Homo sapiens
attcatgaaatgattgagaagt

SEQ ID NO: 6915026 - DNA, 22 bp, Homo sapiens
agggctttgatgtccatgagga

SEQ ID NO: 6915027 - DNA, 22 bp, Homo sapiens
acatgaacatgctcaaataact

SEQ ID NO: 6915028 - DNA, 22 bp, Homo sapiens
ctgaggtgtttagtaggggcgg

SEQ ID NO: 6915029 - DNA, 22 bp, Homo sapiens
atgtgcaaggagtggctgttgt

SEQ ID NO: 6915030 - DNA, 22 bp, Homo sapiens
tctaggtggatgaggaacatag

SEQ ID NO: 6915031 - DNA, 22 bp, Homo sapiens
aacatttgaaaatcaagaatct

SEQ ID NO: 6915032 - DNA, 22 bp, Homo sapiens
tgtctttaaaattaaacacatc

SEQ ID NO: 6915033 - DNA, 23 bp, Homo sapiens
ccagtaaacccttcctcagtgtc

SEQ ID NO: 6915034 - DNA, 22 bp, Homo sapiens
aacatcagaatatccatgttgg

SEQ ID NO: 6915035 - DNA, 22 bp, Homo sapiens
agggagccaggggccagctatt

SEQ ID NO: 6915036 - DNA, 22 bp, Homo sapiens
ttccaggagccacacaggggcg

SEQ ID NO: 6915037 - DNA, 22 bp, Homo sapiens
cttgtagctgcttcttctgaag

SEQ ID NO: 6915038 - DNA, 22 bp, Homo sapiens
acacattctttaaatgtctgtt

SEQ ID NO: 6915039 - DNA, 23 bp, Homo sapiens
tgagggacatggtggcttctgag

SEQ ID NO: 6915040 - DNA, 22 bp, Homo sapiens
gacgagacacgaagggttgaca

SEQ ID NO: 6915041 - DNA, 22 bp, Homo sapiens
tagtcctggattggtggaggca

SEQ ID NO: 6915042 - DNA, 22 bp, Homo sapiens
tcatgctgggtactatggctgc

SEQ ID NO: 6915043 - DNA, 22 bp, Homo sapiens
aagaaagataaggtttgcttgg

SEQ ID NO: 6915044 - DNA, 22 bp, Homo sapiens
tcctgagcctgacaatcaccat

SEQ ID NO: 6915045 - DNA, 22 bp, Homo sapiens
acatatgtgttgtacatgcatg

SEQ ID NO: 6915046 - DNA, 22 bp, Homo sapiens
caggtcttcttcagcacttgga

SEQ ID NO: 6915047 - DNA, 22 bp, Homo sapiens
aagtaaggcagtgaatgagatt

SEQ ID NO: 6915048 - DNA, 22 bp, Homo sapiens
gcctgcacccacaggcatggcc

SEQ ID NO: 6915049 - DNA, 22 bp, Homo sapiens
tgacagagagcttttgactgtc

SEQ ID NO: 6915050 - DNA, 22 bp, Homo sapiens
agggtggcagttactggagcaa

SEQ ID NO: 6915051 - DNA, 22 bp, Homo sapiens
ctgaagttttgacatctcattt

SEQ ID NO: 6915052 - DNA, 22 bp, Homo sapiens
ggccctgcgattaggtggcagg

SEQ ID NO: 6915053 - DNA, 22 bp, Homo sapiens
catgaactccaagcttccttcc

SEQ ID NO: 6915054 - DNA, 22 bp, Homo sapiens
tgcatgcacatgtaggtatggt

SEQ ID NO: 6915055 - DNA, 22 bp, Homo sapiens
tgtaacagagcttttttatagc

SEQ ID NO: 6915056 - DNA, 22 bp, Homo sapiens
tgttgcaggcccctggggtatg

SEQ ID NO: 6915057 - DNA, 22 bp, Homo sapiens
tctcaggactttgggaagctca

SEQ ID NO: 6915058 - DNA, 22 bp, Homo sapiens
aatcttggcaaatgtagcttcc

SEQ ID NO: 6915059 - DNA, 22 bp, Homo sapiens
ctgggttttattacagtgagct

SEQ ID NO: 6915060 - DNA, 22 bp, Homo sapiens
tctggaaggttggctcccagtt

SEQ ID NO: 6915061 - DNA, 22 bp, Homo sapiens
ctgtacatcccgagagccagta

SEQ ID NO: 6915062 - DNA, 22 bp, Homo sapiens
cagagtatccctttagaattaa

SEQ ID NO: 6915063 - DNA, 22 bp, Homo sapiens
ccagagaaaagaggccaaggat

SEQ ID NO: 6915064 - DNA, 22 bp, Homo sapiens
tggaataacctgcttgcagctg

SEQ ID NO: 6915065 - DNA, 17 bp, Homo sapiens
gcagccagtgcagcagg

SEQ ID NO: 6915066 - DNA, 22 bp, Homo sapiens
gtagaggctgaaatctgagggc

SEQ ID NO: 6915067 - DNA, 22 bp, Homo sapiens
acaaatatttactgaatccact

SEQ ID NO: 6915068 - DNA, 22 bp, Homo sapiens
agaggttgggtctgaggtgaga

SEQ ID NO: 6915069 - DNA, 22 bp, Homo sapiens
ggaactttttaacaagctgctg

SEQ ID NO: 6915070 - DNA, 22 bp, Homo sapiens
ctggagccggcgagccccagcc

SEQ ID NO: 6915071 - DNA, 20 bp, Homo sapiens
tactgcaggaatcagctagc

SEQ ID NO: 6915072 - DNA, 22 bp, Homo sapiens
ttgagcgtgggtgctggagcca

SEQ ID NO: 6915073 - DNA, 22 bp, Homo sapiens
actgttcatttggatttctctg

SEQ ID NO: 6915074 - DNA, 22 bp, Homo sapiens
attacagtaacagctacaatgc

SEQ ID NO: 6915075 - DNA, 22 bp, Homo sapiens
aattctctccagggtaacatca

SEQ ID NO: 6915076 - DNA, 22 bp, Homo sapiens
tatggcatttagaaatgtcaga

SEQ ID NO: 6915077 - DNA, 22 bp, Homo sapiens
tcacatgatgtttcctctgtgc

SEQ ID NO: 6915078 - DNA, 22 bp, Homo sapiens
tgagacgaagtcttgctctgtt

SEQ ID NO: 6915079 - DNA, 22 bp, Homo sapiens
atttcagagctttgcagctaat

SEQ ID NO: 6915080 - DNA, 22 bp, Homo sapiens
gcactgggagctgcctgccggt

SEQ ID NO: 6915081 - DNA, 22 bp, Homo sapiens
aggcataggacatctatgtcat

SEQ ID NO: 6915082 - DNA, 22 bp, Homo sapiens
ctccagcaggtgcgtctcagag

SEQ ID NO: 6915083 - DNA, 22 bp, Homo sapiens
gttctctgccacttaccagcta

SEQ ID NO: 6915084 - DNA, 22 bp, Homo sapiens
ctcagagaggttgaacaacttg

SEQ ID NO: 6915085 - DNA, 22 bp, Homo sapiens
atcacattgccagtgattaccc

SEQ ID NO: 6915086 - DNA, 22 bp, Homo sapiens
gctggatttagggttccctcct

SEQ ID NO: 6915087 - DNA, 22 bp, Homo sapiens
ttctggtctctctgacctagga

SEQ ID NO: 6915088 - DNA, 22 bp, Homo sapiens
atgtctgtgtgatcttggataa

SEQ ID NO: 6915089 - DNA, 22 bp, Homo sapiens
atgttcacaaagactctgtaag

SEQ ID NO: 6915090 - DNA, 22 bp, Homo sapiens
aaatcagattatttgattggca

SEQ ID NO: 6915091 - DNA, 20 bp, Homo sapiens
tctgagaagccactgtccaa

SEQ ID NO: 6915092 - DNA, 22 bp, Homo sapiens
ttcctggggacttaccgtcatt

SEQ ID NO: 6915093 - DNA, 22 bp, Homo sapiens
gaagttacccatagccggaatt

SEQ ID NO: 6915094 - DNA, 18 bp, Homo sapiens
aagtaacagaagagcaca

SEQ ID NO: 6915095 - DNA, 18 bp, Homo sapiens
tgctcagctggtgctgaa

SEQ ID NO: 6915096 - DNA, 22 bp, Homo sapiens
ttcacattacaaggccatattt

SEQ ID NO: 6915097 - DNA, 22 bp, Homo sapiens
gcggaaggctgcctggcttgag

SEQ ID NO: 6915098 - DNA, 19 bp, Homo sapiens
ttcaacatgctgaggcagc

SEQ ID NO: 6915099 - DNA, 16 bp, Homo sapiens
tggaggcatctggccc

SEQ ID NO: 6915100 - DNA, 22 bp, Homo sapiens
ctcctacattccaccttggact

SEQ ID NO: 6915101 - DNA, 22 bp, Homo sapiens
tcttaagaaagtgacaaatagg

SEQ ID NO: 6915102 - DNA, 22 bp, Homo sapiens
tcaaattctattctatactcag

SEQ ID NO: 6915103 - DNA, 22 bp, Homo sapiens
gcagcacacggtggtgccctgg

SEQ ID NO: 6915104 - DNA, 22 bp, Homo sapiens
tgtcctgtaggaggcagaacaa

SEQ ID NO: 6915105 - DNA, 22 bp, Homo sapiens
tctcttctaattttcccgagta

SEQ ID NO: 6915106 - DNA, 22 bp, Homo sapiens
tggaggcccccaggcaacagca

SEQ ID NO: 6915107 - DNA, 22 bp, Homo sapiens
tagtgtaaataactgcctagac

SEQ ID NO: 6915108 - DNA, 22 bp, Homo sapiens
agaagtttgctcacttgggaca

SEQ ID NO: 6915109 - DNA, 22 bp, Homo sapiens
taggagaagagtcagggcctaa

SEQ ID NO: 6915110 - DNA, 22 bp, Homo sapiens
cagggacagcgggactctgaca

SEQ ID NO: 6915111 - DNA, 20 bp, Homo sapiens
ggtcagcctggggctccagg

SEQ ID NO: 6915112 - DNA, 22 bp, Homo sapiens
tctgattagagcattcttgagt

SEQ ID NO: 6915113 - DNA, 23 bp, Homo sapiens
gagagcaatgagatgtaaacact

SEQ ID NO: 6915114 - DNA, 22 bp, Homo sapiens
ctgccctgcttctgagggaagc

SEQ ID NO: 6915115 - DNA, 23 bp, Homo sapiens
tgaaggccctggagccacgaggc

SEQ ID NO: 6915116 - DNA, 16 bp, Homo sapiens
tcattttgagtgacag

SEQ ID NO: 6915117 - DNA, 22 bp, Homo sapiens
gacacttcacctttcccagcct

SEQ ID NO: 6915118 - DNA, 22 bp, Homo sapiens
ctgtgatcattcttgatttaag

SEQ ID NO: 6915119 - DNA, 17 bp, Homo sapiens
agtcagaggagtatctg

SEQ ID NO: 6915120 - DNA, 22 bp, Homo sapiens
ttgtttcagcccagatctttac

SEQ ID NO: 6915121 - DNA, 22 bp, Homo sapiens
aagcactaggacttcagtctct

SEQ ID NO: 6915122 - DNA, 22 bp, Homo sapiens
aacattgttttccctatatcca

SEQ ID NO: 6915123 - DNA, 22 bp, Homo sapiens
tgtgtgttattttcagccatta

SEQ ID NO: 6915124 - DNA, 22 bp, Homo sapiens
ctgggtagggtgatatcccaca

SEQ ID NO: 6915125 - DNA, 22 bp, Homo sapiens
ggaagccaaggtggcctctatt

SEQ ID NO: 6915126 - DNA, 22 bp, Homo sapiens
ttgattcaaaacaggaggtagg

SEQ ID NO: 6915127 - DNA, 22 bp, Homo sapiens
catgaacagattcttcatttct

SEQ ID NO: 6915128 - DNA, 22 bp, Homo sapiens
ttagcatttctggaatcacaag

SEQ ID NO: 6915129 - DNA, 22 bp, Homo sapiens
tagaaaggaacaggtcagcgtt

SEQ ID NO: 6915130 - DNA, 22 bp, Homo sapiens
aggtggtcttgtggatgccgca

SEQ ID NO: 6915131 - DNA, 22 bp, Homo sapiens
ctccaggccaagattaagtaat

SEQ ID NO: 6915132 - DNA, 19 bp, Homo sapiens
gggcaaatcccttctttct

SEQ ID NO: 6915133 - DNA, 23 bp, Homo sapiens
tggctccatgaaaattacgagga

SEQ ID NO: 6915134 - DNA, 22 bp, Homo sapiens
gatagaaagaatatagattcca

SEQ ID NO: 6915135 - DNA, 22 bp, Homo sapiens
tcagatttcttcttgcaacggc

SEQ ID NO: 6915136 - DNA, 22 bp, Homo sapiens
aacatagctttactcaaatgac

SEQ ID NO: 6915137 - DNA, 22 bp, Homo sapiens
gagctcattgtggatggatggg

SEQ ID NO: 6915138 - DNA, 22 bp, Homo sapiens
agaggctctaataccagcatgg

SEQ ID NO: 6915139 - DNA, 22 bp, Homo sapiens
ccaggaactaagaatcctttag

SEQ ID NO: 6915140 - DNA, 22 bp, Homo sapiens
atttcccaacacattagaaaat

SEQ ID NO: 6915141 - DNA, 22 bp, Homo sapiens
agtcagtgttctgggttgtaat

SEQ ID NO: 6915142 - DNA, 22 bp, Homo sapiens
ccctgcagagagtgcttttgtg

SEQ ID NO: 6915143 - DNA, 22 bp, Homo sapiens
agctgctccaacccagcgggct

SEQ ID NO: 6915144 - DNA, 22 bp, Homo sapiens
gctgactttgcctgtctttagc

SEQ ID NO: 6915145 - DNA, 22 bp, Homo sapiens
atggggagagcctctgtcccca

SEQ ID NO: 6915146 - DNA, 23 bp, Homo sapiens
tcttttcaatggttctttatgtg

SEQ ID NO: 6915147 - DNA, 22 bp, Homo sapiens
aagggccatgcctctactttct

SEQ ID NO: 6915148 - DNA, 22 bp, Homo sapiens
cacagaggcatgaccctgccct

SEQ ID NO: 6915149 - DNA, 22 bp, Homo sapiens
ggtcatctgtaattctgttcct

SEQ ID NO: 6915150 - DNA, 17 bp, Homo sapiens
gctccttctaacttcca

SEQ ID NO: 6915151 - DNA, 22 bp, Homo sapiens
atgcatctgtagtgttatatga

SEQ ID NO: 6915152 - DNA, 22 bp, Homo sapiens
tactgtgggatgttgtgattag

SEQ ID NO: 6915153 - DNA, 22 bp, Homo sapiens
gcagtcctcatcctttagcagt

SEQ ID NO: 6915154 - DNA, 22 bp, Homo sapiens
catggacttctgaaggtgtgtc

SEQ ID NO: 6915155 - DNA, 17 bp, Homo sapiens
acgtggccataattaaa

SEQ ID NO: 6915156 - DNA, 22 bp, Homo sapiens
agtggaatgtagaaaaaagatg

SEQ ID NO: 6915157 - DNA, 22 bp, Homo sapiens
tctgtccatgcctggaggagag

SEQ ID NO: 6915158 - DNA, 22 bp, Homo sapiens
tcctgcaggggctgaggaacca

SEQ ID NO: 6915159 - DNA, 22 bp, Homo sapiens
aggctcagggactccctccctc

SEQ ID NO: 6915160 - DNA, 22 bp, Homo sapiens
agactctggaggggctggtcct

SEQ ID NO: 6915161 - DNA, 22 bp, Homo sapiens
ccaccagcagtgtgcaaggatt

SEQ ID NO: 6915162 - DNA, 19 bp, Homo sapiens
tctgagggagcacgaaggc

SEQ ID NO: 6915163 - DNA, 22 bp, Homo sapiens
tactgacacaaagccaatccct

SEQ ID NO: 6915164 - DNA, 22 bp, Homo sapiens
gggctctcatgagtgtgtggta

SEQ ID NO: 6915165 - DNA, 22 bp, Homo sapiens
gtggcacagaagtttagagaac

SEQ ID NO: 6915166 - DNA, 22 bp, Homo sapiens
ctgtgtttggacaacttttcag

SEQ ID NO: 6915167 - DNA, 22 bp, Homo sapiens
tggcagagttcgctgtgccttt

SEQ ID NO: 6915168 - DNA, 22 bp, Homo sapiens
gcccgcagagatctttaacaaa

SEQ ID NO: 6915169 - DNA, 22 bp, Homo sapiens
cttacagcattgttcagaggct

SEQ ID NO: 6915170 - DNA, 22 bp, Homo sapiens
ttgtctatacatcaataatgat

SEQ ID NO: 6915171 - DNA, 22 bp, Homo sapiens
agttctgaatgaggaatctggg

SEQ ID NO: 6915172 - DNA, 22 bp, Homo sapiens
tagtgtatctgttcttttatct

SEQ ID NO: 6915173 - DNA, 22 bp, Homo sapiens
actgcctggcagaggtttgcaa

SEQ ID NO: 6915174 - DNA, 22 bp, Homo sapiens
ggagaatgatatatagctcagt

SEQ ID NO: 6915175 - DNA, 22 bp, Homo sapiens
atgtctgttcattattaactgc

SEQ ID NO: 6915176 - DNA, 17 bp, Homo sapiens
cctgcccagagacagat

SEQ ID NO: 6915177 - DNA, 22 bp, Homo sapiens
ggaaactagaagaatactagtc

SEQ ID NO: 6915178 - DNA, 22 bp, Homo sapiens
tgtctcccaggtgtgcccagtg

SEQ ID NO: 6915179 - DNA, 22 bp, Homo sapiens
gtagtaaagcaggttttgctgt

SEQ ID NO: 6915180 - DNA, 22 bp, Homo sapiens
ggcctggctcttgcccagcctg

SEQ ID NO: 6915181 - DNA, 22 bp, Homo sapiens
ctgacttgcctaggtcattgtg

SEQ ID NO: 6915182 - DNA, 22 bp, Homo sapiens
gagggcccgcacctcgaaactc

SEQ ID NO: 6915183 - DNA, 22 bp, Homo sapiens
ctggtggaagcctgggctcaga

SEQ ID NO: 6915184 - DNA, 22 bp, Homo sapiens
tattcctaatacttgttttggg

SEQ ID NO: 6915185 - DNA, 22 bp, Homo sapiens
gagtcagaaagtagtgtgccta

SEQ ID NO: 6915186 - DNA, 22 bp, Homo sapiens
aggcagcctggtttgaatggaa

SEQ ID NO: 6915187 - DNA, 22 bp, Homo sapiens
aacattgagttagggagcgtat

SEQ ID NO: 6915188 - DNA, 22 bp, Homo sapiens
ttacttattaccaccaatgccg

SEQ ID NO: 6915189 - DNA, 22 bp, Homo sapiens
cctaggccctcaaagagcataa

SEQ ID NO: 6915190 - DNA, 20 bp, Homo sapiens
ggcagacctgctgagagccc

SEQ ID NO: 6915191 - DNA, 22 bp, Homo sapiens
agaagccaatcagctctctgct

SEQ ID NO: 6915192 - DNA, 22 bp, Homo sapiens
tggatgtgagagcatcatgttc

SEQ ID NO: 6915193 - DNA, 22 bp, Homo sapiens
tgccttgctgctttggagtcct

SEQ ID NO: 6915194 - DNA, 22 bp, Homo sapiens
ggagggtgcttaagttgtgttt

SEQ ID NO: 6915195 - DNA, 22 bp, Homo sapiens
ctccatggaaccggggctgctt

SEQ ID NO: 6915196 - DNA, 22 bp, Homo sapiens
tggcatgttgagaggcaagatt

SEQ ID NO: 6915197 - DNA, 22 bp, Homo sapiens
aacagtatcttttatcagaaat

SEQ ID NO: 6915198 - DNA, 22 bp, Homo sapiens
tggcatttgtagccacttgcct

SEQ ID NO: 6915199 - DNA, 23 bp, Homo sapiens
tgagcccagttttccctcttgcc

SEQ ID NO: 6915200 - DNA, 22 bp, Homo sapiens
tgaagcagatggtctggtcatt

SEQ ID NO: 6915201 - DNA, 22 bp, Homo sapiens
tagtcagagtcttctctgttgt

SEQ ID NO: 6915202 - DNA, 23 bp, Homo sapiens
tctcagacccgaagccagaggaa

SEQ ID NO: 6915203 - DNA, 22 bp, Homo sapiens
aatgtggactcttgtatttttc

SEQ ID NO: 6915204 - DNA, 20 bp, Homo sapiens
tgttccaggaggccagggct

SEQ ID NO: 6915205 - DNA, 22 bp, Homo sapiens
cccagagggtggaggttgcagt

SEQ ID NO: 6915206 - DNA, 22 bp, Homo sapiens
cagtttggtacatagttcaaaa

SEQ ID NO: 6915207 - DNA, 22 bp, Homo sapiens
ttccttagttatttggtcccct

SEQ ID NO: 6915208 - DNA, 22 bp, Homo sapiens
tgggaggcaggtaggtgatgat

SEQ ID NO: 6915209 - DNA, 22 bp, Homo sapiens
acacaggcaatgtgagtgggag

SEQ ID NO: 6915210 - DNA, 22 bp, Homo sapiens
agagtgatgggttgtgctgacc

SEQ ID NO: 6915211 - DNA, 22 bp, Homo sapiens
tgtttagaatcattcaaaagtt

SEQ ID NO: 6915212 - DNA, 22 bp, Homo sapiens
atgtatgttagacaagcctaca

SEQ ID NO: 6915213 - DNA, 22 bp, Homo sapiens
ccctggctcaggcagctttgtt

SEQ ID NO: 6915214 - DNA, 22 bp, Homo sapiens
gctgtcctgggaacaggcacta

SEQ ID NO: 6915215 - DNA, 22 bp, Homo sapiens
attaagaatcacacggctgtgt

SEQ ID NO: 6915216 - DNA, 22 bp, Homo sapiens
ggagatctttgttatcttttga

SEQ ID NO: 6915217 - DNA, 16 bp, Homo sapiens
cctggcccggcttcct

SEQ ID NO: 6915218 - DNA, 23 bp, Homo sapiens
aaggccagaatttcaatggtgcc

SEQ ID NO: 6915219 - DNA, 22 bp, Homo sapiens
tgtcatttagtcctctgtgtgt

SEQ ID NO: 6915220 - DNA, 22 bp, Homo sapiens
ttcagcaaccagaaaggctggg

SEQ ID NO: 6915221 - DNA, 22 bp, Homo sapiens
ttgtaaagctttgagactacat

SEQ ID NO: 6915222 - DNA, 22 bp, Homo sapiens
tttagagtaaaaactgtgacct

SEQ ID NO: 6915223 - DNA, 22 bp, Homo sapiens
ggccaggaagggaagatcagca

SEQ ID NO: 6915224 - DNA, 22 bp, Homo sapiens
tttctgtaattggccaagtcac

SEQ ID NO: 6915225 - DNA, 22 bp, Homo sapiens
tgtctttgattgataggctatg

SEQ ID NO: 6915226 - DNA, 22 bp, Homo sapiens
tgcctggcaccccagtctgcac

SEQ ID NO: 6915227 - DNA, 22 bp, Homo sapiens
ttatgaaaacaatcagtaggca

SEQ ID NO: 6915228 - DNA, 22 bp, Homo sapiens
gatctgggctggagactgagaa

SEQ ID NO: 6915229 - DNA, 22 bp, Homo sapiens
cccaggtctgccagcctgtggg

SEQ ID NO: 6915230 - DNA, 22 bp, Homo sapiens
ttttcttctacctgctgtccaa

SEQ ID NO: 6915231 - DNA, 22 bp, Homo sapiens
aataaagtgtattctttgtcat

SEQ ID NO: 6915232 - DNA, 22 bp, Homo sapiens
ttagaacagtgtttgcctcgct

SEQ ID NO: 6915233 - DNA, 22 bp, Homo sapiens
aacagtgtctgtggttaaaggt

SEQ ID NO: 6915234 - DNA, 22 bp, Homo sapiens
tggggaaagggatggctcccgc

SEQ ID NO: 6915235 - DNA, 22 bp, Homo sapiens
ggcagtgtggcataacatgtag

SEQ ID NO: 6915236 - DNA, 22 bp, Homo sapiens
ttaaggttaaataaggtcatat

SEQ ID NO: 6915237 - DNA, 22 bp, Homo sapiens
actcagagcttggctccttgct

SEQ ID NO: 6915238 - DNA, 22 bp, Homo sapiens
caggtggtcaggcagatgggct

SEQ ID NO: 6915239 - DNA, 22 bp, Homo sapiens
gtgctttaaaaataggagatga

SEQ ID NO: 6915240 - DNA, 22 bp, Homo sapiens
caaaggctttgctatgatgcat

SEQ ID NO: 6915241 - DNA, 22 bp, Homo sapiens
gtggcaggagggcatcacttgg

SEQ ID NO: 6915242 - DNA, 22 bp, Homo sapiens
caggccttagtaggtgctccct

SEQ ID NO: 6915243 - DNA, 22 bp, Homo sapiens
cttctgtggtaaactttgttgt

SEQ ID NO: 6915244 - DNA, 22 bp, Homo sapiens
acacttcagctccacaaacatt

SEQ ID NO: 6915245 - DNA, 22 bp, Homo sapiens
atgggctggcagcctgaacagc

SEQ ID NO: 6915246 - DNA, 22 bp, Homo sapiens
atgtgtcttatttgattccaca

SEQ ID NO: 6915247 - DNA, 22 bp, Homo sapiens
aggctgcctcgtgagctcgctg

SEQ ID NO: 6915248 - DNA, 22 bp, Homo sapiens
cagtgcaacagattcgagaagc

SEQ ID NO: 6915249 - DNA, 22 bp, Homo sapiens
gaaggtgtccacttctcacctc

SEQ ID NO: 6915250 - DNA, 22 bp, Homo sapiens
aagaatatttcctgcacttggg

SEQ ID NO: 6915251 - DNA, 19 bp, Homo sapiens
gaatgtttgtattcagcgc

SEQ ID NO: 6915252 - DNA, 22 bp, Homo sapiens
gtcacctctcatcacatgctac

SEQ ID NO: 6915253 - DNA, 21 bp, Homo sapiens
tcttcctgctccacactcccc

SEQ ID NO: 6915254 - DNA, 21 bp, Homo sapiens
ctgctctggggaccggctgtg

SEQ ID NO: 6915255 - DNA, 22 bp, Homo sapiens
cgggctcagctccacccacccc

SEQ ID NO: 6915256 - DNA, 22 bp, Homo sapiens
ttagatcttaggcaaatgtgtt

SEQ ID NO: 6915257 - DNA, 22 bp, Homo sapiens
tctagggttgaggccacaggga

SEQ ID NO: 6915258 - DNA, 22 bp, Homo sapiens
tggtgagagctgaccgtgcgag

SEQ ID NO: 6915259 - DNA, 22 bp, Homo sapiens
gtgctgagatcttccctcactg

SEQ ID NO: 6915260 - DNA, 22 bp, Homo sapiens
ctgccagatcattggattcaca

SEQ ID NO: 6915261 - DNA, 20 bp, Homo sapiens
gcagctgtgcattcttagga

SEQ ID NO: 6915262 - DNA, 22 bp, Homo sapiens
tttctacaggttgatgggtttg

SEQ ID NO: 6915263 - DNA, 22 bp, Homo sapiens
tttctgcatatgtatgtatgga

SEQ ID NO: 6915264 - DNA, 18 bp, Homo sapiens
tccctccctgctgtggcc

SEQ ID NO: 6915265 - DNA, 22 bp, Homo sapiens
gcagatgaaaatgctgccgtgc

SEQ ID NO: 6915266 - DNA, 22 bp, Homo sapiens
agaaaactgcagagtagcctca

SEQ ID NO: 6915267 - DNA, 22 bp, Homo sapiens
gagctggttctgtccagggaat

SEQ ID NO: 6915268 - DNA, 22 bp, Homo sapiens
tagtgtctattgaccggaaaga

SEQ ID NO: 6915269 - DNA, 22 bp, Homo sapiens
cagagagagtggggtgtggatt

SEQ ID NO: 6915270 - DNA, 22 bp, Homo sapiens
gcatagtaggctgtcaaaaatg

SEQ ID NO: 6915271 - DNA, 22 bp, Homo sapiens
tctttgaatacaggaagcatga

SEQ ID NO: 6915272 - DNA, 22 bp, Homo sapiens
gttaatgccattaggaaattta

SEQ ID NO: 6915273 - DNA, 22 bp, Homo sapiens
ctcctgcatgctcacatatgcc

SEQ ID NO: 6915274 - DNA, 21 bp, Homo sapiens
ctggagtcattttctgagtag

SEQ ID NO: 6915275 - DNA, 22 bp, Homo sapiens
atctatacccatcatgatttaa

SEQ ID NO: 6915276 - DNA, 22 bp, Homo sapiens
tggccacactgcccccactggg

SEQ ID NO: 6915277 - DNA, 17 bp, Homo sapiens
cttttaatttacttccc

SEQ ID NO: 6915278 - DNA, 22 bp, Homo sapiens
acattgtgacagttttggagaa

SEQ ID NO: 6915279 - DNA, 21 bp, Homo sapiens
tcctgccttagtccagagcag

SEQ ID NO: 6915280 - DNA, 22 bp, Homo sapiens
tggcatcgggccaccccatccc

SEQ ID NO: 6915281 - DNA, 21 bp, Homo sapiens
tcaggcagtgcaaatacatgg

SEQ ID NO: 6915282 - DNA, 22 bp, Homo sapiens
attaatttttctgacagccaca

SEQ ID NO: 6915283 - DNA, 22 bp, Homo sapiens
agctgattccactttttcccca

SEQ ID NO: 6915284 - DNA, 22 bp, Homo sapiens
tcatgcctgattatgttactca

SEQ ID NO: 6915285 - DNA, 22 bp, Homo sapiens
gtgagattccttagattcatgg

SEQ ID NO: 6915286 - DNA, 22 bp, Homo sapiens
cgcagctgtccatgtgtggggg

SEQ ID NO: 6915287 - DNA, 22 bp, Homo sapiens
ccaccctgaggaatggtccggc

SEQ ID NO: 6915288 - DNA, 22 bp, Homo sapiens
ttgcagacccttactgctagag

SEQ ID NO: 6915289 - DNA, 22 bp, Homo sapiens
ctacacttgttcgactgcagga

SEQ ID NO: 6915290 - DNA, 22 bp, Homo sapiens
aggacctgtgttttccttgaat

SEQ ID NO: 6915291 - DNA, 22 bp, Homo sapiens
cagctctgaagaaaggtgtcta

SEQ ID NO: 6915292 - DNA, 22 bp, Homo sapiens
ctggccagcctcccaggtaccc

SEQ ID NO: 6915293 - DNA, 22 bp, Homo sapiens
tctctttactttcaccaatttg

SEQ ID NO: 6915294 - DNA, 22 bp, Homo sapiens
tatggtagaaaaactgagtccc

SEQ ID NO: 6915295 - DNA, 22 bp, Homo sapiens
acatcgatggtcagccgaggag

SEQ ID NO: 6915296 - DNA, 22 bp, Homo sapiens
gcagctattgtctcctgggccc

SEQ ID NO: 6915297 - DNA, 22 bp, Homo sapiens
gggccccaaaatgccaggctct

SEQ ID NO: 6915298 - DNA, 22 bp, Homo sapiens
tgcatgcttcctgtaagtacct

SEQ ID NO: 6915299 - DNA, 22 bp, Homo sapiens
agggaatgctccgtataaatct

SEQ ID NO: 6915300 - DNA, 22 bp, Homo sapiens
atgtggctagtggctatgatct

SEQ ID NO: 6915301 - DNA, 22 bp, Homo sapiens
tgtaagaacatgtgtgggcaca

SEQ ID NO: 6915302 - DNA, 18 bp, Homo sapiens
tgtgtatgtctcagggaa

SEQ ID NO: 6915303 - DNA, 22 bp, Homo sapiens
agtgaccatgttatttatttga

SEQ ID NO: 6915304 - DNA, 23 bp, Homo sapiens
agtcttaatacagctcttttcta

SEQ ID NO: 6915305 - DNA, 22 bp, Homo sapiens
catcagaacgtgagctccttgt

SEQ ID NO: 6915306 - DNA, 19 bp, Homo sapiens
gccttcccaccacccgtcc

SEQ ID NO: 6915307 - DNA, 22 bp, Homo sapiens
accctgtgtcacagtggcctgt

SEQ ID NO: 6915308 - DNA, 22 bp, Homo sapiens
atgaggtactagtatatacgta

SEQ ID NO: 6915309 - DNA, 22 bp, Homo sapiens
atggatcacagtgccgtgggtg

SEQ ID NO: 6915310 - DNA, 22 bp, Homo sapiens
gctgaaattcagattcctaggc

SEQ ID NO: 6915311 - DNA, 22 bp, Homo sapiens
taattatagcattggagtggcc

SEQ ID NO: 6915312 - DNA, 22 bp, Homo sapiens
agttctcttggaagttatgtga

SEQ ID NO: 6915313 - DNA, 22 bp, Homo sapiens
tactaaacatctggcattaaat

SEQ ID NO: 6915314 - DNA, 22 bp, Homo sapiens
gtggagacctcctaggatgtgt

SEQ ID NO: 6915315 - DNA, 22 bp, Homo sapiens
gcatggtggggagatggcagcc

SEQ ID NO: 6915316 - DNA, 22 bp, Homo sapiens
aatcatcccaactgagaatccc

SEQ ID NO: 6915317 - DNA, 22 bp, Homo sapiens
actgggctggggctcattctcc

SEQ ID NO: 6915318 - DNA, 22 bp, Homo sapiens
gagaatgctggagatttatttt

SEQ ID NO: 6915319 - DNA, 22 bp, Homo sapiens
tttctaggacatgataggatat

SEQ ID NO: 6915320 - DNA, 22 bp, Homo sapiens
cagtatttggtaattggctacc

SEQ ID NO: 6915321 - DNA, 22 bp, Homo sapiens
agtaggactaggggttgaggca

SEQ ID NO: 6915322 - DNA, 22 bp, Homo sapiens
ttgattttcaattcattgacaa

SEQ ID NO: 6915323 - DNA, 22 bp, Homo sapiens
accctgagccgccaggaaggcc

SEQ ID NO: 6915324 - DNA, 22 bp, Homo sapiens
tcataaagttctaagaattgta

SEQ ID NO: 6915325 - DNA, 18 bp, Homo sapiens
tttgaggaaatgtcctga

SEQ ID NO: 6915326 - DNA, 22 bp, Homo sapiens
aatactgagatcccacaaagca

SEQ ID NO: 6915327 - DNA, 22 bp, Homo sapiens
cctttggggtcctgcctgggct

SEQ ID NO: 6915328 - DNA, 22 bp, Homo sapiens
cctagccttcggcctacccatc

SEQ ID NO: 6915329 - DNA, 22 bp, Homo sapiens
ccatttgttgtgtattaatatt

SEQ ID NO: 6915330 - DNA, 22 bp, Homo sapiens
gatgaggctagagacatgtgta

SEQ ID NO: 6915331 - DNA, 22 bp, Homo sapiens
agtatacaaataaatgtgtaat

SEQ ID NO: 6915332 - DNA, 22 bp, Homo sapiens
agaagagagtcctaccccatac

SEQ ID NO: 6915333 - DNA, 19 bp, Homo sapiens
actgttctgtatgttgatt

SEQ ID NO: 6915334 - DNA, 22 bp, Homo sapiens
acaagttaccaaaaaagattca

SEQ ID NO: 6915335 - DNA, 22 bp, Homo sapiens
catgtcaagcctcggagggctt

SEQ ID NO: 6915336 - DNA, 22 bp, Homo sapiens
caggagataaaagagatgcttt

SEQ ID NO: 6915337 - DNA, 22 bp, Homo sapiens
aggcctggccccagttgctagg

SEQ ID NO: 6915338 - DNA, 22 bp, Homo sapiens
acttcccaacacttttgagatg

SEQ ID NO: 6915339 - DNA, 22 bp, Homo sapiens
ttgaacagctgttacattgtta

SEQ ID NO: 6915340 - DNA, 22 bp, Homo sapiens
gggctatctgctcaccttcctc

SEQ ID NO: 6915341 - DNA, 16 bp, Homo sapiens
tgtcattaccacctgt

SEQ ID NO: 6915342 - DNA, 22 bp, Homo sapiens
ccctagaacacgcagacactga

SEQ ID NO: 6915343 - DNA, 22 bp, Homo sapiens
gtcaacttgacaggcagagtgg

SEQ ID NO: 6915344 - DNA, 22 bp, Homo sapiens
ctttagatcctggtgtctctct

SEQ ID NO: 6915345 - DNA, 22 bp, Homo sapiens
ctttagtgagtgtggagctaga

SEQ ID NO: 6915346 - DNA, 22 bp, Homo sapiens
agtgagatgctctttcctttct

SEQ ID NO: 6915347 - DNA, 16 bp, Homo sapiens
atcccagaggctagag

SEQ ID NO: 6915348 - DNA, 21 bp, Homo sapiens
tctcaacttttctctttgggc

SEQ ID NO: 6915349 - DNA, 22 bp, Homo sapiens
cgaggccagctctaagccctac

SEQ ID NO: 6915350 - DNA, 22 bp, Homo sapiens
atgtcatctcttaaaaattgca

SEQ ID NO: 6915351 - DNA, 22 bp, Homo sapiens
gctcaccactgctagagtctat

SEQ ID NO: 6915352 - DNA, 22 bp, Homo sapiens
acagagactgggatgcctgcct

SEQ ID NO: 6915353 - DNA, 16 bp, Homo sapiens
gctggagggaggggtt

SEQ ID NO: 6915354 - DNA, 23 bp, Homo sapiens
tctggaatggtactcactggagt

SEQ ID NO: 6915355 - DNA, 22 bp, Homo sapiens
aggctgtggccctggtctagca

SEQ ID NO: 6915356 - DNA, 22 bp, Homo sapiens
aagaacatgaagtcacaaatgc

SEQ ID NO: 6915357 - DNA, 22 bp, Homo sapiens
acttcctgcagcttctcagccc

SEQ ID NO: 6915358 - DNA, 22 bp, Homo sapiens
tcctggtggcagattttaggtc

SEQ ID NO: 6915359 - DNA, 22 bp, Homo sapiens
taacatctaagggagagaaagt

SEQ ID NO: 6915360 - DNA, 22 bp, Homo sapiens
tcccaagacgatgtgcttggcc

SEQ ID NO: 6915361 - DNA, 22 bp, Homo sapiens
atgaatgagcttagaggctgac

SEQ ID NO: 6915362 - DNA, 22 bp, Homo sapiens
agtatttcttctgagcccaagg

SEQ ID NO: 6915363 - DNA, 22 bp, Homo sapiens
cctgcacctgagcagcctgact

SEQ ID NO: 6915364 - DNA, 22 bp, Homo sapiens
agctggtggagaagcagacctc

SEQ ID NO: 6915365 - DNA, 22 bp, Homo sapiens
gaccttgtgatccacctgcctt

SEQ ID NO: 6915366 - DNA, 22 bp, Homo sapiens
agtgaaatcaggttttgactgc

SEQ ID NO: 6915367 - DNA, 22 bp, Homo sapiens
agagctgtggatagtcctggat

SEQ ID NO: 6915368 - DNA, 22 bp, Homo sapiens
tggcacagcctttaaagtacca

SEQ ID NO: 6915369 - DNA, 22 bp, Homo sapiens
tgtcgtcccgctctaagtggcg

SEQ ID NO: 6915370 - DNA, 22 bp, Homo sapiens
acacatgtatggcacttacatt

SEQ ID NO: 6915371 - DNA, 22 bp, Homo sapiens
atttggggctcaccagggctga

SEQ ID NO: 6915372 - DNA, 22 bp, Homo sapiens
atatataagctgatgagccaca

SEQ ID NO: 6915373 - DNA, 22 bp, Homo sapiens
aaggagaaggcatcattcaagt

SEQ ID NO: 6915374 - DNA, 22 bp, Homo sapiens
ctcccatagcattttaaatagt

SEQ ID NO: 6915375 - DNA, 22 bp, Homo sapiens
gtcacaaagcgcggtggtcggt

SEQ ID NO: 6915376 - DNA, 17 bp, Homo sapiens
tctcattgttggttcag

SEQ ID NO: 6915377 - DNA, 22 bp, Homo sapiens
tccaagtttcttctgcacaaca

SEQ ID NO: 6915378 - DNA, 22 bp, Homo sapiens
taaagatgctatagtgaaggag

SEQ ID NO: 6915379 - DNA, 22 bp, Homo sapiens
tatgctgcaatatcattttgct

SEQ ID NO: 6915380 - DNA, 22 bp, Homo sapiens
acagcttctatttctctgtact

SEQ ID NO: 6915381 - DNA, 22 bp, Homo sapiens
acactggaccatttaaacttga

SEQ ID NO: 6915382 - DNA, 22 bp, Homo sapiens
tgacaatacagagagagcaaaa

SEQ ID NO: 6915383 - DNA, 22 bp, Homo sapiens
tccctcaggacccaacttgtaa

SEQ ID NO: 6915384 - DNA, 22 bp, Homo sapiens
agctgcagggcttgggtttccc

SEQ ID NO: 6915385 - DNA, 22 bp, Homo sapiens
gtctttcaggaggggcttagag

SEQ ID NO: 6915386 - DNA, 22 bp, Homo sapiens
aggccagtggttctctgtgtcc

SEQ ID NO: 6915387 - DNA, 22 bp, Homo sapiens
tgaggtagagattgtgactgta

SEQ ID NO: 6915388 - DNA, 22 bp, Homo sapiens
tttgggaaatagtagaaaatgt

SEQ ID NO: 6915389 - DNA, 22 bp, Homo sapiens
cttttctggccaggaacttgcc

SEQ ID NO: 6915390 - DNA, 22 bp, Homo sapiens
gggctccagtttggccaggaag

SEQ ID NO: 6915391 - DNA, 22 bp, Homo sapiens
tctctaaagcactttaaccaca

SEQ ID NO: 6915392 - DNA, 22 bp, Homo sapiens
ctcctgggctgtcggcgctctg

SEQ ID NO: 6915393 - DNA, 22 bp, Homo sapiens
gcaggaagggaaaggttgactc

SEQ ID NO: 6915394 - DNA, 22 bp, Homo sapiens
tactgcataactggcatgtggg

SEQ ID NO: 6915395 - DNA, 22 bp, Homo sapiens
gctggcaggtaaagccccgggg

SEQ ID NO: 6915396 - DNA, 22 bp, Homo sapiens
gttgttcagcctagagtgcagt

SEQ ID NO: 6915397 - DNA, 22 bp, Homo sapiens
agaggaggctctgggatcgtcc

SEQ ID NO: 6915398 - DNA, 22 bp, Homo sapiens
agctgtttttgtgggcatgtga

SEQ ID NO: 6915399 - DNA, 22 bp, Homo sapiens
gcagtggccacatggaggagga

SEQ ID NO: 6915400 - DNA, 22 bp, Homo sapiens
attctgctagttaatatctctc

SEQ ID NO: 6915401 - DNA, 19 bp, Homo sapiens
tgtctgctgatgactctat

SEQ ID NO: 6915402 - DNA, 22 bp, Homo sapiens
gtgttcattgctagtgaggtgt

SEQ ID NO: 6915403 - DNA, 22 bp, Homo sapiens
gcatccaggactatatgatgat

SEQ ID NO: 6915404 - DNA, 22 bp, Homo sapiens
tcccaagagacagaatggtatc

SEQ ID NO: 6915405 - DNA, 19 bp, Homo sapiens
ctgatgttccagagaagct

SEQ ID NO: 6915406 - DNA, 22 bp, Homo sapiens
aggagctgatagtctatggaga

SEQ ID NO: 6915407 - DNA, 22 bp, Homo sapiens
gggctcagtctgcggcgcgcgg

SEQ ID NO: 6915408 - DNA, 22 bp, Homo sapiens
ttgaatctcttgaatctctgtt

SEQ ID NO: 6915409 - DNA, 22 bp, Homo sapiens
tttgttttgaactagctcagaa

SEQ ID NO: 6915410 - DNA, 19 bp, Homo sapiens
tcaaaggcttttaggagac

SEQ ID NO: 6915411 - DNA, 21 bp, Homo sapiens
tgtggctgacaccctttggga

SEQ ID NO: 6915412 - DNA, 22 bp, Homo sapiens
taaacactcacttcatagccat

SEQ ID NO: 6915413 - DNA, 22 bp, Homo sapiens
gcctcttgcaaagcggttagcc

SEQ ID NO: 6915414 - DNA, 22 bp, Homo sapiens
acagagttaaagtggagtttaa

SEQ ID NO: 6915415 - DNA, 22 bp, Homo sapiens
tacagcttaaaaaagccaactt

SEQ ID NO: 6915416 - DNA, 22 bp, Homo sapiens
agtggtctgcctgcctcagcct

SEQ ID NO: 6915417 - DNA, 17 bp, Homo sapiens
aggtgccagtgatatac

SEQ ID NO: 6915418 - DNA, 22 bp, Homo sapiens
tagaaaggcaatcattcttgga

SEQ ID NO: 6915419 - DNA, 22 bp, Homo sapiens
gggtgtttatgtattatgatgt

SEQ ID NO: 6915420 - DNA, 22 bp, Homo sapiens
gtgctatccctggagccttaga

SEQ ID NO: 6915421 - DNA, 22 bp, Homo sapiens
acagatagtatgtaaattaagc

SEQ ID NO: 6915422 - DNA, 22 bp, Homo sapiens
atcttttacattactgcccaga

SEQ ID NO: 6915423 - DNA, 22 bp, Homo sapiens
ttcatgaaagacagcaactgtg

SEQ ID NO: 6915424 - DNA, 22 bp, Homo sapiens
tgacctcttgtcggagctccag

SEQ ID NO: 6915425 - DNA, 22 bp, Homo sapiens
atgctgatgaggtcaggaagac

SEQ ID NO: 6915426 - DNA, 22 bp, Homo sapiens
ggaggctctgcttatgaaaggc

SEQ ID NO: 6915427 - DNA, 22 bp, Homo sapiens
catgtgcgttttagaggtaaca

SEQ ID NO: 6915428 - DNA, 22 bp, Homo sapiens
ccacagggcacagacaggaagc

SEQ ID NO: 6915429 - DNA, 22 bp, Homo sapiens
attacaactatgtgctctgcaa

SEQ ID NO: 6915430 - DNA, 22 bp, Homo sapiens
cagtaggtgctcaacaagtaca

SEQ ID NO: 6915431 - DNA, 22 bp, Homo sapiens
catgcttacttgtctcagcaga

SEQ ID NO: 6915432 - DNA, 22 bp, Homo sapiens
aaacactggtatgatgtatagt

SEQ ID NO: 6915433 - DNA, 22 bp, Homo sapiens
aggggcggcctgcctgaagcag

SEQ ID NO: 6915434 - DNA, 22 bp, Homo sapiens
ttggaaaaattgcctgatgtct

SEQ ID NO: 6915435 - DNA, 20 bp, Homo sapiens
ccacattttactgtttgcca

SEQ ID NO: 6915436 - DNA, 22 bp, Homo sapiens
ccaggaggaaagaccagcccat

SEQ ID NO: 6915437 - DNA, 22 bp, Homo sapiens
gggtctgaggagtaccattgtc

SEQ ID NO: 6915438 - DNA, 22 bp, Homo sapiens
cacggtggaaagtagttagttg

SEQ ID NO: 6915439 - DNA, 19 bp, Homo sapiens
acacatgaggagggacccc

SEQ ID NO: 6915440 - DNA, 22 bp, Homo sapiens
aataatgtctttggcttgacca

SEQ ID NO: 6915441 - DNA, 22 bp, Homo sapiens
aaggtacaaagtattatttaaa

SEQ ID NO: 6915442 - DNA, 17 bp, Homo sapiens
tgagagcagggctgggc

SEQ ID NO: 6915443 - DNA, 22 bp, Homo sapiens
cacagttatatgttcacaagga

SEQ ID NO: 6915444 - DNA, 22 bp, Homo sapiens
tttcggccgcgtgaagttttct

SEQ ID NO: 6915445 - DNA, 22 bp, Homo sapiens
cggggaaaatgaagcaggtgga

SEQ ID NO: 6915446 - DNA, 22 bp, Homo sapiens
gccataggcagcgtggccagca

SEQ ID NO: 6915447 - DNA, 22 bp, Homo sapiens
aacaagaacacctacagttcta

SEQ ID NO: 6915448 - DNA, 22 bp, Homo sapiens
cttggcttttgctcccagatca

SEQ ID NO: 6915449 - DNA, 22 bp, Homo sapiens
gaggagcttgcatttaagtgcc

SEQ ID NO: 6915450 - DNA, 22 bp, Homo sapiens
tggcagtttcatgtgattcaac

SEQ ID NO: 6915451 - DNA, 22 bp, Homo sapiens
gcggggcacagtgatggagcac

SEQ ID NO: 6915452 - DNA, 22 bp, Homo sapiens
atcactgaagaatgggagagga

SEQ ID NO: 6915453 - DNA, 23 bp, Homo sapiens
tggaagcaatcactgtagtgaat

SEQ ID NO: 6915454 - DNA, 22 bp, Homo sapiens
atgcatcacttgaggtcaggag

SEQ ID NO: 6915455 - DNA, 22 bp, Homo sapiens
agaaatctgactgctgtgcaca

SEQ ID NO: 6915456 - DNA, 22 bp, Homo sapiens
gggccacggaaggaccagtggg

SEQ ID NO: 6915457 - DNA, 22 bp, Homo sapiens
cagctgagtttccaagtctgcc

SEQ ID NO: 6915458 - DNA, 22 bp, Homo sapiens
tggaagccgtagggtttgggaa

SEQ ID NO: 6915459 - DNA, 22 bp, Homo sapiens
cccgggaggcagaggttgcagt

SEQ ID NO: 6915460 - DNA, 19 bp, Homo sapiens
acagatggaggaatctggg

SEQ ID NO: 6915461 - DNA, 22 bp, Homo sapiens
tcagcttctttcacttaacatg

SEQ ID NO: 6915462 - DNA, 22 bp, Homo sapiens
ggccatggtcatgggtgagctt

SEQ ID NO: 6915463 - DNA, 22 bp, Homo sapiens
tcccaggattttaggctctcag

SEQ ID NO: 6915464 - DNA, 22 bp, Homo sapiens
tagctattttgcttggaaatac

SEQ ID NO: 6915465 - DNA, 22 bp, Homo sapiens
tcttgacaactatactacttac

SEQ ID NO: 6915466 - DNA, 22 bp, Homo sapiens
gcacatccaatgattgttttga

SEQ ID NO: 6915467 - DNA, 22 bp, Homo sapiens
tggtctcttcttccaagatggc

SEQ ID NO: 6915468 - DNA, 22 bp, Homo sapiens
gcctagtgcactggcagggctc

SEQ ID NO: 6915469 - DNA, 22 bp, Homo sapiens
agctgcagtaaagctctccagg

SEQ ID NO: 6915470 - DNA, 22 bp, Homo sapiens
agtgggagggccatatggtgaa

SEQ ID NO: 6915471 - DNA, 22 bp, Homo sapiens
gacagtcacttccaggagagga

SEQ ID NO: 6915472 - DNA, 22 bp, Homo sapiens
tttcctactgccctatacacac

SEQ ID NO: 6915473 - DNA, 22 bp, Homo sapiens
tgtgcttctctttctcacttaa

SEQ ID NO: 6915474 - DNA, 22 bp, Homo sapiens
tcaaacactgtaacatggaaaa

SEQ ID NO: 6915475 - DNA, 22 bp, Homo sapiens
tgcagaattatggtgctggctt

SEQ ID NO: 6915476 - DNA, 22 bp, Homo sapiens
actagtgaagaagatttgactg

SEQ ID NO: 6915477 - DNA, 22 bp, Homo sapiens
cctggcacatgatagatgctca

SEQ ID NO: 6915478 - DNA, 22 bp, Homo sapiens
tagatacctgctggacctcatt

SEQ ID NO: 6915479 - DNA, 22 bp, Homo sapiens
gtacaagtgtatttggcttgat

SEQ ID NO: 6915480 - DNA, 22 bp, Homo sapiens
agggctcatctgagactgacat

SEQ ID NO: 6915481 - DNA, 22 bp, Homo sapiens
aagggagcggggagaccctatg

SEQ ID NO: 6915482 - DNA, 22 bp, Homo sapiens
tagaagttgctcaataaatgtt

SEQ ID NO: 6915483 - DNA, 22 bp, Homo sapiens
ttggtcatcttccgtttcctca

SEQ ID NO: 6915484 - DNA, 22 bp, Homo sapiens
attgacaggtctttgggagtat

SEQ ID NO: 6915485 - DNA, 22 bp, Homo sapiens
tccagatcatgaagtttggttc

SEQ ID NO: 6915486 - DNA, 22 bp, Homo sapiens
ttcatgtggaaaagggctttca

SEQ ID NO: 6915487 - DNA, 22 bp, Homo sapiens
taggaagcttccagaacttaag

SEQ ID NO: 6915488 - DNA, 22 bp, Homo sapiens
ctgacctgtaactgtaagagac

SEQ ID NO: 6915489 - DNA, 22 bp, Homo sapiens
aggtgccagtgctgtggtcccc

SEQ ID NO: 6915490 - DNA, 22 bp, Homo sapiens
cccatttcttgagttcagctct

SEQ ID NO: 6915491 - DNA, 20 bp, Homo sapiens
gacttcaatttctatctttt

SEQ ID NO: 6915492 - DNA, 22 bp, Homo sapiens
tcagttaagaggccacggcagt

SEQ ID NO: 6915493 - DNA, 22 bp, Homo sapiens
aggacggggacgcaagtcagca

SEQ ID NO: 6915494 - DNA, 22 bp, Homo sapiens
gaggggagcccccatcctccag

SEQ ID NO: 6915495 - DNA, 22 bp, Homo sapiens
tggcagcaccagcagtgtcctt

SEQ ID NO: 6915496 - DNA, 21 bp, Homo sapiens
agagaaagtcatggctgtggc

SEQ ID NO: 6915497 - DNA, 22 bp, Homo sapiens
tatacaatgagtacattctggg

SEQ ID NO: 6915498 - DNA, 22 bp, Homo sapiens
tctgttcactgagcaatggcaa

SEQ ID NO: 6915499 - DNA, 22 bp, Homo sapiens
ttcagccaattagaagccccac

SEQ ID NO: 6915500 - DNA, 22 bp, Homo sapiens
ctggtgcactacagcctggaac

SEQ ID NO: 6915501 - DNA, 22 bp, Homo sapiens
gtggccaaacaccagtttagga

SEQ ID NO: 6915502 - DNA, 22 bp, Homo sapiens
cagatgtatatgcataaaaagt

SEQ ID NO: 6915503 - DNA, 22 bp, Homo sapiens
ttggttacttttaaacttgtct

SEQ ID NO: 6915504 - DNA, 20 bp, Homo sapiens
agccctgtttcctggagaga

SEQ ID NO: 6915505 - DNA, 22 bp, Homo sapiens
ggatttgcgcctgatcccacat

SEQ ID NO: 6915506 - DNA, 22 bp, Homo sapiens
tctcagtaattaatgttatgga

SEQ ID NO: 6915507 - DNA, 22 bp, Homo sapiens
tgctgacgtcaatgagaacata

SEQ ID NO: 6915508 - DNA, 22 bp, Homo sapiens
atccaaaaccagtgcattttcc

SEQ ID NO: 6915509 - DNA, 22 bp, Homo sapiens
attcagttgtaatctttgttag

SEQ ID NO: 6915510 - DNA, 19 bp, Homo sapiens
ctggacacactctattgct

SEQ ID NO: 6915511 - DNA, 22 bp, Homo sapiens
gcccggccaggaacagagtata

SEQ ID NO: 6915512 - DNA, 22 bp, Homo sapiens
tttgctgaatagattgtaaact

SEQ ID NO: 6915513 - DNA, 22 bp, Homo sapiens
cagcgcaggcgtgtgaaggcgc

SEQ ID NO: 6915514 - DNA, 21 bp, Homo sapiens
gcccagtgatttcttcacagt

SEQ ID NO: 6915515 - DNA, 22 bp, Homo sapiens
aaagtttgttatatgataagga

SEQ ID NO: 6915516 - DNA, 22 bp, Homo sapiens
acatctatgaacatttaagtag

SEQ ID NO: 6915517 - DNA, 22 bp, Homo sapiens
tttagcagagcatatgatatcc

SEQ ID NO: 6915518 - DNA, 22 bp, Homo sapiens
tagtgcttaaaagtggaagaga

SEQ ID NO: 6915519 - DNA, 22 bp, Homo sapiens
tttgtgcatgggtatggccaat

SEQ ID NO: 6915520 - DNA, 22 bp, Homo sapiens
aaatgtgtttctttgtgaatgg

SEQ ID NO: 6915521 - DNA, 22 bp, Homo sapiens
atataacatacatacagaaaag

SEQ ID NO: 6915522 - DNA, 22 bp, Homo sapiens
agctgacaggatggcattatta

SEQ ID NO: 6915523 - DNA, 22 bp, Homo sapiens
tcttggctactttcctgtctgc

SEQ ID NO: 6915524 - DNA, 22 bp, Homo sapiens
caaattcaatgaacatgtttaa

SEQ ID NO: 6915525 - DNA, 22 bp, Homo sapiens
agaaacatattcagtgagtaat

SEQ ID NO: 6915526 - DNA, 22 bp, Homo sapiens
agagtttcttgtgagcactgac

SEQ ID NO: 6915527 - DNA, 22 bp, Homo sapiens
acctgaacttccctatatgtgt

SEQ ID NO: 6915528 - DNA, 22 bp, Homo sapiens
agagttaagacgtacatgagtg

SEQ ID NO: 6915529 - DNA, 23 bp, Homo sapiens
tgtctggggcgccagaagagaga

SEQ ID NO: 6915530 - DNA, 22 bp, Homo sapiens
gctctgcctctttgctgcgtca

SEQ ID NO: 6915531 - DNA, 22 bp, Homo sapiens
acataatgagctctttataaat

SEQ ID NO: 6915532 - DNA, 22 bp, Homo sapiens
ttcactgcagcccatgaaggga

SEQ ID NO: 6915533 - DNA, 22 bp, Homo sapiens
aagagtctattggaactagaca

SEQ ID NO: 6915534 - DNA, 18 bp, Homo sapiens
atagaaacctttaatcag

SEQ ID NO: 6915535 - DNA, 22 bp, Homo sapiens
tcccagtggtgggtgcacattt

SEQ ID NO: 6915536 - DNA, 22 bp, Homo sapiens
tagaactaaagaacaactttga

SEQ ID NO: 6915537 - DNA, 22 bp, Homo sapiens
catgtggatatgaattgtagaa

SEQ ID NO: 6915538 - DNA, 22 bp, Homo sapiens
caaaggaaatactaatctggaa

SEQ ID NO: 6915539 - DNA, 20 bp, Homo sapiens
cctgggctcaaagcatcctc

SEQ ID NO: 6915540 - DNA, 22 bp, Homo sapiens
tgtgggaatcagccaggggggc

SEQ ID NO: 6915541 - DNA, 22 bp, Homo sapiens
gccagtggagcacatggtgaag

SEQ ID NO: 6915542 - DNA, 22 bp, Homo sapiens
tcttggcaagtggcagattctt

SEQ ID NO: 6915543 - DNA, 22 bp, Homo sapiens
tgcacatttgttattttgaggt

SEQ ID NO: 6915544 - DNA, 22 bp, Homo sapiens
tatgtgaccttctgaatgagta

SEQ ID NO: 6915545 - DNA, 22 bp, Homo sapiens
ctgccagagatttggtgaacaa

SEQ ID NO: 6915546 - DNA, 22 bp, Homo sapiens
tctgggaggctgggtcccgtcc

SEQ ID NO: 6915547 - DNA, 22 bp, Homo sapiens
aatgcacaaaggtgtctattgc

SEQ ID NO: 6915548 - DNA, 22 bp, Homo sapiens
aatcaggcaaatttctttttct

SEQ ID NO: 6915549 - DNA, 22 bp, Homo sapiens
aaattggagtctgaggagtaag

SEQ ID NO: 6915550 - DNA, 22 bp, Homo sapiens
ttcatgtgaatatatttgtctt

SEQ ID NO: 6915551 - DNA, 22 bp, Homo sapiens
gcaggagccacttcagggatgc

SEQ ID NO: 6915552 - DNA, 22 bp, Homo sapiens
aagctttggaagggcagggttg

SEQ ID NO: 6915553 - DNA, 22 bp, Homo sapiens
tgcaagtagtccagcctttggg

SEQ ID NO: 6915554 - DNA, 22 bp, Homo sapiens
gctgtctcatacaaggccctgc

SEQ ID NO: 6915555 - DNA, 22 bp, Homo sapiens
tcatagatgtgctgtgcacaaa

SEQ ID NO: 6915556 - DNA, 22 bp, Homo sapiens
ctggtggcaatgaggcgtcact

SEQ ID NO: 6915557 - DNA, 22 bp, Homo sapiens
tgcagaagaatgtaggcataag

SEQ ID NO: 6915558 - DNA, 22 bp, Homo sapiens
tattctgatttcaagtgagagt

SEQ ID NO: 6915559 - DNA, 22 bp, Homo sapiens
acctccatccactagatgccag

SEQ ID NO: 6915560 - DNA, 22 bp, Homo sapiens
ttctccctgtcctatcaagact

SEQ ID NO: 6915561 - DNA, 22 bp, Homo sapiens
tcagatgtccttccagagattt

SEQ ID NO: 6915562 - DNA, 22 bp, Homo sapiens
cctccctgggtgacgggctcct

SEQ ID NO: 6915563 - DNA, 22 bp, Homo sapiens
tatacactgatataaggagtaa

SEQ ID NO: 6915564 - DNA, 22 bp, Homo sapiens
agctgggggtagtgagaaataa

SEQ ID NO: 6915565 - DNA, 22 bp, Homo sapiens
cctgatcaagttttctggctcc

SEQ ID NO: 6915566 - DNA, 22 bp, Homo sapiens
aattaggggaggacgtatcata

SEQ ID NO: 6915567 - DNA, 22 bp, Homo sapiens
gccaccagtagctaacaacagt

SEQ ID NO: 6915568 - DNA, 22 bp, Homo sapiens
atgcaagcaatctgagctttgg

SEQ ID NO: 6915569 - DNA, 22 bp, Homo sapiens
tacagtatatactgtgtgtaga

SEQ ID NO: 6915570 - DNA, 22 bp, Homo sapiens
attaattagagaggtgcctgtt

SEQ ID NO: 6915571 - DNA, 22 bp, Homo sapiens
gctagcggtaacagcgtttgcc

SEQ ID NO: 6915572 - DNA, 22 bp, Homo sapiens
ctctggggtggaggaggctgac

SEQ ID NO: 6915573 - DNA, 22 bp, Homo sapiens
ttcagaataactttttattgaa

SEQ ID NO: 6915574 - DNA, 22 bp, Homo sapiens
agtaacatttagcttctcactg

SEQ ID NO: 6915575 - DNA, 22 bp, Homo sapiens
agtgcaatggctgcctgcatgg

SEQ ID NO: 6915576 - DNA, 22 bp, Homo sapiens
tctgcacagctcacctccctgg

SEQ ID NO: 6915577 - DNA, 22 bp, Homo sapiens
gtgggggcagtgggcttcgagc

SEQ ID NO: 6915578 - DNA, 22 bp, Homo sapiens
ggcctgcttctcagtgagcttg

SEQ ID NO: 6915579 - DNA, 22 bp, Homo sapiens
ggcttctcccttcttctgattg

SEQ ID NO: 6915580 - DNA, 22 bp, Homo sapiens
ggctttatgcagggatagaaat

SEQ ID NO: 6915581 - DNA, 22 bp, Homo sapiens
ttcagcaccctctgaggcatcc

SEQ ID NO: 6915582 - DNA, 22 bp, Homo sapiens
cattcattagaatagatatgta

SEQ ID NO: 6915583 - DNA, 22 bp, Homo sapiens
cagcttctgagcaagccagggg

SEQ ID NO: 6915584 - DNA, 22 bp, Homo sapiens
acttcaaattttcagaagaaat

SEQ ID NO: 6915585 - DNA, 22 bp, Homo sapiens
tattggtaggactcagctgaga

SEQ ID NO: 6915586 - DNA, 22 bp, Homo sapiens
ctatatcataaatctgaagagg

SEQ ID NO: 6915587 - DNA, 22 bp, Homo sapiens
tctgggtgccctttgctctgtt

SEQ ID NO: 6915588 - DNA, 22 bp, Homo sapiens
aaagccagtttctggaagtacc

SEQ ID NO: 6915589 - DNA, 18 bp, Homo sapiens
tggcttctattttactca

SEQ ID NO: 6915590 - DNA, 22 bp, Homo sapiens
ggaaaaggccattgtttctctg

SEQ ID NO: 6915591 - DNA, 22 bp, Homo sapiens
caaaattctgcatttctaataa

SEQ ID NO: 6915592 - DNA, 22 bp, Homo sapiens
gttgcacactggctataacaag

SEQ ID NO: 6915593 - DNA, 22 bp, Homo sapiens
aatgtaacagcaacaacaatgg

SEQ ID NO: 6915594 - DNA, 22 bp, Homo sapiens
gcctggagctactggacactga

SEQ ID NO: 6915595 - DNA, 22 bp, Homo sapiens
cagagctgtatttatctttcca

SEQ ID NO: 6915596 - DNA, 18 bp, Homo sapiens
agcccagcggagtgaatc

SEQ ID NO: 6915597 - DNA, 22 bp, Homo sapiens
ggagctctctcagggggtccaa

SEQ ID NO: 6915598 - DNA, 22 bp, Homo sapiens
ccactgctctgccaggagctgg

SEQ ID NO: 6915599 - DNA, 22 bp, Homo sapiens
tgatcagtcccatgatcttcca

SEQ ID NO: 6915600 - DNA, 17 bp, Homo sapiens
tccaagccagcttgcct

SEQ ID NO: 6915601 - DNA, 22 bp, Homo sapiens
gtgcctggcacacagaaggcaa

SEQ ID NO: 6915602 - DNA, 22 bp, Homo sapiens
gctctgagattgagcctttggt

SEQ ID NO: 6915603 - DNA, 23 bp, Homo sapiens
tggccagcagaagcaaggggagc

SEQ ID NO: 6915604 - DNA, 22 bp, Homo sapiens
accagtctgttgttgcagagtg

SEQ ID NO: 6915605 - DNA, 22 bp, Homo sapiens
ccagagaggccttggcaagaca

SEQ ID NO: 6915606 - DNA, 22 bp, Homo sapiens
ttgaagaattaggacgtgagta

SEQ ID NO: 6915607 - DNA, 22 bp, Homo sapiens
ttagtgaaagtaatacaaagta

SEQ ID NO: 6915608 - DNA, 22 bp, Homo sapiens
aaatgtgtatatgaaacatgat

SEQ ID NO: 6915609 - DNA, 23 bp, Homo sapiens
agctcctgaggccagcctctcct

SEQ ID NO: 6915610 - DNA, 22 bp, Homo sapiens
tctctgaacttcctggaaaggc

SEQ ID NO: 6915611 - DNA, 22 bp, Homo sapiens
tgggcctgggctcctgtcctct

SEQ ID NO: 6915612 - DNA, 22 bp, Homo sapiens
catttggtgttaggcatgttaa

SEQ ID NO: 6915613 - DNA, 22 bp, Homo sapiens
gctctctgttattaagatcttt

SEQ ID NO: 6915614 - DNA, 22 bp, Homo sapiens
gtgaagatctgagccctcaggt

SEQ ID NO: 6915615 - DNA, 22 bp, Homo sapiens
aagcataacttgctgcacatag

SEQ ID NO: 6915616 - DNA, 19 bp, Homo sapiens
tctcaattcagactgagag

SEQ ID NO: 6915617 - DNA, 22 bp, Homo sapiens
gatattcctgaaggacagggtt

SEQ ID NO: 6915618 - DNA, 22 bp, Homo sapiens
ggcaggcactgtgatagattct

SEQ ID NO: 6915619 - DNA, 22 bp, Homo sapiens
agccagaacgcatcgccaaggc

SEQ ID NO: 6915620 - DNA, 22 bp, Homo sapiens
ggcaagtggtagaacatctgag

SEQ ID NO: 6915621 - DNA, 21 bp, Homo sapiens
gcccttgaaaagctcacaggc

SEQ ID NO: 6915622 - DNA, 22 bp, Homo sapiens
ttagataatgttattgtaattt

SEQ ID NO: 6915623 - DNA, 22 bp, Homo sapiens
aagacctgggatggccctgaag

SEQ ID NO: 6915624 - DNA, 22 bp, Homo sapiens
ttattgaaatggaagctataac

SEQ ID NO: 6915625 - DNA, 22 bp, Homo sapiens
gagtgcagtatgagaggctgct

SEQ ID NO: 6915626 - DNA, 22 bp, Homo sapiens
gaggaaagaaccccagtcaata

SEQ ID NO: 6915627 - DNA, 19 bp, Homo sapiens
taggccagaagttttccac

SEQ ID NO: 6915628 - DNA, 20 bp, Homo sapiens
aatctcagtatcctatgcaa

SEQ ID NO: 6915629 - DNA, 22 bp, Homo sapiens
aaaccatggctcattggagatg

SEQ ID NO: 6915630 - DNA, 22 bp, Homo sapiens
acactggacactgaactccctg

SEQ ID NO: 6915631 - DNA, 23 bp, Homo sapiens
ttcattaggagataagggggaca

SEQ ID NO: 6915632 - DNA, 22 bp, Homo sapiens
cagtggaggctcaagtgtgctt

SEQ ID NO: 6915633 - DNA, 22 bp, Homo sapiens
ttcctggtgagatttcgttctg

SEQ ID NO: 6915634 - DNA, 22 bp, Homo sapiens
aaggttgtctctttattatctt

SEQ ID NO: 6915635 - DNA, 22 bp, Homo sapiens
cagccagggagcaaagagttga

SEQ ID NO: 6915636 - DNA, 22 bp, Homo sapiens
ccatgtgattccattaggctga

SEQ ID NO: 6915637 - DNA, 20 bp, Homo sapiens
caggagggacatttcagcat

SEQ ID NO: 6915638 - DNA, 22 bp, Homo sapiens
tttagacatagctgaaatcatt

SEQ ID NO: 6915639 - DNA, 19 bp, Homo sapiens
atgaagattggtaaattca

SEQ ID NO: 6915640 - DNA, 22 bp, Homo sapiens
aagtggtggtatgaaccgaggg

SEQ ID NO: 6915641 - DNA, 22 bp, Homo sapiens
gcacagacatatccatatttac

SEQ ID NO: 6915642 - DNA, 22 bp, Homo sapiens
tggctacatttatactctcatt

SEQ ID NO: 6915643 - DNA, 22 bp, Homo sapiens
tggatctaaatgggcagtgctg

SEQ ID NO: 6915644 - DNA, 22 bp, Homo sapiens
gcacaggttgtacttgggcacc

SEQ ID NO: 6915645 - DNA, 22 bp, Homo sapiens
tttcttgaccactatgttgata

SEQ ID NO: 6915646 - DNA, 22 bp, Homo sapiens
tcttcaggagctgaaagcctgc

SEQ ID NO: 6915647 - DNA, 22 bp, Homo sapiens
tgaaatgttaaacaagtggctc

SEQ ID NO: 6915648 - DNA, 22 bp, Homo sapiens
tcctgaattgttgagaagcagc

SEQ ID NO: 6915649 - DNA, 22 bp, Homo sapiens
tccctgcttggaatgaccctta

SEQ ID NO: 6915650 - DNA, 22 bp, Homo sapiens
ggctgtggcattaggtgaggcc

SEQ ID NO: 6915651 - DNA, 22 bp, Homo sapiens
tcaaagtatatcccttcgaaac

SEQ ID NO: 6915652 - DNA, 20 bp, Homo sapiens
ggctgcccactccagagtac

SEQ ID NO: 6915653 - DNA, 19 bp, Homo sapiens
gggcaaagtgatcgtcctg

SEQ ID NO: 6915654 - DNA, 22 bp, Homo sapiens
aatatgcagcttatcttctagg

SEQ ID NO: 6915655 - DNA, 22 bp, Homo sapiens
aatgaatgtttgttgagtgaag

SEQ ID NO: 6915656 - DNA, 22 bp, Homo sapiens
gatggatactataggaggcaca

SEQ ID NO: 6915657 - DNA, 20 bp, Homo sapiens
ctgctgagagcctggcttgc

SEQ ID NO: 6915658 - DNA, 22 bp, Homo sapiens
agccaaagagaccccatatcca

SEQ ID NO: 6915659 - DNA, 22 bp, Homo sapiens
ctgaaactttagttctgcaaca

SEQ ID NO: 6915660 - DNA, 17 bp, Homo sapiens
ggctgtttttaggctgt

SEQ ID NO: 6915661 - DNA, 22 bp, Homo sapiens
gggccctcagtcccaggccttc

SEQ ID NO: 6915662 - DNA, 22 bp, Homo sapiens
ccagggtctctgctgcctgaga

SEQ ID NO: 6915663 - DNA, 22 bp, Homo sapiens
ctgcaggcccccttcctggagt

SEQ ID NO: 6915664 - DNA, 22 bp, Homo sapiens
acacaggggctcggctgggtgc

SEQ ID NO: 6915665 - DNA, 22 bp, Homo sapiens
tatacacacatgctccggcctt

SEQ ID NO: 6915666 - DNA, 22 bp, Homo sapiens
tcagtctcagcacctagtcaca

SEQ ID NO: 6915667 - DNA, 22 bp, Homo sapiens
tgctacacttaaatcagtcacc

SEQ ID NO: 6915668 - DNA, 22 bp, Homo sapiens
ctctcagtcctgcgcgcctctg

SEQ ID NO: 6915669 - DNA, 22 bp, Homo sapiens
tagttttttcaacaaatggtgc

SEQ ID NO: 6915670 - DNA, 22 bp, Homo sapiens
acttgcatatatccctccacat

SEQ ID NO: 6915671 - DNA, 22 bp, Homo sapiens
caggctgggcagcctccccggc

SEQ ID NO: 6915672 - DNA, 22 bp, Homo sapiens
tctgcgttattgaaaagcagcc

SEQ ID NO: 6915673 - DNA, 22 bp, Homo sapiens
ccagggtaccccaagggcaggt

SEQ ID NO: 6915674 - DNA, 22 bp, Homo sapiens
cctggtggccttcagcccacaa

SEQ ID NO: 6915675 - DNA, 22 bp, Homo sapiens
ccaggtgggaggaaagcagaga

SEQ ID NO: 6915676 - DNA, 21 bp, Homo sapiens
tattgcataccatgaatctga

SEQ ID NO: 6915677 - DNA, 22 bp, Homo sapiens
tggctcccgcttgcacctaaga

SEQ ID NO: 6915678 - DNA, 19 bp, Homo sapiens
tctggctcctgccaggctg

SEQ ID NO: 6915679 - DNA, 22 bp, Homo sapiens
agaaatgtttactcaccccctt

SEQ ID NO: 6915680 - DNA, 22 bp, Homo sapiens
ttaatgtatggggttgagatga

SEQ ID NO: 6915681 - DNA, 22 bp, Homo sapiens
ttagcactggatttcatcagaa

SEQ ID NO: 6915682 - DNA, 22 bp, Homo sapiens
atgaggtgatggacatattaac

SEQ ID NO: 6915683 - DNA, 22 bp, Homo sapiens
aggagtgggggcgagaagttaa

SEQ ID NO: 6915684 - DNA, 22 bp, Homo sapiens
caggggcagtctgtgtgcgtgg

SEQ ID NO: 6915685 - DNA, 22 bp, Homo sapiens
tgtcttctgtattcaagtctat

SEQ ID NO: 6915686 - DNA, 22 bp, Homo sapiens
gagaggctcagggacttgctga

SEQ ID NO: 6915687 - DNA, 19 bp, Homo sapiens
ttctaagttttgcttgctg

SEQ ID NO: 6915688 - DNA, 22 bp, Homo sapiens
agttctggttaacctgcaacct

SEQ ID NO: 6915689 - DNA, 19 bp, Homo sapiens
gggatgacagcccagagcc

SEQ ID NO: 6915690 - DNA, 22 bp, Homo sapiens
tttggctagagaaattactata

SEQ ID NO: 6915691 - DNA, 22 bp, Homo sapiens
gtgtcacaggcccagctcttca

SEQ ID NO: 6915692 - DNA, 22 bp, Homo sapiens
cttaaactgggcattcagagaa

SEQ ID NO: 6915693 - DNA, 22 bp, Homo sapiens
ttttcaggctgatttgtgttag

SEQ ID NO: 6915694 - DNA, 22 bp, Homo sapiens
gtcccctggtggctggagctgc

SEQ ID NO: 6915695 - DNA, 22 bp, Homo sapiens
tgcaggcagtaggccagctcca

SEQ ID NO: 6915696 - DNA, 22 bp, Homo sapiens
actctgaactccaggaggctca

SEQ ID NO: 6915697 - DNA, 22 bp, Homo sapiens
agggatgtgggaactgcaggtt

SEQ ID NO: 6915698 - DNA, 22 bp, Homo sapiens
ttgtggggaacccctgtcccac

SEQ ID NO: 6915699 - DNA, 22 bp, Homo sapiens
taatgctgccaagccatgcaga

SEQ ID NO: 6915700 - DNA, 22 bp, Homo sapiens
cctaggagttgaggtggccaga

SEQ ID NO: 6915701 - DNA, 22 bp, Homo sapiens
cacatatatgggcccctgaggg

SEQ ID NO: 6915702 - DNA, 22 bp, Homo sapiens
tcagaacagaagaaggaacacg

SEQ ID NO: 6915703 - DNA, 22 bp, Homo sapiens
attgttgagtgcttcagctgta

SEQ ID NO: 6915704 - DNA, 22 bp, Homo sapiens
agcctggattcgtgcatccaca

SEQ ID NO: 6915705 - DNA, 22 bp, Homo sapiens
tggcaaccgcatggcctgcttc

SEQ ID NO: 6915706 - DNA, 20 bp, Homo sapiens
ctaagaggtccttccacatc

SEQ ID NO: 6915707 - DNA, 22 bp, Homo sapiens
atattgagatgaggatattaac

SEQ ID NO: 6915708 - DNA, 22 bp, Homo sapiens
aggcttaagcctgaggccccag

SEQ ID NO: 6915709 - DNA, 22 bp, Homo sapiens
cccacaggcaggggcagagaca

SEQ ID NO: 6915710 - DNA, 22 bp, Homo sapiens
cacatttatttgaggctaattg

SEQ ID NO: 6915711 - DNA, 22 bp, Homo sapiens
ctactatttgtcctttataagc

SEQ ID NO: 6915712 - DNA, 22 bp, Homo sapiens
tttcattggctccctgatgaat

SEQ ID NO: 6915713 - DNA, 22 bp, Homo sapiens
acagtagtgctcaatcagtgtt

SEQ ID NO: 6915714 - DNA, 22 bp, Homo sapiens
tctcccttggtcacagattcct

SEQ ID NO: 6915715 - DNA, 22 bp, Homo sapiens
ctattccacttttggcaaagcc

SEQ ID NO: 6915716 - DNA, 22 bp, Homo sapiens
gctcccatagcagatttttgac

SEQ ID NO: 6915717 - DNA, 22 bp, Homo sapiens
ggcctttagtggttctggagtc

SEQ ID NO: 6915718 - DNA, 22 bp, Homo sapiens
aacattctattttgctaaaaca

SEQ ID NO: 6915719 - DNA, 22 bp, Homo sapiens
ctcagaaagcaatctggtgagg

SEQ ID NO: 6915720 - DNA, 20 bp, Homo sapiens
tctgtaaagactccagaagc

SEQ ID NO: 6915721 - DNA, 22 bp, Homo sapiens
aagatttgactctgattagcat

SEQ ID NO: 6915722 - DNA, 19 bp, Homo sapiens
acacaatgacacatatata

SEQ ID NO: 6915723 - DNA, 22 bp, Homo sapiens
attgacctattggacatgaaac

SEQ ID NO: 6915724 - DNA, 22 bp, Homo sapiens
attggagtggtggttacatgag

SEQ ID NO: 6915725 - DNA, 22 bp, Homo sapiens
atatgacataaaatcatttttg

SEQ ID NO: 6915726 - DNA, 22 bp, Homo sapiens
agcagatgcattatgattgaaa

SEQ ID NO: 6915727 - DNA, 22 bp, Homo sapiens
atgacatatgattctgaagaca

SEQ ID NO: 6915728 - DNA, 18 bp, Homo sapiens
agagatggtgtagagttt

SEQ ID NO: 6915729 - DNA, 22 bp, Homo sapiens
tcattccctcattgttcactgg

SEQ ID NO: 6915730 - DNA, 22 bp, Homo sapiens
ctgtgaatcatgacctctctgg

SEQ ID NO: 6915731 - DNA, 22 bp, Homo sapiens
tgaagtgcattctctggcactc

SEQ ID NO: 6915732 - DNA, 22 bp, Homo sapiens
cgtcatcacggcaagcatctcc

SEQ ID NO: 6915733 - DNA, 20 bp, Homo sapiens
agatctttgggttgtcatat

SEQ ID NO: 6915734 - DNA, 22 bp, Homo sapiens
gctgctgtcagcaggccttgtt

SEQ ID NO: 6915735 - DNA, 22 bp, Homo sapiens
atctggggaggtatctgtagtc

SEQ ID NO: 6915736 - DNA, 23 bp, Homo sapiens
ttgcactgatcaatttgataagc

SEQ ID NO: 6915737 - DNA, 22 bp, Homo sapiens
ctgtggcgccgctgagagcaga

SEQ ID NO: 6915738 - DNA, 22 bp, Homo sapiens
ccaccagctttgccaccctgct

SEQ ID NO: 6915739 - DNA, 22 bp, Homo sapiens
aaggctggagatggttggaatg

SEQ ID NO: 6915740 - DNA, 22 bp, Homo sapiens
cattgtctcttgtcatttagta

SEQ ID NO: 6915741 - DNA, 22 bp, Homo sapiens
ctggccgcagtgtggagttgtg

SEQ ID NO: 6915742 - DNA, 22 bp, Homo sapiens
aatcaggagagctgcgaacgtt

SEQ ID NO: 6915743 - DNA, 22 bp, Homo sapiens
aagtgctgggattacaggtgtc

SEQ ID NO: 6915744 - DNA, 22 bp, Homo sapiens
ggtgaagtaatgaaacagggag

SEQ ID NO: 6915745 - DNA, 22 bp, Homo sapiens
taaacctgtagttgatgtaatt

SEQ ID NO: 6915746 - DNA, 22 bp, Homo sapiens
ttttcctcaggaatgctaagct

SEQ ID NO: 6915747 - DNA, 22 bp, Homo sapiens
tgcctccaacagcccatcctag

SEQ ID NO: 6915748 - DNA, 22 bp, Homo sapiens
ccaagagggttgccctgagcgt

SEQ ID NO: 6915749 - DNA, 22 bp, Homo sapiens
tccttgaagagtgggcggtcga

SEQ ID NO: 6915750 - DNA, 22 bp, Homo sapiens
tacatacatgtatgtgtgtatt

SEQ ID NO: 6915751 - DNA, 22 bp, Homo sapiens
tgcatacatgtttgtgtatttt

SEQ ID NO: 6915752 - DNA, 22 bp, Homo sapiens
agggttgtatgtgagaatatgt

SEQ ID NO: 6915753 - DNA, 22 bp, Homo sapiens
cccaggcagccccagaagcttg

SEQ ID NO: 6915754 - DNA, 22 bp, Homo sapiens
agagtcaagtagggcatgggct

SEQ ID NO: 6915755 - DNA, 22 bp, Homo sapiens
caagatcaaggtatcagcagat

SEQ ID NO: 6915756 - DNA, 22 bp, Homo sapiens
acagcagcactattgacatttt

SEQ ID NO: 6915757 - DNA, 22 bp, Homo sapiens
caagatcaaggtgtcagcaggt

SEQ ID NO: 6915758 - DNA, 21 bp, Homo sapiens
ggggttggcaagagcagagac

SEQ ID NO: 6915759 - DNA, 22 bp, Homo sapiens
ccagcagcccacaggcgtccct

SEQ ID NO: 6915760 - DNA, 22 bp, Homo sapiens
agcagcttgttaaaaagttcca

SEQ ID NO: 6915761 - DNA, 22 bp, Homo sapiens
tacttgcttggatttcaccaga

SEQ ID NO: 6915762 - DNA, 22 bp, Homo sapiens
aatgtggatgatactagtactt

SEQ ID NO: 6915763 - DNA, 22 bp, Homo sapiens
gctgtccatccacttcccagcg

SEQ ID NO: 6915764 - DNA, 22 bp, Homo sapiens
ttctggagtcattggggctgat

SEQ ID NO: 6915765 - DNA, 22 bp, Homo sapiens
agtgaccaacaatgctgagaag

SEQ ID NO: 6915766 - DNA, 22 bp, Homo sapiens
tatacacatatacgtttgtgtg

SEQ ID NO: 6915767 - DNA, 22 bp, Homo sapiens
aagtttctgatattgttaaagc

SEQ ID NO: 6915768 - DNA, 22 bp, Homo sapiens
attccacaggagctggttttct

SEQ ID NO: 6915769 - DNA, 22 bp, Homo sapiens
gtgctcagggcctggctgggga

SEQ ID NO: 6915770 - DNA, 22 bp, Homo sapiens
tgcttaaaattttccaaggatt

SEQ ID NO: 6915771 - DNA, 22 bp, Homo sapiens
tgcttccagctctctgtaaggt

SEQ ID NO: 6915772 - DNA, 22 bp, Homo sapiens
ctgtcaaagactaaggttctta

SEQ ID NO: 6915773 - DNA, 22 bp, Homo sapiens
tgactctgtacctgtctgcctt

SEQ ID NO: 6915774 - DNA, 22 bp, Homo sapiens
cagagcttcagggaataagaat

SEQ ID NO: 6915775 - DNA, 22 bp, Homo sapiens
ggcatgcacccggtgaccatga

SEQ ID NO: 6915776 - DNA, 22 bp, Homo sapiens
agaggccaggcagcccaaggtg

SEQ ID NO: 6915777 - DNA, 22 bp, Homo sapiens
atgcctggactgtatcccagat

SEQ ID NO: 6915778 - DNA, 22 bp, Homo sapiens
cgcaggctccggggtgccctgg

SEQ ID NO: 6915779 - DNA, 22 bp, Homo sapiens
cagaaatgcctgcttctctctc

SEQ ID NO: 6915780 - DNA, 22 bp, Homo sapiens
cctgcaggtttcccccggacgg

SEQ ID NO: 6915781 - DNA, 22 bp, Homo sapiens
ccagtgtagctcaggactgggc

SEQ ID NO: 6915782 - DNA, 22 bp, Homo sapiens
tcagatagtgataatagcatgt

SEQ ID NO: 6915783 - DNA, 22 bp, Homo sapiens
tagtgggttaactagaagttaa

SEQ ID NO: 6915784 - DNA, 22 bp, Homo sapiens
ccacatgctcttgttacagtgt

SEQ ID NO: 6915785 - DNA, 22 bp, Homo sapiens
aggccccatcaggaaggaggcc

SEQ ID NO: 6915786 - DNA, 22 bp, Homo sapiens
aaatacagagttgcttaaaagc

SEQ ID NO: 6915787 - DNA, 22 bp, Homo sapiens
tttcagaaattgttattattct

SEQ ID NO: 6915788 - DNA, 22 bp, Homo sapiens
gtcctgaggcaggatgggtttc

SEQ ID NO: 6915789 - DNA, 22 bp, Homo sapiens
ctgaactaggattggaatgaga

SEQ ID NO: 6915790 - DNA, 21 bp, Homo sapiens
tgaccagtgccccatcctgtc

SEQ ID NO: 6915791 - DNA, 22 bp, Homo sapiens
aaatcactaagttatagtgtgg

SEQ ID NO: 6915792 - DNA, 22 bp, Homo sapiens
tatttgacactaggtgccctga

SEQ ID NO: 6915793 - DNA, 22 bp, Homo sapiens
actatgctcactacctggggga

SEQ ID NO: 6915794 - DNA, 22 bp, Homo sapiens
tcttcagaggaagtcagtcttt

SEQ ID NO: 6915795 - DNA, 22 bp, Homo sapiens
ctgtctttttagagagtaggat

SEQ ID NO: 6915796 - DNA, 22 bp, Homo sapiens
tcaggcaggacaattatttagg

SEQ ID NO: 6915797 - DNA, 22 bp, Homo sapiens
tgttccagatttagccaaccga

SEQ ID NO: 6915798 - DNA, 22 bp, Homo sapiens
aacagacagaaaaatgtgatct

SEQ ID NO: 6915799 - DNA, 22 bp, Homo sapiens
gtgacaaggaaagacagactgt

SEQ ID NO: 6915800 - DNA, 22 bp, Homo sapiens
gcagagccttgcgtcatgtgcc

SEQ ID NO: 6915801 - DNA, 22 bp, Homo sapiens
aagttcaagtagtgttacatgg

SEQ ID NO: 6915802 - DNA, 22 bp, Homo sapiens
gtgcatgtgcgttgactgtcca

SEQ ID NO: 6915803 - DNA, 22 bp, Homo sapiens
ctggaatgcggagagttggaga

SEQ ID NO: 6915804 - DNA, 22 bp, Homo sapiens
ggctccaggtttaagggtatgt

SEQ ID NO: 6915805 - DNA, 22 bp, Homo sapiens
atccttcaattagaaccaattg

SEQ ID NO: 6915806 - DNA, 22 bp, Homo sapiens
gcatgcagagaatacctgtgat

SEQ ID NO: 6915807 - DNA, 22 bp, Homo sapiens
ccacgaggctatcctgctaggg

SEQ ID NO: 6915808 - DNA, 22 bp, Homo sapiens
taggcttcccgctcacatgccc

SEQ ID NO: 6915809 - DNA, 22 bp, Homo sapiens
agtgggtgacagtgaacacgta

SEQ ID NO: 6915810 - DNA, 22 bp, Homo sapiens
aaatcagttgttatattaaaga

SEQ ID NO: 6915811 - DNA, 22 bp, Homo sapiens
acattgttccagcgatagagaa

SEQ ID NO: 6915812 - DNA, 22 bp, Homo sapiens
taacactggagagttggttgtg

SEQ ID NO: 6915813 - DNA, 22 bp, Homo sapiens
gttgaggagcaagcatgtgtct

SEQ ID NO: 6915814 - DNA, 22 bp, Homo sapiens
ggacaagtggcccggtgtgtta

SEQ ID NO: 6915815 - DNA, 22 bp, Homo sapiens
ttgccattatcatttatgatac

SEQ ID NO: 6915816 - DNA, 22 bp, Homo sapiens
ctgtgggaaaggatgagattgc

SEQ ID NO: 6915817 - DNA, 22 bp, Homo sapiens
tttactcaagtatgcatttatg

SEQ ID NO: 6915818 - DNA, 23 bp, Homo sapiens
atgtagagtacagcacaacagca

SEQ ID NO: 6915819 - DNA, 22 bp, Homo sapiens
gcatgttttgcaacaagtgacc

SEQ ID NO: 6915820 - DNA, 22 bp, Homo sapiens
tcctcctctatcagacagtgcc

SEQ ID NO: 6915821 - DNA, 18 bp, Homo sapiens
gctgcctgcattcctcac

SEQ ID NO: 6915822 - DNA, 22 bp, Homo sapiens
tatcaaagttgtcctgtgaagt

SEQ ID NO: 6915823 - DNA, 22 bp, Homo sapiens
agttctctatgaagtctattgt

SEQ ID NO: 6915824 - DNA, 22 bp, Homo sapiens
tgcaaatgtcaagggttagtgt

SEQ ID NO: 6915825 - DNA, 22 bp, Homo sapiens
attgaagacttggtatccgtgg

SEQ ID NO: 6915826 - DNA, 22 bp, Homo sapiens
atcagaaattgctaccagtgga

SEQ ID NO: 6915827 - DNA, 22 bp, Homo sapiens
tgctggaaccaggaatttgaag

SEQ ID NO: 6915828 - DNA, 22 bp, Homo sapiens
ttgctgaattgaatcctttggt

SEQ ID NO: 6915829 - DNA, 22 bp, Homo sapiens
tttattggatatttacaagata

SEQ ID NO: 6915830 - DNA, 22 bp, Homo sapiens
tttgttcagagatgttcaagct

SEQ ID NO: 6915831 - DNA, 19 bp, Homo sapiens
cagagccaggcctttggcc

SEQ ID NO: 6915832 - DNA, 22 bp, Homo sapiens
ttatttgcccatgtttagcaga

SEQ ID NO: 6915833 - DNA, 22 bp, Homo sapiens
tggacagtgctcagaaatttgt

SEQ ID NO: 6915834 - DNA, 22 bp, Homo sapiens
cctgtgcttcactcaacaagcc

SEQ ID NO: 6915835 - DNA, 22 bp, Homo sapiens
aatgaacacttagcctttctat

SEQ ID NO: 6915836 - DNA, 22 bp, Homo sapiens
ccagtgttcatcaagaaaatgt

SEQ ID NO: 6915837 - DNA, 22 bp, Homo sapiens
cagtagggaatgtgggaggctg

SEQ ID NO: 6915838 - DNA, 22 bp, Homo sapiens
gtgtgggaggaaggtgaacaga

SEQ ID NO: 6915839 - DNA, 22 bp, Homo sapiens
acatgcatgaaatccataaaca

SEQ ID NO: 6915840 - DNA, 20 bp, Homo sapiens
ctgcgggctcggccgacccc

SEQ ID NO: 6915841 - DNA, 22 bp, Homo sapiens
ttgtctactaagaaagacaatt

SEQ ID NO: 6915842 - DNA, 22 bp, Homo sapiens
agcagatgcaaacttaccttga

SEQ ID NO: 6915843 - DNA, 21 bp, Homo sapiens
cacaggcttctatacacaatg

SEQ ID NO: 6915844 - DNA, 22 bp, Homo sapiens
tgtctggaatttctattttgtc

SEQ ID NO: 6915845 - DNA, 22 bp, Homo sapiens
tggccttggccgtgctggggtc

SEQ ID NO: 6915846 - DNA, 22 bp, Homo sapiens
ggttcagagtcaggatctaagt

SEQ ID NO: 6915847 - DNA, 22 bp, Homo sapiens
ttgcagagaggttaggaactca

SEQ ID NO: 6915848 - DNA, 22 bp, Homo sapiens
ttaaacagacagtaaatgaaac

SEQ ID NO: 6915849 - DNA, 22 bp, Homo sapiens
gtccagagttagaaatgaatat

SEQ ID NO: 6915850 - DNA, 22 bp, Homo sapiens
tggggagaggaatttgaatgat

SEQ ID NO: 6915851 - DNA, 22 bp, Homo sapiens
atttggaagcatttccaaagca

SEQ ID NO: 6915852 - DNA, 22 bp, Homo sapiens
taggaccagccagttgctgaga

SEQ ID NO: 6915853 - DNA, 22 bp, Homo sapiens
gaatgtcagttgcgggcatttc

SEQ ID NO: 6915854 - DNA, 22 bp, Homo sapiens
atgtttatgacctccataagga

SEQ ID NO: 6915855 - DNA, 22 bp, Homo sapiens
tacaagctggcgcagttaagat

SEQ ID NO: 6915856 - DNA, 22 bp, Homo sapiens
gtgtggtgaggccccttaggct

SEQ ID NO: 6915857 - DNA, 23 bp, Homo sapiens
actgattcttgaagttgacaagt

SEQ ID NO: 6915858 - DNA, 22 bp, Homo sapiens
cctgctgctatgaaggtgacag

SEQ ID NO: 6915859 - DNA, 22 bp, Homo sapiens
cctttcaaattacatgactgct

SEQ ID NO: 6915860 - DNA, 22 bp, Homo sapiens
agggtgtacatttgttggtgaa

SEQ ID NO: 6915861 - DNA, 22 bp, Homo sapiens
gaacataactattgtgaatagt

SEQ ID NO: 6915862 - DNA, 22 bp, Homo sapiens
cgtaacacacctagagcattct

SEQ ID NO: 6915863 - DNA, 22 bp, Homo sapiens
gctaataattcctttgtgaact

SEQ ID NO: 6915864 - DNA, 22 bp, Homo sapiens
tgtggcagaaccagaattcaaa

SEQ ID NO: 6915865 - DNA, 22 bp, Homo sapiens
ctgaggtggggcctgggcatca

SEQ ID NO: 6915866 - DNA, 22 bp, Homo sapiens
tggagtcaggcaatgcttgctt

SEQ ID NO: 6915867 - DNA, 22 bp, Homo sapiens
tttgattctaagttctgtcaac

SEQ ID NO: 6915868 - DNA, 22 bp, Homo sapiens
taatggtgcagtgggtgtaact

SEQ ID NO: 6915869 - DNA, 22 bp, Homo sapiens
aggaaccagaggttgagcaact

SEQ ID NO: 6915870 - DNA, 22 bp, Homo sapiens
accagcacttccagaggtcagg

SEQ ID NO: 6915871 - DNA, 22 bp, Homo sapiens
ttgagtttacattgtattagcc

SEQ ID NO: 6915872 - DNA, 22 bp, Homo sapiens
ttccatatgtatatagctgtta

SEQ ID NO: 6915873 - DNA, 22 bp, Homo sapiens
gtgctccatggcctgtgtccat

SEQ ID NO: 6915874 - DNA, 22 bp, Homo sapiens
cgtgatagatttctgctcaagc

SEQ ID NO: 6915875 - DNA, 22 bp, Homo sapiens
ttcacaggaatgtaggggtctt

SEQ ID NO: 6915876 - DNA, 18 bp, Homo sapiens
catgtatgcaaataagca

SEQ ID NO: 6915877 - DNA, 22 bp, Homo sapiens
agagaagggaagggattcaccc

SEQ ID NO: 6915878 - DNA, 22 bp, Homo sapiens
cttcacttgctcatcatgctat

SEQ ID NO: 6915879 - DNA, 22 bp, Homo sapiens
ggtagggtgggccgaagctcaa

SEQ ID NO: 6915880 - DNA, 22 bp, Homo sapiens
agtacaagtagaatgctacaag

SEQ ID NO: 6915881 - DNA, 23 bp, Homo sapiens
tagagcttcagcgaatgtgctca

SEQ ID NO: 6915882 - DNA, 22 bp, Homo sapiens
aagatcaccttgacatgaaaag

SEQ ID NO: 6915883 - DNA, 22 bp, Homo sapiens
gccttgagaaatgtttggtttt

SEQ ID NO: 6915884 - DNA, 22 bp, Homo sapiens
tattcagtgcgggaactcagcc

SEQ ID NO: 6915885 - DNA, 22 bp, Homo sapiens
tctcagtggatctcagaatttt

SEQ ID NO: 6915886 - DNA, 22 bp, Homo sapiens
atggacagtgtgtctgtttcca

SEQ ID NO: 6915887 - DNA, 22 bp, Homo sapiens
tcaagagccagagagtgcgctc

SEQ ID NO: 6915888 - DNA, 22 bp, Homo sapiens
tggaagccagctgggcacctgc

SEQ ID NO: 6915889 - DNA, 22 bp, Homo sapiens
actattcacctttcatgcagga

SEQ ID NO: 6915890 - DNA, 22 bp, Homo sapiens
ttagccattctgataggtatgt

SEQ ID NO: 6915891 - DNA, 22 bp, Homo sapiens
cagatagctgactactcttctt

SEQ ID NO: 6915892 - DNA, 22 bp, Homo sapiens
ctgtgcccagctccctgactgc

SEQ ID NO: 6915893 - DNA, 22 bp, Homo sapiens
tatcagaaactctggggcaggg

SEQ ID NO: 6915894 - DNA, 22 bp, Homo sapiens
agaaatctcagtatctcaggga

SEQ ID NO: 6915895 - DNA, 22 bp, Homo sapiens
cagcacagcacagcggtgactc

SEQ ID NO: 6915896 - DNA, 22 bp, Homo sapiens
acagggcttgttgaaagcggag

SEQ ID NO: 6915897 - DNA, 22 bp, Homo sapiens
ctagcatctcactgatttactg

SEQ ID NO: 6915898 - DNA, 22 bp, Homo sapiens
tgtgtatgttttgaggttgcta

SEQ ID NO: 6915899 - DNA, 22 bp, Homo sapiens
cttgtacatgataatctcactc

SEQ ID NO: 6915900 - DNA, 22 bp, Homo sapiens
atgtggggacaaaatgatggcc

SEQ ID NO: 6915901 - DNA, 22 bp, Homo sapiens
aaacatttttctaggtcttggt

SEQ ID NO: 6915902 - DNA, 22 bp, Homo sapiens
ctgtgccttggcgctgtgccac

SEQ ID NO: 6915903 - DNA, 19 bp, Homo sapiens
tcagggaagttcaaagctc

SEQ ID NO: 6915904 - DNA, 22 bp, Homo sapiens
ttggtcagcactgatgtttcag

SEQ ID NO: 6915905 - DNA, 23 bp, Homo sapiens
taagtgataaagagtagagatgg

SEQ ID NO: 6915906 - DNA, 22 bp, Homo sapiens
taccagcctgaccctgtctgac

SEQ ID NO: 6915907 - DNA, 22 bp, Homo sapiens
aagctttaaggaattttatgga

SEQ ID NO: 6915908 - DNA, 22 bp, Homo sapiens
gaggaactgagtaccatgattc

SEQ ID NO: 6915909 - DNA, 18 bp, Homo sapiens
ccatttgaccttgaccga

SEQ ID NO: 6915910 - DNA, 17 bp, Homo sapiens
tgctcctgggacaagga

SEQ ID NO: 6915911 - DNA, 22 bp, Homo sapiens
atgggctctatgtctaggagat

SEQ ID NO: 6915912 - DNA, 22 bp, Homo sapiens
agattgctttccaaaagcgttg

SEQ ID NO: 6915913 - DNA, 22 bp, Homo sapiens
tctgggtatgacctatttttcc

SEQ ID NO: 6915914 - DNA, 22 bp, Homo sapiens
tttgtaacattatggactgctt

SEQ ID NO: 6915915 - DNA, 22 bp, Homo sapiens
actcttgaactgattaagaatg

SEQ ID NO: 6915916 - DNA, 22 bp, Homo sapiens
aaattcaattaactttcatgct

SEQ ID NO: 6915917 - DNA, 22 bp, Homo sapiens
actgcatttgtctgtctcaatt

SEQ ID NO: 6915918 - DNA, 22 bp, Homo sapiens
cccagggctgcagatggaggct

SEQ ID NO: 6915919 - DNA, 21 bp, Homo sapiens
gtaattctgcctcatcttcac

SEQ ID NO: 6915920 - DNA, 22 bp, Homo sapiens
gaagttttagtcaaaatgtaga

SEQ ID NO: 6915921 - DNA, 22 bp, Homo sapiens
cagctgccaagaatcttttcta

SEQ ID NO: 6915922 - DNA, 22 bp, Homo sapiens
ctttacagccccacttccgggc

SEQ ID NO: 6915923 - DNA, 22 bp, Homo sapiens
ccatcctggcctcgctgtccac

SEQ ID NO: 6915924 - DNA, 22 bp, Homo sapiens
ctggagccatgtatagcctatg

SEQ ID NO: 6915925 - DNA, 22 bp, Homo sapiens
atctggaatagcatggggttga

SEQ ID NO: 6915926 - DNA, 22 bp, Homo sapiens
acttctatgccttcctctgttt

SEQ ID NO: 6915927 - DNA, 18 bp, Homo sapiens
acaggtgatatcttgaga

SEQ ID NO: 6915928 - DNA, 22 bp, Homo sapiens
tgcataaaacatgatttctgct

SEQ ID NO: 6915929 - DNA, 22 bp, Homo sapiens
gacaaaacacattagtttaaaa

SEQ ID NO: 6915930 - DNA, 20 bp, Homo sapiens
ccaggcctgggcctgctcta

SEQ ID NO: 6915931 - DNA, 22 bp, Homo sapiens
tacattatcctgtctttgtcct

SEQ ID NO: 6915932 - DNA, 22 bp, Homo sapiens
ggaccaggctgagcacctgcct

SEQ ID NO: 6915933 - DNA, 22 bp, Homo sapiens
agggttaggtcacgctgcctgg

SEQ ID NO: 6915934 - DNA, 22 bp, Homo sapiens
gagattggtaaagaaccaggtt

SEQ ID NO: 6915935 - DNA, 20 bp, Homo sapiens
agaaatgtgaaaggctgagt

SEQ ID NO: 6915936 - DNA, 22 bp, Homo sapiens
ctgtccagcacatgtctgcccc

SEQ ID NO: 6915937 - DNA, 21 bp, Homo sapiens
accaggccaggaggctggcac

SEQ ID NO: 6915938 - DNA, 22 bp, Homo sapiens
aagaccagaggatataaccaga

SEQ ID NO: 6915939 - DNA, 22 bp, Homo sapiens
tcaaatctttgaccacttatgt

SEQ ID NO: 6915940 - DNA, 22 bp, Homo sapiens
tgtaattgcttgtttacctgct

SEQ ID NO: 6915941 - DNA, 22 bp, Homo sapiens
agtagccaattaagtggcaagc

SEQ ID NO: 6915942 - DNA, 22 bp, Homo sapiens
aaagataatgtttccttattct

SEQ ID NO: 6915943 - DNA, 22 bp, Homo sapiens
gggggcgggagacagcagtgac

SEQ ID NO: 6915944 - DNA, 22 bp, Homo sapiens
aagggctccacttgaatcacac

SEQ ID NO: 6915945 - DNA, 22 bp, Homo sapiens
ccaggcagaatgaaacccctgt

SEQ ID NO: 6915946 - DNA, 22 bp, Homo sapiens
gaggctttacctagtaaagtgg

SEQ ID NO: 6915947 - DNA, 22 bp, Homo sapiens
caggccccattcctcttgggac

SEQ ID NO: 6915948 - DNA, 22 bp, Homo sapiens
gtggtgcaggtgtcactgcaga

SEQ ID NO: 6915949 - DNA, 22 bp, Homo sapiens
ttaaagaatagtgcccctattg

SEQ ID NO: 6915950 - DNA, 22 bp, Homo sapiens
acatccagatctcagcatggct

SEQ ID NO: 6915951 - DNA, 22 bp, Homo sapiens
ggctcctgatgctcagatttca

SEQ ID NO: 6915952 - DNA, 21 bp, Homo sapiens
cacattgcccctccacctcct

SEQ ID NO: 6915953 - DNA, 22 bp, Homo sapiens
gatttcactaggtttctaggtg

SEQ ID NO: 6915954 - DNA, 22 bp, Homo sapiens
atgataacaacagcagtgctgg

SEQ ID NO: 6915955 - DNA, 22 bp, Homo sapiens
ttttggtacctacagctgaatt

SEQ ID NO: 6915956 - DNA, 22 bp, Homo sapiens
tcttcttttatttcaagggtgt

SEQ ID NO: 6915957 - DNA, 22 bp, Homo sapiens
agctctttgactaatcttgctt

SEQ ID NO: 6915958 - DNA, 22 bp, Homo sapiens
caaagcagtattggattcttta

SEQ ID NO: 6915959 - DNA, 17 bp, Homo sapiens
ctgaaatattatgataa

SEQ ID NO: 6915960 - DNA, 22 bp, Homo sapiens
aggcactaatccctactatgag

SEQ ID NO: 6915961 - DNA, 22 bp, Homo sapiens
ttagccattgtcagcacatggc

SEQ ID NO: 6915962 - DNA, 21 bp, Homo sapiens
tgctggtcacaggtggcccca

SEQ ID NO: 6915963 - DNA, 22 bp, Homo sapiens
gaaagttatatcatgattttag

SEQ ID NO: 6915964 - DNA, 22 bp, Homo sapiens
cagggctcttccggagcaggga

SEQ ID NO: 6915965 - DNA, 22 bp, Homo sapiens
agaggaatctgtctagacacaa

SEQ ID NO: 6915966 - DNA, 22 bp, Homo sapiens
cctcacagaggggcagccatct

SEQ ID NO: 6915967 - DNA, 23 bp, Homo sapiens
ttaaaagtggagagagaagctgg

SEQ ID NO: 6915968 - DNA, 22 bp, Homo sapiens
tctctttctcagatggtggaga

SEQ ID NO: 6915969 - DNA, 22 bp, Homo sapiens
cagcacagctgaggggctgtct

SEQ ID NO: 6915970 - DNA, 22 bp, Homo sapiens
tcattgacagttgtttcaaata

SEQ ID NO: 6915971 - DNA, 20 bp, Homo sapiens
agtgtttagaatactattat

SEQ ID NO: 6915972 - DNA, 22 bp, Homo sapiens
tccagagtgctgacgcagaccc

SEQ ID NO: 6915973 - DNA, 22 bp, Homo sapiens
cagagtcccagatgcccctcct

SEQ ID NO: 6915974 - DNA, 22 bp, Homo sapiens
atggttgaacttaaagggaatg

SEQ ID NO: 6915975 - DNA, 22 bp, Homo sapiens
agatggatttcttccagtgaga

SEQ ID NO: 6915976 - DNA, 22 bp, Homo sapiens
tcagtaaaggggaggtgatggg

SEQ ID NO: 6915977 - DNA, 22 bp, Homo sapiens
tggaaacatctctgcctttatt

SEQ ID NO: 6915978 - DNA, 22 bp, Homo sapiens
tagcttataaaggttttcaaag

SEQ ID NO: 6915979 - DNA, 22 bp, Homo sapiens
gaggagctgtctttgtgatctt

SEQ ID NO: 6915980 - DNA, 15 bp, Homo sapiens
atgtgtagtcaccag

SEQ ID NO: 6915981 - DNA, 22 bp, Homo sapiens
tttctaagtgtgattttagatt

SEQ ID NO: 6915982 - DNA, 22 bp, Homo sapiens
cttttattttgaattaagggct

SEQ ID NO: 6915983 - DNA, 22 bp, Homo sapiens
accagagctggctctgagcacc

SEQ ID NO: 6915984 - DNA, 22 bp, Homo sapiens
caaatgaatttccctgcaaatg

SEQ ID NO: 6915985 - DNA, 22 bp, Homo sapiens
gttaggatgtggggactttggg

SEQ ID NO: 6915986 - DNA, 22 bp, Homo sapiens
ctgtacacttcagtgagttttg

SEQ ID NO: 6915987 - DNA, 22 bp, Homo sapiens
gcctggaatcatgcaggggtta

SEQ ID NO: 6915988 - DNA, 22 bp, Homo sapiens
ctgggtataggaaacagttaag

SEQ ID NO: 6915989 - DNA, 23 bp, Homo sapiens
gcttgtgtatacaggaggccacc

SEQ ID NO: 6915990 - DNA, 22 bp, Homo sapiens
tcagtgctgagtagcgtgcacc

SEQ ID NO: 6915991 - DNA, 22 bp, Homo sapiens
agagatggatgttattatgggt

SEQ ID NO: 6915992 - DNA, 22 bp, Homo sapiens
tcattgcagactaacaatctca

SEQ ID NO: 6915993 - DNA, 22 bp, Homo sapiens
actgtctggaggcagagaggga

SEQ ID NO: 6915994 - DNA, 22 bp, Homo sapiens
aggaagaggtgtgcaatggtgt

SEQ ID NO: 6915995 - DNA, 22 bp, Homo sapiens
agcacagaatgaggtggaagtg

SEQ ID NO: 6915996 - DNA, 22 bp, Homo sapiens
ctcagcaattacctgtgtctct

SEQ ID NO: 6915997 - DNA, 21 bp, Homo sapiens
aatacagtgaagaatttcttt

SEQ ID NO: 6915998 - DNA, 22 bp, Homo sapiens
ctggagaattctatgaaatatt

SEQ ID NO: 6915999 - DNA, 22 bp, Homo sapiens
tagcatctgcgttgggttggac

SEQ ID NO: 6916000 - DNA, 22 bp, Homo sapiens
gaattgctctgcctggccagcc

SEQ ID NO: 6916001 - DNA, 22 bp, Homo sapiens
tcttcagaaaattatcacttgt

SEQ ID NO: 6916002 - DNA, 22 bp, Homo sapiens
tcagtgacaactatgaatattt

SEQ ID NO: 6916003 - DNA, 22 bp, Homo sapiens
agttctcaagacaattacctgt

SEQ ID NO: 6916004 - DNA, 22 bp, Homo sapiens
actctcgtcctgctgtcctgac

SEQ ID NO: 6916005 - DNA, 22 bp, Homo sapiens
gcatatatgtgcaggctcacac

SEQ ID NO: 6916006 - DNA, 22 bp, Homo sapiens
aaattctgtcctgaatgccatt

SEQ ID NO: 6916007 - DNA, 22 bp, Homo sapiens
tatttcacaaagtttggggaca

SEQ ID NO: 6916008 - DNA, 20 bp, Homo sapiens
tgctgtaagattagagagct

SEQ ID NO: 6916009 - DNA, 22 bp, Homo sapiens
gaatggctcaagattattgtct

SEQ ID NO: 6916010 - DNA, 22 bp, Homo sapiens
tgcagtgtttggatgctgagtc

SEQ ID NO: 6916011 - DNA, 22 bp, Homo sapiens
ctttactatcaggaataaacaa

SEQ ID NO: 6916012 - DNA, 18 bp, Homo sapiens
cttcagtggctgctctgc

SEQ ID NO: 6916013 - DNA, 22 bp, Homo sapiens
tagagagccagttgtcatagtt

SEQ ID NO: 6916014 - DNA, 22 bp, Homo sapiens
gccgggccctgacctcagagtt

SEQ ID NO: 6916015 - DNA, 22 bp, Homo sapiens
tcaggctgaggtcatctgcatc

SEQ ID NO: 6916016 - DNA, 22 bp, Homo sapiens
gaggtcattgttgcattaattg

SEQ ID NO: 6916017 - DNA, 22 bp, Homo sapiens
cagggtagtaatttaatacaag

SEQ ID NO: 6916018 - DNA, 22 bp, Homo sapiens
attactttcagatgtgctgtaa

SEQ ID NO: 6916019 - DNA, 22 bp, Homo sapiens
tcctgtatcctgatacaataag

SEQ ID NO: 6916020 - DNA, 22 bp, Homo sapiens
gccatattcgcattcttcattt

SEQ ID NO: 6916021 - DNA, 22 bp, Homo sapiens
tttgtccagtgcaccagcctca

SEQ ID NO: 6916022 - DNA, 22 bp, Homo sapiens
gtggtttgttttattcctggaa

SEQ ID NO: 6916023 - DNA, 22 bp, Homo sapiens
gagaagcaatcagcagccaccc

SEQ ID NO: 6916024 - DNA, 22 bp, Homo sapiens
caaaattagaaatgcagctgtt

SEQ ID NO: 6916025 - DNA, 22 bp, Homo sapiens
gaaaggcttggttttgaatata

SEQ ID NO: 6916026 - DNA, 22 bp, Homo sapiens
gctggctgacagatttggggtg

SEQ ID NO: 6916027 - DNA, 22 bp, Homo sapiens
ttcagaatgtactgatagaaca

SEQ ID NO: 6916028 - DNA, 22 bp, Homo sapiens
tttcatgtcattccatttcaga

SEQ ID NO: 6916029 - DNA, 22 bp, Homo sapiens
ttaagacattcagatatttcta

SEQ ID NO: 6916030 - DNA, 22 bp, Homo sapiens
tgagacctctgggttctgagct

SEQ ID NO: 6916031 - DNA, 22 bp, Homo sapiens
tgaatgacctttgaggatggaa

SEQ ID NO: 6916032 - DNA, 22 bp, Homo sapiens
gtgttccatgtttgaggtagtt

SEQ ID NO: 6916033 - DNA, 22 bp, Homo sapiens
ctgaggtgagaggaggccatgt

SEQ ID NO: 6916034 - DNA, 22 bp, Homo sapiens
caggcgctgtggctcccacctg

SEQ ID NO: 6916035 - DNA, 22 bp, Homo sapiens
agttctaaggtgagtagagagg

SEQ ID NO: 6916036 - DNA, 22 bp, Homo sapiens
aaacagtgtaggtggccaggca

SEQ ID NO: 6916037 - DNA, 22 bp, Homo sapiens
gagctggtaaaggatcttgtct

SEQ ID NO: 6916038 - DNA, 22 bp, Homo sapiens
ctagctttttatgacaatcttg

SEQ ID NO: 6916039 - DNA, 22 bp, Homo sapiens
gtcagcagtgtcagctctgggg

SEQ ID NO: 6916040 - DNA, 21 bp, Homo sapiens
tagaatacaggtattttggat

SEQ ID NO: 6916041 - DNA, 22 bp, Homo sapiens
ccttcagccagttttctttgtt

SEQ ID NO: 6916042 - DNA, 22 bp, Homo sapiens
aatgtcaataactttatccctc

SEQ ID NO: 6916043 - DNA, 22 bp, Homo sapiens
gctgagagtccaggaaaacatc

SEQ ID NO: 6916044 - DNA, 22 bp, Homo sapiens
attatcacaggtgagtctcact

SEQ ID NO: 6916045 - DNA, 23 bp, Homo sapiens
gcggaaggggtcataatggagac

SEQ ID NO: 6916046 - DNA, 22 bp, Homo sapiens
gacacaggaatcaccttggatg

SEQ ID NO: 6916047 - DNA, 22 bp, Homo sapiens
tgtgtgaaggaatatatactca

SEQ ID NO: 6916048 - DNA, 22 bp, Homo sapiens
tgtcacatcaggtggtggctgt

SEQ ID NO: 6916049 - DNA, 22 bp, Homo sapiens
caatgcacatggacatcaggct

SEQ ID NO: 6916050 - DNA, 19 bp, Homo sapiens
catcagagggcataggatg

SEQ ID NO: 6916051 - DNA, 22 bp, Homo sapiens
aggtctccttgtgggtcttgcc

SEQ ID NO: 6916052 - DNA, 22 bp, Homo sapiens
aaagctttctagctatgttcta

SEQ ID NO: 6916053 - DNA, 21 bp, Homo sapiens
gtcaatacataggtgaagagg

SEQ ID NO: 6916054 - DNA, 20 bp, Homo sapiens
gctctaaagccacagattga

SEQ ID NO: 6916055 - DNA, 22 bp, Homo sapiens
agagcagtcattaatacatgta

SEQ ID NO: 6916056 - DNA, 22 bp, Homo sapiens
atggtcacttcacccatgagct

SEQ ID NO: 6916057 - DNA, 22 bp, Homo sapiens
tcctgtgagacttgtccattat

SEQ ID NO: 6916058 - DNA, 22 bp, Homo sapiens
gtggacagagataataaactga

SEQ ID NO: 6916059 - DNA, 22 bp, Homo sapiens
gctgctttctgaaggtgcactg

SEQ ID NO: 6916060 - DNA, 22 bp, Homo sapiens
ctgaagcaaaggatcgagctaa

SEQ ID NO: 6916061 - DNA, 22 bp, Homo sapiens
ttctactttggacataaaggac

SEQ ID NO: 6916062 - DNA, 22 bp, Homo sapiens
actggttttggaaatcagtaca

SEQ ID NO: 6916063 - DNA, 22 bp, Homo sapiens
ggatgcttaggttgttttatta

SEQ ID NO: 6916064 - DNA, 22 bp, Homo sapiens
tcatggaaacagcaatgctaat

SEQ ID NO: 6916065 - DNA, 22 bp, Homo sapiens
cagggagctggctggctgtgcc

SEQ ID NO: 6916066 - DNA, 22 bp, Homo sapiens
atgaggcatctaacattgcaaa

SEQ ID NO: 6916067 - DNA, 22 bp, Homo sapiens
tggagcagcatcactttgagct

SEQ ID NO: 6916068 - DNA, 22 bp, Homo sapiens
atgaggcatctgcagtcactag

SEQ ID NO: 6916069 - DNA, 22 bp, Homo sapiens
ttcaagtctgtttcattgcatg

SEQ ID NO: 6916070 - DNA, 22 bp, Homo sapiens
ttcatttgcactggattactgg

SEQ ID NO: 6916071 - DNA, 22 bp, Homo sapiens
ctggccctggagggctgtgcga

SEQ ID NO: 6916072 - DNA, 22 bp, Homo sapiens
ttgtagatataaattttattgt

SEQ ID NO: 6916073 - DNA, 22 bp, Homo sapiens
ccagcatctgtcctttccctca

SEQ ID NO: 6916074 - DNA, 22 bp, Homo sapiens
agatgctatacattgtaagaca

SEQ ID NO: 6916075 - DNA, 22 bp, Homo sapiens
gcacagaaccagacatgaggca

SEQ ID NO: 6916076 - DNA, 22 bp, Homo sapiens
ttgatgtagaaccaagatcttt

SEQ ID NO: 6916077 - DNA, 22 bp, Homo sapiens
gagtacatcttaatttgactaa

SEQ ID NO: 6916078 - DNA, 22 bp, Homo sapiens
tcaccaggctagagtgcagtgg

SEQ ID NO: 6916079 - DNA, 22 bp, Homo sapiens
tagggcagagtccaggatgggc

SEQ ID NO: 6916080 - DNA, 22 bp, Homo sapiens
acagtctttgcaaagtcctggt

SEQ ID NO: 6916081 - DNA, 22 bp, Homo sapiens
ctgaccaacatggtgaaacctt

SEQ ID NO: 6916082 - DNA, 22 bp, Homo sapiens
ctctagggtgcaggccccagga

SEQ ID NO: 6916083 - DNA, 22 bp, Homo sapiens
tccagtgagcactacatgaact

SEQ ID NO: 6916084 - DNA, 22 bp, Homo sapiens
caaagaatcactcatctttagc

SEQ ID NO: 6916085 - DNA, 22 bp, Homo sapiens
tgagccaatgatttgaatagag

SEQ ID NO: 6916086 - DNA, 22 bp, Homo sapiens
acacttgtgttgaaagctgtta

SEQ ID NO: 6916087 - DNA, 22 bp, Homo sapiens
ttcttgttggcctcaggtttgc

SEQ ID NO: 6916088 - DNA, 22 bp, Homo sapiens
agtcttcttgatcttttcagtg

SEQ ID NO: 6916089 - DNA, 22 bp, Homo sapiens
tgggagagataggcttctggac

SEQ ID NO: 6916090 - DNA, 22 bp, Homo sapiens
tctgtcctccggagctcccagt

SEQ ID NO: 6916091 - DNA, 22 bp, Homo sapiens
tcaggccctttgctgctgcccc

SEQ ID NO: 6916092 - DNA, 22 bp, Homo sapiens
gggctgtgcctcaggtggggtc

SEQ ID NO: 6916093 - DNA, 22 bp, Homo sapiens
caaggccttcgtctcctagctt

SEQ ID NO: 6916094 - DNA, 20 bp, Homo sapiens
tttctgtgcccaggtctgtt

SEQ ID NO: 6916095 - DNA, 22 bp, Homo sapiens
agctgctgcggaaagatgccac

SEQ ID NO: 6916096 - DNA, 22 bp, Homo sapiens
ttttaattttagcccttctggt

SEQ ID NO: 6916097 - DNA, 22 bp, Homo sapiens
ccagctgctttttgtcacatgg

SEQ ID NO: 6916098 - DNA, 22 bp, Homo sapiens
aggaatgacatagaaaggggag

SEQ ID NO: 6916099 - DNA, 22 bp, Homo sapiens
gtattgcaattactcttcttct

SEQ ID NO: 6916100 - DNA, 22 bp, Homo sapiens
gtgctcctggccacatgaagct

SEQ ID NO: 6916101 - DNA, 23 bp, Homo sapiens
tgcaggctaggaagagagccttc

SEQ ID NO: 6916102 - DNA, 22 bp, Homo sapiens
tagacacatcaagtatagttaa

SEQ ID NO: 6916103 - DNA, 22 bp, Homo sapiens
tctggcagcgaagcgtgtactt

SEQ ID NO: 6916104 - DNA, 22 bp, Homo sapiens
tgtgcatgacagcatacaaacg

SEQ ID NO: 6916105 - DNA, 22 bp, Homo sapiens
aagtatctcaaaaacagtaatc

SEQ ID NO: 6916106 - DNA, 22 bp, Homo sapiens
agcagcaggagccgtggggtga

SEQ ID NO: 6916107 - DNA, 22 bp, Homo sapiens
caacacttcttatacttactga

SEQ ID NO: 6916108 - DNA, 22 bp, Homo sapiens
tctgggcttgggtagaaatcac

SEQ ID NO: 6916109 - DNA, 22 bp, Homo sapiens
gggggcttggcccggtctggtt

SEQ ID NO: 6916110 - DNA, 22 bp, Homo sapiens
aggattttgacttattcaggga

SEQ ID NO: 6916111 - DNA, 22 bp, Homo sapiens
agcttgcctccccctcttagga

SEQ ID NO: 6916112 - DNA, 22 bp, Homo sapiens
atactggatttgaaacatttca

SEQ ID NO: 6916113 - DNA, 22 bp, Homo sapiens
gtgccagagatgacaggcctgc

SEQ ID NO: 6916114 - DNA, 22 bp, Homo sapiens
tggggcacttatgatgtgccac

SEQ ID NO: 6916115 - DNA, 22 bp, Homo sapiens
gatgttattgtgatcatgatac

SEQ ID NO: 6916116 - DNA, 22 bp, Homo sapiens
atgcatgatcctgagcaaccca

SEQ ID NO: 6916117 - DNA, 22 bp, Homo sapiens
cagcatctcctgtgcagaggga

SEQ ID NO: 6916118 - DNA, 22 bp, Homo sapiens
ttctatgttagtatgggtctcc

SEQ ID NO: 6916119 - DNA, 22 bp, Homo sapiens
cgctgctcggaaggtgtcacgt

SEQ ID NO: 6916120 - DNA, 22 bp, Homo sapiens
aggggtgaaagagggccctcaa

SEQ ID NO: 6916121 - DNA, 22 bp, Homo sapiens
cttgcaaagtagctgagaggtt

SEQ ID NO: 6916122 - DNA, 22 bp, Homo sapiens
cagcagcctggagggggccacg

SEQ ID NO: 6916123 - DNA, 22 bp, Homo sapiens
ccaggagggtggttactcaatc

SEQ ID NO: 6916124 - DNA, 22 bp, Homo sapiens
cctggtgtggctgtcacagagg

SEQ ID NO: 6916125 - DNA, 22 bp, Homo sapiens
attgtactccctctcctgcccg

SEQ ID NO: 6916126 - DNA, 22 bp, Homo sapiens
tttctcctaactcaaatttaag

SEQ ID NO: 6916127 - DNA, 22 bp, Homo sapiens
agggaaggaggccatgtgtccc

SEQ ID NO: 6916128 - DNA, 22 bp, Homo sapiens
gctcagagaagttaaggaattt

SEQ ID NO: 6916129 - DNA, 22 bp, Homo sapiens
gatgatggacaaagcattggtg

SEQ ID NO: 6916130 - DNA, 22 bp, Homo sapiens
tctctgtgtgccttcatctgcc

SEQ ID NO: 6916131 - DNA, 22 bp, Homo sapiens
ttggtcacatttgtttcaatta

SEQ ID NO: 6916132 - DNA, 22 bp, Homo sapiens
gatgctgtggtaagccccaccg

SEQ ID NO: 6916133 - DNA, 22 bp, Homo sapiens
cagatgctgctatttcaccctg

SEQ ID NO: 6916134 - DNA, 21 bp, Homo sapiens
ttcttcttggactgttttggc

SEQ ID NO: 6916135 - DNA, 22 bp, Homo sapiens
taatgacattgtatccacagag

SEQ ID NO: 6916136 - DNA, 22 bp, Homo sapiens
tgcaggctttagccccatggct

SEQ ID NO: 6916137 - DNA, 22 bp, Homo sapiens
gctggccccgagtgctacgctc

SEQ ID NO: 6916138 - DNA, 22 bp, Homo sapiens
gtgcatatatatgggagggagc

SEQ ID NO: 6916139 - DNA, 22 bp, Homo sapiens
aagagctgcccaaggtgaacag

SEQ ID NO: 6916140 - DNA, 22 bp, Homo sapiens
ggcttagattgacactgatctc

SEQ ID NO: 6916141 - DNA, 22 bp, Homo sapiens
ttctggaggccagctgccacct

SEQ ID NO: 6916142 - DNA, 22 bp, Homo sapiens
agtgtgagattaaaccgaatca

SEQ ID NO: 6916143 - DNA, 22 bp, Homo sapiens
ttgctgatacatagtgggcaaa

SEQ ID NO: 6916144 - DNA, 20 bp, Homo sapiens
ctgccctgccctgggtcctg

SEQ ID NO: 6916145 - DNA, 22 bp, Homo sapiens
aggcaatttggaatctgtactc

SEQ ID NO: 6916146 - DNA, 22 bp, Homo sapiens
caagtccaagatcaagaagcca

SEQ ID NO: 6916147 - DNA, 22 bp, Homo sapiens
tgaaccttcataaaattaagtg

SEQ ID NO: 6916148 - DNA, 19 bp, Homo sapiens
acttcttttcaacacagga

SEQ ID NO: 6916149 - DNA, 22 bp, Homo sapiens
aaggacagaaacagattgctgg

SEQ ID NO: 6916150 - DNA, 22 bp, Homo sapiens
aggaatgtcgtcataaacatga

SEQ ID NO: 6916151 - DNA, 22 bp, Homo sapiens
acagccagaagtcagggtggga

SEQ ID NO: 6916152 - DNA, 22 bp, Homo sapiens
tcccatcaatgtctgcagaaga

SEQ ID NO: 6916153 - DNA, 23 bp, Homo sapiens
tctgtacttagactggggcagaa

SEQ ID NO: 6916154 - DNA, 22 bp, Homo sapiens
cccactgctgcgccgggcgccg

SEQ ID NO: 6916155 - DNA, 22 bp, Homo sapiens
atggactgggaggtcatcttct

SEQ ID NO: 6916156 - DNA, 21 bp, Homo sapiens
gctcagagagggtaattaacc

SEQ ID NO: 6916157 - DNA, 22 bp, Homo sapiens
cacctagcagaacagaggtgct

SEQ ID NO: 6916158 - DNA, 22 bp, Homo sapiens
attatataaaattctggaagct

SEQ ID NO: 6916159 - DNA, 19 bp, Homo sapiens
cttcagtgttcacctggcc

SEQ ID NO: 6916160 - DNA, 22 bp, Homo sapiens
ccaggccaaattcagtcagcag

SEQ ID NO: 6916161 - DNA, 22 bp, Homo sapiens
ggaaatctctactttgtcattt

SEQ ID NO: 6916162 - DNA, 22 bp, Homo sapiens
atcaggtgggttttgaagaaac

SEQ ID NO: 6916163 - DNA, 22 bp, Homo sapiens
ccagaggtgaacaggaggctgt

SEQ ID NO: 6916164 - DNA, 22 bp, Homo sapiens
aagtgtgtcttgggaagggagg

SEQ ID NO: 6916165 - DNA, 22 bp, Homo sapiens
tgacagagacagattgaagctt

SEQ ID NO: 6916166 - DNA, 22 bp, Homo sapiens
aggctggagcaagggggcatat

SEQ ID NO: 6916167 - DNA, 22 bp, Homo sapiens
gcatctaaatcactttaatgta

SEQ ID NO: 6916168 - DNA, 22 bp, Homo sapiens
gcagcccaggtggagtaatcta

SEQ ID NO: 6916169 - DNA, 22 bp, Homo sapiens
gagtttctgatttagtaggtct

SEQ ID NO: 6916170 - DNA, 22 bp, Homo sapiens
agttcacaagcgtaggtgctga

SEQ ID NO: 6916171 - DNA, 22 bp, Homo sapiens
ccagagaaccttgagctgtgag

SEQ ID NO: 6916172 - DNA, 22 bp, Homo sapiens
tcctgggatgcataaaatatgt

SEQ ID NO: 6916173 - DNA, 22 bp, Homo sapiens
gaaggatttcctatcagttttc

SEQ ID NO: 6916174 - DNA, 22 bp, Homo sapiens
tgctggctaatggaaaccagat

SEQ ID NO: 6916175 - DNA, 23 bp, Homo sapiens
tcctcctggatacaaagggaaca

SEQ ID NO: 6916176 - DNA, 22 bp, Homo sapiens
cctgtacattagctgtgaattg

SEQ ID NO: 6916177 - DNA, 22 bp, Homo sapiens
tctgaagaataggatgttgtgt

SEQ ID NO: 6916178 - DNA, 19 bp, Homo sapiens
gctgcagcagagaaactgg

SEQ ID NO: 6916179 - DNA, 22 bp, Homo sapiens
aggctctgtttgctgtggtacc

SEQ ID NO: 6916180 - DNA, 22 bp, Homo sapiens
gtgagcagttgtgagccccaaa

SEQ ID NO: 6916181 - DNA, 22 bp, Homo sapiens
taaagctctgggtttctagatc

SEQ ID NO: 6916182 - DNA, 22 bp, Homo sapiens
cagaataaaggtacaattgagt

SEQ ID NO: 6916183 - DNA, 20 bp, Homo sapiens
aggcacagttcctagttggg

SEQ ID NO: 6916184 - DNA, 22 bp, Homo sapiens
acaattctctcatatcttatta

SEQ ID NO: 6916185 - DNA, 22 bp, Homo sapiens
acttcaaaatgagtttcctggt

SEQ ID NO: 6916186 - DNA, 22 bp, Homo sapiens
tcactagtggaatctgggagca

SEQ ID NO: 6916187 - DNA, 22 bp, Homo sapiens
tcaaagatagatgttgagaaat

SEQ ID NO: 6916188 - DNA, 22 bp, Homo sapiens
ctatggctccttctctactggg

SEQ ID NO: 6916189 - DNA, 20 bp, Homo sapiens
agggctgagaagggactagc

SEQ ID NO: 6916190 - DNA, 22 bp, Homo sapiens
ggcagcatcccatggaccgcat

SEQ ID NO: 6916191 - DNA, 22 bp, Homo sapiens
aacagtcctgtgctctttcatt

SEQ ID NO: 6916192 - DNA, 22 bp, Homo sapiens
ttccattgagtacctggagaca

SEQ ID NO: 6916193 - DNA, 22 bp, Homo sapiens
gccttaattttttataatctct

SEQ ID NO: 6916194 - DNA, 22 bp, Homo sapiens
cgtcccagcagataaatgagga

SEQ ID NO: 6916195 - DNA, 21 bp, Homo sapiens
gtgcatgcgccgctgagatgc

SEQ ID NO: 6916196 - DNA, 22 bp, Homo sapiens
cagggtggcaggcaccatggcc

SEQ ID NO: 6916197 - DNA, 22 bp, Homo sapiens
aagatacttcacttgccgaaat

SEQ ID NO: 6916198 - DNA, 22 bp, Homo sapiens
catcttttcagaagccattctg

SEQ ID NO: 6916199 - DNA, 22 bp, Homo sapiens
gagtttgatagagaggaaccgg

SEQ ID NO: 6916200 - DNA, 22 bp, Homo sapiens
cactgttattactactatacat

SEQ ID NO: 6916201 - DNA, 22 bp, Homo sapiens
tcacccagacagcttgcactga

SEQ ID NO: 6916202 - DNA, 23 bp, Homo sapiens
agcacgggtacagcctggccagg

SEQ ID NO: 6916203 - DNA, 22 bp, Homo sapiens
aatgccatccctctgtcaccaa

SEQ ID NO: 6916204 - DNA, 22 bp, Homo sapiens
ttcaaatcagaccgaaggcaac

SEQ ID NO: 6916205 - DNA, 22 bp, Homo sapiens
cctcctgggactcattagcacc

SEQ ID NO: 6916206 - DNA, 22 bp, Homo sapiens
tgcctgaggagtcagggcaggt

SEQ ID NO: 6916207 - DNA, 22 bp, Homo sapiens
taagataataccatgggccagg

SEQ ID NO: 6916208 - DNA, 20 bp, Homo sapiens
acactgtgctaaggattttc

SEQ ID NO: 6916209 - DNA, 22 bp, Homo sapiens
aactgactcccatgattaggtc

SEQ ID NO: 6916210 - DNA, 22 bp, Homo sapiens
cttcctgggcaatgttctgctt

SEQ ID NO: 6916211 - DNA, 22 bp, Homo sapiens
tatttgatagagataaatgata

SEQ ID NO: 6916212 - DNA, 22 bp, Homo sapiens
catttggaaagagactagagaa

SEQ ID NO: 6916213 - DNA, 22 bp, Homo sapiens
gccagccccttagggctctccc

SEQ ID NO: 6916214 - DNA, 22 bp, Homo sapiens
cccaggctggtcctgaactcct

SEQ ID NO: 6916215 - DNA, 22 bp, Homo sapiens
actgggcctggattggcgtgtc

SEQ ID NO: 6916216 - DNA, 22 bp, Homo sapiens
ttggtcatcatgaaggatttta

SEQ ID NO: 6916217 - DNA, 22 bp, Homo sapiens
atggcagaagtcaagatgagtt

SEQ ID NO: 6916218 - DNA, 22 bp, Homo sapiens
gtcgccatgacaacaccagccg

SEQ ID NO: 6916219 - DNA, 22 bp, Homo sapiens
agtcttaactatgcaagtacta

SEQ ID NO: 6916220 - DNA, 22 bp, Homo sapiens
acatgtgttttcctacttatga

SEQ ID NO: 6916221 - DNA, 22 bp, Homo sapiens
acatgcaactaaagggtgccac

SEQ ID NO: 6916222 - DNA, 22 bp, Homo sapiens
aaagcctgggttcctcactatc

SEQ ID NO: 6916223 - DNA, 20 bp, Homo sapiens
ggtcagccccacctggcagc

SEQ ID NO: 6916224 - DNA, 22 bp, Homo sapiens
agatttactggagtctttggtg

SEQ ID NO: 6916225 - DNA, 22 bp, Homo sapiens
ccatgtgcttgctctggcacct

SEQ ID NO: 6916226 - DNA, 22 bp, Homo sapiens
gtgtttataggagtgaatgctg

SEQ ID NO: 6916227 - DNA, 22 bp, Homo sapiens
tgtcaccacatttgtcaatatc

SEQ ID NO: 6916228 - DNA, 22 bp, Homo sapiens
cagaggggctgacacccttggc

SEQ ID NO: 6916229 - DNA, 22 bp, Homo sapiens
agcaagctgtcaagagagctga

SEQ ID NO: 6916230 - DNA, 22 bp, Homo sapiens
aagcatcctatatgtaaactgt

SEQ ID NO: 6916231 - DNA, 22 bp, Homo sapiens
atggctttccggactttggcca

SEQ ID NO: 6916232 - DNA, 22 bp, Homo sapiens
ttaaggctgtaagatacattca

SEQ ID NO: 6916233 - DNA, 22 bp, Homo sapiens
catggccagggagagagaatgt

SEQ ID NO: 6916234 - DNA, 22 bp, Homo sapiens
tcggggcgcacctgccctttca

SEQ ID NO: 6916235 - DNA, 22 bp, Homo sapiens
caagaattgtacaaactgggtg

SEQ ID NO: 6916236 - DNA, 22 bp, Homo sapiens
ggtgcatggggagcactctcag

SEQ ID NO: 6916237 - DNA, 22 bp, Homo sapiens
tccaggcagttttccaggttgt

SEQ ID NO: 6916238 - DNA, 22 bp, Homo sapiens
ttctcttcatctcagtaaatgt

SEQ ID NO: 6916239 - DNA, 23 bp, Homo sapiens
cagaggtgtcagtgcccagtgtc

SEQ ID NO: 6916240 - DNA, 22 bp, Homo sapiens
taaacaagaaacattttctgtt

SEQ ID NO: 6916241 - DNA, 22 bp, Homo sapiens
tgtgtcaatttatgtcattcat

SEQ ID NO: 6916242 - DNA, 22 bp, Homo sapiens
ccactggtgccatcttggttct

SEQ ID NO: 6916243 - DNA, 22 bp, Homo sapiens
agagcctggacctgggctctga

SEQ ID NO: 6916244 - DNA, 22 bp, Homo sapiens
gctctgtgctactttgaactct

SEQ ID NO: 6916245 - DNA, 22 bp, Homo sapiens
gctcagaaatggcagatggaga

SEQ ID NO: 6916246 - DNA, 22 bp, Homo sapiens
aggctgagataggtggatcatt

SEQ ID NO: 6916247 - DNA, 22 bp, Homo sapiens
atctagcaccaaactagctttt

SEQ ID NO: 6916248 - DNA, 22 bp, Homo sapiens
cagctacacgtgcccctggggt

SEQ ID NO: 6916249 - DNA, 22 bp, Homo sapiens
tgatggcttttaggcttttaag

SEQ ID NO: 6916250 - DNA, 22 bp, Homo sapiens
gcataggcactttcctcctcct

SEQ ID NO: 6916251 - DNA, 22 bp, Homo sapiens
tccatgatttgagcacatgccg

SEQ ID NO: 6916252 - DNA, 22 bp, Homo sapiens
atgtgtgcatcaatgatagatc

SEQ ID NO: 6916253 - DNA, 22 bp, Homo sapiens
ctgcagggaccacaagcaggtt

SEQ ID NO: 6916254 - DNA, 22 bp, Homo sapiens
aagaagcatggctgtagattcc

SEQ ID NO: 6916255 - DNA, 22 bp, Homo sapiens
ttgcatggaggaacatggccca

SEQ ID NO: 6916256 - DNA, 22 bp, Homo sapiens
tcttggtcttctactcatcagc

SEQ ID NO: 6916257 - DNA, 22 bp, Homo sapiens
ggctgggccagggcctgtggac

SEQ ID NO: 6916258 - DNA, 22 bp, Homo sapiens
gtgtaaacaatgaaaacagagc

SEQ ID NO: 6916259 - DNA, 20 bp, Homo sapiens
agaccctctggactgggccc

SEQ ID NO: 6916260 - DNA, 22 bp, Homo sapiens
ggagggctgtagaggagacctg

SEQ ID NO: 6916261 - DNA, 22 bp, Homo sapiens
cctgccagatcccctgagctga

SEQ ID NO: 6916262 - DNA, 22 bp, Homo sapiens
agcgtttataagaagccagggc

SEQ ID NO: 6916263 - DNA, 22 bp, Homo sapiens
tgagttctttgcaaataacaag

SEQ ID NO: 6916264 - DNA, 21 bp, Homo sapiens
aggtgcagagccagggaccag

SEQ ID NO: 6916265 - DNA, 22 bp, Homo sapiens
taacagcatatgaaattactgg

SEQ ID NO: 6916266 - DNA, 21 bp, Homo sapiens
ggccctggttacgcctcctct

SEQ ID NO: 6916267 - DNA, 22 bp, Homo sapiens
aaggtagcttgcttcctgagta

SEQ ID NO: 6916268 - DNA, 22 bp, Homo sapiens
tctcaggaaataggatttgagt

SEQ ID NO: 6916269 - DNA, 22 bp, Homo sapiens
agctctgggattctcaggccac

SEQ ID NO: 6916270 - DNA, 22 bp, Homo sapiens
tgtcccagtcaaggctgtcatc

SEQ ID NO: 6916271 - DNA, 22 bp, Homo sapiens
gagctcctatggtcggtggctc

SEQ ID NO: 6916272 - DNA, 22 bp, Homo sapiens
tttgggctgtacaatttctgta

SEQ ID NO: 6916273 - DNA, 21 bp, Homo sapiens
ttactaaacaaaacatgcagg

SEQ ID NO: 6916274 - DNA, 22 bp, Homo sapiens
agcctgggtgggggttcggaga

SEQ ID NO: 6916275 - DNA, 22 bp, Homo sapiens
ccagggtcttggagaggagtgc

SEQ ID NO: 6916276 - DNA, 22 bp, Homo sapiens
ttgcacctcatttcatttgggc

SEQ ID NO: 6916277 - DNA, 22 bp, Homo sapiens
cagtgcccaaaggaacagaaag

SEQ ID NO: 6916278 - DNA, 22 bp, Homo sapiens
taagagactattgagcatcttg

SEQ ID NO: 6916279 - DNA, 22 bp, Homo sapiens
tggggaaaagcgttaggagttc

SEQ ID NO: 6916280 - DNA, 22 bp, Homo sapiens
ggtgtcagtgaaggtagagttt

SEQ ID NO: 6916281 - DNA, 22 bp, Homo sapiens
attcacctttccccaaaatgag

SEQ ID NO: 6916282 - DNA, 22 bp, Homo sapiens
ggagaccagaaggaagcttcga

SEQ ID NO: 6916283 - DNA, 20 bp, Homo sapiens
tcagccttctcatcctgggg

SEQ ID NO: 6916284 - DNA, 22 bp, Homo sapiens
gcagctgtcggaaagctaagtg

SEQ ID NO: 6916285 - DNA, 22 bp, Homo sapiens
cattatgaatggagtttgaggt

SEQ ID NO: 6916286 - DNA, 23 bp, Homo sapiens
agagcctgaaagacttctggcac

SEQ ID NO: 6916287 - DNA, 22 bp, Homo sapiens
cctctggcaagtgatttatcat

SEQ ID NO: 6916288 - DNA, 22 bp, Homo sapiens
agactgtttgggttccaaatct

SEQ ID NO: 6916289 - DNA, 22 bp, Homo sapiens
ctctgtgctcccatgctagtaa

SEQ ID NO: 6916290 - DNA, 22 bp, Homo sapiens
ccagtgattcctagtaatataa

SEQ ID NO: 6916291 - DNA, 22 bp, Homo sapiens
actggctttgcctctgcctctc

SEQ ID NO: 6916292 - DNA, 22 bp, Homo sapiens
tcagatgctgttttcttatata

SEQ ID NO: 6916293 - DNA, 22 bp, Homo sapiens
agtgtattctgcatgggagact

SEQ ID NO: 6916294 - DNA, 20 bp, Homo sapiens
agctcctggactagagagtg

SEQ ID NO: 6916295 - DNA, 22 bp, Homo sapiens
atatagtttaggttcgaatggg

SEQ ID NO: 6916296 - DNA, 22 bp, Homo sapiens
tcagactgacggccgaggcaag

SEQ ID NO: 6916297 - DNA, 22 bp, Homo sapiens
tgggaaatgtgtttctggacca

SEQ ID NO: 6916298 - DNA, 22 bp, Homo sapiens
ttaacactgattgtagagacac

SEQ ID NO: 6916299 - DNA, 19 bp, Homo sapiens
cactaagatgagatatagc

SEQ ID NO: 6916300 - DNA, 22 bp, Homo sapiens
aaagggtcagattctgctagtg

SEQ ID NO: 6916301 - DNA, 22 bp, Homo sapiens
aataatgtaggatgataaatga

SEQ ID NO: 6916302 - DNA, 22 bp, Homo sapiens
tttaattagcaagccagagagc

SEQ ID NO: 6916303 - DNA, 22 bp, Homo sapiens
gaggaggggcacttgtctccta

SEQ ID NO: 6916304 - DNA, 22 bp, Homo sapiens
acagaacagagggttttagaat

SEQ ID NO: 6916305 - DNA, 21 bp, Homo sapiens
gcaaccagaccacagggcagt

SEQ ID NO: 6916306 - DNA, 22 bp, Homo sapiens
tcagctctctgggctcgaacct

SEQ ID NO: 6916307 - DNA, 22 bp, Homo sapiens
tggtgccattagccctgctgtt

SEQ ID NO: 6916308 - DNA, 22 bp, Homo sapiens
gggtcatagttattttgcaaga

SEQ ID NO: 6916309 - DNA, 22 bp, Homo sapiens
agttatctgttagtattccagg

SEQ ID NO: 6916310 - DNA, 22 bp, Homo sapiens
acaaggttctatggcgtctgtg

SEQ ID NO: 6916311 - DNA, 22 bp, Homo sapiens
tgggttgtcctctttctgttaa

SEQ ID NO: 6916312 - DNA, 22 bp, Homo sapiens
aaagtggtttatgatattccaa

SEQ ID NO: 6916313 - DNA, 20 bp, Homo sapiens
tctgggagggacaagtctcc

SEQ ID NO: 6916314 - DNA, 16 bp, Homo sapiens
ggtctggaggatgtct

SEQ ID NO: 6916315 - DNA, 22 bp, Homo sapiens
gccagctctcattgtataggct

SEQ ID NO: 6916316 - DNA, 22 bp, Homo sapiens
ggaacattctagagtgttgtga

SEQ ID NO: 6916317 - DNA, 22 bp, Homo sapiens
cccaggagacctgtgaaaggac

SEQ ID NO: 6916318 - DNA, 22 bp, Homo sapiens
atactacaatcataattgtaca

SEQ ID NO: 6916319 - DNA, 22 bp, Homo sapiens
tggaagcagtgattcttgtctg

SEQ ID NO: 6916320 - DNA, 22 bp, Homo sapiens
atgtaggattgagtgatagagg

SEQ ID NO: 6916321 - DNA, 22 bp, Homo sapiens
tcaaaggaaacacaagcttctg

SEQ ID NO: 6916322 - DNA, 22 bp, Homo sapiens
ctggagctccagggtctcctct

SEQ ID NO: 6916323 - DNA, 22 bp, Homo sapiens
tagttagagatgaattttgtct

SEQ ID NO: 6916324 - DNA, 23 bp, Homo sapiens
atgaggcattaaacaggcttttt

SEQ ID NO: 6916325 - DNA, 22 bp, Homo sapiens
tgccagctcagagttaggactg

SEQ ID NO: 6916326 - DNA, 22 bp, Homo sapiens
catacccatttgtttcaggagc

SEQ ID NO: 6916327 - DNA, 22 bp, Homo sapiens
gaacacagtttagaaaatgctg

SEQ ID NO: 6916328 - DNA, 21 bp, Homo sapiens
cagggccaatcctgacctcta

SEQ ID NO: 6916329 - DNA, 22 bp, Homo sapiens
ctgtgccttagtattctcattt

SEQ ID NO: 6916330 - DNA, 22 bp, Homo sapiens
atataatacaacctgctaagtg

SEQ ID NO: 6916331 - DNA, 22 bp, Homo sapiens
ccagtgtggccaggtgctggta

SEQ ID NO: 6916332 - DNA, 22 bp, Homo sapiens
cagctcacccatcacgtctgct

SEQ ID NO: 6916333 - DNA, 22 bp, Homo sapiens
attgaaagcacaaagaacaagt

SEQ ID NO: 6916334 - DNA, 22 bp, Homo sapiens
gggacacaggtatctcaaatga

SEQ ID NO: 6916335 - DNA, 21 bp, Homo sapiens
ggcctcctacagtcatgggcc

SEQ ID NO: 6916336 - DNA, 22 bp, Homo sapiens
ggcacacaaaggcagcatttga

SEQ ID NO: 6916337 - DNA, 22 bp, Homo sapiens
cagatttgccacttactcgttg

SEQ ID NO: 6916338 - DNA, 22 bp, Homo sapiens
caccatctagcagagagatgga

SEQ ID NO: 6916339 - DNA, 22 bp, Homo sapiens
catgtacattctgtagatggag

SEQ ID NO: 6916340 - DNA, 17 bp, Homo sapiens
cagtttcttccccctct

SEQ ID NO: 6916341 - DNA, 22 bp, Homo sapiens
tattggaaggaagcaagagagg

SEQ ID NO: 6916342 - DNA, 22 bp, Homo sapiens
gcaggcctttatccctgcctca

SEQ ID NO: 6916343 - DNA, 22 bp, Homo sapiens
tctccctctgtaagatcagggg

SEQ ID NO: 6916344 - DNA, 22 bp, Homo sapiens
ttcttacatattttcatatggt

SEQ ID NO: 6916345 - DNA, 21 bp, Homo sapiens
tcataaactagtatcaaagtt

SEQ ID NO: 6916346 - DNA, 22 bp, Homo sapiens
cttattgtgaggtattgagatt

SEQ ID NO: 6916347 - DNA, 22 bp, Homo sapiens
tgggcagatgtcctctgaagtg

SEQ ID NO: 6916348 - DNA, 22 bp, Homo sapiens
tgctgcacagattgccttttac

SEQ ID NO: 6916349 - DNA, 22 bp, Homo sapiens
ctggaagggagcactgtagaga

SEQ ID NO: 6916350 - DNA, 19 bp, Homo sapiens
ccttgcctgtccctgcagc

SEQ ID NO: 6916351 - DNA, 22 bp, Homo sapiens
acttatagtttctctgactcat

SEQ ID NO: 6916352 - DNA, 22 bp, Homo sapiens
ctggaactcaggatggttagga

SEQ ID NO: 6916353 - DNA, 22 bp, Homo sapiens
atgaggctatttcatagatttt

SEQ ID NO: 6916354 - DNA, 22 bp, Homo sapiens
tctttcaatccattcatatgtc

SEQ ID NO: 6916355 - DNA, 22 bp, Homo sapiens
cagcacagtttcccccatgagc

SEQ ID NO: 6916356 - DNA, 22 bp, Homo sapiens
tctcaagttttctcataatctc

SEQ ID NO: 6916357 - DNA, 22 bp, Homo sapiens
gagctcatccccatggtccgtc

SEQ ID NO: 6916358 - DNA, 22 bp, Homo sapiens
taaggaagagcttggtaatagg

SEQ ID NO: 6916359 - DNA, 22 bp, Homo sapiens
gaattaactggcagttagtgct

SEQ ID NO: 6916360 - DNA, 22 bp, Homo sapiens
tctctgagcttaaggtgtttca

SEQ ID NO: 6916361 - DNA, 22 bp, Homo sapiens
gacacagctttctgaagagcat

SEQ ID NO: 6916362 - DNA, 22 bp, Homo sapiens
tttcctctttgtaccttgacta

SEQ ID NO: 6916363 - DNA, 22 bp, Homo sapiens
aaaaggaggtcactttattcct

SEQ ID NO: 6916364 - DNA, 22 bp, Homo sapiens
ggcaggcaatgaggatgggaag

SEQ ID NO: 6916365 - DNA, 22 bp, Homo sapiens
aggctagttcctgtgcatccag

SEQ ID NO: 6916366 - DNA, 22 bp, Homo sapiens
cagcccactgcctctgtggtag

SEQ ID NO: 6916367 - DNA, 22 bp, Homo sapiens
tgaagcgtgacccctcacctct

SEQ ID NO: 6916368 - DNA, 22 bp, Homo sapiens
tggcctgcattggctttggtgt

SEQ ID NO: 6916369 - DNA, 22 bp, Homo sapiens
atagtttaccttccagatggct

SEQ ID NO: 6916370 - DNA, 22 bp, Homo sapiens
tacagagtatttttaatatggt

SEQ ID NO: 6916371 - DNA, 22 bp, Homo sapiens
agtgctgtcagttttatagata

SEQ ID NO: 6916372 - DNA, 22 bp, Homo sapiens
ttagaaccagcatttgtcctgg

SEQ ID NO: 6916373 - DNA, 22 bp, Homo sapiens
caggcctttgcagggagagaga

SEQ ID NO: 6916374 - DNA, 22 bp, Homo sapiens
catggaggccaggaaacagcct

SEQ ID NO: 6916375 - DNA, 22 bp, Homo sapiens
cagtcctctgcaacaccccttc

SEQ ID NO: 6916376 - DNA, 22 bp, Homo sapiens
atcatttgtgcatagtaacaga

SEQ ID NO: 6916377 - DNA, 22 bp, Homo sapiens
cagttctggaggctccacatct

SEQ ID NO: 6916378 - DNA, 22 bp, Homo sapiens
tgctgcacaattggaaagtatc

SEQ ID NO: 6916379 - DNA, 22 bp, Homo sapiens
ctagggaatgagagactggatc

SEQ ID NO: 6916380 - DNA, 21 bp, Homo sapiens
cctggactgggagcagcactg

SEQ ID NO: 6916381 - DNA, 22 bp, Homo sapiens
agaggaagattttattaaccag

SEQ ID NO: 6916382 - DNA, 22 bp, Homo sapiens
tggaggtaggacgaagaactct

SEQ ID NO: 6916383 - DNA, 22 bp, Homo sapiens
gggagagaattattgccagacc

SEQ ID NO: 6916384 - DNA, 23 bp, Homo sapiens
tccagggcagtggctgggtctgc

SEQ ID NO: 6916385 - DNA, 22 bp, Homo sapiens
tgttatactatttagaggtaca

SEQ ID NO: 6916386 - DNA, 22 bp, Homo sapiens
tggaaaacattgagataccaag

SEQ ID NO: 6916387 - DNA, 22 bp, Homo sapiens
ggctacagggcctggccaaggt

SEQ ID NO: 6916388 - DNA, 22 bp, Homo sapiens
ctaggaaagacacagagagttt

SEQ ID NO: 6916389 - DNA, 22 bp, Homo sapiens
cctgtgcaatgttgaggtttca

SEQ ID NO: 6916390 - DNA, 22 bp, Homo sapiens
cacacagctagtgacaggagaa

SEQ ID NO: 6916391 - DNA, 23 bp, Homo sapiens
aagcaatgctgagccagttctga

SEQ ID NO: 6916392 - DNA, 22 bp, Homo sapiens
tgtggcctgggaaatgagtgtt

SEQ ID NO: 6916393 - DNA, 22 bp, Homo sapiens
ttctccttgaaaagctgcatct

SEQ ID NO: 6916394 - DNA, 22 bp, Homo sapiens
taagtcatgattctgtgttact

SEQ ID NO: 6916395 - DNA, 22 bp, Homo sapiens
tgtgtgacacattgatatgtgc

SEQ ID NO: 6916396 - DNA, 22 bp, Homo sapiens
gcaacaggcagtttgctcatgt

SEQ ID NO: 6916397 - DNA, 22 bp, Homo sapiens
cttcactgagtagtctagactc

SEQ ID NO: 6916398 - DNA, 22 bp, Homo sapiens
gtctacactgaatttccacaga

SEQ ID NO: 6916399 - DNA, 22 bp, Homo sapiens
ggcttaataaataacatgtcat

SEQ ID NO: 6916400 - DNA, 22 bp, Homo sapiens
gcccacagaggcaccaccaggc

SEQ ID NO: 6916401 - DNA, 22 bp, Homo sapiens
ggggggacgcagtcgctgccta

SEQ ID NO: 6916402 - DNA, 22 bp, Homo sapiens
tagcaagaagctgtcacaggtg

SEQ ID NO: 6916403 - DNA, 22 bp, Homo sapiens
ttttatagctgaatagtattcc

SEQ ID NO: 6916404 - DNA, 22 bp, Homo sapiens
ggggaagaaatctgggttcttc

SEQ ID NO: 6916405 - DNA, 22 bp, Homo sapiens
tacacatgatcatttagtagca

SEQ ID NO: 6916406 - DNA, 22 bp, Homo sapiens
gctgaagtaactcacatcgtta

SEQ ID NO: 6916407 - DNA, 22 bp, Homo sapiens
ttacatgtactggtttgactta

SEQ ID NO: 6916408 - DNA, 22 bp, Homo sapiens
cctgcagagccacgtgccagcg

SEQ ID NO: 6916409 - DNA, 22 bp, Homo sapiens
ggagcagagctcttcatctgca

SEQ ID NO: 6916410 - DNA, 22 bp, Homo sapiens
ttgactttatgtcaacttgcct

SEQ ID NO: 6916411 - DNA, 22 bp, Homo sapiens
tcaatagcatagcaattaatgt

SEQ ID NO: 6916412 - DNA, 22 bp, Homo sapiens
cctctgtgtgatgcgcaaagta

SEQ ID NO: 6916413 - DNA, 22 bp, Homo sapiens
tgggcccaggtcctgggagaag

SEQ ID NO: 6916414 - DNA, 22 bp, Homo sapiens
tagcatatggagggtaagaggg

SEQ ID NO: 6916415 - DNA, 22 bp, Homo sapiens
ggtacagacagggctgcctggg

SEQ ID NO: 6916416 - DNA, 22 bp, Homo sapiens
tctttatgagaaaaagattgta

SEQ ID NO: 6916417 - DNA, 22 bp, Homo sapiens
attaaaagagataatgtgtgtt

SEQ ID NO: 6916418 - DNA, 22 bp, Homo sapiens
ttctggagacccagcaacaggg

SEQ ID NO: 6916419 - DNA, 22 bp, Homo sapiens
tcagatttcctgttgaagaagt

SEQ ID NO: 6916420 - DNA, 22 bp, Homo sapiens
tggtccagtaagggtggagaga

SEQ ID NO: 6916421 - DNA, 22 bp, Homo sapiens
gattgcccagaatattctcatt

SEQ ID NO: 6916422 - DNA, 21 bp, Homo sapiens
tgggacagtgatggctcctcc

SEQ ID NO: 6916423 - DNA, 22 bp, Homo sapiens
catctacatgcttgccactgct

SEQ ID NO: 6916424 - DNA, 22 bp, Homo sapiens
actgattaaaaacagacattta

SEQ ID NO: 6916425 - DNA, 20 bp, Homo sapiens
tcaagttttgcttgacaaga

SEQ ID NO: 6916426 - DNA, 22 bp, Homo sapiens
gataatccaagattgcctcact

SEQ ID NO: 6916427 - DNA, 22 bp, Homo sapiens
tggctctgatcagatgtccagt

SEQ ID NO: 6916428 - DNA, 22 bp, Homo sapiens
tgacagcttggacaggtccctc

SEQ ID NO: 6916429 - DNA, 21 bp, Homo sapiens
gactgcaagcgaggctgtgaa

SEQ ID NO: 6916430 - DNA, 22 bp, Homo sapiens
ttaataaagtatgaattggaaa

SEQ ID NO: 6916431 - DNA, 22 bp, Homo sapiens
tcttattgtctagattgagatg

SEQ ID NO: 6916432 - DNA, 22 bp, Homo sapiens
gtgctaattgtttcaatcccct

SEQ ID NO: 6916433 - DNA, 22 bp, Homo sapiens
ataagcttgatgtaactaacca

SEQ ID NO: 6916434 - DNA, 22 bp, Homo sapiens
agcagctgtggaaaagtaacta

SEQ ID NO: 6916435 - DNA, 22 bp, Homo sapiens
ttgcctgtgtcagcaggtggaa

SEQ ID NO: 6916436 - DNA, 19 bp, Homo sapiens
agggtccagggagcggctc

SEQ ID NO: 6916437 - DNA, 21 bp, Homo sapiens
tacatgaagctggtgtttgtc

SEQ ID NO: 6916438 - DNA, 22 bp, Homo sapiens
cttgagagggagtagtttagga

SEQ ID NO: 6916439 - DNA, 22 bp, Homo sapiens
tgctgagtggcggcctcacttt

SEQ ID NO: 6916440 - DNA, 22 bp, Homo sapiens
ctgcccaggctgaaggaacatc

SEQ ID NO: 6916441 - DNA, 22 bp, Homo sapiens
tctcttcccctttcctttaaca

SEQ ID NO: 6916442 - DNA, 22 bp, Homo sapiens
catgcactgatgcaaggtctgc

SEQ ID NO: 6916443 - DNA, 22 bp, Homo sapiens
tttatctttaggactttgcaga

SEQ ID NO: 6916444 - DNA, 22 bp, Homo sapiens
aggctgagccacggggctggct

SEQ ID NO: 6916445 - DNA, 22 bp, Homo sapiens
ggtcataatggatttgctgttc

SEQ ID NO: 6916446 - DNA, 22 bp, Homo sapiens
atgatgttggtttaatttgagt

SEQ ID NO: 6916447 - DNA, 22 bp, Homo sapiens
tgcagtggaaagactcagactt

SEQ ID NO: 6916448 - DNA, 22 bp, Homo sapiens
ttctgggcatgttacattctgt

SEQ ID NO: 6916449 - DNA, 22 bp, Homo sapiens
gctggcggcagtggtgtctctg

SEQ ID NO: 6916450 - DNA, 22 bp, Homo sapiens
gtctccttgtggatctcaagga

SEQ ID NO: 6916451 - DNA, 22 bp, Homo sapiens
agtcattacagcaggcagaagg

SEQ ID NO: 6916452 - DNA, 22 bp, Homo sapiens
gctcagagcagatggtactcag

SEQ ID NO: 6916453 - DNA, 22 bp, Homo sapiens
tttaatgttcatctcaaaggat

SEQ ID NO: 6916454 - DNA, 22 bp, Homo sapiens
atggtaacagttgagtagaaac

SEQ ID NO: 6916455 - DNA, 22 bp, Homo sapiens
ccagggaaattaatgagttaat

SEQ ID NO: 6916456 - DNA, 22 bp, Homo sapiens
tttgatgctaagatttaataaa

SEQ ID NO: 6916457 - DNA, 22 bp, Homo sapiens
tcagtgtagggcagacccctgg

SEQ ID NO: 6916458 - DNA, 22 bp, Homo sapiens
gtcaacttatctctttatctgt

SEQ ID NO: 6916459 - DNA, 22 bp, Homo sapiens
agtggtcaaagactagatttca

SEQ ID NO: 6916460 - DNA, 22 bp, Homo sapiens
cttattcagaaggagaaatgga

SEQ ID NO: 6916461 - DNA, 22 bp, Homo sapiens
ttgcagggttgaccaataggct

SEQ ID NO: 6916462 - DNA, 22 bp, Homo sapiens
tttgtctataaattactactgc

SEQ ID NO: 6916463 - DNA, 22 bp, Homo sapiens
atctgttattgaataggtgcta

SEQ ID NO: 6916464 - DNA, 22 bp, Homo sapiens
gactgcataggaccaaatagta

SEQ ID NO: 6916465 - DNA, 22 bp, Homo sapiens
gtctgggattggggtaaagaag

SEQ ID NO: 6916466 - DNA, 22 bp, Homo sapiens
aaagtacagatggtgaggttgg

SEQ ID NO: 6916467 - DNA, 22 bp, Homo sapiens
tgtaatggaaaaacattagcat

SEQ ID NO: 6916468 - DNA, 20 bp, Homo sapiens
ctttggtgggggtagcccag

SEQ ID NO: 6916469 - DNA, 22 bp, Homo sapiens
tgtctgaaacttatgatatact

SEQ ID NO: 6916470 - DNA, 22 bp, Homo sapiens
gaggaagaatcagggtggtgag

SEQ ID NO: 6916471 - DNA, 22 bp, Homo sapiens
gatggggatgagaagtgagcag

SEQ ID NO: 6916472 - DNA, 22 bp, Homo sapiens
tgacatttaattaacgaatgct

SEQ ID NO: 6916473 - DNA, 22 bp, Homo sapiens
ctctgaccattcccttgatttt

SEQ ID NO: 6916474 - DNA, 22 bp, Homo sapiens
tctcagggtgaggaaagaattt

SEQ ID NO: 6916475 - DNA, 22 bp, Homo sapiens
tgtaacaagtgcttactttggg

SEQ ID NO: 6916476 - DNA, 22 bp, Homo sapiens
tgagaggagtgattgtaaaatt

SEQ ID NO: 6916477 - DNA, 22 bp, Homo sapiens
tcagttaagactgcactggact

SEQ ID NO: 6916478 - DNA, 21 bp, Homo sapiens
aggcatgagccctgcatggac

SEQ ID NO: 6916479 - DNA, 22 bp, Homo sapiens
ccctgcagatctagggtccttc

SEQ ID NO: 6916480 - DNA, 22 bp, Homo sapiens
actgggacagtcagaaacatga

SEQ ID NO: 6916481 - DNA, 22 bp, Homo sapiens
gtcactcaggctggagttcagt

SEQ ID NO: 6916482 - DNA, 22 bp, Homo sapiens
caggcacagttccaagcatttt

SEQ ID NO: 6916483 - DNA, 22 bp, Homo sapiens
ttacatgacaaagctttggctc

SEQ ID NO: 6916484 - DNA, 23 bp, Homo sapiens
aattatctatttcaaatttagca

SEQ ID NO: 6916485 - DNA, 22 bp, Homo sapiens
ataaatgattcagcaggaaata

SEQ ID NO: 6916486 - DNA, 22 bp, Homo sapiens
gaagtgtaccttcctttccagc

SEQ ID NO: 6916487 - DNA, 21 bp, Homo sapiens
ctttggtatttcactcacata

SEQ ID NO: 6916488 - DNA, 22 bp, Homo sapiens
tgtatacaggcataagagatac

SEQ ID NO: 6916489 - DNA, 23 bp, Homo sapiens
cagggaggagatactgtgtatct

SEQ ID NO: 6916490 - DNA, 22 bp, Homo sapiens
ctgtgacagtttctcagacttt

SEQ ID NO: 6916491 - DNA, 22 bp, Homo sapiens
cctctgagtcatgcgcatagga

SEQ ID NO: 6916492 - DNA, 22 bp, Homo sapiens
ggaagtcctggccatctgccgg

SEQ ID NO: 6916493 - DNA, 22 bp, Homo sapiens
ttgggctttaattccagagagg

SEQ ID NO: 6916494 - DNA, 22 bp, Homo sapiens
catgtgtatgcattcatacata

SEQ ID NO: 6916495 - DNA, 22 bp, Homo sapiens
ctgaatgcttgtgtccccccag

SEQ ID NO: 6916496 - DNA, 22 bp, Homo sapiens
gaccttccatgccttcttccaa

SEQ ID NO: 6916497 - DNA, 22 bp, Homo sapiens
tgctgaggactaaaggagatga

SEQ ID NO: 6916498 - DNA, 22 bp, Homo sapiens
tgaattcttttagaattcagtg

SEQ ID NO: 6916499 - DNA, 22 bp, Homo sapiens
gctttctgtaggtagttactgt

SEQ ID NO: 6916500 - DNA, 22 bp, Homo sapiens
gtctatgtaaacgtctacatta

SEQ ID NO: 6916501 - DNA, 23 bp, Homo sapiens
gcattgaacaaaagaggggagta

SEQ ID NO: 6916502 - DNA, 22 bp, Homo sapiens
tatgcataattggataagtaga

SEQ ID NO: 6916503 - DNA, 22 bp, Homo sapiens
tgcattggaaaactatggctca

SEQ ID NO: 6916504 - DNA, 22 bp, Homo sapiens
aagccaggagcgaggcctcggc

SEQ ID NO: 6916505 - DNA, 22 bp, Homo sapiens
attgctggctgccatcttgccc

SEQ ID NO: 6916506 - DNA, 22 bp, Homo sapiens
ccaggctggtctgaatttctag

SEQ ID NO: 6916507 - DNA, 22 bp, Homo sapiens
atagcatggccaggaagctggg

SEQ ID NO: 6916508 - DNA, 22 bp, Homo sapiens
agatattaggaggattcataat

SEQ ID NO: 6916509 - DNA, 22 bp, Homo sapiens
cctcccttttggtgtctgcata

SEQ ID NO: 6916510 - DNA, 22 bp, Homo sapiens
tttgcagtttcattgctgaaat

SEQ ID NO: 6916511 - DNA, 22 bp, Homo sapiens
aaagcaatctagttccaattct

SEQ ID NO: 6916512 - DNA, 22 bp, Homo sapiens
ctcactgaggcatcccattact

SEQ ID NO: 6916513 - DNA, 22 bp, Homo sapiens
aatctgtattgttaacaagtaa

SEQ ID NO: 6916514 - DNA, 22 bp, Homo sapiens
tttgtgcagatgtatatttgtg

SEQ ID NO: 6916515 - DNA, 22 bp, Homo sapiens
tctgcacctttcttaaaaatcg

SEQ ID NO: 6916516 - DNA, 22 bp, Homo sapiens
aacaataactagacatgccatg

SEQ ID NO: 6916517 - DNA, 20 bp, Homo sapiens
aaattgtgtttgtgagctcc

SEQ ID NO: 6916518 - DNA, 23 bp, Homo sapiens
aaatggtccttggctggcatctt

SEQ ID NO: 6916519 - DNA, 22 bp, Homo sapiens
atccctggctaattttttgtgt

SEQ ID NO: 6916520 - DNA, 22 bp, Homo sapiens
ttttattgggagtcctctactg

SEQ ID NO: 6916521 - DNA, 19 bp, Homo sapiens
ttgcattgtagttggactg

SEQ ID NO: 6916522 - DNA, 22 bp, Homo sapiens
gtgacatatgcacacctttatt

SEQ ID NO: 6916523 - DNA, 22 bp, Homo sapiens
gtacaagtaagaaaattgccca

SEQ ID NO: 6916524 - DNA, 22 bp, Homo sapiens
gagtaagagctggctttggtgt

SEQ ID NO: 6916525 - DNA, 22 bp, Homo sapiens
agtttacacttttgattcttat

SEQ ID NO: 6916526 - DNA, 22 bp, Homo sapiens
gctgaagaccccagctccccag

SEQ ID NO: 6916527 - DNA, 22 bp, Homo sapiens
agctgcctccctgtgcttgtcc

SEQ ID NO: 6916528 - DNA, 22 bp, Homo sapiens
tagttctagccagtgaaatgta

SEQ ID NO: 6916529 - DNA, 22 bp, Homo sapiens
tggcttcattctcctgtgaata

SEQ ID NO: 6916530 - DNA, 22 bp, Homo sapiens
ttgtttcttcaggcttttagga

SEQ ID NO: 6916531 - DNA, 22 bp, Homo sapiens
ctgtatcagactctgcttgagg

SEQ ID NO: 6916532 - DNA, 22 bp, Homo sapiens
tgtaccagatggaaaacgtgag

SEQ ID NO: 6916533 - DNA, 23 bp, Homo sapiens
tggtcttgaactcctgtccctgc

SEQ ID NO: 6916534 - DNA, 22 bp, Homo sapiens
ggaaagtggtggtggaaagagg

SEQ ID NO: 6916535 - DNA, 22 bp, Homo sapiens
ggctcaggttgggtcacatgac

SEQ ID NO: 6916536 - DNA, 22 bp, Homo sapiens
ctctgcagagcctccagcccag

SEQ ID NO: 6916537 - DNA, 22 bp, Homo sapiens
aagtaaaagctttaccatgcgc

SEQ ID NO: 6916538 - DNA, 22 bp, Homo sapiens
tgatcctatttcagtgtatgtt

SEQ ID NO: 6916539 - DNA, 22 bp, Homo sapiens
tctcaagctactaccttggatc

SEQ ID NO: 6916540 - DNA, 22 bp, Homo sapiens
atgaaaattgacagcggaagta

SEQ ID NO: 6916541 - DNA, 22 bp, Homo sapiens
aggccatgtggccccagagtct

SEQ ID NO: 6916542 - DNA, 22 bp, Homo sapiens
ttttctctccaggtggggtgat

SEQ ID NO: 6916543 - DNA, 20 bp, Homo sapiens
tgacttctgggatttgtggt

SEQ ID NO: 6916544 - DNA, 22 bp, Homo sapiens
cccaagtattcctcctctgccc

SEQ ID NO: 6916545 - DNA, 22 bp, Homo sapiens
ccaaggtggctacagccctgca

SEQ ID NO: 6916546 - DNA, 22 bp, Homo sapiens
tgagcattacctgaggccactg

SEQ ID NO: 6916547 - DNA, 22 bp, Homo sapiens
ggctatgagatgggaccagtac

SEQ ID NO: 6916548 - DNA, 21 bp, Homo sapiens
actcaagtggagatgccaggt

SEQ ID NO: 6916549 - DNA, 22 bp, Homo sapiens
ccctccattaaaacagacctat

SEQ ID NO: 6916550 - DNA, 22 bp, Homo sapiens
tgagacagtcccatgatctgca

SEQ ID NO: 6916551 - DNA, 22 bp, Homo sapiens
ggtgcccagcaagctttcaatg

SEQ ID NO: 6916552 - DNA, 22 bp, Homo sapiens
cagcagcttttgcattctcatt

SEQ ID NO: 6916553 - DNA, 22 bp, Homo sapiens
tgcctgaagaaaacttgcagca

SEQ ID NO: 6916554 - DNA, 22 bp, Homo sapiens
ttggctttagcccaaatgactg

SEQ ID NO: 6916555 - DNA, 17 bp, Homo sapiens
acccagagaaggaggtc

SEQ ID NO: 6916556 - DNA, 22 bp, Homo sapiens
ccaggaggcttcgtccgtggag

SEQ ID NO: 6916557 - DNA, 22 bp, Homo sapiens
gagcaggacgtgggaatgggaa

SEQ ID NO: 6916558 - DNA, 22 bp, Homo sapiens
taggacagtagctggtgcacag

SEQ ID NO: 6916559 - DNA, 17 bp, Homo sapiens
aggtttatggtatttga

SEQ ID NO: 6916560 - DNA, 22 bp, Homo sapiens
tccaaagaggattcagggacct

SEQ ID NO: 6916561 - DNA, 22 bp, Homo sapiens
ctgggagtttctagagaaagac

SEQ ID NO: 6916562 - DNA, 22 bp, Homo sapiens
taccaaagaatattttaaatag

SEQ ID NO: 6916563 - DNA, 22 bp, Homo sapiens
atagatggtatttagactagcg

SEQ ID NO: 6916564 - DNA, 22 bp, Homo sapiens
tttcacatatcaactctatcct

SEQ ID NO: 6916565 - DNA, 22 bp, Homo sapiens
tgctgagagatttaaagggcca

SEQ ID NO: 6916566 - DNA, 19 bp, Homo sapiens
tggcagggagagtttgaag

SEQ ID NO: 6916567 - DNA, 22 bp, Homo sapiens
tcaccccaaagttgagtttgat

SEQ ID NO: 6916568 - DNA, 22 bp, Homo sapiens
tagcttcagggaaaccactgct

SEQ ID NO: 6916569 - DNA, 20 bp, Homo sapiens
ttttccttctgagtatgttg

SEQ ID NO: 6916570 - DNA, 22 bp, Homo sapiens
ctagtacaattttagcaagatg

SEQ ID NO: 6916571 - DNA, 22 bp, Homo sapiens
agagaagattcttatatgtctt

SEQ ID NO: 6916572 - DNA, 22 bp, Homo sapiens
aagttcctgttactccccagaa

SEQ ID NO: 6916573 - DNA, 22 bp, Homo sapiens
aggaagagcccgggtgacataa

SEQ ID NO: 6916574 - DNA, 22 bp, Homo sapiens
acaaggctgttggtcacaaacc

SEQ ID NO: 6916575 - DNA, 20 bp, Homo sapiens
accttgggtgagtgacggtc

SEQ ID NO: 6916576 - DNA, 22 bp, Homo sapiens
agacagtgtgagttcagggtgg

SEQ ID NO: 6916577 - DNA, 22 bp, Homo sapiens
tccaggactggttcacacggtg

SEQ ID NO: 6916578 - DNA, 22 bp, Homo sapiens
actttggacaatttattactgt

SEQ ID NO: 6916579 - DNA, 22 bp, Homo sapiens
ccaggggctggtgctgagctgg

SEQ ID NO: 6916580 - DNA, 20 bp, Homo sapiens
gggctagaccagggcagagg

SEQ ID NO: 6916581 - DNA, 22 bp, Homo sapiens
gaagaacttaacataataagga

SEQ ID NO: 6916582 - DNA, 22 bp, Homo sapiens
tttaccaggagtcagaaggact

SEQ ID NO: 6916583 - DNA, 22 bp, Homo sapiens
acacatgcaggtatacatgttc

SEQ ID NO: 6916584 - DNA, 22 bp, Homo sapiens
ccacagctcctcagcctctttc

SEQ ID NO: 6916585 - DNA, 22 bp, Homo sapiens
gagcttaggccagggacaggga

SEQ ID NO: 6916586 - DNA, 21 bp, Homo sapiens
aacaaagggatgctcatcttt

SEQ ID NO: 6916587 - DNA, 22 bp, Homo sapiens
cagaggtagaactggccctcac

SEQ ID NO: 6916588 - DNA, 22 bp, Homo sapiens
aattctgttactaatgtgatgt

SEQ ID NO: 6916589 - DNA, 22 bp, Homo sapiens
tctgctgtgttgaatgattggt

SEQ ID NO: 6916590 - DNA, 22 bp, Homo sapiens
atgtacaaaatgccactgaatt

SEQ ID NO: 6916591 - DNA, 22 bp, Homo sapiens
atctttgtttgtctctgaggtg

SEQ ID NO: 6916592 - DNA, 22 bp, Homo sapiens
tggagaaaaggttgaatccatc

SEQ ID NO: 6916593 - DNA, 22 bp, Homo sapiens
catttggattttgaagagagta

SEQ ID NO: 6916594 - DNA, 22 bp, Homo sapiens
ggaaggctttaagcaccaaagc

SEQ ID NO: 6916595 - DNA, 22 bp, Homo sapiens
tcaggaagccggttaaatagat

SEQ ID NO: 6916596 - DNA, 22 bp, Homo sapiens
cactctgaactattaacttggg

SEQ ID NO: 6916597 - DNA, 22 bp, Homo sapiens
tagtacttatctctgtcattgt

SEQ ID NO: 6916598 - DNA, 20 bp, Homo sapiens
tccagtgtctctctggtgga

SEQ ID NO: 6916599 - DNA, 22 bp, Homo sapiens
gattggttgaaagtagaatact

SEQ ID NO: 6916600 - DNA, 22 bp, Homo sapiens
acctttgacgctatttaatttg

SEQ ID NO: 6916601 - DNA, 22 bp, Homo sapiens
ctccaagggctcccagacgtct

SEQ ID NO: 6916602 - DNA, 22 bp, Homo sapiens
agtctttatctcgctcctggat

SEQ ID NO: 6916603 - DNA, 22 bp, Homo sapiens
tttcaagcataactgggaagag

SEQ ID NO: 6916604 - DNA, 22 bp, Homo sapiens
tctatgaattccatttcacgat

SEQ ID NO: 6916605 - DNA, 22 bp, Homo sapiens
ccttcttctgtgtggcccaaga

SEQ ID NO: 6916606 - DNA, 22 bp, Homo sapiens
ttgaggagcaggatgggaggct

SEQ ID NO: 6916607 - DNA, 22 bp, Homo sapiens
tcagagcaaattcctgtgagcc

SEQ ID NO: 6916608 - DNA, 20 bp, Homo sapiens
gtattaggtgttcctctttc

SEQ ID NO: 6916609 - DNA, 22 bp, Homo sapiens
aagtactagaaatagcagtgcc

SEQ ID NO: 6916610 - DNA, 22 bp, Homo sapiens
ttctaccattgggaaaacagcc

SEQ ID NO: 6916611 - DNA, 22 bp, Homo sapiens
cctctggtatttgcacagatat

SEQ ID NO: 6916612 - DNA, 22 bp, Homo sapiens
ccaggtacatggagaagaacag

SEQ ID NO: 6916613 - DNA, 22 bp, Homo sapiens
atgccacataattacaaataga

SEQ ID NO: 6916614 - DNA, 22 bp, Homo sapiens
atgccctggacttctagtattc

SEQ ID NO: 6916615 - DNA, 22 bp, Homo sapiens
tcattgaatacatatttgggat

SEQ ID NO: 6916616 - DNA, 22 bp, Homo sapiens
tcctgctctgatgggttctcct

SEQ ID NO: 6916617 - DNA, 23 bp, Homo sapiens
aagttcaagtcacagcctgtctt

SEQ ID NO: 6916618 - DNA, 22 bp, Homo sapiens
gaggttggcgccctgcctggcc

SEQ ID NO: 6916619 - DNA, 22 bp, Homo sapiens
gggccagacccttggcgatctg

SEQ ID NO: 6916620 - DNA, 22 bp, Homo sapiens
tgtgggcctgggaaggtgacac

SEQ ID NO: 6916621 - DNA, 20 bp, Homo sapiens
tcttctgttgccttgttctg

SEQ ID NO: 6916622 - DNA, 22 bp, Homo sapiens
ctcagggtaatgaaagacgaat

SEQ ID NO: 6916623 - DNA, 22 bp, Homo sapiens
ggccaaaccgcaattatttttg

SEQ ID NO: 6916624 - DNA, 22 bp, Homo sapiens
aggcttcagtagggagcatgtc

SEQ ID NO: 6916625 - DNA, 23 bp, Homo sapiens
cccagctttcccactgccgagag

SEQ ID NO: 6916626 - DNA, 22 bp, Homo sapiens
aaaggcatggaacagattctcc

SEQ ID NO: 6916627 - DNA, 22 bp, Homo sapiens
ggcacagccactttggagaact

SEQ ID NO: 6916628 - DNA, 22 bp, Homo sapiens
agagcatccatttttgtcacat

SEQ ID NO: 6916629 - DNA, 22 bp, Homo sapiens
aaggcccagggattggaggtca

SEQ ID NO: 6916630 - DNA, 22 bp, Homo sapiens
aatgaggtgttgagaccagcac

SEQ ID NO: 6916631 - DNA, 22 bp, Homo sapiens
atgatgtccctaggcaggtagt

SEQ ID NO: 6916632 - DNA, 22 bp, Homo sapiens
aaagtgatgccaggagtctggt

SEQ ID NO: 6916633 - DNA, 22 bp, Homo sapiens
catcacttttaaaggtgatcga

SEQ ID NO: 6916634 - DNA, 22 bp, Homo sapiens
tacttttatgtgatgaaatctg

SEQ ID NO: 6916635 - DNA, 22 bp, Homo sapiens
atgacctgaggccttactctag

SEQ ID NO: 6916636 - DNA, 22 bp, Homo sapiens
gactgtgtccatgtgctggatt

SEQ ID NO: 6916637 - DNA, 23 bp, Homo sapiens
cttttaaccggcatgggagggca

SEQ ID NO: 6916638 - DNA, 22 bp, Homo sapiens
cctcttcctcaccatctacaac

SEQ ID NO: 6916639 - DNA, 22 bp, Homo sapiens
gccagcaaggaggggaaaaatg

SEQ ID NO: 6916640 - DNA, 22 bp, Homo sapiens
tgatgactatatatgactagtg

SEQ ID NO: 6916641 - DNA, 21 bp, Homo sapiens
aggacagatgtaggaataaag

SEQ ID NO: 6916642 - DNA, 22 bp, Homo sapiens
ttgctctgaaccacaccatcac

SEQ ID NO: 6916643 - DNA, 22 bp, Homo sapiens
agcctctgctggccctggcact

SEQ ID NO: 6916644 - DNA, 22 bp, Homo sapiens
catccctgtcgtcaagtctctg

SEQ ID NO: 6916645 - DNA, 22 bp, Homo sapiens
ctgggcctgagctctgaagagt

SEQ ID NO: 6916646 - DNA, 22 bp, Homo sapiens
aggagctcccgtgaggagacca

SEQ ID NO: 6916647 - DNA, 22 bp, Homo sapiens
aggacacttgagagtccagtca

SEQ ID NO: 6916648 - DNA, 15 bp, Homo sapiens
gcagatgggggtgat

SEQ ID NO: 6916649 - DNA, 21 bp, Homo sapiens
ttcagcagcatgttgtctgtt

SEQ ID NO: 6916650 - DNA, 22 bp, Homo sapiens
gcaaaaattccagggacgactc

SEQ ID NO: 6916651 - DNA, 19 bp, Homo sapiens
tgggagtggggaaggtcct

SEQ ID NO: 6916652 - DNA, 21 bp, Homo sapiens
aggtgccaaggagaagcaggc

SEQ ID NO: 6916653 - DNA, 18 bp, Homo sapiens
tccttgaggtatctctat

SEQ ID NO: 6916654 - DNA, 22 bp, Homo sapiens
tgctgcctttgggacctggcct

SEQ ID NO: 6916655 - DNA, 22 bp, Homo sapiens
tttgcagcttctggtggcctct

SEQ ID NO: 6916656 - DNA, 22 bp, Homo sapiens
gcccttgagtagcaaaaagggc

SEQ ID NO: 6916657 - DNA, 22 bp, Homo sapiens
tcaccattggcaattataaaac

SEQ ID NO: 6916658 - DNA, 22 bp, Homo sapiens
gcctggcactcaatcatctgct

SEQ ID NO: 6916659 - DNA, 22 bp, Homo sapiens
tcctggctcctgatctgtcact

SEQ ID NO: 6916660 - DNA, 22 bp, Homo sapiens
tggccacaaagagaacgaggtc

SEQ ID NO: 6916661 - DNA, 22 bp, Homo sapiens
ctgggggcagcaagaagccatg

SEQ ID NO: 6916662 - DNA, 20 bp, Homo sapiens
gactttacatcagcactctt

SEQ ID NO: 6916663 - DNA, 17 bp, Homo sapiens
ttacaacgtcatctctg

SEQ ID NO: 6916664 - DNA, 22 bp, Homo sapiens
gcacctgcaggatgagccaggg

SEQ ID NO: 6916665 - DNA, 22 bp, Homo sapiens
cagggccattggaacaaagagg

SEQ ID NO: 6916666 - DNA, 22 bp, Homo sapiens
aggcagtgcatgcaaaggtcgg

SEQ ID NO: 6916667 - DNA, 22 bp, Homo sapiens
ccagaagaggacacagtgtgga

SEQ ID NO: 6916668 - DNA, 21 bp, Homo sapiens
ctttgcatctatatgttctca

SEQ ID NO: 6916669 - DNA, 22 bp, Homo sapiens
taagttcagagttctcatttgt

SEQ ID NO: 6916670 - DNA, 22 bp, Homo sapiens
cccaggatgatcgagagtggga

SEQ ID NO: 6916671 - DNA, 22 bp, Homo sapiens
tgctggcacgaaagggtgtcca

SEQ ID NO: 6916672 - DNA, 23 bp, Homo sapiens
tgctgccaagcacgagttgagtt

SEQ ID NO: 6916673 - DNA, 22 bp, Homo sapiens
ttatggaaaactccagagagta

SEQ ID NO: 6916674 - DNA, 22 bp, Homo sapiens
gctgttaggtgccctgaccttg

SEQ ID NO: 6916675 - DNA, 22 bp, Homo sapiens
tgaaatgcaatggggatccatt

SEQ ID NO: 6916676 - DNA, 22 bp, Homo sapiens
aaggcaccataggcaaatccag

SEQ ID NO: 6916677 - DNA, 22 bp, Homo sapiens
gagtctgaggggagagctgggt

SEQ ID NO: 6916678 - DNA, 22 bp, Homo sapiens
tgctcctgagggataaactgcc

SEQ ID NO: 6916679 - DNA, 22 bp, Homo sapiens
gcaaaggccactggggcgatgg

SEQ ID NO: 6916680 - DNA, 22 bp, Homo sapiens
gtaaaatctttcctatttgcct

SEQ ID NO: 6916681 - DNA, 22 bp, Homo sapiens
tggctaaaccctagtaaattaa

SEQ ID NO: 6916682 - DNA, 22 bp, Homo sapiens
gcacaagaataaccatatttaa

SEQ ID NO: 6916683 - DNA, 22 bp, Homo sapiens
aaggagtggggcatatcacaga

SEQ ID NO: 6916684 - DNA, 22 bp, Homo sapiens
cacagcattgccttccaaaagg

SEQ ID NO: 6916685 - DNA, 22 bp, Homo sapiens
aggcctagaggaatggccaggg

SEQ ID NO: 6916686 - DNA, 22 bp, Homo sapiens
ttgcgcgcggctaggtctcggt

SEQ ID NO: 6916687 - DNA, 22 bp, Homo sapiens
ccagcccgaatccctaaagcaa

SEQ ID NO: 6916688 - DNA, 22 bp, Homo sapiens
aaatagaattaactagctactg

SEQ ID NO: 6916689 - DNA, 22 bp, Homo sapiens
ccaggcaggcagcgttctcagg

SEQ ID NO: 6916690 - DNA, 22 bp, Homo sapiens
tggacaggtttgggtgcctgtt

SEQ ID NO: 6916691 - DNA, 22 bp, Homo sapiens
aagaataagtagatgggagaag

SEQ ID NO: 6916692 - DNA, 22 bp, Homo sapiens
cctggaagattcaccactacca

SEQ ID NO: 6916693 - DNA, 22 bp, Homo sapiens
gtctgcccgcctgcaaagtgtt

SEQ ID NO: 6916694 - DNA, 22 bp, Homo sapiens
ctgctttaacagatgatggtgt

SEQ ID NO: 6916695 - DNA, 22 bp, Homo sapiens
ttctagaatccttgtctacttt

SEQ ID NO: 6916696 - DNA, 22 bp, Homo sapiens
tgtagcaccatctcctccttcc

SEQ ID NO: 6916697 - DNA, 22 bp, Homo sapiens
cacccctgggctgggcacacag

SEQ ID NO: 6916698 - DNA, 22 bp, Homo sapiens
tcagatatagtcatttaaataa

SEQ ID NO: 6916699 - DNA, 22 bp, Homo sapiens
tatgcattcagaggttgggtgt

SEQ ID NO: 6916700 - DNA, 22 bp, Homo sapiens
gtccctggaatggactctgcgc

SEQ ID NO: 6916701 - DNA, 22 bp, Homo sapiens
gcttcagctttgtctccttggg

SEQ ID NO: 6916702 - DNA, 22 bp, Homo sapiens
tgaattctggccaatggaatgt

SEQ ID NO: 6916703 - DNA, 22 bp, Homo sapiens
ggaacactgtggttccatagca

SEQ ID NO: 6916704 - DNA, 21 bp, Homo sapiens
ttattgaatgtttaccgtgtg

SEQ ID NO: 6916705 - DNA, 22 bp, Homo sapiens
tttatgtgatgcatcccagaaa

SEQ ID NO: 6916706 - DNA, 22 bp, Homo sapiens
tattggagtactgcgagctgcc

SEQ ID NO: 6916707 - DNA, 17 bp, Homo sapiens
tccttggcaaccagttc

SEQ ID NO: 6916708 - DNA, 21 bp, Homo sapiens
caaggcttaaacattaatcta

SEQ ID NO: 6916709 - DNA, 22 bp, Homo sapiens
agggtctgacaatgtgacttag

SEQ ID NO: 6916710 - DNA, 22 bp, Homo sapiens
tattatgatcccagccctggag

SEQ ID NO: 6916711 - DNA, 22 bp, Homo sapiens
tgtagcacagctgctctctact

SEQ ID NO: 6916712 - DNA, 22 bp, Homo sapiens
gggtggagaggctaagtccagt

SEQ ID NO: 6916713 - DNA, 22 bp, Homo sapiens
tcaggtggccaaatgggagcgc

SEQ ID NO: 6916714 - DNA, 22 bp, Homo sapiens
ccagtgtctagtcacaggtact

SEQ ID NO: 6916715 - DNA, 22 bp, Homo sapiens
ccctgcttccctgggagaggcg

SEQ ID NO: 6916716 - DNA, 22 bp, Homo sapiens
gtatctttcccaccaatcacaa

SEQ ID NO: 6916717 - DNA, 22 bp, Homo sapiens
ttcaacatcaagaatgcatgga

SEQ ID NO: 6916718 - DNA, 22 bp, Homo sapiens
gatttaaagtagacctttgttt

SEQ ID NO: 6916719 - DNA, 22 bp, Homo sapiens
cacagctgtgagaagggagcct

SEQ ID NO: 6916720 - DNA, 22 bp, Homo sapiens
tctttcaaatgcttgaattgga

SEQ ID NO: 6916721 - DNA, 22 bp, Homo sapiens
ttcttccttggtttcctggata

SEQ ID NO: 6916722 - DNA, 22 bp, Homo sapiens
tcttgctccacatgctgagatg

SEQ ID NO: 6916723 - DNA, 22 bp, Homo sapiens
gcgtttaagtgatgatcgtctt

SEQ ID NO: 6916724 - DNA, 22 bp, Homo sapiens
ttctggtgtgttctctctaggc

SEQ ID NO: 6916725 - DNA, 22 bp, Homo sapiens
catgtcaaccagttgtttgaat

SEQ ID NO: 6916726 - DNA, 22 bp, Homo sapiens
ttatgcagagttgagaggaatg

SEQ ID NO: 6916727 - DNA, 17 bp, Homo sapiens
tttctacagttggcagc

SEQ ID NO: 6916728 - DNA, 22 bp, Homo sapiens
agactcatgacacttcctatga

SEQ ID NO: 6916729 - DNA, 19 bp, Homo sapiens
ttctttccacatcttctct

SEQ ID NO: 6916730 - DNA, 22 bp, Homo sapiens
ctgtcattttcttccaatataa

SEQ ID NO: 6916731 - DNA, 22 bp, Homo sapiens
acaaggcttatagttgcttttt

SEQ ID NO: 6916732 - DNA, 22 bp, Homo sapiens
aggaacacttgtggaaacattc

SEQ ID NO: 6916733 - DNA, 22 bp, Homo sapiens
gctcatttcttctttccacaat

SEQ ID NO: 6916734 - DNA, 22 bp, Homo sapiens
taggaacaaagagcctcacatt

SEQ ID NO: 6916735 - DNA, 22 bp, Homo sapiens
tgctgaggcatttggacagagt

SEQ ID NO: 6916736 - DNA, 22 bp, Homo sapiens
agggtgctaatctcattcacat

SEQ ID NO: 6916737 - DNA, 22 bp, Homo sapiens
atgctgtgtattttactctttc

SEQ ID NO: 6916738 - DNA, 22 bp, Homo sapiens
gaggctgctttcctcctatcct

SEQ ID NO: 6916739 - DNA, 22 bp, Homo sapiens
tctgggaggtcacattggtctt

SEQ ID NO: 6916740 - DNA, 22 bp, Homo sapiens
cttcacatctccctaaaacagc

SEQ ID NO: 6916741 - DNA, 22 bp, Homo sapiens
attctagatgctgtaagtagca

SEQ ID NO: 6916742 - DNA, 22 bp, Homo sapiens
cacacttgtgaccgatataatg

SEQ ID NO: 6916743 - DNA, 22 bp, Homo sapiens
gactatgtgggagggacaagga

SEQ ID NO: 6916744 - DNA, 22 bp, Homo sapiens
cctgagtagctggaattaaagg

SEQ ID NO: 6916745 - DNA, 22 bp, Homo sapiens
tttgacagggtgatgaggtggt

SEQ ID NO: 6916746 - DNA, 22 bp, Homo sapiens
aggtcgagtttcggggctactt

SEQ ID NO: 6916747 - DNA, 22 bp, Homo sapiens
tgcacgttgaagtcccaggttg

SEQ ID NO: 6916748 - DNA, 22 bp, Homo sapiens
aacctggccctaatcccagtag

SEQ ID NO: 6916749 - DNA, 14 bp, Homo sapiens
aggaatgtcctagg

SEQ ID NO: 6916750 - DNA, 22 bp, Homo sapiens
ttatagaatggtggattttctg

SEQ ID NO: 6916751 - DNA, 22 bp, Homo sapiens
agctggcagtatgactggtgac

SEQ ID NO: 6916752 - DNA, 22 bp, Homo sapiens
gaagggctcatcaggtggccgc

SEQ ID NO: 6916753 - DNA, 22 bp, Homo sapiens
aatgaattgcagtactgacttg

SEQ ID NO: 6916754 - DNA, 22 bp, Homo sapiens
ataacttgatgttatttgtcca

SEQ ID NO: 6916755 - DNA, 22 bp, Homo sapiens
gggcttctattcaagtctgttt

SEQ ID NO: 6916756 - DNA, 22 bp, Homo sapiens
agaagcttcaagatatttggta

SEQ ID NO: 6916757 - DNA, 22 bp, Homo sapiens
cttcctttgctgttcggaggtt

SEQ ID NO: 6916758 - DNA, 22 bp, Homo sapiens
gactggatttaaggacttctga

SEQ ID NO: 6916759 - DNA, 22 bp, Homo sapiens
tgcaaaggaggccaaaccaagt

SEQ ID NO: 6916760 - DNA, 23 bp, Homo sapiens
ctgaatgcgacatttctctccac

SEQ ID NO: 6916761 - DNA, 22 bp, Homo sapiens
gcagtgttacttggagtactaa

SEQ ID NO: 6916762 - DNA, 22 bp, Homo sapiens
aaattcctctgatcataagaat

SEQ ID NO: 6916763 - DNA, 22 bp, Homo sapiens
atcatctgcacagatcctattt

SEQ ID NO: 6916764 - DNA, 22 bp, Homo sapiens
tcagcactttgaagcagaagga

SEQ ID NO: 6916765 - DNA, 22 bp, Homo sapiens
tagaatccaagaaggtgagcaa

SEQ ID NO: 6916766 - DNA, 22 bp, Homo sapiens
gactctggtgtcagaagtgccc

SEQ ID NO: 6916767 - DNA, 23 bp, Homo sapiens
agaggcacagcacttggctggcc

SEQ ID NO: 6916768 - DNA, 22 bp, Homo sapiens
ggcttgtggcaagtgttttaag

SEQ ID NO: 6916769 - DNA, 22 bp, Homo sapiens
aacaagaagagagggacgtaat

SEQ ID NO: 6916770 - DNA, 22 bp, Homo sapiens
catgaaggaattaaggtaagga

SEQ ID NO: 6916771 - DNA, 22 bp, Homo sapiens
tgtaacacctaactgaggcatt

SEQ ID NO: 6916772 - DNA, 23 bp, Homo sapiens
accaggagccaagatctccctgg

SEQ ID NO: 6916773 - DNA, 22 bp, Homo sapiens
cagcttggaggaggatctaaga

SEQ ID NO: 6916774 - DNA, 22 bp, Homo sapiens
cttctgtgttaaatgagtcttt

SEQ ID NO: 6916775 - DNA, 22 bp, Homo sapiens
gcaggcctggtttacatggtag

SEQ ID NO: 6916776 - DNA, 22 bp, Homo sapiens
gagaggaggtggctatgacagc

SEQ ID NO: 6916777 - DNA, 22 bp, Homo sapiens
tagctttaggatggttctcttg

SEQ ID NO: 6916778 - DNA, 22 bp, Homo sapiens
attccagtgtcatgctctcagg

SEQ ID NO: 6916779 - DNA, 22 bp, Homo sapiens
gggacctgaggccctgctccac

SEQ ID NO: 6916780 - DNA, 22 bp, Homo sapiens
ttgccctgaagaacgtcccaga

SEQ ID NO: 6916781 - DNA, 22 bp, Homo sapiens
taccatgatgtttgagttacta

SEQ ID NO: 6916782 - DNA, 22 bp, Homo sapiens
cacttggaggaaggcctattca

SEQ ID NO: 6916783 - DNA, 22 bp, Homo sapiens
tctcttctgaaacctgtcttta

SEQ ID NO: 6916784 - DNA, 22 bp, Homo sapiens
ggatgtaactttcctagtccat

SEQ ID NO: 6916785 - DNA, 22 bp, Homo sapiens
gaaacctgtcccctcttcctca

SEQ ID NO: 6916786 - DNA, 22 bp, Homo sapiens
gattaggagggagaggcaagta

SEQ ID NO: 6916787 - DNA, 19 bp, Homo sapiens
aggtatttgggagatatat

SEQ ID NO: 6916788 - DNA, 22 bp, Homo sapiens
aagcgcagacacagagagtgga

SEQ ID NO: 6916789 - DNA, 22 bp, Homo sapiens
tgcatcagtgactgggagataa

SEQ ID NO: 6916790 - DNA, 22 bp, Homo sapiens
ctgctacagtttaaaggggaag

SEQ ID NO: 6916791 - DNA, 22 bp, Homo sapiens
ggcactgaaccaggacacaagc

SEQ ID NO: 6916792 - DNA, 22 bp, Homo sapiens
aactccagtgtcagctgcaatg

SEQ ID NO: 6916793 - DNA, 22 bp, Homo sapiens
tagaatatgattaattttctta

SEQ ID NO: 6916794 - DNA, 21 bp, Homo sapiens
actgttaagacgtagctgggg

SEQ ID NO: 6916795 - DNA, 22 bp, Homo sapiens
agatctgacctaaccccaccac

SEQ ID NO: 6916796 - DNA, 22 bp, Homo sapiens
ttcaacaagtatttattgagca

SEQ ID NO: 6916797 - DNA, 22 bp, Homo sapiens
tcacatctaattccatttctgc

SEQ ID NO: 6916798 - DNA, 22 bp, Homo sapiens
tcagggaagaaatgggacttta

SEQ ID NO: 6916799 - DNA, 22 bp, Homo sapiens
tggtcacccctaaataggaaag

SEQ ID NO: 6916800 - DNA, 22 bp, Homo sapiens
cctgaggcttaatctgtcccaa

SEQ ID NO: 6916801 - DNA, 22 bp, Homo sapiens
ctcggatacaaaagtttagatg

SEQ ID NO: 6916802 - DNA, 22 bp, Homo sapiens
ctgaagcaaatgaaacagctct

SEQ ID NO: 6916803 - DNA, 22 bp, Homo sapiens
agtaagacccagtcacttgaga

SEQ ID NO: 6916804 - DNA, 22 bp, Homo sapiens
gcattagagcccatcacctgta

SEQ ID NO: 6916805 - DNA, 22 bp, Homo sapiens
caaggttattatgtgcatctgt

SEQ ID NO: 6916806 - DNA, 22 bp, Homo sapiens
ctttggtggaggggtgcaggca

SEQ ID NO: 6916807 - DNA, 22 bp, Homo sapiens
aaacctgtggccactaaatttg

SEQ ID NO: 6916808 - DNA, 23 bp, Homo sapiens
ggaggctcaagtatcacgggcag

SEQ ID NO: 6916809 - DNA, 22 bp, Homo sapiens
ctgttggatggtttccaaaaga

SEQ ID NO: 6916810 - DNA, 22 bp, Homo sapiens
tactagctaacattctcaccaa

SEQ ID NO: 6916811 - DNA, 22 bp, Homo sapiens
atctgcatttacattgcttgta

SEQ ID NO: 6916812 - DNA, 22 bp, Homo sapiens
atatatttactctcctgttgca

SEQ ID NO: 6916813 - DNA, 22 bp, Homo sapiens
ctgtatgttgggtaagcattgc

SEQ ID NO: 6916814 - DNA, 22 bp, Homo sapiens
gttagcttcttgaaggaaaggg

SEQ ID NO: 6916815 - DNA, 22 bp, Homo sapiens
gtgaagcctcggaaccaagctc

SEQ ID NO: 6916816 - DNA, 22 bp, Homo sapiens
gtgtcccaatgttcaggacggc

SEQ ID NO: 6916817 - DNA, 22 bp, Homo sapiens
aggccagaaaaagacagctcca

SEQ ID NO: 6916818 - DNA, 19 bp, Homo sapiens
gaacttggccaggcacagt

SEQ ID NO: 6916819 - DNA, 22 bp, Homo sapiens
tgatgaaatgttgaggcagtga

SEQ ID NO: 6916820 - DNA, 22 bp, Homo sapiens
agaaacatcgcttagtcctcat

SEQ ID NO: 6916821 - DNA, 22 bp, Homo sapiens
tgtctctctagctcttggtttg

SEQ ID NO: 6916822 - DNA, 22 bp, Homo sapiens
taatgcttaatgtaggctggaa

SEQ ID NO: 6916823 - DNA, 22 bp, Homo sapiens
tctcactttccagacttttcaa

SEQ ID NO: 6916824 - DNA, 22 bp, Homo sapiens
gaattcttttctttctgaaagt

SEQ ID NO: 6916825 - DNA, 20 bp, Homo sapiens
agtggccactgcagagatgc

SEQ ID NO: 6916826 - DNA, 22 bp, Homo sapiens
gcattattaactggaggaaaag

SEQ ID NO: 6916827 - DNA, 22 bp, Homo sapiens
gtcagcaaaaaatttatgtgag

SEQ ID NO: 6916828 - DNA, 22 bp, Homo sapiens
acagcaattgtatgcatagcat

SEQ ID NO: 6916829 - DNA, 21 bp, Homo sapiens
tgtgataatactatatgctct

SEQ ID NO: 6916830 - DNA, 22 bp, Homo sapiens
tctagacactactagtaaccgg

SEQ ID NO: 6916831 - DNA, 22 bp, Homo sapiens
tgctccagggctgccagaccct

SEQ ID NO: 6916832 - DNA, 22 bp, Homo sapiens
atagcacctgtgatgggatgag

SEQ ID NO: 6916833 - DNA, 21 bp, Homo sapiens
ttattctgagatgagattctt

SEQ ID NO: 6916834 - DNA, 22 bp, Homo sapiens
aggagcagcttctgaaccatgt

SEQ ID NO: 6916835 - DNA, 22 bp, Homo sapiens
taagatgttttggtttgataag

SEQ ID NO: 6916836 - DNA, 19 bp, Homo sapiens
cagacctgtccagcctgtg

SEQ ID NO: 6916837 - DNA, 22 bp, Homo sapiens
tgtatttggtgtatttaatgag

SEQ ID NO: 6916838 - DNA, 22 bp, Homo sapiens
agtcaacagagtggccgcagcg

SEQ ID NO: 6916839 - DNA, 22 bp, Homo sapiens
gaatgaggtcatcttgtaatct

SEQ ID NO: 6916840 - DNA, 22 bp, Homo sapiens
ttttggcaagctgggagatatt

SEQ ID NO: 6916841 - DNA, 22 bp, Homo sapiens
tgtattttgtgaggatcactct

SEQ ID NO: 6916842 - DNA, 22 bp, Homo sapiens
ggactctgtagaggttctcatt

SEQ ID NO: 6916843 - DNA, 22 bp, Homo sapiens
ccgtgcttcttcagatgtgaat

SEQ ID NO: 6916844 - DNA, 22 bp, Homo sapiens
cccctgttatagaaccacctca

SEQ ID NO: 6916845 - DNA, 20 bp, Homo sapiens
tctgtagtctgtggcaagac

SEQ ID NO: 6916846 - DNA, 22 bp, Homo sapiens
tacagctgcaagggtttctggg

SEQ ID NO: 6916847 - DNA, 22 bp, Homo sapiens
agagatttacacatgccttttc

SEQ ID NO: 6916848 - DNA, 22 bp, Homo sapiens
ttgcagattaaaacactgagct

SEQ ID NO: 6916849 - DNA, 22 bp, Homo sapiens
gttgaatgaatggagaattaat

SEQ ID NO: 6916850 - DNA, 22 bp, Homo sapiens
aaatggcagcccagaggtaagg

SEQ ID NO: 6916851 - DNA, 22 bp, Homo sapiens
agtcttctttcatttactcagt

SEQ ID NO: 6916852 - DNA, 22 bp, Homo sapiens
gggcctgtgcacagttctgtta

SEQ ID NO: 6916853 - DNA, 22 bp, Homo sapiens
tcataaatcatactccatttgc

SEQ ID NO: 6916854 - DNA, 22 bp, Homo sapiens
tggacagccatgcaaatgagct

SEQ ID NO: 6916855 - DNA, 22 bp, Homo sapiens
gtcaggaagtggcattggagaa

SEQ ID NO: 6916856 - DNA, 22 bp, Homo sapiens
ccaggcagcaaattttctgaat

SEQ ID NO: 6916857 - DNA, 22 bp, Homo sapiens
ttgagagaggaaacatagtctc

SEQ ID NO: 6916858 - DNA, 22 bp, Homo sapiens
tgctcagtcctcctgcagtgcc

SEQ ID NO: 6916859 - DNA, 22 bp, Homo sapiens
tctttggcatttaggagcagga

SEQ ID NO: 6916860 - DNA, 22 bp, Homo sapiens
cactgcttctggaggaatttgg

SEQ ID NO: 6916861 - DNA, 22 bp, Homo sapiens
tcagggcaccaaaaaagatgcc

SEQ ID NO: 6916862 - DNA, 22 bp, Homo sapiens
ctgctgttctgaagcaacaagc

SEQ ID NO: 6916863 - DNA, 22 bp, Homo sapiens
gaaaggccatttctgagggttt

SEQ ID NO: 6916864 - DNA, 22 bp, Homo sapiens
aggctgagtgctcccctagatg

SEQ ID NO: 6916865 - DNA, 18 bp, Homo sapiens
atatccaataatgaacac

SEQ ID NO: 6916866 - DNA, 22 bp, Homo sapiens
tgggcactcttctgtgcaaaca

SEQ ID NO: 6916867 - DNA, 22 bp, Homo sapiens
gtgacacccgcatgccactgtg

SEQ ID NO: 6916868 - DNA, 22 bp, Homo sapiens
ggattaagacctgtcagtacac

SEQ ID NO: 6916869 - DNA, 23 bp, Homo sapiens
agggcctgatggctcccgctggc

SEQ ID NO: 6916870 - DNA, 22 bp, Homo sapiens
aaagactaaatgaatgagctca

SEQ ID NO: 6916871 - DNA, 20 bp, Homo sapiens
attctacaagaataagcatg

SEQ ID NO: 6916872 - DNA, 22 bp, Homo sapiens
atttgcaaagtcgtatctgtga

SEQ ID NO: 6916873 - DNA, 20 bp, Homo sapiens
actttacagagaagactgac

SEQ ID NO: 6916874 - DNA, 22 bp, Homo sapiens
tagcaacggtatgcaatctgtc

SEQ ID NO: 6916875 - DNA, 22 bp, Homo sapiens
ttgctgggtgctattatgaaca

SEQ ID NO: 6916876 - DNA, 22 bp, Homo sapiens
agaccacagtcaggctcctggt

SEQ ID NO: 6916877 - DNA, 22 bp, Homo sapiens
ttagcagcttagactgcctggg

SEQ ID NO: 6916878 - DNA, 22 bp, Homo sapiens
ttggtagaagaatatgagtatt

SEQ ID NO: 6916879 - DNA, 20 bp, Homo sapiens
accaggaatcttttctgagc

SEQ ID NO: 6916880 - DNA, 22 bp, Homo sapiens
ttcaatgcctagaacttagcat

SEQ ID NO: 6916881 - DNA, 22 bp, Homo sapiens
ggtgccaggctgtagtcagggt

SEQ ID NO: 6916882 - DNA, 22 bp, Homo sapiens
tattggaatttagttagagaat

SEQ ID NO: 6916883 - DNA, 22 bp, Homo sapiens
tagccttctcaagacaaagttg

SEQ ID NO: 6916884 - DNA, 22 bp, Homo sapiens
ggaggtgaggccgtagggtgtg

SEQ ID NO: 6916885 - DNA, 22 bp, Homo sapiens
gaggggctggggttgactccaa

SEQ ID NO: 6916886 - DNA, 22 bp, Homo sapiens
tagctctgcaatgaagcccagg

SEQ ID NO: 6916887 - DNA, 21 bp, Homo sapiens
atgtgattatatgacttttac

SEQ ID NO: 6916888 - DNA, 22 bp, Homo sapiens
agtttcccttgcaaacccattt

SEQ ID NO: 6916889 - DNA, 22 bp, Homo sapiens
tggtctttaaggtagctgtcat

SEQ ID NO: 6916890 - DNA, 22 bp, Homo sapiens
ctgagcccttgaacccaagtcc

SEQ ID NO: 6916891 - DNA, 22 bp, Homo sapiens
ggagaaggcgaagtcattcttt

SEQ ID NO: 6916892 - DNA, 22 bp, Homo sapiens
atccatttgccgtgctatgtgc

SEQ ID NO: 6916893 - DNA, 20 bp, Homo sapiens
aggccactgaatgccaatca

SEQ ID NO: 6916894 - DNA, 22 bp, Homo sapiens
gactgcttatatgttaaagata

SEQ ID NO: 6916895 - DNA, 22 bp, Homo sapiens
agactgaagctccttgaggaca

SEQ ID NO: 6916896 - DNA, 22 bp, Homo sapiens
gtaggtccaccctgagctggga

SEQ ID NO: 6916897 - DNA, 22 bp, Homo sapiens
gccagccccagacatcctatcg

SEQ ID NO: 6916898 - DNA, 22 bp, Homo sapiens
tttcttctccatggcaggtcct

SEQ ID NO: 6916899 - DNA, 22 bp, Homo sapiens
atttctcattaagatcttccaa

SEQ ID NO: 6916900 - DNA, 22 bp, Homo sapiens
gtccaagggtgcacaactagta

SEQ ID NO: 6916901 - DNA, 22 bp, Homo sapiens
gttcaaaattcaaatggtatac

SEQ ID NO: 6916902 - DNA, 22 bp, Homo sapiens
cctgcagctccggatttctggg

SEQ ID NO: 6916903 - DNA, 22 bp, Homo sapiens
ctcctgacacagtccacacttg

SEQ ID NO: 6916904 - DNA, 22 bp, Homo sapiens
cgaacacacttgggagttctga

SEQ ID NO: 6916905 - DNA, 22 bp, Homo sapiens
ttccttcaaacgcctcctgcac

SEQ ID NO: 6916906 - DNA, 22 bp, Homo sapiens
gcaggagttagaggtttaatct

SEQ ID NO: 6916907 - DNA, 22 bp, Homo sapiens
acctaagagatcttctggtcca

SEQ ID NO: 6916908 - DNA, 22 bp, Homo sapiens
tcatttcctcaaattcaaggtt

SEQ ID NO: 6916909 - DNA, 22 bp, Homo sapiens
tagaggcagaagaaattgacaa

SEQ ID NO: 6916910 - DNA, 19 bp, Homo sapiens
aaggctgtttctccctcag

SEQ ID NO: 6916911 - DNA, 22 bp, Homo sapiens
agtatactgaaagtaaatatga

SEQ ID NO: 6916912 - DNA, 22 bp, Homo sapiens
gccacctgtgtgggcctttgtg

SEQ ID NO: 6916913 - DNA, 22 bp, Homo sapiens
cactggtctttggctaggtgtg

SEQ ID NO: 6916914 - DNA, 19 bp, Homo sapiens
aatctttccacaatgaggc

SEQ ID NO: 6916915 - DNA, 22 bp, Homo sapiens
actgtctttattagaatcttat

SEQ ID NO: 6916916 - DNA, 22 bp, Homo sapiens
cggccctggcggaggcgggaga

SEQ ID NO: 6916917 - DNA, 22 bp, Homo sapiens
ggcttggaaattgcaggacaca

SEQ ID NO: 6916918 - DNA, 22 bp, Homo sapiens
atgacatgcgaatgtactggag

SEQ ID NO: 6916919 - DNA, 22 bp, Homo sapiens
accctgagccaaaccagttaga

SEQ ID NO: 6916920 - DNA, 21 bp, Homo sapiens
cctgtgccagtctatgtgttc

SEQ ID NO: 6916921 - DNA, 22 bp, Homo sapiens
ttctaaaaccaattctgcttct

SEQ ID NO: 6916922 - DNA, 22 bp, Homo sapiens
ggttccagaagggggcgaggtg

SEQ ID NO: 6916923 - DNA, 22 bp, Homo sapiens
taaagctgttcagtgcagaaag

SEQ ID NO: 6916924 - DNA, 22 bp, Homo sapiens
ccctatcagaagctgagagaag

SEQ ID NO: 6916925 - DNA, 22 bp, Homo sapiens
ataacagagttgggaagtgaaa

SEQ ID NO: 6916926 - DNA, 22 bp, Homo sapiens
ggaatagcttcaccttccttgc

SEQ ID NO: 6916927 - DNA, 22 bp, Homo sapiens
ctgtcatttttttagaacacct

SEQ ID NO: 6916928 - DNA, 22 bp, Homo sapiens
tctggaggctctgagggtgagt

SEQ ID NO: 6916929 - DNA, 22 bp, Homo sapiens
cacagttatgggaaacgtagtt

SEQ ID NO: 6916930 - DNA, 22 bp, Homo sapiens
gggcccttcatgtattattttt

SEQ ID NO: 6916931 - DNA, 22 bp, Homo sapiens
aataatgataatggttatagct

SEQ ID NO: 6916932 - DNA, 22 bp, Homo sapiens
tttgtgtgcaacgcatggagtc

SEQ ID NO: 6916933 - DNA, 20 bp, Homo sapiens
agaatctgacccagagagac

SEQ ID NO: 6916934 - DNA, 23 bp, Homo sapiens
gcctctggagccccagtgctcag

SEQ ID NO: 6916935 - DNA, 22 bp, Homo sapiens
gtctggctccgaggagtggcag

SEQ ID NO: 6916936 - DNA, 22 bp, Homo sapiens
tacattcatggtgacttgtatg

SEQ ID NO: 6916937 - DNA, 22 bp, Homo sapiens
gaggggctggctgtggtcccat

SEQ ID NO: 6916938 - DNA, 22 bp, Homo sapiens
ttatttgtggcatccatgttgg

SEQ ID NO: 6916939 - DNA, 22 bp, Homo sapiens
tgtgggtttaagaggcagcatg

SEQ ID NO: 6916940 - DNA, 22 bp, Homo sapiens
ctgggcctttgcttattaattt

SEQ ID NO: 6916941 - DNA, 22 bp, Homo sapiens
tggggaggttcgggaatcttgt

SEQ ID NO: 6916942 - DNA, 22 bp, Homo sapiens
ttaaaatgcagattatgactca

SEQ ID NO: 6916943 - DNA, 22 bp, Homo sapiens
tgggccacagctcacacatcca

SEQ ID NO: 6916944 - DNA, 22 bp, Homo sapiens
agaagcagaaactgggcttgtg

SEQ ID NO: 6916945 - DNA, 17 bp, Homo sapiens
actcaggatctgggagt

SEQ ID NO: 6916946 - DNA, 22 bp, Homo sapiens
agctcagagggaggtgaagtgg

SEQ ID NO: 6916947 - DNA, 22 bp, Homo sapiens
gctggcagtcccatcagctggg

SEQ ID NO: 6916948 - DNA, 22 bp, Homo sapiens
atcacagttttgtgccttgtgg

SEQ ID NO: 6916949 - DNA, 22 bp, Homo sapiens
tcaagacatattaaatgtgcga

SEQ ID NO: 6916950 - DNA, 22 bp, Homo sapiens
tgagaaaactcaaagacagatc

SEQ ID NO: 6916951 - DNA, 19 bp, Homo sapiens
tcttgcagccccagcaggc

SEQ ID NO: 6916952 - DNA, 22 bp, Homo sapiens
tacccagggcttttctgatgca

SEQ ID NO: 6916953 - DNA, 22 bp, Homo sapiens
gaagccaacattccaagtagaa

SEQ ID NO: 6916954 - DNA, 22 bp, Homo sapiens
aatgtattcctcatgcaagagt

SEQ ID NO: 6916955 - DNA, 19 bp, Homo sapiens
gggtggtccaactttcagg

SEQ ID NO: 6916956 - DNA, 22 bp, Homo sapiens
cctggagtctgtgactttcctc

SEQ ID NO: 6916957 - DNA, 22 bp, Homo sapiens
ttgacataagacttagagtatt

SEQ ID NO: 6916958 - DNA, 22 bp, Homo sapiens
gcctggcaggcctcatgagggg

SEQ ID NO: 6916959 - DNA, 22 bp, Homo sapiens
gaggcagttcctgagtgacaag

SEQ ID NO: 6916960 - DNA, 22 bp, Homo sapiens
ctgctgcattactcttctcaag

SEQ ID NO: 6916961 - DNA, 22 bp, Homo sapiens
tgcaaagttgaggaaggcatgg

SEQ ID NO: 6916962 - DNA, 22 bp, Homo sapiens
gcagatgtgtcctggagggagg

SEQ ID NO: 6916963 - DNA, 23 bp, Homo sapiens
tcataaatattagcacagtagga

SEQ ID NO: 6916964 - DNA, 22 bp, Homo sapiens
gcagatggatcacctgaggtcg

SEQ ID NO: 6916965 - DNA, 23 bp, Homo sapiens
tgctgtggatggcaggtccttgc

SEQ ID NO: 6916966 - DNA, 22 bp, Homo sapiens
tttggcatttaataggtgatca

SEQ ID NO: 6916967 - DNA, 22 bp, Homo sapiens
cttcttggaagtcgtccttcca

SEQ ID NO: 6916968 - DNA, 22 bp, Homo sapiens
tttacaagtacacctaacagct

SEQ ID NO: 6916969 - DNA, 20 bp, Homo sapiens
gctgaagattcccatgcaag

SEQ ID NO: 6916970 - DNA, 22 bp, Homo sapiens
tggcattgggttgatgtctcag

SEQ ID NO: 6916971 - DNA, 22 bp, Homo sapiens
tccagcagcccgaaggcccatc

SEQ ID NO: 6916972 - DNA, 22 bp, Homo sapiens
tgtgtgttatcttagttcatct

SEQ ID NO: 6916973 - DNA, 22 bp, Homo sapiens
aggcaagaacagacatgggagt

SEQ ID NO: 6916974 - DNA, 22 bp, Homo sapiens
tctgtgtacgcaggcgtgcgcg

SEQ ID NO: 6916975 - DNA, 22 bp, Homo sapiens
cagtggccgcggggctgtgggt

SEQ ID NO: 6916976 - DNA, 22 bp, Homo sapiens
agccagtcagaggctcccccaa

SEQ ID NO: 6916977 - DNA, 22 bp, Homo sapiens
ctaacatttattgagcacttag

SEQ ID NO: 6916978 - DNA, 22 bp, Homo sapiens
ttggaacagaactgcgttcatt

SEQ ID NO: 6916979 - DNA, 22 bp, Homo sapiens
ctctgtcaggctgcagatgctc

SEQ ID NO: 6916980 - DNA, 22 bp, Homo sapiens
ttttggaaccaacagtgcacct

SEQ ID NO: 6916981 - DNA, 22 bp, Homo sapiens
tctctcagcattactcttacta

SEQ ID NO: 6916982 - DNA, 22 bp, Homo sapiens
ctgcagatgggcgatggggcct

SEQ ID NO: 6916983 - DNA, 22 bp, Homo sapiens
atcagagcccggcaatttattt

SEQ ID NO: 6916984 - DNA, 22 bp, Homo sapiens
agcagggaggtctagcacgtgg

SEQ ID NO: 6916985 - DNA, 22 bp, Homo sapiens
gaagccaagggctgcttttcct

SEQ ID NO: 6916986 - DNA, 22 bp, Homo sapiens
gcagacaggcccagtggaggga

SEQ ID NO: 6916987 - DNA, 22 bp, Homo sapiens
cattcttatatttactcattca

SEQ ID NO: 6916988 - DNA, 22 bp, Homo sapiens
ctgaattctatctctggatgtc

SEQ ID NO: 6916989 - DNA, 22 bp, Homo sapiens
ttaacctgtaaaatgggagaag

SEQ ID NO: 6916990 - DNA, 22 bp, Homo sapiens
tggccaccttcccacttctgcc

SEQ ID NO: 6916991 - DNA, 22 bp, Homo sapiens
agtccagaaagtgaacagtgtt

SEQ ID NO: 6916992 - DNA, 22 bp, Homo sapiens
tcaccctgtttctcttttgtct

SEQ ID NO: 6916993 - DNA, 20 bp, Homo sapiens
atccaagaaaggatgcaggt

SEQ ID NO: 6916994 - DNA, 22 bp, Homo sapiens
tacatgcttaaaatgcaatgtt

SEQ ID NO: 6916995 - DNA, 22 bp, Homo sapiens
gacaaagtgctaaaccacagag

SEQ ID NO: 6916996 - DNA, 22 bp, Homo sapiens
tcttccaaggttgcacactatc

SEQ ID NO: 6916997 - DNA, 22 bp, Homo sapiens
caccctgaaggctggccctgac

SEQ ID NO: 6916998 - DNA, 22 bp, Homo sapiens
ctgaagatttggctgtaaagca

SEQ ID NO: 6916999 - DNA, 22 bp, Homo sapiens
taacagcagtcctcttctcatg

SEQ ID NO: 6917000 - DNA, 22 bp, Homo sapiens
tctggctcaggagctgtgttca

SEQ ID NO: 6917001 - DNA, 22 bp, Homo sapiens
tcctgaggatggttgaagtgca

SEQ ID NO: 6917002 - DNA, 22 bp, Homo sapiens
atagtgtgactgaggagttgaa

SEQ ID NO: 6917003 - DNA, 22 bp, Homo sapiens
aggaattcaagaccagctgggc

SEQ ID NO: 6917004 - DNA, 22 bp, Homo sapiens
gagcaaggatgggtctatagta

SEQ ID NO: 6917005 - DNA, 22 bp, Homo sapiens
ggctctggtgagggtaggagat

SEQ ID NO: 6917006 - DNA, 22 bp, Homo sapiens
cttcagtgaatgttgagtaagg

SEQ ID NO: 6917007 - DNA, 22 bp, Homo sapiens
gatgtttggctcaaacgagtgt

SEQ ID NO: 6917008 - DNA, 23 bp, Homo sapiens
tgctgcccactcttccagccctc

SEQ ID NO: 6917009 - DNA, 17 bp, Homo sapiens
gctttggaaagccttcc

SEQ ID NO: 6917010 - DNA, 20 bp, Homo sapiens
gtcagaggaccctagagcga

SEQ ID NO: 6917011 - DNA, 21 bp, Homo sapiens
agtaaactgtctgcttgagca

SEQ ID NO: 6917012 - DNA, 22 bp, Homo sapiens
aagtggcacgctttttggagtt

SEQ ID NO: 6917013 - DNA, 22 bp, Homo sapiens
agagctggggcataaatgccac

SEQ ID NO: 6917014 - DNA, 23 bp, Homo sapiens
gttaacatggtccatggaagagc

SEQ ID NO: 6917015 - DNA, 22 bp, Homo sapiens
tagtgccaaggttcgaagtaca

SEQ ID NO: 6917016 - DNA, 22 bp, Homo sapiens
tagaaagacagaggttttgtct

SEQ ID NO: 6917017 - DNA, 22 bp, Homo sapiens
tccagcttcttgacttggtggt

SEQ ID NO: 6917018 - DNA, 22 bp, Homo sapiens
ttggctttacaagcagtggcac

SEQ ID NO: 6917019 - DNA, 22 bp, Homo sapiens
tacctggccttaaggtgctgac

SEQ ID NO: 6917020 - DNA, 22 bp, Homo sapiens
taagcaacaagtggctggagga

SEQ ID NO: 6917021 - DNA, 22 bp, Homo sapiens
cacagtcctacagagatcagag

SEQ ID NO: 6917022 - DNA, 22 bp, Homo sapiens
gagactcttgctttaatagccc

SEQ ID NO: 6917023 - DNA, 20 bp, Homo sapiens
cctgcctgtgtttgtgatga

SEQ ID NO: 6917024 - DNA, 23 bp, Homo sapiens
ggctccaggcctgacgggcgcgg

SEQ ID NO: 6917025 - DNA, 22 bp, Homo sapiens
acattgtagacttttcatatgt

SEQ ID NO: 6917026 - DNA, 22 bp, Homo sapiens
caattgacaatgacagtgtcaa

SEQ ID NO: 6917027 - DNA, 21 bp, Homo sapiens
tcacagttggccaggcattta

SEQ ID NO: 6917028 - DNA, 22 bp, Homo sapiens
tggttgcctctcagagattccg

SEQ ID NO: 6917029 - DNA, 22 bp, Homo sapiens
ctgaattaagcattacatacat

SEQ ID NO: 6917030 - DNA, 22 bp, Homo sapiens
gataatttaagtcttgggggct

SEQ ID NO: 6917031 - DNA, 19 bp, Homo sapiens
cctagagggaaggcaggac

SEQ ID NO: 6917032 - DNA, 22 bp, Homo sapiens
gtttgcatgtattaagtcaata

SEQ ID NO: 6917033 - DNA, 22 bp, Homo sapiens
gctggtggcagagctccgcggc

SEQ ID NO: 6917034 - DNA, 22 bp, Homo sapiens
acaggacagggaattcgaaatt

SEQ ID NO: 6917035 - DNA, 22 bp, Homo sapiens
atcactgttatctagaagcaca

SEQ ID NO: 6917036 - DNA, 22 bp, Homo sapiens
acagatgatttttatgaaaaca

SEQ ID NO: 6917037 - DNA, 22 bp, Homo sapiens
gtgggcagagcaagggaactca

SEQ ID NO: 6917038 - DNA, 22 bp, Homo sapiens
gccaggctggttatttaatgag

SEQ ID NO: 6917039 - DNA, 18 bp, Homo sapiens
ttggaggatgtccatgaa

SEQ ID NO: 6917040 - DNA, 22 bp, Homo sapiens
tgcttgtcttcaggaatgctga

SEQ ID NO: 6917041 - DNA, 22 bp, Homo sapiens
atggacagctggcctcaaggga

SEQ ID NO: 6917042 - DNA, 22 bp, Homo sapiens
aaggcagagattagcagaatga

SEQ ID NO: 6917043 - DNA, 22 bp, Homo sapiens
tttctctgctgcctgtgtcgat

SEQ ID NO: 6917044 - DNA, 22 bp, Homo sapiens
ataaagagtctgggaggcccac

SEQ ID NO: 6917045 - DNA, 22 bp, Homo sapiens
ttccttcttcattgtgttacag

SEQ ID NO: 6917046 - DNA, 22 bp, Homo sapiens
aatgcacatgccacatgtggta

SEQ ID NO: 6917047 - DNA, 22 bp, Homo sapiens
gtgattgtttttataaatagga

SEQ ID NO: 6917048 - DNA, 22 bp, Homo sapiens
atgctgagactggagcagctgg

SEQ ID NO: 6917049 - DNA, 22 bp, Homo sapiens
tgacagtgaataagtctcttaa

SEQ ID NO: 6917050 - DNA, 22 bp, Homo sapiens
ccaagattactttcttaattgc

SEQ ID NO: 6917051 - DNA, 22 bp, Homo sapiens
ctgctggtgatgtctgggcatg

SEQ ID NO: 6917052 - DNA, 22 bp, Homo sapiens
aagaaactggaatatagagagc

SEQ ID NO: 6917053 - DNA, 22 bp, Homo sapiens
gaagaagtcattctgtctttca

SEQ ID NO: 6917054 - DNA, 22 bp, Homo sapiens
gtgggggatgctgagttggaaa

SEQ ID NO: 6917055 - DNA, 22 bp, Homo sapiens
aaactcagatgtggtgaagacc

SEQ ID NO: 6917056 - DNA, 22 bp, Homo sapiens
taggaaatattgatttcagtca

SEQ ID NO: 6917057 - DNA, 22 bp, Homo sapiens
ttgtcaggaactatgattatgc

SEQ ID NO: 6917058 - DNA, 22 bp, Homo sapiens
tttgtgtttaatacaaggacct

SEQ ID NO: 6917059 - DNA, 22 bp, Homo sapiens
aagcacctgcaccggtcgcctt

SEQ ID NO: 6917060 - DNA, 22 bp, Homo sapiens
tgccatttagtgcatcattagt

SEQ ID NO: 6917061 - DNA, 22 bp, Homo sapiens
tctggatgatatgtgaacttga

SEQ ID NO: 6917062 - DNA, 22 bp, Homo sapiens
acacatatatgtgcgtgtatat

SEQ ID NO: 6917063 - DNA, 22 bp, Homo sapiens
tctggaccctgggctgtgattt

SEQ ID NO: 6917064 - DNA, 22 bp, Homo sapiens
cagggccagccatcctgctggg

SEQ ID NO: 6917065 - DNA, 22 bp, Homo sapiens
cccaggctgatgttcagcgggt

SEQ ID NO: 6917066 - DNA, 22 bp, Homo sapiens
ttcatattttctgcttgctcac

SEQ ID NO: 6917067 - DNA, 22 bp, Homo sapiens
ctggatccatcgggtcccgagt

SEQ ID NO: 6917068 - DNA, 22 bp, Homo sapiens
caggaaagggatgggctgccac

SEQ ID NO: 6917069 - DNA, 16 bp, Homo sapiens
ttattccctgcctcaa

SEQ ID NO: 6917070 - DNA, 22 bp, Homo sapiens
cttcttaaatatttggctgact

SEQ ID NO: 6917071 - DNA, 18 bp, Homo sapiens
taaggaagggggtgaaga

SEQ ID NO: 6917072 - DNA, 22 bp, Homo sapiens
gcatattttcacaagctcttgg

SEQ ID NO: 6917073 - DNA, 22 bp, Homo sapiens
caagttattcctttacactata

SEQ ID NO: 6917074 - DNA, 22 bp, Homo sapiens
tgggccactgctgcggaaggcg

SEQ ID NO: 6917075 - DNA, 22 bp, Homo sapiens
agtgattttgctttgaagtgac

SEQ ID NO: 6917076 - DNA, 21 bp, Homo sapiens
agaaacatgatcaaaggaacc

SEQ ID NO: 6917077 - DNA, 22 bp, Homo sapiens
ttattcttggatctgagtctct

SEQ ID NO: 6917078 - DNA, 22 bp, Homo sapiens
caccctgggagtggaagtcagt

SEQ ID NO: 6917079 - DNA, 22 bp, Homo sapiens
atctgacatctactagaacaga

SEQ ID NO: 6917080 - DNA, 22 bp, Homo sapiens
aagttgattaatctttcgagaa

SEQ ID NO: 6917081 - DNA, 22 bp, Homo sapiens
atagatcatgttaaaagctcca

SEQ ID NO: 6917082 - DNA, 22 bp, Homo sapiens
gtttatatgtgtgccactctta

SEQ ID NO: 6917083 - DNA, 22 bp, Homo sapiens
gggctgctgggcaagaaacatt

SEQ ID NO: 6917084 - DNA, 22 bp, Homo sapiens
cctctgtggtctgtctaatgca

SEQ ID NO: 6917085 - DNA, 22 bp, Homo sapiens
tgaggcacaggcagtgcccccg

SEQ ID NO: 6917086 - DNA, 22 bp, Homo sapiens
tctgtcattagccttgactgta

SEQ ID NO: 6917087 - DNA, 19 bp, Homo sapiens
atgtaccatttgaagttct

SEQ ID NO: 6917088 - DNA, 22 bp, Homo sapiens
cccagcaggtcggtgctgcctg

SEQ ID NO: 6917089 - DNA, 22 bp, Homo sapiens
ttgttcaggaggggaatgtgag

SEQ ID NO: 6917090 - DNA, 18 bp, Homo sapiens
cttgaagaattttgcagt

SEQ ID NO: 6917091 - DNA, 22 bp, Homo sapiens
cagatggtagcagtagcttgct

SEQ ID NO: 6917092 - DNA, 19 bp, Homo sapiens
agacataaagagtttgcaa

SEQ ID NO: 6917093 - DNA, 22 bp, Homo sapiens
ttctattgaatgataatctata

SEQ ID NO: 6917094 - DNA, 22 bp, Homo sapiens
tagcagagcagggatcagagcc

SEQ ID NO: 6917095 - DNA, 22 bp, Homo sapiens
tttcggaaatgcagaaacttca

SEQ ID NO: 6917096 - DNA, 19 bp, Homo sapiens
aggaatggaattaattctg

SEQ ID NO: 6917097 - DNA, 22 bp, Homo sapiens
cttggtcatttcttgtcctgtt

SEQ ID NO: 6917098 - DNA, 22 bp, Homo sapiens
gtgtgtgccaactttatgtgca

SEQ ID NO: 6917099 - DNA, 22 bp, Homo sapiens
ggagttggtgagcaccaggctt

SEQ ID NO: 6917100 - DNA, 22 bp, Homo sapiens
agggctaccaccaagctgcaca

SEQ ID NO: 6917101 - DNA, 22 bp, Homo sapiens
aattggtttgagttgtctctat

SEQ ID NO: 6917102 - DNA, 23 bp, Homo sapiens
atgattaggtgctatttggagaa

SEQ ID NO: 6917103 - DNA, 22 bp, Homo sapiens
caacatatataaggatttacta

SEQ ID NO: 6917104 - DNA, 22 bp, Homo sapiens
acatatgtgtctgcacatgccc

SEQ ID NO: 6917105 - DNA, 21 bp, Homo sapiens
tgggcccagctctgtctgttt

SEQ ID NO: 6917106 - DNA, 22 bp, Homo sapiens
gtgatggaataatccaagattt

SEQ ID NO: 6917107 - DNA, 23 bp, Homo sapiens
cagatgaggttggcagcatggtc

SEQ ID NO: 6917108 - DNA, 22 bp, Homo sapiens
gtggcagagatagaactggaat

SEQ ID NO: 6917109 - DNA, 22 bp, Homo sapiens
actcggttccactggctactac

SEQ ID NO: 6917110 - DNA, 22 bp, Homo sapiens
caagccgacacacttccctttg

SEQ ID NO: 6917111 - DNA, 22 bp, Homo sapiens
atcatgcttggattatgtttgg

SEQ ID NO: 6917112 - DNA, 22 bp, Homo sapiens
cataactagagtgaaatgttga

SEQ ID NO: 6917113 - DNA, 22 bp, Homo sapiens
ggctgtctctgtgactgccacc

SEQ ID NO: 6917114 - DNA, 22 bp, Homo sapiens
ttgctaatttgtataatgaaaa

SEQ ID NO: 6917115 - DNA, 22 bp, Homo sapiens
gtctgtccttccgactgtagct

SEQ ID NO: 6917116 - DNA, 22 bp, Homo sapiens
tgcagcaagaccggatatgtcg

SEQ ID NO: 6917117 - DNA, 22 bp, Homo sapiens
aaagtgctgcgacatttgagcg

SEQ ID NO: 6917118 - DNA, 22 bp, Homo sapiens
gtaacatttacagttcctagag

SEQ ID NO: 6917119 - DNA, 22 bp, Homo sapiens
gcctggctacccactgaaatat

SEQ ID NO: 6917120 - DNA, 22 bp, Homo sapiens
actcagttatcatgtgtccaca

SEQ ID NO: 6917121 - DNA, 22 bp, Homo sapiens
acaggaggagctgtttcaggga

SEQ ID NO: 6917122 - DNA, 17 bp, Homo sapiens
tttcaaagcagtcagga

SEQ ID NO: 6917123 - DNA, 22 bp, Homo sapiens
gaaatattgtactggagatgtt

SEQ ID NO: 6917124 - DNA, 22 bp, Homo sapiens
tgacagacatggaagccagagt

SEQ ID NO: 6917125 - DNA, 22 bp, Homo sapiens
ctcttacacagattcctctagc

SEQ ID NO: 6917126 - DNA, 22 bp, Homo sapiens
tcccaggacatgggctctgctc

SEQ ID NO: 6917127 - DNA, 18 bp, Homo sapiens
taggaacattgattggag

SEQ ID NO: 6917128 - DNA, 22 bp, Homo sapiens
gtgaccagacagagtctagccc

SEQ ID NO: 6917129 - DNA, 22 bp, Homo sapiens
atgccccaggaggtgccatcca

SEQ ID NO: 6917130 - DNA, 16 bp, Homo sapiens
tgggtgggaggagcgg

SEQ ID NO: 6917131 - DNA, 22 bp, Homo sapiens
attttctggttgaggtttaaca

SEQ ID NO: 6917132 - DNA, 21 bp, Homo sapiens
gcttatagaaacatcaccaga

SEQ ID NO: 6917133 - DNA, 22 bp, Homo sapiens
acaatgttttgaaacatctagg

SEQ ID NO: 6917134 - DNA, 22 bp, Homo sapiens
tcttgattggttgtatagctac

SEQ ID NO: 6917135 - DNA, 18 bp, Homo sapiens
ccttctgacgcttgagaa

SEQ ID NO: 6917136 - DNA, 22 bp, Homo sapiens
taatgactgccgtctctcttca

SEQ ID NO: 6917137 - DNA, 22 bp, Homo sapiens
gctcacctcgctgcaggtgggt

SEQ ID NO: 6917138 - DNA, 22 bp, Homo sapiens
ccagtgtgattgttgcaagaat

SEQ ID NO: 6917139 - DNA, 22 bp, Homo sapiens
ctgcccctggtgatggacgcca

SEQ ID NO: 6917140 - DNA, 22 bp, Homo sapiens
tccaagggaaactgcacttcta

SEQ ID NO: 6917141 - DNA, 22 bp, Homo sapiens
ctgggttgccctgggcctgtga

SEQ ID NO: 6917142 - DNA, 22 bp, Homo sapiens
agtgctatttttgctcatgaac

SEQ ID NO: 6917143 - DNA, 22 bp, Homo sapiens
tggaatgttgggatttaagtgt

SEQ ID NO: 6917144 - DNA, 22 bp, Homo sapiens
tcacattgctcccatagtggat

SEQ ID NO: 6917145 - DNA, 22 bp, Homo sapiens
gtacatacgtagatccatcatt

SEQ ID NO: 6917146 - DNA, 22 bp, Homo sapiens
agacccttcatgtagttcccca

SEQ ID NO: 6917147 - DNA, 22 bp, Homo sapiens
aaaagaggagtggtttatgaca

SEQ ID NO: 6917148 - DNA, 22 bp, Homo sapiens
tcagggagcctggacttcaagg

SEQ ID NO: 6917149 - DNA, 22 bp, Homo sapiens
cccatgtgtgacagtccatttg

SEQ ID NO: 6917150 - DNA, 22 bp, Homo sapiens
gacaggcctagattcactgctg

SEQ ID NO: 6917151 - DNA, 22 bp, Homo sapiens
aattttgtttaagtgatctgct

SEQ ID NO: 6917152 - DNA, 22 bp, Homo sapiens
tgttaacagccagatttggtga

SEQ ID NO: 6917153 - DNA, 22 bp, Homo sapiens
aagttagagattccatcatgct

SEQ ID NO: 6917154 - DNA, 22 bp, Homo sapiens
ctggggtgaaggattacctgag

SEQ ID NO: 6917155 - DNA, 22 bp, Homo sapiens
ggaaagggcatggccttttcac

SEQ ID NO: 6917156 - DNA, 22 bp, Homo sapiens
ggtgtcagtctgggatgagact

SEQ ID NO: 6917157 - DNA, 20 bp, Homo sapiens
tgtgagagggtggcttgccc

SEQ ID NO: 6917158 - DNA, 22 bp, Homo sapiens
aggacagtccggggtcctccac

SEQ ID NO: 6917159 - DNA, 22 bp, Homo sapiens
cccacagttaaccaaaggaatt

SEQ ID NO: 6917160 - DNA, 22 bp, Homo sapiens
ccaaagtcctttctccacctgc

SEQ ID NO: 6917161 - DNA, 22 bp, Homo sapiens
ataggagatcaatatgcaattt

SEQ ID NO: 6917162 - DNA, 22 bp, Homo sapiens
cgcccagggcaggaggccgctc

SEQ ID NO: 6917163 - DNA, 22 bp, Homo sapiens
gctatggctttggaatagctgt

SEQ ID NO: 6917164 - DNA, 22 bp, Homo sapiens
tttgtgtgggggaaacaaggta

SEQ ID NO: 6917165 - DNA, 18 bp, Homo sapiens
tgtgggttgggcagacca

SEQ ID NO: 6917166 - DNA, 22 bp, Homo sapiens
ggtccagccaggtgctcatgcc

SEQ ID NO: 6917167 - DNA, 22 bp, Homo sapiens
tgccagcttctaaggacccagg

SEQ ID NO: 6917168 - DNA, 22 bp, Homo sapiens
gtctggagggaagagatgtcag

SEQ ID NO: 6917169 - DNA, 17 bp, Homo sapiens
ggcatttgtcaggcaga

SEQ ID NO: 6917170 - DNA, 22 bp, Homo sapiens
tgctgaaatatttatgggtcaa

SEQ ID NO: 6917171 - DNA, 22 bp, Homo sapiens
atgtgtccattatcagttctgg

SEQ ID NO: 6917172 - DNA, 22 bp, Homo sapiens
atgtagcttcctaggagtgatt

SEQ ID NO: 6917173 - DNA, 22 bp, Homo sapiens
tatgagaacaagaacaatctcc

SEQ ID NO: 6917174 - DNA, 17 bp, Homo sapiens
gaggagctccagtaggt

SEQ ID NO: 6917175 - DNA, 22 bp, Homo sapiens
tagaatgttaagaatatgtata

SEQ ID NO: 6917176 - DNA, 19 bp, Homo sapiens
tgaaggagggggatggcca

SEQ ID NO: 6917177 - DNA, 22 bp, Homo sapiens
tttagtaagttcactgcaaagc

SEQ ID NO: 6917178 - DNA, 21 bp, Homo sapiens
gggtaaggaaaatgattcttc

SEQ ID NO: 6917179 - DNA, 22 bp, Homo sapiens
ttgatgttcataaatgatacag

SEQ ID NO: 6917180 - DNA, 22 bp, Homo sapiens
ttagtgtattttcaaatgtaga

SEQ ID NO: 6917181 - DNA, 22 bp, Homo sapiens
gatgcaaaagtatcattttaat

SEQ ID NO: 6917182 - DNA, 22 bp, Homo sapiens
actgaatttgtgtagatggtct

SEQ ID NO: 6917183 - DNA, 22 bp, Homo sapiens
cagctcttcctcccaccggaca

SEQ ID NO: 6917184 - DNA, 22 bp, Homo sapiens
gaatgcagttcatttctctatg

SEQ ID NO: 6917185 - DNA, 22 bp, Homo sapiens
acttccccgaagctggaaatag

SEQ ID NO: 6917186 - DNA, 22 bp, Homo sapiens
ctcccgtgatcctggaggagag

SEQ ID NO: 6917187 - DNA, 22 bp, Homo sapiens
ttgaagaacataatagctactt

SEQ ID NO: 6917188 - DNA, 22 bp, Homo sapiens
gctgcaggggggtctggacttg

SEQ ID NO: 6917189 - DNA, 22 bp, Homo sapiens
ggagatactatctttacaattc

SEQ ID NO: 6917190 - DNA, 22 bp, Homo sapiens
tgtcaattatcaaggttcattt

SEQ ID NO: 6917191 - DNA, 22 bp, Homo sapiens
tcaattcaattgcatttctgtg

SEQ ID NO: 6917192 - DNA, 23 bp, Homo sapiens
tgagcccaggaggtcaaggctgc

SEQ ID NO: 6917193 - DNA, 22 bp, Homo sapiens
aaattgtaatgacttcacttga

SEQ ID NO: 6917194 - DNA, 22 bp, Homo sapiens
atgctttacagttttccaaaca

SEQ ID NO: 6917195 - DNA, 19 bp, Homo sapiens
ccctagagtaagactgcat

SEQ ID NO: 6917196 - DNA, 22 bp, Homo sapiens
gtgcctcccgggaccatgcact

SEQ ID NO: 6917197 - DNA, 22 bp, Homo sapiens
tggaagacattttggaccttgg

SEQ ID NO: 6917198 - DNA, 22 bp, Homo sapiens
gaacatttccagaaaggaacta

SEQ ID NO: 6917199 - DNA, 22 bp, Homo sapiens
tccctagaatatctgctgcagc

SEQ ID NO: 6917200 - DNA, 22 bp, Homo sapiens
gggctctgcgctcagctccagc

SEQ ID NO: 6917201 - DNA, 22 bp, Homo sapiens
tcagaggtccctagcaggagtg

SEQ ID NO: 6917202 - DNA, 22 bp, Homo sapiens
ggacaggccgcctcggtggggg

SEQ ID NO: 6917203 - DNA, 19 bp, Homo sapiens
tgtgttccatccaccaccc

SEQ ID NO: 6917204 - DNA, 22 bp, Homo sapiens
cagtgctgacagggaggaacct

SEQ ID NO: 6917205 - DNA, 22 bp, Homo sapiens
ttctttctggggtccttcggct

SEQ ID NO: 6917206 - DNA, 22 bp, Homo sapiens
tcttcctagttacatatgcaca

SEQ ID NO: 6917207 - DNA, 22 bp, Homo sapiens
attatctcaagggatagcagat

SEQ ID NO: 6917208 - DNA, 22 bp, Homo sapiens
tgggctgccctgatggtcctca

SEQ ID NO: 6917209 - DNA, 22 bp, Homo sapiens
gctgcctcccccatggctggaa

SEQ ID NO: 6917210 - DNA, 22 bp, Homo sapiens
ctgggtgttgggtactgaccgt

SEQ ID NO: 6917211 - DNA, 22 bp, Homo sapiens
tgtagctttatattgtgttggg

SEQ ID NO: 6917212 - DNA, 19 bp, Homo sapiens
tttcatgtttttggtgaga

SEQ ID NO: 6917213 - DNA, 22 bp, Homo sapiens
aggagcaaggaagctacagttt

SEQ ID NO: 6917214 - DNA, 21 bp, Homo sapiens
cctgtggattttaaaattgga

SEQ ID NO: 6917215 - DNA, 22 bp, Homo sapiens
tgccacctcctctaacaagtgg

SEQ ID NO: 6917216 - DNA, 22 bp, Homo sapiens
tgtggcacttctctccttgtaa

SEQ ID NO: 6917217 - DNA, 22 bp, Homo sapiens
agatgttttctaattctatatt

SEQ ID NO: 6917218 - DNA, 22 bp, Homo sapiens
agataggccattaagaaggata

SEQ ID NO: 6917219 - DNA, 22 bp, Homo sapiens
gtgaagccacagagccacgccg

SEQ ID NO: 6917220 - DNA, 18 bp, Homo sapiens
acagtgattgttctatgc

SEQ ID NO: 6917221 - DNA, 22 bp, Homo sapiens
atggtttaagggagaatattga

SEQ ID NO: 6917222 - DNA, 22 bp, Homo sapiens
ttctgtctccctgatgtagagc

SEQ ID NO: 6917223 - DNA, 22 bp, Homo sapiens
atctggaggcattactctgtct

SEQ ID NO: 6917224 - DNA, 19 bp, Homo sapiens
ttggttacaactgagcttc

SEQ ID NO: 6917225 - DNA, 22 bp, Homo sapiens
tcatatactgccttgtagatta

SEQ ID NO: 6917226 - DNA, 22 bp, Homo sapiens
tgacattagaacccaggtgtct

SEQ ID NO: 6917227 - DNA, 22 bp, Homo sapiens
tcagaagtcccagaattcacat

SEQ ID NO: 6917228 - DNA, 22 bp, Homo sapiens
gaacataattaaatgtcctggg

SEQ ID NO: 6917229 - DNA, 22 bp, Homo sapiens
accactgagtgtccttcagggt

SEQ ID NO: 6917230 - DNA, 22 bp, Homo sapiens
tactttttgtctctttgaatgt

SEQ ID NO: 6917231 - DNA, 22 bp, Homo sapiens
ttgtgtaaatatctaaatgttt

SEQ ID NO: 6917232 - DNA, 21 bp, Homo sapiens
cagaaacttgctttgccttct

SEQ ID NO: 6917233 - DNA, 22 bp, Homo sapiens
tcactgctctgaaagtacaggg

SEQ ID NO: 6917234 - DNA, 22 bp, Homo sapiens
caagcagggatactgcagggag

SEQ ID NO: 6917235 - DNA, 22 bp, Homo sapiens
tctgaaagaaagattttgtttc

SEQ ID NO: 6917236 - DNA, 22 bp, Homo sapiens
caagagcttctgctcttcatgg

SEQ ID NO: 6917237 - DNA, 22 bp, Homo sapiens
caacacaggttctgcaaaggaa

SEQ ID NO: 6917238 - DNA, 22 bp, Homo sapiens
tcaattagggtctatttctagt

SEQ ID NO: 6917239 - DNA, 22 bp, Homo sapiens
tggcaggaaccaggaggctctc

SEQ ID NO: 6917240 - DNA, 22 bp, Homo sapiens
caggcctgtgagttgaggcccc

SEQ ID NO: 6917241 - DNA, 22 bp, Homo sapiens
cctgagtccaaaagtctttagc

SEQ ID NO: 6917242 - DNA, 22 bp, Homo sapiens
gaggcctgggcaagggggtctg

SEQ ID NO: 6917243 - DNA, 19 bp, Homo sapiens
tctctatatttgtttctga

SEQ ID NO: 6917244 - DNA, 22 bp, Homo sapiens
tgcctcataacactcctggagt

SEQ ID NO: 6917245 - DNA, 22 bp, Homo sapiens
cacaggaagatctcccagaggt

SEQ ID NO: 6917246 - DNA, 22 bp, Homo sapiens
gacttctgcctcaggggaaggt

SEQ ID NO: 6917247 - DNA, 22 bp, Homo sapiens
attaaatgttggcatattttgt

SEQ ID NO: 6917248 - DNA, 22 bp, Homo sapiens
tctagaagtatattgtagggtg

SEQ ID NO: 6917249 - DNA, 22 bp, Homo sapiens
aggtttctttatgctgctagaa

SEQ ID NO: 6917250 - DNA, 22 bp, Homo sapiens
taggtagaaatagatattggta

SEQ ID NO: 6917251 - DNA, 22 bp, Homo sapiens
tagtgtggtatcttctatggaa

SEQ ID NO: 6917252 - DNA, 22 bp, Homo sapiens
ggctatggaagataaggctgaa

SEQ ID NO: 6917253 - DNA, 22 bp, Homo sapiens
ggacagggctcttggcactcct

SEQ ID NO: 6917254 - DNA, 20 bp, Homo sapiens
atggaggaagggcaagagaa

SEQ ID NO: 6917255 - DNA, 23 bp, Homo sapiens
tgtgtacacaatagatgaggttt

SEQ ID NO: 6917256 - DNA, 22 bp, Homo sapiens
aagtgattccttgcagacacac

SEQ ID NO: 6917257 - DNA, 22 bp, Homo sapiens
gctccagagtgtggcatctggg

SEQ ID NO: 6917258 - DNA, 22 bp, Homo sapiens
gccaaggcctctgcaggatgag

SEQ ID NO: 6917259 - DNA, 22 bp, Homo sapiens
tggaaaatcaggggacattgat

SEQ ID NO: 6917260 - DNA, 22 bp, Homo sapiens
ctgtccgccgacttggccaggc

SEQ ID NO: 6917261 - DNA, 22 bp, Homo sapiens
ttggaaatgcatttgttattat

SEQ ID NO: 6917262 - DNA, 22 bp, Homo sapiens
ctcttagtcaatgtgcatattt

SEQ ID NO: 6917263 - DNA, 22 bp, Homo sapiens
atagtgcagtggactgagttaa

SEQ ID NO: 6917264 - DNA, 22 bp, Homo sapiens
agccctgcgatcgtgatttctt

SEQ ID NO: 6917265 - DNA, 22 bp, Homo sapiens
ttccacaattcagattgttgcc

SEQ ID NO: 6917266 - DNA, 22 bp, Homo sapiens
taagttcataagcttattctta

SEQ ID NO: 6917267 - DNA, 22 bp, Homo sapiens
taggggaactggcacagggcag

SEQ ID NO: 6917268 - DNA, 22 bp, Homo sapiens
tggcttcagatctgccccggag

SEQ ID NO: 6917269 - DNA, 22 bp, Homo sapiens
cctgcagaagagtccagctcat

SEQ ID NO: 6917270 - DNA, 22 bp, Homo sapiens
acttccagctgccctgtgtgct

SEQ ID NO: 6917271 - DNA, 22 bp, Homo sapiens
aataatgtacatacatatttcg

SEQ ID NO: 6917272 - DNA, 22 bp, Homo sapiens
gatgagtgaggacagggtggca

SEQ ID NO: 6917273 - DNA, 22 bp, Homo sapiens
agaaatgtcaagtgttcttgtt

SEQ ID NO: 6917274 - DNA, 22 bp, Homo sapiens
ctcatggagggagtgctcttcc

SEQ ID NO: 6917275 - DNA, 22 bp, Homo sapiens
tacgtgtgttcgtgtaagcact

SEQ ID NO: 6917276 - DNA, 22 bp, Homo sapiens
gctgccctagaagtacagagag

SEQ ID NO: 6917277 - DNA, 23 bp, Homo sapiens
acatttcatataaaagggatcag

SEQ ID NO: 6917278 - DNA, 22 bp, Homo sapiens
atgtcatgaggctagcccccaa

SEQ ID NO: 6917279 - DNA, 22 bp, Homo sapiens
ccagaaaaatcctcccttgtcc

SEQ ID NO: 6917280 - DNA, 22 bp, Homo sapiens
ttggccagtggaaagaggagga

SEQ ID NO: 6917281 - DNA, 22 bp, Homo sapiens
caggtgttttttattctgaaag

SEQ ID NO: 6917282 - DNA, 22 bp, Homo sapiens
acacactgttgctcatccaggc

SEQ ID NO: 6917283 - DNA, 22 bp, Homo sapiens
tgtctgtctgtacctatttttt

SEQ ID NO: 6917284 - DNA, 22 bp, Homo sapiens
cgctgggcgccgacctgctggc

SEQ ID NO: 6917285 - DNA, 22 bp, Homo sapiens
ttctcataggagcgcaaaccct

SEQ ID NO: 6917286 - DNA, 22 bp, Homo sapiens
atgctttattgcttctgggcac

SEQ ID NO: 6917287 - DNA, 23 bp, Homo sapiens
gtcatctctcctgggccagcgcc

SEQ ID NO: 6917288 - DNA, 22 bp, Homo sapiens
ggttctttggcagtctgattga

SEQ ID NO: 6917289 - DNA, 22 bp, Homo sapiens
actgtgggcagcttctgggaac

SEQ ID NO: 6917290 - DNA, 22 bp, Homo sapiens
ggcaattttcatgaattattga

SEQ ID NO: 6917291 - DNA, 22 bp, Homo sapiens
cttagaatgtctactcttacca

SEQ ID NO: 6917292 - DNA, 22 bp, Homo sapiens
aaagccatatctattctattct

SEQ ID NO: 6917293 - DNA, 22 bp, Homo sapiens
cctgctgaggtcagccacccaa

SEQ ID NO: 6917294 - DNA, 22 bp, Homo sapiens
tggctccaaaaacaaatgacat

SEQ ID NO: 6917295 - DNA, 22 bp, Homo sapiens
taatttatatggaattgttgct

SEQ ID NO: 6917296 - DNA, 22 bp, Homo sapiens
ctggagtgtaaagagcatagaa

SEQ ID NO: 6917297 - DNA, 22 bp, Homo sapiens
gaattcctctgagctaggagat

SEQ ID NO: 6917298 - DNA, 22 bp, Homo sapiens
tgcttggcttcatttaagtttt

SEQ ID NO: 6917299 - DNA, 22 bp, Homo sapiens
gctggacttagaggtggaaaag

SEQ ID NO: 6917300 - DNA, 22 bp, Homo sapiens
gcatagaaggttttggtatcaa

SEQ ID NO: 6917301 - DNA, 22 bp, Homo sapiens
agctggcccactgtgtggtcca

SEQ ID NO: 6917302 - DNA, 16 bp, Homo sapiens
ggaggtgggtaaggtg

SEQ ID NO: 6917303 - DNA, 22 bp, Homo sapiens
ttgtcttaccaaatatgatgca

SEQ ID NO: 6917304 - DNA, 22 bp, Homo sapiens
tctgttcatttgcctcggctct

SEQ ID NO: 6917305 - DNA, 22 bp, Homo sapiens
agctctccacacataggactag

SEQ ID NO: 6917306 - DNA, 21 bp, Homo sapiens
ctctttgtggcaatgtatttt

SEQ ID NO: 6917307 - DNA, 22 bp, Homo sapiens
ttccatgttgatgtgggcccca

SEQ ID NO: 6917308 - DNA, 22 bp, Homo sapiens
gataaagggggaccaaatgact

SEQ ID NO: 6917309 - DNA, 22 bp, Homo sapiens
ttgaggtatagttgacaattta

SEQ ID NO: 6917310 - DNA, 22 bp, Homo sapiens
tgtctcttgttaatgattacta

SEQ ID NO: 6917311 - DNA, 22 bp, Homo sapiens
ctactgaagataactggctctt

SEQ ID NO: 6917312 - DNA, 22 bp, Homo sapiens
tatgtacagtccttaacttaaa

SEQ ID NO: 6917313 - DNA, 22 bp, Homo sapiens
catttgaaattcttagaacaaa

SEQ ID NO: 6917314 - DNA, 19 bp, Homo sapiens
ttcagcattatattctagc

SEQ ID NO: 6917315 - DNA, 22 bp, Homo sapiens
atcagcccaccatcttcataac

SEQ ID NO: 6917316 - DNA, 22 bp, Homo sapiens
gctgaggctcaagtcatgggtc

SEQ ID NO: 6917317 - DNA, 22 bp, Homo sapiens
taggcaagaccttccctcttta

SEQ ID NO: 6917318 - DNA, 17 bp, Homo sapiens
tctgttcaagtgagagg

SEQ ID NO: 6917319 - DNA, 22 bp, Homo sapiens
ttagggaaatatttatatactt

SEQ ID NO: 6917320 - DNA, 22 bp, Homo sapiens
ctacagtgaagactagctatag

SEQ ID NO: 6917321 - DNA, 22 bp, Homo sapiens
ccccaaccctggttccgtggcg

SEQ ID NO: 6917322 - DNA, 22 bp, Homo sapiens
ttgtgtggataatattacttga

SEQ ID NO: 6917323 - DNA, 22 bp, Homo sapiens
gcctggattccttgtttctcag

SEQ ID NO: 6917324 - DNA, 22 bp, Homo sapiens
tccaagggcatgctgaaataag

SEQ ID NO: 6917325 - DNA, 20 bp, Homo sapiens
ctcttattgcattagtttct

SEQ ID NO: 6917326 - DNA, 22 bp, Homo sapiens
gcttggccaacatggtgaaacc

SEQ ID NO: 6917327 - DNA, 22 bp, Homo sapiens
tatttaaaataagccccagtgg

SEQ ID NO: 6917328 - DNA, 22 bp, Homo sapiens
gttgtgcaccactgttgattga

SEQ ID NO: 6917329 - DNA, 22 bp, Homo sapiens
aggtggctgtggcttcccttgt

SEQ ID NO: 6917330 - DNA, 22 bp, Homo sapiens
ttgcttccagtccaagtctgtt

SEQ ID NO: 6917331 - DNA, 22 bp, Homo sapiens
aaagcagcggtgtctttactgc

SEQ ID NO: 6917332 - DNA, 22 bp, Homo sapiens
cagaaggagcgctaaggtccca

SEQ ID NO: 6917333 - DNA, 22 bp, Homo sapiens
aacatcagcacacaatagcaag

SEQ ID NO: 6917334 - DNA, 22 bp, Homo sapiens
ctgtttcaaagggtactgtgag

SEQ ID NO: 6917335 - DNA, 22 bp, Homo sapiens
aaggcactgagccagccgtctc

SEQ ID NO: 6917336 - DNA, 22 bp, Homo sapiens
tgtatacaagtcgtgtaaactt

SEQ ID NO: 6917337 - DNA, 22 bp, Homo sapiens
atgtcctttgcttctctggtcc

SEQ ID NO: 6917338 - DNA, 22 bp, Homo sapiens
gcgagtccactggggggcgcag

SEQ ID NO: 6917339 - DNA, 22 bp, Homo sapiens
tgccttgcaggttttaaataca

SEQ ID NO: 6917340 - DNA, 22 bp, Homo sapiens
ttgctgattctgtatttaaggt

SEQ ID NO: 6917341 - DNA, 22 bp, Homo sapiens
cagtcctgagccaatcatgatg

SEQ ID NO: 6917342 - DNA, 22 bp, Homo sapiens
tgagagttcctcctctttccac

SEQ ID NO: 6917343 - DNA, 22 bp, Homo sapiens
aagggttgaagataaataaggt

SEQ ID NO: 6917344 - DNA, 22 bp, Homo sapiens
gcgaggaggggtgctgggcccc

SEQ ID NO: 6917345 - DNA, 22 bp, Homo sapiens
agatccatccagcactcttgcc

SEQ ID NO: 6917346 - DNA, 22 bp, Homo sapiens
cttcctgcccacttcctgctgg

SEQ ID NO: 6917347 - DNA, 22 bp, Homo sapiens
gaggaagaaagcataggtgggg

SEQ ID NO: 6917348 - DNA, 22 bp, Homo sapiens
tctcagtggtgttttgagtcca

SEQ ID NO: 6917349 - DNA, 22 bp, Homo sapiens
gtttgctgccaccaccgccaca

SEQ ID NO: 6917350 - DNA, 22 bp, Homo sapiens
ttctgagattatcatacaacat

SEQ ID NO: 6917351 - DNA, 22 bp, Homo sapiens
gggtgaaccagagctgttttct

SEQ ID NO: 6917352 - DNA, 22 bp, Homo sapiens
atgtgcttcataatcttctcat

SEQ ID NO: 6917353 - DNA, 20 bp, Homo sapiens
gcatggcatgtagtgaagtg

SEQ ID NO: 6917354 - DNA, 22 bp, Homo sapiens
gttccttggaagaacttgaggt

SEQ ID NO: 6917355 - DNA, 18 bp, Homo sapiens
ggctgctcgctctccccg

SEQ ID NO: 6917356 - DNA, 22 bp, Homo sapiens
agcatctgttaagtgccttcaa

SEQ ID NO: 6917357 - DNA, 19 bp, Homo sapiens
agccagaactagtgtttct

SEQ ID NO: 6917358 - DNA, 22 bp, Homo sapiens
tattgtgtttgcaagtcctatt

SEQ ID NO: 6917359 - DNA, 22 bp, Homo sapiens
atggctgtgtgcttctccccat

SEQ ID NO: 6917360 - DNA, 22 bp, Homo sapiens
tgctgtcaagaaaacaagcaat

SEQ ID NO: 6917361 - DNA, 22 bp, Homo sapiens
aggtaagaatagaggattgggg

SEQ ID NO: 6917362 - DNA, 22 bp, Homo sapiens
tttggtcagcaatattgtgggg

SEQ ID NO: 6917363 - DNA, 22 bp, Homo sapiens
gagaggtagcagtaagaacagg

SEQ ID NO: 6917364 - DNA, 22 bp, Homo sapiens
atagtacaatcagttaattagt

SEQ ID NO: 6917365 - DNA, 22 bp, Homo sapiens
tccaaagaatagaggtgacatt

SEQ ID NO: 6917366 - DNA, 23 bp, Homo sapiens
ttcatatgttgctgaaaacagca

SEQ ID NO: 6917367 - DNA, 22 bp, Homo sapiens
attctagctcatctactttcca

SEQ ID NO: 6917368 - DNA, 22 bp, Homo sapiens
actgtactcttctagccatctg

SEQ ID NO: 6917369 - DNA, 21 bp, Homo sapiens
tccagtggtgtctagaatgtg

SEQ ID NO: 6917370 - DNA, 22 bp, Homo sapiens
gtaaagtaaacccactttgtag

SEQ ID NO: 6917371 - DNA, 20 bp, Homo sapiens
ctccaggggaagagccttcc

SEQ ID NO: 6917372 - DNA, 22 bp, Homo sapiens
tttggactgcatgatgatctgg

SEQ ID NO: 6917373 - DNA, 22 bp, Homo sapiens
tctgggagagtctaacttgttt

SEQ ID NO: 6917374 - DNA, 22 bp, Homo sapiens
tttcagtttatgtcttgaatta

SEQ ID NO: 6917375 - DNA, 21 bp, Homo sapiens
ttacacactgcttctagaatg

SEQ ID NO: 6917376 - DNA, 22 bp, Homo sapiens
gaactgtgggtaatatattaga

SEQ ID NO: 6917377 - DNA, 22 bp, Homo sapiens
tacatagcaaggaaatgacaga

SEQ ID NO: 6917378 - DNA, 22 bp, Homo sapiens
tctggacgtgttggtgaggacc

SEQ ID NO: 6917379 - DNA, 22 bp, Homo sapiens
gtcttctgcaactgcacctgcc

SEQ ID NO: 6917380 - DNA, 22 bp, Homo sapiens
gagcttggaagcagatcctcac

SEQ ID NO: 6917381 - DNA, 22 bp, Homo sapiens
aggaggcctgtgtttgtctgta

SEQ ID NO: 6917382 - DNA, 20 bp, Homo sapiens
acagtcgcctatcaaccagg

SEQ ID NO: 6917383 - DNA, 22 bp, Homo sapiens
ttggtcacagaacgtgatttta

SEQ ID NO: 6917384 - DNA, 22 bp, Homo sapiens
tgtgcctgttggtgtagacata

SEQ ID NO: 6917385 - DNA, 22 bp, Homo sapiens
gccaggtgatttcaaagtcctt

SEQ ID NO: 6917386 - DNA, 22 bp, Homo sapiens
agaggctgcaggctggaaatca

SEQ ID NO: 6917387 - DNA, 22 bp, Homo sapiens
ctggagccactgggtcttgtat

SEQ ID NO: 6917388 - DNA, 22 bp, Homo sapiens
tcacagaatagcactgtaagcg

SEQ ID NO: 6917389 - DNA, 22 bp, Homo sapiens
caggcatagaagggcaagaata

SEQ ID NO: 6917390 - DNA, 22 bp, Homo sapiens
ctgtttctccacactcttccca

SEQ ID NO: 6917391 - DNA, 22 bp, Homo sapiens
tggcatctccgacagtcttgat

SEQ ID NO: 6917392 - DNA, 22 bp, Homo sapiens
actatgtaggctcaacttccac

SEQ ID NO: 6917393 - DNA, 22 bp, Homo sapiens
cttcttggctgcaagtctctgt

SEQ ID NO: 6917394 - DNA, 22 bp, Homo sapiens
cgccgtaaatgcaagcctgtag

SEQ ID NO: 6917395 - DNA, 22 bp, Homo sapiens
ctgaggcctctgttcaccagaa

SEQ ID NO: 6917396 - DNA, 22 bp, Homo sapiens
gttgaatatcgtgttcttgttt

SEQ ID NO: 6917397 - DNA, 22 bp, Homo sapiens
ctacatgtaggtttccttaatt

SEQ ID NO: 6917398 - DNA, 22 bp, Homo sapiens
gatgtgtgctgcatagtatatt

SEQ ID NO: 6917399 - DNA, 22 bp, Homo sapiens
ctctactcttaacacagctagg

SEQ ID NO: 6917400 - DNA, 22 bp, Homo sapiens
gtcagtggtagggctagttcag

SEQ ID NO: 6917401 - DNA, 22 bp, Homo sapiens
tagaagcaccactcatcacgtg

SEQ ID NO: 6917402 - DNA, 17 bp, Homo sapiens
tggtctggaagaactga

SEQ ID NO: 6917403 - DNA, 22 bp, Homo sapiens
tccaggctgggctgaagggtgc

SEQ ID NO: 6917404 - DNA, 22 bp, Homo sapiens
cctgcacttctcacagctgctg

SEQ ID NO: 6917405 - DNA, 18 bp, Homo sapiens
acagacacttagtatgag

SEQ ID NO: 6917406 - DNA, 22 bp, Homo sapiens
cacagtttggtatagaagtgat

SEQ ID NO: 6917407 - DNA, 22 bp, Homo sapiens
agacacctaatagatgaattca

SEQ ID NO: 6917408 - DNA, 22 bp, Homo sapiens
aaaacctcagttctgctcttaa

SEQ ID NO: 6917409 - DNA, 22 bp, Homo sapiens
actgcctgctcataacattgct

SEQ ID NO: 6917410 - DNA, 22 bp, Homo sapiens
cgcagagacatggcgacagaga

SEQ ID NO: 6917411 - DNA, 22 bp, Homo sapiens
gggcactggtgctgccatcttg

SEQ ID NO: 6917412 - DNA, 22 bp, Homo sapiens
ttaagtgcctacttgtgagtta

SEQ ID NO: 6917413 - DNA, 22 bp, Homo sapiens
gaatagattatacttgaagcat

SEQ ID NO: 6917414 - DNA, 22 bp, Homo sapiens
acacagagttattatgtgaact

SEQ ID NO: 6917415 - DNA, 22 bp, Homo sapiens
ctaacatttggaaggcttatga

SEQ ID NO: 6917416 - DNA, 22 bp, Homo sapiens
ctcagaaagtgacaggggggtg

SEQ ID NO: 6917417 - DNA, 22 bp, Homo sapiens
ctggccacatgtgtgctgagca

SEQ ID NO: 6917418 - DNA, 22 bp, Homo sapiens
actcaacagggaacaagatcag

SEQ ID NO: 6917419 - DNA, 22 bp, Homo sapiens
ggttccaggcatggcaggatgt

SEQ ID NO: 6917420 - DNA, 22 bp, Homo sapiens
ggcacagcgactaccatcgaaa

SEQ ID NO: 6917421 - DNA, 22 bp, Homo sapiens
gctgacaagtccagagcccttc

SEQ ID NO: 6917422 - DNA, 22 bp, Homo sapiens
cgctcagtacagtaatgatggg

SEQ ID NO: 6917423 - DNA, 20 bp, Homo sapiens
atgcaaaccctgctttgtgg

SEQ ID NO: 6917424 - DNA, 22 bp, Homo sapiens
ttattgcatagattatgccata

SEQ ID NO: 6917425 - DNA, 22 bp, Homo sapiens
ctatttggccatagtgcagtta

SEQ ID NO: 6917426 - DNA, 22 bp, Homo sapiens
attttgatgctatctaatgaat

SEQ ID NO: 6917427 - DNA, 21 bp, Homo sapiens
tttatgtacttcatagagtag

SEQ ID NO: 6917428 - DNA, 22 bp, Homo sapiens
agctcccagggctgggcaagtt

SEQ ID NO: 6917429 - DNA, 21 bp, Homo sapiens
atcaatgacctggcatgaggg

SEQ ID NO: 6917430 - DNA, 22 bp, Homo sapiens
cctggctcagcagctctttctc

SEQ ID NO: 6917431 - DNA, 22 bp, Homo sapiens
agtgggagataacttaacagct

SEQ ID NO: 6917432 - DNA, 22 bp, Homo sapiens
acactttagtatgaagaggtag

SEQ ID NO: 6917433 - DNA, 22 bp, Homo sapiens
acactgactgggcagtatagtc

SEQ ID NO: 6917434 - DNA, 22 bp, Homo sapiens
gagcaatagaaagaatactgct

SEQ ID NO: 6917435 - DNA, 19 bp, Homo sapiens
ctttgcttgtttctgtgtc

SEQ ID NO: 6917436 - DNA, 22 bp, Homo sapiens
acatcacagtagttaagccaga

SEQ ID NO: 6917437 - DNA, 22 bp, Homo sapiens
cccagggattataaaggtgaaa

SEQ ID NO: 6917438 - DNA, 22 bp, Homo sapiens
atttgcctttcgaatcaacagg

SEQ ID NO: 6917439 - DNA, 22 bp, Homo sapiens
gcgtgtcaatctatctgttcca

SEQ ID NO: 6917440 - DNA, 22 bp, Homo sapiens
tgaagccatccctcagatggcc

SEQ ID NO: 6917441 - DNA, 22 bp, Homo sapiens
tcccaccaggtgaccatttcat

SEQ ID NO: 6917442 - DNA, 22 bp, Homo sapiens
tgggaagaggggtataaagaag

SEQ ID NO: 6917443 - DNA, 22 bp, Homo sapiens
tgcatcagtgactgaatatgag

SEQ ID NO: 6917444 - DNA, 22 bp, Homo sapiens
ggctgcttctgatttctaatgt

SEQ ID NO: 6917445 - DNA, 22 bp, Homo sapiens
attacagtaaatgctacaggca

SEQ ID NO: 6917446 - DNA, 22 bp, Homo sapiens
ctatgcaggccaggtccgcccg

SEQ ID NO: 6917447 - DNA, 22 bp, Homo sapiens
tgggcaaactgtcaaccatgtc

SEQ ID NO: 6917448 - DNA, 22 bp, Homo sapiens
tgaaagtagcgcatttcactca

SEQ ID NO: 6917449 - DNA, 22 bp, Homo sapiens
cttgatggtggcagaagagtga

SEQ ID NO: 6917450 - DNA, 22 bp, Homo sapiens
tatgtatccgtgtgtgtacaga

SEQ ID NO: 6917451 - DNA, 22 bp, Homo sapiens
cagaggaagagatacaagccct

SEQ ID NO: 6917452 - DNA, 21 bp, Homo sapiens
acaggctttagaaaatgactc

SEQ ID NO: 6917453 - DNA, 22 bp, Homo sapiens
tgcaataatgtatgtcactccc

SEQ ID NO: 6917454 - DNA, 22 bp, Homo sapiens
tacaaagtcaccagcttcttgc

SEQ ID NO: 6917455 - DNA, 22 bp, Homo sapiens
ttccttagagtttccagaaagc

SEQ ID NO: 6917456 - DNA, 22 bp, Homo sapiens
atctacaaaaactgtctcagga

SEQ ID NO: 6917457 - DNA, 22 bp, Homo sapiens
tcaggctttgggaatgccactt

SEQ ID NO: 6917458 - DNA, 22 bp, Homo sapiens
tgagcccaggagttggagaccg

SEQ ID NO: 6917459 - DNA, 22 bp, Homo sapiens
atgtccagaggtgagtcagagc

SEQ ID NO: 6917460 - DNA, 22 bp, Homo sapiens
gctaggagtaaggagaccttca

SEQ ID NO: 6917461 - DNA, 22 bp, Homo sapiens
ttccactcttctctggacttat

SEQ ID NO: 6917462 - DNA, 22 bp, Homo sapiens
tggaagataagagattgggaag

SEQ ID NO: 6917463 - DNA, 22 bp, Homo sapiens
taggaggccatccagcctgcct

SEQ ID NO: 6917464 - DNA, 22 bp, Homo sapiens
cttggctgcttttgtgcacatt

SEQ ID NO: 6917465 - DNA, 22 bp, Homo sapiens
tattatgaggtatttggacttt

SEQ ID NO: 6917466 - DNA, 22 bp, Homo sapiens
caggtttctagttctaagaata

SEQ ID NO: 6917467 - DNA, 22 bp, Homo sapiens
gcttcctagcattagccattgc

SEQ ID NO: 6917468 - DNA, 21 bp, Homo sapiens
agggtcctacagggctcagga

SEQ ID NO: 6917469 - DNA, 22 bp, Homo sapiens
tgccctgtgctggaatcttccc

SEQ ID NO: 6917470 - DNA, 22 bp, Homo sapiens
atgtccttgagaccctcctcgg

SEQ ID NO: 6917471 - DNA, 22 bp, Homo sapiens
atcactgggcttctaatcactg

SEQ ID NO: 6917472 - DNA, 22 bp, Homo sapiens
caggatggagagtgaggggtca

SEQ ID NO: 6917473 - DNA, 17 bp, Homo sapiens
cagctctgcatcttcct

SEQ ID NO: 6917474 - DNA, 22 bp, Homo sapiens
tggtggagacctcgctaacccc

SEQ ID NO: 6917475 - DNA, 22 bp, Homo sapiens
aatgtggttaaaatttggttgt

SEQ ID NO: 6917476 - DNA, 22 bp, Homo sapiens
tgtgtgaagcactctgggtgat

SEQ ID NO: 6917477 - DNA, 22 bp, Homo sapiens
ccataaggttgaaaactgtaca

SEQ ID NO: 6917478 - DNA, 22 bp, Homo sapiens
gcagacatgttcctttctgtca

SEQ ID NO: 6917479 - DNA, 22 bp, Homo sapiens
acctgtgctttcaaggagctca

SEQ ID NO: 6917480 - DNA, 21 bp, Homo sapiens
cccaggagaagaaaagatgca

SEQ ID NO: 6917481 - DNA, 22 bp, Homo sapiens
ttctgaatttctgtgtatctta

SEQ ID NO: 6917482 - DNA, 22 bp, Homo sapiens
tgaaagttaggatgtagtaatt

SEQ ID NO: 6917483 - DNA, 22 bp, Homo sapiens
tcctggcacaaccctttaccag

SEQ ID NO: 6917484 - DNA, 22 bp, Homo sapiens
accagacactgtgaagacaggc

SEQ ID NO: 6917485 - DNA, 21 bp, Homo sapiens
gagctctctacttgcacattt

SEQ ID NO: 6917486 - DNA, 22 bp, Homo sapiens
gatcattgctgcctttttctat

SEQ ID NO: 6917487 - DNA, 22 bp, Homo sapiens
acttggatatgttcactagacc

SEQ ID NO: 6917488 - DNA, 22 bp, Homo sapiens
catgctccaaaaacaagagaat

SEQ ID NO: 6917489 - DNA, 22 bp, Homo sapiens
gtctataagcaggggaaaactt

SEQ ID NO: 6917490 - DNA, 22 bp, Homo sapiens
ggactgcaacaggcttattcaa

SEQ ID NO: 6917491 - DNA, 22 bp, Homo sapiens
aagttgatcaagtagcgagttc

SEQ ID NO: 6917492 - DNA, 22 bp, Homo sapiens
gctaggtctgtgcgcagccgct

SEQ ID NO: 6917493 - DNA, 22 bp, Homo sapiens
aaactgcaattacttttgcacc

SEQ ID NO: 6917494 - DNA, 22 bp, Homo sapiens
atgggtggagggtgacacggat

SEQ ID NO: 6917495 - DNA, 22 bp, Homo sapiens
gtgttgctctgtttgggggttg

SEQ ID NO: 6917496 - DNA, 19 bp, Homo sapiens
ttacatgacatatgaagga

SEQ ID NO: 6917497 - DNA, 22 bp, Homo sapiens
tagtggatgttcagagatttga

SEQ ID NO: 6917498 - DNA, 22 bp, Homo sapiens
caggacctaactcacctgtctc

SEQ ID NO: 6917499 - DNA, 22 bp, Homo sapiens
gctctgagtgcacatttacaca

SEQ ID NO: 6917500 - DNA, 22 bp, Homo sapiens
ggtggcctcagcaaggctggca

SEQ ID NO: 6917501 - DNA, 22 bp, Homo sapiens
gcagagctctgttcttatctcc

SEQ ID NO: 6917502 - DNA, 22 bp, Homo sapiens
agtttcttcatccaaaaaatgg

SEQ ID NO: 6917503 - DNA, 20 bp, Homo sapiens
cagagctgggatttgaacac

SEQ ID NO: 6917504 - DNA, 23 bp, Homo sapiens
tattgcaagctctgcctcccggg

SEQ ID NO: 6917505 - DNA, 22 bp, Homo sapiens
tgttaagggtaaacagcagtaa

SEQ ID NO: 6917506 - DNA, 22 bp, Homo sapiens
acacagatgcaacctgaccgag

SEQ ID NO: 6917507 - DNA, 22 bp, Homo sapiens
aaagtttacagtgcacatgggt

SEQ ID NO: 6917508 - DNA, 22 bp, Homo sapiens
cctgcccatcccgtccttggcc

SEQ ID NO: 6917509 - DNA, 22 bp, Homo sapiens
tagtcagtcttacatatttgaa

SEQ ID NO: 6917510 - DNA, 22 bp, Homo sapiens
agaagtttggtccttttcaagg

SEQ ID NO: 6917511 - DNA, 22 bp, Homo sapiens
tagagcacagtttcagggtgta

SEQ ID NO: 6917512 - DNA, 18 bp, Homo sapiens
aggttctgacagtccaaa

SEQ ID NO: 6917513 - DNA, 22 bp, Homo sapiens
cattaagtatttcagttactgt

SEQ ID NO: 6917514 - DNA, 22 bp, Homo sapiens
tctggccctgctgctgtgagca

SEQ ID NO: 6917515 - DNA, 22 bp, Homo sapiens
ctgctgaacctttgctagataa

SEQ ID NO: 6917516 - DNA, 22 bp, Homo sapiens
ttaatgaatgtgtgctaacgtt

SEQ ID NO: 6917517 - DNA, 22 bp, Homo sapiens
ccggtcccaggtgccccggtga

SEQ ID NO: 6917518 - DNA, 22 bp, Homo sapiens
cgcaaagagctctaaatcagac

SEQ ID NO: 6917519 - DNA, 18 bp, Homo sapiens
aaagaaggattggagagc

SEQ ID NO: 6917520 - DNA, 22 bp, Homo sapiens
aacagaatgcaggggatgctgc

SEQ ID NO: 6917521 - DNA, 22 bp, Homo sapiens
tacatcaaggaacacctggtat

SEQ ID NO: 6917522 - DNA, 21 bp, Homo sapiens
agtgtgtgataggcaggaaga

SEQ ID NO: 6917523 - DNA, 22 bp, Homo sapiens
agcccaggcagagggatgcttg

SEQ ID NO: 6917524 - DNA, 22 bp, Homo sapiens
tggatttcatagactgccatct

SEQ ID NO: 6917525 - DNA, 22 bp, Homo sapiens
tggaagggagctggaatttgga

SEQ ID NO: 6917526 - DNA, 22 bp, Homo sapiens
tggtgtgagcaggtcaagttca

SEQ ID NO: 6917527 - DNA, 20 bp, Homo sapiens
cctcatctcaagggcagtcc

SEQ ID NO: 6917528 - DNA, 21 bp, Homo sapiens
aagcaggacatatgatgccct

SEQ ID NO: 6917529 - DNA, 22 bp, Homo sapiens
tgtctgcaaagtccagcacagg

SEQ ID NO: 6917530 - DNA, 22 bp, Homo sapiens
agtctgtgaacttggcagggaa

SEQ ID NO: 6917531 - DNA, 22 bp, Homo sapiens
gtcctctggcctttcccaggac

SEQ ID NO: 6917532 - DNA, 22 bp, Homo sapiens
cagctgtgctgattgctcagta

SEQ ID NO: 6917533 - DNA, 22 bp, Homo sapiens
cttgttttggaacagagtgaat

SEQ ID NO: 6917534 - DNA, 22 bp, Homo sapiens
aattgatgatacccacacttat

SEQ ID NO: 6917535 - DNA, 20 bp, Homo sapiens
tctgccactttttctgtcac

SEQ ID NO: 6917536 - DNA, 22 bp, Homo sapiens
tagaatgtagtgcttcaagatt

SEQ ID NO: 6917537 - DNA, 22 bp, Homo sapiens
agggcgcctgctgtggccaccg

SEQ ID NO: 6917538 - DNA, 22 bp, Homo sapiens
tacataattgtctttgtcctca

SEQ ID NO: 6917539 - DNA, 22 bp, Homo sapiens
tgtcaggtagtaggtagaaact

SEQ ID NO: 6917540 - DNA, 22 bp, Homo sapiens
aaattccagttcttttacctgc

SEQ ID NO: 6917541 - DNA, 22 bp, Homo sapiens
tagtgaatgggggttatgagac

SEQ ID NO: 6917542 - DNA, 22 bp, Homo sapiens
tgtgaaatgctatttccatgag

SEQ ID NO: 6917543 - DNA, 22 bp, Homo sapiens
tccgcagaggaggagttgctgt

SEQ ID NO: 6917544 - DNA, 22 bp, Homo sapiens
gctaggctgtgtttcagaccct

SEQ ID NO: 6917545 - DNA, 22 bp, Homo sapiens
acatgacacaggcctggccaat

SEQ ID NO: 6917546 - DNA, 17 bp, Homo sapiens
cagtggcctatggcttt

SEQ ID NO: 6917547 - DNA, 18 bp, Homo sapiens
ttgagaaataagcactaa

SEQ ID NO: 6917548 - DNA, 22 bp, Homo sapiens
tctttagacatccagtttctct

SEQ ID NO: 6917549 - DNA, 22 bp, Homo sapiens
aaatgacaataaaagtccatgc

SEQ ID NO: 6917550 - DNA, 22 bp, Homo sapiens
gcctgggaactctgatctcctg

SEQ ID NO: 6917551 - DNA, 22 bp, Homo sapiens
gctgctttaactggacggctcc

SEQ ID NO: 6917552 - DNA, 22 bp, Homo sapiens
atatgccagctccaagtaagag

SEQ ID NO: 6917553 - DNA, 22 bp, Homo sapiens
tttaatgaataattcaaatctg

SEQ ID NO: 6917554 - DNA, 22 bp, Homo sapiens
gtgagcttctgacagatgcacc

SEQ ID NO: 6917555 - DNA, 22 bp, Homo sapiens
ggcctgagcttgggcagcgtat

SEQ ID NO: 6917556 - DNA, 18 bp, Homo sapiens
ttggagtccaggtatgac

SEQ ID NO: 6917557 - DNA, 22 bp, Homo sapiens
ttgcaaatgtgaataattacac

SEQ ID NO: 6917558 - DNA, 22 bp, Homo sapiens
tacattgcactttattagatac

SEQ ID NO: 6917559 - DNA, 22 bp, Homo sapiens
ggtaagtttataggtccctttg

SEQ ID NO: 6917560 - DNA, 22 bp, Homo sapiens
agcagcagtacatataagacta

SEQ ID NO: 6917561 - DNA, 22 bp, Homo sapiens
tgctggctgtatatgtgagagt

SEQ ID NO: 6917562 - DNA, 22 bp, Homo sapiens
tctgcacattttaccaatactc

SEQ ID NO: 6917563 - DNA, 21 bp, Homo sapiens
ctgcactgtgatttaaaatgt

SEQ ID NO: 6917564 - DNA, 22 bp, Homo sapiens
ctgttaaatagactgcagtgca

SEQ ID NO: 6917565 - DNA, 22 bp, Homo sapiens
aggttgttttgcctcattatcc

SEQ ID NO: 6917566 - DNA, 22 bp, Homo sapiens
gagtaattgatttctgcttcta

SEQ ID NO: 6917567 - DNA, 22 bp, Homo sapiens
gtgtgcaactttcattaatatt

SEQ ID NO: 6917568 - DNA, 22 bp, Homo sapiens
gcactgagagctttattctaga

SEQ ID NO: 6917569 - DNA, 18 bp, Homo sapiens
agacaaacttcttctgcc

SEQ ID NO: 6917570 - DNA, 22 bp, Homo sapiens
gcattacacatagacattcgtt

SEQ ID NO: 6917571 - DNA, 22 bp, Homo sapiens
tgagataactattctgtcaact

SEQ ID NO: 6917572 - DNA, 22 bp, Homo sapiens
tgattcagtactttctctaact

SEQ ID NO: 6917573 - DNA, 22 bp, Homo sapiens
ttgcatcatttcctggccgtgt

SEQ ID NO: 6917574 - DNA, 22 bp, Homo sapiens
gcaggcaaggtagacagaggaa

SEQ ID NO: 6917575 - DNA, 22 bp, Homo sapiens
taaatgtgttgtggatgaagtt

SEQ ID NO: 6917576 - DNA, 19 bp, Homo sapiens
tctggttcatttctgctgt

SEQ ID NO: 6917577 - DNA, 22 bp, Homo sapiens
ggcatttagttttcatattctg

SEQ ID NO: 6917578 - DNA, 19 bp, Homo sapiens
agtcacagaccttgtctcc

SEQ ID NO: 6917579 - DNA, 22 bp, Homo sapiens
gcagtgggagcttaggcagtgc

SEQ ID NO: 6917580 - DNA, 20 bp, Homo sapiens
catcatcacatgagccaatt

SEQ ID NO: 6917581 - DNA, 16 bp, Homo sapiens
tcctaacgtgcagcca

SEQ ID NO: 6917582 - DNA, 22 bp, Homo sapiens
gtggtcatctgggtttgtggca

SEQ ID NO: 6917583 - DNA, 22 bp, Homo sapiens
ttcatcattacagtcatgttat

SEQ ID NO: 6917584 - DNA, 22 bp, Homo sapiens
gaacttaacggcaactatttaa

SEQ ID NO: 6917585 - DNA, 20 bp, Homo sapiens
gtttagctccaaatatgatc

SEQ ID NO: 6917586 - DNA, 22 bp, Homo sapiens
ggaggaagcacacggcttgtat

SEQ ID NO: 6917587 - DNA, 22 bp, Homo sapiens
cagcagaaacccagcaaagcca

SEQ ID NO: 6917588 - DNA, 22 bp, Homo sapiens
gcaggggagtggcaggcccgga

SEQ ID NO: 6917589 - DNA, 22 bp, Homo sapiens
ctaaatgtcatggagttgtaga

SEQ ID NO: 6917590 - DNA, 22 bp, Homo sapiens
ttggcagctacttccccagtgc

SEQ ID NO: 6917591 - DNA, 22 bp, Homo sapiens
aaggcaccattgtcaacggtaa

SEQ ID NO: 6917592 - DNA, 23 bp, Homo sapiens
tggctctagaaggccattttcct

SEQ ID NO: 6917593 - DNA, 22 bp, Homo sapiens
gaagatgttatggagagctcag

SEQ ID NO: 6917594 - DNA, 23 bp, Homo sapiens
tacagccatgtcgctgatttaac

SEQ ID NO: 6917595 - DNA, 22 bp, Homo sapiens
gctgcaatggagtcaggctggt

SEQ ID NO: 6917596 - DNA, 22 bp, Homo sapiens
gctaatcaatgttaaggctgtg

SEQ ID NO: 6917597 - DNA, 22 bp, Homo sapiens
ctgaaaggagagctgcaaggat

SEQ ID NO: 6917598 - DNA, 22 bp, Homo sapiens
ttcaaaggaggtgctgggtctt

SEQ ID NO: 6917599 - DNA, 22 bp, Homo sapiens
catcacatttaaggggaaggac

SEQ ID NO: 6917600 - DNA, 22 bp, Homo sapiens
gtgaggtcaccggccgttgcca

SEQ ID NO: 6917601 - DNA, 22 bp, Homo sapiens
agccacagggggtgagggacaa

SEQ ID NO: 6917602 - DNA, 22 bp, Homo sapiens
aagctttgataattggattact

SEQ ID NO: 6917603 - DNA, 22 bp, Homo sapiens
ttctgcatggttggggagaagc

SEQ ID NO: 6917604 - DNA, 22 bp, Homo sapiens
atcagtgttccttgagactgcc

SEQ ID NO: 6917605 - DNA, 22 bp, Homo sapiens
ggcaggtaggccccctctccag

SEQ ID NO: 6917606 - DNA, 22 bp, Homo sapiens
gcagagcatgtcctcaggacag

SEQ ID NO: 6917607 - DNA, 22 bp, Homo sapiens
caggcaaggagctggctcaagt

SEQ ID NO: 6917608 - DNA, 22 bp, Homo sapiens
ctgcttctccctgagatagtgt

SEQ ID NO: 6917609 - DNA, 22 bp, Homo sapiens
ctggaagcttgtttgccagtct

SEQ ID NO: 6917610 - DNA, 23 bp, Homo sapiens
cagcttctttgggattctttata

SEQ ID NO: 6917611 - DNA, 22 bp, Homo sapiens
gggcacatgcttagggaggaaa

SEQ ID NO: 6917612 - DNA, 19 bp, Homo sapiens
tctcacagtttccttgcct

SEQ ID NO: 6917613 - DNA, 22 bp, Homo sapiens
agctttctaccaggtcctgtct

SEQ ID NO: 6917614 - DNA, 22 bp, Homo sapiens
tgcaatttttccatgacctaga

SEQ ID NO: 6917615 - DNA, 22 bp, Homo sapiens
gagcccttttcctagatactgt

SEQ ID NO: 6917616 - DNA, 22 bp, Homo sapiens
tactaggaagcagctgcattgg

SEQ ID NO: 6917617 - DNA, 22 bp, Homo sapiens
taaacatgcccagtgacaggga

SEQ ID NO: 6917618 - DNA, 22 bp, Homo sapiens
gaaatgtctgccaggcacatag

SEQ ID NO: 6917619 - DNA, 22 bp, Homo sapiens
tgagaatcagctgcacagaggt

SEQ ID NO: 6917620 - DNA, 22 bp, Homo sapiens
gaaggaagctgtctggatgtgt

SEQ ID NO: 6917621 - DNA, 22 bp, Homo sapiens
acaatgctcatatttatgccaa

SEQ ID NO: 6917622 - DNA, 22 bp, Homo sapiens
aaatggtcactggtgagtgtca

SEQ ID NO: 6917623 - DNA, 17 bp, Homo sapiens
ccagggaggggccgcgc

SEQ ID NO: 6917624 - DNA, 22 bp, Homo sapiens
tgaatttggcttgaggcagata

SEQ ID NO: 6917625 - DNA, 22 bp, Homo sapiens
caggcattagagaattgtgata

SEQ ID NO: 6917626 - DNA, 22 bp, Homo sapiens
cttctagactatgggaatttcc

SEQ ID NO: 6917627 - DNA, 17 bp, Homo sapiens
gcatcacagataacacg

SEQ ID NO: 6917628 - DNA, 22 bp, Homo sapiens
acaggcttctcacagaaaaggg

SEQ ID NO: 6917629 - DNA, 22 bp, Homo sapiens
tactgttaatgttaaattcagg

SEQ ID NO: 6917630 - DNA, 22 bp, Homo sapiens
tagcaaatgcctggttaattag

SEQ ID NO: 6917631 - DNA, 22 bp, Homo sapiens
tgggacacagtgtgtgaagtgc

SEQ ID NO: 6917632 - DNA, 22 bp, Homo sapiens
tcctgctgtgtctagctggttc

SEQ ID NO: 6917633 - DNA, 16 bp, Homo sapiens
aacctctctactgtgg

SEQ ID NO: 6917634 - DNA, 22 bp, Homo sapiens
tagctcctacaagtacagcaaa

SEQ ID NO: 6917635 - DNA, 22 bp, Homo sapiens
catctttcagtttataagtctg

SEQ ID NO: 6917636 - DNA, 22 bp, Homo sapiens
agtctgaagactcatgtctgaa

SEQ ID NO: 6917637 - DNA, 21 bp, Homo sapiens
cggcttctgcattccagagct

SEQ ID NO: 6917638 - DNA, 20 bp, Homo sapiens
gctctaaaccacaaagccca

SEQ ID NO: 6917639 - DNA, 22 bp, Homo sapiens
ctctcctggtgtggaggacagg

SEQ ID NO: 6917640 - DNA, 22 bp, Homo sapiens
gggtctggacggctgcaggaag

SEQ ID NO: 6917641 - DNA, 22 bp, Homo sapiens
tttacatttccctctgtcagtt

SEQ ID NO: 6917642 - DNA, 22 bp, Homo sapiens
tttgcacttaaatttacaacac

SEQ ID NO: 6917643 - DNA, 20 bp, Homo sapiens
catttcattgtgtcttcact

SEQ ID NO: 6917644 - DNA, 22 bp, Homo sapiens
gggttgtcaatcaaaagaaaac

SEQ ID NO: 6917645 - DNA, 22 bp, Homo sapiens
tttgttcataatggcaaagaga

SEQ ID NO: 6917646 - DNA, 22 bp, Homo sapiens
tgtctagggcgagaatgtgtag

SEQ ID NO: 6917647 - DNA, 22 bp, Homo sapiens
gaggctgattcggggaacagca

SEQ ID NO: 6917648 - DNA, 21 bp, Homo sapiens
tatgtgtctgtggaaaactag

SEQ ID NO: 6917649 - DNA, 22 bp, Homo sapiens
tccagcctttctactcactgag

SEQ ID NO: 6917650 - DNA, 22 bp, Homo sapiens
ttcatgaaagtgtatcttgtgg

SEQ ID NO: 6917651 - DNA, 22 bp, Homo sapiens
ggcagggactatgtttcatgga

SEQ ID NO: 6917652 - DNA, 22 bp, Homo sapiens
ctttgttttactcagaggcatg

SEQ ID NO: 6917653 - DNA, 22 bp, Homo sapiens
tgcccccagacagaatccagtt

SEQ ID NO: 6917654 - DNA, 23 bp, Homo sapiens
tcttgaaggttgtgcccctgcag

SEQ ID NO: 6917655 - DNA, 22 bp, Homo sapiens
actgaagaacgcatcagtggtt

SEQ ID NO: 6917656 - DNA, 22 bp, Homo sapiens
tgctgtgggatatatgttcaaa

SEQ ID NO: 6917657 - DNA, 22 bp, Homo sapiens
ttgcagcttctaacagcttcag

SEQ ID NO: 6917658 - DNA, 22 bp, Homo sapiens
agtgccctggacggcggcccca

SEQ ID NO: 6917659 - DNA, 22 bp, Homo sapiens
ccggaaggcggaacgtgcagtg

SEQ ID NO: 6917660 - DNA, 22 bp, Homo sapiens
agctcagggcaaagactcaaat

SEQ ID NO: 6917661 - DNA, 22 bp, Homo sapiens
tttaagcagagaaatgatgtat

SEQ ID NO: 6917662 - DNA, 22 bp, Homo sapiens
tccagggcagtgactacagcgg

SEQ ID NO: 6917663 - DNA, 22 bp, Homo sapiens
ggtctgagctctaaaactaact

SEQ ID NO: 6917664 - DNA, 22 bp, Homo sapiens
ctcagccagacatgacccagtc

SEQ ID NO: 6917665 - DNA, 21 bp, Homo sapiens
aggcagctcaggcccagagag

SEQ ID NO: 6917666 - DNA, 22 bp, Homo sapiens
acagaactgcaggaggaaaagc

SEQ ID NO: 6917667 - DNA, 22 bp, Homo sapiens
cagctctggccagatctatcct

SEQ ID NO: 6917668 - DNA, 16 bp, Homo sapiens
acagtgtctcaagcac

SEQ ID NO: 6917669 - DNA, 22 bp, Homo sapiens
atgcaacagaaaattgcctggg

SEQ ID NO: 6917670 - DNA, 22 bp, Homo sapiens
aataatagttgcaaagtgttta

SEQ ID NO: 6917671 - DNA, 22 bp, Homo sapiens
gagatatattaacattaatctt

SEQ ID NO: 6917672 - DNA, 22 bp, Homo sapiens
ctcaaagataatcctatgtctc

SEQ ID NO: 6917673 - DNA, 22 bp, Homo sapiens
attctgagtttatttgggaggt

SEQ ID NO: 6917674 - DNA, 22 bp, Homo sapiens
gccaggctgccttatctctagc

SEQ ID NO: 6917675 - DNA, 22 bp, Homo sapiens
gaagtcatgaggcacagtcctg

SEQ ID NO: 6917676 - DNA, 22 bp, Homo sapiens
agcagaccaggagtgcacaggt

SEQ ID NO: 6917677 - DNA, 22 bp, Homo sapiens
cttgtatatagcatgagtttga

SEQ ID NO: 6917678 - DNA, 22 bp, Homo sapiens
agtgatgtgggagagtatagct

SEQ ID NO: 6917679 - DNA, 22 bp, Homo sapiens
tacagcactgtgcatagtggtt

SEQ ID NO: 6917680 - DNA, 22 bp, Homo sapiens
atgaatgtaagtggatttcttt

SEQ ID NO: 6917681 - DNA, 22 bp, Homo sapiens
tcactttggaagatagcacatc

SEQ ID NO: 6917682 - DNA, 22 bp, Homo sapiens
aggaaggtaatgaactgaggag

SEQ ID NO: 6917683 - DNA, 22 bp, Homo sapiens
cacaggtggctccaagttagag

SEQ ID NO: 6917684 - DNA, 22 bp, Homo sapiens
cgcgctgtttacgtgacttaat

SEQ ID NO: 6917685 - DNA, 22 bp, Homo sapiens
cttcttcttcccccttcagggg

SEQ ID NO: 6917686 - DNA, 22 bp, Homo sapiens
gtgtttggtcagacgtccgggg

SEQ ID NO: 6917687 - DNA, 21 bp, Homo sapiens
atatcttcttcaaaccactca

SEQ ID NO: 6917688 - DNA, 22 bp, Homo sapiens
gctctgctgtcttcttgcaggc

SEQ ID NO: 6917689 - DNA, 22 bp, Homo sapiens
tctctaaagatatttatggcaa

SEQ ID NO: 6917690 - DNA, 22 bp, Homo sapiens
attatttgcttggctcatctaa

SEQ ID NO: 6917691 - DNA, 22 bp, Homo sapiens
ggccacatgaattcttggacag

SEQ ID NO: 6917692 - DNA, 22 bp, Homo sapiens
ccagagtgacgtgaagtgtgaa

SEQ ID NO: 6917693 - DNA, 21 bp, Homo sapiens
agatcattcttctgagcactt

SEQ ID NO: 6917694 - DNA, 22 bp, Homo sapiens
aatggtttgtacctgtccttgg

SEQ ID NO: 6917695 - DNA, 23 bp, Homo sapiens
ctgagcacagctctgtgggcctc

SEQ ID NO: 6917696 - DNA, 22 bp, Homo sapiens
tatcagtgctcccagcttagca

SEQ ID NO: 6917697 - DNA, 22 bp, Homo sapiens
taaactatctgtgtttgaagtt

SEQ ID NO: 6917698 - DNA, 22 bp, Homo sapiens
agcctagggggtcctgggccac

SEQ ID NO: 6917699 - DNA, 22 bp, Homo sapiens
atacatgcttgggtgtagtgcg

SEQ ID NO: 6917700 - DNA, 22 bp, Homo sapiens
ccattctgaacaattcttgtct

SEQ ID NO: 6917701 - DNA, 22 bp, Homo sapiens
tggtccagtttagcattgagtg

SEQ ID NO: 6917702 - DNA, 22 bp, Homo sapiens
cctgggaggctgtttccagcct

SEQ ID NO: 6917703 - DNA, 22 bp, Homo sapiens
tccaggctgtgcgcaccgtgtg

SEQ ID NO: 6917704 - DNA, 22 bp, Homo sapiens
tttccaagagcttatttctgaa

SEQ ID NO: 6917705 - DNA, 22 bp, Homo sapiens
tggaggagtagattttcagagg

SEQ ID NO: 6917706 - DNA, 19 bp, Homo sapiens
tgggagaggcaacagagta

SEQ ID NO: 6917707 - DNA, 22 bp, Homo sapiens
aggcttggtgccaaggagcctg

SEQ ID NO: 6917708 - DNA, 22 bp, Homo sapiens
tgtcaaccacttcattatgaga

SEQ ID NO: 6917709 - DNA, 18 bp, Homo sapiens
aggatattaagagtacag

SEQ ID NO: 6917710 - DNA, 22 bp, Homo sapiens
ctctgggccatgctactgctct

SEQ ID NO: 6917711 - DNA, 21 bp, Homo sapiens
tccagggaacttctcaggaat

SEQ ID NO: 6917712 - DNA, 22 bp, Homo sapiens
atcctggaggctggaggcttgc

SEQ ID NO: 6917713 - DNA, 22 bp, Homo sapiens
ttaccaattcagacatctcttc

SEQ ID NO: 6917714 - DNA, 22 bp, Homo sapiens
ctgtaattttccagccaatatg

SEQ ID NO: 6917715 - DNA, 22 bp, Homo sapiens
atgcaggagaccaattggatgg

SEQ ID NO: 6917716 - DNA, 22 bp, Homo sapiens
ttattcactctgaagccatcct

SEQ ID NO: 6917717 - DNA, 22 bp, Homo sapiens
ctggcctttttagaaaacagct

SEQ ID NO: 6917718 - DNA, 22 bp, Homo sapiens
atttgcttctgtgaaatcaagt

SEQ ID NO: 6917719 - DNA, 22 bp, Homo sapiens
caagaaacaccaatgactgctg

SEQ ID NO: 6917720 - DNA, 22 bp, Homo sapiens
agcctggcttaatcctcctttt

SEQ ID NO: 6917721 - DNA, 21 bp, Homo sapiens
aagacagaaaagcctattttc

SEQ ID NO: 6917722 - DNA, 22 bp, Homo sapiens
aaactgtaaatactagtaagtg

SEQ ID NO: 6917723 - DNA, 22 bp, Homo sapiens
ctgcaagccaagctgagagcct

SEQ ID NO: 6917724 - DNA, 22 bp, Homo sapiens
gagataaagctaccatgttgat

SEQ ID NO: 6917725 - DNA, 22 bp, Homo sapiens
agtgcaggccccaggccaggcc

SEQ ID NO: 6917726 - DNA, 20 bp, Homo sapiens
tctgttattattacattgcc

SEQ ID NO: 6917727 - DNA, 22 bp, Homo sapiens
caagaatcttgcagcttagact

SEQ ID NO: 6917728 - DNA, 22 bp, Homo sapiens
aggtcaaagaacctagctatag

SEQ ID NO: 6917729 - DNA, 22 bp, Homo sapiens
gtggcaagtgttccaagaggcg

SEQ ID NO: 6917730 - DNA, 22 bp, Homo sapiens
gctggagtcttgaaagtggact

SEQ ID NO: 6917731 - DNA, 22 bp, Homo sapiens
ctgaggagttggtgaataagcc

SEQ ID NO: 6917732 - DNA, 22 bp, Homo sapiens
tctggagaggggcctagaattt

SEQ ID NO: 6917733 - DNA, 22 bp, Homo sapiens
accctgggggtggccagtgcca

SEQ ID NO: 6917734 - DNA, 22 bp, Homo sapiens
tctgcaggcttataggatgggt

SEQ ID NO: 6917735 - DNA, 22 bp, Homo sapiens
ggaagattttccattcctcttt

SEQ ID NO: 6917736 - DNA, 22 bp, Homo sapiens
acttgagagaatcggaggagtc

SEQ ID NO: 6917737 - DNA, 22 bp, Homo sapiens
accctgatataggtccaagagc

SEQ ID NO: 6917738 - DNA, 22 bp, Homo sapiens
ctgctttgtaaaatagacataa

SEQ ID NO: 6917739 - DNA, 22 bp, Homo sapiens
acagtgttttagaaaagcttga

SEQ ID NO: 6917740 - DNA, 22 bp, Homo sapiens
gtatctagtcaatgctgttcaa

SEQ ID NO: 6917741 - DNA, 22 bp, Homo sapiens
aaaggcatgtggtcaaggctca

SEQ ID NO: 6917742 - DNA, 22 bp, Homo sapiens
catttctcactccagcaacttt

SEQ ID NO: 6917743 - DNA, 21 bp, Homo sapiens
accaggcttgtgggagggagc

SEQ ID NO: 6917744 - DNA, 22 bp, Homo sapiens
gaagacatcgtgtggactaaca

SEQ ID NO: 6917745 - DNA, 22 bp, Homo sapiens
aggaggccatgtactaggttcc

SEQ ID NO: 6917746 - DNA, 19 bp, Homo sapiens
ctgggggtgctcacgctct

SEQ ID NO: 6917747 - DNA, 22 bp, Homo sapiens
aaattccagaaactcagtatat

SEQ ID NO: 6917748 - DNA, 22 bp, Homo sapiens
ttcgagttggctttattaaact

SEQ ID NO: 6917749 - DNA, 19 bp, Homo sapiens
aggtccctccctcgaggct

SEQ ID NO: 6917750 - DNA, 22 bp, Homo sapiens
ctgctgttcagaggacctcact

SEQ ID NO: 6917751 - DNA, 22 bp, Homo sapiens
aaccactggtctgaggtacaag

SEQ ID NO: 6917752 - DNA, 22 bp, Homo sapiens
tcagaaggaagttagagtatgg

SEQ ID NO: 6917753 - DNA, 22 bp, Homo sapiens
aacatataaactcttaagttca

SEQ ID NO: 6917754 - DNA, 22 bp, Homo sapiens
tctaggtataaagaaatcagga

SEQ ID NO: 6917755 - DNA, 22 bp, Homo sapiens
aatatagcattgtatgactgtg

SEQ ID NO: 6917756 - DNA, 22 bp, Homo sapiens
ttttggcttaaagagaatgtat

SEQ ID NO: 6917757 - DNA, 22 bp, Homo sapiens
tcacaccagtttcctttcaatt

SEQ ID NO: 6917758 - DNA, 19 bp, Homo sapiens
ttacactcctgggcagtgg

SEQ ID NO: 6917759 - DNA, 22 bp, Homo sapiens
cacccagccttcacacaggagt

SEQ ID NO: 6917760 - DNA, 22 bp, Homo sapiens
agccacagcccacaggactctt

SEQ ID NO: 6917761 - DNA, 22 bp, Homo sapiens
agcatcccatgactctggagga

SEQ ID NO: 6917762 - DNA, 22 bp, Homo sapiens
ttttctccccagagaccatcat

SEQ ID NO: 6917763 - DNA, 22 bp, Homo sapiens
gggtctcctgagagaagatgct

SEQ ID NO: 6917764 - DNA, 22 bp, Homo sapiens
agctggccagatgtcccaaaga

SEQ ID NO: 6917765 - DNA, 22 bp, Homo sapiens
cctgcttccttcaagtttatct

SEQ ID NO: 6917766 - DNA, 22 bp, Homo sapiens
gggctggagttgggaagacaaa

SEQ ID NO: 6917767 - DNA, 22 bp, Homo sapiens
cccaggagatgcactccattgg

SEQ ID NO: 6917768 - DNA, 22 bp, Homo sapiens
ttgttaaaattggagccgagag

SEQ ID NO: 6917769 - DNA, 22 bp, Homo sapiens
gttgttttcagcagtttatgac

SEQ ID NO: 6917770 - DNA, 22 bp, Homo sapiens
agctttcagtctctgaaggaac

SEQ ID NO: 6917771 - DNA, 22 bp, Homo sapiens
cagaggaagcagacacatcttg

SEQ ID NO: 6917772 - DNA, 22 bp, Homo sapiens
tgtccagcacagccaggcttac

SEQ ID NO: 6917773 - DNA, 22 bp, Homo sapiens
ctggaaagtgcttttctgagag

SEQ ID NO: 6917774 - DNA, 22 bp, Homo sapiens
cccttgaaggcagggagtcctg

SEQ ID NO: 6917775 - DNA, 22 bp, Homo sapiens
tccaatcagctcctatgagaat

SEQ ID NO: 6917776 - DNA, 22 bp, Homo sapiens
atggccagagaggccagcctgg

SEQ ID NO: 6917777 - DNA, 22 bp, Homo sapiens
tttgtgtgaaaatatttaagtt

SEQ ID NO: 6917778 - DNA, 22 bp, Homo sapiens
agttctgtggctgtgccctgta

SEQ ID NO: 6917779 - DNA, 22 bp, Homo sapiens
agaatccctggggagctgcagc

SEQ ID NO: 6917780 - DNA, 18 bp, Homo sapiens
gtgcagattgcggagccc

SEQ ID NO: 6917781 - DNA, 22 bp, Homo sapiens
agtgaccaagcctgaccaatca

SEQ ID NO: 6917782 - DNA, 22 bp, Homo sapiens
tacaaagtcagaataacaggtg

SEQ ID NO: 6917783 - DNA, 22 bp, Homo sapiens
taggtgctggataaagaatggt

SEQ ID NO: 6917784 - DNA, 22 bp, Homo sapiens
aagattgtccaccacctggatt

SEQ ID NO: 6917785 - DNA, 22 bp, Homo sapiens
ttccttgtttgtagctctggga

SEQ ID NO: 6917786 - DNA, 22 bp, Homo sapiens
ttcagtgtcaatttttaaatat

SEQ ID NO: 6917787 - DNA, 22 bp, Homo sapiens
aggagtcactcagggcttcatc

SEQ ID NO: 6917788 - DNA, 22 bp, Homo sapiens
ttggcacctgatatgtgacctt

SEQ ID NO: 6917789 - DNA, 22 bp, Homo sapiens
taggagtgcataaaactatatt

SEQ ID NO: 6917790 - DNA, 22 bp, Homo sapiens
accagcatccttcctattaaca

SEQ ID NO: 6917791 - DNA, 22 bp, Homo sapiens
gggaccaggtgggtgcattccg

SEQ ID NO: 6917792 - DNA, 22 bp, Homo sapiens
atgattcaagaaaataggatgg

SEQ ID NO: 6917793 - DNA, 22 bp, Homo sapiens
tgcagcattcttggccactact

SEQ ID NO: 6917794 - DNA, 22 bp, Homo sapiens
actgatgaagagtaccactgtt

SEQ ID NO: 6917795 - DNA, 22 bp, Homo sapiens
acagaagtgtctttttcattca

SEQ ID NO: 6917796 - DNA, 23 bp, Homo sapiens
tggacagttatctcattgtcctg

SEQ ID NO: 6917797 - DNA, 22 bp, Homo sapiens
tgcagctcatattagagagaag

SEQ ID NO: 6917798 - DNA, 22 bp, Homo sapiens
cagaggctgccagccatgtgca

SEQ ID NO: 6917799 - DNA, 22 bp, Homo sapiens
tcaaatgctgcctttgtgtgcc

SEQ ID NO: 6917800 - DNA, 22 bp, Homo sapiens
acaaatttcataggcaaatttt

SEQ ID NO: 6917801 - DNA, 22 bp, Homo sapiens
ctgaggctctgagaaagccaaa

SEQ ID NO: 6917802 - DNA, 22 bp, Homo sapiens
ttaccttgaagagcttgagggc

SEQ ID NO: 6917803 - DNA, 22 bp, Homo sapiens
ctggcaggagcattcacagagg

SEQ ID NO: 6917804 - DNA, 21 bp, Homo sapiens
aaggaaaagcttggtctctga

SEQ ID NO: 6917805 - DNA, 22 bp, Homo sapiens
tgtcctgtaggtttatttgtgt

SEQ ID NO: 6917806 - DNA, 22 bp, Homo sapiens
cttcctgcatggagtctgaatg

SEQ ID NO: 6917807 - DNA, 15 bp, Homo sapiens
tgcatgctctccaga

SEQ ID NO: 6917808 - DNA, 22 bp, Homo sapiens
attttgctacagttggtggaaa

SEQ ID NO: 6917809 - DNA, 22 bp, Homo sapiens
ataaggtatgaaaagtaaatgg

SEQ ID NO: 6917810 - DNA, 22 bp, Homo sapiens
ctaaagaattttgcttgaccag

SEQ ID NO: 6917811 - DNA, 22 bp, Homo sapiens
cacactgataggcttgacaggc

SEQ ID NO: 6917812 - DNA, 22 bp, Homo sapiens
ttaaggcattctcctactaata

SEQ ID NO: 6917813 - DNA, 22 bp, Homo sapiens
ctgggtgttcaggagctgggct

SEQ ID NO: 6917814 - DNA, 22 bp, Homo sapiens
cagaggtagcatgctgtggctt

SEQ ID NO: 6917815 - DNA, 22 bp, Homo sapiens
tgcccaggctggaatgcagtgg

SEQ ID NO: 6917816 - DNA, 22 bp, Homo sapiens
aacactggttctgactacacag

SEQ ID NO: 6917817 - DNA, 22 bp, Homo sapiens
ggctccctcaccaccatcacat

SEQ ID NO: 6917818 - DNA, 22 bp, Homo sapiens
agctgctgggatacagtagtga

SEQ ID NO: 6917819 - DNA, 22 bp, Homo sapiens
ctggctgatctcctgaatgtct

SEQ ID NO: 6917820 - DNA, 22 bp, Homo sapiens
tttgactgcccgagcctcccag

SEQ ID NO: 6917821 - DNA, 22 bp, Homo sapiens
aatttagtgtaaagctactgga

SEQ ID NO: 6917822 - DNA, 22 bp, Homo sapiens
gagctttgtaaaaaacttgcac

SEQ ID NO: 6917823 - DNA, 22 bp, Homo sapiens
cttcaaggaagccacgttggga

SEQ ID NO: 6917824 - DNA, 22 bp, Homo sapiens
atgttacctgttaggtacctgt

SEQ ID NO: 6917825 - DNA, 22 bp, Homo sapiens
tgccagcttgtggtcagaggct

SEQ ID NO: 6917826 - DNA, 22 bp, Homo sapiens
gtttggttccaaagcccattct

SEQ ID NO: 6917827 - DNA, 22 bp, Homo sapiens
ttggccagactgaggtgctggg

SEQ ID NO: 6917828 - DNA, 22 bp, Homo sapiens
tgaagaataaatggttgagact

SEQ ID NO: 6917829 - DNA, 22 bp, Homo sapiens
ctgtgattgttagttcctatac

SEQ ID NO: 6917830 - DNA, 23 bp, Homo sapiens
aaatagctccgtggcacactctc

SEQ ID NO: 6917831 - DNA, 22 bp, Homo sapiens
ttcccagttagtcatttttaca

SEQ ID NO: 6917832 - DNA, 22 bp, Homo sapiens
tacatgctggtgactgtagaca

SEQ ID NO: 6917833 - DNA, 22 bp, Homo sapiens
aaactctaagacactgtacaat

SEQ ID NO: 6917834 - DNA, 22 bp, Homo sapiens
taggacatgtgttttatatatg

SEQ ID NO: 6917835 - DNA, 22 bp, Homo sapiens
gcacagaacagagaaatagcca

SEQ ID NO: 6917836 - DNA, 22 bp, Homo sapiens
ggcctgaatgcctgagtgtggg

SEQ ID NO: 6917837 - DNA, 22 bp, Homo sapiens
tcctgaatccaggagagtaggg

SEQ ID NO: 6917838 - DNA, 22 bp, Homo sapiens
tggaaaatatttaggtgaatga

SEQ ID NO: 6917839 - DNA, 22 bp, Homo sapiens
agactaaagactcattctgctg

SEQ ID NO: 6917840 - DNA, 22 bp, Homo sapiens
attcaagagctggctttgaaat

SEQ ID NO: 6917841 - DNA, 22 bp, Homo sapiens
tgtcttggattatctgtgcaac

SEQ ID NO: 6917842 - DNA, 22 bp, Homo sapiens
tttgaagaccttatctctaaat

SEQ ID NO: 6917843 - DNA, 17 bp, Homo sapiens
tttataattggcctctt

SEQ ID NO: 6917844 - DNA, 22 bp, Homo sapiens
ggaggtggcagggaacataatt

SEQ ID NO: 6917845 - DNA, 22 bp, Homo sapiens
atgattgcagccctacagctgt

SEQ ID NO: 6917846 - DNA, 22 bp, Homo sapiens
aggggctgctgggtccgcccct

SEQ ID NO: 6917847 - DNA, 19 bp, Homo sapiens
ccttggctttaactatgaa

SEQ ID NO: 6917848 - DNA, 22 bp, Homo sapiens
aaatgcagacagcttcacacac

SEQ ID NO: 6917849 - DNA, 22 bp, Homo sapiens
ccccaggacacatggaccaagt

SEQ ID NO: 6917850 - DNA, 16 bp, Homo sapiens
gcagaggaaaggggag

SEQ ID NO: 6917851 - DNA, 22 bp, Homo sapiens
tgattatcttttactgccagag

SEQ ID NO: 6917852 - DNA, 22 bp, Homo sapiens
ggtcagagccgttagcattcag

SEQ ID NO: 6917853 - DNA, 22 bp, Homo sapiens
tgtcatgtaacctttctgagcc

SEQ ID NO: 6917854 - DNA, 22 bp, Homo sapiens
aaagcattgtttcaagattaac

SEQ ID NO: 6917855 - DNA, 22 bp, Homo sapiens
atggcagaattaggatttcaag

SEQ ID NO: 6917856 - DNA, 22 bp, Homo sapiens
cttgaattgggggaagatcact

SEQ ID NO: 6917857 - DNA, 22 bp, Homo sapiens
tctctggggatggacctgggag

SEQ ID NO: 6917858 - DNA, 17 bp, Homo sapiens
tgggccagtagaaggga

SEQ ID NO: 6917859 - DNA, 22 bp, Homo sapiens
ggcctcttagagttaactgctt

SEQ ID NO: 6917860 - DNA, 22 bp, Homo sapiens
ttcagaaaggataattggaagg

SEQ ID NO: 6917861 - DNA, 22 bp, Homo sapiens
atgaaaattctatgcaggccag

SEQ ID NO: 6917862 - DNA, 22 bp, Homo sapiens
ctcctggggccatggaaggaac

SEQ ID NO: 6917863 - DNA, 22 bp, Homo sapiens
aaatcctaaggagaatatgatt

SEQ ID NO: 6917864 - DNA, 22 bp, Homo sapiens
tgtggactagagaattctgttg

SEQ ID NO: 6917865 - DNA, 22 bp, Homo sapiens
tgactgtctctatggctctaaa

SEQ ID NO: 6917866 - DNA, 22 bp, Homo sapiens
tgcgtttaggacataaggagaa

SEQ ID NO: 6917867 - DNA, 22 bp, Homo sapiens
atagtaactggcatgtttatga

SEQ ID NO: 6917868 - DNA, 22 bp, Homo sapiens
ttttctaagggaaacgtcctcc

SEQ ID NO: 6917869 - DNA, 22 bp, Homo sapiens
tgacagaacaggttgggagcaa

SEQ ID NO: 6917870 - DNA, 20 bp, Homo sapiens
ggccttgggtttcgcctgtt

SEQ ID NO: 6917871 - DNA, 22 bp, Homo sapiens
gacattcacaggtaaacattcc

SEQ ID NO: 6917872 - DNA, 18 bp, Homo sapiens
ggcttctcactgacctca

SEQ ID NO: 6917873 - DNA, 20 bp, Homo sapiens
ggcatgggtggggctcccag

SEQ ID NO: 6917874 - DNA, 22 bp, Homo sapiens
acttcctgaatggggctaatta

SEQ ID NO: 6917875 - DNA, 22 bp, Homo sapiens
ttcttttcctacacagcgattt

SEQ ID NO: 6917876 - DNA, 22 bp, Homo sapiens
caccaggaagctgcaatttgag

SEQ ID NO: 6917877 - DNA, 22 bp, Homo sapiens
tggtacttggaggcagaaaaat

SEQ ID NO: 6917878 - DNA, 19 bp, Homo sapiens
ttgaaagattagctttcta

SEQ ID NO: 6917879 - DNA, 22 bp, Homo sapiens
ttgttacacataataacatttt

SEQ ID NO: 6917880 - DNA, 22 bp, Homo sapiens
gtgagtcaagcagaaacgtgga

SEQ ID NO: 6917881 - DNA, 22 bp, Homo sapiens
aaacagtcatggttgctgttca

SEQ ID NO: 6917882 - DNA, 22 bp, Homo sapiens
tcactgcactccagcctgggtg

SEQ ID NO: 6917883 - DNA, 22 bp, Homo sapiens
gctccctaatttgttaatgctg

SEQ ID NO: 6917884 - DNA, 22 bp, Homo sapiens
catgagtgtgccagtctgatat

SEQ ID NO: 6917885 - DNA, 22 bp, Homo sapiens
tctggcaggttcccatgttatg

SEQ ID NO: 6917886 - DNA, 22 bp, Homo sapiens
tctcagtgggaagggcacagtt

SEQ ID NO: 6917887 - DNA, 22 bp, Homo sapiens
gtacaggacatagacagagtag

SEQ ID NO: 6917888 - DNA, 22 bp, Homo sapiens
cttcatagggttgtaaggatta

SEQ ID NO: 6917889 - DNA, 22 bp, Homo sapiens
acctccattttgtttcaggctg

SEQ ID NO: 6917890 - DNA, 22 bp, Homo sapiens
ctgcaggcatttattcatgcaa

SEQ ID NO: 6917891 - DNA, 22 bp, Homo sapiens
tgaatgaactaaatcatagttc

SEQ ID NO: 6917892 - DNA, 19 bp, Homo sapiens
ccagtagagacagctgcag

SEQ ID NO: 6917893 - DNA, 22 bp, Homo sapiens
gcctccctccaccactgcaggt

SEQ ID NO: 6917894 - DNA, 18 bp, Homo sapiens
gcgtggagcgggctcggt

SEQ ID NO: 6917895 - DNA, 22 bp, Homo sapiens
tttacagggaatattttggctt

SEQ ID NO: 6917896 - DNA, 22 bp, Homo sapiens
ctctctcagtgtaatacaggat

SEQ ID NO: 6917897 - DNA, 16 bp, Homo sapiens
ggcttggctccatggc

SEQ ID NO: 6917898 - DNA, 22 bp, Homo sapiens
aatcaggatatgaacccaggta

SEQ ID NO: 6917899 - DNA, 22 bp, Homo sapiens
tgcgagagtgtagttgtctgga

SEQ ID NO: 6917900 - DNA, 19 bp, Homo sapiens
cagagttacatggctgtgg

SEQ ID NO: 6917901 - DNA, 22 bp, Homo sapiens
acccaggccattggcaagagtc

SEQ ID NO: 6917902 - DNA, 22 bp, Homo sapiens
ctaaaggatattagaggagaaa

SEQ ID NO: 6917903 - DNA, 22 bp, Homo sapiens
atgaggtattagcagtaactga

SEQ ID NO: 6917904 - DNA, 22 bp, Homo sapiens
gtttactgtcttgcacagtgca

SEQ ID NO: 6917905 - DNA, 22 bp, Homo sapiens
ccaggaagaaacagtctttata

SEQ ID NO: 6917906 - DNA, 22 bp, Homo sapiens
tcttcatgaatgaatctttgac

SEQ ID NO: 6917907 - DNA, 22 bp, Homo sapiens
cagaaagcagagctgagccttt

SEQ ID NO: 6917908 - DNA, 22 bp, Homo sapiens
tgagctggcacttttcctggga

SEQ ID NO: 6917909 - DNA, 22 bp, Homo sapiens
ttgcagagatcagcaggtttga

SEQ ID NO: 6917910 - DNA, 22 bp, Homo sapiens
gggcttctgttcctttcacttg

SEQ ID NO: 6917911 - DNA, 21 bp, Homo sapiens
gacaggcaaggagtcacttag

SEQ ID NO: 6917912 - DNA, 22 bp, Homo sapiens
atgccctgagcaggccttcaag

SEQ ID NO: 6917913 - DNA, 22 bp, Homo sapiens
ccagggaaaggaggttgacttg

SEQ ID NO: 6917914 - DNA, 22 bp, Homo sapiens
ggagcagttgttgagcaagcca

SEQ ID NO: 6917915 - DNA, 22 bp, Homo sapiens
cagtttctcaggcctctcccag

SEQ ID NO: 6917916 - DNA, 22 bp, Homo sapiens
cataccctcccctgtgtcacgt

SEQ ID NO: 6917917 - DNA, 22 bp, Homo sapiens
ttgcactccagtctgggaacaa

SEQ ID NO: 6917918 - DNA, 22 bp, Homo sapiens
atctgtgagaaaggcttgtgct

SEQ ID NO: 6917919 - DNA, 22 bp, Homo sapiens
tctgacatagcaggacctaggc

SEQ ID NO: 6917920 - DNA, 22 bp, Homo sapiens
ttctcatgatgcaattcatccc

SEQ ID NO: 6917921 - DNA, 22 bp, Homo sapiens
tcctcttctgcccatcagaggc

SEQ ID NO: 6917922 - DNA, 20 bp, Homo sapiens
atttcaggttgtgttctgtt

SEQ ID NO: 6917923 - DNA, 22 bp, Homo sapiens
tgttaactaatggtctaacatt

SEQ ID NO: 6917924 - DNA, 18 bp, Homo sapiens
tggagcaggaagcctggc

SEQ ID NO: 6917925 - DNA, 22 bp, Homo sapiens
agtcctgggttctggtgttttg

SEQ ID NO: 6917926 - DNA, 22 bp, Homo sapiens
aggacttctaagctaagaagtt

SEQ ID NO: 6917927 - DNA, 22 bp, Homo sapiens
ttcttgatgcttgtttaaaggt

SEQ ID NO: 6917928 - DNA, 22 bp, Homo sapiens
gcaggctccaggccggcccctt

SEQ ID NO: 6917929 - DNA, 22 bp, Homo sapiens
atacacagctacattgaacaat

SEQ ID NO: 6917930 - DNA, 22 bp, Homo sapiens
ttactatagtccagcccttttt

SEQ ID NO: 6917931 - DNA, 22 bp, Homo sapiens
ttttatgaagataattttctga

SEQ ID NO: 6917932 - DNA, 22 bp, Homo sapiens
ctgctgacagccctgcttcagg

SEQ ID NO: 6917933 - DNA, 22 bp, Homo sapiens
ttcagtgcctgtccacagcttc

SEQ ID NO: 6917934 - DNA, 22 bp, Homo sapiens
atacattcctactgactagcta

SEQ ID NO: 6917935 - DNA, 22 bp, Homo sapiens
atggctagttgatatggtgttt

SEQ ID NO: 6917936 - DNA, 22 bp, Homo sapiens
taattagagtcacaagtaacca

SEQ ID NO: 6917937 - DNA, 22 bp, Homo sapiens
ttaccttggatttcacccttat

SEQ ID NO: 6917938 - DNA, 22 bp, Homo sapiens
tacctgaaccaagcccagctct

SEQ ID NO: 6917939 - DNA, 22 bp, Homo sapiens
tgcctggcacagagcaggtggc

SEQ ID NO: 6917940 - DNA, 21 bp, Homo sapiens
agcattctgcttctttcctgg

SEQ ID NO: 6917941 - DNA, 22 bp, Homo sapiens
gcagtcacagggagatggtgac

SEQ ID NO: 6917942 - DNA, 22 bp, Homo sapiens
gttggctcattttatagacagc

SEQ ID NO: 6917943 - DNA, 22 bp, Homo sapiens
caggggccaagggtccagacct

SEQ ID NO: 6917944 - DNA, 22 bp, Homo sapiens
ttgcatgtcttgcggatgccag

SEQ ID NO: 6917945 - DNA, 22 bp, Homo sapiens
cacccacattcctctagtatgt

SEQ ID NO: 6917946 - DNA, 20 bp, Homo sapiens
agtctctcccagaatgagca

SEQ ID NO: 6917947 - DNA, 22 bp, Homo sapiens
agctgacctggaagggggcacg

SEQ ID NO: 6917948 - DNA, 22 bp, Homo sapiens
ggtcagaattaggtctagagta

SEQ ID NO: 6917949 - DNA, 22 bp, Homo sapiens
atgctacttgccagttacttga

SEQ ID NO: 6917950 - DNA, 19 bp, Homo sapiens
agtttccctggagacatca

SEQ ID NO: 6917951 - DNA, 22 bp, Homo sapiens
ccagattcatagaaactcatag

SEQ ID NO: 6917952 - DNA, 22 bp, Homo sapiens
gttaaggatgcagagcatggaa

SEQ ID NO: 6917953 - DNA, 22 bp, Homo sapiens
cccaggctggaattccaggcct

SEQ ID NO: 6917954 - DNA, 22 bp, Homo sapiens
atgatgtcattcttgtttgctc

SEQ ID NO: 6917955 - DNA, 22 bp, Homo sapiens
ttgtttatgtgttgtctatggc

SEQ ID NO: 6917956 - DNA, 22 bp, Homo sapiens
gtctagcacatcatctcactgc

SEQ ID NO: 6917957 - DNA, 22 bp, Homo sapiens
tcgtgtcagatcagaggttcct

SEQ ID NO: 6917958 - DNA, 22 bp, Homo sapiens
tgccaccccggcccagagagca

SEQ ID NO: 6917959 - DNA, 22 bp, Homo sapiens
tgacagtgtcagtttcctaata

SEQ ID NO: 6917960 - DNA, 22 bp, Homo sapiens
tcagtgtttcctagagcatata

SEQ ID NO: 6917961 - DNA, 19 bp, Homo sapiens
gtgcttaacattttattgt

SEQ ID NO: 6917962 - DNA, 22 bp, Homo sapiens
atggccagtgtttccctcagtt

SEQ ID NO: 6917963 - DNA, 22 bp, Homo sapiens
taagaatcggtcgcaacagagg

SEQ ID NO: 6917964 - DNA, 22 bp, Homo sapiens
cagcttcatgacaaacagtttt

SEQ ID NO: 6917965 - DNA, 22 bp, Homo sapiens
tggacagttactgagcttgagt

SEQ ID NO: 6917966 - DNA, 22 bp, Homo sapiens
gggagctgagggacctctgtgg

SEQ ID NO: 6917967 - DNA, 21 bp, Homo sapiens
acaattgatggcttaagttgc

SEQ ID NO: 6917968 - DNA, 22 bp, Homo sapiens
tctctgtggtttgagagccggg

SEQ ID NO: 6917969 - DNA, 19 bp, Homo sapiens
ttttgtcttcccttagttt

SEQ ID NO: 6917970 - DNA, 22 bp, Homo sapiens
tcccccaaatgaatgaggaata

SEQ ID NO: 6917971 - DNA, 22 bp, Homo sapiens
ggagcctggcctggctctgtgt

SEQ ID NO: 6917972 - DNA, 22 bp, Homo sapiens
cactgggctttgtagttagcat

SEQ ID NO: 6917973 - DNA, 18 bp, Homo sapiens
ttacagcagcaacaggaa

SEQ ID NO: 6917974 - DNA, 22 bp, Homo sapiens
gtaccattgtttgaagtactca

SEQ ID NO: 6917975 - DNA, 22 bp, Homo sapiens
acaggatccgctggctttatat

SEQ ID NO: 6917976 - DNA, 22 bp, Homo sapiens
tcagagttctctgtccagatga

SEQ ID NO: 6917977 - DNA, 22 bp, Homo sapiens
agaatcttggaactcagatcac

SEQ ID NO: 6917978 - DNA, 22 bp, Homo sapiens
aagccactattaaataatgatt

SEQ ID NO: 6917979 - DNA, 22 bp, Homo sapiens
ttaaaatcgctgttgcttctgt

SEQ ID NO: 6917980 - DNA, 22 bp, Homo sapiens
atgaggtaagcactgggcccaa

SEQ ID NO: 6917981 - DNA, 22 bp, Homo sapiens
caatgtgtttgcatattaaaat

SEQ ID NO: 6917982 - DNA, 18 bp, Homo sapiens
agctgcttgcaggccttc

SEQ ID NO: 6917983 - DNA, 22 bp, Homo sapiens
taagaacagtagaacagtaggt

SEQ ID NO: 6917984 - DNA, 20 bp, Homo sapiens
tagaggggacaatcattgcc

SEQ ID NO: 6917985 - DNA, 22 bp, Homo sapiens
tgggagcaccctgaggagcttc

SEQ ID NO: 6917986 - DNA, 19 bp, Homo sapiens
accctgagaggtggtccgg

SEQ ID NO: 6917987 - DNA, 23 bp, Homo sapiens
tctcagattcagagatccctaaa

SEQ ID NO: 6917988 - DNA, 22 bp, Homo sapiens
taagaagtgagtgcaccttctt

SEQ ID NO: 6917989 - DNA, 22 bp, Homo sapiens
tttcaattaggatgtttccatg

SEQ ID NO: 6917990 - DNA, 22 bp, Homo sapiens
agtggggaagagcatgggccct

SEQ ID NO: 6917991 - DNA, 22 bp, Homo sapiens
tgtctgaaggcctgacctacat

SEQ ID NO: 6917992 - DNA, 22 bp, Homo sapiens
tccctggggttcctccagccac

SEQ ID NO: 6917993 - DNA, 22 bp, Homo sapiens
agagctgtttgtctagagagtg

SEQ ID NO: 6917994 - DNA, 22 bp, Homo sapiens
gcttccaagtcaatcaatgctg

SEQ ID NO: 6917995 - DNA, 22 bp, Homo sapiens
gggaggctggctctggccacag

SEQ ID NO: 6917996 - DNA, 22 bp, Homo sapiens
aggtctctagaaattcagccag

SEQ ID NO: 6917997 - DNA, 22 bp, Homo sapiens
atacatacgtacatacgtatgt

SEQ ID NO: 6917998 - DNA, 22 bp, Homo sapiens
agacagacagagaatttaaata

SEQ ID NO: 6917999 - DNA, 20 bp, Homo sapiens
agcctggcaaacacccccag

SEQ ID NO: 6918000 - DNA, 22 bp, Homo sapiens
acctgtttagaaagcttatgag

SEQ ID NO: 6918001 - DNA, 22 bp, Homo sapiens
cagaagggacagggtttgtaga

SEQ ID NO: 6918002 - DNA, 22 bp, Homo sapiens
gagtcactgtttcccggctctg

SEQ ID NO: 6918003 - DNA, 22 bp, Homo sapiens
ttctttgtaaagccacagtcct

SEQ ID NO: 6918004 - DNA, 22 bp, Homo sapiens
gaacacatcacattttacagtg

SEQ ID NO: 6918005 - DNA, 22 bp, Homo sapiens
tgcaacaggagagttcagggca

SEQ ID NO: 6918006 - DNA, 22 bp, Homo sapiens
catggccacattggaccgaagc

SEQ ID NO: 6918007 - DNA, 21 bp, Homo sapiens
tgctggtgagctcatgtggct

SEQ ID NO: 6918008 - DNA, 22 bp, Homo sapiens
tccatttaactgtccccagcac

SEQ ID NO: 6918009 - DNA, 22 bp, Homo sapiens
ggctccagatgtctcctggcaa

SEQ ID NO: 6918010 - DNA, 18 bp, Homo sapiens
ctcagtgtttgctgaaaa

SEQ ID NO: 6918011 - DNA, 22 bp, Homo sapiens
tgctgctttaaaaagtgctgat

SEQ ID NO: 6918012 - DNA, 22 bp, Homo sapiens
catattcaaggggtaaggcaaa

SEQ ID NO: 6918013 - DNA, 16 bp, Homo sapiens
tctctgggttgcacag

SEQ ID NO: 6918014 - DNA, 19 bp, Homo sapiens
tctctaacctcaagaggtt

SEQ ID NO: 6918015 - DNA, 22 bp, Homo sapiens
ctgtccatcagaaaggggctta

SEQ ID NO: 6918016 - DNA, 22 bp, Homo sapiens
ctgtcaccatttgagccctgga

SEQ ID NO: 6918017 - DNA, 22 bp, Homo sapiens
tttcttagtcctagagtgattt

SEQ ID NO: 6918018 - DNA, 22 bp, Homo sapiens
aacttgtaatgaaaggcaatag

SEQ ID NO: 6918019 - DNA, 22 bp, Homo sapiens
tacaatgctgtgcatgtaatgg

SEQ ID NO: 6918020 - DNA, 22 bp, Homo sapiens
tcagagaggcaatactgtttaa

SEQ ID NO: 6918021 - DNA, 22 bp, Homo sapiens
tcattgctggctctggagtatg

SEQ ID NO: 6918022 - DNA, 22 bp, Homo sapiens
agaaatacattctctggtgtgt

SEQ ID NO: 6918023 - DNA, 22 bp, Homo sapiens
gtggccaaaaggaagaaggtta

SEQ ID NO: 6918024 - DNA, 22 bp, Homo sapiens
gtcctctgggcagctgccccac

SEQ ID NO: 6918025 - DNA, 22 bp, Homo sapiens
tcaggagatggtctttataggc

SEQ ID NO: 6918026 - DNA, 22 bp, Homo sapiens
caatagcttccaaggcatgtct

SEQ ID NO: 6918027 - DNA, 22 bp, Homo sapiens
ttcagtgtggtgcacagttttg

SEQ ID NO: 6918028 - DNA, 22 bp, Homo sapiens
tttgcagggctggtaggaccac

SEQ ID NO: 6918029 - DNA, 22 bp, Homo sapiens
agcggtcaggagaaataagcat

SEQ ID NO: 6918030 - DNA, 22 bp, Homo sapiens
aggctggagtgcagtggtgtga

SEQ ID NO: 6918031 - DNA, 22 bp, Homo sapiens
gtccagagctggcacactgtca

SEQ ID NO: 6918032 - DNA, 22 bp, Homo sapiens
gaactctgacagggggcaaaag

SEQ ID NO: 6918033 - DNA, 22 bp, Homo sapiens
catgcttcatgcaaaattctga

SEQ ID NO: 6918034 - DNA, 22 bp, Homo sapiens
aagtttggaagccgtctgcaaa

SEQ ID NO: 6918035 - DNA, 22 bp, Homo sapiens
aatgaatgtgattaacttcaag

SEQ ID NO: 6918036 - DNA, 22 bp, Homo sapiens
gcctggagcccagtgtggggct

SEQ ID NO: 6918037 - DNA, 22 bp, Homo sapiens
ctgatcctcctttaagtagctg

SEQ ID NO: 6918038 - DNA, 22 bp, Homo sapiens
caccagcttacagtctcacccc

SEQ ID NO: 6918039 - DNA, 22 bp, Homo sapiens
acaggcctggaaaggaaggagt

SEQ ID NO: 6918040 - DNA, 22 bp, Homo sapiens
tccctgggtcattctctggcac

SEQ ID NO: 6918041 - DNA, 22 bp, Homo sapiens
agtgacatgaccacaaagcagc

SEQ ID NO: 6918042 - DNA, 22 bp, Homo sapiens
gcacagcttcctctttctctga

SEQ ID NO: 6918043 - DNA, 22 bp, Homo sapiens
agtctgagattctgcatttcta

SEQ ID NO: 6918044 - DNA, 22 bp, Homo sapiens
agaaaatattcattgagaggct

SEQ ID NO: 6918045 - DNA, 21 bp, Homo sapiens
agtgattatgggtttttacat

SEQ ID NO: 6918046 - DNA, 22 bp, Homo sapiens
gacagtaaggtggcttcttctt

SEQ ID NO: 6918047 - DNA, 22 bp, Homo sapiens
tttcagtgtgtaaattgaaata

SEQ ID NO: 6918048 - DNA, 22 bp, Homo sapiens
agaatttttgcagtttagccat

SEQ ID NO: 6918049 - DNA, 22 bp, Homo sapiens
ccagagctgattcctgggactt

SEQ ID NO: 6918050 - DNA, 22 bp, Homo sapiens
gtaatcgtggtggttaattcca

SEQ ID NO: 6918051 - DNA, 22 bp, Homo sapiens
atatgtgaagtgggttattttg

SEQ ID NO: 6918052 - DNA, 22 bp, Homo sapiens
agacactgttctcacatgcttg

SEQ ID NO: 6918053 - DNA, 19 bp, Homo sapiens
gggcttctgggatcaagag

SEQ ID NO: 6918054 - DNA, 22 bp, Homo sapiens
agaaatgtattctgtatgtttt

SEQ ID NO: 6918055 - DNA, 19 bp, Homo sapiens
ctcgtgcacccatcacctg

SEQ ID NO: 6918056 - DNA, 22 bp, Homo sapiens
ccagtttttccagtgctttctg

SEQ ID NO: 6918057 - DNA, 23 bp, Homo sapiens
accaacaagcctctggagagtgg

SEQ ID NO: 6918058 - DNA, 22 bp, Homo sapiens
attacagcttgctcagtttgca

SEQ ID NO: 6918059 - DNA, 22 bp, Homo sapiens
aaagagttctgtttgagctgaa

SEQ ID NO: 6918060 - DNA, 22 bp, Homo sapiens
agtccagtgaactgtaaatagg

SEQ ID NO: 6918061 - DNA, 22 bp, Homo sapiens
tgcagaaggcctgacattgcac

SEQ ID NO: 6918062 - DNA, 22 bp, Homo sapiens
ctcctgcgggagctccgcctag

SEQ ID NO: 6918063 - DNA, 22 bp, Homo sapiens
ccagtgtgaccatctgttagct

SEQ ID NO: 6918064 - DNA, 22 bp, Homo sapiens
ctgcttccaagaaagagatagg

SEQ ID NO: 6918065 - DNA, 22 bp, Homo sapiens
ctgaagtcatacactgttctga

SEQ ID NO: 6918066 - DNA, 22 bp, Homo sapiens
gtgcacaatcttcatatggcgt

SEQ ID NO: 6918067 - DNA, 22 bp, Homo sapiens
aaatctcagtgttctaagcatt

SEQ ID NO: 6918068 - DNA, 22 bp, Homo sapiens
gtgctgagagtttattatgata

SEQ ID NO: 6918069 - DNA, 22 bp, Homo sapiens
cagtcctgaatactggacggtg

SEQ ID NO: 6918070 - DNA, 22 bp, Homo sapiens
tctgatttatatatgcagatac

SEQ ID NO: 6918071 - DNA, 22 bp, Homo sapiens
ttcagggttacagttggctctg

SEQ ID NO: 6918072 - DNA, 22 bp, Homo sapiens
cagtgtaagaattcaaagccta

SEQ ID NO: 6918073 - DNA, 22 bp, Homo sapiens
tctgggctcttagtgtaccctc

SEQ ID NO: 6918074 - DNA, 22 bp, Homo sapiens
ctgcattacagcctccttagga

SEQ ID NO: 6918075 - DNA, 20 bp, Homo sapiens
cttgatgagataaacagcag

SEQ ID NO: 6918076 - DNA, 22 bp, Homo sapiens
tgatattttatgagctttcata

SEQ ID NO: 6918077 - DNA, 22 bp, Homo sapiens
tgcatcatttataatgtctttg

SEQ ID NO: 6918078 - DNA, 22 bp, Homo sapiens
tgaggcctgtcattgtcttgtt

SEQ ID NO: 6918079 - DNA, 22 bp, Homo sapiens
tttatccagtgttggaattttt

SEQ ID NO: 6918080 - DNA, 22 bp, Homo sapiens
gagtggggcccactgctgggtg

SEQ ID NO: 6918081 - DNA, 22 bp, Homo sapiens
tggcagctgattagatggtgcc

SEQ ID NO: 6918082 - DNA, 22 bp, Homo sapiens
tcaaagcactggggaaagcctg

SEQ ID NO: 6918083 - DNA, 22 bp, Homo sapiens
ggacatcatattgcccagggcc

SEQ ID NO: 6918084 - DNA, 22 bp, Homo sapiens
tttcattatacagcttcataaa

SEQ ID NO: 6918085 - DNA, 22 bp, Homo sapiens
catgcctctgcagctgtttatt

SEQ ID NO: 6918086 - DNA, 18 bp, Homo sapiens
tccaggctccaggctaac

SEQ ID NO: 6918087 - DNA, 21 bp, Homo sapiens
ctgcaggatgctgaagccagg

SEQ ID NO: 6918088 - DNA, 22 bp, Homo sapiens
caatgctaaagtcagtagttag

SEQ ID NO: 6918089 - DNA, 22 bp, Homo sapiens
aagcaggcagggtggagagttt

SEQ ID NO: 6918090 - DNA, 22 bp, Homo sapiens
tgtgttcatctttaaagggaag

SEQ ID NO: 6918091 - DNA, 22 bp, Homo sapiens
atgatgtctgaagctgttggct

SEQ ID NO: 6918092 - DNA, 22 bp, Homo sapiens
gaggcacatcacttggtgcatt

SEQ ID NO: 6918093 - DNA, 22 bp, Homo sapiens
aaatctcaggcctctatttact

SEQ ID NO: 6918094 - DNA, 22 bp, Homo sapiens
aggtgggcccagtgggctccag

SEQ ID NO: 6918095 - DNA, 22 bp, Homo sapiens
cacttcaggttctggcagggcg

SEQ ID NO: 6918096 - DNA, 22 bp, Homo sapiens
actcaggcttcaggcacagctg

SEQ ID NO: 6918097 - DNA, 22 bp, Homo sapiens
gtaatgtactgcagccagatgt

SEQ ID NO: 6918098 - DNA, 22 bp, Homo sapiens
atctgggagtcttggctctgct

SEQ ID NO: 6918099 - DNA, 22 bp, Homo sapiens
tcactgctctccaatgtggagt

SEQ ID NO: 6918100 - DNA, 22 bp, Homo sapiens
atgctgtggaagttcctgaagc

SEQ ID NO: 6918101 - DNA, 22 bp, Homo sapiens
caaggaggcagtgggacttgaa

SEQ ID NO: 6918102 - DNA, 22 bp, Homo sapiens
agccaacacatgtaaatgcacc

SEQ ID NO: 6918103 - DNA, 22 bp, Homo sapiens
acagaggctgcgcttgggaacg

SEQ ID NO: 6918104 - DNA, 20 bp, Homo sapiens
tagagcatgaagtcctatcc

SEQ ID NO: 6918105 - DNA, 22 bp, Homo sapiens
aaagctcagtcagtggtgtatg

SEQ ID NO: 6918106 - DNA, 22 bp, Homo sapiens
tagctgccattgctccaggaag

SEQ ID NO: 6918107 - DNA, 22 bp, Homo sapiens
tctatgtatatctttccattca

SEQ ID NO: 6918108 - DNA, 21 bp, Homo sapiens
aaccagagccaggctctcagc

SEQ ID NO: 6918109 - DNA, 22 bp, Homo sapiens
gggctcagctccttccttccta

SEQ ID NO: 6918110 - DNA, 22 bp, Homo sapiens
agtgattttggcctggcctttt

SEQ ID NO: 6918111 - DNA, 22 bp, Homo sapiens
agatgtggaacactagactgct

SEQ ID NO: 6918112 - DNA, 22 bp, Homo sapiens
acagggcacctgaggtaggaag

SEQ ID NO: 6918113 - DNA, 22 bp, Homo sapiens
tatgctaactgggggaaaagag

SEQ ID NO: 6918114 - DNA, 22 bp, Homo sapiens
tccagggagcaagtcaggccgg

SEQ ID NO: 6918115 - DNA, 22 bp, Homo sapiens
tgtgggtggcatcgtcctggcc

SEQ ID NO: 6918116 - DNA, 22 bp, Homo sapiens
aacatagccagaatgtctcctg

SEQ ID NO: 6918117 - DNA, 22 bp, Homo sapiens
caaatttaggtaacagtctgta

SEQ ID NO: 6918118 - DNA, 22 bp, Homo sapiens
aatcaggcacagcgactgcagc

SEQ ID NO: 6918119 - DNA, 22 bp, Homo sapiens
tatgacattggccaagttctgt

SEQ ID NO: 6918120 - DNA, 22 bp, Homo sapiens
cgggcactcagggtcgaggtgg

SEQ ID NO: 6918121 - DNA, 22 bp, Homo sapiens
aagggtcttagaggttcatttt

SEQ ID NO: 6918122 - DNA, 22 bp, Homo sapiens
gtgtgtgctccccaggagagct

SEQ ID NO: 6918123 - DNA, 22 bp, Homo sapiens
aatttctccaagaatgcttaga

SEQ ID NO: 6918124 - DNA, 21 bp, Homo sapiens
ggtcttcccactgtctggtga

SEQ ID NO: 6918125 - DNA, 22 bp, Homo sapiens
gcaggagacaactgtaaggaga

SEQ ID NO: 6918126 - DNA, 22 bp, Homo sapiens
agtctctcttgggtgtggtttg

SEQ ID NO: 6918127 - DNA, 22 bp, Homo sapiens
gaggctgttaggagggactctg

SEQ ID NO: 6918128 - DNA, 22 bp, Homo sapiens
agctggtaacattagtcagtat

SEQ ID NO: 6918129 - DNA, 22 bp, Homo sapiens
gcatctgttagagtgtgcatgc

SEQ ID NO: 6918130 - DNA, 22 bp, Homo sapiens
atttgcttggtcttctctccgt

SEQ ID NO: 6918131 - DNA, 22 bp, Homo sapiens
cctgggcatctcatgcacctgc

SEQ ID NO: 6918132 - DNA, 22 bp, Homo sapiens
cagtgtgtggattgcccttgca

SEQ ID NO: 6918133 - DNA, 22 bp, Homo sapiens
ctggggagtgaaggtaattaca

SEQ ID NO: 6918134 - DNA, 22 bp, Homo sapiens
ggcagctctgctccacatgagt

SEQ ID NO: 6918135 - DNA, 22 bp, Homo sapiens
agcagcatttaagtttcttcta

SEQ ID NO: 6918136 - DNA, 22 bp, Homo sapiens
tccaacttctgcaatcagtttg

SEQ ID NO: 6918137 - DNA, 22 bp, Homo sapiens
tgctggaaagtgaggtgaatga

SEQ ID NO: 6918138 - DNA, 22 bp, Homo sapiens
attcacggttgtgtgatgcaga

SEQ ID NO: 6918139 - DNA, 22 bp, Homo sapiens
aggagattgtactgtcatcact

SEQ ID NO: 6918140 - DNA, 22 bp, Homo sapiens
cagggctgggttaaaagcaggg

SEQ ID NO: 6918141 - DNA, 22 bp, Homo sapiens
acaggcttagggcaggctgacc

SEQ ID NO: 6918142 - DNA, 22 bp, Homo sapiens
ctgctttgattagaagagtaca

SEQ ID NO: 6918143 - DNA, 22 bp, Homo sapiens
ttggcacctccctaggaagaag

SEQ ID NO: 6918144 - DNA, 22 bp, Homo sapiens
ggctacagaaggagaaagaaat

SEQ ID NO: 6918145 - DNA, 22 bp, Homo sapiens
tattgtcaagaagtttatagtg

SEQ ID NO: 6918146 - DNA, 22 bp, Homo sapiens
cattccagagctgcctctgcta

SEQ ID NO: 6918147 - DNA, 22 bp, Homo sapiens
caccagagtgagtggactgtcg

SEQ ID NO: 6918148 - DNA, 22 bp, Homo sapiens
cagataatccaagtagttttca

SEQ ID NO: 6918149 - DNA, 22 bp, Homo sapiens
ctgggtcccctcagtgacactg

SEQ ID NO: 6918150 - DNA, 22 bp, Homo sapiens
gtgcctcttcacctatgtggtt

SEQ ID NO: 6918151 - DNA, 22 bp, Homo sapiens
tagctctagcactggataatcc

SEQ ID NO: 6918152 - DNA, 22 bp, Homo sapiens
cctcacacagttatctcttcat

SEQ ID NO: 6918153 - DNA, 22 bp, Homo sapiens
aggcagaatgttggaaaggaag

SEQ ID NO: 6918154 - DNA, 22 bp, Homo sapiens
tgcttcacaagaattcaggacc

SEQ ID NO: 6918155 - DNA, 22 bp, Homo sapiens
cctgtctgaaggcagggggatg

SEQ ID NO: 6918156 - DNA, 22 bp, Homo sapiens
gttttggtaagaatagtcatcc

SEQ ID NO: 6918157 - DNA, 22 bp, Homo sapiens
taagtccataatggcagtaaat

SEQ ID NO: 6918158 - DNA, 22 bp, Homo sapiens
tccttggggacgctgacatcgt

SEQ ID NO: 6918159 - DNA, 22 bp, Homo sapiens
ccctgcagaaccacagacaaac

SEQ ID NO: 6918160 - DNA, 22 bp, Homo sapiens
gtaagtctctcaagagggtcag

SEQ ID NO: 6918161 - DNA, 22 bp, Homo sapiens
agataataagtctggtaataat

SEQ ID NO: 6918162 - DNA, 22 bp, Homo sapiens
ccctgcttgtcacccctgggtc

SEQ ID NO: 6918163 - DNA, 22 bp, Homo sapiens
agctgaggacgtgaagggcggc

SEQ ID NO: 6918164 - DNA, 22 bp, Homo sapiens
gagcaaacaaaactgatgtgac

SEQ ID NO: 6918165 - DNA, 22 bp, Homo sapiens
gcatccaaaccattcatcagcc

SEQ ID NO: 6918166 - DNA, 22 bp, Homo sapiens
gccgggttcaagccattctcct

SEQ ID NO: 6918167 - DNA, 18 bp, Homo sapiens
aatgtccagtgttcatat

SEQ ID NO: 6918168 - DNA, 22 bp, Homo sapiens
caacaagtgttcgtaaagtgcc

SEQ ID NO: 6918169 - DNA, 23 bp, Homo sapiens
gtgcttgaaagatgcagaattaa

SEQ ID NO: 6918170 - DNA, 22 bp, Homo sapiens
gcacatgacagtaagtagagca

SEQ ID NO: 6918171 - DNA, 22 bp, Homo sapiens
tgctccaggctgctgaagatct

SEQ ID NO: 6918172 - DNA, 22 bp, Homo sapiens
ctactactccaccacttaccag

SEQ ID NO: 6918173 - DNA, 22 bp, Homo sapiens
aagcacagattgctgcatccat

SEQ ID NO: 6918174 - DNA, 22 bp, Homo sapiens
gtgtggctaggatggctttgct

SEQ ID NO: 6918175 - DNA, 22 bp, Homo sapiens
aaatataatttctgcctcaata

SEQ ID NO: 6918176 - DNA, 22 bp, Homo sapiens
caacatatgattttgtatataa

SEQ ID NO: 6918177 - DNA, 22 bp, Homo sapiens
gcaaagacaatttgaatagctt

SEQ ID NO: 6918178 - DNA, 23 bp, Homo sapiens
tggaagcagttccagcacaaata

SEQ ID NO: 6918179 - DNA, 17 bp, Homo sapiens
tctgagaaaggagaatc

SEQ ID NO: 6918180 - DNA, 22 bp, Homo sapiens
gagtgtgggcacgggggccttg

SEQ ID NO: 6918181 - DNA, 22 bp, Homo sapiens
gatacacggagtggagactgtg

SEQ ID NO: 6918182 - DNA, 22 bp, Homo sapiens
atgtagaagtgggcattataga

SEQ ID NO: 6918183 - DNA, 22 bp, Homo sapiens
cttcaaacactagaaacacagg

SEQ ID NO: 6918184 - DNA, 22 bp, Homo sapiens
gtgagacctccttgggctgact

SEQ ID NO: 6918185 - DNA, 22 bp, Homo sapiens
gccagccagaaacgtcacactg

SEQ ID NO: 6918186 - DNA, 22 bp, Homo sapiens
cagcaagggataaagagttact

SEQ ID NO: 6918187 - DNA, 22 bp, Homo sapiens
ccctgaccaccagctccatttg

SEQ ID NO: 6918188 - DNA, 22 bp, Homo sapiens
agcagcaatggaaagcaacaca

SEQ ID NO: 6918189 - DNA, 22 bp, Homo sapiens
tgttctcttctcattgaacatg

SEQ ID NO: 6918190 - DNA, 22 bp, Homo sapiens
ctcacagttttctgtagtccaa

SEQ ID NO: 6918191 - DNA, 22 bp, Homo sapiens
agtcctgtaattgtgagttaac

SEQ ID NO: 6918192 - DNA, 22 bp, Homo sapiens
ctagaaactccatctcactaca

SEQ ID NO: 6918193 - DNA, 22 bp, Homo sapiens
atttctaggtagagaagcttag

SEQ ID NO: 6918194 - DNA, 16 bp, Homo sapiens
gactgaggctcagaga

SEQ ID NO: 6918195 - DNA, 22 bp, Homo sapiens
gaggacagtgtgatctgccagc

SEQ ID NO: 6918196 - DNA, 22 bp, Homo sapiens
ctcagggtctggtccttagatt

SEQ ID NO: 6918197 - DNA, 22 bp, Homo sapiens
tcctggccttgcgtcttgggag

SEQ ID NO: 6918198 - DNA, 23 bp, Homo sapiens
cccagctggaagttagaggacca

SEQ ID NO: 6918199 - DNA, 22 bp, Homo sapiens
gcagagtgagccgaggctgctc

SEQ ID NO: 6918200 - DNA, 22 bp, Homo sapiens
tgtataaatttaaattcctgct

SEQ ID NO: 6918201 - DNA, 22 bp, Homo sapiens
aataagactctgctagaaattc

SEQ ID NO: 6918202 - DNA, 22 bp, Homo sapiens
cagtctcttttcagctccatcc

SEQ ID NO: 6918203 - DNA, 22 bp, Homo sapiens
ctatgtggtaggtgtccttagt

SEQ ID NO: 6918204 - DNA, 22 bp, Homo sapiens
gtcctcgcggcgcgaagccagt

SEQ ID NO: 6918205 - DNA, 22 bp, Homo sapiens
tatcctcgtggcctttataaaa

SEQ ID NO: 6918206 - DNA, 22 bp, Homo sapiens
tatgcctatatgtgtgtttata

SEQ ID NO: 6918207 - DNA, 22 bp, Homo sapiens
aatactgcctgtgaggtaactc

SEQ ID NO: 6918208 - DNA, 22 bp, Homo sapiens
cacaggtccttcctgccctggg

SEQ ID NO: 6918209 - DNA, 22 bp, Homo sapiens
ctgtgtgatgggaagaatgttt

SEQ ID NO: 6918210 - DNA, 22 bp, Homo sapiens
agtgcccggacaactggacaga

SEQ ID NO: 6918211 - DNA, 22 bp, Homo sapiens
taatgaatgagaatataacaga

SEQ ID NO: 6918212 - DNA, 22 bp, Homo sapiens
tggtgactgggactggatatga

SEQ ID NO: 6918213 - DNA, 22 bp, Homo sapiens
actttacatttgatctctctaa

SEQ ID NO: 6918214 - DNA, 22 bp, Homo sapiens
accttatttggaaatataatta

SEQ ID NO: 6918215 - DNA, 20 bp, Homo sapiens
tcgtttatttgaaattgctc

SEQ ID NO: 6918216 - DNA, 22 bp, Homo sapiens
caactcaggcacctcatataag

SEQ ID NO: 6918217 - DNA, 22 bp, Homo sapiens
tgaggctcaagaaagatttgtt

SEQ ID NO: 6918218 - DNA, 22 bp, Homo sapiens
ctgctggttagtcttagtggga

SEQ ID NO: 6918219 - DNA, 22 bp, Homo sapiens
cttttacatttgttgaagagta

SEQ ID NO: 6918220 - DNA, 22 bp, Homo sapiens
tcaccattaaggactttcagct

SEQ ID NO: 6918221 - DNA, 22 bp, Homo sapiens
caggcacagctaagactggcca

SEQ ID NO: 6918222 - DNA, 22 bp, Homo sapiens
caactgtaagctccttatgggg

SEQ ID NO: 6918223 - DNA, 22 bp, Homo sapiens
atttgcataatagtgatttgta

SEQ ID NO: 6918224 - DNA, 23 bp, Homo sapiens
agtttttctgcatggttctgtat

SEQ ID NO: 6918225 - DNA, 22 bp, Homo sapiens
attagtgatatgtgactagacc

SEQ ID NO: 6918226 - DNA, 22 bp, Homo sapiens
aatgtgctccactccaggctgc

SEQ ID NO: 6918227 - DNA, 22 bp, Homo sapiens
ccatcctggccttgctgtccac

SEQ ID NO: 6918228 - DNA, 22 bp, Homo sapiens
gtgcaatgtgcttcgtgccatg

SEQ ID NO: 6918229 - DNA, 22 bp, Homo sapiens
cctgggaggcagaggttgcagt

SEQ ID NO: 6918230 - DNA, 22 bp, Homo sapiens
ttccttagtgcctcttccgctg

SEQ ID NO: 6918231 - DNA, 22 bp, Homo sapiens
ctttgatataagtatacatagt

SEQ ID NO: 6918232 - DNA, 22 bp, Homo sapiens
cacatttatgggctgggaggca

SEQ ID NO: 6918233 - DNA, 22 bp, Homo sapiens
ggtctgctttccttgccactgt

SEQ ID NO: 6918234 - DNA, 17 bp, Homo sapiens
cagagtctgtctgcatc

SEQ ID NO: 6918235 - DNA, 22 bp, Homo sapiens
tggcccagcactccaagtaggg

SEQ ID NO: 6918236 - DNA, 22 bp, Homo sapiens
ctgaaggcaccaggggtgccag

SEQ ID NO: 6918237 - DNA, 22 bp, Homo sapiens
ttgctgccagcgccctgcaggg

SEQ ID NO: 6918238 - DNA, 22 bp, Homo sapiens
ttggccttagcttcttcttaaa

SEQ ID NO: 6918239 - DNA, 22 bp, Homo sapiens
aggcactgattctgttttccat

SEQ ID NO: 6918240 - DNA, 22 bp, Homo sapiens
tggacccaccccagggcctgct

SEQ ID NO: 6918241 - DNA, 22 bp, Homo sapiens
gggaggtgttccagtgttggta

SEQ ID NO: 6918242 - DNA, 22 bp, Homo sapiens
taacagcagggttacaggcatt

SEQ ID NO: 6918243 - DNA, 22 bp, Homo sapiens
gccaaagtacctagccctctgc

SEQ ID NO: 6918244 - DNA, 22 bp, Homo sapiens
agcccaggttgaggctgcagtg

SEQ ID NO: 6918245 - DNA, 22 bp, Homo sapiens
tagaaggcccattcatttgttc

SEQ ID NO: 6918246 - DNA, 22 bp, Homo sapiens
ccaggagataagctgagtttat

SEQ ID NO: 6918247 - DNA, 22 bp, Homo sapiens
tattgctgacttgttcagtgtt

SEQ ID NO: 6918248 - DNA, 22 bp, Homo sapiens
taaaggttagtagcagggaaac

SEQ ID NO: 6918249 - DNA, 23 bp, Homo sapiens
ctgtgtctatgcagccatatcca

SEQ ID NO: 6918250 - DNA, 22 bp, Homo sapiens
aaggcaagttttagttttctgg

SEQ ID NO: 6918251 - DNA, 22 bp, Homo sapiens
ccagagaattttagacaaaaat

SEQ ID NO: 6918252 - DNA, 22 bp, Homo sapiens
agtcagaattcgatcccaggtc

SEQ ID NO: 6918253 - DNA, 22 bp, Homo sapiens
ttcctttttacataatcacatt

SEQ ID NO: 6918254 - DNA, 22 bp, Homo sapiens
ggtcccagtccctttccaccgt

SEQ ID NO: 6918255 - DNA, 21 bp, Homo sapiens
agaactgattaaataagcagt

SEQ ID NO: 6918256 - DNA, 22 bp, Homo sapiens
tatctgtcacctgtagggtagg

SEQ ID NO: 6918257 - DNA, 22 bp, Homo sapiens
actggccaggcacagctgtggg

SEQ ID NO: 6918258 - DNA, 21 bp, Homo sapiens
ttctctggcttctgtagctgg

SEQ ID NO: 6918259 - DNA, 22 bp, Homo sapiens
ccacatgctcaccaagtccctg

SEQ ID NO: 6918260 - DNA, 22 bp, Homo sapiens
gacataaaatggaattctgttg

SEQ ID NO: 6918261 - DNA, 22 bp, Homo sapiens
gagctgtgttcatgaggagaaa

SEQ ID NO: 6918262 - DNA, 22 bp, Homo sapiens
aaggatgtcagtcattttggat

SEQ ID NO: 6918263 - DNA, 22 bp, Homo sapiens
agggttttgtgaggctcaaact

SEQ ID NO: 6918264 - DNA, 22 bp, Homo sapiens
taaggaaaatggacatcaaaca

SEQ ID NO: 6918265 - DNA, 22 bp, Homo sapiens
tacagaaaaacttggaggcttt

SEQ ID NO: 6918266 - DNA, 22 bp, Homo sapiens
gatttgtagttttatgtgtcag

SEQ ID NO: 6918267 - DNA, 22 bp, Homo sapiens
gtgcaggtggctggtggcaccc

SEQ ID NO: 6918268 - DNA, 22 bp, Homo sapiens
tgtcaaactgtgacttctaatg

SEQ ID NO: 6918269 - DNA, 22 bp, Homo sapiens
atgtatgtaaatttcagtcctt

SEQ ID NO: 6918270 - DNA, 22 bp, Homo sapiens
ccacaggacggaggtctggccg

SEQ ID NO: 6918271 - DNA, 22 bp, Homo sapiens
tggttatgggagtcatgttgcc

SEQ ID NO: 6918272 - DNA, 22 bp, Homo sapiens
ttgagggattttaaatgaacaa

SEQ ID NO: 6918273 - DNA, 22 bp, Homo sapiens
tcctgctccaccgtgggctgga

SEQ ID NO: 6918274 - DNA, 22 bp, Homo sapiens
ataaaaaggacagatgtggtct

SEQ ID NO: 6918275 - DNA, 21 bp, Homo sapiens
aggcatctaaagagagtagac

SEQ ID NO: 6918276 - DNA, 20 bp, Homo sapiens
cccaggtgtctgaagctctg

SEQ ID NO: 6918277 - DNA, 22 bp, Homo sapiens
aatttcaattacttttgcacca

SEQ ID NO: 6918278 - DNA, 22 bp, Homo sapiens
ctccctcaggccttagccctgc

SEQ ID NO: 6918279 - DNA, 22 bp, Homo sapiens
caaagtttaaagtagatttcag

SEQ ID NO: 6918280 - DNA, 22 bp, Homo sapiens
aggagagggtggcattaagttt

SEQ ID NO: 6918281 - DNA, 22 bp, Homo sapiens
gttcctggtggtcatggcagct

SEQ ID NO: 6918282 - DNA, 22 bp, Homo sapiens
cagtcctgcccaggctgacaga

SEQ ID NO: 6918283 - DNA, 22 bp, Homo sapiens
tacatgctccttatgagaatct

SEQ ID NO: 6918284 - DNA, 22 bp, Homo sapiens
agtaccaagacataagattttt

SEQ ID NO: 6918285 - DNA, 22 bp, Homo sapiens
taggaccagcagggtcagggtc

SEQ ID NO: 6918286 - DNA, 22 bp, Homo sapiens
ctggcaggatctaaccagggaa

SEQ ID NO: 6918287 - DNA, 22 bp, Homo sapiens
tgatgcattgccgacttactgg

SEQ ID NO: 6918288 - DNA, 22 bp, Homo sapiens
tttcgtcaattgtaacaaatgt

SEQ ID NO: 6918289 - DNA, 22 bp, Homo sapiens
tgtctacagaatgttaatattt

SEQ ID NO: 6918290 - DNA, 22 bp, Homo sapiens
accctccaggcgggcttgtgac

SEQ ID NO: 6918291 - DNA, 23 bp, Homo sapiens
tgctaattggacttgattctgca

SEQ ID NO: 6918292 - DNA, 20 bp, Homo sapiens
tctgtgcagtttaggaaggc

SEQ ID NO: 6918293 - DNA, 22 bp, Homo sapiens
tgagacatgtgaatatttgtac

SEQ ID NO: 6918294 - DNA, 22 bp, Homo sapiens
ttgattcttagctggtgataat

SEQ ID NO: 6918295 - DNA, 22 bp, Homo sapiens
aagagattcctcactcagaatg

SEQ ID NO: 6918296 - DNA, 22 bp, Homo sapiens
caccaggaggacaggcccctac

SEQ ID NO: 6918297 - DNA, 22 bp, Homo sapiens
aaaggcttgactagaagggaga

SEQ ID NO: 6918298 - DNA, 22 bp, Homo sapiens
acagcagcataaactgactaag

SEQ ID NO: 6918299 - DNA, 22 bp, Homo sapiens
atgcaggaagagccctggagct

SEQ ID NO: 6918300 - DNA, 22 bp, Homo sapiens
aaaaggaggacatggttacaga

SEQ ID NO: 6918301 - DNA, 22 bp, Homo sapiens
ttcagcttcatttgtctttatg

SEQ ID NO: 6918302 - DNA, 22 bp, Homo sapiens
cgcaactcagcaacttaactgc

SEQ ID NO: 6918303 - DNA, 22 bp, Homo sapiens
aagagctggcccaatctgagca

SEQ ID NO: 6918304 - DNA, 22 bp, Homo sapiens
tcctggtggtctgtgcttcttc

SEQ ID NO: 6918305 - DNA, 22 bp, Homo sapiens
aatactgaattagttgagacaa

SEQ ID NO: 6918306 - DNA, 21 bp, Homo sapiens
tgctgctgatcggggttggct

SEQ ID NO: 6918307 - DNA, 22 bp, Homo sapiens
agtgggtaggcctctggtgcct

SEQ ID NO: 6918308 - DNA, 22 bp, Homo sapiens
agccctctctttagagatctga

SEQ ID NO: 6918309 - DNA, 22 bp, Homo sapiens
gcaggggtagagattgctggtg

SEQ ID NO: 6918310 - DNA, 22 bp, Homo sapiens
atgaggcagtacacacaaagcc

SEQ ID NO: 6918311 - DNA, 23 bp, Homo sapiens
agccacagccagagctatctcca

SEQ ID NO: 6918312 - DNA, 22 bp, Homo sapiens
tgggaagctactcatgcaggca

SEQ ID NO: 6918313 - DNA, 22 bp, Homo sapiens
tggcagagaacacacatgattc

SEQ ID NO: 6918314 - DNA, 22 bp, Homo sapiens
attgtctttggtgcttccagga

SEQ ID NO: 6918315 - DNA, 22 bp, Homo sapiens
aaatggctgactaaattaaatt

SEQ ID NO: 6918316 - DNA, 22 bp, Homo sapiens
tcattcagagagaatgttccag

SEQ ID NO: 6918317 - DNA, 22 bp, Homo sapiens
tggaccatgagctgcaggtgtt

SEQ ID NO: 6918318 - DNA, 22 bp, Homo sapiens
ttcaacgagtatttactgagtc

SEQ ID NO: 6918319 - DNA, 21 bp, Homo sapiens
ggcatggcacctctgggcagg

SEQ ID NO: 6918320 - DNA, 22 bp, Homo sapiens
tggatacagctgatagcaggat

SEQ ID NO: 6918321 - DNA, 22 bp, Homo sapiens
tgcacagtgtaatgaatcagaa

SEQ ID NO: 6918322 - DNA, 22 bp, Homo sapiens
ccagcctggagggcagtggtgg

SEQ ID NO: 6918323 - DNA, 22 bp, Homo sapiens
tacagtagacaggaccacaggc

SEQ ID NO: 6918324 - DNA, 22 bp, Homo sapiens
cttcctgggacacctaactcta

SEQ ID NO: 6918325 - DNA, 22 bp, Homo sapiens
caggccacgccccggcgtgtga

SEQ ID NO: 6918326 - DNA, 22 bp, Homo sapiens
tcctgcctcacagttgaagttt

SEQ ID NO: 6918327 - DNA, 22 bp, Homo sapiens
agcattcattgctagaatgtaa

SEQ ID NO: 6918328 - DNA, 22 bp, Homo sapiens
agtctatttttggttcttcggg

SEQ ID NO: 6918329 - DNA, 22 bp, Homo sapiens
gccaagaaatgcccctcacaga

SEQ ID NO: 6918330 - DNA, 22 bp, Homo sapiens
cacaagacttatttgtgtagaa

SEQ ID NO: 6918331 - DNA, 22 bp, Homo sapiens
agcccagggaaccaggaagtgg

SEQ ID NO: 6918332 - DNA, 22 bp, Homo sapiens
aggacctactgatatcttagca

SEQ ID NO: 6918333 - DNA, 22 bp, Homo sapiens
tatccattaggtctatggtcaa

SEQ ID NO: 6918334 - DNA, 22 bp, Homo sapiens
cagctgggtgatcttgggcagg

SEQ ID NO: 6918335 - DNA, 22 bp, Homo sapiens
ccttgctcatcccccagtgcct

SEQ ID NO: 6918336 - DNA, 22 bp, Homo sapiens
cctggagcttttccatcctgga

SEQ ID NO: 6918337 - DNA, 22 bp, Homo sapiens
cagggccaagcccctttggctg

SEQ ID NO: 6918338 - DNA, 22 bp, Homo sapiens
aggaagaacctaagaaagtctc

SEQ ID NO: 6918339 - DNA, 22 bp, Homo sapiens
gggaaggcaccatggtgttcca

SEQ ID NO: 6918340 - DNA, 18 bp, Homo sapiens
aagtggcacaggagtgca

SEQ ID NO: 6918341 - DNA, 22 bp, Homo sapiens
aagctgaaattcctcctgaaat

SEQ ID NO: 6918342 - DNA, 22 bp, Homo sapiens
ttaactattaccactctaggtt

SEQ ID NO: 6918343 - DNA, 22 bp, Homo sapiens
gagctctgggtggcaggtgtct

SEQ ID NO: 6918344 - DNA, 22 bp, Homo sapiens
tacttacatttctgtaatcggc

SEQ ID NO: 6918345 - DNA, 22 bp, Homo sapiens
gccccaggtggtaaacctaaga

SEQ ID NO: 6918346 - DNA, 22 bp, Homo sapiens
agttattactctttaacatatt

SEQ ID NO: 6918347 - DNA, 22 bp, Homo sapiens
cagacaggtagggacagaacat

SEQ ID NO: 6918348 - DNA, 22 bp, Homo sapiens
caggtctcccatcccctctgtt

SEQ ID NO: 6918349 - DNA, 22 bp, Homo sapiens
tttgaagtcaggctttctaccc

SEQ ID NO: 6918350 - DNA, 22 bp, Homo sapiens
tgtgaaggttaaataatatgat

SEQ ID NO: 6918351 - DNA, 22 bp, Homo sapiens
agttacataatctgtgaatttt

SEQ ID NO: 6918352 - DNA, 22 bp, Homo sapiens
ggaggccaggaagagccgccct

SEQ ID NO: 6918353 - DNA, 22 bp, Homo sapiens
tggtgagaagttttgagattct

SEQ ID NO: 6918354 - DNA, 22 bp, Homo sapiens
gccaggaaaaagggtggccaat

SEQ ID NO: 6918355 - DNA, 22 bp, Homo sapiens
gccatgagatgttttatttgca

SEQ ID NO: 6918356 - DNA, 19 bp, Homo sapiens
ggagaagcatctagaaata

SEQ ID NO: 6918357 - DNA, 17 bp, Homo sapiens
ggctctcttccagactt

SEQ ID NO: 6918358 - DNA, 22 bp, Homo sapiens
atgaggcccaaacattacaaat

SEQ ID NO: 6918359 - DNA, 22 bp, Homo sapiens
caaatgatagagccgattatca

SEQ ID NO: 6918360 - DNA, 22 bp, Homo sapiens
ggggcctgtagagcttcaggga

SEQ ID NO: 6918361 - DNA, 22 bp, Homo sapiens
tttgttcaatccagacaatagc

SEQ ID NO: 6918362 - DNA, 22 bp, Homo sapiens
acattgcaataataattctctt

SEQ ID NO: 6918363 - DNA, 23 bp, Homo sapiens
tcttcgggctcactatttcctcc

SEQ ID NO: 6918364 - DNA, 22 bp, Homo sapiens
aggagtcaggaccaaatggaaa

SEQ ID NO: 6918365 - DNA, 18 bp, Homo sapiens
agcatcactgatcatcct

SEQ ID NO: 6918366 - DNA, 22 bp, Homo sapiens
tgcttcagtcctatgggcaggt

SEQ ID NO: 6918367 - DNA, 19 bp, Homo sapiens
atctgagattataaacaga

SEQ ID NO: 6918368 - DNA, 22 bp, Homo sapiens
tgcacacactcgtgtatatgag

SEQ ID NO: 6918369 - DNA, 22 bp, Homo sapiens
agcatctgcataatgccttccc

SEQ ID NO: 6918370 - DNA, 22 bp, Homo sapiens
tttgacaactgtgcagtttgta

SEQ ID NO: 6918371 - DNA, 19 bp, Homo sapiens
tacatcctcttcctctttg

SEQ ID NO: 6918372 - DNA, 22 bp, Homo sapiens
taaatccctacatctgtgtttt

SEQ ID NO: 6918373 - DNA, 22 bp, Homo sapiens
gacacccctttcaacttggtgg

SEQ ID NO: 6918374 - DNA, 22 bp, Homo sapiens
ctattttgtccttagtgcaggg

SEQ ID NO: 6918375 - DNA, 19 bp, Homo sapiens
agtgccaagggtggattgt

SEQ ID NO: 6918376 - DNA, 22 bp, Homo sapiens
tgacaccttgatcttggactta

SEQ ID NO: 6918377 - DNA, 23 bp, Homo sapiens
cagtggtcagaacgtgggagggt

SEQ ID NO: 6918378 - DNA, 21 bp, Homo sapiens
gatttgtattattggttccaa

SEQ ID NO: 6918379 - DNA, 22 bp, Homo sapiens
tggctagcccttgtggggagag

SEQ ID NO: 6918380 - DNA, 22 bp, Homo sapiens
ttgcagggctggaacatggaat

SEQ ID NO: 6918381 - DNA, 22 bp, Homo sapiens
cagaggcccagtgagagggctg

SEQ ID NO: 6918382 - DNA, 22 bp, Homo sapiens
tccagggctccccaacatccag

SEQ ID NO: 6918383 - DNA, 22 bp, Homo sapiens
tgtcctttgttccctgtctctg

SEQ ID NO: 6918384 - DNA, 22 bp, Homo sapiens
actctcccttatctaactttac

SEQ ID NO: 6918385 - DNA, 22 bp, Homo sapiens
tatgtgtaagctgtttatcttt

SEQ ID NO: 6918386 - DNA, 22 bp, Homo sapiens
tggaatgttgtgtataggtcag

SEQ ID NO: 6918387 - DNA, 22 bp, Homo sapiens
atggctggtctcccatggaaaa

SEQ ID NO: 6918388 - DNA, 22 bp, Homo sapiens
agtgctcacctgtcaggtcaag

SEQ ID NO: 6918389 - DNA, 22 bp, Homo sapiens
ccagtttaggacacatgcccac

SEQ ID NO: 6918390 - DNA, 22 bp, Homo sapiens
cacaggaagaggtatacaattc

SEQ ID NO: 6918391 - DNA, 22 bp, Homo sapiens
agctctcccaccttcttcttac

SEQ ID NO: 6918392 - DNA, 22 bp, Homo sapiens
tgcagtgcagctggaatatctt

SEQ ID NO: 6918393 - DNA, 22 bp, Homo sapiens
gccctggagagggatatggcat

SEQ ID NO: 6918394 - DNA, 22 bp, Homo sapiens
gagaatgtggagcctgtggttg

SEQ ID NO: 6918395 - DNA, 22 bp, Homo sapiens
caggcaagatccagaggctgct

SEQ ID NO: 6918396 - DNA, 22 bp, Homo sapiens
gatcagagagctctttatggcc

SEQ ID NO: 6918397 - DNA, 22 bp, Homo sapiens
tttactacttcattgacttacg

SEQ ID NO: 6918398 - DNA, 22 bp, Homo sapiens
agacattttgcattccctgaag

SEQ ID NO: 6918399 - DNA, 22 bp, Homo sapiens
tggtccagatgccttggcttta

SEQ ID NO: 6918400 - DNA, 22 bp, Homo sapiens
attgtactggtaaagaagtggg

SEQ ID NO: 6918401 - DNA, 21 bp, Homo sapiens
gggtggccgcatgggtgcgtg

SEQ ID NO: 6918402 - DNA, 22 bp, Homo sapiens
gagagccatggtggagatgggg

SEQ ID NO: 6918403 - DNA, 22 bp, Homo sapiens
agccaagcactcaactcctgga

SEQ ID NO: 6918404 - DNA, 22 bp, Homo sapiens
cctgttcccaaaccatctttct

SEQ ID NO: 6918405 - DNA, 16 bp, Homo sapiens
cccaggtatccaaggg

SEQ ID NO: 6918406 - DNA, 22 bp, Homo sapiens
aggctagactttggcgaagcac

SEQ ID NO: 6918407 - DNA, 22 bp, Homo sapiens
cccaggcaggagtgtggtggct

SEQ ID NO: 6918408 - DNA, 22 bp, Homo sapiens
atggacagggcacaggcgcaga

SEQ ID NO: 6918409 - DNA, 22 bp, Homo sapiens
tgatatctgaagtgtataaaca

SEQ ID NO: 6918410 - DNA, 22 bp, Homo sapiens
acccaggagacggaggtgcagt

SEQ ID NO: 6918411 - DNA, 22 bp, Homo sapiens
actgcagttggtgacaataacc

SEQ ID NO: 6918412 - DNA, 22 bp, Homo sapiens
tgctactgaataggtgtccaat

SEQ ID NO: 6918413 - DNA, 22 bp, Homo sapiens
ggggatgagactagagctaaag

SEQ ID NO: 6918414 - DNA, 22 bp, Homo sapiens
taggaaatgctccattgcataa

SEQ ID NO: 6918415 - DNA, 22 bp, Homo sapiens
tttgaaatctaatcaaggaaca

SEQ ID NO: 6918416 - DNA, 22 bp, Homo sapiens
aagttcaaggctctagagttcc

SEQ ID NO: 6918417 - DNA, 22 bp, Homo sapiens
ttgcatgtagaatactcaactt

SEQ ID NO: 6918418 - DNA, 22 bp, Homo sapiens
actgttttcttagctccctgct

SEQ ID NO: 6918419 - DNA, 22 bp, Homo sapiens
agtgatttggcggcagagttag

SEQ ID NO: 6918420 - DNA, 22 bp, Homo sapiens
cagttctatcattttagagatg

SEQ ID NO: 6918421 - DNA, 22 bp, Homo sapiens
ttgttatcaatgaatcaaaact

SEQ ID NO: 6918422 - DNA, 20 bp, Homo sapiens
cagggcctatgattgagctt

SEQ ID NO: 6918423 - DNA, 22 bp, Homo sapiens
ctcccagagaccaagctgagaa

SEQ ID NO: 6918424 - DNA, 22 bp, Homo sapiens
ctggaatgaagctatgtacatt

SEQ ID NO: 6918425 - DNA, 22 bp, Homo sapiens
atgaaatgctgagaggtgcttc

SEQ ID NO: 6918426 - DNA, 19 bp, Homo sapiens
ggaggcttcttggggtcgg

SEQ ID NO: 6918427 - DNA, 22 bp, Homo sapiens
gagccctgctgggccttgtctc

SEQ ID NO: 6918428 - DNA, 22 bp, Homo sapiens
ctgcttggcttataacctcagg

SEQ ID NO: 6918429 - DNA, 22 bp, Homo sapiens
cctgagccgagcgctctttctc

SEQ ID NO: 6918430 - DNA, 17 bp, Homo sapiens
atttgtgatgtaacgtc

SEQ ID NO: 6918431 - DNA, 22 bp, Homo sapiens
gtgcaaacatcatagagtgtac

SEQ ID NO: 6918432 - DNA, 22 bp, Homo sapiens
ttgaggcccggcaggccgagcg

SEQ ID NO: 6918433 - DNA, 22 bp, Homo sapiens
gttcgcatcttgatcatggact

SEQ ID NO: 6918434 - DNA, 22 bp, Homo sapiens
aataccttccaacatcaagaca

SEQ ID NO: 6918435 - DNA, 22 bp, Homo sapiens
tgcctgcattttgtggctggct

SEQ ID NO: 6918436 - DNA, 17 bp, Homo sapiens
ttgcttttgaaattgtc

SEQ ID NO: 6918437 - DNA, 22 bp, Homo sapiens
ctgctgactcattttcaacact

SEQ ID NO: 6918438 - DNA, 22 bp, Homo sapiens
tagcatttggacattgtcacct

SEQ ID NO: 6918439 - DNA, 22 bp, Homo sapiens
ggcctgctgtagcttttgttct

SEQ ID NO: 6918440 - DNA, 22 bp, Homo sapiens
cctggctgcattttgctggatg

SEQ ID NO: 6918441 - DNA, 22 bp, Homo sapiens
gtgcctgtttgtagactggaca

SEQ ID NO: 6918442 - DNA, 22 bp, Homo sapiens
gggtgctgactggggcctgaaa

SEQ ID NO: 6918443 - DNA, 22 bp, Homo sapiens
atgccctgctgctggggcagtg

SEQ ID NO: 6918444 - DNA, 22 bp, Homo sapiens
aagtagccttatggttttccag

SEQ ID NO: 6918445 - DNA, 22 bp, Homo sapiens
gaaggacctgtccgtggtgctg

SEQ ID NO: 6918446 - DNA, 22 bp, Homo sapiens
tattgtctctgcgttgttctat

SEQ ID NO: 6918447 - DNA, 22 bp, Homo sapiens
agggcctgtcagcggtgtcctg

SEQ ID NO: 6918448 - DNA, 20 bp, Homo sapiens
tgacaacaaaatggtaattt

SEQ ID NO: 6918449 - DNA, 22 bp, Homo sapiens
tcctgtggggaaaagcctatct

SEQ ID NO: 6918450 - DNA, 22 bp, Homo sapiens
ctggggtgtgctcagagcaggg

SEQ ID NO: 6918451 - DNA, 22 bp, Homo sapiens
tatcatgctaagattgattctt

SEQ ID NO: 6918452 - DNA, 22 bp, Homo sapiens
tgaaagcttgttggaaatgtag

SEQ ID NO: 6918453 - DNA, 22 bp, Homo sapiens
ttgaaccaggaacaattagctc

SEQ ID NO: 6918454 - DNA, 22 bp, Homo sapiens
ctgttgctctgaacaggtcttg

SEQ ID NO: 6918455 - DNA, 22 bp, Homo sapiens
gctgtaaagaacattaggaatc

SEQ ID NO: 6918456 - DNA, 22 bp, Homo sapiens
tatgtctggaagtgtacttgtc

SEQ ID NO: 6918457 - DNA, 18 bp, Homo sapiens
taagagcagactgtaggc

SEQ ID NO: 6918458 - DNA, 19 bp, Homo sapiens
tgtacctgggtcatggtgc

SEQ ID NO: 6918459 - DNA, 22 bp, Homo sapiens
agagggctgggatgtgctgtgt

SEQ ID NO: 6918460 - DNA, 22 bp, Homo sapiens
aaacaggcttccattagagcaa

SEQ ID NO: 6918461 - DNA, 22 bp, Homo sapiens
ctgactgtttgctgaaaggtct

SEQ ID NO: 6918462 - DNA, 20 bp, Homo sapiens
agaaatcagaccacacacta

SEQ ID NO: 6918463 - DNA, 22 bp, Homo sapiens
ttgttatttacaacaatcctat

SEQ ID NO: 6918464 - DNA, 22 bp, Homo sapiens
tgggacctgctcttggaatgag

SEQ ID NO: 6918465 - DNA, 22 bp, Homo sapiens
aggacagtataggctttaggag

SEQ ID NO: 6918466 - DNA, 22 bp, Homo sapiens
caaagagttttttcatataatg

SEQ ID NO: 6918467 - DNA, 22 bp, Homo sapiens
actctggctgccttgtgagcat

SEQ ID NO: 6918468 - DNA, 22 bp, Homo sapiens
caggacagaccaagatcgtgct

SEQ ID NO: 6918469 - DNA, 22 bp, Homo sapiens
caaatctccttaaaggtaaaat

SEQ ID NO: 6918470 - DNA, 22 bp, Homo sapiens
ctattattagataatctacttg

SEQ ID NO: 6918471 - DNA, 22 bp, Homo sapiens
ttgctgaaatctatgacatcct

SEQ ID NO: 6918472 - DNA, 22 bp, Homo sapiens
gctcagaggccaagtgcccgcc

SEQ ID NO: 6918473 - DNA, 22 bp, Homo sapiens
agcctgcttgagagtcctggct

SEQ ID NO: 6918474 - DNA, 22 bp, Homo sapiens
ggctgccaggagaagctcagtg

SEQ ID NO: 6918475 - DNA, 22 bp, Homo sapiens
ttccaaggtttctccagcctcc

SEQ ID NO: 6918476 - DNA, 22 bp, Homo sapiens
catttacatttaaggttaatat

SEQ ID NO: 6918477 - DNA, 22 bp, Homo sapiens
tgtttcttctcacacaaactca

SEQ ID NO: 6918478 - DNA, 22 bp, Homo sapiens
ccaagggccatcctatcacttg

SEQ ID NO: 6918479 - DNA, 22 bp, Homo sapiens
aagaattattgcaatactagat

SEQ ID NO: 6918480 - DNA, 22 bp, Homo sapiens
gtaaagaagtttttgaatgcat

SEQ ID NO: 6918481 - DNA, 22 bp, Homo sapiens
tctgtcacccaggctggagtgc

SEQ ID NO: 6918482 - DNA, 22 bp, Homo sapiens
aaacattagacaccatatgctc

SEQ ID NO: 6918483 - DNA, 22 bp, Homo sapiens
tggcaggtgcacttttggtttc

SEQ ID NO: 6918484 - DNA, 22 bp, Homo sapiens
gctccaggctgctctgtcccat

SEQ ID NO: 6918485 - DNA, 22 bp, Homo sapiens
ttgtgtcccctgttctacctgt

SEQ ID NO: 6918486 - DNA, 22 bp, Homo sapiens
gtcatgaaattctagagcttga

SEQ ID NO: 6918487 - DNA, 20 bp, Homo sapiens
gtttagtgatgaatagggga

SEQ ID NO: 6918488 - DNA, 22 bp, Homo sapiens
ctgaagaatagcaggtgggcac

SEQ ID NO: 6918489 - DNA, 22 bp, Homo sapiens
agcaaggggcagtgaaagtgtg

SEQ ID NO: 6918490 - DNA, 22 bp, Homo sapiens
agataaaatgattttctggatc

SEQ ID NO: 6918491 - DNA, 22 bp, Homo sapiens
gatgattttctgtgttagaaga

SEQ ID NO: 6918492 - DNA, 22 bp, Homo sapiens
caggattgcagatttgattaga

SEQ ID NO: 6918493 - DNA, 22 bp, Homo sapiens
cagcccttaagagtcatccctc

SEQ ID NO: 6918494 - DNA, 22 bp, Homo sapiens
caagtttaaagtgaggtttgaa

SEQ ID NO: 6918495 - DNA, 22 bp, Homo sapiens
aaaagatgaaatggtgtcttgg

SEQ ID NO: 6918496 - DNA, 22 bp, Homo sapiens
tttaagagcatttgcaatttat

SEQ ID NO: 6918497 - DNA, 22 bp, Homo sapiens
ctctgccatttatcagaactgt

SEQ ID NO: 6918498 - DNA, 22 bp, Homo sapiens
aggtgtctggacttgtgaagca

SEQ ID NO: 6918499 - DNA, 22 bp, Homo sapiens
ggcagccatgctccaggtgcag

SEQ ID NO: 6918500 - DNA, 22 bp, Homo sapiens
cataatgtctgacacagtaaga

SEQ ID NO: 6918501 - DNA, 23 bp, Homo sapiens
acttcatggcactgtcttagagg

SEQ ID NO: 6918502 - DNA, 22 bp, Homo sapiens
tctgctttattacactagccaa

SEQ ID NO: 6918503 - DNA, 22 bp, Homo sapiens
ggtgcagcagtttgttcagctt

SEQ ID NO: 6918504 - DNA, 22 bp, Homo sapiens
gtccatctgtaggagggacaca

SEQ ID NO: 6918505 - DNA, 22 bp, Homo sapiens
atgcctgccatttagaagtctt

SEQ ID NO: 6918506 - DNA, 22 bp, Homo sapiens
tgtgggtgatgaatttgttctt

SEQ ID NO: 6918507 - DNA, 22 bp, Homo sapiens
gcaggtgtcagtccccaaggtg

SEQ ID NO: 6918508 - DNA, 22 bp, Homo sapiens
aagaatacgtatcaacaatggt

SEQ ID NO: 6918509 - DNA, 22 bp, Homo sapiens
aggataattggcatttgtaggc

SEQ ID NO: 6918510 - DNA, 22 bp, Homo sapiens
agccagtgggattagagcctct

SEQ ID NO: 6918511 - DNA, 22 bp, Homo sapiens
gaatatatttctcttaccttta

SEQ ID NO: 6918512 - DNA, 22 bp, Homo sapiens
ctccagggaaaggggcgtccgc

SEQ ID NO: 6918513 - DNA, 22 bp, Homo sapiens
tcttagcaaattttctttgcct

SEQ ID NO: 6918514 - DNA, 22 bp, Homo sapiens
aattaagtcacacacctaaacc

SEQ ID NO: 6918515 - DNA, 22 bp, Homo sapiens
agctggtttatttctcacaaca

SEQ ID NO: 6918516 - DNA, 22 bp, Homo sapiens
cagctgtctaagttgagcagga

SEQ ID NO: 6918517 - DNA, 23 bp, Homo sapiens
tttgcaaattttcctgactactc

SEQ ID NO: 6918518 - DNA, 22 bp, Homo sapiens
ttcaaggaagaagtggctttga

SEQ ID NO: 6918519 - DNA, 22 bp, Homo sapiens
tcagttttcatttcatgagcag

SEQ ID NO: 6918520 - DNA, 22 bp, Homo sapiens
agctgtgaccttcaagagctac

SEQ ID NO: 6918521 - DNA, 22 bp, Homo sapiens
tttcaaaattttgcagtggtaa

SEQ ID NO: 6918522 - DNA, 22 bp, Homo sapiens
ctctttggatgtttatgataag

SEQ ID NO: 6918523 - DNA, 22 bp, Homo sapiens
acatctttttggaaacggctga

SEQ ID NO: 6918524 - DNA, 22 bp, Homo sapiens
tcctataattagaagcaatttg

SEQ ID NO: 6918525 - DNA, 22 bp, Homo sapiens
atgaagatacaggcagggccat

SEQ ID NO: 6918526 - DNA, 22 bp, Homo sapiens
tgaaggcttgactgaggcagga

SEQ ID NO: 6918527 - DNA, 22 bp, Homo sapiens
agtcactggttctgtaattaat

SEQ ID NO: 6918528 - DNA, 22 bp, Homo sapiens
tgcctctgaggaagattgtgtt

SEQ ID NO: 6918529 - DNA, 22 bp, Homo sapiens
gaggtcaataatatgtgcttta

SEQ ID NO: 6918530 - DNA, 22 bp, Homo sapiens
aagcacctagcacagtagatta

SEQ ID NO: 6918531 - DNA, 22 bp, Homo sapiens
acagagcaactttatttcatgg

SEQ ID NO: 6918532 - DNA, 22 bp, Homo sapiens
tcagaagactactaggacacat

SEQ ID NO: 6918533 - DNA, 22 bp, Homo sapiens
gctgcttcctagaaggcccagt

SEQ ID NO: 6918534 - DNA, 22 bp, Homo sapiens
ctgctctggggaagccagatgt

SEQ ID NO: 6918535 - DNA, 22 bp, Homo sapiens
tggcacctgaacttagaggtgt

SEQ ID NO: 6918536 - DNA, 22 bp, Homo sapiens
ttcattgatttccttggaataa

SEQ ID NO: 6918537 - DNA, 22 bp, Homo sapiens
aaagctgattgcaggaagagag

SEQ ID NO: 6918538 - DNA, 22 bp, Homo sapiens
tataaaatggcatcagctccaa

SEQ ID NO: 6918539 - DNA, 22 bp, Homo sapiens
cagttaactgagctctgtgaga

SEQ ID NO: 6918540 - DNA, 22 bp, Homo sapiens
tccaggagcatccaggtgaagc

SEQ ID NO: 6918541 - DNA, 22 bp, Homo sapiens
aagcttttgacttggtagggaa

SEQ ID NO: 6918542 - DNA, 22 bp, Homo sapiens
gagggtggatcagcctgattgg

SEQ ID NO: 6918543 - DNA, 22 bp, Homo sapiens
ttctggtaatcggatttcacag

SEQ ID NO: 6918544 - DNA, 22 bp, Homo sapiens
aagtagttgtccctgaggaacg

SEQ ID NO: 6918545 - DNA, 22 bp, Homo sapiens
ctcatagatttagatagatcga

SEQ ID NO: 6918546 - DNA, 22 bp, Homo sapiens
tgtgtgtgagtcctggctttcc

SEQ ID NO: 6918547 - DNA, 22 bp, Homo sapiens
cattgcaggagagtaaataaaa

SEQ ID NO: 6918548 - DNA, 22 bp, Homo sapiens
ttttattgtctgtattgcctat

SEQ ID NO: 6918549 - DNA, 22 bp, Homo sapiens
ggagagatggtaaccctggggc

SEQ ID NO: 6918550 - DNA, 22 bp, Homo sapiens
attagtcttctcatttggatcc

SEQ ID NO: 6918551 - DNA, 22 bp, Homo sapiens
tttcacattagatatgtcattt

SEQ ID NO: 6918552 - DNA, 23 bp, Homo sapiens
tgtcaacaaaactttcaggagaa

SEQ ID NO: 6918553 - DNA, 22 bp, Homo sapiens
tgtctaggttgcggttttatgt

SEQ ID NO: 6918554 - DNA, 22 bp, Homo sapiens
ctgcttgtcttcgaggggtgca

SEQ ID NO: 6918555 - DNA, 22 bp, Homo sapiens
tttacagtctgtctagcaatgt

SEQ ID NO: 6918556 - DNA, 22 bp, Homo sapiens
aggagagtaccattgggccgca

SEQ ID NO: 6918557 - DNA, 22 bp, Homo sapiens
ggctgctggcctctccccggcc

SEQ ID NO: 6918558 - DNA, 22 bp, Homo sapiens
gcagggttctcagcagtgatgg

SEQ ID NO: 6918559 - DNA, 22 bp, Homo sapiens
aagctgtgagctggatgctcca

SEQ ID NO: 6918560 - DNA, 22 bp, Homo sapiens
tttattgcactgtctcaatacc

SEQ ID NO: 6918561 - DNA, 22 bp, Homo sapiens
ctgtgccattctttgtagcatg

SEQ ID NO: 6918562 - DNA, 22 bp, Homo sapiens
cagtctgggactgagctccacc

SEQ ID NO: 6918563 - DNA, 21 bp, Homo sapiens
aagaagcaatttattggaagg

SEQ ID NO: 6918564 - DNA, 22 bp, Homo sapiens
gagcagtgtttgtggacctgga

SEQ ID NO: 6918565 - DNA, 22 bp, Homo sapiens
cctgtcatactaacgtagtggg

SEQ ID NO: 6918566 - DNA, 22 bp, Homo sapiens
tcccaatttcgagagttttaga

SEQ ID NO: 6918567 - DNA, 22 bp, Homo sapiens
acagtaatattgatgctcgtca

SEQ ID NO: 6918568 - DNA, 22 bp, Homo sapiens
taccatttctacatatcttgtc

SEQ ID NO: 6918569 - DNA, 22 bp, Homo sapiens
ctgtgtggcctcaagccagcct

SEQ ID NO: 6918570 - DNA, 22 bp, Homo sapiens
ctcatactcccagccagctgtc

SEQ ID NO: 6918571 - DNA, 22 bp, Homo sapiens
agagtgggcctagctgtaaaag

SEQ ID NO: 6918572 - DNA, 22 bp, Homo sapiens
agacagctccaagtgtctctgt

SEQ ID NO: 6918573 - DNA, 22 bp, Homo sapiens
tttctaagcttagtatgaggca

SEQ ID NO: 6918574 - DNA, 22 bp, Homo sapiens
ttactatatgcgtggcaggtgc

SEQ ID NO: 6918575 - DNA, 22 bp, Homo sapiens
actgtaccaccttgctcttgtc

SEQ ID NO: 6918576 - DNA, 22 bp, Homo sapiens
ttagagaagatgaaccatcgtt

SEQ ID NO: 6918577 - DNA, 20 bp, Homo sapiens
ctgggtcacttggctgctct

SEQ ID NO: 6918578 - DNA, 22 bp, Homo sapiens
gcggcagaggtgttgcgagcga

SEQ ID NO: 6918579 - DNA, 22 bp, Homo sapiens
ggcctctctccctggcttgcag

SEQ ID NO: 6918580 - DNA, 22 bp, Homo sapiens
aactatacatatttacatagac

SEQ ID NO: 6918581 - DNA, 22 bp, Homo sapiens
gttttccttctcagccattgcc

SEQ ID NO: 6918582 - DNA, 20 bp, Homo sapiens
agctcctctgcccattcttc

SEQ ID NO: 6918583 - DNA, 22 bp, Homo sapiens
tgacagtttattttgcagaatg

SEQ ID NO: 6918584 - DNA, 22 bp, Homo sapiens
ctagcaggctaatgtaagcttg

SEQ ID NO: 6918585 - DNA, 22 bp, Homo sapiens
gctgaggtggtgatggttcatc

SEQ ID NO: 6918586 - DNA, 22 bp, Homo sapiens
ggtaacaaccctacaaatccac

SEQ ID NO: 6918587 - DNA, 23 bp, Homo sapiens
aactgtcttgcaagtgtgatacc

SEQ ID NO: 6918588 - DNA, 22 bp, Homo sapiens
aagggcagcttaaattggtagc

SEQ ID NO: 6918589 - DNA, 22 bp, Homo sapiens
tagtttagccatttaggaattg

SEQ ID NO: 6918590 - DNA, 22 bp, Homo sapiens
agctagaggtgaaacatgccaa

SEQ ID NO: 6918591 - DNA, 22 bp, Homo sapiens
tgcagcagctccaggttaccct

SEQ ID NO: 6918592 - DNA, 22 bp, Homo sapiens
cccgctccttacctgtccaacc

SEQ ID NO: 6918593 - DNA, 22 bp, Homo sapiens
tctctgtaaaatgtggatgata

SEQ ID NO: 6918594 - DNA, 22 bp, Homo sapiens
ataggaatgtgatttataaatg

SEQ ID NO: 6918595 - DNA, 22 bp, Homo sapiens
aaggacagagagccattccaga

SEQ ID NO: 6918596 - DNA, 22 bp, Homo sapiens
ctgttatttctgaatgccatcc

SEQ ID NO: 6918597 - DNA, 22 bp, Homo sapiens
cctctcccagggagagcctgag

SEQ ID NO: 6918598 - DNA, 17 bp, Homo sapiens
tgtatgtggatacacta

SEQ ID NO: 6918599 - DNA, 22 bp, Homo sapiens
gcagcaggcttttcataccttg

SEQ ID NO: 6918600 - DNA, 22 bp, Homo sapiens
ccctgctgtcaggtgctgggag

SEQ ID NO: 6918601 - DNA, 22 bp, Homo sapiens
tgagcagaaaagaatgctgagc

SEQ ID NO: 6918602 - DNA, 22 bp, Homo sapiens
ttgaagtagtatcttaaggaca

SEQ ID NO: 6918603 - DNA, 22 bp, Homo sapiens
ccagagcatgaagggcaatgac

SEQ ID NO: 6918604 - DNA, 22 bp, Homo sapiens
agaaactatcctgagtagcaaa

SEQ ID NO: 6918605 - DNA, 22 bp, Homo sapiens
actttcatggtagttgtattct

SEQ ID NO: 6918606 - DNA, 22 bp, Homo sapiens
tatggcttctataaggaagctt

SEQ ID NO: 6918607 - DNA, 22 bp, Homo sapiens
ttttaacactcagcactatctc

SEQ ID NO: 6918608 - DNA, 22 bp, Homo sapiens
attaaatactgcaggctaagca

SEQ ID NO: 6918609 - DNA, 22 bp, Homo sapiens
cctgggaggcggaggttgcagg

SEQ ID NO: 6918610 - DNA, 23 bp, Homo sapiens
caggtggctccacgaggggtggg

SEQ ID NO: 6918611 - DNA, 18 bp, Homo sapiens
tcaggtgttttctgtata

SEQ ID NO: 6918612 - DNA, 19 bp, Homo sapiens
aggctggagacaccaggcc

SEQ ID NO: 6918613 - DNA, 22 bp, Homo sapiens
gtctctgcctggggggatcaga

SEQ ID NO: 6918614 - DNA, 22 bp, Homo sapiens
catctttaacagaatggatttg

SEQ ID NO: 6918615 - DNA, 22 bp, Homo sapiens
atacagtaatttgtaactcatc

SEQ ID NO: 6918616 - DNA, 22 bp, Homo sapiens
caccaataattttatatcacat

SEQ ID NO: 6918617 - DNA, 22 bp, Homo sapiens
tgaaagcatgcttgccaagctt

SEQ ID NO: 6918618 - DNA, 22 bp, Homo sapiens
aaaattgaggctcatgttaaat

SEQ ID NO: 6918619 - DNA, 22 bp, Homo sapiens
taaaggcttttacaggagtgca

SEQ ID NO: 6918620 - DNA, 22 bp, Homo sapiens
gtggaacaatatcgaagagagg

SEQ ID NO: 6918621 - DNA, 22 bp, Homo sapiens
cgcagctggatatcatgtgcct

SEQ ID NO: 6918622 - DNA, 22 bp, Homo sapiens
tggtaccatgacaaatgtcagg

SEQ ID NO: 6918623 - DNA, 22 bp, Homo sapiens
ttctgtctgtaaacttctcaat

SEQ ID NO: 6918624 - DNA, 22 bp, Homo sapiens
tatatagctaaaagagatattg

SEQ ID NO: 6918625 - DNA, 22 bp, Homo sapiens
tcactgcatcccatctccagcc

SEQ ID NO: 6918626 - DNA, 22 bp, Homo sapiens
tgtgatgaagagtccaagaaca

SEQ ID NO: 6918627 - DNA, 22 bp, Homo sapiens
gcagtgtgcatggcttttggcc

SEQ ID NO: 6918628 - DNA, 22 bp, Homo sapiens
taggacttagaactggaagaca

SEQ ID NO: 6918629 - DNA, 22 bp, Homo sapiens
ctctgacaagacagaccataac

SEQ ID NO: 6918630 - DNA, 20 bp, Homo sapiens
cagtccaggctagaaaacaa

SEQ ID NO: 6918631 - DNA, 22 bp, Homo sapiens
tgctcctgccgtggtcgggact

SEQ ID NO: 6918632 - DNA, 22 bp, Homo sapiens
tgcagacctcccatggctgcct

SEQ ID NO: 6918633 - DNA, 22 bp, Homo sapiens
ttctagggaatgggatgaggat

SEQ ID NO: 6918634 - DNA, 22 bp, Homo sapiens
atgcactttctagagattctga

SEQ ID NO: 6918635 - DNA, 22 bp, Homo sapiens
gtcctccatggtcttgaagtaa

SEQ ID NO: 6918636 - DNA, 22 bp, Homo sapiens
tcgttttaggtggacattgtgt

SEQ ID NO: 6918637 - DNA, 22 bp, Homo sapiens
tgggtgaaaattttggtggcac

SEQ ID NO: 6918638 - DNA, 22 bp, Homo sapiens
gaggccagaagtctgagatcag

SEQ ID NO: 6918639 - DNA, 22 bp, Homo sapiens
tctgacattttgagaatgacat

SEQ ID NO: 6918640 - DNA, 22 bp, Homo sapiens
cttcctcatgtgcaatgcaagc

SEQ ID NO: 6918641 - DNA, 23 bp, Homo sapiens
ttttttgtcttgctaggctgccc

SEQ ID NO: 6918642 - DNA, 22 bp, Homo sapiens
tctcaccccgttttctgtgtga

SEQ ID NO: 6918643 - DNA, 22 bp, Homo sapiens
tggtccctgatctaatgtctca

SEQ ID NO: 6918644 - DNA, 22 bp, Homo sapiens
gcagatgtaatggctggaggtc

SEQ ID NO: 6918645 - DNA, 22 bp, Homo sapiens
ttcctgatgcacacagtcattt

SEQ ID NO: 6918646 - DNA, 22 bp, Homo sapiens
aaggtgttcttcagtagaggtc

SEQ ID NO: 6918647 - DNA, 22 bp, Homo sapiens
ttctttctgtcatggtgtactg

SEQ ID NO: 6918648 - DNA, 22 bp, Homo sapiens
atacactaatcatgtgctcagt

SEQ ID NO: 6918649 - DNA, 22 bp, Homo sapiens
ccaaaggtgttggccttcagtg

SEQ ID NO: 6918650 - DNA, 22 bp, Homo sapiens
ttcctccatccttagggagagc

SEQ ID NO: 6918651 - DNA, 20 bp, Homo sapiens
cactggaaagcaggcgactc

SEQ ID NO: 6918652 - DNA, 22 bp, Homo sapiens
gttagcatgattcctgctcatt

SEQ ID NO: 6918653 - DNA, 22 bp, Homo sapiens
aaaaccaagttttccttagtct

SEQ ID NO: 6918654 - DNA, 22 bp, Homo sapiens
cccagcatttctgggctgcact

SEQ ID NO: 6918655 - DNA, 22 bp, Homo sapiens
ctgagcagaggtcaagatactt

SEQ ID NO: 6918656 - DNA, 22 bp, Homo sapiens
ggctgcagagctgggtgggcct

SEQ ID NO: 6918657 - DNA, 22 bp, Homo sapiens
gtttaattcccacacctgccct

SEQ ID NO: 6918658 - DNA, 22 bp, Homo sapiens
gaaatgtctttgacaagagagg

SEQ ID NO: 6918659 - DNA, 22 bp, Homo sapiens
gcttctctcaggagcatcagcc

SEQ ID NO: 6918660 - DNA, 22 bp, Homo sapiens
tggaatgtgctactgttgattt

SEQ ID NO: 6918661 - DNA, 22 bp, Homo sapiens
tagctgagagctcacttgagga

SEQ ID NO: 6918662 - DNA, 22 bp, Homo sapiens
gggtccagagttgaagaggtta

SEQ ID NO: 6918663 - DNA, 22 bp, Homo sapiens
tgcaggtgtaaattttcaagag

SEQ ID NO: 6918664 - DNA, 22 bp, Homo sapiens
tgatgtttaatactatgctttt

SEQ ID NO: 6918665 - DNA, 22 bp, Homo sapiens
taatgtgaagacataaatcaga

SEQ ID NO: 6918666 - DNA, 22 bp, Homo sapiens
ttccttttcttctaccacatgt

SEQ ID NO: 6918667 - DNA, 22 bp, Homo sapiens
ttaaggaagcctatgggaatag

SEQ ID NO: 6918668 - DNA, 22 bp, Homo sapiens
ggcacagtgattaagagccagt

SEQ ID NO: 6918669 - DNA, 21 bp, Homo sapiens
gttcttgcaggatttccttcc

SEQ ID NO: 6918670 - DNA, 22 bp, Homo sapiens
ctgccctgtccttcccgccggc

SEQ ID NO: 6918671 - DNA, 22 bp, Homo sapiens
acagatgaatctgtgattgctg

SEQ ID NO: 6918672 - DNA, 20 bp, Homo sapiens
cagcatcaaaggaaggtttg

SEQ ID NO: 6918673 - DNA, 22 bp, Homo sapiens
tgttaagcgacatactgaagga

SEQ ID NO: 6918674 - DNA, 22 bp, Homo sapiens
caagtttactactacctgtgtg

SEQ ID NO: 6918675 - DNA, 22 bp, Homo sapiens
tccctctgggctccagcacgga

SEQ ID NO: 6918676 - DNA, 22 bp, Homo sapiens
ttaaactgggtccctgctggca

SEQ ID NO: 6918677 - DNA, 22 bp, Homo sapiens
agctgttttcttgccgtcctag

SEQ ID NO: 6918678 - DNA, 22 bp, Homo sapiens
gtggaaagaacacaaaattagg

SEQ ID NO: 6918679 - DNA, 22 bp, Homo sapiens
ccacccgtcctgctcgggccgc

SEQ ID NO: 6918680 - DNA, 21 bp, Homo sapiens
caagttctgtgtcttactcct

SEQ ID NO: 6918681 - DNA, 22 bp, Homo sapiens
tacactaaatcttcatctttta

SEQ ID NO: 6918682 - DNA, 22 bp, Homo sapiens
cacatgagacaattaaagactt

SEQ ID NO: 6918683 - DNA, 22 bp, Homo sapiens
aaagtgttatgagaactaagtg

SEQ ID NO: 6918684 - DNA, 22 bp, Homo sapiens
tcaaataaggagtcatgaccat

SEQ ID NO: 6918685 - DNA, 20 bp, Homo sapiens
gggctggcgcatggggaaag

SEQ ID NO: 6918686 - DNA, 22 bp, Homo sapiens
tacgtgcgtggatggaggttaa

SEQ ID NO: 6918687 - DNA, 22 bp, Homo sapiens
ggccccagcagtgcttgtttat

SEQ ID NO: 6918688 - DNA, 22 bp, Homo sapiens
tagtggctgcttcattggtgag

SEQ ID NO: 6918689 - DNA, 22 bp, Homo sapiens
ccagaggctggggaaggataca

SEQ ID NO: 6918690 - DNA, 22 bp, Homo sapiens
agtctctgttccagggcttcag

SEQ ID NO: 6918691 - DNA, 22 bp, Homo sapiens
tctaccctgcggtcttggggca

SEQ ID NO: 6918692 - DNA, 22 bp, Homo sapiens
tcttatcttatacctaacagcc

SEQ ID NO: 6918693 - DNA, 22 bp, Homo sapiens
tccatctggtaaaattcattga

SEQ ID NO: 6918694 - DNA, 22 bp, Homo sapiens
cagcaagagttggggttgttgg

SEQ ID NO: 6918695 - DNA, 21 bp, Homo sapiens
cagttattcttgatgtgtgtg

SEQ ID NO: 6918696 - DNA, 22 bp, Homo sapiens
cagggccttttagcatcttctc

SEQ ID NO: 6918697 - DNA, 22 bp, Homo sapiens
ggactctgctggttttgttcac

SEQ ID NO: 6918698 - DNA, 22 bp, Homo sapiens
ttattctgtgaacatggttaat

SEQ ID NO: 6918699 - DNA, 22 bp, Homo sapiens
aagatgtgatgggttaagggcc

SEQ ID NO: 6918700 - DNA, 22 bp, Homo sapiens
ccctgggataccagacaccaga

SEQ ID NO: 6918701 - DNA, 22 bp, Homo sapiens
ggagccagaaatgctgtggttg

SEQ ID NO: 6918702 - DNA, 22 bp, Homo sapiens
gctggcagtttcctcaccgagg

SEQ ID NO: 6918703 - DNA, 22 bp, Homo sapiens
ggtgaagcctctagttacattt

SEQ ID NO: 6918704 - DNA, 22 bp, Homo sapiens
gcctcagagggcagggtggtga

SEQ ID NO: 6918705 - DNA, 22 bp, Homo sapiens
tattctgggtaccaaacttcaa

SEQ ID NO: 6918706 - DNA, 22 bp, Homo sapiens
cctgagcttacaatttaagaac

SEQ ID NO: 6918707 - DNA, 22 bp, Homo sapiens
acccctccattctgaaggctgc

SEQ ID NO: 6918708 - DNA, 22 bp, Homo sapiens
gcctggagcctcagcaaggagg

SEQ ID NO: 6918709 - DNA, 22 bp, Homo sapiens
tctgagtttaggaccaggctga

SEQ ID NO: 6918710 - DNA, 22 bp, Homo sapiens
ctgggtaaaggctgcttttcta

SEQ ID NO: 6918711 - DNA, 22 bp, Homo sapiens
ttgatacaggccttctagatga

SEQ ID NO: 6918712 - DNA, 22 bp, Homo sapiens
aaggaggaatgtagccagctcc

SEQ ID NO: 6918713 - DNA, 22 bp, Homo sapiens
tagaaggcatttcctttatttt

SEQ ID NO: 6918714 - DNA, 22 bp, Homo sapiens
cctgggaagcccatagcagctt

SEQ ID NO: 6918715 - DNA, 22 bp, Homo sapiens
gtgggatggtaggtaggtaata

SEQ ID NO: 6918716 - DNA, 22 bp, Homo sapiens
aggagccagttccaccccagga

SEQ ID NO: 6918717 - DNA, 22 bp, Homo sapiens
tgctcagagctccagctctcct

SEQ ID NO: 6918718 - DNA, 22 bp, Homo sapiens
ttgacctggaaggtgcttcctg

SEQ ID NO: 6918719 - DNA, 22 bp, Homo sapiens
gggctgagattggtgccctgtc

SEQ ID NO: 6918720 - DNA, 22 bp, Homo sapiens
gaacctctttgtgcttcagctt

SEQ ID NO: 6918721 - DNA, 22 bp, Homo sapiens
ttgccattggcaggcctcttgt

SEQ ID NO: 6918722 - DNA, 22 bp, Homo sapiens
tacacattttgcgggtacatgt

SEQ ID NO: 6918723 - DNA, 21 bp, Homo sapiens
acagttcatgataactccatc

SEQ ID NO: 6918724 - DNA, 20 bp, Homo sapiens
agaagtttgggggtgtggag

SEQ ID NO: 6918725 - DNA, 22 bp, Homo sapiens
tgaggtaataagtgtttgtttt

SEQ ID NO: 6918726 - DNA, 22 bp, Homo sapiens
ggagcaccacaggttgagggga

SEQ ID NO: 6918727 - DNA, 22 bp, Homo sapiens
tgaagcagcaccattttagagc

SEQ ID NO: 6918728 - DNA, 21 bp, Homo sapiens
tccagtcaacttggcttggct

SEQ ID NO: 6918729 - DNA, 22 bp, Homo sapiens
ggagctgcttcttgctgtgggt

SEQ ID NO: 6918730 - DNA, 22 bp, Homo sapiens
tactctgctcattggagtgtgt

SEQ ID NO: 6918731 - DNA, 22 bp, Homo sapiens
gtgtggctagaagtgtcttgtt

SEQ ID NO: 6918732 - DNA, 22 bp, Homo sapiens
ccagctggggaagtggggcata

SEQ ID NO: 6918733 - DNA, 22 bp, Homo sapiens
gatgctcatctgtcctttgatg

SEQ ID NO: 6918734 - DNA, 22 bp, Homo sapiens
gtttattatacaacaaaagcta

SEQ ID NO: 6918735 - DNA, 22 bp, Homo sapiens
cggcgcaggcagaccgcgggct

SEQ ID NO: 6918736 - DNA, 21 bp, Homo sapiens
atatcacaaacatatggtctg

SEQ ID NO: 6918737 - DNA, 22 bp, Homo sapiens
catagaaacttgcagcaagcac

SEQ ID NO: 6918738 - DNA, 22 bp, Homo sapiens
caaggtttcgagttcccaacca

SEQ ID NO: 6918739 - DNA, 23 bp, Homo sapiens
tttatttatttaggctgagggat

SEQ ID NO: 6918740 - DNA, 22 bp, Homo sapiens
aggcaagtgcattagaagagca

SEQ ID NO: 6918741 - DNA, 22 bp, Homo sapiens
atggcctgggcccgcttcagat

SEQ ID NO: 6918742 - DNA, 22 bp, Homo sapiens
tggagagcaatgaggggcaggc

SEQ ID NO: 6918743 - DNA, 22 bp, Homo sapiens
cagggctcactcggctggcgtc

SEQ ID NO: 6918744 - DNA, 22 bp, Homo sapiens
ttctatgtggatatagaactgc

SEQ ID NO: 6918745 - DNA, 22 bp, Homo sapiens
caggcctggcccccggcacacc

SEQ ID NO: 6918746 - DNA, 22 bp, Homo sapiens
tcttatgtttctagaaaataag

SEQ ID NO: 6918747 - DNA, 22 bp, Homo sapiens
atttggcagtataaattctggc

SEQ ID NO: 6918748 - DNA, 22 bp, Homo sapiens
gtcataatataaaaactgactt

SEQ ID NO: 6918749 - DNA, 22 bp, Homo sapiens
tccaaggagtcttaagttacat

SEQ ID NO: 6918750 - DNA, 22 bp, Homo sapiens
ctgggaagggacgccagtgcct

SEQ ID NO: 6918751 - DNA, 22 bp, Homo sapiens
tagtacagttccatcaaagcag

SEQ ID NO: 6918752 - DNA, 22 bp, Homo sapiens
aaagttctatgtaatgtttttt

SEQ ID NO: 6918753 - DNA, 22 bp, Homo sapiens
tgtgcccattacacagaggcat

SEQ ID NO: 6918754 - DNA, 22 bp, Homo sapiens
cacaccatatgattccatttag

SEQ ID NO: 6918755 - DNA, 22 bp, Homo sapiens
aggatcatgtggtcattcctga

SEQ ID NO: 6918756 - DNA, 22 bp, Homo sapiens
ggaatgatggtgcctagattat

SEQ ID NO: 6918757 - DNA, 22 bp, Homo sapiens
gtactataggtaatgtagacca

SEQ ID NO: 6918758 - DNA, 22 bp, Homo sapiens
tggatgtaggacacatagaatt

SEQ ID NO: 6918759 - DNA, 22 bp, Homo sapiens
aaactgaagagctttttgacac

SEQ ID NO: 6918760 - DNA, 22 bp, Homo sapiens
tctgtcaaatgagcaagtaact

SEQ ID NO: 6918761 - DNA, 22 bp, Homo sapiens
tgtgctgggagatagagggagg

SEQ ID NO: 6918762 - DNA, 22 bp, Homo sapiens
agcagcaacttatttttcttat

SEQ ID NO: 6918763 - DNA, 22 bp, Homo sapiens
ctcgatgactttcaaagatgta

SEQ ID NO: 6918764 - DNA, 22 bp, Homo sapiens
ggtccttgggtctcctgtgttt

SEQ ID NO: 6918765 - DNA, 22 bp, Homo sapiens
acagcatccctgaagataacca

SEQ ID NO: 6918766 - DNA, 22 bp, Homo sapiens
taggccattccttctcttgatc

SEQ ID NO: 6918767 - DNA, 22 bp, Homo sapiens
aaaataagttggtcctgtcctt

SEQ ID NO: 6918768 - DNA, 18 bp, Homo sapiens
ggataggaccttaggcag

SEQ ID NO: 6918769 - DNA, 20 bp, Homo sapiens
ggcttgtctgagtccctggc

SEQ ID NO: 6918770 - DNA, 22 bp, Homo sapiens
cccagtgtgcccctcctgcagc

SEQ ID NO: 6918771 - DNA, 22 bp, Homo sapiens
agcagtggacctcagtgctatt

SEQ ID NO: 6918772 - DNA, 22 bp, Homo sapiens
cacagcttgggctctgacaata

SEQ ID NO: 6918773 - DNA, 22 bp, Homo sapiens
cctgcaggtccccggatgcgca

SEQ ID NO: 6918774 - DNA, 22 bp, Homo sapiens
ggtggctgcttcctcaagagga

SEQ ID NO: 6918775 - DNA, 22 bp, Homo sapiens
gactgggatcagctagatgatt

SEQ ID NO: 6918776 - DNA, 22 bp, Homo sapiens
tactatttatggagtggttatt

SEQ ID NO: 6918777 - DNA, 22 bp, Homo sapiens
tgcccaagccgagctctctgtt

SEQ ID NO: 6918778 - DNA, 22 bp, Homo sapiens
agcgcgctcgatggtttccgcg

SEQ ID NO: 6918779 - DNA, 22 bp, Homo sapiens
tcagcagtagagggggcacagt

SEQ ID NO: 6918780 - DNA, 22 bp, Homo sapiens
atcctgggcagttttgagtgct

SEQ ID NO: 6918781 - DNA, 17 bp, Homo sapiens
ggaagaaaaggatcatc

SEQ ID NO: 6918782 - DNA, 22 bp, Homo sapiens
aatcattgtaaatggttttgtt

SEQ ID NO: 6918783 - DNA, 22 bp, Homo sapiens
tgaactgtagcaggtttagagt

SEQ ID NO: 6918784 - DNA, 22 bp, Homo sapiens
aggtcttggctcctgtgtgcag

SEQ ID NO: 6918785 - DNA, 22 bp, Homo sapiens
ggtgtcagcctgggagcctagc

SEQ ID NO: 6918786 - DNA, 22 bp, Homo sapiens
tggcagagatgaagagttgttt

SEQ ID NO: 6918787 - DNA, 22 bp, Homo sapiens
ttgaagctccggtgtataggaa

SEQ ID NO: 6918788 - DNA, 22 bp, Homo sapiens
aaactgaggaacaaggaaggat

SEQ ID NO: 6918789 - DNA, 22 bp, Homo sapiens
ttccttctgaagcctttgtgtt

SEQ ID NO: 6918790 - DNA, 17 bp, Homo sapiens
tttctccttccatctca

SEQ ID NO: 6918791 - DNA, 19 bp, Homo sapiens
gctcagagtccccctgcgg

SEQ ID NO: 6918792 - DNA, 22 bp, Homo sapiens
tgctccagctggagatgggggc

SEQ ID NO: 6918793 - DNA, 22 bp, Homo sapiens
agaaaacactgccccctctctc

SEQ ID NO: 6918794 - DNA, 22 bp, Homo sapiens
aatgttttaaaagagattgaga

SEQ ID NO: 6918795 - DNA, 22 bp, Homo sapiens
acctggcttcaaccatcatttg

SEQ ID NO: 6918796 - DNA, 22 bp, Homo sapiens
tattatgcataggcaataatgg

SEQ ID NO: 6918797 - DNA, 22 bp, Homo sapiens
aagccagggtcaggggcctcct

SEQ ID NO: 6918798 - DNA, 22 bp, Homo sapiens
ctagcaggtcaaaccagctgat

SEQ ID NO: 6918799 - DNA, 22 bp, Homo sapiens
cagcttcccttggctgagcaga

SEQ ID NO: 6918800 - DNA, 22 bp, Homo sapiens
caggtaggatggaagggctcaa

SEQ ID NO: 6918801 - DNA, 22 bp, Homo sapiens
atgggggcctgaacaggcaaaa

SEQ ID NO: 6918802 - DNA, 22 bp, Homo sapiens
atgctgaagagttcatgattat

SEQ ID NO: 6918803 - DNA, 22 bp, Homo sapiens
tgtaattatgttgttagagtat

SEQ ID NO: 6918804 - DNA, 22 bp, Homo sapiens
cttatcagattatctgggctgt

SEQ ID NO: 6918805 - DNA, 22 bp, Homo sapiens
gctgtttccccttcacagtggc

SEQ ID NO: 6918806 - DNA, 22 bp, Homo sapiens
ttatggaatacttatgctgcag

SEQ ID NO: 6918807 - DNA, 22 bp, Homo sapiens
tcgagtcatgttctcccattaa

SEQ ID NO: 6918808 - DNA, 22 bp, Homo sapiens
tagctgcctagacagctatagc

SEQ ID NO: 6918809 - DNA, 19 bp, Homo sapiens
tgcaagccgagcatcgcta

SEQ ID NO: 6918810 - DNA, 22 bp, Homo sapiens
tccaggagaggtgtggggactg

SEQ ID NO: 6918811 - DNA, 22 bp, Homo sapiens
ttgggagagtttacatcctttt

SEQ ID NO: 6918812 - DNA, 22 bp, Homo sapiens
tcccagcgcggggggaggatcc

SEQ ID NO: 6918813 - DNA, 22 bp, Homo sapiens
gatgtaaagcttcagagccggc

SEQ ID NO: 6918814 - DNA, 22 bp, Homo sapiens
tggcttcttagaccagtggcct

SEQ ID NO: 6918815 - DNA, 22 bp, Homo sapiens
ccagaagttcctaagcatcatt

SEQ ID NO: 6918816 - DNA, 22 bp, Homo sapiens
ttcaagtttttaaaggcagtta

SEQ ID NO: 6918817 - DNA, 19 bp, Homo sapiens
ctagcttgtcatttgtgtg

SEQ ID NO: 6918818 - DNA, 22 bp, Homo sapiens
tttagggacaagggtctggggt

SEQ ID NO: 6918819 - DNA, 22 bp, Homo sapiens
atgccacataaccagttcactt

SEQ ID NO: 6918820 - DNA, 22 bp, Homo sapiens
gagcaagattaaaaggctgggt

SEQ ID NO: 6918821 - DNA, 22 bp, Homo sapiens
attaggtagtataatctttgtt

SEQ ID NO: 6918822 - DNA, 22 bp, Homo sapiens
tgctgcagtgggattagcctga

SEQ ID NO: 6918823 - DNA, 22 bp, Homo sapiens
taagacacattggagtagatga

SEQ ID NO: 6918824 - DNA, 22 bp, Homo sapiens
cactgcctataaatttggccaa

SEQ ID NO: 6918825 - DNA, 22 bp, Homo sapiens
ctgcctggtctcaggcatgggg

SEQ ID NO: 6918826 - DNA, 22 bp, Homo sapiens
acacatgctccagtctccagga

SEQ ID NO: 6918827 - DNA, 22 bp, Homo sapiens
acgtagtgtgttgtggaaagag

SEQ ID NO: 6918828 - DNA, 22 bp, Homo sapiens
cagcaactcctatattgaaagc

SEQ ID NO: 6918829 - DNA, 20 bp, Homo sapiens
acctctgacccagagcaggc

SEQ ID NO: 6918830 - DNA, 22 bp, Homo sapiens
tactcaaaaagttatgaatcat

SEQ ID NO: 6918831 - DNA, 22 bp, Homo sapiens
gtgtctcttagcctgctaatgc

SEQ ID NO: 6918832 - DNA, 22 bp, Homo sapiens
gctgacctcgtccaggcgcttc

SEQ ID NO: 6918833 - DNA, 20 bp, Homo sapiens
agtaggggaatgcaagagca

SEQ ID NO: 6918834 - DNA, 22 bp, Homo sapiens
tctgtacatttggggaccccag

SEQ ID NO: 6918835 - DNA, 22 bp, Homo sapiens
gatttatgacagagctgactct

SEQ ID NO: 6918836 - DNA, 22 bp, Homo sapiens
agctgccaagtttctcagttta

SEQ ID NO: 6918837 - DNA, 22 bp, Homo sapiens
ggaatctttgaaggattttaag

SEQ ID NO: 6918838 - DNA, 22 bp, Homo sapiens
gcaagttatttccatttaaagc

SEQ ID NO: 6918839 - DNA, 22 bp, Homo sapiens
gctttggtcaggtgtccagccc

SEQ ID NO: 6918840 - DNA, 23 bp, Homo sapiens
aaaccttttgtagaacaattgct

SEQ ID NO: 6918841 - DNA, 22 bp, Homo sapiens
cagcagcgcacactggtatgga

SEQ ID NO: 6918842 - DNA, 22 bp, Homo sapiens
tctgggaagctgcgtgcctgtt

SEQ ID NO: 6918843 - DNA, 22 bp, Homo sapiens
agttaagaaggtcaacgaggga

SEQ ID NO: 6918844 - DNA, 22 bp, Homo sapiens
aagttacagttggaactgtgaa

SEQ ID NO: 6918845 - DNA, 22 bp, Homo sapiens
atacaagtgagaaaactgaaga

SEQ ID NO: 6918846 - DNA, 22 bp, Homo sapiens
tgtctgcagaagatggcatggg

SEQ ID NO: 6918847 - DNA, 19 bp, Homo sapiens
ttgacgttgtggaattaac

SEQ ID NO: 6918848 - DNA, 22 bp, Homo sapiens
gaactgcatcttaaataatact

SEQ ID NO: 6918849 - DNA, 22 bp, Homo sapiens
gatgatttgaggatttcatgag

SEQ ID NO: 6918850 - DNA, 22 bp, Homo sapiens
tgatatcagctggcagcagtgg

SEQ ID NO: 6918851 - DNA, 22 bp, Homo sapiens
gaggcctgtcgctaggcctctg

SEQ ID NO: 6918852 - DNA, 22 bp, Homo sapiens
gaggagggttggccttaggtag

SEQ ID NO: 6918853 - DNA, 22 bp, Homo sapiens
tcagacaggcttctttctccct

SEQ ID NO: 6918854 - DNA, 22 bp, Homo sapiens
agcagctgggctcagagctggg

SEQ ID NO: 6918855 - DNA, 20 bp, Homo sapiens
gccagctgcccttccaccct

SEQ ID NO: 6918856 - DNA, 22 bp, Homo sapiens
aagattctgtcagttaggagga

SEQ ID NO: 6918857 - DNA, 22 bp, Homo sapiens
gcagaggctctttaatgcttag

SEQ ID NO: 6918858 - DNA, 22 bp, Homo sapiens
tttttctgtctcttacattgca

SEQ ID NO: 6918859 - DNA, 22 bp, Homo sapiens
cctgggtctggtcactaagtca

SEQ ID NO: 6918860 - DNA, 22 bp, Homo sapiens
ctcagcacactcccatctaatt

SEQ ID NO: 6918861 - DNA, 22 bp, Homo sapiens
tgttaacacaattctggagaga

SEQ ID NO: 6918862 - DNA, 22 bp, Homo sapiens
tggcttggctaagatctaagct

SEQ ID NO: 6918863 - DNA, 22 bp, Homo sapiens
aagaagttaataatggtgagaa

SEQ ID NO: 6918864 - DNA, 20 bp, Homo sapiens
tgcctgcccctgctttttcc

SEQ ID NO: 6918865 - DNA, 22 bp, Homo sapiens
cacagtggtttccgattcagac

SEQ ID NO: 6918866 - DNA, 23 bp, Homo sapiens
gggccttggatttgtggagttca

SEQ ID NO: 6918867 - DNA, 20 bp, Homo sapiens
tgcttttatacctataatga

SEQ ID NO: 6918868 - DNA, 22 bp, Homo sapiens
ttttaaactcccctagttggtg

SEQ ID NO: 6918869 - DNA, 22 bp, Homo sapiens
tgaatcagtataaattctcaaa

SEQ ID NO: 6918870 - DNA, 22 bp, Homo sapiens
aggcctgttccaggcccctttt

SEQ ID NO: 6918871 - DNA, 20 bp, Homo sapiens
tccagatattaagacaggca

SEQ ID NO: 6918872 - DNA, 22 bp, Homo sapiens
catccaccgcgtgcacctctac

SEQ ID NO: 6918873 - DNA, 22 bp, Homo sapiens
tgccctggggtctggagcagca

SEQ ID NO: 6918874 - DNA, 22 bp, Homo sapiens
catgttgaatggccttgatttt

SEQ ID NO: 6918875 - DNA, 22 bp, Homo sapiens
cagagtggagaaacgcttcgtc

SEQ ID NO: 6918876 - DNA, 22 bp, Homo sapiens
acatttcttttcatctctatat

SEQ ID NO: 6918877 - DNA, 22 bp, Homo sapiens
taagacatttgacaaaccattt

SEQ ID NO: 6918878 - DNA, 22 bp, Homo sapiens
ggaggctctgctccgtgtgttc

SEQ ID NO: 6918879 - DNA, 22 bp, Homo sapiens
ctttggaagtgaccacaatcct

SEQ ID NO: 6918880 - DNA, 22 bp, Homo sapiens
ttgagaaacctggcagtagaga

SEQ ID NO: 6918881 - DNA, 22 bp, Homo sapiens
agcaaagccgagacagccagtg

SEQ ID NO: 6918882 - DNA, 22 bp, Homo sapiens
cagtagccaactccaggaacta

SEQ ID NO: 6918883 - DNA, 22 bp, Homo sapiens
atctgtaattttgaatgcaaat

SEQ ID NO: 6918884 - DNA, 16 bp, Homo sapiens
agctctgagtagagtt

SEQ ID NO: 6918885 - DNA, 22 bp, Homo sapiens
tgctgacctaaattgaggaaga

SEQ ID NO: 6918886 - DNA, 22 bp, Homo sapiens
tatggcttgtctttataccagg

SEQ ID NO: 6918887 - DNA, 22 bp, Homo sapiens
tagcacccatggaatctgctgg

SEQ ID NO: 6918888 - DNA, 22 bp, Homo sapiens
aaaggcatgcctccatttctat

SEQ ID NO: 6918889 - DNA, 22 bp, Homo sapiens
taccagttgatgttttaaatag

SEQ ID NO: 6918890 - DNA, 22 bp, Homo sapiens
tggctctgagacacaggctctc

SEQ ID NO: 6918891 - DNA, 19 bp, Homo sapiens
tttcttttcccctcagcac

SEQ ID NO: 6918892 - DNA, 22 bp, Homo sapiens
agacgcttttcccatagctggt

SEQ ID NO: 6918893 - DNA, 22 bp, Homo sapiens
cattttgtgctagacactatgg

SEQ ID NO: 6918894 - DNA, 22 bp, Homo sapiens
tttctcagtcacatgaaccaat

SEQ ID NO: 6918895 - DNA, 22 bp, Homo sapiens
gctgctgtctggtctgagggct

SEQ ID NO: 6918896 - DNA, 22 bp, Homo sapiens
gaagagaaaggcaaggagtttt

SEQ ID NO: 6918897 - DNA, 23 bp, Homo sapiens
cacatcagtttaggtcagatttt

SEQ ID NO: 6918898 - DNA, 23 bp, Homo sapiens
agctccagaacatagcacaggaa

SEQ ID NO: 6918899 - DNA, 22 bp, Homo sapiens
actgccagcctcagtgaaggca

SEQ ID NO: 6918900 - DNA, 23 bp, Homo sapiens
taacacagtcctggtctttggcc

SEQ ID NO: 6918901 - DNA, 22 bp, Homo sapiens
gagaatgccttggaagaagtcc

SEQ ID NO: 6918902 - DNA, 22 bp, Homo sapiens
acaatatttgggggcagtttgt

SEQ ID NO: 6918903 - DNA, 22 bp, Homo sapiens
ctgtttattgagcaatctgcca

SEQ ID NO: 6918904 - DNA, 20 bp, Homo sapiens
tcatttcttggggttccaag

SEQ ID NO: 6918905 - DNA, 22 bp, Homo sapiens
attggtccatttaccctctctt

SEQ ID NO: 6918906 - DNA, 22 bp, Homo sapiens
atctggctggattcttagcgtt

SEQ ID NO: 6918907 - DNA, 22 bp, Homo sapiens
cgcaattaattcgggccacagt

SEQ ID NO: 6918908 - DNA, 21 bp, Homo sapiens
tgcagataattgaaagctgac

SEQ ID NO: 6918909 - DNA, 22 bp, Homo sapiens
ttgagcaagtgtacgagcaggc

SEQ ID NO: 6918910 - DNA, 22 bp, Homo sapiens
tggtgccaagcatgaggactct

SEQ ID NO: 6918911 - DNA, 17 bp, Homo sapiens
tactagaatagagacag

SEQ ID NO: 6918912 - DNA, 22 bp, Homo sapiens
cctgagacatgaaccaggctcc

SEQ ID NO: 6918913 - DNA, 19 bp, Homo sapiens
tcctggcatcttcctccct

SEQ ID NO: 6918914 - DNA, 22 bp, Homo sapiens
gcagtatatccattacttcata

SEQ ID NO: 6918915 - DNA, 22 bp, Homo sapiens
aagaggcagtggtgatgaatgg

SEQ ID NO: 6918916 - DNA, 22 bp, Homo sapiens
attaagtgtgacatgctgctct

SEQ ID NO: 6918917 - DNA, 22 bp, Homo sapiens
tggaataaggaatctttcagaa

SEQ ID NO: 6918918 - DNA, 20 bp, Homo sapiens
tgctctgggggtggagagac

SEQ ID NO: 6918919 - DNA, 22 bp, Homo sapiens
attgttcactgtgaatcttgat

SEQ ID NO: 6918920 - DNA, 22 bp, Homo sapiens
ctgaactctttatgacagcttg

SEQ ID NO: 6918921 - DNA, 22 bp, Homo sapiens
ccacccagccagatgcaggaag

SEQ ID NO: 6918922 - DNA, 22 bp, Homo sapiens
actcttcacacttgtctccagg

SEQ ID NO: 6918923 - DNA, 22 bp, Homo sapiens
acccttctgtgacctgcctgtc

SEQ ID NO: 6918924 - DNA, 20 bp, Homo sapiens
tctgcactcctgcatgtgcc

SEQ ID NO: 6918925 - DNA, 22 bp, Homo sapiens
accagtttgtaacctgttttca

SEQ ID NO: 6918926 - DNA, 22 bp, Homo sapiens
cacattgaacttgtctggtggg

SEQ ID NO: 6918927 - DNA, 22 bp, Homo sapiens
tttgggaacaatgaggatctga

SEQ ID NO: 6918928 - DNA, 22 bp, Homo sapiens
agcaaggcctacagagaggggc

SEQ ID NO: 6918929 - DNA, 22 bp, Homo sapiens
agaattagctgggcagattcct

SEQ ID NO: 6918930 - DNA, 22 bp, Homo sapiens
tccatgagaggtaactttacaa

SEQ ID NO: 6918931 - DNA, 22 bp, Homo sapiens
aaagctttgctggaaggaagag

SEQ ID NO: 6918932 - DNA, 22 bp, Homo sapiens
acgcctgtaatcccagcacttt

SEQ ID NO: 6918933 - DNA, 22 bp, Homo sapiens
acatgcagaattcttagagagc

SEQ ID NO: 6918934 - DNA, 22 bp, Homo sapiens
tgtggacaccactgggaggtct

SEQ ID NO: 6918935 - DNA, 22 bp, Homo sapiens
cccatggcaataaggtcacagg

SEQ ID NO: 6918936 - DNA, 22 bp, Homo sapiens
tgtttggaaacactggcagaaa

SEQ ID NO: 6918937 - DNA, 22 bp, Homo sapiens
tatgtgatataggctatttgat

SEQ ID NO: 6918938 - DNA, 22 bp, Homo sapiens
ggagagggtgtggaaagttatc

SEQ ID NO: 6918939 - DNA, 22 bp, Homo sapiens
atgacagtgggtcttgcaaaga

SEQ ID NO: 6918940 - DNA, 22 bp, Homo sapiens
tagagggcaggagtgtcctact

SEQ ID NO: 6918941 - DNA, 22 bp, Homo sapiens
acagatttgactggtacctggc

SEQ ID NO: 6918942 - DNA, 22 bp, Homo sapiens
tgagataatacttcttagctgg

SEQ ID NO: 6918943 - DNA, 22 bp, Homo sapiens
tgtgggacctcagagggtcccc

SEQ ID NO: 6918944 - DNA, 22 bp, Homo sapiens
aatcagaatcagttgacacagc

SEQ ID NO: 6918945 - DNA, 22 bp, Homo sapiens
taggaagcacttaaagaatttg

SEQ ID NO: 6918946 - DNA, 22 bp, Homo sapiens
gctctagatcataggtcattat

SEQ ID NO: 6918947 - DNA, 22 bp, Homo sapiens
tctgaattttgatgtgcattga

SEQ ID NO: 6918948 - DNA, 21 bp, Homo sapiens
aagtgctaatggttgcaacag

SEQ ID NO: 6918949 - DNA, 22 bp, Homo sapiens
gtggaaaactgagaaaattgct

SEQ ID NO: 6918950 - DNA, 22 bp, Homo sapiens
taggaatgtaatctctgttatg

SEQ ID NO: 6918951 - DNA, 22 bp, Homo sapiens
aataggctgagaggaagattta

SEQ ID NO: 6918952 - DNA, 22 bp, Homo sapiens
cctggctctgccacttactgcc

SEQ ID NO: 6918953 - DNA, 23 bp, Homo sapiens
tctggctctatgtgacagctctc

SEQ ID NO: 6918954 - DNA, 22 bp, Homo sapiens
taagtcacttaagtttgcatgt

SEQ ID NO: 6918955 - DNA, 22 bp, Homo sapiens
tggagctggaatttctgggcct

SEQ ID NO: 6918956 - DNA, 22 bp, Homo sapiens
atgccaattgcaggaagaaaac

SEQ ID NO: 6918957 - DNA, 22 bp, Homo sapiens
gtgctgttctggctgccaccac

SEQ ID NO: 6918958 - DNA, 22 bp, Homo sapiens
ctgtctgtagacatttttggtt

SEQ ID NO: 6918959 - DNA, 19 bp, Homo sapiens
ggctgcacttgaggaagtg

SEQ ID NO: 6918960 - DNA, 19 bp, Homo sapiens
agggaggtagcattggaaa

SEQ ID NO: 6918961 - DNA, 22 bp, Homo sapiens
tcttttaacctaactagcttgg

SEQ ID NO: 6918962 - DNA, 18 bp, Homo sapiens
tttgctttccttcttcag

SEQ ID NO: 6918963 - DNA, 22 bp, Homo sapiens
gcaaattcttaactggactgtg

SEQ ID NO: 6918964 - DNA, 22 bp, Homo sapiens
tcttggagtattgggcctcagg

SEQ ID NO: 6918965 - DNA, 22 bp, Homo sapiens
cctcttgaatgccaggaaggac

SEQ ID NO: 6918966 - DNA, 22 bp, Homo sapiens
ggtgtgggtcagctttattaat

SEQ ID NO: 6918967 - DNA, 22 bp, Homo sapiens
atttccttcccagatttggttc

SEQ ID NO: 6918968 - DNA, 22 bp, Homo sapiens
ctcctggatcttagccagattc

SEQ ID NO: 6918969 - DNA, 22 bp, Homo sapiens
atgaatgaataccatgcaacta

SEQ ID NO: 6918970 - DNA, 22 bp, Homo sapiens
atggcctggggagcatgggaag

SEQ ID NO: 6918971 - DNA, 22 bp, Homo sapiens
cctcccctcagacagagactgg

SEQ ID NO: 6918972 - DNA, 23 bp, Homo sapiens
agagcaaggaaatgaggtgtgat

SEQ ID NO: 6918973 - DNA, 22 bp, Homo sapiens
gatatagttggaattataaagg

SEQ ID NO: 6918974 - DNA, 22 bp, Homo sapiens
ggtctgtcacttactagctgta

SEQ ID NO: 6918975 - DNA, 22 bp, Homo sapiens
gtgtgtcctcttaactattatg

SEQ ID NO: 6918976 - DNA, 22 bp, Homo sapiens
gacctcgtgaactctgagggta

SEQ ID NO: 6918977 - DNA, 22 bp, Homo sapiens
aggctccagccaatgggtctgt

SEQ ID NO: 6918978 - DNA, 22 bp, Homo sapiens
ttggcagctcttgatggcaccc

SEQ ID NO: 6918979 - DNA, 19 bp, Homo sapiens
agagaggctgtgtgaggga

SEQ ID NO: 6918980 - DNA, 22 bp, Homo sapiens
atgtagcagatatttgtgcaca

SEQ ID NO: 6918981 - DNA, 22 bp, Homo sapiens
tacatggttgctttgttgatga

SEQ ID NO: 6918982 - DNA, 22 bp, Homo sapiens
tccattaaacctggatggagtt

SEQ ID NO: 6918983 - DNA, 22 bp, Homo sapiens
gggttcagtgatgccttcagga

SEQ ID NO: 6918984 - DNA, 22 bp, Homo sapiens
agcacccttcagcccagcctgg

SEQ ID NO: 6918985 - DNA, 22 bp, Homo sapiens
taaagtcatctttacatctttg

SEQ ID NO: 6918986 - DNA, 22 bp, Homo sapiens
agactgtactttctgcagctct

SEQ ID NO: 6918987 - DNA, 22 bp, Homo sapiens
atttccaatttcatccatgtcc

SEQ ID NO: 6918988 - DNA, 22 bp, Homo sapiens
catgtctttgttatgctcacca

SEQ ID NO: 6918989 - DNA, 22 bp, Homo sapiens
tctgtccaagacaccatagtgg

SEQ ID NO: 6918990 - DNA, 22 bp, Homo sapiens
cagagggctcagtcctgctgga

SEQ ID NO: 6918991 - DNA, 22 bp, Homo sapiens
aagttagtgcctccttaaattt

SEQ ID NO: 6918992 - DNA, 22 bp, Homo sapiens
cctgaggacacacgctgcagga

SEQ ID NO: 6918993 - DNA, 23 bp, Homo sapiens
aagtagatagctaaagttttgtt

SEQ ID NO: 6918994 - DNA, 20 bp, Homo sapiens
tctcttttagcttacagctg

SEQ ID NO: 6918995 - DNA, 22 bp, Homo sapiens
gatgcacaaagcagagggaatc

SEQ ID NO: 6918996 - DNA, 22 bp, Homo sapiens
ctgacagcaaaggccagtggct

SEQ ID NO: 6918997 - DNA, 22 bp, Homo sapiens
aggcaagggggcgccaccttcc

SEQ ID NO: 6918998 - DNA, 22 bp, Homo sapiens
tgcatgagcgaatgtgtcctgt

SEQ ID NO: 6918999 - DNA, 22 bp, Homo sapiens
tcagaggaaaggtcagatggct

SEQ ID NO: 6919000 - DNA, 20 bp, Homo sapiens
tcccatgtccatatcagccc

SEQ ID NO: 6919001 - DNA, 22 bp, Homo sapiens
tgtaaactgagggtagctgatt

SEQ ID NO: 6919002 - DNA, 22 bp, Homo sapiens
tgctgtgctctttaaggtgctg

SEQ ID NO: 6919003 - DNA, 22 bp, Homo sapiens
gagtttggcctccccagcagtt

SEQ ID NO: 6919004 - DNA, 22 bp, Homo sapiens
tttcaaagacagccatatttgt

SEQ ID NO: 6919005 - DNA, 21 bp, Homo sapiens
cctgggtgggacccctcttcc

SEQ ID NO: 6919006 - DNA, 22 bp, Homo sapiens
tctgggctgcttcagccttcgc

SEQ ID NO: 6919007 - DNA, 23 bp, Homo sapiens
aaattccttgcagataggtattg

SEQ ID NO: 6919008 - DNA, 19 bp, Homo sapiens
ctctcagcctgtctccttg

SEQ ID NO: 6919009 - DNA, 22 bp, Homo sapiens
gaagggggttgcagtctagggt

SEQ ID NO: 6919010 - DNA, 22 bp, Homo sapiens
aggagctcatgtggctgcctgt

SEQ ID NO: 6919011 - DNA, 22 bp, Homo sapiens
tttattctaacttgctgctcta

SEQ ID NO: 6919012 - DNA, 19 bp, Homo sapiens
atgatacaggtgaaaattg

SEQ ID NO: 6919013 - DNA, 22 bp, Homo sapiens
ctcagagccccaggagggtgtg

SEQ ID NO: 6919014 - DNA, 22 bp, Homo sapiens
atgctattgaaaagaaataaga

SEQ ID NO: 6919015 - DNA, 22 bp, Homo sapiens
tgccttcttgaatatggttctt

SEQ ID NO: 6919016 - DNA, 22 bp, Homo sapiens
acagacgggacaacgtgcagct

SEQ ID NO: 6919017 - DNA, 22 bp, Homo sapiens
atttctcaaccaggtcaaaaag

SEQ ID NO: 6919018 - DNA, 17 bp, Homo sapiens
ccaggtggaatcgtgga

SEQ ID NO: 6919019 - DNA, 22 bp, Homo sapiens
ggcacaagtttgatgtgagtta

SEQ ID NO: 6919020 - DNA, 22 bp, Homo sapiens
ttttagattataagtctaattc

SEQ ID NO: 6919021 - DNA, 22 bp, Homo sapiens
ccattcatagcaagctacatct

SEQ ID NO: 6919022 - DNA, 22 bp, Homo sapiens
gccagctaactcatctaaagaa

SEQ ID NO: 6919023 - DNA, 22 bp, Homo sapiens
gcccagaagttgaggctgcagt

SEQ ID NO: 6919024 - DNA, 22 bp, Homo sapiens
agcagcattcctggcttctatc

SEQ ID NO: 6919025 - DNA, 22 bp, Homo sapiens
ttgctaaaaatggaattatagg

SEQ ID NO: 6919026 - DNA, 22 bp, Homo sapiens
gagcccaggttctgcttccagc

SEQ ID NO: 6919027 - DNA, 22 bp, Homo sapiens
ggtggtctgtttattgaaggtt

SEQ ID NO: 6919028 - DNA, 22 bp, Homo sapiens
tgtgagatacctgttcaaatta

SEQ ID NO: 6919029 - DNA, 22 bp, Homo sapiens
agtgaacaaaggtagtgagcat

SEQ ID NO: 6919030 - DNA, 22 bp, Homo sapiens
acatgactgctcctgctctaac

SEQ ID NO: 6919031 - DNA, 22 bp, Homo sapiens
agtctcaagtgttagtattatt

SEQ ID NO: 6919032 - DNA, 22 bp, Homo sapiens
cctgaggggaagcttcccaaga

SEQ ID NO: 6919033 - DNA, 21 bp, Homo sapiens
gatccactgacctggggatcc

SEQ ID NO: 6919034 - DNA, 21 bp, Homo sapiens
agtttcctcaactgcagaagg

SEQ ID NO: 6919035 - DNA, 22 bp, Homo sapiens
ctgaggcaggagagttgcttga

SEQ ID NO: 6919036 - DNA, 22 bp, Homo sapiens
acatgccatgaaggtatttttg

SEQ ID NO: 6919037 - DNA, 22 bp, Homo sapiens
gatttagtgctgaaatccctgg

SEQ ID NO: 6919038 - DNA, 22 bp, Homo sapiens
agtctacaatcttaaatgaact

SEQ ID NO: 6919039 - DNA, 22 bp, Homo sapiens
atgtcctttgtatgcttgtact

SEQ ID NO: 6919040 - DNA, 22 bp, Homo sapiens
tacatttgattctctcctccaa

SEQ ID NO: 6919041 - DNA, 22 bp, Homo sapiens
tccctttcacttaactagccca

SEQ ID NO: 6919042 - DNA, 22 bp, Homo sapiens
caatagtgtctgcttgtttcta

SEQ ID NO: 6919043 - DNA, 22 bp, Homo sapiens
caataactgctaaattccctgt

SEQ ID NO: 6919044 - DNA, 22 bp, Homo sapiens
tgcagcaaatggggcccgtcct

SEQ ID NO: 6919045 - DNA, 22 bp, Homo sapiens
ccagccagtcccgcatgaccgc

SEQ ID NO: 6919046 - DNA, 22 bp, Homo sapiens
tctcacagggctaggccctgcc

SEQ ID NO: 6919047 - DNA, 22 bp, Homo sapiens
taactccatctctgtgtctgct

SEQ ID NO: 6919048 - DNA, 20 bp, Homo sapiens
agaagcatcattctgatgtc

SEQ ID NO: 6919049 - DNA, 22 bp, Homo sapiens
tcagtgcttgcctctggaggag

SEQ ID NO: 6919050 - DNA, 22 bp, Homo sapiens
tttgtactgaagattgtaaact

SEQ ID NO: 6919051 - DNA, 22 bp, Homo sapiens
agggtcaacactttaaacatat

SEQ ID NO: 6919052 - DNA, 21 bp, Homo sapiens
ttagcaaagcaaacacatgct

SEQ ID NO: 6919053 - DNA, 22 bp, Homo sapiens
tattacagctttgattatctgg

SEQ ID NO: 6919054 - DNA, 22 bp, Homo sapiens
ttaagaggtggtcgtgtctgtg

SEQ ID NO: 6919055 - DNA, 22 bp, Homo sapiens
agggagcattgtgacatatcac

SEQ ID NO: 6919056 - DNA, 22 bp, Homo sapiens
ttcacattggtgatatgtttct

SEQ ID NO: 6919057 - DNA, 22 bp, Homo sapiens
acttcttcttcagctgggggat

SEQ ID NO: 6919058 - DNA, 23 bp, Homo sapiens
catgcaaacactattgcatttgg

SEQ ID NO: 6919059 - DNA, 22 bp, Homo sapiens
agctttctcttctttagaaagt

SEQ ID NO: 6919060 - DNA, 22 bp, Homo sapiens
agctgctctacatgatggggaa

SEQ ID NO: 6919061 - DNA, 21 bp, Homo sapiens
tttctagaatgactggttctt

SEQ ID NO: 6919062 - DNA, 22 bp, Homo sapiens
gcttggccagcagccgggatgc

SEQ ID NO: 6919063 - DNA, 22 bp, Homo sapiens
gatcctgtcccaagagtgacag

SEQ ID NO: 6919064 - DNA, 22 bp, Homo sapiens
aggagcctgaatcagagggtga

SEQ ID NO: 6919065 - DNA, 22 bp, Homo sapiens
ctgatggatggacaggggtagt

SEQ ID NO: 6919066 - DNA, 22 bp, Homo sapiens
tcaggctgtgtctttaaacaat

SEQ ID NO: 6919067 - DNA, 22 bp, Homo sapiens
aggctggtctatacggagacga

SEQ ID NO: 6919068 - DNA, 22 bp, Homo sapiens
gtgctgggattacaggtgtgag

SEQ ID NO: 6919069 - DNA, 22 bp, Homo sapiens
actggcctatcagcatgagtct

SEQ ID NO: 6919070 - DNA, 22 bp, Homo sapiens
acagtgacgtttatttgagacg

SEQ ID NO: 6919071 - DNA, 22 bp, Homo sapiens
gagagctgggaaagccgtggag

SEQ ID NO: 6919072 - DNA, 22 bp, Homo sapiens
atcattggaggcactgtgcagt

SEQ ID NO: 6919073 - DNA, 22 bp, Homo sapiens
tttcatcatgttggcagattgg

SEQ ID NO: 6919074 - DNA, 22 bp, Homo sapiens
ggagaaggaagaaagctactat

SEQ ID NO: 6919075 - DNA, 22 bp, Homo sapiens
aggctgtctcacctcaggaggg

SEQ ID NO: 6919076 - DNA, 22 bp, Homo sapiens
ccagctcctgggtcttagtcag

SEQ ID NO: 6919077 - DNA, 22 bp, Homo sapiens
tctttctctctaatcaagcaca

SEQ ID NO: 6919078 - DNA, 22 bp, Homo sapiens
gtacacataggttactgattaa

SEQ ID NO: 6919079 - DNA, 22 bp, Homo sapiens
tcagctttctcaaagaagctgg

SEQ ID NO: 6919080 - DNA, 22 bp, Homo sapiens
cagagacagcctgggagggaca

SEQ ID NO: 6919081 - DNA, 22 bp, Homo sapiens
gtatatatgtgtgaacatgtat

SEQ ID NO: 6919082 - DNA, 22 bp, Homo sapiens
atattcacagatagaaggttct

SEQ ID NO: 6919083 - DNA, 22 bp, Homo sapiens
gctgtttaagtggaatttgttt

SEQ ID NO: 6919084 - DNA, 22 bp, Homo sapiens
caagagtgaaactctgtctcaa

SEQ ID NO: 6919085 - DNA, 22 bp, Homo sapiens
acctttatgaaacagctgtcgt

SEQ ID NO: 6919086 - DNA, 20 bp, Homo sapiens
tagcaggtagctgcacgttt

SEQ ID NO: 6919087 - DNA, 22 bp, Homo sapiens
cacacatgaatccctagtacct

SEQ ID NO: 6919088 - DNA, 22 bp, Homo sapiens
tgggaaaccatgtgtgtcactt

SEQ ID NO: 6919089 - DNA, 22 bp, Homo sapiens
agaatctgcattttaacaagcc

SEQ ID NO: 6919090 - DNA, 22 bp, Homo sapiens
atttgcctgtaagacaaggcct

SEQ ID NO: 6919091 - DNA, 22 bp, Homo sapiens
ataataatactgtgcaatggat

SEQ ID NO: 6919092 - DNA, 22 bp, Homo sapiens
taggggttacctttagcatctc

SEQ ID NO: 6919093 - DNA, 23 bp, Homo sapiens
ggaagctcacgtagtcctgcact

SEQ ID NO: 6919094 - DNA, 22 bp, Homo sapiens
gaagcacatggctatagctatt

SEQ ID NO: 6919095 - DNA, 19 bp, Homo sapiens
taagacacaaatgcaagcc

SEQ ID NO: 6919096 - DNA, 22 bp, Homo sapiens
ccaggcctcccttttccagcca

SEQ ID NO: 6919097 - DNA, 22 bp, Homo sapiens
tgcttgggaatgtggagtcaga

SEQ ID NO: 6919098 - DNA, 23 bp, Homo sapiens
aagccttgtggaggctctcattt

SEQ ID NO: 6919099 - DNA, 22 bp, Homo sapiens
cataagaaggtaacatccttaa

SEQ ID NO: 6919100 - DNA, 19 bp, Homo sapiens
tttagcttacgtttcattg

SEQ ID NO: 6919101 - DNA, 19 bp, Homo sapiens
tagaagcagggaagctgag

SEQ ID NO: 6919102 - DNA, 22 bp, Homo sapiens
accactggcctggtggggacca

SEQ ID NO: 6919103 - DNA, 22 bp, Homo sapiens
caccagccccctcacgctgtca

SEQ ID NO: 6919104 - DNA, 22 bp, Homo sapiens
tctggaagaacggggcatgctg

SEQ ID NO: 6919105 - DNA, 22 bp, Homo sapiens
gatgaggcaagccagaggactg

SEQ ID NO: 6919106 - DNA, 23 bp, Homo sapiens
aggtacacattatagaaatagac

SEQ ID NO: 6919107 - DNA, 22 bp, Homo sapiens
taacacttgggggcatccttag

SEQ ID NO: 6919108 - DNA, 22 bp, Homo sapiens
gtgccagcctggtgcgcctggg

SEQ ID NO: 6919109 - DNA, 22 bp, Homo sapiens
gttcagttttggggctgttaca

SEQ ID NO: 6919110 - DNA, 22 bp, Homo sapiens
ctcagtttccccggcctgggcg

SEQ ID NO: 6919111 - DNA, 22 bp, Homo sapiens
aagcagcattgtaaccaatgcc

SEQ ID NO: 6919112 - DNA, 22 bp, Homo sapiens
ctggactaggcgctggcgggcg

SEQ ID NO: 6919113 - DNA, 22 bp, Homo sapiens
tctcttcacattcctggcaaac

SEQ ID NO: 6919114 - DNA, 22 bp, Homo sapiens
agctacctgatccttcttctga

SEQ ID NO: 6919115 - DNA, 22 bp, Homo sapiens
cttagcagtgggtaccagggct

SEQ ID NO: 6919116 - DNA, 22 bp, Homo sapiens
aggcacttgattaatgtgaatt

SEQ ID NO: 6919117 - DNA, 22 bp, Homo sapiens
ttattattgtgacctgagaatg

SEQ ID NO: 6919118 - DNA, 22 bp, Homo sapiens
actgatgtctggggcagagtct

SEQ ID NO: 6919119 - DNA, 22 bp, Homo sapiens
acagaactgtgtgatgattaag

SEQ ID NO: 6919120 - DNA, 22 bp, Homo sapiens
aaagatttaagaataatttgtg

SEQ ID NO: 6919121 - DNA, 22 bp, Homo sapiens
gcgtgtatgcaggtctgtgcag

SEQ ID NO: 6919122 - DNA, 22 bp, Homo sapiens
atcttgatcaaggctatcatga

SEQ ID NO: 6919123 - DNA, 22 bp, Homo sapiens
tttgaatagaggcccctcagaa

SEQ ID NO: 6919124 - DNA, 22 bp, Homo sapiens
agtcccagagaggtcggggcca

SEQ ID NO: 6919125 - DNA, 19 bp, Homo sapiens
taacaaagtctgaagtcag

SEQ ID NO: 6919126 - DNA, 22 bp, Homo sapiens
agcgcgctctaggacaccgcgg

SEQ ID NO: 6919127 - DNA, 22 bp, Homo sapiens
gctgcctcctgaaagcgctctg

SEQ ID NO: 6919128 - DNA, 22 bp, Homo sapiens
ctcaagtcagaaataaaagcat

SEQ ID NO: 6919129 - DNA, 22 bp, Homo sapiens
agaaaccatctttatatatctg

SEQ ID NO: 6919130 - DNA, 22 bp, Homo sapiens
gtggccttgggcactgaccttg

SEQ ID NO: 6919131 - DNA, 22 bp, Homo sapiens
ttgcacagatgagcttatttaa

SEQ ID NO: 6919132 - DNA, 22 bp, Homo sapiens
aggcctgagccccaggtttgtt

SEQ ID NO: 6919133 - DNA, 22 bp, Homo sapiens
gttcagagacacttattggaaa

SEQ ID NO: 6919134 - DNA, 19 bp, Homo sapiens
gcaggtagagacagcagcc

SEQ ID NO: 6919135 - DNA, 20 bp, Homo sapiens
gtgtggccaggagctgcgct

SEQ ID NO: 6919136 - DNA, 20 bp, Homo sapiens
cttgcccagggtctcctgcc

SEQ ID NO: 6919137 - DNA, 22 bp, Homo sapiens
acattgtttgagaatacagatg

SEQ ID NO: 6919138 - DNA, 22 bp, Homo sapiens
tatgtatctgttcatcagttaa

SEQ ID NO: 6919139 - DNA, 22 bp, Homo sapiens
gggggcgccgccgctcatctca

SEQ ID NO: 6919140 - DNA, 22 bp, Homo sapiens
cctcaggctgtcttccttctgg

SEQ ID NO: 6919141 - DNA, 22 bp, Homo sapiens
gatgggtgccccagacaagctg

SEQ ID NO: 6919142 - DNA, 22 bp, Homo sapiens
ctttggctaacaaatcagcttg

SEQ ID NO: 6919143 - DNA, 22 bp, Homo sapiens
caggacactacagatgggaggg

SEQ ID NO: 6919144 - DNA, 22 bp, Homo sapiens
atcagaagcaggaggaatgaag

SEQ ID NO: 6919145 - DNA, 22 bp, Homo sapiens
ttgacttcagcctgtacttgta

SEQ ID NO: 6919146 - DNA, 22 bp, Homo sapiens
ctcttagtaatgccatgaagca

SEQ ID NO: 6919147 - DNA, 22 bp, Homo sapiens
tgtatgcataaaattatttaca

SEQ ID NO: 6919148 - DNA, 22 bp, Homo sapiens
ctaaacaagggattataattga

SEQ ID NO: 6919149 - DNA, 22 bp, Homo sapiens
cttgatcctaggatggaaggga

SEQ ID NO: 6919150 - DNA, 21 bp, Homo sapiens
tgctgtaggtttcgtggcact

SEQ ID NO: 6919151 - DNA, 19 bp, Homo sapiens
tcagttctgctcgctgtgc

SEQ ID NO: 6919152 - DNA, 22 bp, Homo sapiens
ggagtgtggagaggacatgggt

SEQ ID NO: 6919153 - DNA, 22 bp, Homo sapiens
cttcatgttcttggtgaaaggc

SEQ ID NO: 6919154 - DNA, 22 bp, Homo sapiens
cagctgggtggctcttctgctc

SEQ ID NO: 6919155 - DNA, 22 bp, Homo sapiens
tatggctttcaaaggaactcgg

SEQ ID NO: 6919156 - DNA, 22 bp, Homo sapiens
ctgtgcctccaagtggtctctg

SEQ ID NO: 6919157 - DNA, 22 bp, Homo sapiens
gtaaatgtgactccacctgagt

SEQ ID NO: 6919158 - DNA, 22 bp, Homo sapiens
cagctgacagtgaggtgggggc

SEQ ID NO: 6919159 - DNA, 23 bp, Homo sapiens
atgcatcatgaaaactagagagc

SEQ ID NO: 6919160 - DNA, 22 bp, Homo sapiens
tgttgcacggccttcacagagc

SEQ ID NO: 6919161 - DNA, 22 bp, Homo sapiens
catctgttaaagtctaatgaaa

SEQ ID NO: 6919162 - DNA, 22 bp, Homo sapiens
tatgccactgctctccatccta

SEQ ID NO: 6919163 - DNA, 22 bp, Homo sapiens
ccacttaagagaacagctatag

SEQ ID NO: 6919164 - DNA, 22 bp, Homo sapiens
ctctttctgattcgctgggacc

SEQ ID NO: 6919165 - DNA, 22 bp, Homo sapiens
taagaacattttcggaaagata

SEQ ID NO: 6919166 - DNA, 22 bp, Homo sapiens
tggcccctgaggagcatcagcc

SEQ ID NO: 6919167 - DNA, 22 bp, Homo sapiens
tcctgggcaaagaggggcagtg

SEQ ID NO: 6919168 - DNA, 22 bp, Homo sapiens
atggcccaaactgcaattactt

SEQ ID NO: 6919169 - DNA, 19 bp, Homo sapiens
aagattgccttgttccatt

SEQ ID NO: 6919170 - DNA, 22 bp, Homo sapiens
actataacccatggaatataag

SEQ ID NO: 6919171 - DNA, 22 bp, Homo sapiens
agggtggggtgctacatcttta

SEQ ID NO: 6919172 - DNA, 22 bp, Homo sapiens
cattcactcagcgatgccagta

SEQ ID NO: 6919173 - DNA, 22 bp, Homo sapiens
cacacatgagtctccccattgg

SEQ ID NO: 6919174 - DNA, 22 bp, Homo sapiens
gggagctggggcatttataccc

SEQ ID NO: 6919175 - DNA, 22 bp, Homo sapiens
acagaatactacagactggtta

SEQ ID NO: 6919176 - DNA, 22 bp, Homo sapiens
caaatctaggatgcatgtagtg

SEQ ID NO: 6919177 - DNA, 22 bp, Homo sapiens
taaagtgctggatttgagtaaa

SEQ ID NO: 6919178 - DNA, 22 bp, Homo sapiens
ggcccatctcttgctctgggtt

SEQ ID NO: 6919179 - DNA, 22 bp, Homo sapiens
gcctggcacattgcagtggatt

SEQ ID NO: 6919180 - DNA, 22 bp, Homo sapiens
tgcattaaggccattgaaattt

SEQ ID NO: 6919181 - DNA, 22 bp, Homo sapiens
cagattccagtttgtggctccc

SEQ ID NO: 6919182 - DNA, 22 bp, Homo sapiens
ggaagacagaagcctacagctt

SEQ ID NO: 6919183 - DNA, 22 bp, Homo sapiens
atccgtttttatgaaatgtcca

SEQ ID NO: 6919184 - DNA, 22 bp, Homo sapiens
gtttcaagcagatggcctgagg

SEQ ID NO: 6919185 - DNA, 21 bp, Homo sapiens
tgttgttttatggctatgaat

SEQ ID NO: 6919186 - DNA, 22 bp, Homo sapiens
cattagaacctataaaaagcat

SEQ ID NO: 6919187 - DNA, 22 bp, Homo sapiens
taggtggttatgtcagcctaga

SEQ ID NO: 6919188 - DNA, 22 bp, Homo sapiens
tttctccctccactacaggctc

SEQ ID NO: 6919189 - DNA, 22 bp, Homo sapiens
tacattgactgtgtgcatcaca

SEQ ID NO: 6919190 - DNA, 19 bp, Homo sapiens
tacaagcttaaagtaatgt

SEQ ID NO: 6919191 - DNA, 22 bp, Homo sapiens
taatgtttagaagcagacagct

SEQ ID NO: 6919192 - DNA, 22 bp, Homo sapiens
tcaggaggccaccaggacctgt

SEQ ID NO: 6919193 - DNA, 22 bp, Homo sapiens
ttcagaactgtctgtccttttc

SEQ ID NO: 6919194 - DNA, 20 bp, Homo sapiens
tctctggcaagaagctgcag

SEQ ID NO: 6919195 - DNA, 22 bp, Homo sapiens
agctgccctgggtcttgctgct

SEQ ID NO: 6919196 - DNA, 22 bp, Homo sapiens
acacactttaaattaaacctct

SEQ ID NO: 6919197 - DNA, 22 bp, Homo sapiens
ctgaggctgaagagggcctacg

SEQ ID NO: 6919198 - DNA, 22 bp, Homo sapiens
caacatggtgaaaccccgtctc

SEQ ID NO: 6919199 - DNA, 22 bp, Homo sapiens
atacttgttcctgttgctatag

SEQ ID NO: 6919200 - DNA, 22 bp, Homo sapiens
ggtctattgagcagcctctgaa

SEQ ID NO: 6919201 - DNA, 19 bp, Homo sapiens
gccatgggctggcagcaga

SEQ ID NO: 6919202 - DNA, 22 bp, Homo sapiens
catctgggactgtcaggttagc

SEQ ID NO: 6919203 - DNA, 22 bp, Homo sapiens
gccctctgctcagctcctcagc

SEQ ID NO: 6919204 - DNA, 22 bp, Homo sapiens
cctcagacttgataattgggtt

SEQ ID NO: 6919205 - DNA, 22 bp, Homo sapiens
tgggcctccaattccagcggga

SEQ ID NO: 6919206 - DNA, 18 bp, Homo sapiens
catgtctgcgccacaagg

SEQ ID NO: 6919207 - DNA, 22 bp, Homo sapiens
tgcaaatgtgttttaaaccaaa

SEQ ID NO: 6919208 - DNA, 22 bp, Homo sapiens
tggtctgctgaacagccgtatc

SEQ ID NO: 6919209 - DNA, 22 bp, Homo sapiens
agatgcttcagtgtttaattta

SEQ ID NO: 6919210 - DNA, 19 bp, Homo sapiens
gatgctcattcaggtggaa

SEQ ID NO: 6919211 - DNA, 19 bp, Homo sapiens
gtaagggctaatggactat

SEQ ID NO: 6919212 - DNA, 22 bp, Homo sapiens
cattcacagagggggaagcatc

SEQ ID NO: 6919213 - DNA, 22 bp, Homo sapiens
catctgtttcctaatctgtagc

SEQ ID NO: 6919214 - DNA, 22 bp, Homo sapiens
ttggcccagactcggggactga

SEQ ID NO: 6919215 - DNA, 22 bp, Homo sapiens
agttaagtaaacatttcccaga

SEQ ID NO: 6919216 - DNA, 22 bp, Homo sapiens
ccgtatgtctgggtttcttaat

SEQ ID NO: 6919217 - DNA, 22 bp, Homo sapiens
gcttctggtagaattcaataga

SEQ ID NO: 6919218 - DNA, 22 bp, Homo sapiens
aagagggctgcaatcttattgc

SEQ ID NO: 6919219 - DNA, 22 bp, Homo sapiens
ttactagttgcttcactttgct

SEQ ID NO: 6919220 - DNA, 22 bp, Homo sapiens
tagctctctctatatgagtgac

SEQ ID NO: 6919221 - DNA, 22 bp, Homo sapiens
aggctctaaggagggctgtcta

SEQ ID NO: 6919222 - DNA, 22 bp, Homo sapiens
atattaagatgctattggtttt

SEQ ID NO: 6919223 - DNA, 23 bp, Homo sapiens
ctgcagtcgccggcctgggtgcc

SEQ ID NO: 6919224 - DNA, 22 bp, Homo sapiens
agatacaaaaagggagaagatt

SEQ ID NO: 6919225 - DNA, 22 bp, Homo sapiens
atgaaggcagttaaacgtcatc

SEQ ID NO: 6919226 - DNA, 23 bp, Homo sapiens
actcacaaagcaggatcatgttg

SEQ ID NO: 6919227 - DNA, 22 bp, Homo sapiens
ttctgtggaggtttggaacatt

SEQ ID NO: 6919228 - DNA, 22 bp, Homo sapiens
aattccagctgattgactttcc

SEQ ID NO: 6919229 - DNA, 22 bp, Homo sapiens
aaggccaaggctgcagtgagcc

SEQ ID NO: 6919230 - DNA, 22 bp, Homo sapiens
ttggtttagagagtgtggttac

SEQ ID NO: 6919231 - DNA, 22 bp, Homo sapiens
tcagcatcaggttgtctgaatt

SEQ ID NO: 6919232 - DNA, 22 bp, Homo sapiens
tgtcataatgctgctagaaatt

SEQ ID NO: 6919233 - DNA, 22 bp, Homo sapiens
cggctgtgtcttcacaggagcc

SEQ ID NO: 6919234 - DNA, 22 bp, Homo sapiens
ctccagaggtccccgcggcact

SEQ ID NO: 6919235 - DNA, 22 bp, Homo sapiens
ttcacagagagaactcaaacca

SEQ ID NO: 6919236 - DNA, 22 bp, Homo sapiens
agaaatgcagtcattgtatagt

SEQ ID NO: 6919237 - DNA, 22 bp, Homo sapiens
aacatgtaaatatcattgtact

SEQ ID NO: 6919238 - DNA, 21 bp, Homo sapiens
aagaaagataattaaggaccc

SEQ ID NO: 6919239 - DNA, 22 bp, Homo sapiens
catcacagtttgtcagaaatca

SEQ ID NO: 6919240 - DNA, 22 bp, Homo sapiens
ctatttgaaaccaagaatgccg

SEQ ID NO: 6919241 - DNA, 22 bp, Homo sapiens
cttcagtgacattccttccctc

SEQ ID NO: 6919242 - DNA, 22 bp, Homo sapiens
aagactttcaaacctatgtttg

SEQ ID NO: 6919243 - DNA, 22 bp, Homo sapiens
cttgcaggcagggcctcctgga

SEQ ID NO: 6919244 - DNA, 21 bp, Homo sapiens
acagcaagccttcctttcagg

SEQ ID NO: 6919245 - DNA, 22 bp, Homo sapiens
aggaccattatgcttgctgaaa

SEQ ID NO: 6919246 - DNA, 21 bp, Homo sapiens
agtggctctcagcttgctaag

SEQ ID NO: 6919247 - DNA, 22 bp, Homo sapiens
agttggtgagcgtgtggtaatc

SEQ ID NO: 6919248 - DNA, 22 bp, Homo sapiens
atagcaaactggagcttgcttt

SEQ ID NO: 6919249 - DNA, 22 bp, Homo sapiens
gcagtgttgctaggtgcggtga

SEQ ID NO: 6919250 - DNA, 22 bp, Homo sapiens
cagtatagaaagttttaaattg

SEQ ID NO: 6919251 - DNA, 22 bp, Homo sapiens
tcaggctgcccgttcagggctc

SEQ ID NO: 6919252 - DNA, 22 bp, Homo sapiens
cctgaggtcatggtccagtgtt

SEQ ID NO: 6919253 - DNA, 22 bp, Homo sapiens
gtactagatgagacagcgtggg

SEQ ID NO: 6919254 - DNA, 22 bp, Homo sapiens
aagatgcttattgctcctgcag

SEQ ID NO: 6919255 - DNA, 22 bp, Homo sapiens
tcagcattcctgaagacaagca

SEQ ID NO: 6919256 - DNA, 22 bp, Homo sapiens
tctgtggaagattccaggcgtt

SEQ ID NO: 6919257 - DNA, 19 bp, Homo sapiens
agacagctctattattttg

SEQ ID NO: 6919258 - DNA, 22 bp, Homo sapiens
ccagttaatcactgagtcctgt

SEQ ID NO: 6919259 - DNA, 19 bp, Homo sapiens
agctgcaaaaggtggaact

SEQ ID NO: 6919260 - DNA, 21 bp, Homo sapiens
taagacagtatgaatactttc

SEQ ID NO: 6919261 - DNA, 22 bp, Homo sapiens
tgaaatgtgatctgagcttggc

SEQ ID NO: 6919262 - DNA, 23 bp, Homo sapiens
tgccacaagatctgtgaataaga

SEQ ID NO: 6919263 - DNA, 22 bp, Homo sapiens
gccagctggaaatctgcttgaa

SEQ ID NO: 6919264 - DNA, 22 bp, Homo sapiens
tatacacattacagtttcagga

SEQ ID NO: 6919265 - DNA, 22 bp, Homo sapiens
ctgggcacattttgactagtgt

SEQ ID NO: 6919266 - DNA, 22 bp, Homo sapiens
gaggcacctcgcgggaggaggc

SEQ ID NO: 6919267 - DNA, 22 bp, Homo sapiens
atgcaggttgggcaagtgtggg

SEQ ID NO: 6919268 - DNA, 22 bp, Homo sapiens
tccagctcttgttgcccactgc

SEQ ID NO: 6919269 - DNA, 22 bp, Homo sapiens
tgtttccctaaggtctggctct

SEQ ID NO: 6919270 - DNA, 22 bp, Homo sapiens
gggcgtggatggtcagtgcagg

SEQ ID NO: 6919271 - DNA, 17 bp, Homo sapiens
ggaaggtcaaggggagg

SEQ ID NO: 6919272 - DNA, 22 bp, Homo sapiens
tttagggaatagaagatctgaa

SEQ ID NO: 6919273 - DNA, 22 bp, Homo sapiens
aatcaaaacctacagaggtaat

SEQ ID NO: 6919274 - DNA, 22 bp, Homo sapiens
gaccaggcttccccagacctca

SEQ ID NO: 6919275 - DNA, 19 bp, Homo sapiens
tggctcctgcctgccttct

SEQ ID NO: 6919276 - DNA, 22 bp, Homo sapiens
tcttcacacacagtcctctttc

SEQ ID NO: 6919277 - DNA, 22 bp, Homo sapiens
ctgtgcaatgcctaatcacaaa

SEQ ID NO: 6919278 - DNA, 22 bp, Homo sapiens
agcttgacagacagatggtagc

SEQ ID NO: 6919279 - DNA, 17 bp, Homo sapiens
gtgttcacaatgactgt

SEQ ID NO: 6919280 - DNA, 22 bp, Homo sapiens
tttccttcttagcggtgttctt

SEQ ID NO: 6919281 - DNA, 20 bp, Homo sapiens
catttagaaattggcatgga

SEQ ID NO: 6919282 - DNA, 22 bp, Homo sapiens
cttgtggcccatggcttcctgc

SEQ ID NO: 6919283 - DNA, 22 bp, Homo sapiens
atgttctatatcattattgtga

SEQ ID NO: 6919284 - DNA, 22 bp, Homo sapiens
cgctggcagggctgatctgaag

SEQ ID NO: 6919285 - DNA, 22 bp, Homo sapiens
ctgtggcagaggtgacacctct

SEQ ID NO: 6919286 - DNA, 22 bp, Homo sapiens
gcgacgcaggcacgacgtgttg

SEQ ID NO: 6919287 - DNA, 22 bp, Homo sapiens
ctcaggtcacggatctgagctg

SEQ ID NO: 6919288 - DNA, 22 bp, Homo sapiens
tcccttgagagttggccaattg

SEQ ID NO: 6919289 - DNA, 22 bp, Homo sapiens
cctggcagcccagagcgccgct

SEQ ID NO: 6919290 - DNA, 22 bp, Homo sapiens
aggctccaagaggttaagtcac

SEQ ID NO: 6919291 - DNA, 22 bp, Homo sapiens
cagaggctgaccctgctgttgt

SEQ ID NO: 6919292 - DNA, 22 bp, Homo sapiens
tctatgaacctctgcaatgaca

SEQ ID NO: 6919293 - DNA, 22 bp, Homo sapiens
aggatgtgccaccagctttgca

SEQ ID NO: 6919294 - DNA, 22 bp, Homo sapiens
ttcaagtagtcacacatgatat

SEQ ID NO: 6919295 - DNA, 22 bp, Homo sapiens
gacagacactgtgtcctcactt

SEQ ID NO: 6919296 - DNA, 22 bp, Homo sapiens
gagttagaccactctgtctggt

SEQ ID NO: 6919297 - DNA, 22 bp, Homo sapiens
tccatataatgggattccttat

SEQ ID NO: 6919298 - DNA, 22 bp, Homo sapiens
ggcagtggctcctctctactcc

SEQ ID NO: 6919299 - DNA, 22 bp, Homo sapiens
attcaaagtctagatgtagtgt

SEQ ID NO: 6919300 - DNA, 22 bp, Homo sapiens
gaagaggactgtggcatcctag

SEQ ID NO: 6919301 - DNA, 22 bp, Homo sapiens
gtttggagccccgtgggaagga

SEQ ID NO: 6919302 - DNA, 23 bp, Homo sapiens
aagccccaaggaacttcctggga

SEQ ID NO: 6919303 - DNA, 22 bp, Homo sapiens
gtgagacatcttgggaagtgat

SEQ ID NO: 6919304 - DNA, 22 bp, Homo sapiens
agataactggtttacattattg

SEQ ID NO: 6919305 - DNA, 22 bp, Homo sapiens
tactgaaagactgaatatttag

SEQ ID NO: 6919306 - DNA, 22 bp, Homo sapiens
aggcaggcagggctcactgtct

SEQ ID NO: 6919307 - DNA, 22 bp, Homo sapiens
ggtgtcctgggcaggcagctga

SEQ ID NO: 6919308 - DNA, 22 bp, Homo sapiens
tatgtttcattcttttctggta

SEQ ID NO: 6919309 - DNA, 22 bp, Homo sapiens
attagcaatctgaaaattgcgg

SEQ ID NO: 6919310 - DNA, 22 bp, Homo sapiens
atcctcacaacactgcaagatg

SEQ ID NO: 6919311 - DNA, 22 bp, Homo sapiens
cattgaaacagatgtacccatg

SEQ ID NO: 6919312 - DNA, 22 bp, Homo sapiens
ctggtctgaggttgcccttgaa

SEQ ID NO: 6919313 - DNA, 22 bp, Homo sapiens
tgagccaggctcaagtgatcct

SEQ ID NO: 6919314 - DNA, 22 bp, Homo sapiens
tgaggcaggagttaatgtgctc

SEQ ID NO: 6919315 - DNA, 22 bp, Homo sapiens
ccaggctggattttgcagttca

SEQ ID NO: 6919316 - DNA, 22 bp, Homo sapiens
tttcaagtcagtagctaatcat

SEQ ID NO: 6919317 - DNA, 21 bp, Homo sapiens
actatgtcatttaagtcactg

SEQ ID NO: 6919318 - DNA, 23 bp, Homo sapiens
tggctgaggtccaggtagtttca

SEQ ID NO: 6919319 - DNA, 22 bp, Homo sapiens
ttcacaggtgagcattaggccg

SEQ ID NO: 6919320 - DNA, 22 bp, Homo sapiens
ctaaggaaaggaaatacagtaa

SEQ ID NO: 6919321 - DNA, 22 bp, Homo sapiens
tggtccgctcctattcgccgca

SEQ ID NO: 6919322 - DNA, 22 bp, Homo sapiens
caggaggagctggccgcctcat

SEQ ID NO: 6919323 - DNA, 17 bp, Homo sapiens
tctcttgttcactgctg

SEQ ID NO: 6919324 - DNA, 22 bp, Homo sapiens
ttgtgtcaggggcccatactca

SEQ ID NO: 6919325 - DNA, 22 bp, Homo sapiens
gtgtataataatgtgagctaaa

SEQ ID NO: 6919326 - DNA, 22 bp, Homo sapiens
ccaggagagcaggcgtgcagct

SEQ ID NO: 6919327 - DNA, 22 bp, Homo sapiens
gtggcattgacatgtaaacagt

SEQ ID NO: 6919328 - DNA, 22 bp, Homo sapiens
aaagctaaggtagcattggaga

SEQ ID NO: 6919329 - DNA, 23 bp, Homo sapiens
tccagagtgtgagcttgccgtgc

SEQ ID NO: 6919330 - DNA, 22 bp, Homo sapiens
atgacagatgctgtggggaggt

SEQ ID NO: 6919331 - DNA, 21 bp, Homo sapiens
cttcaattcaacactgccatg

SEQ ID NO: 6919332 - DNA, 22 bp, Homo sapiens
ggctgatcctgagcaggcagtg

SEQ ID NO: 6919333 - DNA, 22 bp, Homo sapiens
ttattctgccaggagcgtcagt

SEQ ID NO: 6919334 - DNA, 22 bp, Homo sapiens
ctgccctgtagctgttctagca

SEQ ID NO: 6919335 - DNA, 22 bp, Homo sapiens
gctaggctcttccatcagggca

SEQ ID NO: 6919336 - DNA, 22 bp, Homo sapiens
ggctggagaagggtggttgaca

SEQ ID NO: 6919337 - DNA, 22 bp, Homo sapiens
gaggggcaagaagttggcctct

SEQ ID NO: 6919338 - DNA, 22 bp, Homo sapiens
cagcaggtcccactgagggccc

SEQ ID NO: 6919339 - DNA, 22 bp, Homo sapiens
agtggtaggggccatgccaaca

SEQ ID NO: 6919340 - DNA, 22 bp, Homo sapiens
ttcatgtttcaattgttaatgt

SEQ ID NO: 6919341 - DNA, 22 bp, Homo sapiens
gtgaggctactcagctgtccga

SEQ ID NO: 6919342 - DNA, 22 bp, Homo sapiens
aatgcttatacctaatgatctt

SEQ ID NO: 6919343 - DNA, 21 bp, Homo sapiens
gtgctgctagcgggacgggag

SEQ ID NO: 6919344 - DNA, 22 bp, Homo sapiens
ggttgaatcattctttgcaccg

SEQ ID NO: 6919345 - DNA, 22 bp, Homo sapiens
gcttgggaagggccctgtgtac

SEQ ID NO: 6919346 - DNA, 22 bp, Homo sapiens
agtagaaatgtagtgtagagaa

SEQ ID NO: 6919347 - DNA, 18 bp, Homo sapiens
gaatatctagcacatagt

SEQ ID NO: 6919348 - DNA, 20 bp, Homo sapiens
aggcatctgagtcacatctt

SEQ ID NO: 6919349 - DNA, 21 bp, Homo sapiens
taggaactgttctgagtggtc

SEQ ID NO: 6919350 - DNA, 23 bp, Homo sapiens
atgttattattagcagtcttgcc

SEQ ID NO: 6919351 - DNA, 22 bp, Homo sapiens
tcttcacagctttgtccagaag

SEQ ID NO: 6919352 - DNA, 22 bp, Homo sapiens
agttacagcactcaaagttttc

SEQ ID NO: 6919353 - DNA, 22 bp, Homo sapiens
gatggcttgttttctggctgaa

SEQ ID NO: 6919354 - DNA, 22 bp, Homo sapiens
gctttctgatgagcttaagaaa

SEQ ID NO: 6919355 - DNA, 22 bp, Homo sapiens
aaggtaggttaacctgcaggag

SEQ ID NO: 6919356 - DNA, 17 bp, Homo sapiens
ggtacaaacccattttt

SEQ ID NO: 6919357 - DNA, 22 bp, Homo sapiens
tctttcttcagccctgtaagat

SEQ ID NO: 6919358 - DNA, 22 bp, Homo sapiens
gccacatttgtgcctttatgaa

SEQ ID NO: 6919359 - DNA, 22 bp, Homo sapiens
tatttctgagaaccaacttacc

SEQ ID NO: 6919360 - DNA, 22 bp, Homo sapiens
ccaagggctctggacagagtgg

SEQ ID NO: 6919361 - DNA, 19 bp, Homo sapiens
agaactgggtccatggctt

SEQ ID NO: 6919362 - DNA, 22 bp, Homo sapiens
cctatgaacaggaaatggaacg

SEQ ID NO: 6919363 - DNA, 22 bp, Homo sapiens
gcatgttatgtatctgcccagc

SEQ ID NO: 6919364 - DNA, 22 bp, Homo sapiens
cactgcttggttgcaacattgc

SEQ ID NO: 6919365 - DNA, 22 bp, Homo sapiens
atttcctaacagaggcaacagt

SEQ ID NO: 6919366 - DNA, 22 bp, Homo sapiens
acagttattctttatgcaacca

SEQ ID NO: 6919367 - DNA, 22 bp, Homo sapiens
gaaagtgcatgtgcccaccatt

SEQ ID NO: 6919368 - DNA, 22 bp, Homo sapiens
ccatgtgggattttggtgtctg

SEQ ID NO: 6919369 - DNA, 22 bp, Homo sapiens
ttggacagaattttgtgtgtgt

SEQ ID NO: 6919370 - DNA, 22 bp, Homo sapiens
ggtattgttctagctttaaagg

SEQ ID NO: 6919371 - DNA, 22 bp, Homo sapiens
tgctcagtcctaccttggctcc

SEQ ID NO: 6919372 - DNA, 22 bp, Homo sapiens
atcatacagcctttgttagtgt

SEQ ID NO: 6919373 - DNA, 22 bp, Homo sapiens
agatgcagagttgcttaagcat

SEQ ID NO: 6919374 - DNA, 22 bp, Homo sapiens
cagcaaggccattggatgcagt

SEQ ID NO: 6919375 - DNA, 22 bp, Homo sapiens
gagacagcacaggccactggga

SEQ ID NO: 6919376 - DNA, 22 bp, Homo sapiens
gaggcttttcttcaggtatcaa

SEQ ID NO: 6919377 - DNA, 22 bp, Homo sapiens
cagagcctctcagaggtcagac

SEQ ID NO: 6919378 - DNA, 22 bp, Homo sapiens
ttgaatcttagctctgccactt

SEQ ID NO: 6919379 - DNA, 21 bp, Homo sapiens
cagtgccccagctacaaaagg

SEQ ID NO: 6919380 - DNA, 22 bp, Homo sapiens
tgtgtctttgttccaggtacga

SEQ ID NO: 6919381 - DNA, 22 bp, Homo sapiens
ctaaccagagattagatttagt

SEQ ID NO: 6919382 - DNA, 22 bp, Homo sapiens
taaaggtttattcaacaaaata

SEQ ID NO: 6919383 - DNA, 22 bp, Homo sapiens
gggagggacacaaagagttccc

SEQ ID NO: 6919384 - DNA, 21 bp, Homo sapiens
gatgaatgtcctgaccagaac

SEQ ID NO: 6919385 - DNA, 22 bp, Homo sapiens
attcaagtaaacactgaaggaa

SEQ ID NO: 6919386 - DNA, 22 bp, Homo sapiens
tgcaaatggagcatgtataaga

SEQ ID NO: 6919387 - DNA, 22 bp, Homo sapiens
tctagctgccccgaggcagggt

SEQ ID NO: 6919388 - DNA, 22 bp, Homo sapiens
tctcctgctcccaactgctgca

SEQ ID NO: 6919389 - DNA, 22 bp, Homo sapiens
gcctgagacagtgtggtccaat

SEQ ID NO: 6919390 - DNA, 22 bp, Homo sapiens
aactcaggagaatggagggtat

SEQ ID NO: 6919391 - DNA, 22 bp, Homo sapiens
aatcttaaagaatattctacca

SEQ ID NO: 6919392 - DNA, 22 bp, Homo sapiens
ttggaatttgagaccaagaaaa

SEQ ID NO: 6919393 - DNA, 22 bp, Homo sapiens
gtgagcatagtaccaggtagta

SEQ ID NO: 6919394 - DNA, 22 bp, Homo sapiens
ctgctgtcatctggcgctgtgc

SEQ ID NO: 6919395 - DNA, 22 bp, Homo sapiens
ctggaatgggtttcaggcactg

SEQ ID NO: 6919396 - DNA, 22 bp, Homo sapiens
aggggcacgagtagagctctag

SEQ ID NO: 6919397 - DNA, 22 bp, Homo sapiens
gccttgggtttcctatcctgag

SEQ ID NO: 6919398 - DNA, 22 bp, Homo sapiens
ggaggccaggatgggaactcaa

SEQ ID NO: 6919399 - DNA, 22 bp, Homo sapiens
ggctccctgcctgtcctcagtc

SEQ ID NO: 6919400 - DNA, 22 bp, Homo sapiens
tagcagggccaggctgggaacc

SEQ ID NO: 6919401 - DNA, 20 bp, Homo sapiens
ttttgcagagaaggcgactg

SEQ ID NO: 6919402 - DNA, 22 bp, Homo sapiens
aagctacagtttacccatggtt

SEQ ID NO: 6919403 - DNA, 22 bp, Homo sapiens
ccagagaaggtggagcttgtgt

SEQ ID NO: 6919404 - DNA, 22 bp, Homo sapiens
actgtcatcttgtaagcaatgt

SEQ ID NO: 6919405 - DNA, 22 bp, Homo sapiens
gcccttgggaggttccactggg

SEQ ID NO: 6919406 - DNA, 22 bp, Homo sapiens
ctttacagatggataattgttt

SEQ ID NO: 6919407 - DNA, 22 bp, Homo sapiens
ctttggagaaaagttcttgggc

SEQ ID NO: 6919408 - DNA, 22 bp, Homo sapiens
ggacacaagctccggggctgca

SEQ ID NO: 6919409 - DNA, 22 bp, Homo sapiens
ctgcctatctacaaagtgggat

SEQ ID NO: 6919410 - DNA, 22 bp, Homo sapiens
gtgtcaggagccttccatgggc

SEQ ID NO: 6919411 - DNA, 22 bp, Homo sapiens
ctggtacagtgttacaaaatgg

SEQ ID NO: 6919412 - DNA, 22 bp, Homo sapiens
cagtttgtgctaggcactattt

SEQ ID NO: 6919413 - DNA, 23 bp, Homo sapiens
tctctttcaagagcttaatgtgc

SEQ ID NO: 6919414 - DNA, 22 bp, Homo sapiens
tctggatcctatgcactggact

SEQ ID NO: 6919415 - DNA, 22 bp, Homo sapiens
gatatgtgcttgtaatatttat

SEQ ID NO: 6919416 - DNA, 22 bp, Homo sapiens
aatgtataaagtgttaataact

SEQ ID NO: 6919417 - DNA, 22 bp, Homo sapiens
gtttccatggaagcaaaggtgg

SEQ ID NO: 6919418 - DNA, 22 bp, Homo sapiens
agtgtacagtttgtagtactac

SEQ ID NO: 6919419 - DNA, 22 bp, Homo sapiens
agagctgggaccgtctggaagt

SEQ ID NO: 6919420 - DNA, 22 bp, Homo sapiens
aggcttggttaattctgtgtga

SEQ ID NO: 6919421 - DNA, 22 bp, Homo sapiens
tggaagatatgctgattctctg

SEQ ID NO: 6919422 - DNA, 22 bp, Homo sapiens
acaatttgaggctactcaattg

SEQ ID NO: 6919423 - DNA, 22 bp, Homo sapiens
gcagcattgcacttttgttctt

SEQ ID NO: 6919424 - DNA, 22 bp, Homo sapiens
tagttacaattatgcatggaaa

SEQ ID NO: 6919425 - DNA, 22 bp, Homo sapiens
ggcagcaacaggtgtgttgtga

SEQ ID NO: 6919426 - DNA, 22 bp, Homo sapiens
ctgagccatgagcctgcgccca

SEQ ID NO: 6919427 - DNA, 22 bp, Homo sapiens
tgccagtgtggaactaggaaga

SEQ ID NO: 6919428 - DNA, 22 bp, Homo sapiens
tgatatgtccctcgacatcagg

SEQ ID NO: 6919429 - DNA, 22 bp, Homo sapiens
ttgtcttttgtgggaaatatgg

SEQ ID NO: 6919430 - DNA, 22 bp, Homo sapiens
aagtgctaaatgttttagttaa

SEQ ID NO: 6919431 - DNA, 22 bp, Homo sapiens
cagcatgagggtctccatgcag

SEQ ID NO: 6919432 - DNA, 22 bp, Homo sapiens
ttccacaagtgatatctagctg

SEQ ID NO: 6919433 - DNA, 22 bp, Homo sapiens
tagttagcactcggtctgctct

SEQ ID NO: 6919434 - DNA, 22 bp, Homo sapiens
catgcatacacaggtcaggcag

SEQ ID NO: 6919435 - DNA, 22 bp, Homo sapiens
tgctggttgtattttctctgtg

SEQ ID NO: 6919436 - DNA, 22 bp, Homo sapiens
tggcaaagattaccacatctac

SEQ ID NO: 6919437 - DNA, 22 bp, Homo sapiens
ggttacatctcaagtggagtct

SEQ ID NO: 6919438 - DNA, 22 bp, Homo sapiens
ttaatggccccattttatgtct

SEQ ID NO: 6919439 - DNA, 22 bp, Homo sapiens
cctggtgccactagagaatgtc

SEQ ID NO: 6919440 - DNA, 22 bp, Homo sapiens
taacaaggtaagcctggccatg

SEQ ID NO: 6919441 - DNA, 22 bp, Homo sapiens
gatgtataacctggctatgtta

SEQ ID NO: 6919442 - DNA, 22 bp, Homo sapiens
ggttgccggggcaggactggaa

SEQ ID NO: 6919443 - DNA, 22 bp, Homo sapiens
agcaaatattttgttgaagtgc

SEQ ID NO: 6919444 - DNA, 19 bp, Homo sapiens
ggccttgatgagtggggag

SEQ ID NO: 6919445 - DNA, 22 bp, Homo sapiens
ctgcagttctttggcttttaga

SEQ ID NO: 6919446 - DNA, 22 bp, Homo sapiens
tcgataatatcttacatgtgct

SEQ ID NO: 6919447 - DNA, 23 bp, Homo sapiens
tcctgccagatgactcctttctt

SEQ ID NO: 6919448 - DNA, 22 bp, Homo sapiens
gagtccaggcatccctcccata

SEQ ID NO: 6919449 - DNA, 22 bp, Homo sapiens
tttaggaaatactgtcctatga

SEQ ID NO: 6919450 - DNA, 22 bp, Homo sapiens
gctgatccatacataaatgtgt

SEQ ID NO: 6919451 - DNA, 22 bp, Homo sapiens
tctgggaaggagcctgagaatt

SEQ ID NO: 6919452 - DNA, 22 bp, Homo sapiens
atacatacatgtatgcacatac

SEQ ID NO: 6919453 - DNA, 22 bp, Homo sapiens
attccagtgtgcatggtacaca

SEQ ID NO: 6919454 - DNA, 21 bp, Homo sapiens
tgggacctagctttgcacagg

SEQ ID NO: 6919455 - DNA, 22 bp, Homo sapiens
ggtcatctgcctccaaagcact

SEQ ID NO: 6919456 - DNA, 22 bp, Homo sapiens
tgtgccatgaggctctgatatg

SEQ ID NO: 6919457 - DNA, 22 bp, Homo sapiens
tgtataacttgtggttatgaat

SEQ ID NO: 6919458 - DNA, 22 bp, Homo sapiens
atacatagcagagtcaattaat

SEQ ID NO: 6919459 - DNA, 22 bp, Homo sapiens
ttccgaacccggatctgctgct

SEQ ID NO: 6919460 - DNA, 22 bp, Homo sapiens
taaagtgttgtacaaatgtatg

SEQ ID NO: 6919461 - DNA, 22 bp, Homo sapiens
acaaggctctggagaagcagaa

SEQ ID NO: 6919462 - DNA, 22 bp, Homo sapiens
gctctggaccctggagtggctg

SEQ ID NO: 6919463 - DNA, 22 bp, Homo sapiens
tcaatgacattgtatcagagtt

SEQ ID NO: 6919464 - DNA, 22 bp, Homo sapiens
acaagtatttaaggttagtata

SEQ ID NO: 6919465 - DNA, 22 bp, Homo sapiens
cccaaagtacaagtaaacatgt

SEQ ID NO: 6919466 - DNA, 22 bp, Homo sapiens
ttcaaggttcagggagaaattg

SEQ ID NO: 6919467 - DNA, 22 bp, Homo sapiens
tccaatgttattatctagaggc

SEQ ID NO: 6919468 - DNA, 22 bp, Homo sapiens
aatttggaggtatttagctgtc

SEQ ID NO: 6919469 - DNA, 22 bp, Homo sapiens
aagaggccccccagcaggtgaa

SEQ ID NO: 6919470 - DNA, 22 bp, Homo sapiens
gtctggaagaacctgtgccagt

SEQ ID NO: 6919471 - DNA, 22 bp, Homo sapiens
tccctgaagccagggaaggaag

SEQ ID NO: 6919472 - DNA, 22 bp, Homo sapiens
tttcagagcctttatctctcta

SEQ ID NO: 6919473 - DNA, 19 bp, Homo sapiens
cctgtggcagagtggaaac

SEQ ID NO: 6919474 - DNA, 21 bp, Homo sapiens
tgaaatctgatgggacaaatg

SEQ ID NO: 6919475 - DNA, 22 bp, Homo sapiens
gtaggaaagtaaatgaaataca

SEQ ID NO: 6919476 - DNA, 21 bp, Homo sapiens
tggtggaccagtgctgggaga

SEQ ID NO: 6919477 - DNA, 22 bp, Homo sapiens
ctggaagggaaatctcttggca

SEQ ID NO: 6919478 - DNA, 22 bp, Homo sapiens
cccaaggacacgggcagggaca

SEQ ID NO: 6919479 - DNA, 22 bp, Homo sapiens
aggtttctggaaaggttttgct

SEQ ID NO: 6919480 - DNA, 22 bp, Homo sapiens
gcagactgtatcaatgtcagta

SEQ ID NO: 6919481 - DNA, 23 bp, Homo sapiens
taaattgatggtatgggttaagc

SEQ ID NO: 6919482 - DNA, 22 bp, Homo sapiens
aatccagctgtgtcacaggtga

SEQ ID NO: 6919483 - DNA, 22 bp, Homo sapiens
cagtgcatgtctgtgtggggat

SEQ ID NO: 6919484 - DNA, 22 bp, Homo sapiens
cacattcttgagttacagtcta

SEQ ID NO: 6919485 - DNA, 22 bp, Homo sapiens
tctgggagcagctcagcagatt

SEQ ID NO: 6919486 - DNA, 22 bp, Homo sapiens
catttgcaagagataaatgttt

SEQ ID NO: 6919487 - DNA, 21 bp, Homo sapiens
ttgaggagtgagagtgggttt

SEQ ID NO: 6919488 - DNA, 22 bp, Homo sapiens
aatagcatcctgtatctcttcc

SEQ ID NO: 6919489 - DNA, 22 bp, Homo sapiens
tcaggaagctcttgctgattct

SEQ ID NO: 6919490 - DNA, 22 bp, Homo sapiens
cgttggtctgtcccctggcacc

SEQ ID NO: 6919491 - DNA, 22 bp, Homo sapiens
accctgagggatgagagttgca

SEQ ID NO: 6919492 - DNA, 22 bp, Homo sapiens
tttcctctgtcatgacagctga

SEQ ID NO: 6919493 - DNA, 22 bp, Homo sapiens
atctcaggggttccttctagag

SEQ ID NO: 6919494 - DNA, 22 bp, Homo sapiens
gctgctgtcagtctgaatctga

SEQ ID NO: 6919495 - DNA, 22 bp, Homo sapiens
agtatttctagttggttctact

SEQ ID NO: 6919496 - DNA, 22 bp, Homo sapiens
ttccaggaggcttggcgggagg

SEQ ID NO: 6919497 - DNA, 18 bp, Homo sapiens
tcaaatactttgggcagt

SEQ ID NO: 6919498 - DNA, 22 bp, Homo sapiens
tatgcaattctcttaatattct

SEQ ID NO: 6919499 - DNA, 22 bp, Homo sapiens
tgtattatgattgttgttcatg

SEQ ID NO: 6919500 - DNA, 22 bp, Homo sapiens
attctgcattgctcacaaagat

SEQ ID NO: 6919501 - DNA, 22 bp, Homo sapiens
atgctgtgccttctctgtgcca

SEQ ID NO: 6919502 - DNA, 22 bp, Homo sapiens
atggaggtctgtgactcccaaa

SEQ ID NO: 6919503 - DNA, 22 bp, Homo sapiens
cagcaagattaagggcagaaaa

SEQ ID NO: 6919504 - DNA, 22 bp, Homo sapiens
aggcagaaaatagtcatccaaa

SEQ ID NO: 6919505 - DNA, 22 bp, Homo sapiens
aagccctgtcaccctgacttca

SEQ ID NO: 6919506 - DNA, 22 bp, Homo sapiens
tgagtaatctcacatattatgt

SEQ ID NO: 6919507 - DNA, 22 bp, Homo sapiens
tactataaagtcttaatgagtc

SEQ ID NO: 6919508 - DNA, 22 bp, Homo sapiens
ttctagttcatattctcaaaga

SEQ ID NO: 6919509 - DNA, 22 bp, Homo sapiens
ctagaaggaagcccagcacttc

SEQ ID NO: 6919510 - DNA, 22 bp, Homo sapiens
ggctgccataactgataccata

SEQ ID NO: 6919511 - DNA, 22 bp, Homo sapiens
tcgctgacggtcgcggtgtccc

SEQ ID NO: 6919512 - DNA, 22 bp, Homo sapiens
ggctgaggctcatgccatcttg

SEQ ID NO: 6919513 - DNA, 22 bp, Homo sapiens
tttgggcattagaatattcttt

SEQ ID NO: 6919514 - DNA, 22 bp, Homo sapiens
ctagaaacattacatgtgttaa

SEQ ID NO: 6919515 - DNA, 22 bp, Homo sapiens
taggctgcaagcatagaacaaa

SEQ ID NO: 6919516 - DNA, 22 bp, Homo sapiens
aatggctctttgaggacagaag

SEQ ID NO: 6919517 - DNA, 22 bp, Homo sapiens
ctgggacatattgctagtgttg

SEQ ID NO: 6919518 - DNA, 22 bp, Homo sapiens
aggcagtgcctggaccccagct

SEQ ID NO: 6919519 - DNA, 22 bp, Homo sapiens
atgtagaggagtttctggtctg

SEQ ID NO: 6919520 - DNA, 22 bp, Homo sapiens
cgctgataaacgtcacgttccc

SEQ ID NO: 6919521 - DNA, 22 bp, Homo sapiens
ggcttccctgtttgctgtgcct

SEQ ID NO: 6919522 - DNA, 22 bp, Homo sapiens
atttagtgaccagcactagaaa

SEQ ID NO: 6919523 - DNA, 22 bp, Homo sapiens
gtgggctgcttcctccttccac

SEQ ID NO: 6919524 - DNA, 22 bp, Homo sapiens
tcaggattatttcagtggcttt

SEQ ID NO: 6919525 - DNA, 22 bp, Homo sapiens
ccagataagaccatcagctatg

SEQ ID NO: 6919526 - DNA, 22 bp, Homo sapiens
tatgttattttcatacaacaga

SEQ ID NO: 6919527 - DNA, 22 bp, Homo sapiens
cgcatgcttcctttgcttcctt

SEQ ID NO: 6919528 - DNA, 22 bp, Homo sapiens
caccatgcctggctaatttttt

SEQ ID NO: 6919529 - DNA, 22 bp, Homo sapiens
ggcataaagttagagattaaga

SEQ ID NO: 6919530 - DNA, 22 bp, Homo sapiens
aggcgggttcagggctgccatg

SEQ ID NO: 6919531 - DNA, 21 bp, Homo sapiens
tacaccagtttacacttcctc

SEQ ID NO: 6919532 - DNA, 22 bp, Homo sapiens
tggtgcaaaactaattgcggtt

SEQ ID NO: 6919533 - DNA, 22 bp, Homo sapiens
tgccagatgcaggaggtaaggc

SEQ ID NO: 6919534 - DNA, 22 bp, Homo sapiens
tagtgcagaggaggagcctctg

SEQ ID NO: 6919535 - DNA, 22 bp, Homo sapiens
gagctaggctagggggagtcgc

SEQ ID NO: 6919536 - DNA, 22 bp, Homo sapiens
tacacatctctgtcagtagtga

SEQ ID NO: 6919537 - DNA, 22 bp, Homo sapiens
tatttgcaacataaaactctga

SEQ ID NO: 6919538 - DNA, 22 bp, Homo sapiens
catctttgtaacttccacataa

SEQ ID NO: 6919539 - DNA, 22 bp, Homo sapiens
gggcagcctgctttctgatcca

SEQ ID NO: 6919540 - DNA, 22 bp, Homo sapiens
actgtaaaacaggtttcatcat

SEQ ID NO: 6919541 - DNA, 23 bp, Homo sapiens
tccagccaaatctggctgacagt

SEQ ID NO: 6919542 - DNA, 22 bp, Homo sapiens
aatgcatgtattcattgtggaa

SEQ ID NO: 6919543 - DNA, 22 bp, Homo sapiens
attcagctgatggtatttaaat

SEQ ID NO: 6919544 - DNA, 22 bp, Homo sapiens
ctggctgacacaaaggtatcga

SEQ ID NO: 6919545 - DNA, 22 bp, Homo sapiens
tcctggaacatggataaagaat

SEQ ID NO: 6919546 - DNA, 22 bp, Homo sapiens
attgctgaataatattccactg

SEQ ID NO: 6919547 - DNA, 22 bp, Homo sapiens
agagtcagtaacatatatggta

SEQ ID NO: 6919548 - DNA, 22 bp, Homo sapiens
tttctcatggcccttggctttt

SEQ ID NO: 6919549 - DNA, 22 bp, Homo sapiens
aggataactataggataatgct

SEQ ID NO: 6919550 - DNA, 22 bp, Homo sapiens
tgttaaatgttcctttactgga

SEQ ID NO: 6919551 - DNA, 22 bp, Homo sapiens
aggctaagatgactccaccccc

SEQ ID NO: 6919552 - DNA, 22 bp, Homo sapiens
accttagatttggcttactatg

SEQ ID NO: 6919553 - DNA, 22 bp, Homo sapiens
ataactgagagcaatctttctt

SEQ ID NO: 6919554 - DNA, 23 bp, Homo sapiens
gcgtcaggactgttttgtgaccc

SEQ ID NO: 6919555 - DNA, 18 bp, Homo sapiens
agctctggcatacttgaa

SEQ ID NO: 6919556 - DNA, 22 bp, Homo sapiens
ggcgagcatgagtcactctggg

SEQ ID NO: 6919557 - DNA, 22 bp, Homo sapiens
tccagaggcagctgcggtcagg

SEQ ID NO: 6919558 - DNA, 22 bp, Homo sapiens
actggggcctcctccatgctct

SEQ ID NO: 6919559 - DNA, 23 bp, Homo sapiens
ctgctgttttctgtacctgaagc

SEQ ID NO: 6919560 - DNA, 22 bp, Homo sapiens
cactgtgaaaaatggagtggtc

SEQ ID NO: 6919561 - DNA, 22 bp, Homo sapiens
gagcttccatccttactgtgtg

SEQ ID NO: 6919562 - DNA, 23 bp, Homo sapiens
gaggcctggccctgccacatctc

SEQ ID NO: 6919563 - DNA, 22 bp, Homo sapiens
tcagctcttaaccctctggcct

SEQ ID NO: 6919564 - DNA, 22 bp, Homo sapiens
actcctgccacacagatgctgt

SEQ ID NO: 6919565 - DNA, 22 bp, Homo sapiens
caagtgaagatatacagaaaat

SEQ ID NO: 6919566 - DNA, 22 bp, Homo sapiens
tagtgtctcttcctgtttgaaa

SEQ ID NO: 6919567 - DNA, 22 bp, Homo sapiens
gccgccgctgtgcaatttagca

SEQ ID NO: 6919568 - DNA, 22 bp, Homo sapiens
agtaaacacgtggggtttcttt

SEQ ID NO: 6919569 - DNA, 22 bp, Homo sapiens
gaaggggactggcagctgcaga

SEQ ID NO: 6919570 - DNA, 22 bp, Homo sapiens
ttctccagacacaaaatctaag

SEQ ID NO: 6919571 - DNA, 22 bp, Homo sapiens
catgtgattacactaagaaggt

SEQ ID NO: 6919572 - DNA, 22 bp, Homo sapiens
aaagtgctgggattacaagcgt

SEQ ID NO: 6919573 - DNA, 22 bp, Homo sapiens
tgctgtcaaggttacatgcttt

SEQ ID NO: 6919574 - DNA, 22 bp, Homo sapiens
agattgggtttgcttctgtgcc

SEQ ID NO: 6919575 - DNA, 22 bp, Homo sapiens
ctatgttacaaagcagttagtt

SEQ ID NO: 6919576 - DNA, 22 bp, Homo sapiens
aggagcaccattgtgctggtgt

SEQ ID NO: 6919577 - DNA, 22 bp, Homo sapiens
tacttggtaaatgcttatggaa

SEQ ID NO: 6919578 - DNA, 22 bp, Homo sapiens
gtttctgagcacttttattgca

SEQ ID NO: 6919579 - DNA, 22 bp, Homo sapiens
caggctgtgttcctggaacccc

SEQ ID NO: 6919580 - DNA, 22 bp, Homo sapiens
aaggctctctgatggcagcagt

SEQ ID NO: 6919581 - DNA, 19 bp, Homo sapiens
tcaggcagttattcacaaa

SEQ ID NO: 6919582 - DNA, 22 bp, Homo sapiens
taacttctgaatagcaatagta

SEQ ID NO: 6919583 - DNA, 22 bp, Homo sapiens
atgtggctagtcctctgcggca

SEQ ID NO: 6919584 - DNA, 22 bp, Homo sapiens
gggcacagagaaggttttagtg

SEQ ID NO: 6919585 - DNA, 22 bp, Homo sapiens
taactgccagcagcgatgaaca

SEQ ID NO: 6919586 - DNA, 22 bp, Homo sapiens
gtcaccagtcccagctcctgaa

SEQ ID NO: 6919587 - DNA, 22 bp, Homo sapiens
cactgctttcacagtttgttcc

SEQ ID NO: 6919588 - DNA, 22 bp, Homo sapiens
cccgagtgtctactcactccca

SEQ ID NO: 6919589 - DNA, 22 bp, Homo sapiens
gagccctgttcaggcctcctca

SEQ ID NO: 6919590 - DNA, 19 bp, Homo sapiens
cctcaagtatgaagaggcc

SEQ ID NO: 6919591 - DNA, 18 bp, Homo sapiens
ggcatgtgagtgctgagg

SEQ ID NO: 6919592 - DNA, 22 bp, Homo sapiens
actaaagatgtctaaatatatt

SEQ ID NO: 6919593 - DNA, 22 bp, Homo sapiens
taaggctgttaggaggattaaa

SEQ ID NO: 6919594 - DNA, 22 bp, Homo sapiens
aattcacaaaagttagatccat

SEQ ID NO: 6919595 - DNA, 22 bp, Homo sapiens
cctaaacagaacaaagaggcag

SEQ ID NO: 6919596 - DNA, 22 bp, Homo sapiens
tgcacagtatgtggtcctttgt

SEQ ID NO: 6919597 - DNA, 22 bp, Homo sapiens
agtaatttgttataaagcaata

SEQ ID NO: 6919598 - DNA, 22 bp, Homo sapiens
gtcacaggcctggatgaggggc

SEQ ID NO: 6919599 - DNA, 22 bp, Homo sapiens
tggcccaatatgttaacatgat

SEQ ID NO: 6919600 - DNA, 22 bp, Homo sapiens
gtgtggggaggagagagccctt

SEQ ID NO: 6919601 - DNA, 22 bp, Homo sapiens
tagtccttacttactagaataa

SEQ ID NO: 6919602 - DNA, 22 bp, Homo sapiens
tgtgatagaaagtatcacaagg

SEQ ID NO: 6919603 - DNA, 22 bp, Homo sapiens
tccccaatttgagtcacctctg

SEQ ID NO: 6919604 - DNA, 22 bp, Homo sapiens
tggccagcctggtgcttgctcc

SEQ ID NO: 6919605 - DNA, 22 bp, Homo sapiens
tgctggaaaaatcatttgcttt

SEQ ID NO: 6919606 - DNA, 22 bp, Homo sapiens
tgtgtcctccagggagatgtaa

SEQ ID NO: 6919607 - DNA, 22 bp, Homo sapiens
taggaatgggcaagacaaagaa

SEQ ID NO: 6919608 - DNA, 22 bp, Homo sapiens
tcaatgcaacctccacctcccg

SEQ ID NO: 6919609 - DNA, 22 bp, Homo sapiens
atttggcttctctaatactata

SEQ ID NO: 6919610 - DNA, 22 bp, Homo sapiens
gagatggagtctcactctgtca

SEQ ID NO: 6919611 - DNA, 22 bp, Homo sapiens
agctgctcattggcgtagttga

SEQ ID NO: 6919612 - DNA, 22 bp, Homo sapiens
aattggcatagcatacaattca

SEQ ID NO: 6919613 - DNA, 22 bp, Homo sapiens
ttctggagggcctgatcacaca

SEQ ID NO: 6919614 - DNA, 22 bp, Homo sapiens
caggttgaaagtggaggagcta

SEQ ID NO: 6919615 - DNA, 22 bp, Homo sapiens
atagtttgaaggctgttctact

SEQ ID NO: 6919616 - DNA, 22 bp, Homo sapiens
cattgttggtaatgctcagagg

SEQ ID NO: 6919617 - DNA, 22 bp, Homo sapiens
agtgtgactacattacaagagt

SEQ ID NO: 6919618 - DNA, 22 bp, Homo sapiens
atgctgtgtggtcaagttaatt

SEQ ID NO: 6919619 - DNA, 22 bp, Homo sapiens
ccacttgtcagagtttctctgc

SEQ ID NO: 6919620 - DNA, 22 bp, Homo sapiens
catgttggcaaggatacagcag

SEQ ID NO: 6919621 - DNA, 22 bp, Homo sapiens
gatgaagctttgaagtctaatc

SEQ ID NO: 6919622 - DNA, 22 bp, Homo sapiens
atacaccaccttggatctttca

SEQ ID NO: 6919623 - DNA, 22 bp, Homo sapiens
ctgctgaggctccggaccaagt

SEQ ID NO: 6919624 - DNA, 22 bp, Homo sapiens
tctaactaactacagtaagagg

SEQ ID NO: 6919625 - DNA, 22 bp, Homo sapiens
cctgaggcccctgaggatagca

SEQ ID NO: 6919626 - DNA, 22 bp, Homo sapiens
atggccagtctgttggacagca

SEQ ID NO: 6919627 - DNA, 22 bp, Homo sapiens
ggagtggcagctaggctgtcag

SEQ ID NO: 6919628 - DNA, 22 bp, Homo sapiens
aatttctgtatgaatagagaaa

SEQ ID NO: 6919629 - DNA, 22 bp, Homo sapiens
cctttctaagatactgcaactt

SEQ ID NO: 6919630 - DNA, 18 bp, Homo sapiens
actctttctgcccacagg

SEQ ID NO: 6919631 - DNA, 22 bp, Homo sapiens
aattccatatctgtgattatta

SEQ ID NO: 6919632 - DNA, 22 bp, Homo sapiens
actgctagtgagaaaataacca

SEQ ID NO: 6919633 - DNA, 22 bp, Homo sapiens
gcgaagggtcctcactagatgc

SEQ ID NO: 6919634 - DNA, 22 bp, Homo sapiens
ctgaagaaatatgattgcttaa

SEQ ID NO: 6919635 - DNA, 19 bp, Homo sapiens
tgagtgggagcccaggtat

SEQ ID NO: 6919636 - DNA, 22 bp, Homo sapiens
tccctctctagcctgttcagta

SEQ ID NO: 6919637 - DNA, 22 bp, Homo sapiens
atccatcagaagggcaaaattt

SEQ ID NO: 6919638 - DNA, 19 bp, Homo sapiens
agtggcagatctggaagta

SEQ ID NO: 6919639 - DNA, 22 bp, Homo sapiens
aggtgagaaaacgagggttgca

SEQ ID NO: 6919640 - DNA, 22 bp, Homo sapiens
tggattctgggctgtttgcatt

SEQ ID NO: 6919641 - DNA, 20 bp, Homo sapiens
agaatcagagtggaaaggaa

SEQ ID NO: 6919642 - DNA, 22 bp, Homo sapiens
agaacataattatcataaactg

SEQ ID NO: 6919643 - DNA, 22 bp, Homo sapiens
acttatcttagttcatttgtat

SEQ ID NO: 6919644 - DNA, 22 bp, Homo sapiens
tacagaatgttatgaagcatag

SEQ ID NO: 6919645 - DNA, 22 bp, Homo sapiens
agggagcaaaggtttcagggtt

SEQ ID NO: 6919646 - DNA, 22 bp, Homo sapiens
ttgtattctttatgacttccct

SEQ ID NO: 6919647 - DNA, 22 bp, Homo sapiens
ttcctaacaaggggtattcatc

SEQ ID NO: 6919648 - DNA, 22 bp, Homo sapiens
aatgagaaccttgaaaggaact

SEQ ID NO: 6919649 - DNA, 22 bp, Homo sapiens
gcagcttggatttctgtagttt

SEQ ID NO: 6919650 - DNA, 22 bp, Homo sapiens
gcctgtttggaatctgtttaat

SEQ ID NO: 6919651 - DNA, 22 bp, Homo sapiens
tccctaggtcctagtcacagta

SEQ ID NO: 6919652 - DNA, 22 bp, Homo sapiens
gaatgacattgaaaagacattg

SEQ ID NO: 6919653 - DNA, 22 bp, Homo sapiens
acagtagaaacaggcaggcaga

SEQ ID NO: 6919654 - DNA, 22 bp, Homo sapiens
tctctatgacaaggtttggttg

SEQ ID NO: 6919655 - DNA, 23 bp, Homo sapiens
agtgaattcagtttaaaacagag

SEQ ID NO: 6919656 - DNA, 22 bp, Homo sapiens
cctgccaggctttgggcttctg

SEQ ID NO: 6919657 - DNA, 22 bp, Homo sapiens
tgtctcctgcaggggtgtgggc

SEQ ID NO: 6919658 - DNA, 22 bp, Homo sapiens
cagaccccgagtttgcagagtt

SEQ ID NO: 6919659 - DNA, 22 bp, Homo sapiens
tgtccagggatggggtcaggga

SEQ ID NO: 6919660 - DNA, 22 bp, Homo sapiens
ttgttaaagatgcagattccat

SEQ ID NO: 6919661 - DNA, 22 bp, Homo sapiens
gagcttccatggacgccatctg

SEQ ID NO: 6919662 - DNA, 22 bp, Homo sapiens
agtcagtggatttaccatgcgt

SEQ ID NO: 6919663 - DNA, 22 bp, Homo sapiens
tggaaggaaaggtagcagagaa

SEQ ID NO: 6919664 - DNA, 22 bp, Homo sapiens
tggctagaccgcggagccaaga

SEQ ID NO: 6919665 - DNA, 22 bp, Homo sapiens
cagtggttttcagctgggagtt

SEQ ID NO: 6919666 - DNA, 22 bp, Homo sapiens
gacaggtggggaaactaaggta

SEQ ID NO: 6919667 - DNA, 22 bp, Homo sapiens
ctgtagccagtttggcctcacc

SEQ ID NO: 6919668 - DNA, 22 bp, Homo sapiens
cctgcctgcaaaatgggacaag

SEQ ID NO: 6919669 - DNA, 22 bp, Homo sapiens
gctgctggcgctgggcgtccgg

SEQ ID NO: 6919670 - DNA, 22 bp, Homo sapiens
tcagtaaagtctctagagggta

SEQ ID NO: 6919671 - DNA, 22 bp, Homo sapiens
agttgactctcaagatcctgtt

SEQ ID NO: 6919672 - DNA, 22 bp, Homo sapiens
tgcctgtgcccttcttggcatt

SEQ ID NO: 6919673 - DNA, 21 bp, Homo sapiens
tgactttatattgtgtcagga

SEQ ID NO: 6919674 - DNA, 22 bp, Homo sapiens
ttgtcatcatgttttccaaagg

SEQ ID NO: 6919675 - DNA, 22 bp, Homo sapiens
cattcacagcaggtcagctgaa

SEQ ID NO: 6919676 - DNA, 22 bp, Homo sapiens
ggatgcaggaacacagcgacct

SEQ ID NO: 6919677 - DNA, 22 bp, Homo sapiens
aggtctcccaagggccagggag

SEQ ID NO: 6919678 - DNA, 22 bp, Homo sapiens
tgtggctgtgtccacctgctgc

SEQ ID NO: 6919679 - DNA, 22 bp, Homo sapiens
tgtgtactgagggtgaattcac

SEQ ID NO: 6919680 - DNA, 22 bp, Homo sapiens
ggtaacaaacttctgacttaag

SEQ ID NO: 6919681 - DNA, 22 bp, Homo sapiens
agctgcttataagatttgggag

SEQ ID NO: 6919682 - DNA, 18 bp, Homo sapiens
catgcagagggatctgtg

SEQ ID NO: 6919683 - DNA, 22 bp, Homo sapiens
tccttggcagcagggagcatga

SEQ ID NO: 6919684 - DNA, 22 bp, Homo sapiens
ggactctcaggctgtcggcttc

SEQ ID NO: 6919685 - DNA, 22 bp, Homo sapiens
ctgcattaagttgcctgtaaga

SEQ ID NO: 6919686 - DNA, 22 bp, Homo sapiens
catgtatacagtagaatactat

SEQ ID NO: 6919687 - DNA, 22 bp, Homo sapiens
cagaagaggactgggtagctca

SEQ ID NO: 6919688 - DNA, 22 bp, Homo sapiens
aatatttcgttgcgtggctaga

SEQ ID NO: 6919689 - DNA, 22 bp, Homo sapiens
ctgaggcaggagaattgctgga

SEQ ID NO: 6919690 - DNA, 22 bp, Homo sapiens
agagttgctccattagaactta

SEQ ID NO: 6919691 - DNA, 22 bp, Homo sapiens
cttggcagtttcggaaggatga

SEQ ID NO: 6919692 - DNA, 22 bp, Homo sapiens
ctggctcaggaaagttgctgct

SEQ ID NO: 6919693 - DNA, 22 bp, Homo sapiens
tctgtctgacagggtatgaact

SEQ ID NO: 6919694 - DNA, 22 bp, Homo sapiens
agactgtgagaagatggctgcg

SEQ ID NO: 6919695 - DNA, 22 bp, Homo sapiens
tagatcttgttacagatttcct

SEQ ID NO: 6919696 - DNA, 22 bp, Homo sapiens
aagttccctttctttgccagga

SEQ ID NO: 6919697 - DNA, 22 bp, Homo sapiens
aagaacatttatgatggcattt

SEQ ID NO: 6919698 - DNA, 22 bp, Homo sapiens
ctttgcattctcagcacagagc

SEQ ID NO: 6919699 - DNA, 22 bp, Homo sapiens
gtggcagcagaggggtggtatg

SEQ ID NO: 6919700 - DNA, 22 bp, Homo sapiens
ctgcccataaactttccacctg

SEQ ID NO: 6919701 - DNA, 22 bp, Homo sapiens
ttatttgctgatttcagtttca

SEQ ID NO: 6919702 - DNA, 22 bp, Homo sapiens
tctggctgaaattagaaggttc

SEQ ID NO: 6919703 - DNA, 22 bp, Homo sapiens
aggcactgtgctgatgtcttat

SEQ ID NO: 6919704 - DNA, 22 bp, Homo sapiens
gttctggaattgtctgaaatcc

SEQ ID NO: 6919705 - DNA, 22 bp, Homo sapiens
ggcagcatcacttgtctccagc

SEQ ID NO: 6919706 - DNA, 22 bp, Homo sapiens
agccacgtccctgtcagggtca

SEQ ID NO: 6919707 - DNA, 19 bp, Homo sapiens
ttggatgctaccaggtacc

SEQ ID NO: 6919708 - DNA, 22 bp, Homo sapiens
ctttatctgtgtcctcttgcct

SEQ ID NO: 6919709 - DNA, 22 bp, Homo sapiens
cttagggaatcttagagctgga

SEQ ID NO: 6919710 - DNA, 22 bp, Homo sapiens
tggaaggcaacggagtgagctg

SEQ ID NO: 6919711 - DNA, 22 bp, Homo sapiens
aaagactggaaggtgaggctgt

SEQ ID NO: 6919712 - DNA, 22 bp, Homo sapiens
actcgtgtcaagatcctaagtc

SEQ ID NO: 6919713 - DNA, 22 bp, Homo sapiens
ccacatttttgatactctcact

SEQ ID NO: 6919714 - DNA, 22 bp, Homo sapiens
atgacttttaaaagctggtact

SEQ ID NO: 6919715 - DNA, 22 bp, Homo sapiens
accagcctgtctgagtcgtggg

SEQ ID NO: 6919716 - DNA, 22 bp, Homo sapiens
atgaaatttgaccaattattta

SEQ ID NO: 6919717 - DNA, 22 bp, Homo sapiens
atgtggatttgggagtgatcag

SEQ ID NO: 6919718 - DNA, 22 bp, Homo sapiens
agaggcacccgcgcgcggccat

SEQ ID NO: 6919719 - DNA, 20 bp, Homo sapiens
agcagcagatgttggaggtg

SEQ ID NO: 6919720 - DNA, 22 bp, Homo sapiens
cagtaaatacatatcagagaag

SEQ ID NO: 6919721 - DNA, 22 bp, Homo sapiens
gtatttttcattccaagtgaga

SEQ ID NO: 6919722 - DNA, 22 bp, Homo sapiens
gcccatggtgaggttgttggtg

SEQ ID NO: 6919723 - DNA, 22 bp, Homo sapiens
catttctgtacatgttttggtg

SEQ ID NO: 6919724 - DNA, 22 bp, Homo sapiens
cctgtgtctgaccatgcacatg

SEQ ID NO: 6919725 - DNA, 22 bp, Homo sapiens
cccaggaaatcaggctttctag

SEQ ID NO: 6919726 - DNA, 17 bp, Homo sapiens
tgtggctttgactggga

SEQ ID NO: 6919727 - DNA, 22 bp, Homo sapiens
cagccctgagcaaggcttttaa

SEQ ID NO: 6919728 - DNA, 22 bp, Homo sapiens
tggtcctggaaggtcctgaggg

SEQ ID NO: 6919729 - DNA, 22 bp, Homo sapiens
ccagaggagcaggctggctcca

SEQ ID NO: 6919730 - DNA, 22 bp, Homo sapiens
tccttgaatataataacagtag

SEQ ID NO: 6919731 - DNA, 22 bp, Homo sapiens
attctgttacttggtgatcttc

SEQ ID NO: 6919732 - DNA, 22 bp, Homo sapiens
ggtgcagaagaaagcagtcatt

SEQ ID NO: 6919733 - DNA, 22 bp, Homo sapiens
atagtacacatcctacaatgtt

SEQ ID NO: 6919734 - DNA, 23 bp, Homo sapiens
ctttaatgaaattctctgtgaag

SEQ ID NO: 6919735 - DNA, 22 bp, Homo sapiens
ataggctggagtgcagtggcat

SEQ ID NO: 6919736 - DNA, 22 bp, Homo sapiens
cacaactgccatctgagcagca

SEQ ID NO: 6919737 - DNA, 22 bp, Homo sapiens
acttcacatttgcaagtcttgg

SEQ ID NO: 6919738 - DNA, 22 bp, Homo sapiens
tttctagaaagttcatgtgttt

SEQ ID NO: 6919739 - DNA, 18 bp, Homo sapiens
gcagtgccagcctctcct

SEQ ID NO: 6919740 - DNA, 22 bp, Homo sapiens
tctgtaggttaaaagtagacaa

SEQ ID NO: 6919741 - DNA, 22 bp, Homo sapiens
tcagcactgaatctggatttgc

SEQ ID NO: 6919742 - DNA, 22 bp, Homo sapiens
gaaggctttttgggtaattgta

SEQ ID NO: 6919743 - DNA, 22 bp, Homo sapiens
ctcttaaataacatcattgctt

SEQ ID NO: 6919744 - DNA, 22 bp, Homo sapiens
accagcctggccaacatggtga

SEQ ID NO: 6919745 - DNA, 22 bp, Homo sapiens
cagcttctagcatcggctttga

SEQ ID NO: 6919746 - DNA, 22 bp, Homo sapiens
cagaataagctgtgttgtcaag

SEQ ID NO: 6919747 - DNA, 21 bp, Homo sapiens
agcttacattaccattgttgc

SEQ ID NO: 6919748 - DNA, 22 bp, Homo sapiens
aataagttgcttcagcttggtg

SEQ ID NO: 6919749 - DNA, 22 bp, Homo sapiens
agggccagtattaaggtaatta

SEQ ID NO: 6919750 - DNA, 22 bp, Homo sapiens
aagcctgaacattactagttgt

SEQ ID NO: 6919751 - DNA, 18 bp, Homo sapiens
aataaagcaggatttctc

SEQ ID NO: 6919752 - DNA, 22 bp, Homo sapiens
ggtagccaggcatcccagatgc

SEQ ID NO: 6919753 - DNA, 22 bp, Homo sapiens
tatgtacaatttgttgtatgtc

SEQ ID NO: 6919754 - DNA, 17 bp, Homo sapiens
cccttagagcaaaagat

SEQ ID NO: 6919755 - DNA, 22 bp, Homo sapiens
tttctagatcaaacttttatat

SEQ ID NO: 6919756 - DNA, 22 bp, Homo sapiens
tggagagtctctgagccagggc

SEQ ID NO: 6919757 - DNA, 17 bp, Homo sapiens
tttgaaaggatgtcagt

SEQ ID NO: 6919758 - DNA, 22 bp, Homo sapiens
agttaaagtctgaaatagagaa

SEQ ID NO: 6919759 - DNA, 22 bp, Homo sapiens
caaagtatattggattgaatgg

SEQ ID NO: 6919760 - DNA, 22 bp, Homo sapiens
cctctcaaaagcacaacattga

SEQ ID NO: 6919761 - DNA, 22 bp, Homo sapiens
attaaggcacttgagcatgatg

SEQ ID NO: 6919762 - DNA, 22 bp, Homo sapiens
gggggagctacaggtcccttgg

SEQ ID NO: 6919763 - DNA, 20 bp, Homo sapiens
tgcatggcgcacatctgtgg

SEQ ID NO: 6919764 - DNA, 22 bp, Homo sapiens
tgaagacaagaaaacactgggg

SEQ ID NO: 6919765 - DNA, 22 bp, Homo sapiens
gagctgagacacactttggcaa

SEQ ID NO: 6919766 - DNA, 22 bp, Homo sapiens
ctctgcctcagtgatttcttta

SEQ ID NO: 6919767 - DNA, 22 bp, Homo sapiens
agggcacaggctccgggtccag

SEQ ID NO: 6919768 - DNA, 21 bp, Homo sapiens
ttacagaatccatgggaagtc

SEQ ID NO: 6919769 - DNA, 22 bp, Homo sapiens
tcttataatctctattttaatg

SEQ ID NO: 6919770 - DNA, 23 bp, Homo sapiens
catcagtgagggggaatcactaa

SEQ ID NO: 6919771 - DNA, 23 bp, Homo sapiens
aacacaaagctgattccagtggc

SEQ ID NO: 6919772 - DNA, 22 bp, Homo sapiens
gtgctctgtgtattaggatgtc

SEQ ID NO: 6919773 - DNA, 18 bp, Homo sapiens
tcagagagaatagtaatt

SEQ ID NO: 6919774 - DNA, 22 bp, Homo sapiens
gaagtttaggttcttatgttta

SEQ ID NO: 6919775 - DNA, 22 bp, Homo sapiens
gaccatctgtttaaagcagtgt

SEQ ID NO: 6919776 - DNA, 22 bp, Homo sapiens
gtgccatcattcaataaattca

SEQ ID NO: 6919777 - DNA, 22 bp, Homo sapiens
aaggttagtaatatttctatat

SEQ ID NO: 6919778 - DNA, 22 bp, Homo sapiens
gatccacagtttgatgatcata

SEQ ID NO: 6919779 - DNA, 22 bp, Homo sapiens
tgtctcttactttgattcttgg

SEQ ID NO: 6919780 - DNA, 22 bp, Homo sapiens
aagaacataaacagaaggacag

SEQ ID NO: 6919781 - DNA, 20 bp, Homo sapiens
gcttccaggagggctgatat

SEQ ID NO: 6919782 - DNA, 22 bp, Homo sapiens
acaagtaggtgcacttcaatag

SEQ ID NO: 6919783 - DNA, 22 bp, Homo sapiens
ggttcccggatctccgagtccc

SEQ ID NO: 6919784 - DNA, 22 bp, Homo sapiens
atggcagagggattgaacagct

SEQ ID NO: 6919785 - DNA, 23 bp, Homo sapiens
tgaattttggcatattctgaaat

SEQ ID NO: 6919786 - DNA, 16 bp, Homo sapiens
cagctttgtctcctcg

SEQ ID NO: 6919787 - DNA, 22 bp, Homo sapiens
aacaacagctgctaaagagttg

SEQ ID NO: 6919788 - DNA, 22 bp, Homo sapiens
taagaatctgcattttaacaag

SEQ ID NO: 6919789 - DNA, 22 bp, Homo sapiens
atggctgggttcttctataggt

SEQ ID NO: 6919790 - DNA, 19 bp, Homo sapiens
cctgggtccactcagacta

SEQ ID NO: 6919791 - DNA, 22 bp, Homo sapiens
tagggttgtaatttatgtatgg

SEQ ID NO: 6919792 - DNA, 22 bp, Homo sapiens
ttttcacattgtcccagcacta

SEQ ID NO: 6919793 - DNA, 22 bp, Homo sapiens
ctccagcttctgcccagagact

SEQ ID NO: 6919794 - DNA, 22 bp, Homo sapiens
tgtgtgggagcacgggctgttg

SEQ ID NO: 6919795 - DNA, 19 bp, Homo sapiens
atttggaaataaggtcttc

SEQ ID NO: 6919796 - DNA, 22 bp, Homo sapiens
gcgcgctgagtgtccgttgggg

SEQ ID NO: 6919797 - DNA, 22 bp, Homo sapiens
cagcagctgatggggaagtgat

SEQ ID NO: 6919798 - DNA, 22 bp, Homo sapiens
gctggttcacctggctcctccc

SEQ ID NO: 6919799 - DNA, 22 bp, Homo sapiens
gccattttctgtcttgtttatt

SEQ ID NO: 6919800 - DNA, 22 bp, Homo sapiens
gtcaacaattccagtttttact

SEQ ID NO: 6919801 - DNA, 19 bp, Homo sapiens
ctgagcagcggcagcactt

SEQ ID NO: 6919802 - DNA, 22 bp, Homo sapiens
tcccagagtattagcaattgct

SEQ ID NO: 6919803 - DNA, 22 bp, Homo sapiens
gggcttcttgagctgccggccc

SEQ ID NO: 6919804 - DNA, 22 bp, Homo sapiens
gtttttgtccatggaggcaaac

SEQ ID NO: 6919805 - DNA, 22 bp, Homo sapiens
ttgaagaaagtcatatataatg

SEQ ID NO: 6919806 - DNA, 22 bp, Homo sapiens
aacactggtttggcattagatg

SEQ ID NO: 6919807 - DNA, 22 bp, Homo sapiens
ctgcagagggtttgagcatcct

SEQ ID NO: 6919808 - DNA, 22 bp, Homo sapiens
aagatcctgtactttcctcact

SEQ ID NO: 6919809 - DNA, 20 bp, Homo sapiens
cacctctgaaagtttccagc

SEQ ID NO: 6919810 - DNA, 17 bp, Homo sapiens
tgtcatggctatggttg

SEQ ID NO: 6919811 - DNA, 22 bp, Homo sapiens
atctccagatgcctggaaatga

SEQ ID NO: 6919812 - DNA, 22 bp, Homo sapiens
ctattattaatgtggggctttg

SEQ ID NO: 6919813 - DNA, 22 bp, Homo sapiens
acattctgaaaaacagtgtttt

SEQ ID NO: 6919814 - DNA, 22 bp, Homo sapiens
ggcccagcgaggccacctacag

SEQ ID NO: 6919815 - DNA, 22 bp, Homo sapiens
aacacaggcatactggctccag

SEQ ID NO: 6919816 - DNA, 22 bp, Homo sapiens
tggatctgactggcttttcttc

SEQ ID NO: 6919817 - DNA, 22 bp, Homo sapiens
gtctgtccacttggaagctccc

SEQ ID NO: 6919818 - DNA, 18 bp, Homo sapiens
aatttccatatgaattgc

SEQ ID NO: 6919819 - DNA, 22 bp, Homo sapiens
ctgatcttaagtaacattattt

SEQ ID NO: 6919820 - DNA, 22 bp, Homo sapiens
tcagcagaaaggcactagatga

SEQ ID NO: 6919821 - DNA, 22 bp, Homo sapiens
attgcagtgtgtgttccatgag

SEQ ID NO: 6919822 - DNA, 22 bp, Homo sapiens
ttctcaaagtgtgctccctgga

SEQ ID NO: 6919823 - DNA, 22 bp, Homo sapiens
atgttgatggtgcagacacatt

SEQ ID NO: 6919824 - DNA, 22 bp, Homo sapiens
tggttacacaagtgtgtgcagt

SEQ ID NO: 6919825 - DNA, 22 bp, Homo sapiens
aggaaggcacattgttggctaa

SEQ ID NO: 6919826 - DNA, 22 bp, Homo sapiens
gcactgggaatgagggcagctt

SEQ ID NO: 6919827 - DNA, 22 bp, Homo sapiens
gagggctgaagattgtggcccc

SEQ ID NO: 6919828 - DNA, 22 bp, Homo sapiens
tctctggccccatggctgagct

SEQ ID NO: 6919829 - DNA, 22 bp, Homo sapiens
attctgccgctgccacttacta

SEQ ID NO: 6919830 - DNA, 22 bp, Homo sapiens
aaacagtgactggtacataata

SEQ ID NO: 6919831 - DNA, 23 bp, Homo sapiens
tgctggaatttgtaccctggcag

SEQ ID NO: 6919832 - DNA, 22 bp, Homo sapiens
ttcagaaaaagaccattgcaat

SEQ ID NO: 6919833 - DNA, 22 bp, Homo sapiens
aatgcataatggtttgtgacaa

SEQ ID NO: 6919834 - DNA, 22 bp, Homo sapiens
tacattcagaattgggaggcaa

SEQ ID NO: 6919835 - DNA, 22 bp, Homo sapiens
cggggaatcatggctgggcagt

SEQ ID NO: 6919836 - DNA, 22 bp, Homo sapiens
gggcatgcctgcgcagtgcatg

SEQ ID NO: 6919837 - DNA, 22 bp, Homo sapiens
ctcaagaagagggagacctaca

SEQ ID NO: 6919838 - DNA, 22 bp, Homo sapiens
ggttgacagatatacattgtag

SEQ ID NO: 6919839 - DNA, 22 bp, Homo sapiens
cagaagtaagattactgtgagt

SEQ ID NO: 6919840 - DNA, 22 bp, Homo sapiens
tgtgaatatttccttctttgga

SEQ ID NO: 6919841 - DNA, 22 bp, Homo sapiens
aactaaatctggcatttagagc

SEQ ID NO: 6919842 - DNA, 22 bp, Homo sapiens
tgatccctggacttgagtaagt

SEQ ID NO: 6919843 - DNA, 22 bp, Homo sapiens
agaggctcctagccactggctt

SEQ ID NO: 6919844 - DNA, 22 bp, Homo sapiens
tgcaggctggggaggcagactt

SEQ ID NO: 6919845 - DNA, 22 bp, Homo sapiens
caccactgaattgttcactttc

SEQ ID NO: 6919846 - DNA, 22 bp, Homo sapiens
tgagaaccaagaccaagggcct

SEQ ID NO: 6919847 - DNA, 22 bp, Homo sapiens
agggggtgaatgtctgtctaca

SEQ ID NO: 6919848 - DNA, 22 bp, Homo sapiens
ccagttaattgggtgggtctcg

SEQ ID NO: 6919849 - DNA, 21 bp, Homo sapiens
tcatgtaatgcatgaagtaaa

SEQ ID NO: 6919850 - DNA, 22 bp, Homo sapiens
tttggcagtgaagccctctcat

SEQ ID NO: 6919851 - DNA, 22 bp, Homo sapiens
tgagctgtggtggggtagagga

SEQ ID NO: 6919852 - DNA, 22 bp, Homo sapiens
accacaggaggatggctgctgg

SEQ ID NO: 6919853 - DNA, 22 bp, Homo sapiens
ctgtcagggggcctggccatca

SEQ ID NO: 6919854 - DNA, 22 bp, Homo sapiens
ttcaagtcttccatggtattct

SEQ ID NO: 6919855 - DNA, 22 bp, Homo sapiens
ttccacaatgtatgaataagat

SEQ ID NO: 6919856 - DNA, 22 bp, Homo sapiens
gcctgagattctgcatttctaa

SEQ ID NO: 6919857 - DNA, 22 bp, Homo sapiens
attcactggtgtcagggatcag

SEQ ID NO: 6919858 - DNA, 22 bp, Homo sapiens
aggggaaatctctcgccatctg

SEQ ID NO: 6919859 - DNA, 21 bp, Homo sapiens
gacatccatgtgagtggcagt

SEQ ID NO: 6919860 - DNA, 22 bp, Homo sapiens
tagcatttatggtcatgtgtcc

SEQ ID NO: 6919861 - DNA, 22 bp, Homo sapiens
tagttaatgctaattaacaaat

SEQ ID NO: 6919862 - DNA, 22 bp, Homo sapiens
tcagtttctacctactatgtgt

SEQ ID NO: 6919863 - DNA, 22 bp, Homo sapiens
acagtggggtcttaatagaaca

SEQ ID NO: 6919864 - DNA, 22 bp, Homo sapiens
ggctttgcagtcatgttttgct

SEQ ID NO: 6919865 - DNA, 22 bp, Homo sapiens
gctggctctttttgccgggctc

SEQ ID NO: 6919866 - DNA, 22 bp, Homo sapiens
tcctgagggctgcagtcatagg

SEQ ID NO: 6919867 - DNA, 22 bp, Homo sapiens
ctgaccatcatggtgaaacccc

SEQ ID NO: 6919868 - DNA, 22 bp, Homo sapiens
aggctctccagagagctgcttt

SEQ ID NO: 6919869 - DNA, 22 bp, Homo sapiens
aggtgtctggatgggtgtcctt

SEQ ID NO: 6919870 - DNA, 22 bp, Homo sapiens
taagtaaaacattcaagaagtc

SEQ ID NO: 6919871 - DNA, 17 bp, Homo sapiens
tctgaatttatactttg

SEQ ID NO: 6919872 - DNA, 22 bp, Homo sapiens
ttgttccaacctaatagatgat

SEQ ID NO: 6919873 - DNA, 22 bp, Homo sapiens
gtggctgctggtactctgggaa

SEQ ID NO: 6919874 - DNA, 22 bp, Homo sapiens
acaaagcacgagtgccatggac

SEQ ID NO: 6919875 - DNA, 22 bp, Homo sapiens
gaccctttcagaccctttagta

SEQ ID NO: 6919876 - DNA, 22 bp, Homo sapiens
ggatctttaagttcttttccat

SEQ ID NO: 6919877 - DNA, 22 bp, Homo sapiens
gctgcccacagcgggtgtttcg

SEQ ID NO: 6919878 - DNA, 22 bp, Homo sapiens
ttccttagggaaagggataagg

SEQ ID NO: 6919879 - DNA, 22 bp, Homo sapiens
attgctgcttcttgcatgaagt

SEQ ID NO: 6919880 - DNA, 22 bp, Homo sapiens
aacaggcaaactgtgggatccc

SEQ ID NO: 6919881 - DNA, 22 bp, Homo sapiens
cactaaatgtttcaatgtggga

SEQ ID NO: 6919882 - DNA, 22 bp, Homo sapiens
ctggtctggctacccagcgaat

SEQ ID NO: 6919883 - DNA, 22 bp, Homo sapiens
tattcaaagtaccttcattgcc

SEQ ID NO: 6919884 - DNA, 22 bp, Homo sapiens
atgaggcagctggctttctccc

SEQ ID NO: 6919885 - DNA, 22 bp, Homo sapiens
ctttctagtaggaagtagatca

SEQ ID NO: 6919886 - DNA, 22 bp, Homo sapiens
gccaaccattggcttcttgtca

SEQ ID NO: 6919887 - DNA, 22 bp, Homo sapiens
gcaggtggtggggctatgatct

SEQ ID NO: 6919888 - DNA, 22 bp, Homo sapiens
cttaataataggtgaggctatg

SEQ ID NO: 6919889 - DNA, 22 bp, Homo sapiens
gtggccagaagactgcaatgct

SEQ ID NO: 6919890 - DNA, 22 bp, Homo sapiens
ggcccagattagaagctgaatg

SEQ ID NO: 6919891 - DNA, 22 bp, Homo sapiens
agctccagttacttacctagag

SEQ ID NO: 6919892 - DNA, 22 bp, Homo sapiens
gtaattgactcagctctgttca

SEQ ID NO: 6919893 - DNA, 22 bp, Homo sapiens
tctggaaataaaattatagttg

SEQ ID NO: 6919894 - DNA, 22 bp, Homo sapiens
tcacaaggataagccacatata

SEQ ID NO: 6919895 - DNA, 22 bp, Homo sapiens
caggcactgtgttaggcactgt

SEQ ID NO: 6919896 - DNA, 22 bp, Homo sapiens
tggagggcgcttagatggaggg

SEQ ID NO: 6919897 - DNA, 22 bp, Homo sapiens
tcagttttctcatttatgagat

SEQ ID NO: 6919898 - DNA, 22 bp, Homo sapiens
atgagctgagtttgtaagtctt

SEQ ID NO: 6919899 - DNA, 17 bp, Homo sapiens
ttggcagtttggcggcc

SEQ ID NO: 6919900 - DNA, 22 bp, Homo sapiens
ttgtgaatagtgccgcaataaa

SEQ ID NO: 6919901 - DNA, 22 bp, Homo sapiens
tttcagagaggcttcaaatctt

SEQ ID NO: 6919902 - DNA, 22 bp, Homo sapiens
cattaaatcttccagacctcac

SEQ ID NO: 6919903 - DNA, 22 bp, Homo sapiens
ctgggaggacaacttggagctc

SEQ ID NO: 6919904 - DNA, 22 bp, Homo sapiens
agactttcttgacctagttaat

SEQ ID NO: 6919905 - DNA, 22 bp, Homo sapiens
atccatccactgatgtttctga

SEQ ID NO: 6919906 - DNA, 22 bp, Homo sapiens
tcgaatggcaaggaaagaggct

SEQ ID NO: 6919907 - DNA, 22 bp, Homo sapiens
ctcttacaagctcccgatataa

SEQ ID NO: 6919908 - DNA, 22 bp, Homo sapiens
aataaccttacttattacatgg

SEQ ID NO: 6919909 - DNA, 22 bp, Homo sapiens
agcaggggcagggttttgtgct

SEQ ID NO: 6919910 - DNA, 22 bp, Homo sapiens
aggtcagatgggagatgggatg

SEQ ID NO: 6919911 - DNA, 22 bp, Homo sapiens
ccctttaccacatgtgctgtcc

SEQ ID NO: 6919912 - DNA, 22 bp, Homo sapiens
tctggcttcacactgaagtttg

SEQ ID NO: 6919913 - DNA, 22 bp, Homo sapiens
aactttctttgcatctaagttt

SEQ ID NO: 6919914 - DNA, 22 bp, Homo sapiens
aggagatcagcttagggaaggt

SEQ ID NO: 6919915 - DNA, 22 bp, Homo sapiens
agctcctctagatctgccactt

SEQ ID NO: 6919916 - DNA, 22 bp, Homo sapiens
ttccttctagcccaagtattgg

SEQ ID NO: 6919917 - DNA, 22 bp, Homo sapiens
tattcatagtaaacaaaagtgg

SEQ ID NO: 6919918 - DNA, 22 bp, Homo sapiens
ggctggcacccttggggatagg

SEQ ID NO: 6919919 - DNA, 22 bp, Homo sapiens
actgtctggatggaagccagcg

SEQ ID NO: 6919920 - DNA, 22 bp, Homo sapiens
aaaattactattgttcctgggc

SEQ ID NO: 6919921 - DNA, 23 bp, Homo sapiens
gctgaggtcctgctgagtggtgg

SEQ ID NO: 6919922 - DNA, 22 bp, Homo sapiens
aacagctttagaggataatagt

SEQ ID NO: 6919923 - DNA, 22 bp, Homo sapiens
tgcagctgctggtggctgaaag

SEQ ID NO: 6919924 - DNA, 22 bp, Homo sapiens
catccttcatacgactgaccct

SEQ ID NO: 6919925 - DNA, 22 bp, Homo sapiens
atctaaagtgtcataagtagct

SEQ ID NO: 6919926 - DNA, 22 bp, Homo sapiens
tatgtcttaactctagaaaggt

SEQ ID NO: 6919927 - DNA, 22 bp, Homo sapiens
gagagctgtaatagtcatgtct

SEQ ID NO: 6919928 - DNA, 22 bp, Homo sapiens
aatgcacttagtatgaatgcct

SEQ ID NO: 6919929 - DNA, 22 bp, Homo sapiens
tgtgtacaggccttgctagact

SEQ ID NO: 6919930 - DNA, 22 bp, Homo sapiens
acatccttagggcagcagccag

SEQ ID NO: 6919931 - DNA, 22 bp, Homo sapiens
gaaaatttagaactgaacttct

SEQ ID NO: 6919932 - DNA, 22 bp, Homo sapiens
atgaagcgttcgagataggtag

SEQ ID NO: 6919933 - DNA, 22 bp, Homo sapiens
ttgtaagatggataggaacagc

SEQ ID NO: 6919934 - DNA, 22 bp, Homo sapiens
cttcagggcatattattggctc

SEQ ID NO: 6919935 - DNA, 22 bp, Homo sapiens
gccagcagcttcttctcatcct

SEQ ID NO: 6919936 - DNA, 22 bp, Homo sapiens
gggtccctggaattacttgaca

SEQ ID NO: 6919937 - DNA, 22 bp, Homo sapiens
agcatttgaaaactatttaatt

SEQ ID NO: 6919938 - DNA, 22 bp, Homo sapiens
cagcacctaggacagtagtcag

SEQ ID NO: 6919939 - DNA, 22 bp, Homo sapiens
gaagttatcaaagatgtattct

SEQ ID NO: 6919940 - DNA, 22 bp, Homo sapiens
ctgagggcctgaggacctagat

SEQ ID NO: 6919941 - DNA, 22 bp, Homo sapiens
aaagcttagcattttcaaaatg

SEQ ID NO: 6919942 - DNA, 23 bp, Homo sapiens
agctccaggtgattgtaatgtgt

SEQ ID NO: 6919943 - DNA, 22 bp, Homo sapiens
tgggtccagtgtcctggctatg

SEQ ID NO: 6919944 - DNA, 20 bp, Homo sapiens
aggtctcagagcaagagccc

SEQ ID NO: 6919945 - DNA, 22 bp, Homo sapiens
atggacacatgagttacgattg

SEQ ID NO: 6919946 - DNA, 22 bp, Homo sapiens
tctgcatggagaggagatgcta

SEQ ID NO: 6919947 - DNA, 22 bp, Homo sapiens
tgtcaagttgtggcatgtctaa

SEQ ID NO: 6919948 - DNA, 22 bp, Homo sapiens
aaggaactttgcagaggtgatt

SEQ ID NO: 6919949 - DNA, 22 bp, Homo sapiens
gaccttgggcacagcacagctt

SEQ ID NO: 6919950 - DNA, 23 bp, Homo sapiens
gtgccgacgctccagcaccatcc

SEQ ID NO: 6919951 - DNA, 21 bp, Homo sapiens
atgcatggatttcagtgagag

SEQ ID NO: 6919952 - DNA, 22 bp, Homo sapiens
aatgctaaaatggcactaaagt

SEQ ID NO: 6919953 - DNA, 22 bp, Homo sapiens
ctgtattaaaggcagtgatctt

SEQ ID NO: 6919954 - DNA, 22 bp, Homo sapiens
ttctcagggttggcctcaaatc

SEQ ID NO: 6919955 - DNA, 22 bp, Homo sapiens
catagttttaggtagaaactgg

SEQ ID NO: 6919956 - DNA, 22 bp, Homo sapiens
ccagcctccatgtagatagctg

SEQ ID NO: 6919957 - DNA, 22 bp, Homo sapiens
atgtgcttcaggatgtcagtgt

SEQ ID NO: 6919958 - DNA, 22 bp, Homo sapiens
caatgtttgtgatctactgact

SEQ ID NO: 6919959 - DNA, 22 bp, Homo sapiens
cagaaacaggcaacgtgtgcac

SEQ ID NO: 6919960 - DNA, 22 bp, Homo sapiens
atgaaggatagggcaaaatttt

SEQ ID NO: 6919961 - DNA, 20 bp, Homo sapiens
caggaggcaaggtcaaggtc

SEQ ID NO: 6919962 - DNA, 22 bp, Homo sapiens
acatatgtctatttcatgtaaa

SEQ ID NO: 6919963 - DNA, 22 bp, Homo sapiens
tggtggctgctccctgccttga

SEQ ID NO: 6919964 - DNA, 20 bp, Homo sapiens
cactgtggcacattggttta

SEQ ID NO: 6919965 - DNA, 22 bp, Homo sapiens
taaactacttccatctagagat

SEQ ID NO: 6919966 - DNA, 22 bp, Homo sapiens
agaaagcccaggagaacagatt

SEQ ID NO: 6919967 - DNA, 22 bp, Homo sapiens
ttcattcattacgtgccaggca

SEQ ID NO: 6919968 - DNA, 22 bp, Homo sapiens
acaggtgtctaaggcagacagc

SEQ ID NO: 6919969 - DNA, 22 bp, Homo sapiens
aagtcaggcttctcccagagcc

SEQ ID NO: 6919970 - DNA, 17 bp, Homo sapiens
tgggatccgtctctgtg

SEQ ID NO: 6919971 - DNA, 22 bp, Homo sapiens
tttctttaattctcacagcaat

SEQ ID NO: 6919972 - DNA, 22 bp, Homo sapiens
gttgaaaatacagattcctagg

SEQ ID NO: 6919973 - DNA, 22 bp, Homo sapiens
ttgcaagttttacttacctgga

SEQ ID NO: 6919974 - DNA, 22 bp, Homo sapiens
agccggcaataggaaaggagag

SEQ ID NO: 6919975 - DNA, 22 bp, Homo sapiens
tatctattccaaatatcagcgt

SEQ ID NO: 6919976 - DNA, 22 bp, Homo sapiens
ttcaggatccccaccgcgttta

SEQ ID NO: 6919977 - DNA, 22 bp, Homo sapiens
ggcttaagaaatgtctagtttt

SEQ ID NO: 6919978 - DNA, 22 bp, Homo sapiens
caggaatgaggtcgtaagtgtc

SEQ ID NO: 6919979 - DNA, 22 bp, Homo sapiens
ttcaaatctctcctaatccact

SEQ ID NO: 6919980 - DNA, 22 bp, Homo sapiens
ttgtcatatttataaaatgtaa

SEQ ID NO: 6919981 - DNA, 19 bp, Homo sapiens
gtcttacaggcaacatgag

SEQ ID NO: 6919982 - DNA, 22 bp, Homo sapiens
gtatttgacaccagtgaatggt

SEQ ID NO: 6919983 - DNA, 23 bp, Homo sapiens
gggcagcttaagcttgtttttct

SEQ ID NO: 6919984 - DNA, 22 bp, Homo sapiens
tttgcaaacggccctgagtccc

SEQ ID NO: 6919985 - DNA, 22 bp, Homo sapiens
agagctaagaaacagaattgct

SEQ ID NO: 6919986 - DNA, 22 bp, Homo sapiens
cacattgtaggtctcagctctt

SEQ ID NO: 6919987 - DNA, 22 bp, Homo sapiens
gtatttctagaaaatgcagatt

SEQ ID NO: 6919988 - DNA, 22 bp, Homo sapiens
gatattctatgtagaatgagct

SEQ ID NO: 6919989 - DNA, 19 bp, Homo sapiens
ttctccaggctgcagaggg

SEQ ID NO: 6919990 - DNA, 22 bp, Homo sapiens
aggaggtgacagcctgcatctg

SEQ ID NO: 6919991 - DNA, 22 bp, Homo sapiens
ggcttatgggctacggtttgct

SEQ ID NO: 6919992 - DNA, 22 bp, Homo sapiens
ctcataaacaattctttgaggt

SEQ ID NO: 6919993 - DNA, 22 bp, Homo sapiens
ttaacctaaagaaggatgtgtg

SEQ ID NO: 6919994 - DNA, 20 bp, Homo sapiens
tcactgtaattgcctacatt

SEQ ID NO: 6919995 - DNA, 18 bp, Homo sapiens
tggcaggggcagtacgcc

SEQ ID NO: 6919996 - DNA, 22 bp, Homo sapiens
caggaagaagggtggtgagtcc

SEQ ID NO: 6919997 - DNA, 22 bp, Homo sapiens
gctcctgggtgtggctgcccct

SEQ ID NO: 6919998 - DNA, 22 bp, Homo sapiens
actgataagttgcttgctctca

SEQ ID NO: 6919999 - DNA, 22 bp, Homo sapiens
ttaaggatgttgtgatttatta

SEQ ID NO: 6920000 - DNA, 22 bp, Homo sapiens
tgcattatttgcatgtgcctgt

SEQ ID NO: 6920001 - DNA, 22 bp, Homo sapiens
tgtatagatgaggaagctgtta

SEQ ID NO: 6920002 - DNA, 22 bp, Homo sapiens
tgggttctagagggaccagaac

SEQ ID NO: 6920003 - DNA, 22 bp, Homo sapiens
cagtgctggtgtaggctgacca

SEQ ID NO: 6920004 - DNA, 23 bp, Homo sapiens
gctgcctcctacaaaagcccagc

SEQ ID NO: 6920005 - DNA, 22 bp, Homo sapiens
gactccagtgattgtcctgtct

SEQ ID NO: 6920006 - DNA, 22 bp, Homo sapiens
aggctctgttattctagagggc

SEQ ID NO: 6920007 - DNA, 22 bp, Homo sapiens
gtttcttaccacttggacctct

SEQ ID NO: 6920008 - DNA, 22 bp, Homo sapiens
ctggccaagcttctctaagcag

SEQ ID NO: 6920009 - DNA, 22 bp, Homo sapiens
ggtggggctcagcaatctgtgt

SEQ ID NO: 6920010 - DNA, 22 bp, Homo sapiens
tgggttaacagtttataccaga

SEQ ID NO: 6920011 - DNA, 21 bp, Homo sapiens
ccaagactcccatctagtggt

SEQ ID NO: 6920012 - DNA, 22 bp, Homo sapiens
tgctccctgacccaggtcttct

SEQ ID NO: 6920013 - DNA, 22 bp, Homo sapiens
ctagatttgcatgcctacacca

SEQ ID NO: 6920014 - DNA, 22 bp, Homo sapiens
ttacaactgaagctaatgtgct

SEQ ID NO: 6920015 - DNA, 22 bp, Homo sapiens
gaggctctggagtaggtacaca

SEQ ID NO: 6920016 - DNA, 22 bp, Homo sapiens
agcagccatttaaaatgaattg

SEQ ID NO: 6920017 - DNA, 22 bp, Homo sapiens
gggcaggaacaaatcaaatgat

SEQ ID NO: 6920018 - DNA, 22 bp, Homo sapiens
aataacttgtatggttattcca

SEQ ID NO: 6920019 - DNA, 22 bp, Homo sapiens
ttccagagaggctcatgttccc

SEQ ID NO: 6920020 - DNA, 22 bp, Homo sapiens
tcttgcattgctcattgtgcca

SEQ ID NO: 6920021 - DNA, 22 bp, Homo sapiens
ccaatgcattgaattaggtttt

SEQ ID NO: 6920022 - DNA, 22 bp, Homo sapiens
taatgcaattttctcagtccat

SEQ ID NO: 6920023 - DNA, 23 bp, Homo sapiens
ctgcagagaactgagggacagcc

SEQ ID NO: 6920024 - DNA, 22 bp, Homo sapiens
gatctttatactgtaataatga

SEQ ID NO: 6920025 - DNA, 22 bp, Homo sapiens
tccagcatatatagagaatgag

SEQ ID NO: 6920026 - DNA, 22 bp, Homo sapiens
ttaccacaaaacagttagaagt

SEQ ID NO: 6920027 - DNA, 20 bp, Homo sapiens
cagcacagagcttggctcta

SEQ ID NO: 6920028 - DNA, 22 bp, Homo sapiens
attctgctagtaacagatgaag

SEQ ID NO: 6920029 - DNA, 22 bp, Homo sapiens
gaacacaactcagaatgctggt

SEQ ID NO: 6920030 - DNA, 22 bp, Homo sapiens
ttcctttgggaaatcactaagg

SEQ ID NO: 6920031 - DNA, 22 bp, Homo sapiens
ccctggggagcaggcgaaggag

SEQ ID NO: 6920032 - DNA, 22 bp, Homo sapiens
aatcctactccaggagattctg

SEQ ID NO: 6920033 - DNA, 22 bp, Homo sapiens
ggggactgaggcactgaaggtg

SEQ ID NO: 6920034 - DNA, 22 bp, Homo sapiens
aggatttgttgagttttagtgg

SEQ ID NO: 6920035 - DNA, 19 bp, Homo sapiens
tacagtgaaccaggaggag

SEQ ID NO: 6920036 - DNA, 22 bp, Homo sapiens
ggcagcatttagagcacagtgt

SEQ ID NO: 6920037 - DNA, 22 bp, Homo sapiens
atttacagaagcatgtaatagc

SEQ ID NO: 6920038 - DNA, 22 bp, Homo sapiens
cagttcctggttccattcttct

SEQ ID NO: 6920039 - DNA, 22 bp, Homo sapiens
gcaggtgtcttcagcaggatga

SEQ ID NO: 6920040 - DNA, 22 bp, Homo sapiens
gcactagtcaagtgaacaattt

SEQ ID NO: 6920041 - DNA, 22 bp, Homo sapiens
ctttggaagtgatagatatgat

SEQ ID NO: 6920042 - DNA, 18 bp, Homo sapiens
ccctctcctgctagtggg

SEQ ID NO: 6920043 - DNA, 22 bp, Homo sapiens
tatgatctttataacctatctt

SEQ ID NO: 6920044 - DNA, 22 bp, Homo sapiens
agtccctggattgtctctgtca

SEQ ID NO: 6920045 - DNA, 22 bp, Homo sapiens
aatcagaggaagtcaacggatc

SEQ ID NO: 6920046 - DNA, 22 bp, Homo sapiens
ggctcctggcaatgtaacttta

SEQ ID NO: 6920047 - DNA, 22 bp, Homo sapiens
actcatctgactggtgggaatg

SEQ ID NO: 6920048 - DNA, 22 bp, Homo sapiens
gtttcttaaaagaggagttaga

SEQ ID NO: 6920049 - DNA, 22 bp, Homo sapiens
tacagaaatcacatcgctttga

SEQ ID NO: 6920050 - DNA, 22 bp, Homo sapiens
tacttttctataggtttgaaat

SEQ ID NO: 6920051 - DNA, 18 bp, Homo sapiens
gatggccatttcaatgtt

SEQ ID NO: 6920052 - DNA, 22 bp, Homo sapiens
ccagaccctgctctggggctct

SEQ ID NO: 6920053 - DNA, 22 bp, Homo sapiens
gcatattagtaatctttcaaca

SEQ ID NO: 6920054 - DNA, 22 bp, Homo sapiens
gaccagctctctgaagaaagag

SEQ ID NO: 6920055 - DNA, 22 bp, Homo sapiens
ccagcttcatgggcatgcacca

SEQ ID NO: 6920056 - DNA, 22 bp, Homo sapiens
acacccttgtccatagcagatg

SEQ ID NO: 6920057 - DNA, 22 bp, Homo sapiens
ttccaggatgctgctgcttttt

SEQ ID NO: 6920058 - DNA, 22 bp, Homo sapiens
gggcatggtggtgcacacctgt

SEQ ID NO: 6920059 - DNA, 22 bp, Homo sapiens
ctggctgtatgctggcctcaga

SEQ ID NO: 6920060 - DNA, 22 bp, Homo sapiens
aacttaaacccactcatgtaga

SEQ ID NO: 6920061 - DNA, 19 bp, Homo sapiens
gtgaagtgccagaagtcag

SEQ ID NO: 6920062 - DNA, 20 bp, Homo sapiens
aaagtgtaagcatataatta

SEQ ID NO: 6920063 - DNA, 22 bp, Homo sapiens
atgtatactaacacatgcagtt

SEQ ID NO: 6920064 - DNA, 22 bp, Homo sapiens
gtttcttttgtgatcaccaacc

SEQ ID NO: 6920065 - DNA, 18 bp, Homo sapiens
acctggaattgatagaca

SEQ ID NO: 6920066 - DNA, 20 bp, Homo sapiens
tcctgagacctgggaaggtt

SEQ ID NO: 6920067 - DNA, 22 bp, Homo sapiens
ggctcactgcaaactgtgcctc

SEQ ID NO: 6920068 - DNA, 22 bp, Homo sapiens
tggtcagtacctggtcaccata

SEQ ID NO: 6920069 - DNA, 22 bp, Homo sapiens
ctggacatcagtgtgcctggct

SEQ ID NO: 6920070 - DNA, 18 bp, Homo sapiens
tgttccaaggaaggaatc

SEQ ID NO: 6920071 - DNA, 22 bp, Homo sapiens
agtctgtctacttaaagtctgt

SEQ ID NO: 6920072 - DNA, 22 bp, Homo sapiens
ttgcttgcctgttaggagaaac

SEQ ID NO: 6920073 - DNA, 22 bp, Homo sapiens
agctgcaaaggcacacttgggc

SEQ ID NO: 6920074 - DNA, 22 bp, Homo sapiens
ttccttctaatattctgcctgt

SEQ ID NO: 6920075 - DNA, 22 bp, Homo sapiens
ccatttgtgatgtggcagcatc

SEQ ID NO: 6920076 - DNA, 22 bp, Homo sapiens
actttgcaaggtactaactgta

SEQ ID NO: 6920077 - DNA, 22 bp, Homo sapiens
actgaaaaagacatcttggtaa

SEQ ID NO: 6920078 - DNA, 22 bp, Homo sapiens
ctacttctgtgatgaaactaca

SEQ ID NO: 6920079 - DNA, 22 bp, Homo sapiens
ttccagggcagcaagtgaatgg

SEQ ID NO: 6920080 - DNA, 22 bp, Homo sapiens
ccgaggctggagtgcagtggcg

SEQ ID NO: 6920081 - DNA, 22 bp, Homo sapiens
ctgggatgcggaggttgcggtg

SEQ ID NO: 6920082 - DNA, 22 bp, Homo sapiens
agacactgccacttctgttccc

SEQ ID NO: 6920083 - DNA, 19 bp, Homo sapiens
catctggatgattctcctg

SEQ ID NO: 6920084 - DNA, 22 bp, Homo sapiens
atcttctactttgccaatcagg

SEQ ID NO: 6920085 - DNA, 22 bp, Homo sapiens
tcatgcttattgcatatttgga

SEQ ID NO: 6920086 - DNA, 20 bp, Homo sapiens
tggagggattgttggcaaat

SEQ ID NO: 6920087 - DNA, 22 bp, Homo sapiens
tttgttgtcatcagtgatgagt

SEQ ID NO: 6920088 - DNA, 22 bp, Homo sapiens
caaggaaaaagcgagctcgggg

SEQ ID NO: 6920089 - DNA, 22 bp, Homo sapiens
tgaaacttataagaatatgaat

SEQ ID NO: 6920090 - DNA, 22 bp, Homo sapiens
acaagcctaacataacataagt

SEQ ID NO: 6920091 - DNA, 22 bp, Homo sapiens
aatcagacagttctggattcaa

SEQ ID NO: 6920092 - DNA, 22 bp, Homo sapiens
aatgagattccaatagctcctg

SEQ ID NO: 6920093 - DNA, 22 bp, Homo sapiens
gaagccagcatccctctcccat

SEQ ID NO: 6920094 - DNA, 22 bp, Homo sapiens
aaattgcaggtaggtgggtgat

SEQ ID NO: 6920095 - DNA, 22 bp, Homo sapiens
agctgtatgcccaagatgctat

SEQ ID NO: 6920096 - DNA, 22 bp, Homo sapiens
ctcacccagaggctttccccct

SEQ ID NO: 6920097 - DNA, 22 bp, Homo sapiens
atctgtgatcaagacagacagt

SEQ ID NO: 6920098 - DNA, 22 bp, Homo sapiens
aggccaaaccggatggaaaagg

SEQ ID NO: 6920099 - DNA, 22 bp, Homo sapiens
tctctttaaaaatagtgaaata

SEQ ID NO: 6920100 - DNA, 22 bp, Homo sapiens
ttgacagctacggagcagctgt

SEQ ID NO: 6920101 - DNA, 22 bp, Homo sapiens
tcctggagccaggacccttccc

SEQ ID NO: 6920102 - DNA, 22 bp, Homo sapiens
cagaatgggaaggactgcagtt

SEQ ID NO: 6920103 - DNA, 22 bp, Homo sapiens
tgcatggataaaagtatattat

SEQ ID NO: 6920104 - DNA, 22 bp, Homo sapiens
ccctgctagttgtctcagtgat

SEQ ID NO: 6920105 - DNA, 22 bp, Homo sapiens
cagaaataaacttctcacatcg

SEQ ID NO: 6920106 - DNA, 22 bp, Homo sapiens
gtggcactggggtctagctggc

SEQ ID NO: 6920107 - DNA, 22 bp, Homo sapiens
agcagggctggggcacgagcca

SEQ ID NO: 6920108 - DNA, 22 bp, Homo sapiens
ttctgggtagtatggttagttt

SEQ ID NO: 6920109 - DNA, 22 bp, Homo sapiens
ttcaaaacagctagatattgga

SEQ ID NO: 6920110 - DNA, 22 bp, Homo sapiens
gtcataaaaggaccacctattg

SEQ ID NO: 6920111 - DNA, 22 bp, Homo sapiens
atttgaaaacctgagcctcccg

SEQ ID NO: 6920112 - DNA, 22 bp, Homo sapiens
atttactgaagggtaggttgtt

SEQ ID NO: 6920113 - DNA, 22 bp, Homo sapiens
gtgctgcctccatatccgtcag

SEQ ID NO: 6920114 - DNA, 22 bp, Homo sapiens
tcagcatatcttgagcttcatg

SEQ ID NO: 6920115 - DNA, 22 bp, Homo sapiens
attaaggaagcctattctctcc

SEQ ID NO: 6920116 - DNA, 22 bp, Homo sapiens
atttcgggtgtgtgcatgtgag

SEQ ID NO: 6920117 - DNA, 23 bp, Homo sapiens
ttgcattaatgtggaggcacagg

SEQ ID NO: 6920118 - DNA, 22 bp, Homo sapiens
aggtagggggtttgggaactgc

SEQ ID NO: 6920119 - DNA, 19 bp, Homo sapiens
actctgttgtacttgaggg

SEQ ID NO: 6920120 - DNA, 22 bp, Homo sapiens
attcaggagtgtgccaggaagg

SEQ ID NO: 6920121 - DNA, 22 bp, Homo sapiens
caggagctcagatgacatctca

SEQ ID NO: 6920122 - DNA, 22 bp, Homo sapiens
gtgtttcctcacttctctgact

SEQ ID NO: 6920123 - DNA, 22 bp, Homo sapiens
tgaggccatgcccgtgccggcc

SEQ ID NO: 6920124 - DNA, 22 bp, Homo sapiens
gacctcgtgatctgccagcctt

SEQ ID NO: 6920125 - DNA, 22 bp, Homo sapiens
gcctgctgttgagggaagagct

SEQ ID NO: 6920126 - DNA, 22 bp, Homo sapiens
ctgattagagtgttaatgagga

SEQ ID NO: 6920127 - DNA, 22 bp, Homo sapiens
gcagctttgtaaagtatgaagc

SEQ ID NO: 6920128 - DNA, 22 bp, Homo sapiens
aagagctgttgtctgcttactg

SEQ ID NO: 6920129 - DNA, 22 bp, Homo sapiens
actgatcacatagatatattcc

SEQ ID NO: 6920130 - DNA, 22 bp, Homo sapiens
gtgctagggacaaagcagtgaa

SEQ ID NO: 6920131 - DNA, 21 bp, Homo sapiens
acatacataccttaccacctt

SEQ ID NO: 6920132 - DNA, 22 bp, Homo sapiens
aaacaagagcttacatggctgc

SEQ ID NO: 6920133 - DNA, 18 bp, Homo sapiens
tatctttgagtcctctgc

SEQ ID NO: 6920134 - DNA, 22 bp, Homo sapiens
tgccagtgcctgctgcccaata

SEQ ID NO: 6920135 - DNA, 22 bp, Homo sapiens
cactggcttgatgggtaatgcc

SEQ ID NO: 6920136 - DNA, 22 bp, Homo sapiens
accctttaggttggatgaggat

SEQ ID NO: 6920137 - DNA, 22 bp, Homo sapiens
ttactggctgggcctgagggct

SEQ ID NO: 6920138 - DNA, 22 bp, Homo sapiens
ttgagggagaaagctgaggtgt

SEQ ID NO: 6920139 - DNA, 22 bp, Homo sapiens
tagggctgctgcagatgacagg

SEQ ID NO: 6920140 - DNA, 22 bp, Homo sapiens
gaatgcagggctcctaagattc

SEQ ID NO: 6920141 - DNA, 22 bp, Homo sapiens
tggttgcattaactgagagggg

SEQ ID NO: 6920142 - DNA, 22 bp, Homo sapiens
ccagagactggctgagagatct

SEQ ID NO: 6920143 - DNA, 22 bp, Homo sapiens
tgggcatgaagaaggaagtggg

SEQ ID NO: 6920144 - DNA, 15 bp, Homo sapiens
caggagaggaaggtt

SEQ ID NO: 6920145 - DNA, 22 bp, Homo sapiens
aagatttaccactttattcaag

SEQ ID NO: 6920146 - DNA, 22 bp, Homo sapiens
atttacagtgtgcctactatat

SEQ ID NO: 6920147 - DNA, 22 bp, Homo sapiens
cctgtgctgggaaaacacggag

SEQ ID NO: 6920148 - DNA, 22 bp, Homo sapiens
taaatcacattcgtctgctcct

SEQ ID NO: 6920149 - DNA, 22 bp, Homo sapiens
tagcaaggtgaagtatgggtga

SEQ ID NO: 6920150 - DNA, 22 bp, Homo sapiens
ctgaggtacgctggctccctgg

SEQ ID NO: 6920151 - DNA, 22 bp, Homo sapiens
tgcaaagccaccctggcggtgg

SEQ ID NO: 6920152 - DNA, 22 bp, Homo sapiens
aaaggtaactggggttttgcca

SEQ ID NO: 6920153 - DNA, 22 bp, Homo sapiens
cagggcagggagcttagaatga

SEQ ID NO: 6920154 - DNA, 22 bp, Homo sapiens
tcttaaagttcttggtaactgc

SEQ ID NO: 6920155 - DNA, 22 bp, Homo sapiens
atcagaaatctaggattcagaa

SEQ ID NO: 6920156 - DNA, 22 bp, Homo sapiens
ctgaagaggacgcagcagcaag

SEQ ID NO: 6920157 - DNA, 23 bp, Homo sapiens
tcagtgcaaaaataggattttgg

SEQ ID NO: 6920158 - DNA, 22 bp, Homo sapiens
acagtcagacagttaataacct

SEQ ID NO: 6920159 - DNA, 22 bp, Homo sapiens
tgattgtataggggttattaat

SEQ ID NO: 6920160 - DNA, 22 bp, Homo sapiens
gttcttgagtcagactattttg

SEQ ID NO: 6920161 - DNA, 22 bp, Homo sapiens
gaacttggaactggggctactg

SEQ ID NO: 6920162 - DNA, 22 bp, Homo sapiens
tgtgggtgttctcacttagata

SEQ ID NO: 6920163 - DNA, 22 bp, Homo sapiens
tgtcttacatgagtcaccccaa

SEQ ID NO: 6920164 - DNA, 22 bp, Homo sapiens
ggtgaagctctaccattcccag

SEQ ID NO: 6920165 - DNA, 22 bp, Homo sapiens
actgaggggttggagagtgagg

SEQ ID NO: 6920166 - DNA, 22 bp, Homo sapiens
tcacaagaatttgtagatgaaa

SEQ ID NO: 6920167 - DNA, 22 bp, Homo sapiens
tagcatggctgtggtttcttct

SEQ ID NO: 6920168 - DNA, 19 bp, Homo sapiens
gtacaacaatgctgagcat

SEQ ID NO: 6920169 - DNA, 22 bp, Homo sapiens
gccagctgtatctttggccagc

SEQ ID NO: 6920170 - DNA, 21 bp, Homo sapiens
cagaagtaagggtaacttctc

SEQ ID NO: 6920171 - DNA, 20 bp, Homo sapiens
tggcttcataatggtttctg

SEQ ID NO: 6920172 - DNA, 22 bp, Homo sapiens
accattgccccctagtgtctgt

SEQ ID NO: 6920173 - DNA, 22 bp, Homo sapiens
agttcaggcataaggcatgaac

SEQ ID NO: 6920174 - DNA, 22 bp, Homo sapiens
atgcttctgtaatgtgggaatg

SEQ ID NO: 6920175 - DNA, 22 bp, Homo sapiens
aggttattgctctccaagttca

SEQ ID NO: 6920176 - DNA, 19 bp, Homo sapiens
ttaggaaaccactttcctt

SEQ ID NO: 6920177 - DNA, 22 bp, Homo sapiens
cagaacagtacctagcacatag

SEQ ID NO: 6920178 - DNA, 22 bp, Homo sapiens
attccttgctctcatcaacctt

SEQ ID NO: 6920179 - DNA, 22 bp, Homo sapiens
aggaccatgcagtcatcaccaa

SEQ ID NO: 6920180 - DNA, 22 bp, Homo sapiens
ctgcagggcccaaggtcaacgg

SEQ ID NO: 6920181 - DNA, 22 bp, Homo sapiens
tcagtaacttcatgaccaagca

SEQ ID NO: 6920182 - DNA, 22 bp, Homo sapiens
aggcctctgttccccatgtttt

SEQ ID NO: 6920183 - DNA, 22 bp, Homo sapiens
atacatatatggtacttcctgg

SEQ ID NO: 6920184 - DNA, 22 bp, Homo sapiens
tggcacatggtaagactcagta

SEQ ID NO: 6920185 - DNA, 22 bp, Homo sapiens
ttgtaaactgttaaaagccaga

SEQ ID NO: 6920186 - DNA, 22 bp, Homo sapiens
aatttggaagatgttgtttatc

SEQ ID NO: 6920187 - DNA, 22 bp, Homo sapiens
tttcaacttgtttgcttccata

SEQ ID NO: 6920188 - DNA, 22 bp, Homo sapiens
tcaaagtcatggctagtaatga

SEQ ID NO: 6920189 - DNA, 22 bp, Homo sapiens
ccaaggcttcccagagatgctc

SEQ ID NO: 6920190 - DNA, 22 bp, Homo sapiens
gcttttggacctctgatgtttc

SEQ ID NO: 6920191 - DNA, 22 bp, Homo sapiens
tatcattatacagacgtataca

SEQ ID NO: 6920192 - DNA, 22 bp, Homo sapiens
gttgctctgggaaatggattca

SEQ ID NO: 6920193 - DNA, 22 bp, Homo sapiens
ttgagcacattccctttcatgg

SEQ ID NO: 6920194 - DNA, 22 bp, Homo sapiens
tgttaaacctagtacaggtcct

SEQ ID NO: 6920195 - DNA, 22 bp, Homo sapiens
ggtgcaaaaataattgcggttt

SEQ ID NO: 6920196 - DNA, 22 bp, Homo sapiens
aggttcccaggatctgtctggg

SEQ ID NO: 6920197 - DNA, 22 bp, Homo sapiens
tccatgtttcagcatctacatc

SEQ ID NO: 6920198 - DNA, 21 bp, Homo sapiens
aagcagggactgcccaggtcc

SEQ ID NO: 6920199 - DNA, 22 bp, Homo sapiens
gataatgtaattttatgttcac

SEQ ID NO: 6920200 - DNA, 22 bp, Homo sapiens
taggtttaggagtgaaggtgaa

SEQ ID NO: 6920201 - DNA, 22 bp, Homo sapiens
atagcaaagtgcaggggcagca

SEQ ID NO: 6920202 - DNA, 22 bp, Homo sapiens
atagctgtgggctatttgtggg

SEQ ID NO: 6920203 - DNA, 22 bp, Homo sapiens
acagtctaggtgtgtgatttaa

SEQ ID NO: 6920204 - DNA, 22 bp, Homo sapiens
agtctggtagaggaagaggcct

SEQ ID NO: 6920205 - DNA, 22 bp, Homo sapiens
tggcatgtgtgtgtaggataca

SEQ ID NO: 6920206 - DNA, 22 bp, Homo sapiens
cattgcactccagcctgggtga

SEQ ID NO: 6920207 - DNA, 22 bp, Homo sapiens
ctggctaaagagcaagaagatg

SEQ ID NO: 6920208 - DNA, 21 bp, Homo sapiens
ccacagttctggcaagggctg

SEQ ID NO: 6920209 - DNA, 22 bp, Homo sapiens
aaggcacttaacgtgggaggat

SEQ ID NO: 6920210 - DNA, 22 bp, Homo sapiens
aattaatggaaagtaaggaagg

SEQ ID NO: 6920211 - DNA, 22 bp, Homo sapiens
tattacagaatcaggcataact

SEQ ID NO: 6920212 - DNA, 22 bp, Homo sapiens
ttccaaaacaatattctgtgaa

SEQ ID NO: 6920213 - DNA, 22 bp, Homo sapiens
ggactatgcagaatatgacagt

SEQ ID NO: 6920214 - DNA, 22 bp, Homo sapiens
taagagttactggtttagaacc

SEQ ID NO: 6920215 - DNA, 22 bp, Homo sapiens
tgtgaggaggcggccagaagag

SEQ ID NO: 6920216 - DNA, 22 bp, Homo sapiens
agtatgaatctttcagaccgta

SEQ ID NO: 6920217 - DNA, 22 bp, Homo sapiens
tttgtactctcagaattcagaa

SEQ ID NO: 6920218 - DNA, 22 bp, Homo sapiens
gaacattcacagactcaccatt

SEQ ID NO: 6920219 - DNA, 22 bp, Homo sapiens
ctacaggagtaaaataatttca

SEQ ID NO: 6920220 - DNA, 22 bp, Homo sapiens
gggccctggggatgtggacgcg

SEQ ID NO: 6920221 - DNA, 22 bp, Homo sapiens
gcttgagtcatttagatcatca

SEQ ID NO: 6920222 - DNA, 22 bp, Homo sapiens
tggtcaaatgccaatctgtagt

SEQ ID NO: 6920223 - DNA, 16 bp, Homo sapiens
tggctgagagagggtt

SEQ ID NO: 6920224 - DNA, 22 bp, Homo sapiens
gctctatggctgctgggagtcc

SEQ ID NO: 6920225 - DNA, 22 bp, Homo sapiens
ggcacagaggttgcctccagat

SEQ ID NO: 6920226 - DNA, 22 bp, Homo sapiens
gcagtagaacgtgttgaatcaa

SEQ ID NO: 6920227 - DNA, 22 bp, Homo sapiens
ttcctggtcactgctgttccct

SEQ ID NO: 6920228 - DNA, 22 bp, Homo sapiens
tgcaaggcacccactctgcttt

SEQ ID NO: 6920229 - DNA, 20 bp, Homo sapiens
tacagtgtatgtatttaggc

SEQ ID NO: 6920230 - DNA, 21 bp, Homo sapiens
ccactgagcattgttatgaag

SEQ ID NO: 6920231 - DNA, 22 bp, Homo sapiens
agcagtcctccagtgtgtttta

SEQ ID NO: 6920232 - DNA, 22 bp, Homo sapiens
caagagcacgtgccctccataa

SEQ ID NO: 6920233 - DNA, 22 bp, Homo sapiens
gagccaagggcgtgctggagag

SEQ ID NO: 6920234 - DNA, 22 bp, Homo sapiens
gccatcttgagccaggaagtga

SEQ ID NO: 6920235 - DNA, 22 bp, Homo sapiens
atgatgtaacataaagatgtct

SEQ ID NO: 6920236 - DNA, 22 bp, Homo sapiens
ttgtacaatggatgccagatga

SEQ ID NO: 6920237 - DNA, 22 bp, Homo sapiens
gtgtgggctatgtgcgtgggca

SEQ ID NO: 6920238 - DNA, 22 bp, Homo sapiens
tgtgactgtgctgtggagggag

SEQ ID NO: 6920239 - DNA, 22 bp, Homo sapiens
ttcttctttccccctgtggtac

SEQ ID NO: 6920240 - DNA, 22 bp, Homo sapiens
gcctccattgaaagctgtctat

SEQ ID NO: 6920241 - DNA, 22 bp, Homo sapiens
cctgccacttcttgctatggag

SEQ ID NO: 6920242 - DNA, 22 bp, Homo sapiens
ctcataagccttgctcaggtct

SEQ ID NO: 6920243 - DNA, 22 bp, Homo sapiens
aacttgaatgagaacttttgcc

SEQ ID NO: 6920244 - DNA, 22 bp, Homo sapiens
agggcactccttggcagctctg

SEQ ID NO: 6920245 - DNA, 22 bp, Homo sapiens
ccccttgacctgtgatagcttc

SEQ ID NO: 6920246 - DNA, 22 bp, Homo sapiens
aagctttgcaccggtggctgga

SEQ ID NO: 6920247 - DNA, 17 bp, Homo sapiens
tctgttcatgcatacct

SEQ ID NO: 6920248 - DNA, 22 bp, Homo sapiens
aaacacgtataatgtgacagag

SEQ ID NO: 6920249 - DNA, 22 bp, Homo sapiens
aaggtgactcacaaagccagtt

SEQ ID NO: 6920250 - DNA, 22 bp, Homo sapiens
ttattgcctgattgaggtcatt

SEQ ID NO: 6920251 - DNA, 22 bp, Homo sapiens
tttcacaactgcttatttgaga

SEQ ID NO: 6920252 - DNA, 22 bp, Homo sapiens
taaaagaccacaaggtggtaat

SEQ ID NO: 6920253 - DNA, 19 bp, Homo sapiens
agagatccagcttctagct

SEQ ID NO: 6920254 - DNA, 22 bp, Homo sapiens
tggcttcagacttctgctacgt

SEQ ID NO: 6920255 - DNA, 22 bp, Homo sapiens
ggctggacatgagcttggcagt

SEQ ID NO: 6920256 - DNA, 22 bp, Homo sapiens
tccaaaggggcagtgtccagcc

SEQ ID NO: 6920257 - DNA, 23 bp, Homo sapiens
tgctctgggaggccctggagagc

SEQ ID NO: 6920258 - DNA, 22 bp, Homo sapiens
cagggttatacagctgaacaaa

SEQ ID NO: 6920259 - DNA, 22 bp, Homo sapiens
acaacagtccagtatagactgt

SEQ ID NO: 6920260 - DNA, 22 bp, Homo sapiens
ttaagcgccttctctttgtctt

SEQ ID NO: 6920261 - DNA, 22 bp, Homo sapiens
caggaagctgccggtgagcgag

SEQ ID NO: 6920262 - DNA, 19 bp, Homo sapiens
ttttctcagcttctagcgg

SEQ ID NO: 6920263 - DNA, 22 bp, Homo sapiens
tgggttgttccccaagtccaca

SEQ ID NO: 6920264 - DNA, 22 bp, Homo sapiens
tgtttatacctgcaacctgtca

SEQ ID NO: 6920265 - DNA, 22 bp, Homo sapiens
ttacaaactgtcatatagtatt

SEQ ID NO: 6920266 - DNA, 22 bp, Homo sapiens
aagccaatgatacgggtgatct

SEQ ID NO: 6920267 - DNA, 22 bp, Homo sapiens
aaattgctgggtcccacccaag

SEQ ID NO: 6920268 - DNA, 22 bp, Homo sapiens
tacactggccccagggcggggc

SEQ ID NO: 6920269 - DNA, 22 bp, Homo sapiens
tagctacaaggaagaatggaaa

SEQ ID NO: 6920270 - DNA, 22 bp, Homo sapiens
gcagatgccactaggtgaagtg

SEQ ID NO: 6920271 - DNA, 22 bp, Homo sapiens
tttattcatcatctgttcatat

SEQ ID NO: 6920272 - DNA, 22 bp, Homo sapiens
ccagtcagttctgattatgtgg

SEQ ID NO: 6920273 - DNA, 19 bp, Homo sapiens
gtggcctgcgctgggtgcg

SEQ ID NO: 6920274 - DNA, 22 bp, Homo sapiens
tggcactaagacggtgcttccc

SEQ ID NO: 6920275 - DNA, 22 bp, Homo sapiens
ttccacacttaaggaatatgat

SEQ ID NO: 6920276 - DNA, 22 bp, Homo sapiens
agccatcacttgagaatctatt

SEQ ID NO: 6920277 - DNA, 20 bp, Homo sapiens
actgggcatacctgtcctgt

SEQ ID NO: 6920278 - DNA, 22 bp, Homo sapiens
ttcctcagaaaatactgtccaa

SEQ ID NO: 6920279 - DNA, 22 bp, Homo sapiens
ggtgcatgtgagaaagactggg

SEQ ID NO: 6920280 - DNA, 22 bp, Homo sapiens
cagtgctagggcagagcactcc

SEQ ID NO: 6920281 - DNA, 22 bp, Homo sapiens
tcatgacatctgttaggtttat

SEQ ID NO: 6920282 - DNA, 22 bp, Homo sapiens
atgaggcagagggctgtgccag

SEQ ID NO: 6920283 - DNA, 22 bp, Homo sapiens
caatttcactaataatatttac

SEQ ID NO: 6920284 - DNA, 22 bp, Homo sapiens
cgagcagagcagagacgtctgg

SEQ ID NO: 6920285 - DNA, 22 bp, Homo sapiens
tttctgtggattttccattcaa

SEQ ID NO: 6920286 - DNA, 22 bp, Homo sapiens
ttgaaatcaggaaagttccagg

SEQ ID NO: 6920287 - DNA, 19 bp, Homo sapiens
gttaggcagggtggggagt

SEQ ID NO: 6920288 - DNA, 22 bp, Homo sapiens
cctggctccggttcaagggaaa

SEQ ID NO: 6920289 - DNA, 22 bp, Homo sapiens
atgtttccttatagataaaagc

SEQ ID NO: 6920290 - DNA, 22 bp, Homo sapiens
tgtgctgctgtgaataagacct

SEQ ID NO: 6920291 - DNA, 22 bp, Homo sapiens
tacttgttttgtgttcctaaac

SEQ ID NO: 6920292 - DNA, 22 bp, Homo sapiens
tgtatctgtgatgtaggggttt

SEQ ID NO: 6920293 - DNA, 22 bp, Homo sapiens
gctctcaggtgccactttgtgg

SEQ ID NO: 6920294 - DNA, 19 bp, Homo sapiens
cagagagaccaaggcgcca

SEQ ID NO: 6920295 - DNA, 22 bp, Homo sapiens
aggcagcatgctctgcttctac

SEQ ID NO: 6920296 - DNA, 22 bp, Homo sapiens
gcaccagctgccttctgtgccc

SEQ ID NO: 6920297 - DNA, 22 bp, Homo sapiens
tgcctgtcagggggagtgggaa

SEQ ID NO: 6920298 - DNA, 22 bp, Homo sapiens
cagtaaacagttactaagaaga

SEQ ID NO: 6920299 - DNA, 22 bp, Homo sapiens
aggtccaaatgttgagactgat

SEQ ID NO: 6920300 - DNA, 22 bp, Homo sapiens
tctgggctttagtttgttatct

SEQ ID NO: 6920301 - DNA, 22 bp, Homo sapiens
gcataacaaatatgctttaaat

SEQ ID NO: 6920302 - DNA, 22 bp, Homo sapiens
gcagagatggctgcctctgagt

SEQ ID NO: 6920303 - DNA, 22 bp, Homo sapiens
cttgttgctgaattcaggattc

SEQ ID NO: 6920304 - DNA, 22 bp, Homo sapiens
cagtaaatgcagatatagatac

SEQ ID NO: 6920305 - DNA, 22 bp, Homo sapiens
ctgggagcaagtcaggaaaggt

SEQ ID NO: 6920306 - DNA, 22 bp, Homo sapiens
ttgtattttgttatgctactgc

SEQ ID NO: 6920307 - DNA, 22 bp, Homo sapiens
tcctgctttgtgcctcacactt

SEQ ID NO: 6920308 - DNA, 22 bp, Homo sapiens
gtcagtgccaccagccactgcc

SEQ ID NO: 6920309 - DNA, 22 bp, Homo sapiens
tttctcagctcagcatctgggt

SEQ ID NO: 6920310 - DNA, 22 bp, Homo sapiens
tgtcacttcagttttgaaacaa

SEQ ID NO: 6920311 - DNA, 22 bp, Homo sapiens
tctctgagaagctgaggctggg

SEQ ID NO: 6920312 - DNA, 22 bp, Homo sapiens
cctgtgaatccatcattatttc

SEQ ID NO: 6920313 - DNA, 22 bp, Homo sapiens
tgttgacttgaaccaaagtgtt

SEQ ID NO: 6920314 - DNA, 22 bp, Homo sapiens
agcactttgtgcatttctgaag

SEQ ID NO: 6920315 - DNA, 22 bp, Homo sapiens
gctggcccagcgtggggccgtg

SEQ ID NO: 6920316 - DNA, 22 bp, Homo sapiens
aatagaatgtaatctaatacat

SEQ ID NO: 6920317 - DNA, 20 bp, Homo sapiens
actggcagcctgcctgctgt

SEQ ID NO: 6920318 - DNA, 22 bp, Homo sapiens
agggacctcttcttgcagctga

SEQ ID NO: 6920319 - DNA, 22 bp, Homo sapiens
tgaaacattaggaaatcattat

SEQ ID NO: 6920320 - DNA, 20 bp, Homo sapiens
cagtttaactttgagcagtt

SEQ ID NO: 6920321 - DNA, 22 bp, Homo sapiens
tggggtgtgagaagtagaggga

SEQ ID NO: 6920322 - DNA, 22 bp, Homo sapiens
acctgctgtgattctaattggc

SEQ ID NO: 6920323 - DNA, 22 bp, Homo sapiens
aggtgccattgcttgccagttt

SEQ ID NO: 6920324 - DNA, 17 bp, Homo sapiens
aggcaggtaagagttat

SEQ ID NO: 6920325 - DNA, 22 bp, Homo sapiens
tgagggcctcatacctgattct

SEQ ID NO: 6920326 - DNA, 22 bp, Homo sapiens
aggagcctggctggcccacagg

SEQ ID NO: 6920327 - DNA, 22 bp, Homo sapiens
catacattgaatttgcacgtgt

SEQ ID NO: 6920328 - DNA, 22 bp, Homo sapiens
agcagctatttcttccagagag

SEQ ID NO: 6920329 - DNA, 22 bp, Homo sapiens
gtcagtgttataagtttagcca

SEQ ID NO: 6920330 - DNA, 22 bp, Homo sapiens
ctgtgactccttctacctgtct

SEQ ID NO: 6920331 - DNA, 22 bp, Homo sapiens
atgcccttcaacgtgaggattt

SEQ ID NO: 6920332 - DNA, 22 bp, Homo sapiens
cgtgaattttccgtcgctaact

SEQ ID NO: 6920333 - DNA, 22 bp, Homo sapiens
tacactttgtgatgccgggagc

SEQ ID NO: 6920334 - DNA, 22 bp, Homo sapiens
ggcatcccttcttccagtgtca

SEQ ID NO: 6920335 - DNA, 22 bp, Homo sapiens
tctgcctgctaactcctgcacc

SEQ ID NO: 6920336 - DNA, 21 bp, Homo sapiens
aagggagataggaatcaggcc

SEQ ID NO: 6920337 - DNA, 22 bp, Homo sapiens
gtgttaatggctatgaactgat

SEQ ID NO: 6920338 - DNA, 22 bp, Homo sapiens
atgatgtcactcttctgcctaa

SEQ ID NO: 6920339 - DNA, 19 bp, Homo sapiens
tccagctggtatgcccaga

SEQ ID NO: 6920340 - DNA, 23 bp, Homo sapiens
agcaaataatctgcttgcttttt

SEQ ID NO: 6920341 - DNA, 22 bp, Homo sapiens
tcatgtctgggagcagactcca

SEQ ID NO: 6920342 - DNA, 22 bp, Homo sapiens
caagtcaagcatgcccttattt

SEQ ID NO: 6920343 - DNA, 22 bp, Homo sapiens
gagtctctcatgcagttacagt

SEQ ID NO: 6920344 - DNA, 22 bp, Homo sapiens
ttcaagtaacacaaatgcaccc

SEQ ID NO: 6920345 - DNA, 22 bp, Homo sapiens
tgctggaagctcctgcatgtct

SEQ ID NO: 6920346 - DNA, 23 bp, Homo sapiens
tctcaagcttcactgtgtgttgt

SEQ ID NO: 6920347 - DNA, 22 bp, Homo sapiens
tgaaagaagcctccctttggag

SEQ ID NO: 6920348 - DNA, 22 bp, Homo sapiens
ggtaaggagagagaaattatgc

SEQ ID NO: 6920349 - DNA, 22 bp, Homo sapiens
tggcaaagtaattgggtttctc

SEQ ID NO: 6920350 - DNA, 22 bp, Homo sapiens
tgggtcactctatcctgcttag

SEQ ID NO: 6920351 - DNA, 23 bp, Homo sapiens
cagctgaagcagcctgggctgga

SEQ ID NO: 6920352 - DNA, 20 bp, Homo sapiens
agcttgcccctgtctttgcc

SEQ ID NO: 6920353 - DNA, 23 bp, Homo sapiens
agttcataatttcttatttgtgt

SEQ ID NO: 6920354 - DNA, 22 bp, Homo sapiens
gcagaaacttggagaagccagg

SEQ ID NO: 6920355 - DNA, 20 bp, Homo sapiens
taatgcctcatgatactaga

SEQ ID NO: 6920356 - DNA, 22 bp, Homo sapiens
gttctttaggggcccaatttcc

SEQ ID NO: 6920357 - DNA, 22 bp, Homo sapiens
ctctgtgttaaattgggttttt

SEQ ID NO: 6920358 - DNA, 22 bp, Homo sapiens
tgagccagggtttccggctgct

SEQ ID NO: 6920359 - DNA, 22 bp, Homo sapiens
catgccagggcttgctgcctgg

SEQ ID NO: 6920360 - DNA, 22 bp, Homo sapiens
actcaggaaattgagataatgg

SEQ ID NO: 6920361 - DNA, 22 bp, Homo sapiens
gaccagctgataaggcatataa

SEQ ID NO: 6920362 - DNA, 22 bp, Homo sapiens
taaactgaagctcaactcaaat

SEQ ID NO: 6920363 - DNA, 22 bp, Homo sapiens
tagcactatctattgcatgcaa

SEQ ID NO: 6920364 - DNA, 22 bp, Homo sapiens
tgccaggtacacaagtagccag

SEQ ID NO: 6920365 - DNA, 22 bp, Homo sapiens
cccctttctcccgcgtctggcc

SEQ ID NO: 6920366 - DNA, 22 bp, Homo sapiens
ccgtggcttcccaggcggatgt

SEQ ID NO: 6920367 - DNA, 22 bp, Homo sapiens
gcagcttcaagatactttttct

SEQ ID NO: 6920368 - DNA, 22 bp, Homo sapiens
agagcactgagtgagcaaggcc

SEQ ID NO: 6920369 - DNA, 21 bp, Homo sapiens
cctgtcttggactgaggcacc

SEQ ID NO: 6920370 - DNA, 22 bp, Homo sapiens
atgctgaaccttaacttggagc

SEQ ID NO: 6920371 - DNA, 17 bp, Homo sapiens
aggtctgagagtatctg

SEQ ID NO: 6920372 - DNA, 22 bp, Homo sapiens
cctgtgctgggtgtgagggaca

SEQ ID NO: 6920373 - DNA, 22 bp, Homo sapiens
tctcttcatagtgacacccatc

SEQ ID NO: 6920374 - DNA, 22 bp, Homo sapiens
ttcaagcagttaagcagtctcc

SEQ ID NO: 6920375 - DNA, 22 bp, Homo sapiens
tgatttacacatcaaagcagca

SEQ ID NO: 6920376 - DNA, 18 bp, Homo sapiens
tggctggcagtgggcagc

SEQ ID NO: 6920377 - DNA, 22 bp, Homo sapiens
tagattctcccacctgccaggc

SEQ ID NO: 6920378 - DNA, 22 bp, Homo sapiens
gcaaaaaccacaattacttttg

SEQ ID NO: 6920379 - DNA, 21 bp, Homo sapiens
aaggctgagacaactcaggag

SEQ ID NO: 6920380 - DNA, 22 bp, Homo sapiens
cttcagcacctcagctggagag

SEQ ID NO: 6920381 - DNA, 22 bp, Homo sapiens
gtattccattagtgttaatatc

SEQ ID NO: 6920382 - DNA, 19 bp, Homo sapiens
ttctatgattaacatgaga

SEQ ID NO: 6920383 - DNA, 22 bp, Homo sapiens
tagagtgtccaacacataggag

SEQ ID NO: 6920384 - DNA, 22 bp, Homo sapiens
gaggctgcagctatcagacatt

SEQ ID NO: 6920385 - DNA, 20 bp, Homo sapiens
tttattcagcctaccctctt

SEQ ID NO: 6920386 - DNA, 22 bp, Homo sapiens
tgttgcacacataggagtgatc

SEQ ID NO: 6920387 - DNA, 22 bp, Homo sapiens
ttgtgggcttgcctggctcttg

SEQ ID NO: 6920388 - DNA, 22 bp, Homo sapiens
tccagttgcccatctctcttct

SEQ ID NO: 6920389 - DNA, 22 bp, Homo sapiens
agaaactaaagccaagggctct

SEQ ID NO: 6920390 - DNA, 22 bp, Homo sapiens
agcaatagacacaagatggata

SEQ ID NO: 6920391 - DNA, 22 bp, Homo sapiens
agcctctgatggctcccaagga

SEQ ID NO: 6920392 - DNA, 22 bp, Homo sapiens
acttctttcacaatgtttctag

SEQ ID NO: 6920393 - DNA, 22 bp, Homo sapiens
tctgtaggacagagaaatgggg

SEQ ID NO: 6920394 - DNA, 22 bp, Homo sapiens
tcagaacaggttgtactatgtc

SEQ ID NO: 6920395 - DNA, 19 bp, Homo sapiens
gctggctggaggagggaca

SEQ ID NO: 6920396 - DNA, 22 bp, Homo sapiens
ccctgtgcattggagggtgttt

SEQ ID NO: 6920397 - DNA, 21 bp, Homo sapiens
cagcacagtactgggtcttgc

SEQ ID NO: 6920398 - DNA, 22 bp, Homo sapiens
aggtgccagcagggttgatgac

SEQ ID NO: 6920399 - DNA, 22 bp, Homo sapiens
actgtgcatttgtcatggggtt

SEQ ID NO: 6920400 - DNA, 22 bp, Homo sapiens
tagggggctgtcctgtgcatta

SEQ ID NO: 6920401 - DNA, 22 bp, Homo sapiens
agaacatatctgttttctaact

SEQ ID NO: 6920402 - DNA, 22 bp, Homo sapiens
ttcagtgttaatcttgggagaa

SEQ ID NO: 6920403 - DNA, 22 bp, Homo sapiens
aaggctgagccagggcccctat

SEQ ID NO: 6920404 - DNA, 22 bp, Homo sapiens
agggccaagtccaggacctcgg

SEQ ID NO: 6920405 - DNA, 22 bp, Homo sapiens
atctttgggtacaaacttgcct

SEQ ID NO: 6920406 - DNA, 22 bp, Homo sapiens
ttgtatttgattgtcatatcgt

SEQ ID NO: 6920407 - DNA, 22 bp, Homo sapiens
aggtcacatggataatgatcag

SEQ ID NO: 6920408 - DNA, 22 bp, Homo sapiens
gcctaatacatgatgataggta

SEQ ID NO: 6920409 - DNA, 22 bp, Homo sapiens
ttttagtgtagtcaccgtgggt

SEQ ID NO: 6920410 - DNA, 22 bp, Homo sapiens
gtgtatgggaaagcccttgagt

SEQ ID NO: 6920411 - DNA, 22 bp, Homo sapiens
tgggttggtcagcataagatgg

SEQ ID NO: 6920412 - DNA, 22 bp, Homo sapiens
cagtccttattcctatattcct

SEQ ID NO: 6920413 - DNA, 22 bp, Homo sapiens
ttaaacagtatatctgagcaag

SEQ ID NO: 6920414 - DNA, 22 bp, Homo sapiens
agcagccaaccttacattcatc

SEQ ID NO: 6920415 - DNA, 22 bp, Homo sapiens
ttgccctgtcttaagctggcaa

SEQ ID NO: 6920416 - DNA, 22 bp, Homo sapiens
ggggtccctgcaccagcatgtc

SEQ ID NO: 6920417 - DNA, 22 bp, Homo sapiens
ctagagtaagaagtacagttgc

SEQ ID NO: 6920418 - DNA, 22 bp, Homo sapiens
cttcatacaattttttgacata

SEQ ID NO: 6920419 - DNA, 22 bp, Homo sapiens
gcagagtcaggtccaaggactg

SEQ ID NO: 6920420 - DNA, 19 bp, Homo sapiens
tcagctggcaggcctcctc

SEQ ID NO: 6920421 - DNA, 22 bp, Homo sapiens
acaggcaggagctccccattcc

SEQ ID NO: 6920422 - DNA, 22 bp, Homo sapiens
actacagaagtcttattagaga

SEQ ID NO: 6920423 - DNA, 22 bp, Homo sapiens
tggagagaacagtgtctgaaag

SEQ ID NO: 6920424 - DNA, 22 bp, Homo sapiens
ggctctgcccaggtggacagca

SEQ ID NO: 6920425 - DNA, 22 bp, Homo sapiens
tgtcttattaagaccagtgact

SEQ ID NO: 6920426 - DNA, 19 bp, Homo sapiens
cagttacagcagctaagac

SEQ ID NO: 6920427 - DNA, 22 bp, Homo sapiens
acaatgtaggagtatgacagta

SEQ ID NO: 6920428 - DNA, 22 bp, Homo sapiens
ggtgtcagatttgacatccaga

SEQ ID NO: 6920429 - DNA, 22 bp, Homo sapiens
gctcttgatacatcaagaactt

SEQ ID NO: 6920430 - DNA, 22 bp, Homo sapiens
taacccgtgttactggcataag

SEQ ID NO: 6920431 - DNA, 20 bp, Homo sapiens
aaaaacagtaatgctgaaga

SEQ ID NO: 6920432 - DNA, 22 bp, Homo sapiens
tctccagtcccttctctgttag

SEQ ID NO: 6920433 - DNA, 22 bp, Homo sapiens
ctcttaaaaacttgatatattt

SEQ ID NO: 6920434 - DNA, 22 bp, Homo sapiens
cagtagtggtctatcactggag

SEQ ID NO: 6920435 - DNA, 22 bp, Homo sapiens
cctgtgccttccttaggcacct

SEQ ID NO: 6920436 - DNA, 22 bp, Homo sapiens
aggtgctatcactaccccatta

SEQ ID NO: 6920437 - DNA, 22 bp, Homo sapiens
tgtcatctggcctgattggtgt

SEQ ID NO: 6920438 - DNA, 22 bp, Homo sapiens
tgctattattgtcaccactgta

SEQ ID NO: 6920439 - DNA, 22 bp, Homo sapiens
actcaagagctggctggttcct

SEQ ID NO: 6920440 - DNA, 22 bp, Homo sapiens
aggcttctagggttggcagcgg

SEQ ID NO: 6920441 - DNA, 18 bp, Homo sapiens
tgcccagaaaagcaggga

SEQ ID NO: 6920442 - DNA, 22 bp, Homo sapiens
ttatttccctgagggttgcagg

SEQ ID NO: 6920443 - DNA, 22 bp, Homo sapiens
gaatgttactttgattttgtcc

SEQ ID NO: 6920444 - DNA, 22 bp, Homo sapiens
gcagcaggcatggccgccctgg

SEQ ID NO: 6920445 - DNA, 22 bp, Homo sapiens
tgagtagcggctatgtgtaact

SEQ ID NO: 6920446 - DNA, 22 bp, Homo sapiens
aacccaggtctttggcttccag

SEQ ID NO: 6920447 - DNA, 23 bp, Homo sapiens
aaatattcttttttagtaagtgc

SEQ ID NO: 6920448 - DNA, 22 bp, Homo sapiens
tagacctgcagacctgggcccc

SEQ ID NO: 6920449 - DNA, 22 bp, Homo sapiens
agttgacacgcagaggggctgc

SEQ ID NO: 6920450 - DNA, 22 bp, Homo sapiens
actgagagagctgggtatctcc

SEQ ID NO: 6920451 - DNA, 22 bp, Homo sapiens
cctctctgtagcagcccccagt

SEQ ID NO: 6920452 - DNA, 22 bp, Homo sapiens
gtttgcatggaagacagtgagt

SEQ ID NO: 6920453 - DNA, 22 bp, Homo sapiens
cttgggcttagaaggtaagtga

SEQ ID NO: 6920454 - DNA, 22 bp, Homo sapiens
gccaaaactcccatattttaat

SEQ ID NO: 6920455 - DNA, 22 bp, Homo sapiens
atacacatatatacacgtttaa

SEQ ID NO: 6920456 - DNA, 22 bp, Homo sapiens
acagtagttatctaacttattt

SEQ ID NO: 6920457 - DNA, 22 bp, Homo sapiens
aggaaaattatcatgagagcca

SEQ ID NO: 6920458 - DNA, 22 bp, Homo sapiens
gcaaggcagtcctggggccctg

SEQ ID NO: 6920459 - DNA, 18 bp, Homo sapiens
agagtccagggtgaggtg

SEQ ID NO: 6920460 - DNA, 22 bp, Homo sapiens
gcttttgcctacatcttggtct

SEQ ID NO: 6920461 - DNA, 22 bp, Homo sapiens
aggttaacccttcttttcctct

SEQ ID NO: 6920462 - DNA, 23 bp, Homo sapiens
attacatgagcaaatatagctat

SEQ ID NO: 6920463 - DNA, 22 bp, Homo sapiens
ggatgacaaggaaagcaaacca

SEQ ID NO: 6920464 - DNA, 22 bp, Homo sapiens
caagaatatatatggagtggag

SEQ ID NO: 6920465 - DNA, 22 bp, Homo sapiens
gtcaacatttactgccctggcc

SEQ ID NO: 6920466 - DNA, 22 bp, Homo sapiens
gatttctttgaattagagaggt

SEQ ID NO: 6920467 - DNA, 22 bp, Homo sapiens
ctgccccatggtccctggtggg

SEQ ID NO: 6920468 - DNA, 22 bp, Homo sapiens
ggcttcagtgagctgagctcac

SEQ ID NO: 6920469 - DNA, 22 bp, Homo sapiens
tttgggcacacaaatattttat

SEQ ID NO: 6920470 - DNA, 22 bp, Homo sapiens
gtccattgttctatggctcaaa

SEQ ID NO: 6920471 - DNA, 22 bp, Homo sapiens
ctgtgtgtgaacacagcccagc

SEQ ID NO: 6920472 - DNA, 22 bp, Homo sapiens
gtagatatggctcaaaggcatg

SEQ ID NO: 6920473 - DNA, 22 bp, Homo sapiens
attgaaaatataattctaggag

SEQ ID NO: 6920474 - DNA, 22 bp, Homo sapiens
tcagctggcaggttctgggaag

SEQ ID NO: 6920475 - DNA, 22 bp, Homo sapiens
gtcacctgttccagttgcggtc

SEQ ID NO: 6920476 - DNA, 22 bp, Homo sapiens
caacagtctggtttatataata

SEQ ID NO: 6920477 - DNA, 22 bp, Homo sapiens
gaactatatgtcttaaagcttt

SEQ ID NO: 6920478 - DNA, 22 bp, Homo sapiens
gaggtcctctgtgtccgcgggc

SEQ ID NO: 6920479 - DNA, 20 bp, Homo sapiens
agacaaaatgacttcatgca

SEQ ID NO: 6920480 - DNA, 21 bp, Homo sapiens
agcacagctttaagccatgtg

SEQ ID NO: 6920481 - DNA, 22 bp, Homo sapiens
tagcattaaaggtaagacatta

SEQ ID NO: 6920482 - DNA, 22 bp, Homo sapiens
acctgcatgatggaacatgagg

SEQ ID NO: 6920483 - DNA, 22 bp, Homo sapiens
ggtcctgtgagatgtatgcatt

SEQ ID NO: 6920484 - DNA, 22 bp, Homo sapiens
aaatagatttaacatccatccc

SEQ ID NO: 6920485 - DNA, 17 bp, Homo sapiens
catctgctctgcccctt

SEQ ID NO: 6920486 - DNA, 22 bp, Homo sapiens
agctgggtactgatgtcttcag

SEQ ID NO: 6920487 - DNA, 22 bp, Homo sapiens
aggctccagtctgaaccttggg

SEQ ID NO: 6920488 - DNA, 22 bp, Homo sapiens
caggtatgaggacactgacagc

SEQ ID NO: 6920489 - DNA, 21 bp, Homo sapiens
tactttgcaatgtatctcctt

SEQ ID NO: 6920490 - DNA, 22 bp, Homo sapiens
tctggattgcacttgtgggcca

SEQ ID NO: 6920491 - DNA, 22 bp, Homo sapiens
caccattttctaaaaatatgac

SEQ ID NO: 6920492 - DNA, 22 bp, Homo sapiens
tcccagaagtccagccatgggc

SEQ ID NO: 6920493 - DNA, 20 bp, Homo sapiens
tttgtgccaagtagccagtg

SEQ ID NO: 6920494 - DNA, 22 bp, Homo sapiens
aggaattactcatctgtggtat

SEQ ID NO: 6920495 - DNA, 22 bp, Homo sapiens
aaccaagtttattccaagttac

SEQ ID NO: 6920496 - DNA, 22 bp, Homo sapiens
attttaccttaaagtctatatt

SEQ ID NO: 6920497 - DNA, 22 bp, Homo sapiens
aagcaagtacaatagcaagtac

SEQ ID NO: 6920498 - DNA, 22 bp, Homo sapiens
tctggtactagaggagtgctgg

SEQ ID NO: 6920499 - DNA, 22 bp, Homo sapiens
agatgctctctattatgcagaa

SEQ ID NO: 6920500 - DNA, 23 bp, Homo sapiens
atagttatgctgcatgcatgtac

SEQ ID NO: 6920501 - DNA, 22 bp, Homo sapiens
tggaaggggccaggcgcggagt

SEQ ID NO: 6920502 - DNA, 22 bp, Homo sapiens
tctgtggctatcatactgaagg

SEQ ID NO: 6920503 - DNA, 22 bp, Homo sapiens
catgaggatccaggtgacaggc

SEQ ID NO: 6920504 - DNA, 22 bp, Homo sapiens
gcagccctaacctgtcatagtg

SEQ ID NO: 6920505 - DNA, 22 bp, Homo sapiens
tctcagagatctttctgcatgt

SEQ ID NO: 6920506 - DNA, 22 bp, Homo sapiens
tggcgaagctgaacataggcta

SEQ ID NO: 6920507 - DNA, 22 bp, Homo sapiens
tctttaatatctgccccagagc

SEQ ID NO: 6920508 - DNA, 23 bp, Homo sapiens
gggctcagatttcattctgtgcc

SEQ ID NO: 6920509 - DNA, 22 bp, Homo sapiens
actgggagagtttgcttataat

SEQ ID NO: 6920510 - DNA, 22 bp, Homo sapiens
ttctgagggctaatgtactgta

SEQ ID NO: 6920511 - DNA, 22 bp, Homo sapiens
tgcaggtgctccgggggtgccc

SEQ ID NO: 6920512 - DNA, 22 bp, Homo sapiens
tgtggaggtttaagtaatggga

SEQ ID NO: 6920513 - DNA, 22 bp, Homo sapiens
gctcccagactgaccagaggtg

SEQ ID NO: 6920514 - DNA, 22 bp, Homo sapiens
ctggctcacaggtgagatgcat

SEQ ID NO: 6920515 - DNA, 22 bp, Homo sapiens
cacatttctaggaaattaaatg

SEQ ID NO: 6920516 - DNA, 22 bp, Homo sapiens
agctcctactctatgccagaca

SEQ ID NO: 6920517 - DNA, 22 bp, Homo sapiens
ctttggctgggcaaagggaggt

SEQ ID NO: 6920518 - DNA, 17 bp, Homo sapiens
tggctctgtcctcagct

SEQ ID NO: 6920519 - DNA, 22 bp, Homo sapiens
agcagagctgggatcctgggtc

SEQ ID NO: 6920520 - DNA, 22 bp, Homo sapiens
gcagccacagaggagggatgca

SEQ ID NO: 6920521 - DNA, 18 bp, Homo sapiens
atcaactgctgtttcctt

SEQ ID NO: 6920522 - DNA, 22 bp, Homo sapiens
agtgtggggtcaccggcccagg

SEQ ID NO: 6920523 - DNA, 22 bp, Homo sapiens
acagctgtgggctctgcatata

SEQ ID NO: 6920524 - DNA, 22 bp, Homo sapiens
gttcttaagaccacaataaaaa

SEQ ID NO: 6920525 - DNA, 22 bp, Homo sapiens
gtgataggtttacacctgagca

SEQ ID NO: 6920526 - DNA, 22 bp, Homo sapiens
tctgcagacactggggtctgga

SEQ ID NO: 6920527 - DNA, 22 bp, Homo sapiens
ttaggcatataggtaggaattg

SEQ ID NO: 6920528 - DNA, 22 bp, Homo sapiens
gctatgtcaagtgtacatacca

SEQ ID NO: 6920529 - DNA, 22 bp, Homo sapiens
gaattctaaccattaagccaag

SEQ ID NO: 6920530 - DNA, 22 bp, Homo sapiens
atttcacttagtgtaatgtctt

SEQ ID NO: 6920531 - DNA, 22 bp, Homo sapiens
agcagctgggtccggcggagca

SEQ ID NO: 6920532 - DNA, 22 bp, Homo sapiens
agcctggtgatatcagtggttt

SEQ ID NO: 6920533 - DNA, 22 bp, Homo sapiens
ttatttcttgtctatgtagcca

SEQ ID NO: 6920534 - DNA, 22 bp, Homo sapiens
gcctgcccacggggctggcata

SEQ ID NO: 6920535 - DNA, 22 bp, Homo sapiens
tgacagagagatgggaaagggc

SEQ ID NO: 6920536 - DNA, 22 bp, Homo sapiens
tgtgtcaaagtcaggtgtcact

SEQ ID NO: 6920537 - DNA, 22 bp, Homo sapiens
gtgtagtataaggttaaaacct

SEQ ID NO: 6920538 - DNA, 22 bp, Homo sapiens
tatggcagttacccttgatgat

SEQ ID NO: 6920539 - DNA, 22 bp, Homo sapiens
atggccctgctggtttgatcgt

SEQ ID NO: 6920540 - DNA, 22 bp, Homo sapiens
ttaacctagtcagggctttgaa

SEQ ID NO: 6920541 - DNA, 22 bp, Homo sapiens
aagacccacaaggctgaatgtt

SEQ ID NO: 6920542 - DNA, 22 bp, Homo sapiens
aactttaaggctataaattatg

SEQ ID NO: 6920543 - DNA, 22 bp, Homo sapiens
ttggagagttaattgacagtta

SEQ ID NO: 6920544 - DNA, 22 bp, Homo sapiens
acagctcatttgtaaaacggag

SEQ ID NO: 6920545 - DNA, 22 bp, Homo sapiens
ttcattcttcagagctgcgctt

SEQ ID NO: 6920546 - DNA, 22 bp, Homo sapiens
gagcacctgctaaatgacagtt

SEQ ID NO: 6920547 - DNA, 20 bp, Homo sapiens
ctcttttcactctcagtggt

SEQ ID NO: 6920548 - DNA, 21 bp, Homo sapiens
aagctgtgttccactgatagc

SEQ ID NO: 6920549 - DNA, 22 bp, Homo sapiens
tctggattctgaggtgggtgca

SEQ ID NO: 6920550 - DNA, 22 bp, Homo sapiens
caaagtgagttataaacatctt

SEQ ID NO: 6920551 - DNA, 22 bp, Homo sapiens
tggcaggctctgagtagcacct

SEQ ID NO: 6920552 - DNA, 22 bp, Homo sapiens
agacaatatttcttgcctggtt

SEQ ID NO: 6920553 - DNA, 22 bp, Homo sapiens
gagaccttaagagatgtcagct

SEQ ID NO: 6920554 - DNA, 22 bp, Homo sapiens
tctgggggaggaggcatggccc

SEQ ID NO: 6920555 - DNA, 22 bp, Homo sapiens
aggtaggagttgatggatgttc

SEQ ID NO: 6920556 - DNA, 23 bp, Homo sapiens
agcagtaacttcagaaacatcag

SEQ ID NO: 6920557 - DNA, 22 bp, Homo sapiens
tcattcaatgtaagcatatata

SEQ ID NO: 6920558 - DNA, 22 bp, Homo sapiens
agtctgtggatggactggcaga

SEQ ID NO: 6920559 - DNA, 22 bp, Homo sapiens
catgggcaccttaaaatgaggc

SEQ ID NO: 6920560 - DNA, 22 bp, Homo sapiens
ttgtcatgatccttctgttagg

SEQ ID NO: 6920561 - DNA, 22 bp, Homo sapiens
tctcacatttcattgacagctg

SEQ ID NO: 6920562 - DNA, 22 bp, Homo sapiens
tctctgtggcaactacttagct

SEQ ID NO: 6920563 - DNA, 22 bp, Homo sapiens
aatgtatggattcatgtctgtg

SEQ ID NO: 6920564 - DNA, 19 bp, Homo sapiens
ttactcattctaaatgggc

SEQ ID NO: 6920565 - DNA, 20 bp, Homo sapiens
actcttgagaaattctctgt

SEQ ID NO: 6920566 - DNA, 22 bp, Homo sapiens
tacagatatagggcgagcttag

SEQ ID NO: 6920567 - DNA, 22 bp, Homo sapiens
tcacagaaatctgttttttcta

SEQ ID NO: 6920568 - DNA, 22 bp, Homo sapiens
gaaaggctcagattcccccagg

SEQ ID NO: 6920569 - DNA, 22 bp, Homo sapiens
tacattgttttttcttgccatc

SEQ ID NO: 6920570 - DNA, 22 bp, Homo sapiens
gggcgtgaccatctgggagctc

SEQ ID NO: 6920571 - DNA, 22 bp, Homo sapiens
agaggtgacataggagaggctc

SEQ ID NO: 6920572 - DNA, 22 bp, Homo sapiens
tgtaatttgcatggctgaatgc

SEQ ID NO: 6920573 - DNA, 22 bp, Homo sapiens
cagagcatttggaagccacgtg

SEQ ID NO: 6920574 - DNA, 22 bp, Homo sapiens
tctcactgcaaatattatgtat

SEQ ID NO: 6920575 - DNA, 19 bp, Homo sapiens
taacaagcactctgcattc

SEQ ID NO: 6920576 - DNA, 22 bp, Homo sapiens
agagtcagaaccaagatgaggc

SEQ ID NO: 6920577 - DNA, 22 bp, Homo sapiens
cttcaactgggcttcgatgtgg

SEQ ID NO: 6920578 - DNA, 22 bp, Homo sapiens
atggccaggcacctctggctga

SEQ ID NO: 6920579 - DNA, 22 bp, Homo sapiens
ggcttctctcttcacatggctt

SEQ ID NO: 6920580 - DNA, 22 bp, Homo sapiens
ctggaagcgtcggaggaagggc

SEQ ID NO: 6920581 - DNA, 23 bp, Homo sapiens
tacttagggtttagatctgactg

SEQ ID NO: 6920582 - DNA, 22 bp, Homo sapiens
tccttcagaaaacctcagtctt

SEQ ID NO: 6920583 - DNA, 22 bp, Homo sapiens
agcccaaggccacacagttagt

SEQ ID NO: 6920584 - DNA, 20 bp, Homo sapiens
ctgtgtagtgctcaggtaag

SEQ ID NO: 6920585 - DNA, 22 bp, Homo sapiens
caggatattagttttcttgtta

SEQ ID NO: 6920586 - DNA, 22 bp, Homo sapiens
atgaaacaaacctctatggagt

SEQ ID NO: 6920587 - DNA, 20 bp, Homo sapiens
aagcagtgaggtgaggagtg

SEQ ID NO: 6920588 - DNA, 22 bp, Homo sapiens
cactgaggagagaggtaactag

SEQ ID NO: 6920589 - DNA, 22 bp, Homo sapiens
ctggggcccatcgagggctgag

SEQ ID NO: 6920590 - DNA, 22 bp, Homo sapiens
ttcattcctgagcccatattta

SEQ ID NO: 6920591 - DNA, 22 bp, Homo sapiens
ggccatggaccccgagctgacc

SEQ ID NO: 6920592 - DNA, 19 bp, Homo sapiens
aggcacaggttgtctggac

SEQ ID NO: 6920593 - DNA, 22 bp, Homo sapiens
aaggctgttgtttcacaacaaa

SEQ ID NO: 6920594 - DNA, 22 bp, Homo sapiens
tgcctgtgtggtctgcgcatta

SEQ ID NO: 6920595 - DNA, 22 bp, Homo sapiens
ccagggtggaggctggatggag

SEQ ID NO: 6920596 - DNA, 21 bp, Homo sapiens
ggagtcagggtctggctgggg

SEQ ID NO: 6920597 - DNA, 22 bp, Homo sapiens
tcagaactgctgctcctgcaaa

SEQ ID NO: 6920598 - DNA, 22 bp, Homo sapiens
agactctaactcatgccattgc

SEQ ID NO: 6920599 - DNA, 22 bp, Homo sapiens
ctgaggtagccatggcccaagt

SEQ ID NO: 6920600 - DNA, 21 bp, Homo sapiens
tgctggaaaaagtggttctag

SEQ ID NO: 6920601 - DNA, 22 bp, Homo sapiens
cagtccagccccctgctaaaag

SEQ ID NO: 6920602 - DNA, 22 bp, Homo sapiens
ctggcagggcaggggtttgtgc

SEQ ID NO: 6920603 - DNA, 22 bp, Homo sapiens
tgagcttcaaaatatgtgaatc

SEQ ID NO: 6920604 - DNA, 22 bp, Homo sapiens
ctccttagtgcctctgcacgag

SEQ ID NO: 6920605 - DNA, 22 bp, Homo sapiens
tcagttgttggaagtagatgta

SEQ ID NO: 6920606 - DNA, 22 bp, Homo sapiens
gctctggtagatcctcaggctc

SEQ ID NO: 6920607 - DNA, 22 bp, Homo sapiens
atttgctttcagccttaaggat

SEQ ID NO: 6920608 - DNA, 22 bp, Homo sapiens
tcagaaggaaacgatgccagct

SEQ ID NO: 6920609 - DNA, 22 bp, Homo sapiens
acagagactcatgaaagatgac

SEQ ID NO: 6920610 - DNA, 22 bp, Homo sapiens
tgtcatatagaatgttctatga

SEQ ID NO: 6920611 - DNA, 22 bp, Homo sapiens
ggatgacacagttagaaagaga

SEQ ID NO: 6920612 - DNA, 22 bp, Homo sapiens
ttccagttcactccatttctgg

SEQ ID NO: 6920613 - DNA, 22 bp, Homo sapiens
atgaaacatgagaaatggagag

SEQ ID NO: 6920614 - DNA, 22 bp, Homo sapiens
ctaaccatcttacaaatgtctg

SEQ ID NO: 6920615 - DNA, 21 bp, Homo sapiens
cagtgccagccacaggacgcc

SEQ ID NO: 6920616 - DNA, 22 bp, Homo sapiens
gagctggcaatgacttgtgtat

SEQ ID NO: 6920617 - DNA, 22 bp, Homo sapiens
accagctgctgattgctaaatg

SEQ ID NO: 6920618 - DNA, 22 bp, Homo sapiens
tttgtacacaggatgttataat

SEQ ID NO: 6920619 - DNA, 22 bp, Homo sapiens
tttagagaggctctgtaaaatg

SEQ ID NO: 6920620 - DNA, 22 bp, Homo sapiens
tgaggtctgcagggctgtgcat

SEQ ID NO: 6920621 - DNA, 22 bp, Homo sapiens
gacagtaagagtgtctgggttc

SEQ ID NO: 6920622 - DNA, 22 bp, Homo sapiens
tgggagcagctgggaacacagc

SEQ ID NO: 6920623 - DNA, 22 bp, Homo sapiens
ctggcttttttcccattatgca

SEQ ID NO: 6920624 - DNA, 22 bp, Homo sapiens
tccatctggtgagtgaggagcc

SEQ ID NO: 6920625 - DNA, 22 bp, Homo sapiens
tggggagtcgctgcagagcgat

SEQ ID NO: 6920626 - DNA, 22 bp, Homo sapiens
taacagaagaaaacatattgga

SEQ ID NO: 6920627 - DNA, 22 bp, Homo sapiens
gttcctcatgagtaccccttaa

SEQ ID NO: 6920628 - DNA, 22 bp, Homo sapiens
tagaaatgaatgtttaaaagtc

SEQ ID NO: 6920629 - DNA, 22 bp, Homo sapiens
gtggcacataggatcctgtggc

SEQ ID NO: 6920630 - DNA, 22 bp, Homo sapiens
tattgtgaataatgccgcaata

SEQ ID NO: 6920631 - DNA, 18 bp, Homo sapiens
cttggtaagtaaaacagc

SEQ ID NO: 6920632 - DNA, 22 bp, Homo sapiens
aaattgccaaattgttttccag

SEQ ID NO: 6920633 - DNA, 22 bp, Homo sapiens
tagcagtcatcggcagagaaaa

SEQ ID NO: 6920634 - DNA, 19 bp, Homo sapiens
tggctgggtgccaatggcc

SEQ ID NO: 6920635 - DNA, 22 bp, Homo sapiens
gacagggtggctgatagggctc

SEQ ID NO: 6920636 - DNA, 22 bp, Homo sapiens
tgggcagtccagctggaaacgg

SEQ ID NO: 6920637 - DNA, 22 bp, Homo sapiens
agatccttttctattgtttcga

SEQ ID NO: 6920638 - DNA, 22 bp, Homo sapiens
atggggggatgaaggagtccaa

SEQ ID NO: 6920639 - DNA, 18 bp, Homo sapiens
gtggtctttctgtcttct

SEQ ID NO: 6920640 - DNA, 22 bp, Homo sapiens
acccaggctggagtgcagtggc

SEQ ID NO: 6920641 - DNA, 22 bp, Homo sapiens
agagctcaagacgctcacagta

SEQ ID NO: 6920642 - DNA, 22 bp, Homo sapiens
gcttctattatttggagctgag

SEQ ID NO: 6920643 - DNA, 22 bp, Homo sapiens
tgctggcccagtactaatgtct

SEQ ID NO: 6920644 - DNA, 22 bp, Homo sapiens
tctctgacatgcctaagacttt

SEQ ID NO: 6920645 - DNA, 22 bp, Homo sapiens
ctactgatgctatacttctcag

SEQ ID NO: 6920646 - DNA, 22 bp, Homo sapiens
tctgtggactcaagggatcaca

SEQ ID NO: 6920647 - DNA, 22 bp, Homo sapiens
gtacaatagtccctgtttggat

SEQ ID NO: 6920648 - DNA, 22 bp, Homo sapiens
ggcaggactcttctgtgggccg

SEQ ID NO: 6920649 - DNA, 22 bp, Homo sapiens
atttcagtgttttaagagttca

SEQ ID NO: 6920650 - DNA, 22 bp, Homo sapiens
tcacagagaggttaagcagttg

SEQ ID NO: 6920651 - DNA, 22 bp, Homo sapiens
tggagttagataaacctgggta

SEQ ID NO: 6920652 - DNA, 22 bp, Homo sapiens
tctgttattctgtctattgcca

SEQ ID NO: 6920653 - DNA, 21 bp, Homo sapiens
atacagtggtatgaatgtagg

SEQ ID NO: 6920654 - DNA, 20 bp, Homo sapiens
aattgaagcagaggagaggc

SEQ ID NO: 6920655 - DNA, 22 bp, Homo sapiens
ttactttaagggtgtcttatta

SEQ ID NO: 6920656 - DNA, 22 bp, Homo sapiens
gtgtgcagatgtgatgctgggc

SEQ ID NO: 6920657 - DNA, 22 bp, Homo sapiens
tccccagcttgctacttctgct

SEQ ID NO: 6920658 - DNA, 22 bp, Homo sapiens
aagtgggtaactggcctttgtt

SEQ ID NO: 6920659 - DNA, 22 bp, Homo sapiens
tgttctgagtgcagcttaataa

SEQ ID NO: 6920660 - DNA, 22 bp, Homo sapiens
gcagtgtttcagtgctttttct

SEQ ID NO: 6920661 - DNA, 22 bp, Homo sapiens
agcaggctaagggacctgttta

SEQ ID NO: 6920662 - DNA, 22 bp, Homo sapiens
gtaaatgccacttaatgtaaag

SEQ ID NO: 6920663 - DNA, 22 bp, Homo sapiens
aggcaggtgttgggagacacca

SEQ ID NO: 6920664 - DNA, 22 bp, Homo sapiens
atctttgtgaatctcaacttgg

SEQ ID NO: 6920665 - DNA, 22 bp, Homo sapiens
tgctatttgggggctacatgat

SEQ ID NO: 6920666 - DNA, 22 bp, Homo sapiens
atttgtctctgcactttactca

SEQ ID NO: 6920667 - DNA, 22 bp, Homo sapiens
tgaacacagggaatgggggttt

SEQ ID NO: 6920668 - DNA, 20 bp, Homo sapiens
tctcttggcttgggggacac

SEQ ID NO: 6920669 - DNA, 22 bp, Homo sapiens
gctcccagggacactggccact

SEQ ID NO: 6920670 - DNA, 22 bp, Homo sapiens
aggcgctgcatgtgaaggagtt

SEQ ID NO: 6920671 - DNA, 22 bp, Homo sapiens
tcggagctcagtttttgcttca

SEQ ID NO: 6920672 - DNA, 22 bp, Homo sapiens
gcctcagtggctttaggagttc

SEQ ID NO: 6920673 - DNA, 20 bp, Homo sapiens
tcctcccccacctttgcagc

SEQ ID NO: 6920674 - DNA, 22 bp, Homo sapiens
aataacttttaaaagaccctgg

SEQ ID NO: 6920675 - DNA, 22 bp, Homo sapiens
tctgctgcagagctgcgggtgc

SEQ ID NO: 6920676 - DNA, 22 bp, Homo sapiens
agcagcttatcttggagaggca

SEQ ID NO: 6920677 - DNA, 23 bp, Homo sapiens
actcatcttctggtatccacagt

SEQ ID NO: 6920678 - DNA, 22 bp, Homo sapiens
tgtagacagtgggatctctggg

SEQ ID NO: 6920679 - DNA, 22 bp, Homo sapiens
ctccaggtagctaagtcctggg

SEQ ID NO: 6920680 - DNA, 22 bp, Homo sapiens
ctggcttgaagttatgcaccag

SEQ ID NO: 6920681 - DNA, 22 bp, Homo sapiens
ttttatgtcataaggacactca

SEQ ID NO: 6920682 - DNA, 22 bp, Homo sapiens
aggcctgaggaccagataaatg

SEQ ID NO: 6920683 - DNA, 22 bp, Homo sapiens
aacttgcagacacctgtctcaa

SEQ ID NO: 6920684 - DNA, 22 bp, Homo sapiens
aacattaagatggcggaacagt

SEQ ID NO: 6920685 - DNA, 22 bp, Homo sapiens
actcaggaaatgagaggctctc

SEQ ID NO: 6920686 - DNA, 22 bp, Homo sapiens
tggaggtgaaatgagattttgt

SEQ ID NO: 6920687 - DNA, 22 bp, Homo sapiens
tgtatcaaaccaaattaattct

SEQ ID NO: 6920688 - DNA, 22 bp, Homo sapiens
ttgaaactcccttttgtctagt

SEQ ID NO: 6920689 - DNA, 22 bp, Homo sapiens
taatgagaattctttttgggta

SEQ ID NO: 6920690 - DNA, 22 bp, Homo sapiens
tgactagaattgtatttagtgt

SEQ ID NO: 6920691 - DNA, 22 bp, Homo sapiens
catccattcattaattctaaag

SEQ ID NO: 6920692 - DNA, 22 bp, Homo sapiens
aacagtacttgataatttgcac

SEQ ID NO: 6920693 - DNA, 22 bp, Homo sapiens
caggttcttaagtaacagcaca

SEQ ID NO: 6920694 - DNA, 22 bp, Homo sapiens
caagagatacatttctagtagg

SEQ ID NO: 6920695 - DNA, 22 bp, Homo sapiens
agctctcattactttacagatg

SEQ ID NO: 6920696 - DNA, 22 bp, Homo sapiens
agggctccgggccaccggcctg

SEQ ID NO: 6920697 - DNA, 22 bp, Homo sapiens
tggtatatgcatggaggtatca

SEQ ID NO: 6920698 - DNA, 22 bp, Homo sapiens
ttggaccatggtagggaacttg

SEQ ID NO: 6920699 - DNA, 22 bp, Homo sapiens
tgtgtctgttttgctcaccatt

SEQ ID NO: 6920700 - DNA, 18 bp, Homo sapiens
tatagccactgaaatgtg

SEQ ID NO: 6920701 - DNA, 22 bp, Homo sapiens
tgtgatgcatagtttttattgc

SEQ ID NO: 6920702 - DNA, 22 bp, Homo sapiens
tgattagctttgaatgtgctgc

SEQ ID NO: 6920703 - DNA, 22 bp, Homo sapiens
attctcagatcttagaggaata

SEQ ID NO: 6920704 - DNA, 22 bp, Homo sapiens
tgttatttgggaaagttgtaca

SEQ ID NO: 6920705 - DNA, 22 bp, Homo sapiens
tggattagaactctgggtttaa

SEQ ID NO: 6920706 - DNA, 23 bp, Homo sapiens
tccaggcacgcatttcttctagc

SEQ ID NO: 6920707 - DNA, 22 bp, Homo sapiens
atgttagcttgtgtgaaaatgc

SEQ ID NO: 6920708 - DNA, 22 bp, Homo sapiens
ccatgatggctgctggtaaaat

SEQ ID NO: 6920709 - DNA, 22 bp, Homo sapiens
atttcatcccaggctctggaag

SEQ ID NO: 6920710 - DNA, 22 bp, Homo sapiens
taggaaaagcacaggatgttct

SEQ ID NO: 6920711 - DNA, 22 bp, Homo sapiens
gcctgagggctcctagcaggct

SEQ ID NO: 6920712 - DNA, 22 bp, Homo sapiens
ctcatagacaagcctcttttaa

SEQ ID NO: 6920713 - DNA, 22 bp, Homo sapiens
ttacacaaagctccccaaatag

SEQ ID NO: 6920714 - DNA, 22 bp, Homo sapiens
tgcagctcctgtgctgagtgtg

SEQ ID NO: 6920715 - DNA, 22 bp, Homo sapiens
cacattcagggcagaccactca

SEQ ID NO: 6920716 - DNA, 22 bp, Homo sapiens
gaggagggcctggtgtcccttc

SEQ ID NO: 6920717 - DNA, 22 bp, Homo sapiens
ctctcaaagaaattgcctgtca

SEQ ID NO: 6920718 - DNA, 22 bp, Homo sapiens
atggaaagggaagcaaggaaca

SEQ ID NO: 6920719 - DNA, 22 bp, Homo sapiens
ctgctgtgtggtgaaactcagt

SEQ ID NO: 6920720 - DNA, 22 bp, Homo sapiens
tttgcaagaagaatggcacaaa

SEQ ID NO: 6920721 - DNA, 22 bp, Homo sapiens
taaagcacatatcttacaataa

SEQ ID NO: 6920722 - DNA, 22 bp, Homo sapiens
tacttacactgaagcaaagata

SEQ ID NO: 6920723 - DNA, 22 bp, Homo sapiens
aaatctcaaaggcttagcatct

SEQ ID NO: 6920724 - DNA, 22 bp, Homo sapiens
acacagctagtgagtggcagag

SEQ ID NO: 6920725 - DNA, 22 bp, Homo sapiens
gggcttctgctcttttggtgct

SEQ ID NO: 6920726 - DNA, 22 bp, Homo sapiens
tgtacagtgccatgcagtttgc

SEQ ID NO: 6920727 - DNA, 22 bp, Homo sapiens
gcagttgctcttgaggcacttt

SEQ ID NO: 6920728 - DNA, 22 bp, Homo sapiens
caatggctggagacaatctgct

SEQ ID NO: 6920729 - DNA, 22 bp, Homo sapiens
tgtcagtgtgcaccgggaggcc

SEQ ID NO: 6920730 - DNA, 22 bp, Homo sapiens
gagccctcattgaatctgcatt

SEQ ID NO: 6920731 - DNA, 22 bp, Homo sapiens
tcagcagtgtgcttggaatgga

SEQ ID NO: 6920732 - DNA, 22 bp, Homo sapiens
cagtgctcatagctgttcctcc

SEQ ID NO: 6920733 - DNA, 22 bp, Homo sapiens
aggtacaaaagagtatatgaga

SEQ ID NO: 6920734 - DNA, 22 bp, Homo sapiens
tatgcattttatagtgcaaagc

SEQ ID NO: 6920735 - DNA, 19 bp, Homo sapiens
tcatcacccctcctctcta

SEQ ID NO: 6920736 - DNA, 18 bp, Homo sapiens
tctcagcccagctccggc

SEQ ID NO: 6920737 - DNA, 22 bp, Homo sapiens
ctgaagagatgtcaatattggc

SEQ ID NO: 6920738 - DNA, 22 bp, Homo sapiens
tgaagccagtcaatgttaagtt

SEQ ID NO: 6920739 - DNA, 22 bp, Homo sapiens
ccagagtcattttgagtcataa

SEQ ID NO: 6920740 - DNA, 22 bp, Homo sapiens
actgtgggccattgggttctgt

SEQ ID NO: 6920741 - DNA, 22 bp, Homo sapiens
gctgcagtgagccaagatcgtg

SEQ ID NO: 6920742 - DNA, 22 bp, Homo sapiens
acacctggtctttgcatgagca

SEQ ID NO: 6920743 - DNA, 21 bp, Homo sapiens
agccagtcattatgagcggga

SEQ ID NO: 6920744 - DNA, 22 bp, Homo sapiens
ccatggtctctgtgaagcctgt

SEQ ID NO: 6920745 - DNA, 22 bp, Homo sapiens
agaggggtgggcacagcgccca

SEQ ID NO: 6920746 - DNA, 22 bp, Homo sapiens
acacatctgcaagagccagacc

SEQ ID NO: 6920747 - DNA, 22 bp, Homo sapiens
tgacacccattatctgtgtgac

SEQ ID NO: 6920748 - DNA, 22 bp, Homo sapiens
tgggcctcctttccattcagag

SEQ ID NO: 6920749 - DNA, 22 bp, Homo sapiens
tgagccagtggaagatggcagt

SEQ ID NO: 6920750 - DNA, 22 bp, Homo sapiens
ttccaggctgcagttttctagt

SEQ ID NO: 6920751 - DNA, 22 bp, Homo sapiens
ttgccagataggcatgaaaagt

SEQ ID NO: 6920752 - DNA, 22 bp, Homo sapiens
cacctgaagatttagagattga

SEQ ID NO: 6920753 - DNA, 19 bp, Homo sapiens
aaagtgttttaaagaggat

SEQ ID NO: 6920754 - DNA, 22 bp, Homo sapiens
atattggggataattgtgctgc

SEQ ID NO: 6920755 - DNA, 22 bp, Homo sapiens
cccaggactctgacacccccaa

SEQ ID NO: 6920756 - DNA, 22 bp, Homo sapiens
tggtactgtcatccattttaaa

SEQ ID NO: 6920757 - DNA, 22 bp, Homo sapiens
gcaaagtaaaaatagattctga

SEQ ID NO: 6920758 - DNA, 22 bp, Homo sapiens
acagaaacccagaaaacctctc

SEQ ID NO: 6920759 - DNA, 22 bp, Homo sapiens
tccaatttgaaatggtatatgt

SEQ ID NO: 6920760 - DNA, 22 bp, Homo sapiens
aaggctcactgaaatgtaggca

SEQ ID NO: 6920761 - DNA, 22 bp, Homo sapiens
aggcatgtatatgtgcacatgt

SEQ ID NO: 6920762 - DNA, 22 bp, Homo sapiens
cctgtgggcgcagctggagtca

SEQ ID NO: 6920763 - DNA, 22 bp, Homo sapiens
atgaggccaccttctacatttc

SEQ ID NO: 6920764 - DNA, 22 bp, Homo sapiens
cggggtgggaatagacctgtct

SEQ ID NO: 6920765 - DNA, 22 bp, Homo sapiens
agggcctggggtagcttactgc

SEQ ID NO: 6920766 - DNA, 22 bp, Homo sapiens
acatttatataactcactagga

SEQ ID NO: 6920767 - DNA, 18 bp, Homo sapiens
gcagtgcaggaagaagag

SEQ ID NO: 6920768 - DNA, 22 bp, Homo sapiens
cctgggcaacatagtgagacct

SEQ ID NO: 6920769 - DNA, 22 bp, Homo sapiens
ctgaaatatagatgtgaacagt

SEQ ID NO: 6920770 - DNA, 22 bp, Homo sapiens
ccctatgctttgggaggatcac

SEQ ID NO: 6920771 - DNA, 22 bp, Homo sapiens
ggagtcaaggaaggctctgtga

SEQ ID NO: 6920772 - DNA, 22 bp, Homo sapiens
atgctcagtagctggctgaccc

SEQ ID NO: 6920773 - DNA, 22 bp, Homo sapiens
attggctattgagtgtgtgctg

SEQ ID NO: 6920774 - DNA, 22 bp, Homo sapiens
tctaaaatgcagatctactggt

SEQ ID NO: 6920775 - DNA, 22 bp, Homo sapiens
atctacagcagtgccaggtagc

SEQ ID NO: 6920776 - DNA, 22 bp, Homo sapiens
atgaggcaggtggaggctgcca

SEQ ID NO: 6920777 - DNA, 22 bp, Homo sapiens
aattgggcactttcttcttgca

SEQ ID NO: 6920778 - DNA, 22 bp, Homo sapiens
gggctttaatcttgttaactag

SEQ ID NO: 6920779 - DNA, 20 bp, Homo sapiens
atgatagtcagaaaactagc

SEQ ID NO: 6920780 - DNA, 22 bp, Homo sapiens
aaatcagagtctgattttaagg

SEQ ID NO: 6920781 - DNA, 22 bp, Homo sapiens
aggcattctagaagtagaagta

SEQ ID NO: 6920782 - DNA, 22 bp, Homo sapiens
gtacacatatttccaagggtaa

SEQ ID NO: 6920783 - DNA, 22 bp, Homo sapiens
gccagctgaaatttcagttctg

SEQ ID NO: 6920784 - DNA, 22 bp, Homo sapiens
tgtggagtggtctgaaggctcc

SEQ ID NO: 6920785 - DNA, 22 bp, Homo sapiens
agcccagcggagcgggcccggg

SEQ ID NO: 6920786 - DNA, 22 bp, Homo sapiens
cagatgaccgtcttccagccag

SEQ ID NO: 6920787 - DNA, 22 bp, Homo sapiens
tggaagacaggcatggaagtgg

SEQ ID NO: 6920788 - DNA, 22 bp, Homo sapiens
agggatgatttcagtgtctgcc

SEQ ID NO: 6920789 - DNA, 22 bp, Homo sapiens
tcactgtcttttaaggtggtta

SEQ ID NO: 6920790 - DNA, 22 bp, Homo sapiens
gcagtgtgaccgagcttgcttc

SEQ ID NO: 6920791 - DNA, 22 bp, Homo sapiens
tattccaggtttcttgttgtat

SEQ ID NO: 6920792 - DNA, 22 bp, Homo sapiens
tttgctgggctctgtgccagac

SEQ ID NO: 6920793 - DNA, 22 bp, Homo sapiens
ctagcctgggatttgaacttat

SEQ ID NO: 6920794 - DNA, 22 bp, Homo sapiens
tcttggctgcgtcctggctgtg

SEQ ID NO: 6920795 - DNA, 22 bp, Homo sapiens
gctgccaccgtggagatgagtg

SEQ ID NO: 6920796 - DNA, 22 bp, Homo sapiens
agccctggctcccagcagcgct

SEQ ID NO: 6920797 - DNA, 22 bp, Homo sapiens
atgggcagtgtattggaaggaa

SEQ ID NO: 6920798 - DNA, 22 bp, Homo sapiens
cactgaactccttgtttgtcct

SEQ ID NO: 6920799 - DNA, 22 bp, Homo sapiens
aatctcacctcccgctcctggt

SEQ ID NO: 6920800 - DNA, 22 bp, Homo sapiens
gtgtaatgttgtcagcatcatc

SEQ ID NO: 6920801 - DNA, 17 bp, Homo sapiens
aggctgctgggccaggg

SEQ ID NO: 6920802 - DNA, 22 bp, Homo sapiens
ctctgggaagtagatttggcct

SEQ ID NO: 6920803 - DNA, 22 bp, Homo sapiens
tgtggccagaggtactatttta

SEQ ID NO: 6920804 - DNA, 22 bp, Homo sapiens
ttcatgatagtatctattcaat

SEQ ID NO: 6920805 - DNA, 22 bp, Homo sapiens
aatgtgggggtgagctgtatat

SEQ ID NO: 6920806 - DNA, 22 bp, Homo sapiens
cttccctctgctccttggtcca

SEQ ID NO: 6920807 - DNA, 22 bp, Homo sapiens
cagaggctcttcctcactgccc

SEQ ID NO: 6920808 - DNA, 22 bp, Homo sapiens
tattattgactattcagaatgt

SEQ ID NO: 6920809 - DNA, 22 bp, Homo sapiens
tctgcatcatgatgtttgcaag

SEQ ID NO: 6920810 - DNA, 22 bp, Homo sapiens
actgtactccagcctggtggca

SEQ ID NO: 6920811 - DNA, 22 bp, Homo sapiens
ctacaaagaaagctgaggggaa

SEQ ID NO: 6920812 - DNA, 22 bp, Homo sapiens
ctgttagtcttttgcaggagag

SEQ ID NO: 6920813 - DNA, 20 bp, Homo sapiens
actctgtaggtaatgagact

SEQ ID NO: 6920814 - DNA, 22 bp, Homo sapiens
tgtcaccttgctcatcctcgga

SEQ ID NO: 6920815 - DNA, 22 bp, Homo sapiens
aatggcttctttttggtataat

SEQ ID NO: 6920816 - DNA, 22 bp, Homo sapiens
tatcttggactctttgcagtgc

SEQ ID NO: 6920817 - DNA, 22 bp, Homo sapiens
caggatgctgaaaacacgagga

SEQ ID NO: 6920818 - DNA, 22 bp, Homo sapiens
ctgctgccttccaaaggccagg

SEQ ID NO: 6920819 - DNA, 22 bp, Homo sapiens
tggctgagagcaattgactctg

SEQ ID NO: 6920820 - DNA, 22 bp, Homo sapiens
cctggctggggtagaagtgagg

SEQ ID NO: 6920821 - DNA, 21 bp, Homo sapiens
tgcctatatgaaaggggtgtt

SEQ ID NO: 6920822 - DNA, 22 bp, Homo sapiens
ctgggctaattaagcacagctg

SEQ ID NO: 6920823 - DNA, 22 bp, Homo sapiens
aacctggccccagattccccat

SEQ ID NO: 6920824 - DNA, 22 bp, Homo sapiens
tggaaagacatgtccttcatta

SEQ ID NO: 6920825 - DNA, 22 bp, Homo sapiens
gaaatctgaactctgtatcctt

SEQ ID NO: 6920826 - DNA, 20 bp, Homo sapiens
ggaaacatttttatttccat

SEQ ID NO: 6920827 - DNA, 22 bp, Homo sapiens
tggccctcagcactgagacctt

SEQ ID NO: 6920828 - DNA, 22 bp, Homo sapiens
ttgctatttcctgaaataagca

SEQ ID NO: 6920829 - DNA, 22 bp, Homo sapiens
aaggcagataagaattcagcaa

SEQ ID NO: 6920830 - DNA, 22 bp, Homo sapiens
tgaaagtgtcatagaaacccat

SEQ ID NO: 6920831 - DNA, 22 bp, Homo sapiens
gtttatcattattattagcaac

SEQ ID NO: 6920832 - DNA, 22 bp, Homo sapiens
cccagactcatccctgggagct

SEQ ID NO: 6920833 - DNA, 22 bp, Homo sapiens
gctgctgtacttggggggtgct

SEQ ID NO: 6920834 - DNA, 23 bp, Homo sapiens
taggcttctgctgtccccgacgc

SEQ ID NO: 6920835 - DNA, 22 bp, Homo sapiens
aacctcatttccttctttgtaa

SEQ ID NO: 6920836 - DNA, 22 bp, Homo sapiens
tggctccgttgtacaggctgga

SEQ ID NO: 6920837 - DNA, 22 bp, Homo sapiens
gtcctgctcatttaattcagca

SEQ ID NO: 6920838 - DNA, 19 bp, Homo sapiens
gggatgggccctcaccctc

SEQ ID NO: 6920839 - DNA, 22 bp, Homo sapiens
gttttatttccatgagagaccg

SEQ ID NO: 6920840 - DNA, 22 bp, Homo sapiens
agtcactctgctacatgacagc

SEQ ID NO: 6920841 - DNA, 22 bp, Homo sapiens
ttaatgtcaacatttctgaaga

SEQ ID NO: 6920842 - DNA, 22 bp, Homo sapiens
ctgctggtctctttggattgcg

SEQ ID NO: 6920843 - DNA, 22 bp, Homo sapiens
gacactttgggactcagcccta

SEQ ID NO: 6920844 - DNA, 22 bp, Homo sapiens
gctatattttgaaggagagcca

SEQ ID NO: 6920845 - DNA, 22 bp, Homo sapiens
tagtgcaaggttttgccaactt

SEQ ID NO: 6920846 - DNA, 19 bp, Homo sapiens
gagtacaggtgcagaaatg

SEQ ID NO: 6920847 - DNA, 22 bp, Homo sapiens
taaaatgtagcttctaggctgg

SEQ ID NO: 6920848 - DNA, 20 bp, Homo sapiens
gttctcactgatctgcaggg

SEQ ID NO: 6920849 - DNA, 19 bp, Homo sapiens
agaaggctcctgttggaga

SEQ ID NO: 6920850 - DNA, 22 bp, Homo sapiens
tttgcaaacacttaagaagaga

SEQ ID NO: 6920851 - DNA, 22 bp, Homo sapiens
tgattagatagtaagtgactaa

SEQ ID NO: 6920852 - DNA, 22 bp, Homo sapiens
ctagatccattttctgtctctg

SEQ ID NO: 6920853 - DNA, 22 bp, Homo sapiens
tctgttgcatatgctgctgggt

SEQ ID NO: 6920854 - DNA, 22 bp, Homo sapiens
aatccatctcagtagtaccctg

SEQ ID NO: 6920855 - DNA, 22 bp, Homo sapiens
gttcaagttatgcctttaccct

SEQ ID NO: 6920856 - DNA, 21 bp, Homo sapiens
gtttagaagtagtctggctca

SEQ ID NO: 6920857 - DNA, 22 bp, Homo sapiens
tttcaagtagccctggctccca

SEQ ID NO: 6920858 - DNA, 22 bp, Homo sapiens
tatatattcttaagtagtgtag

SEQ ID NO: 6920859 - DNA, 22 bp, Homo sapiens
tttcctcttcttcccatgtcat

SEQ ID NO: 6920860 - DNA, 22 bp, Homo sapiens
tcccctgagacccctcagcact

SEQ ID NO: 6920861 - DNA, 22 bp, Homo sapiens
agtgaagtgatagtttgcctag

SEQ ID NO: 6920862 - DNA, 22 bp, Homo sapiens
cctgtctctgcagggccctgcc

SEQ ID NO: 6920863 - DNA, 22 bp, Homo sapiens
ggctttgatgtggtgtcaattt

SEQ ID NO: 6920864 - DNA, 22 bp, Homo sapiens
aaagccagttcttttatattgg

SEQ ID NO: 6920865 - DNA, 22 bp, Homo sapiens
tcacaatggcatagtataaaat

SEQ ID NO: 6920866 - DNA, 22 bp, Homo sapiens
tgcctgggacatgctgtggact

SEQ ID NO: 6920867 - DNA, 22 bp, Homo sapiens
tgccaccttgtgcagcaggagg

SEQ ID NO: 6920868 - DNA, 22 bp, Homo sapiens
gagctgagtctgcagtcgccat

SEQ ID NO: 6920869 - DNA, 22 bp, Homo sapiens
tgcaaggaagggacagctgaga

SEQ ID NO: 6920870 - DNA, 22 bp, Homo sapiens
aagggcttacatctgtttctaa

SEQ ID NO: 6920871 - DNA, 22 bp, Homo sapiens
ccttctcccctctgcagggtgt

SEQ ID NO: 6920872 - DNA, 22 bp, Homo sapiens
ttgttatctgcgtgaagaaaat

SEQ ID NO: 6920873 - DNA, 22 bp, Homo sapiens
aaggattagtaggtacagttca

SEQ ID NO: 6920874 - DNA, 22 bp, Homo sapiens
gtgaagcagttgcgtgggttcc

SEQ ID NO: 6920875 - DNA, 22 bp, Homo sapiens
tcaagctgcatcagtgcagtga

SEQ ID NO: 6920876 - DNA, 22 bp, Homo sapiens
cccagaaggtcgaggctgcagt

SEQ ID NO: 6920877 - DNA, 22 bp, Homo sapiens
cccaggaggtcgaagctgcagt

SEQ ID NO: 6920878 - DNA, 22 bp, Homo sapiens
aatctagtttcagactttgagt

SEQ ID NO: 6920879 - DNA, 17 bp, Homo sapiens
gtcactgtctaatgaag

SEQ ID NO: 6920880 - DNA, 19 bp, Homo sapiens
tgtctctgaaagatgagct

SEQ ID NO: 6920881 - DNA, 22 bp, Homo sapiens
ggctagaactttacactttgca

SEQ ID NO: 6920882 - DNA, 22 bp, Homo sapiens
tacagtagaatttttagtaact

SEQ ID NO: 6920883 - DNA, 22 bp, Homo sapiens
acagaacttggaacttttcaca

SEQ ID NO: 6920884 - DNA, 22 bp, Homo sapiens
gacagacacctggggggttgct

SEQ ID NO: 6920885 - DNA, 22 bp, Homo sapiens
tacagaggctgggttttcaggg

SEQ ID NO: 6920886 - DNA, 22 bp, Homo sapiens
gttagaaagtgtctgcttgggt

SEQ ID NO: 6920887 - DNA, 22 bp, Homo sapiens
ccctgaggcaaaggctagagtt

SEQ ID NO: 6920888 - DNA, 17 bp, Homo sapiens
ggccttggggcctcagt

SEQ ID NO: 6920889 - DNA, 22 bp, Homo sapiens
tgtttccccaaccccacaagta

SEQ ID NO: 6920890 - DNA, 20 bp, Homo sapiens
ctgtggcatcttgaaggagg

SEQ ID NO: 6920891 - DNA, 19 bp, Homo sapiens
tgccctaggggatgcgggg

SEQ ID NO: 6920892 - DNA, 22 bp, Homo sapiens
catgaaattgctcctttggtgc

SEQ ID NO: 6920893 - DNA, 22 bp, Homo sapiens
gatacattccatttctacttaa

SEQ ID NO: 6920894 - DNA, 22 bp, Homo sapiens
tggcagctcccagagcttccaa

SEQ ID NO: 6920895 - DNA, 22 bp, Homo sapiens
atatcattatgttatgagcaca

SEQ ID NO: 6920896 - DNA, 22 bp, Homo sapiens
aaagaggggactgttaattcca

SEQ ID NO: 6920897 - DNA, 23 bp, Homo sapiens
attaccagcctgacaccaacaaa

SEQ ID NO: 6920898 - DNA, 22 bp, Homo sapiens
agaaaatttaaagagacacaca

SEQ ID NO: 6920899 - DNA, 22 bp, Homo sapiens
aatgtcattgtgagttaggctt

SEQ ID NO: 6920900 - DNA, 22 bp, Homo sapiens
cacagggagttacagaagcact

SEQ ID NO: 6920901 - DNA, 22 bp, Homo sapiens
ctggaacagaagcactggagag

SEQ ID NO: 6920902 - DNA, 22 bp, Homo sapiens
acaggattactggattatgaca

SEQ ID NO: 6920903 - DNA, 22 bp, Homo sapiens
acatccatgcatgtctgtgcac

SEQ ID NO: 6920904 - DNA, 22 bp, Homo sapiens
tcactgcaacctccgcctgctg

SEQ ID NO: 6920905 - DNA, 22 bp, Homo sapiens
acatttctgcatgtagggtaat

SEQ ID NO: 6920906 - DNA, 22 bp, Homo sapiens
ttcctggcacatagttagtgct

SEQ ID NO: 6920907 - DNA, 22 bp, Homo sapiens
tttctagaaacattatctctat

SEQ ID NO: 6920908 - DNA, 19 bp, Homo sapiens
accctctctgtagaaagat

SEQ ID NO: 6920909 - DNA, 22 bp, Homo sapiens
cagaggtagggttggcccagga

SEQ ID NO: 6920910 - DNA, 22 bp, Homo sapiens
tttcattacgtgtttgacttgt

SEQ ID NO: 6920911 - DNA, 22 bp, Homo sapiens
gctgcagccctgcggatcactt

SEQ ID NO: 6920912 - DNA, 22 bp, Homo sapiens
gtctgatatcagaaaaagtaaa

SEQ ID NO: 6920913 - DNA, 22 bp, Homo sapiens
gcagaaacaggagaaagggatc

SEQ ID NO: 6920914 - DNA, 22 bp, Homo sapiens
ctggattttatcattgtagttt

SEQ ID NO: 6920915 - DNA, 22 bp, Homo sapiens
tgcacacacaggagtctcctcc

SEQ ID NO: 6920916 - DNA, 22 bp, Homo sapiens
ctagcagggattgggcactggg

SEQ ID NO: 6920917 - DNA, 22 bp, Homo sapiens
gcatagaatttagagacaaaag

SEQ ID NO: 6920918 - DNA, 22 bp, Homo sapiens
gtgctgtctccctctcctgagt

SEQ ID NO: 6920919 - DNA, 22 bp, Homo sapiens
tgtcttcagcaaatgcctttct

SEQ ID NO: 6920920 - DNA, 22 bp, Homo sapiens
atttactgagcagctaccatgt

SEQ ID NO: 6920921 - DNA, 22 bp, Homo sapiens
aagctggacactgacccactgt

SEQ ID NO: 6920922 - DNA, 22 bp, Homo sapiens
aaaaagtattggccatggttga

SEQ ID NO: 6920923 - DNA, 22 bp, Homo sapiens
tgagagcacacagaaatatttt

SEQ ID NO: 6920924 - DNA, 22 bp, Homo sapiens
tgcatgacactgctgattagat

SEQ ID NO: 6920925 - DNA, 22 bp, Homo sapiens
tcatagaagtagtatccacatt

SEQ ID NO: 6920926 - DNA, 22 bp, Homo sapiens
gtccacagtgaggtgtttaaat

SEQ ID NO: 6920927 - DNA, 22 bp, Homo sapiens
actctgggagaggacaaacaaa

SEQ ID NO: 6920928 - DNA, 22 bp, Homo sapiens
ggcaggctccgtgttccattcc

SEQ ID NO: 6920929 - DNA, 22 bp, Homo sapiens
tagcacatcttcttggcctgca

SEQ ID NO: 6920930 - DNA, 22 bp, Homo sapiens
agctccagaaaggtacacacag

SEQ ID NO: 6920931 - DNA, 22 bp, Homo sapiens
aatatggctccattcctttagg

SEQ ID NO: 6920932 - DNA, 22 bp, Homo sapiens
cagcatggacccatcgctgagt

SEQ ID NO: 6920933 - DNA, 22 bp, Homo sapiens
ggctctatttgtgtgttcgtaa

SEQ ID NO: 6920934 - DNA, 22 bp, Homo sapiens
ttcatactcactccaataactg

SEQ ID NO: 6920935 - DNA, 22 bp, Homo sapiens
tgtacgctcacatctgaccata

SEQ ID NO: 6920936 - DNA, 22 bp, Homo sapiens
aactccagcaggaaggtgagaa

SEQ ID NO: 6920937 - DNA, 22 bp, Homo sapiens
tccaagaatcactgacacagct

SEQ ID NO: 6920938 - DNA, 22 bp, Homo sapiens
ttacagatggatctagcaaaat

SEQ ID NO: 6920939 - DNA, 22 bp, Homo sapiens
tgcagaaggaggaggaaatcca

SEQ ID NO: 6920940 - DNA, 22 bp, Homo sapiens
gagaagcaatcgtgacatctcc

SEQ ID NO: 6920941 - DNA, 17 bp, Homo sapiens
tctcagtgactgatagc

SEQ ID NO: 6920942 - DNA, 22 bp, Homo sapiens
gctgggtctggctgtgagccgg

SEQ ID NO: 6920943 - DNA, 22 bp, Homo sapiens
tggtccacagggagtccgtgct

SEQ ID NO: 6920944 - DNA, 22 bp, Homo sapiens
taagtgatgagcacagtaatta

SEQ ID NO: 6920945 - DNA, 22 bp, Homo sapiens
tgacaaagtgctagtcggtgaa

SEQ ID NO: 6920946 - DNA, 22 bp, Homo sapiens
aattaatatttgtggaattaat

SEQ ID NO: 6920947 - DNA, 22 bp, Homo sapiens
tcaaccagagtttttcttaata

SEQ ID NO: 6920948 - DNA, 22 bp, Homo sapiens
gtgtttgtctcttggcctacct

SEQ ID NO: 6920949 - DNA, 22 bp, Homo sapiens
tgcacctggactaactaactca

SEQ ID NO: 6920950 - DNA, 22 bp, Homo sapiens
gaaaagggcaagagagagggca

SEQ ID NO: 6920951 - DNA, 22 bp, Homo sapiens
gtcaatatagatcaatgcacag

SEQ ID NO: 6920952 - DNA, 22 bp, Homo sapiens
gttcagctaggaatggagatgc

SEQ ID NO: 6920953 - DNA, 22 bp, Homo sapiens
tctccctgtttgctacgctatc

SEQ ID NO: 6920954 - DNA, 22 bp, Homo sapiens
cagatttcaaggaggcactcca

SEQ ID NO: 6920955 - DNA, 22 bp, Homo sapiens
gcctggctgtctggcaaggttc

SEQ ID NO: 6920956 - DNA, 22 bp, Homo sapiens
tgtccagctgaaggcagcctca

SEQ ID NO: 6920957 - DNA, 22 bp, Homo sapiens
taccaggaattattttacattt

SEQ ID NO: 6920958 - DNA, 20 bp, Homo sapiens
tggtcctgtcccacccactc

SEQ ID NO: 6920959 - DNA, 22 bp, Homo sapiens
gaggaaagagtcaaatctgaag

SEQ ID NO: 6920960 - DNA, 22 bp, Homo sapiens
cccaggcagagagctggtgagc

SEQ ID NO: 6920961 - DNA, 22 bp, Homo sapiens
ttagccatgagctgggcgactc

SEQ ID NO: 6920962 - DNA, 22 bp, Homo sapiens
tgaggctcaaggtctggtggag

SEQ ID NO: 6920963 - DNA, 21 bp, Homo sapiens
ctgacatgtggaaaaggagag

SEQ ID NO: 6920964 - DNA, 22 bp, Homo sapiens
ttgcacctgtctctgtgttggg

SEQ ID NO: 6920965 - DNA, 22 bp, Homo sapiens
cctgggctctgaggagggagtc

SEQ ID NO: 6920966 - DNA, 17 bp, Homo sapiens
gtattctttgccttcca

SEQ ID NO: 6920967 - DNA, 22 bp, Homo sapiens
aagttcgaaatttagggagatg

SEQ ID NO: 6920968 - DNA, 22 bp, Homo sapiens
tgtacacaatgtgcaggtttgt

SEQ ID NO: 6920969 - DNA, 22 bp, Homo sapiens
ttagtgtccagagtttttatta

SEQ ID NO: 6920970 - DNA, 21 bp, Homo sapiens
aggtacaggtcttgtgagtct

SEQ ID NO: 6920971 - DNA, 22 bp, Homo sapiens
gatcttgaaatatcttttccta

SEQ ID NO: 6920972 - DNA, 22 bp, Homo sapiens
attgttgggtagtttgttcagc

SEQ ID NO: 6920973 - DNA, 22 bp, Homo sapiens
ccagggcacgttgggacagtac

SEQ ID NO: 6920974 - DNA, 22 bp, Homo sapiens
gctcagtttcttctattgtatt

SEQ ID NO: 6920975 - DNA, 18 bp, Homo sapiens
tactgagcaacaggagaa

SEQ ID NO: 6920976 - DNA, 22 bp, Homo sapiens
tgatgtcctcatgtcaagctcc

SEQ ID NO: 6920977 - DNA, 22 bp, Homo sapiens
attgttgccacaaggcaattct

SEQ ID NO: 6920978 - DNA, 22 bp, Homo sapiens
tctcaagcttgttggtatgttt

SEQ ID NO: 6920979 - DNA, 22 bp, Homo sapiens
acatctgtttaacgaaggcatt

SEQ ID NO: 6920980 - DNA, 22 bp, Homo sapiens
tcatacataacttgtacagtga

SEQ ID NO: 6920981 - DNA, 22 bp, Homo sapiens
catcaaattatgtgtcaaagca

SEQ ID NO: 6920982 - DNA, 20 bp, Homo sapiens
gtgtttcatgtgatacaatg

SEQ ID NO: 6920983 - DNA, 22 bp, Homo sapiens
cctgataaaccctggaatttgt

SEQ ID NO: 6920984 - DNA, 22 bp, Homo sapiens
agcagcacgagtccacaaatcc

SEQ ID NO: 6920985 - DNA, 22 bp, Homo sapiens
atttggaactgggcatgcaaac

SEQ ID NO: 6920986 - DNA, 22 bp, Homo sapiens
aggaccaggtctaatgaagaca

SEQ ID NO: 6920987 - DNA, 22 bp, Homo sapiens
ttccctttcttaaagagttagg

SEQ ID NO: 6920988 - DNA, 22 bp, Homo sapiens
catactgtcagagcctgaaggg

SEQ ID NO: 6920989 - DNA, 22 bp, Homo sapiens
tgaacatgctgttgatggcctg

SEQ ID NO: 6920990 - DNA, 22 bp, Homo sapiens
agtggtagagtcaaggttgtaa

SEQ ID NO: 6920991 - DNA, 22 bp, Homo sapiens
gtaagttagttcctgtgttagt

SEQ ID NO: 6920992 - DNA, 22 bp, Homo sapiens
tccaagaatcagtctcttttgg

SEQ ID NO: 6920993 - DNA, 22 bp, Homo sapiens
tggctggaaacaggagattcag

SEQ ID NO: 6920994 - DNA, 19 bp, Homo sapiens
gaaaacatgggtgagggtc

SEQ ID NO: 6920995 - DNA, 22 bp, Homo sapiens
aggcagcctttttggaaacata

SEQ ID NO: 6920996 - DNA, 22 bp, Homo sapiens
ctcacctgtaagatggaagaga

SEQ ID NO: 6920997 - DNA, 22 bp, Homo sapiens
gtcaggggatgtgctggtggcc

SEQ ID NO: 6920998 - DNA, 22 bp, Homo sapiens
gctatgaaacacatttagttca

SEQ ID NO: 6920999 - DNA, 22 bp, Homo sapiens
taatgtcagtgacctggtttaa

SEQ ID NO: 6921000 - DNA, 22 bp, Homo sapiens
gcagggggatggagttgaaatg

SEQ ID NO: 6921001 - DNA, 22 bp, Homo sapiens
acatgtgtaagatgtgatatat

SEQ ID NO: 6921002 - DNA, 22 bp, Homo sapiens
tctctagggcgggttgaaatga

SEQ ID NO: 6921003 - DNA, 22 bp, Homo sapiens
caggcctgatacactgaactct

SEQ ID NO: 6921004 - DNA, 22 bp, Homo sapiens
agcaatatttaaaggtttgcaa

SEQ ID NO: 6921005 - DNA, 22 bp, Homo sapiens
ttcttacaagtattccaggtcc

SEQ ID NO: 6921006 - DNA, 22 bp, Homo sapiens
tgatgggaggtgctgcaggacc

SEQ ID NO: 6921007 - DNA, 22 bp, Homo sapiens
ggggcgcgtcagttccccgcct

SEQ ID NO: 6921008 - DNA, 22 bp, Homo sapiens
tacagataactgaatgcagact

SEQ ID NO: 6921009 - DNA, 22 bp, Homo sapiens
caggctccctaagtcagcagcc

SEQ ID NO: 6921010 - DNA, 22 bp, Homo sapiens
aaaagttaactgtgttcatgca

SEQ ID NO: 6921011 - DNA, 22 bp, Homo sapiens
atcacatatatgcaccaagaca

SEQ ID NO: 6921012 - DNA, 22 bp, Homo sapiens
tcacacacataatctaagatta

SEQ ID NO: 6921013 - DNA, 22 bp, Homo sapiens
atacagaattcactacagtttc

SEQ ID NO: 6921014 - DNA, 22 bp, Homo sapiens
caaaccggaaagtgtgaggaca

SEQ ID NO: 6921015 - DNA, 22 bp, Homo sapiens
tatctaataaatctgataagta

SEQ ID NO: 6921016 - DNA, 22 bp, Homo sapiens
aaggctttatgactccagtgga

SEQ ID NO: 6921017 - DNA, 22 bp, Homo sapiens
actaagagtacataggtaggaa

SEQ ID NO: 6921018 - DNA, 22 bp, Homo sapiens
tctggcttgagcttcgaccagt

SEQ ID NO: 6921019 - DNA, 21 bp, Homo sapiens
tgtggcatcattgatctgtga

SEQ ID NO: 6921020 - DNA, 17 bp, Homo sapiens
ctgatggattttttcca

SEQ ID NO: 6921021 - DNA, 22 bp, Homo sapiens
tccacagactattaagtgatct

SEQ ID NO: 6921022 - DNA, 22 bp, Homo sapiens
aagcttgtagagtttgacttcc

SEQ ID NO: 6921023 - DNA, 22 bp, Homo sapiens
aatactagttaaatgaatgaat

SEQ ID NO: 6921024 - DNA, 22 bp, Homo sapiens
tggctacctgatttcttttcag

SEQ ID NO: 6921025 - DNA, 22 bp, Homo sapiens
acttgcatgatcctgagagtat

SEQ ID NO: 6921026 - DNA, 22 bp, Homo sapiens
ctgacaaaccactgctccagct

SEQ ID NO: 6921027 - DNA, 22 bp, Homo sapiens
gagtgatttaagctatttttaa

SEQ ID NO: 6921028 - DNA, 22 bp, Homo sapiens
tcccaggaatccgtcctctaga

SEQ ID NO: 6921029 - DNA, 22 bp, Homo sapiens
caccagaacaagacaggagaat

SEQ ID NO: 6921030 - DNA, 22 bp, Homo sapiens
cctttctctggcagcaggacag

SEQ ID NO: 6921031 - DNA, 22 bp, Homo sapiens
aattatccttaatgcagtaagc

SEQ ID NO: 6921032 - DNA, 22 bp, Homo sapiens
atgtccttgttttggtgacact

SEQ ID NO: 6921033 - DNA, 20 bp, Homo sapiens
gggaggcattggtccctcac

SEQ ID NO: 6921034 - DNA, 22 bp, Homo sapiens
tgaggccacaggaaagggcccg

SEQ ID NO: 6921035 - DNA, 22 bp, Homo sapiens
agacactggtgaagaaatcagg

SEQ ID NO: 6921036 - DNA, 22 bp, Homo sapiens
tagatcaggctgcttagataga

SEQ ID NO: 6921037 - DNA, 22 bp, Homo sapiens
agccacagtgcaagagagaaaa

SEQ ID NO: 6921038 - DNA, 22 bp, Homo sapiens
ggttccttctgaggtccctgta

SEQ ID NO: 6921039 - DNA, 22 bp, Homo sapiens
tgactggattgtcattacgacg

SEQ ID NO: 6921040 - DNA, 22 bp, Homo sapiens
ttgctttattcacatctatatt

SEQ ID NO: 6921041 - DNA, 22 bp, Homo sapiens
cagcagggaagctgtgctgttt

SEQ ID NO: 6921042 - DNA, 22 bp, Homo sapiens
gccaaagtgctgctctttacca

SEQ ID NO: 6921043 - DNA, 22 bp, Homo sapiens
acatgccagcctcagcagcagt

SEQ ID NO: 6921044 - DNA, 22 bp, Homo sapiens
cctgccagtgaagctgacgggc

SEQ ID NO: 6921045 - DNA, 22 bp, Homo sapiens
aggatgaataactgaaatggtg

SEQ ID NO: 6921046 - DNA, 22 bp, Homo sapiens
tgagttatctaaaatagtcaaa

SEQ ID NO: 6921047 - DNA, 22 bp, Homo sapiens
ctgtcaggtttcccggctcacg

SEQ ID NO: 6921048 - DNA, 22 bp, Homo sapiens
atcagctcattttgatggaaat

SEQ ID NO: 6921049 - DNA, 22 bp, Homo sapiens
tttttgtggtatattgcaacaa

SEQ ID NO: 6921050 - DNA, 22 bp, Homo sapiens
tctcccagtcctctgtgcttac

SEQ ID NO: 6921051 - DNA, 22 bp, Homo sapiens
tgctgcctttgcttagcgaata

SEQ ID NO: 6921052 - DNA, 22 bp, Homo sapiens
ctcatctgtctgggctggtttt

SEQ ID NO: 6921053 - DNA, 22 bp, Homo sapiens
aattgatgggcactgaaatatt

SEQ ID NO: 6921054 - DNA, 22 bp, Homo sapiens
actgggctccaaggacctggag

SEQ ID NO: 6921055 - DNA, 22 bp, Homo sapiens
ttcacagggccactggcaggag

SEQ ID NO: 6921056 - DNA, 22 bp, Homo sapiens
acagtgatcttttagttggaac

SEQ ID NO: 6921057 - DNA, 22 bp, Homo sapiens
atgttcttctatctttattaaa

SEQ ID NO: 6921058 - DNA, 22 bp, Homo sapiens
agatactatggaattttatgag

SEQ ID NO: 6921059 - DNA, 22 bp, Homo sapiens
tcactactgtggaacaactgat

SEQ ID NO: 6921060 - DNA, 22 bp, Homo sapiens
aaccaggatttaagattctaga

SEQ ID NO: 6921061 - DNA, 22 bp, Homo sapiens
tgcaacattattaaactaagca

SEQ ID NO: 6921062 - DNA, 22 bp, Homo sapiens
tagggcatttgtgggtgttgtt

SEQ ID NO: 6921063 - DNA, 22 bp, Homo sapiens
tactgtttttaaaattgcatcc

SEQ ID NO: 6921064 - DNA, 22 bp, Homo sapiens
gattctgagacagaaacgtatt

SEQ ID NO: 6921065 - DNA, 20 bp, Homo sapiens
ggctgctggtttggctctgt

SEQ ID NO: 6921066 - DNA, 22 bp, Homo sapiens
agtggtgccattaaaatcattg

SEQ ID NO: 6921067 - DNA, 22 bp, Homo sapiens
gtattctgtttacagtgagcaa

SEQ ID NO: 6921068 - DNA, 22 bp, Homo sapiens
tatagacaagcgtaacaagaag

SEQ ID NO: 6921069 - DNA, 22 bp, Homo sapiens
gctgcctgtgtggccactcact

SEQ ID NO: 6921070 - DNA, 22 bp, Homo sapiens
cagatgagagtggccagggttc

SEQ ID NO: 6921071 - DNA, 22 bp, Homo sapiens
tattttgtatttatgcaagaaa

SEQ ID NO: 6921072 - DNA, 22 bp, Homo sapiens
tgttactgtggttaccagaagc

SEQ ID NO: 6921073 - DNA, 22 bp, Homo sapiens
cccgggaggaggaagttgcagt

SEQ ID NO: 6921074 - DNA, 22 bp, Homo sapiens
cagccctgtgctaagcaccctc

SEQ ID NO: 6921075 - DNA, 22 bp, Homo sapiens
tgttaaaaattcagctctagat

SEQ ID NO: 6921076 - DNA, 22 bp, Homo sapiens
gccggtcttaagctgactgtga

SEQ ID NO: 6921077 - DNA, 22 bp, Homo sapiens
cagtggcctgagccaggcttcc

SEQ ID NO: 6921078 - DNA, 22 bp, Homo sapiens
tggggctgtggattctcacgaa

SEQ ID NO: 6921079 - DNA, 22 bp, Homo sapiens
tagtaacagatttatacagtct

SEQ ID NO: 6921080 - DNA, 22 bp, Homo sapiens
gctcctgttttcttccagaaat

SEQ ID NO: 6921081 - DNA, 21 bp, Homo sapiens
agaagtcaattgaactgaaat

SEQ ID NO: 6921082 - DNA, 22 bp, Homo sapiens
tgtgaatagattgaagctttgg

SEQ ID NO: 6921083 - DNA, 22 bp, Homo sapiens
ggtgagccgaaaagggtcataa

SEQ ID NO: 6921084 - DNA, 22 bp, Homo sapiens
gccagagaggcctaaggccata

SEQ ID NO: 6921085 - DNA, 22 bp, Homo sapiens
tggctagctgtgggctggaagc

SEQ ID NO: 6921086 - DNA, 22 bp, Homo sapiens
ctcagcaagacccccaccgtgt

SEQ ID NO: 6921087 - DNA, 22 bp, Homo sapiens
agaggtatggtatattggaaga

SEQ ID NO: 6921088 - DNA, 22 bp, Homo sapiens
aaatattggtaggatgcttgtt

SEQ ID NO: 6921089 - DNA, 22 bp, Homo sapiens
atctccccgagcttacctcctg

SEQ ID NO: 6921090 - DNA, 22 bp, Homo sapiens
atttcaagaaggcagcagtggt

SEQ ID NO: 6921091 - DNA, 20 bp, Homo sapiens
gggcagatgtttttatgttg

SEQ ID NO: 6921092 - DNA, 22 bp, Homo sapiens
ggacctgcattttaacaagatc

SEQ ID NO: 6921093 - DNA, 22 bp, Homo sapiens
ctgttgttccgggagctgcagc

SEQ ID NO: 6921094 - DNA, 22 bp, Homo sapiens
aatgttgaggatatcagaaaat

SEQ ID NO: 6921095 - DNA, 22 bp, Homo sapiens
tgctgagaagagggccgaccca

SEQ ID NO: 6921096 - DNA, 22 bp, Homo sapiens
agtgaccatctaacgcctgtga

SEQ ID NO: 6921097 - DNA, 22 bp, Homo sapiens
ggggtctgcgccactgtctgcg

SEQ ID NO: 6921098 - DNA, 22 bp, Homo sapiens
caggcccagtgatcagggctct

SEQ ID NO: 6921099 - DNA, 22 bp, Homo sapiens
agtggcagacagagacagtacc

SEQ ID NO: 6921100 - DNA, 23 bp, Homo sapiens
ctacaggttaattttcagtggaa

SEQ ID NO: 6921101 - DNA, 22 bp, Homo sapiens
tttgttcaaaaattataagata

SEQ ID NO: 6921102 - DNA, 22 bp, Homo sapiens
tgatacagtcagctcacaattg

SEQ ID NO: 6921103 - DNA, 21 bp, Homo sapiens
cctgtgtgtgtccctttaaga

SEQ ID NO: 6921104 - DNA, 22 bp, Homo sapiens
cttcctgggtctggagactgga

SEQ ID NO: 6921105 - DNA, 22 bp, Homo sapiens
atggcagggaccaagctgtcat

SEQ ID NO: 6921106 - DNA, 22 bp, Homo sapiens
acattcatgtcccacttctagc

SEQ ID NO: 6921107 - DNA, 22 bp, Homo sapiens
gcccagcacattgctgaggacc

SEQ ID NO: 6921108 - DNA, 21 bp, Homo sapiens
agagttactgtcatcctaggt

SEQ ID NO: 6921109 - DNA, 22 bp, Homo sapiens
taatgcaacagctgctagtgat

SEQ ID NO: 6921110 - DNA, 22 bp, Homo sapiens
tggtgttgaacctcagcagggg

SEQ ID NO: 6921111 - DNA, 21 bp, Homo sapiens
agctcagcaagatggaggctc

SEQ ID NO: 6921112 - DNA, 22 bp, Homo sapiens
tgttatctgagcaacgtcgacg

SEQ ID NO: 6921113 - DNA, 22 bp, Homo sapiens
ctcaagatcacacagctgagaa

SEQ ID NO: 6921114 - DNA, 22 bp, Homo sapiens
gagcatggcagctgagggcagg

SEQ ID NO: 6921115 - DNA, 18 bp, Homo sapiens
ggcagtgcagtctcaggg

SEQ ID NO: 6921116 - DNA, 23 bp, Homo sapiens
atgtcctgcatagttgcttctgt

SEQ ID NO: 6921117 - DNA, 22 bp, Homo sapiens
gtattatgttccttgcttcttt

SEQ ID NO: 6921118 - DNA, 22 bp, Homo sapiens
aagtacaatctttctgtaaagg

SEQ ID NO: 6921119 - DNA, 22 bp, Homo sapiens
gtgaaaaatcatcatgacttga

SEQ ID NO: 6921120 - DNA, 22 bp, Homo sapiens
gctctgggattaccagccttag

SEQ ID NO: 6921121 - DNA, 22 bp, Homo sapiens
ttcttgaccatgtatgtggtcc

SEQ ID NO: 6921122 - DNA, 22 bp, Homo sapiens
ggcagggtttctccattctgcc

SEQ ID NO: 6921123 - DNA, 22 bp, Homo sapiens
ttaaatgagatgttcagatatt

SEQ ID NO: 6921124 - DNA, 22 bp, Homo sapiens
tacaggagctgctctgtgatac

SEQ ID NO: 6921125 - DNA, 22 bp, Homo sapiens
agagctgtagcttcctagagcc

SEQ ID NO: 6921126 - DNA, 22 bp, Homo sapiens
gctggctggaggtgaggaagaa

SEQ ID NO: 6921127 - DNA, 22 bp, Homo sapiens
ccttagagagtactgggctgcc

SEQ ID NO: 6921128 - DNA, 22 bp, Homo sapiens
agtctggagtagagcctagaaa

SEQ ID NO: 6921129 - DNA, 22 bp, Homo sapiens
tgcacgaaatctttctagtctt

SEQ ID NO: 6921130 - DNA, 22 bp, Homo sapiens
agatgacaagagcttgctgcag

SEQ ID NO: 6921131 - DNA, 22 bp, Homo sapiens
atcagagtgtaagttctttcct

SEQ ID NO: 6921132 - DNA, 22 bp, Homo sapiens
acacagtaaatattgtctcctc

SEQ ID NO: 6921133 - DNA, 22 bp, Homo sapiens
tggttactagtgacttggggac

SEQ ID NO: 6921134 - DNA, 22 bp, Homo sapiens
agggctttgtggcagtcactat

SEQ ID NO: 6921135 - DNA, 22 bp, Homo sapiens
aatgccactaaatctgtgaata

SEQ ID NO: 6921136 - DNA, 17 bp, Homo sapiens
gcacagtgatattattt

SEQ ID NO: 6921137 - DNA, 22 bp, Homo sapiens
tggcagttcaggttggactctt

SEQ ID NO: 6921138 - DNA, 23 bp, Homo sapiens
aggaaccttagaattcactgcca

SEQ ID NO: 6921139 - DNA, 22 bp, Homo sapiens
tctgcaagggcacagccaaccc

SEQ ID NO: 6921140 - DNA, 22 bp, Homo sapiens
ttcttgattcttccttgaagga

SEQ ID NO: 6921141 - DNA, 22 bp, Homo sapiens
cagtggcaaggacagtaataat

SEQ ID NO: 6921142 - DNA, 22 bp, Homo sapiens
ctgtgacaaaagcagcctgcct

SEQ ID NO: 6921143 - DNA, 22 bp, Homo sapiens
gtctgtctctctccagagtgca

SEQ ID NO: 6921144 - DNA, 22 bp, Homo sapiens
actgcattctttatcccacaac

SEQ ID NO: 6921145 - DNA, 22 bp, Homo sapiens
actttacaatatcctgtgactt

SEQ ID NO: 6921146 - DNA, 22 bp, Homo sapiens
acatgaaaaatgtttgcagttt

SEQ ID NO: 6921147 - DNA, 22 bp, Homo sapiens
cttaatgaaaggttgcacatgg

SEQ ID NO: 6921148 - DNA, 22 bp, Homo sapiens
aattaggcatattataaggcat

SEQ ID NO: 6921149 - DNA, 22 bp, Homo sapiens
tcactgtaatttgtatctgtgg

SEQ ID NO: 6921150 - DNA, 22 bp, Homo sapiens
ggactcaggctggtgttcggac

SEQ ID NO: 6921151 - DNA, 22 bp, Homo sapiens
tcaattacagtgtcaccttaag

SEQ ID NO: 6921152 - DNA, 22 bp, Homo sapiens
taaatcactcctaataatcagt

SEQ ID NO: 6921153 - DNA, 22 bp, Homo sapiens
tacacatccatgttttgacttt

SEQ ID NO: 6921154 - DNA, 22 bp, Homo sapiens
tcctgaattgccttagtttctg

SEQ ID NO: 6921155 - DNA, 22 bp, Homo sapiens
atgccctgtggcagtacatatt

SEQ ID NO: 6921156 - DNA, 22 bp, Homo sapiens
cagtcccacaagatctccacaa

SEQ ID NO: 6921157 - DNA, 22 bp, Homo sapiens
tccagccaagccttggtagctg

SEQ ID NO: 6921158 - DNA, 22 bp, Homo sapiens
aacagaattgtacaccagggag

SEQ ID NO: 6921159 - DNA, 22 bp, Homo sapiens
tgcaggaagcaaccaggtccaa

SEQ ID NO: 6921160 - DNA, 22 bp, Homo sapiens
tatacagtgcctcttccattag

SEQ ID NO: 6921161 - DNA, 22 bp, Homo sapiens
tccaggtattactaagtgttaa

SEQ ID NO: 6921162 - DNA, 22 bp, Homo sapiens
tggcactgaccccaggcctgtg

SEQ ID NO: 6921163 - DNA, 22 bp, Homo sapiens
gatgtgtgcttttcgcagtgtc

SEQ ID NO: 6921164 - DNA, 22 bp, Homo sapiens
tggcatgcatctgttgtcctag

SEQ ID NO: 6921165 - DNA, 22 bp, Homo sapiens
tcaggaagggtggtccacaggg

SEQ ID NO: 6921166 - DNA, 22 bp, Homo sapiens
actttctaattgtctccagtgt

SEQ ID NO: 6921167 - DNA, 22 bp, Homo sapiens
cttattgttcctggaccctgag

SEQ ID NO: 6921168 - DNA, 22 bp, Homo sapiens
ttcaaagagttgggtgtctggg

SEQ ID NO: 6921169 - DNA, 22 bp, Homo sapiens
tgttaatttctttagaagtgga

SEQ ID NO: 6921170 - DNA, 22 bp, Homo sapiens
ggctgctgacaaacatgatcat

SEQ ID NO: 6921171 - DNA, 22 bp, Homo sapiens
tgccacctgtacatgctatctg

SEQ ID NO: 6921172 - DNA, 22 bp, Homo sapiens
caggtggcttagtcccatttta

SEQ ID NO: 6921173 - DNA, 22 bp, Homo sapiens
cagtggggaggccaggatagaa

SEQ ID NO: 6921174 - DNA, 22 bp, Homo sapiens
tatgtaggaaacatagggaaac

SEQ ID NO: 6921175 - DNA, 22 bp, Homo sapiens
acacacatggtattgttcagaa

SEQ ID NO: 6921176 - DNA, 22 bp, Homo sapiens
ccaaattaaatcatacagacag

SEQ ID NO: 6921177 - DNA, 22 bp, Homo sapiens
gttccttgtaatttgttaagga

SEQ ID NO: 6921178 - DNA, 22 bp, Homo sapiens
aacaatgcagttaatgggaaga

SEQ ID NO: 6921179 - DNA, 22 bp, Homo sapiens
atggggctgggattctcctcgg

SEQ ID NO: 6921180 - DNA, 20 bp, Homo sapiens
ccagtccacctgagacatgt

SEQ ID NO: 6921181 - DNA, 22 bp, Homo sapiens
gatagagactataatgctcttt

SEQ ID NO: 6921182 - DNA, 23 bp, Homo sapiens
ggcagctctcatctgatgactga

SEQ ID NO: 6921183 - DNA, 22 bp, Homo sapiens
tttggggagacatggccagctg

SEQ ID NO: 6921184 - DNA, 22 bp, Homo sapiens
tcttgtttggattttgggcagt

SEQ ID NO: 6921185 - DNA, 22 bp, Homo sapiens
cctgatatggtgtcatttaaac

SEQ ID NO: 6921186 - DNA, 22 bp, Homo sapiens
gttgttgatcacatgcatatct

SEQ ID NO: 6921187 - DNA, 22 bp, Homo sapiens
tttcaggactcaaaacgataat

SEQ ID NO: 6921188 - DNA, 22 bp, Homo sapiens
atagggtgagtgggtgctggct

SEQ ID NO: 6921189 - DNA, 22 bp, Homo sapiens
gcctaggagacaagcgtgaaag

SEQ ID NO: 6921190 - DNA, 19 bp, Homo sapiens
gcttgctggcgggggtctg

SEQ ID NO: 6921191 - DNA, 22 bp, Homo sapiens
aaagcccccctgatctgagatg

SEQ ID NO: 6921192 - DNA, 22 bp, Homo sapiens
atgtttcatccactggcctttc

SEQ ID NO: 6921193 - DNA, 20 bp, Homo sapiens
catgagaagggcagtgtgag

SEQ ID NO: 6921194 - DNA, 22 bp, Homo sapiens
ttttgaagaagatgggaattta

SEQ ID NO: 6921195 - DNA, 20 bp, Homo sapiens
acagagtagaacatatgcca

SEQ ID NO: 6921196 - DNA, 22 bp, Homo sapiens
agagcagacatccttgtcttgt

SEQ ID NO: 6921197 - DNA, 22 bp, Homo sapiens
actccctcaagtcactttagtt

SEQ ID NO: 6921198 - DNA, 22 bp, Homo sapiens
agtttatgtaaaattagtaatg

SEQ ID NO: 6921199 - DNA, 21 bp, Homo sapiens
tggcatgcagtgttcctgtgc

SEQ ID NO: 6921200 - DNA, 22 bp, Homo sapiens
gcctacatttcccagttgaatg

SEQ ID NO: 6921201 - DNA, 22 bp, Homo sapiens
gaaagggtctttgatttccctc

SEQ ID NO: 6921202 - DNA, 23 bp, Homo sapiens
aaaacagcttcctccagtggctc

SEQ ID NO: 6921203 - DNA, 19 bp, Homo sapiens
gatctttgccaatttaagc

SEQ ID NO: 6921204 - DNA, 22 bp, Homo sapiens
gtattttcaagagcagtagtat

SEQ ID NO: 6921205 - DNA, 22 bp, Homo sapiens
tgagtgaaattctggtaaagga

SEQ ID NO: 6921206 - DNA, 22 bp, Homo sapiens
gagctctgcggaaaacgtgccg

SEQ ID NO: 6921207 - DNA, 22 bp, Homo sapiens
tccatcagcatgcaggctgttc

SEQ ID NO: 6921208 - DNA, 19 bp, Homo sapiens
ccactttgcagatagtgag

SEQ ID NO: 6921209 - DNA, 22 bp, Homo sapiens
gaacctctagtttgttctttga

SEQ ID NO: 6921210 - DNA, 22 bp, Homo sapiens
cctttggtcttgatgaactgtt

SEQ ID NO: 6921211 - DNA, 22 bp, Homo sapiens
gctgggcttggtttccctgctt

SEQ ID NO: 6921212 - DNA, 22 bp, Homo sapiens
tttatgctgaggcccaggaata

SEQ ID NO: 6921213 - DNA, 22 bp, Homo sapiens
cattcccttggggagttcatgc

SEQ ID NO: 6921214 - DNA, 22 bp, Homo sapiens
cgtgtgttgaaagatgtacatc

SEQ ID NO: 6921215 - DNA, 22 bp, Homo sapiens
ctagctagcagcattacaacaa

SEQ ID NO: 6921216 - DNA, 22 bp, Homo sapiens
ttgttcatcaggtgacacatac

SEQ ID NO: 6921217 - DNA, 22 bp, Homo sapiens
tctgagagccactgaacagcaa

SEQ ID NO: 6921218 - DNA, 22 bp, Homo sapiens
aggagctggccactaggatgca

SEQ ID NO: 6921219 - DNA, 22 bp, Homo sapiens
atctttgggatatttgtgatta

SEQ ID NO: 6921220 - DNA, 22 bp, Homo sapiens
ttacagtatgatcaacttttca

SEQ ID NO: 6921221 - DNA, 22 bp, Homo sapiens
tggaaactaacaacagagcaga

SEQ ID NO: 6921222 - DNA, 22 bp, Homo sapiens
agagctggcagcagcttctcct

SEQ ID NO: 6921223 - DNA, 22 bp, Homo sapiens
ccacagcttcttatatcactgg

SEQ ID NO: 6921224 - DNA, 22 bp, Homo sapiens
ggccaggtggctgtcctggcgt

SEQ ID NO: 6921225 - DNA, 22 bp, Homo sapiens
acaaattgccccattttgaact

SEQ ID NO: 6921226 - DNA, 22 bp, Homo sapiens
ggctgctggggacgtgggagag

SEQ ID NO: 6921227 - DNA, 22 bp, Homo sapiens
ggctttcaaggaaaggcctcat

SEQ ID NO: 6921228 - DNA, 22 bp, Homo sapiens
ctgggacctcctgaggtggagc

SEQ ID NO: 6921229 - DNA, 22 bp, Homo sapiens
tcagatggaatgatgccactgc

SEQ ID NO: 6921230 - DNA, 23 bp, Homo sapiens
gaaaggctctgggacccccaact

SEQ ID NO: 6921231 - DNA, 20 bp, Homo sapiens
agattattcctaagatttct

SEQ ID NO: 6921232 - DNA, 22 bp, Homo sapiens
tttacagaatgtcaatttctat

SEQ ID NO: 6921233 - DNA, 22 bp, Homo sapiens
ccctggaggcggatgttgcagt

SEQ ID NO: 6921234 - DNA, 22 bp, Homo sapiens
aatttcacagtgaactttgagg

SEQ ID NO: 6921235 - DNA, 22 bp, Homo sapiens
tattgctgccaggaccctatcc

SEQ ID NO: 6921236 - DNA, 22 bp, Homo sapiens
catttcaagtaacagattgctt

SEQ ID NO: 6921237 - DNA, 22 bp, Homo sapiens
acctctgtacctcctctgacag

SEQ ID NO: 6921238 - DNA, 21 bp, Homo sapiens
acactgctgtagcatattggg

SEQ ID NO: 6921239 - DNA, 22 bp, Homo sapiens
ctgtgtcccagtaccttgggta

SEQ ID NO: 6921240 - DNA, 18 bp, Homo sapiens
ctgcacttcagcttgggc

SEQ ID NO: 6921241 - DNA, 19 bp, Homo sapiens
gtagggacagtggttctga

SEQ ID NO: 6921242 - DNA, 22 bp, Homo sapiens
acactaaatgagtctacagtac

SEQ ID NO: 6921243 - DNA, 22 bp, Homo sapiens
ctctcgcgtgtgcctttccgct

SEQ ID NO: 6921244 - DNA, 22 bp, Homo sapiens
tgtatattctgcctaaaagctt

SEQ ID NO: 6921245 - DNA, 22 bp, Homo sapiens
tccaagctctctatgccatgat

SEQ ID NO: 6921246 - DNA, 18 bp, Homo sapiens
cccagcttagcgcccctc

SEQ ID NO: 6921247 - DNA, 21 bp, Homo sapiens
tgagcccttgcctcagagccc

SEQ ID NO: 6921248 - DNA, 22 bp, Homo sapiens
ctggagctctgtgtgttcctga

SEQ ID NO: 6921249 - DNA, 22 bp, Homo sapiens
agctgtgtttccagatggtagc

SEQ ID NO: 6921250 - DNA, 22 bp, Homo sapiens
ccctctgagacaggtagctcac

SEQ ID NO: 6921251 - DNA, 22 bp, Homo sapiens
ttggccaaaaaagtcattagaa

SEQ ID NO: 6921252 - DNA, 22 bp, Homo sapiens
aagaccctaagacctcttgatg

SEQ ID NO: 6921253 - DNA, 23 bp, Homo sapiens
cacaggctgcgcataagcttctc

SEQ ID NO: 6921254 - DNA, 22 bp, Homo sapiens
agaagccattctcagttcctga

SEQ ID NO: 6921255 - DNA, 22 bp, Homo sapiens
atccactccctaacaccatgtt

SEQ ID NO: 6921256 - DNA, 22 bp, Homo sapiens
tcacagctttgagcagagacca

SEQ ID NO: 6921257 - DNA, 22 bp, Homo sapiens
taaggctttctaaatatgcaga

SEQ ID NO: 6921258 - DNA, 22 bp, Homo sapiens
tgaagtaactgtccaggatcca

SEQ ID NO: 6921259 - DNA, 22 bp, Homo sapiens
ttaggaaaggaacattgaaacg

SEQ ID NO: 6921260 - DNA, 22 bp, Homo sapiens
gcgctgagcttttcttattgaa

SEQ ID NO: 6921261 - DNA, 22 bp, Homo sapiens
ttatgtgccactttttgaagat

SEQ ID NO: 6921262 - DNA, 22 bp, Homo sapiens
ttttgttttcttagaaacctgg

SEQ ID NO: 6921263 - DNA, 22 bp, Homo sapiens
acatgaaaactggttccttcag

SEQ ID NO: 6921264 - DNA, 22 bp, Homo sapiens
tctctataggaatacttgaaca

SEQ ID NO: 6921265 - DNA, 22 bp, Homo sapiens
ggagagataggagtcctggact

SEQ ID NO: 6921266 - DNA, 22 bp, Homo sapiens
agttaactattttaagattgtt

SEQ ID NO: 6921267 - DNA, 22 bp, Homo sapiens
tagtagcatttggaaaaattgg

SEQ ID NO: 6921268 - DNA, 22 bp, Homo sapiens
tcttggaagcctcaagatactc

SEQ ID NO: 6921269 - DNA, 19 bp, Homo sapiens
attcttgttaagtgtcatc

SEQ ID NO: 6921270 - DNA, 22 bp, Homo sapiens
ttattgactatttgctatgtgt

SEQ ID NO: 6921271 - DNA, 22 bp, Homo sapiens
tgagcagaggccagcacctggg

SEQ ID NO: 6921272 - DNA, 22 bp, Homo sapiens
agaaatgtggatcgttttaaaa

SEQ ID NO: 6921273 - DNA, 22 bp, Homo sapiens
atggtattcctttatgtagaag

SEQ ID NO: 6921274 - DNA, 22 bp, Homo sapiens
tctgatgataaagcatccttta

SEQ ID NO: 6921275 - DNA, 20 bp, Homo sapiens
tccagcaccctcacagagaa

SEQ ID NO: 6921276 - DNA, 22 bp, Homo sapiens
ttttcacatgcttggggactta

SEQ ID NO: 6921277 - DNA, 22 bp, Homo sapiens
atagttctggatgtacttatag

SEQ ID NO: 6921278 - DNA, 22 bp, Homo sapiens
cagtggcacgatctcagctcac

SEQ ID NO: 6921279 - DNA, 22 bp, Homo sapiens
ggcagctttgccctcactgtcc

SEQ ID NO: 6921280 - DNA, 22 bp, Homo sapiens
ctttttctaatcataattgtct

SEQ ID NO: 6921281 - DNA, 22 bp, Homo sapiens
gctatgtaatttgcaagaccca

SEQ ID NO: 6921282 - DNA, 22 bp, Homo sapiens
ccctcactctgcctcctggggt

SEQ ID NO: 6921283 - DNA, 22 bp, Homo sapiens
gggtaggaaatccagaggtggc

SEQ ID NO: 6921284 - DNA, 23 bp, Homo sapiens
tcccattgagctctgagaactgc

SEQ ID NO: 6921285 - DNA, 18 bp, Homo sapiens
tcaggctgccctgtgtct

SEQ ID NO: 6921286 - DNA, 22 bp, Homo sapiens
gatgcacagtgaccctgccagt

SEQ ID NO: 6921287 - DNA, 22 bp, Homo sapiens
tagcttcttgagaaagggtgcc

SEQ ID NO: 6921288 - DNA, 22 bp, Homo sapiens
agtcactgctttgtccctgtgt

SEQ ID NO: 6921289 - DNA, 15 bp, Homo sapiens
gaggccaggcatgtg

SEQ ID NO: 6921290 - DNA, 22 bp, Homo sapiens
gtgcactggagttcgtacagat

SEQ ID NO: 6921291 - DNA, 22 bp, Homo sapiens
ctgaagttattgtacaaatttg

SEQ ID NO: 6921292 - DNA, 22 bp, Homo sapiens
acaatatgttttggcccttata

SEQ ID NO: 6921293 - DNA, 19 bp, Homo sapiens
aggcaggtgcagaggtccc

SEQ ID NO: 6921294 - DNA, 22 bp, Homo sapiens
aggcctgttggcgtgggctcta

SEQ ID NO: 6921295 - DNA, 23 bp, Homo sapiens
tcagagcaaagggtgcctccgtt

SEQ ID NO: 6921296 - DNA, 22 bp, Homo sapiens
tgttcatttgcaacaaccaaat

SEQ ID NO: 6921297 - DNA, 22 bp, Homo sapiens
agctggctgggtgccagtctcc

SEQ ID NO: 6921298 - DNA, 22 bp, Homo sapiens
atcaggaagtctgccacaaggc

SEQ ID NO: 6921299 - DNA, 22 bp, Homo sapiens
ggaagtttattgagttcaagta

SEQ ID NO: 6921300 - DNA, 22 bp, Homo sapiens
gggtctgcctgctgtgaagtca

SEQ ID NO: 6921301 - DNA, 22 bp, Homo sapiens
aggtggtcgaatgaaataattt

SEQ ID NO: 6921302 - DNA, 22 bp, Homo sapiens
catgtgtagaccgtgacctcat

SEQ ID NO: 6921303 - DNA, 22 bp, Homo sapiens
catcttgcttgtctttagtaag

SEQ ID NO: 6921304 - DNA, 22 bp, Homo sapiens
aggcatctgagatttttatact

SEQ ID NO: 6921305 - DNA, 22 bp, Homo sapiens
gggctgacgaaggccatgtgtg

SEQ ID NO: 6921306 - DNA, 21 bp, Homo sapiens
gatgttggaggctggggtctg

SEQ ID NO: 6921307 - DNA, 22 bp, Homo sapiens
gaattcgggtactctaggccag

SEQ ID NO: 6921308 - DNA, 22 bp, Homo sapiens
atctcacatcctcagtagtgca

SEQ ID NO: 6921309 - DNA, 22 bp, Homo sapiens
cagctcttggagaaaccagagc

SEQ ID NO: 6921310 - DNA, 22 bp, Homo sapiens
ggctgctggcagatgtagttta

SEQ ID NO: 6921311 - DNA, 22 bp, Homo sapiens
atggtacatagtttaaataagg

SEQ ID NO: 6921312 - DNA, 22 bp, Homo sapiens
tgtgcagcagcagctgtggaga

SEQ ID NO: 6921313 - DNA, 20 bp, Homo sapiens
tttcagttggttaatggcat

SEQ ID NO: 6921314 - DNA, 22 bp, Homo sapiens
gggaagacttagtcggttcaat

SEQ ID NO: 6921315 - DNA, 22 bp, Homo sapiens
gtgagtacaagaaccgtagtct

SEQ ID NO: 6921316 - DNA, 22 bp, Homo sapiens
ggacagtgcgagacacagtaac

SEQ ID NO: 6921317 - DNA, 22 bp, Homo sapiens
cgtcattgtcctggacttgcaa

SEQ ID NO: 6921318 - DNA, 22 bp, Homo sapiens
agaactgatttgaaggttgggg

SEQ ID NO: 6921319 - DNA, 22 bp, Homo sapiens
aattgatggacagagatgaaga

SEQ ID NO: 6921320 - DNA, 21 bp, Homo sapiens
gtgaatatgcagcagaggcag

SEQ ID NO: 6921321 - DNA, 22 bp, Homo sapiens
cagcttggcttcacattctgta

SEQ ID NO: 6921322 - DNA, 22 bp, Homo sapiens
gcgaggcagccctcaggtgtta

SEQ ID NO: 6921323 - DNA, 22 bp, Homo sapiens
gcaggggagtccactctatgca

SEQ ID NO: 6921324 - DNA, 22 bp, Homo sapiens
cagaaacctgtctggagtggga

SEQ ID NO: 6921325 - DNA, 22 bp, Homo sapiens
agtgcctcttgtctacggtttt

SEQ ID NO: 6921326 - DNA, 22 bp, Homo sapiens
tcagaaggatgtgcaggtggca

SEQ ID NO: 6921327 - DNA, 19 bp, Homo sapiens
tctcccagctgagaagggc

SEQ ID NO: 6921328 - DNA, 22 bp, Homo sapiens
ttcgtttagtccacaaatgcat

SEQ ID NO: 6921329 - DNA, 22 bp, Homo sapiens
ttctaagaatgctttgcaaaat

SEQ ID NO: 6921330 - DNA, 19 bp, Homo sapiens
gcaaggttcactcccagag

SEQ ID NO: 6921331 - DNA, 22 bp, Homo sapiens
gcctggagtactccttgaagtg

SEQ ID NO: 6921332 - DNA, 22 bp, Homo sapiens
agctggctgccttctccttagg

SEQ ID NO: 6921333 - DNA, 22 bp, Homo sapiens
cacacgtgtgagagctgtggca

SEQ ID NO: 6921334 - DNA, 22 bp, Homo sapiens
aagtcctgccagcaaatgtata

SEQ ID NO: 6921335 - DNA, 21 bp, Homo sapiens
taggatgaaagtgagtgagaa

SEQ ID NO: 6921336 - DNA, 22 bp, Homo sapiens
atattcgtggtcaagtaaggcc

SEQ ID NO: 6921337 - DNA, 22 bp, Homo sapiens
agtgggtgtagtcttcctcctg

SEQ ID NO: 6921338 - DNA, 22 bp, Homo sapiens
tagtttaggaacaagtagtgga

SEQ ID NO: 6921339 - DNA, 18 bp, Homo sapiens
cctgaagcctgtgtcttt

SEQ ID NO: 6921340 - DNA, 22 bp, Homo sapiens
cagtccttggcaagttctcagt

SEQ ID NO: 6921341 - DNA, 21 bp, Homo sapiens
atttcagaaatattggtggga

SEQ ID NO: 6921342 - DNA, 22 bp, Homo sapiens
cagctttgtcctgcaaacctga

SEQ ID NO: 6921343 - DNA, 22 bp, Homo sapiens
caaactttcagttataacatga

SEQ ID NO: 6921344 - DNA, 22 bp, Homo sapiens
aagcaactgttgaattggacta

SEQ ID NO: 6921345 - DNA, 22 bp, Homo sapiens
tcaaaactcattttggaagtaa

SEQ ID NO: 6921346 - DNA, 22 bp, Homo sapiens
agaggaggcagcttaactcagt

SEQ ID NO: 6921347 - DNA, 22 bp, Homo sapiens
ttgtattcatttggccatactg

SEQ ID NO: 6921348 - DNA, 22 bp, Homo sapiens
cagcccgtcacacgctagcatc

SEQ ID NO: 6921349 - DNA, 22 bp, Homo sapiens
agctatttattgagctccattg

SEQ ID NO: 6921350 - DNA, 22 bp, Homo sapiens
atacaaaggaacacaggcatgt

SEQ ID NO: 6921351 - DNA, 22 bp, Homo sapiens
aggtcttaggagcatggtgctg

SEQ ID NO: 6921352 - DNA, 22 bp, Homo sapiens
aaaccgcaatcacttttgcacc

SEQ ID NO: 6921353 - DNA, 22 bp, Homo sapiens
agaggtggccatgggcgctgga

SEQ ID NO: 6921354 - DNA, 22 bp, Homo sapiens
cagggcctgcaagagacctggg

SEQ ID NO: 6921355 - DNA, 22 bp, Homo sapiens
agaatcaaggtgaagcccacag

SEQ ID NO: 6921356 - DNA, 22 bp, Homo sapiens
caactaatatagggcatgagaa

SEQ ID NO: 6921357 - DNA, 22 bp, Homo sapiens
tgggtagagcaggctggggctt

SEQ ID NO: 6921358 - DNA, 19 bp, Homo sapiens
tgctttgccttgattagct

SEQ ID NO: 6921359 - DNA, 22 bp, Homo sapiens
tgagctcctggtcacaattatc

SEQ ID NO: 6921360 - DNA, 22 bp, Homo sapiens
gtcaggtttgttgtctggatac

SEQ ID NO: 6921361 - DNA, 22 bp, Homo sapiens
gcaatctttaaaaatcaagtcg

SEQ ID NO: 6921362 - DNA, 22 bp, Homo sapiens
agtgtggcaggaatgactagaa

SEQ ID NO: 6921363 - DNA, 22 bp, Homo sapiens
gtggagcatgtgaggactgagt

SEQ ID NO: 6921364 - DNA, 22 bp, Homo sapiens
gtgcgccagctcaaggggaggc

SEQ ID NO: 6921365 - DNA, 22 bp, Homo sapiens
ggcactgactgtgcagcgcacc

SEQ ID NO: 6921366 - DNA, 22 bp, Homo sapiens
ctctagagtacgggctggcatg

SEQ ID NO: 6921367 - DNA, 22 bp, Homo sapiens
atgtgtcttctgtgggtttgaa

SEQ ID NO: 6921368 - DNA, 22 bp, Homo sapiens
atttagtgtattctaatatgtg

SEQ ID NO: 6921369 - DNA, 22 bp, Homo sapiens
cagatgtaattactcaagtcaa

SEQ ID NO: 6921370 - DNA, 20 bp, Homo sapiens
atgcctctaattttgcaaac

SEQ ID NO: 6921371 - DNA, 22 bp, Homo sapiens
acagagatcagaggcataagca

SEQ ID NO: 6921372 - DNA, 22 bp, Homo sapiens
acagtggaagaagcactgaact

SEQ ID NO: 6921373 - DNA, 22 bp, Homo sapiens
atggctttctgtgtttccgtag

SEQ ID NO: 6921374 - DNA, 22 bp, Homo sapiens
aatgttctgcaactgttttcat

SEQ ID NO: 6921375 - DNA, 20 bp, Homo sapiens
gggcaaattgctatttcttt

SEQ ID NO: 6921376 - DNA, 23 bp, Homo sapiens
tcctcctgacacagcctgagtga

SEQ ID NO: 6921377 - DNA, 22 bp, Homo sapiens
tgactccaaacagaaaacgaat

SEQ ID NO: 6921378 - DNA, 22 bp, Homo sapiens
acagttcctgactttaactcca

SEQ ID NO: 6921379 - DNA, 19 bp, Homo sapiens
ctttgtcagaacatgcttc

SEQ ID NO: 6921380 - DNA, 22 bp, Homo sapiens
gagctgaattgaagcaaggagc

SEQ ID NO: 6921381 - DNA, 22 bp, Homo sapiens
tctgcggtccccttctcgccct

SEQ ID NO: 6921382 - DNA, 22 bp, Homo sapiens
tatacacaaacaaggggttaag

SEQ ID NO: 6921383 - DNA, 22 bp, Homo sapiens
tgggatgccggcaggaggcaat

SEQ ID NO: 6921384 - DNA, 22 bp, Homo sapiens
cctgttcaatgccctggcttca

SEQ ID NO: 6921385 - DNA, 22 bp, Homo sapiens
tgcttgcaaatactctgctgtt

SEQ ID NO: 6921386 - DNA, 22 bp, Homo sapiens
tgtgatactggtttatatcatt

SEQ ID NO: 6921387 - DNA, 22 bp, Homo sapiens
tccaagttctaggaactgctgc

SEQ ID NO: 6921388 - DNA, 22 bp, Homo sapiens
acacaatgattcacaagcagca

SEQ ID NO: 6921389 - DNA, 22 bp, Homo sapiens
caatatagagagaaaattatgt

SEQ ID NO: 6921390 - DNA, 22 bp, Homo sapiens
tccctcagcttgtctccatgca

SEQ ID NO: 6921391 - DNA, 22 bp, Homo sapiens
gaaaagccttctcacataagta

SEQ ID NO: 6921392 - DNA, 22 bp, Homo sapiens
tcttctggatcgatcacattgt

SEQ ID NO: 6921393 - DNA, 22 bp, Homo sapiens
tctggatgagattaatggtgtg

SEQ ID NO: 6921394 - DNA, 22 bp, Homo sapiens
agcagggctcacattagtggat

SEQ ID NO: 6921395 - DNA, 22 bp, Homo sapiens
acttctatgcacagagcttgga

SEQ ID NO: 6921396 - DNA, 22 bp, Homo sapiens
tgctggcttcctgtgcacagca

SEQ ID NO: 6921397 - DNA, 22 bp, Homo sapiens
agtgagcaacagaagcgtgggt

SEQ ID NO: 6921398 - DNA, 22 bp, Homo sapiens
gctgcttttgagttaaagtcat

SEQ ID NO: 6921399 - DNA, 22 bp, Homo sapiens
aagtcaatcaagggtgtaggca

SEQ ID NO: 6921400 - DNA, 22 bp, Homo sapiens
catagaatgcagcaggaaagtt

SEQ ID NO: 6921401 - DNA, 22 bp, Homo sapiens
gccagggttgccaatgggggca

SEQ ID NO: 6921402 - DNA, 22 bp, Homo sapiens
atggtttagcaacttagggaaa

SEQ ID NO: 6921403 - DNA, 22 bp, Homo sapiens
aaactgagttttctgaacccca

SEQ ID NO: 6921404 - DNA, 20 bp, Homo sapiens
gagggcaggcacccatttca

SEQ ID NO: 6921405 - DNA, 22 bp, Homo sapiens
ctctgagctgaaacatgagcat

SEQ ID NO: 6921406 - DNA, 22 bp, Homo sapiens
agtcaactgcattaggaaatga

SEQ ID NO: 6921407 - DNA, 22 bp, Homo sapiens
tgaggggaggttggggcacatc

SEQ ID NO: 6921408 - DNA, 22 bp, Homo sapiens
tctgcagatccctttagtgagg

SEQ ID NO: 6921409 - DNA, 20 bp, Homo sapiens
gcagctgcccccagtccctg

SEQ ID NO: 6921410 - DNA, 22 bp, Homo sapiens
tgcttatttaggtagatattaa

SEQ ID NO: 6921411 - DNA, 20 bp, Homo sapiens
caggtattacatctgcacct

SEQ ID NO: 6921412 - DNA, 22 bp, Homo sapiens
ataaacaagactggccaacttt

SEQ ID NO: 6921413 - DNA, 22 bp, Homo sapiens
tcccatttattaattagtttgc

SEQ ID NO: 6921414 - DNA, 18 bp, Homo sapiens
attcaggggctgaatgtg

SEQ ID NO: 6921415 - DNA, 22 bp, Homo sapiens
tcagtgtggcccagggaagcag

SEQ ID NO: 6921416 - DNA, 22 bp, Homo sapiens
ttctgccttacgatattttcaa

SEQ ID NO: 6921417 - DNA, 22 bp, Homo sapiens
gccactgttcttctttgttcca

SEQ ID NO: 6921418 - DNA, 22 bp, Homo sapiens
tgagcaggcgcagcaggaggtc

SEQ ID NO: 6921419 - DNA, 22 bp, Homo sapiens
agagttatcctgtcctagggga

SEQ ID NO: 6921420 - DNA, 22 bp, Homo sapiens
gcagtgcaggacaaatcagtgc

SEQ ID NO: 6921421 - DNA, 18 bp, Homo sapiens
cagatggtggagttttta

SEQ ID NO: 6921422 - DNA, 19 bp, Homo sapiens
tgctggaggttgacagggt

SEQ ID NO: 6921423 - DNA, 22 bp, Homo sapiens
acagatgtggagtttgcatgat

SEQ ID NO: 6921424 - DNA, 22 bp, Homo sapiens
aatgattggcactagatacaca

SEQ ID NO: 6921425 - DNA, 22 bp, Homo sapiens
gccaagaaatgtgtcgggcagc

SEQ ID NO: 6921426 - DNA, 22 bp, Homo sapiens
tcagttctaagtgctttacatg

SEQ ID NO: 6921427 - DNA, 22 bp, Homo sapiens
aaagtcttaatgtaagtttagt

SEQ ID NO: 6921428 - DNA, 19 bp, Homo sapiens
taccaaattgcattatggc

SEQ ID NO: 6921429 - DNA, 22 bp, Homo sapiens
gtgtccagggccgtgttgtctt

SEQ ID NO: 6921430 - DNA, 22 bp, Homo sapiens
caagttatggcttcccagtagg

SEQ ID NO: 6921431 - DNA, 22 bp, Homo sapiens
ggttaaggaataggccatttag

SEQ ID NO: 6921432 - DNA, 22 bp, Homo sapiens
gagttattctaggtcctttgta

SEQ ID NO: 6921433 - DNA, 22 bp, Homo sapiens
acagcagggtcacattccctct

SEQ ID NO: 6921434 - DNA, 22 bp, Homo sapiens
gccagagagatggaaaagctta

SEQ ID NO: 6921435 - DNA, 22 bp, Homo sapiens
atgcatcttatcaaaaattata

SEQ ID NO: 6921436 - DNA, 22 bp, Homo sapiens
gtctggctctggaaggcaaagg

SEQ ID NO: 6921437 - DNA, 22 bp, Homo sapiens
tcctccttgttttgtctctgct

SEQ ID NO: 6921438 - DNA, 22 bp, Homo sapiens
gggacatgaggccatagtgatt

SEQ ID NO: 6921439 - DNA, 22 bp, Homo sapiens
tgccaaagaagtatcaaagatg

SEQ ID NO: 6921440 - DNA, 22 bp, Homo sapiens
atgcagtacatacaaacactga

SEQ ID NO: 6921441 - DNA, 22 bp, Homo sapiens
gtgtggccttgggagaggtctg

SEQ ID NO: 6921442 - DNA, 19 bp, Homo sapiens
tcatgcagtggggggtgtg

SEQ ID NO: 6921443 - DNA, 21 bp, Homo sapiens
atgcatctatcttctactcca

SEQ ID NO: 6921444 - DNA, 22 bp, Homo sapiens
agccctgttgtctgatgatggg

SEQ ID NO: 6921445 - DNA, 21 bp, Homo sapiens
acagtgtgcttctctccctcc

SEQ ID NO: 6921446 - DNA, 22 bp, Homo sapiens
gaggcctctgtcccaccaggga

SEQ ID NO: 6921447 - DNA, 22 bp, Homo sapiens
tcaagtgcttgtgaggtatttg

SEQ ID NO: 6921448 - DNA, 22 bp, Homo sapiens
ggagtcaggagcaggctgggct

SEQ ID NO: 6921449 - DNA, 22 bp, Homo sapiens
tttgtgtgtatatccttccaga

SEQ ID NO: 6921450 - DNA, 22 bp, Homo sapiens
aaggctgggaaacatgcaggcc

SEQ ID NO: 6921451 - DNA, 22 bp, Homo sapiens
actaatgattattgtcattgtg

SEQ ID NO: 6921452 - DNA, 22 bp, Homo sapiens
attagacatcatatgattcagc

SEQ ID NO: 6921453 - DNA, 22 bp, Homo sapiens
cttctcggggttcccgcgccct

SEQ ID NO: 6921454 - DNA, 22 bp, Homo sapiens
ttgtacacacaggaacaaacgt

SEQ ID NO: 6921455 - DNA, 22 bp, Homo sapiens
atcaaagtggttttctgtgctt

SEQ ID NO: 6921456 - DNA, 22 bp, Homo sapiens
agagtgcagaggtcaaagaaca

SEQ ID NO: 6921457 - DNA, 22 bp, Homo sapiens
gaggaggaaaccctgttcctct

SEQ ID NO: 6921458 - DNA, 22 bp, Homo sapiens
caagtgatcagacactgaagtc

SEQ ID NO: 6921459 - DNA, 22 bp, Homo sapiens
aatggccattgggtcatgctag

SEQ ID NO: 6921460 - DNA, 22 bp, Homo sapiens
tttatctgaggaaagcagacaa

SEQ ID NO: 6921461 - DNA, 22 bp, Homo sapiens
aggctcatccccacaaagcaaa

SEQ ID NO: 6921462 - DNA, 17 bp, Homo sapiens
ggctctgggtgtcacat

SEQ ID NO: 6921463 - DNA, 22 bp, Homo sapiens
aatccatttacctttgcttgaa

SEQ ID NO: 6921464 - DNA, 22 bp, Homo sapiens
agtagcacaattttgtccctaa

SEQ ID NO: 6921465 - DNA, 22 bp, Homo sapiens
tcatttatgtctttgccatcca

SEQ ID NO: 6921466 - DNA, 22 bp, Homo sapiens
aacatttattctaattctggga

SEQ ID NO: 6921467 - DNA, 22 bp, Homo sapiens
ttcttcagcccatatcttccag

SEQ ID NO: 6921468 - DNA, 22 bp, Homo sapiens
ccagaagaacttaattcaaaac

SEQ ID NO: 6921469 - DNA, 22 bp, Homo sapiens
actcagactataagcttatttt

SEQ ID NO: 6921470 - DNA, 18 bp, Homo sapiens
tgaggtagctttcctcct

SEQ ID NO: 6921471 - DNA, 22 bp, Homo sapiens
tgcataaatcttggaagttgtt

SEQ ID NO: 6921472 - DNA, 22 bp, Homo sapiens
tggattgggtgctgaagcatag

SEQ ID NO: 6921473 - DNA, 22 bp, Homo sapiens
tcttggattttaatggatcaaa

SEQ ID NO: 6921474 - DNA, 18 bp, Homo sapiens
gggcaagcggctgtcacc

SEQ ID NO: 6921475 - DNA, 22 bp, Homo sapiens
aaggcccacagaactgtctcca

SEQ ID NO: 6921476 - DNA, 22 bp, Homo sapiens
ctaaagtccttatcaagtgtaa

SEQ ID NO: 6921477 - DNA, 22 bp, Homo sapiens
tgaggtggtccaaagactgttt

SEQ ID NO: 6921478 - DNA, 22 bp, Homo sapiens
tctttcctactttattgtgaac

SEQ ID NO: 6921479 - DNA, 22 bp, Homo sapiens
tgaaatgtttgaagaccactga

SEQ ID NO: 6921480 - DNA, 22 bp, Homo sapiens
cccagcccccgagtgtctggaa

SEQ ID NO: 6921481 - DNA, 22 bp, Homo sapiens
aatgtcttttgatacaagttac

SEQ ID NO: 6921482 - DNA, 22 bp, Homo sapiens
tggacatgagctgagtgggtgt

SEQ ID NO: 6921483 - DNA, 22 bp, Homo sapiens
cagtcccatgagcccagaacat

SEQ ID NO: 6921484 - DNA, 22 bp, Homo sapiens
acacagagcaaatcatgacaga

SEQ ID NO: 6921485 - DNA, 22 bp, Homo sapiens
aatgagaagcctaggtgtactg

SEQ ID NO: 6921486 - DNA, 22 bp, Homo sapiens
ggcactgagcgggctctgagcg

SEQ ID NO: 6921487 - DNA, 22 bp, Homo sapiens
ggggcaggaggtgttctctttt

SEQ ID NO: 6921488 - DNA, 22 bp, Homo sapiens
cttggaacttagtaatatgaca

SEQ ID NO: 6921489 - DNA, 22 bp, Homo sapiens
catgattatattaatggcttca

SEQ ID NO: 6921490 - DNA, 22 bp, Homo sapiens
tgtgaggataaaaaggaaggag

SEQ ID NO: 6921491 - DNA, 21 bp, Homo sapiens
tcaggggctgtgttttccatc

SEQ ID NO: 6921492 - DNA, 22 bp, Homo sapiens
cttgaagtgcctgagtcttatc

SEQ ID NO: 6921493 - DNA, 22 bp, Homo sapiens
aacatttctgagaatatcagtt

SEQ ID NO: 6921494 - DNA, 22 bp, Homo sapiens
ttaggaatattttctgagtagt

SEQ ID NO: 6921495 - DNA, 22 bp, Homo sapiens
aaacaagagtcttgctccacct

SEQ ID NO: 6921496 - DNA, 22 bp, Homo sapiens
agaggcaggaagagctgatttt

SEQ ID NO: 6921497 - DNA, 22 bp, Homo sapiens
aagagccatacaagtaaaagca

SEQ ID NO: 6921498 - DNA, 22 bp, Homo sapiens
tgtagcattttatgtaataagt

SEQ ID NO: 6921499 - DNA, 22 bp, Homo sapiens
ggatggagatgaccatggtgac

SEQ ID NO: 6921500 - DNA, 22 bp, Homo sapiens
acctttcgtcctggttcctccg

SEQ ID NO: 6921501 - DNA, 22 bp, Homo sapiens
ttggaatttgcttcagctaata

SEQ ID NO: 6921502 - DNA, 21 bp, Homo sapiens
aggcttaaagccattatttcc

SEQ ID NO: 6921503 - DNA, 21 bp, Homo sapiens
agttctatagtcttcacagcc

SEQ ID NO: 6921504 - DNA, 22 bp, Homo sapiens
aaggtcacactcccagagctga

SEQ ID NO: 6921505 - DNA, 22 bp, Homo sapiens
tatttgtccttattaagatctg

SEQ ID NO: 6921506 - DNA, 22 bp, Homo sapiens
tactgttacagggagtgttcaa

SEQ ID NO: 6921507 - DNA, 22 bp, Homo sapiens
cagattcttaatttatgggatt

SEQ ID NO: 6921508 - DNA, 22 bp, Homo sapiens
ttgctgatggagggaatgctca

SEQ ID NO: 6921509 - DNA, 22 bp, Homo sapiens
ctgctttgtggaatcacactgg

SEQ ID NO: 6921510 - DNA, 22 bp, Homo sapiens
attgatgggtgccaatggagtg

SEQ ID NO: 6921511 - DNA, 22 bp, Homo sapiens
taaagcttgtattgcaatattt

SEQ ID NO: 6921512 - DNA, 22 bp, Homo sapiens
gttttctgtttcttaacggcat

SEQ ID NO: 6921513 - DNA, 22 bp, Homo sapiens
caggctggagtgcagtggtgcc

SEQ ID NO: 6921514 - DNA, 22 bp, Homo sapiens
agggctggagggtactagttta

SEQ ID NO: 6921515 - DNA, 22 bp, Homo sapiens
atctgggtgaagtttaaaaatc

SEQ ID NO: 6921516 - DNA, 22 bp, Homo sapiens
agccagcacggcgccatggagt

SEQ ID NO: 6921517 - DNA, 21 bp, Homo sapiens
ctcatttatttttgtgtccaa

SEQ ID NO: 6921518 - DNA, 22 bp, Homo sapiens
ttcaggtgggccttttgagcat

SEQ ID NO: 6921519 - DNA, 22 bp, Homo sapiens
ccctccaggcctgtcatgttcc

SEQ ID NO: 6921520 - DNA, 22 bp, Homo sapiens
gattcttacttctaagcaagct

SEQ ID NO: 6921521 - DNA, 22 bp, Homo sapiens
cttattcataagtcagacacac

SEQ ID NO: 6921522 - DNA, 22 bp, Homo sapiens
ctggagttctatgtgcttgtga

SEQ ID NO: 6921523 - DNA, 17 bp, Homo sapiens
tattgacctttgtatgt

SEQ ID NO: 6921524 - DNA, 22 bp, Homo sapiens
ggagccagagcactggggagcc

SEQ ID NO: 6921525 - DNA, 22 bp, Homo sapiens
ggtcatactctttgagtggagg

SEQ ID NO: 6921526 - DNA, 22 bp, Homo sapiens
ggttctgacaagctgggatggt

SEQ ID NO: 6921527 - DNA, 22 bp, Homo sapiens
tctgtccagacgcctccgtgag

SEQ ID NO: 6921528 - DNA, 20 bp, Homo sapiens
aactttctcccattggactg

SEQ ID NO: 6921529 - DNA, 22 bp, Homo sapiens
aattaggcaaattaatttctct

SEQ ID NO: 6921530 - DNA, 19 bp, Homo sapiens
tttggcagcattaatatca

SEQ ID NO: 6921531 - DNA, 22 bp, Homo sapiens
agccttgacactggggaaactg

SEQ ID NO: 6921532 - DNA, 22 bp, Homo sapiens
ggctgagacaacctgggaccca

SEQ ID NO: 6921533 - DNA, 22 bp, Homo sapiens
gcacaaactgcaattacttttg

SEQ ID NO: 6921534 - DNA, 17 bp, Homo sapiens
tttggaatttaaaggca

SEQ ID NO: 6921535 - DNA, 22 bp, Homo sapiens
tacactctaattctttggtcct

SEQ ID NO: 6921536 - DNA, 22 bp, Homo sapiens
tgtttagacagaatgagttctt

SEQ ID NO: 6921537 - DNA, 22 bp, Homo sapiens
gtttcaaagggaagacgctgga

SEQ ID NO: 6921538 - DNA, 21 bp, Homo sapiens
ggccagctgcatatgtcactg

SEQ ID NO: 6921539 - DNA, 22 bp, Homo sapiens
tctcacagtgagcctgaggtcg

SEQ ID NO: 6921540 - DNA, 22 bp, Homo sapiens
cagaggaccattgtatgtattg

SEQ ID NO: 6921541 - DNA, 22 bp, Homo sapiens
ttttcagaggcctaagaggttt

SEQ ID NO: 6921542 - DNA, 22 bp, Homo sapiens
ggctgctgccctcctaagtgca

SEQ ID NO: 6921543 - DNA, 22 bp, Homo sapiens
tggaccaacattcactggcata

SEQ ID NO: 6921544 - DNA, 22 bp, Homo sapiens
tcctgggccaagggctgtgagg

SEQ ID NO: 6921545 - DNA, 20 bp, Homo sapiens
ctgtggaattttaccatgcg

SEQ ID NO: 6921546 - DNA, 22 bp, Homo sapiens
atggcagaatatctgcatcgca

SEQ ID NO: 6921547 - DNA, 22 bp, Homo sapiens
tataagtgacagattatccaaa

SEQ ID NO: 6921548 - DNA, 21 bp, Homo sapiens
gaggcccatgggacaggggct

SEQ ID NO: 6921549 - DNA, 22 bp, Homo sapiens
ttctggtaccgtgtcagaaacc

SEQ ID NO: 6921550 - DNA, 22 bp, Homo sapiens
ttggctttctctgtatctgaat

SEQ ID NO: 6921551 - DNA, 22 bp, Homo sapiens
ttctcttttgtgatgtgagatg

SEQ ID NO: 6921552 - DNA, 22 bp, Homo sapiens
agcttcccggcaggcacgtcct

SEQ ID NO: 6921553 - DNA, 22 bp, Homo sapiens
aggggcgtgctcttccccgacg

SEQ ID NO: 6921554 - DNA, 22 bp, Homo sapiens
tttttgggtccaggctgtatct

SEQ ID NO: 6921555 - DNA, 22 bp, Homo sapiens
ttgtattagtaagtcagctgct

SEQ ID NO: 6921556 - DNA, 22 bp, Homo sapiens
aagagtttccatgctctgtgct

SEQ ID NO: 6921557 - DNA, 22 bp, Homo sapiens
taccttgaaccccaagctttgc

SEQ ID NO: 6921558 - DNA, 22 bp, Homo sapiens
tatgtattatctgtgactgctt

SEQ ID NO: 6921559 - DNA, 22 bp, Homo sapiens
agggtagtacagagagtgtcct

SEQ ID NO: 6921560 - DNA, 22 bp, Homo sapiens
cctgcagagcaggagaggcatc

SEQ ID NO: 6921561 - DNA, 22 bp, Homo sapiens
attgtacatatgatgtatgtaa

SEQ ID NO: 6921562 - DNA, 20 bp, Homo sapiens
agaaggcaggagacaaaagg

SEQ ID NO: 6921563 - DNA, 22 bp, Homo sapiens
ggccagaggtggtacatagctt

SEQ ID NO: 6921564 - DNA, 22 bp, Homo sapiens
cagtggctgtttctggaaggca

SEQ ID NO: 6921565 - DNA, 22 bp, Homo sapiens
tgcaagattttgacactcgtct

SEQ ID NO: 6921566 - DNA, 22 bp, Homo sapiens
cctaattgatttgcttctacat

SEQ ID NO: 6921567 - DNA, 22 bp, Homo sapiens
gtggtggtcaccaaattgaggg

SEQ ID NO: 6921568 - DNA, 22 bp, Homo sapiens
atgtacacacaagtttgcacgc

SEQ ID NO: 6921569 - DNA, 22 bp, Homo sapiens
acccctcatcagttgcttccta

SEQ ID NO: 6921570 - DNA, 22 bp, Homo sapiens
cctgacctacctgaagtctaca

SEQ ID NO: 6921571 - DNA, 22 bp, Homo sapiens
tgtgttcctgcctggctctggt

SEQ ID NO: 6921572 - DNA, 22 bp, Homo sapiens
aattgcaacaggtagacttttc

SEQ ID NO: 6921573 - DNA, 22 bp, Homo sapiens
ggagtggcaggccacagtgctg

SEQ ID NO: 6921574 - DNA, 22 bp, Homo sapiens
cttcagtgattgcagaaagcct

SEQ ID NO: 6921575 - DNA, 22 bp, Homo sapiens
ttccataactgaccgaatgcat

SEQ ID NO: 6921576 - DNA, 22 bp, Homo sapiens
aaggttagtaagtatcttatgt

SEQ ID NO: 6921577 - DNA, 22 bp, Homo sapiens
tgtgagaaaatgattgcacagt

SEQ ID NO: 6921578 - DNA, 22 bp, Homo sapiens
agtttaggaaacaattacctta

SEQ ID NO: 6921579 - DNA, 22 bp, Homo sapiens
agtgattctttaaagtggtatt

SEQ ID NO: 6921580 - DNA, 22 bp, Homo sapiens
agccctctaaaaatgataacta

SEQ ID NO: 6921581 - DNA, 20 bp, Homo sapiens
catcaggaccctcagttttt

SEQ ID NO: 6921582 - DNA, 22 bp, Homo sapiens
acacagtttttcagacagagat

SEQ ID NO: 6921583 - DNA, 22 bp, Homo sapiens
tcaggacaacctgttttcagac

SEQ ID NO: 6921584 - DNA, 22 bp, Homo sapiens
cccagggtaatcatgtgaagcc

SEQ ID NO: 6921585 - DNA, 22 bp, Homo sapiens
catgccaacaacaagcaatgag

SEQ ID NO: 6921586 - DNA, 22 bp, Homo sapiens
aatcattgttgtcgttcctaga

SEQ ID NO: 6921587 - DNA, 22 bp, Homo sapiens
attgtattcagttacaggtctt

SEQ ID NO: 6921588 - DNA, 22 bp, Homo sapiens
tagcactacttaggtacagcca

SEQ ID NO: 6921589 - DNA, 22 bp, Homo sapiens
tttctagggctcttgtcttctg

SEQ ID NO: 6921590 - DNA, 22 bp, Homo sapiens
gatggcttgcttagtgacagca

SEQ ID NO: 6921591 - DNA, 22 bp, Homo sapiens
gaacttcagaatcagcatatct

SEQ ID NO: 6921592 - DNA, 20 bp, Homo sapiens
gcttcccaattcttgatctg

SEQ ID NO: 6921593 - DNA, 22 bp, Homo sapiens
agtgtgtccaggaagcagatgg

SEQ ID NO: 6921594 - DNA, 22 bp, Homo sapiens
tcttggcaagaagcttcagcta

SEQ ID NO: 6921595 - DNA, 19 bp, Homo sapiens
attgcagctatagactgcc

SEQ ID NO: 6921596 - DNA, 22 bp, Homo sapiens
taggctgaggttgatgccaggg

SEQ ID NO: 6921597 - DNA, 22 bp, Homo sapiens
tcttcagacccttagctgtgat

SEQ ID NO: 6921598 - DNA, 22 bp, Homo sapiens
agcactgatttaaactggattt

SEQ ID NO: 6921599 - DNA, 22 bp, Homo sapiens
ggcagaaggcctcccagctcct

SEQ ID NO: 6921600 - DNA, 22 bp, Homo sapiens
catctttaaaatgggaacaaca

SEQ ID NO: 6921601 - DNA, 22 bp, Homo sapiens
cggctgctgcctgagtcgctgt

SEQ ID NO: 6921602 - DNA, 22 bp, Homo sapiens
tggctggccctgggagtgcaga

SEQ ID NO: 6921603 - DNA, 22 bp, Homo sapiens
acagcttccagtattcttgaaa

SEQ ID NO: 6921604 - DNA, 22 bp, Homo sapiens
cctggcacattcccgcgcatgc

SEQ ID NO: 6921605 - DNA, 22 bp, Homo sapiens
tggctcagtttgggggattgaa

SEQ ID NO: 6921606 - DNA, 22 bp, Homo sapiens
tagctcttgccatctgtcttat

SEQ ID NO: 6921607 - DNA, 22 bp, Homo sapiens
cacctggttctagtgaaagtct

SEQ ID NO: 6921608 - DNA, 20 bp, Homo sapiens
ccagacagcacctgcctggt

SEQ ID NO: 6921609 - DNA, 22 bp, Homo sapiens
tgccacccctctgcaccctcag

SEQ ID NO: 6921610 - DNA, 17 bp, Homo sapiens
tggggtccccgatggtg

SEQ ID NO: 6921611 - DNA, 22 bp, Homo sapiens
ttaccattgttccccatgtgta

SEQ ID NO: 6921612 - DNA, 22 bp, Homo sapiens
gaaggagggagcggcgcggatt

SEQ ID NO: 6921613 - DNA, 22 bp, Homo sapiens
caggccggtgattctggatgta

SEQ ID NO: 6921614 - DNA, 22 bp, Homo sapiens
cttatacataaaatgggtgtag

SEQ ID NO: 6921615 - DNA, 22 bp, Homo sapiens
gagttaaaggaaaataacttta

SEQ ID NO: 6921616 - DNA, 22 bp, Homo sapiens
ttgcttttaatctttgtacatc

SEQ ID NO: 6921617 - DNA, 22 bp, Homo sapiens
tgattctttctccaccaattca

SEQ ID NO: 6921618 - DNA, 22 bp, Homo sapiens
cctggggagaagagcttccccc

SEQ ID NO: 6921619 - DNA, 22 bp, Homo sapiens
attgttactgggttaatttgga

SEQ ID NO: 6921620 - DNA, 21 bp, Homo sapiens
agctgtggcgaggggaacatg

SEQ ID NO: 6921621 - DNA, 22 bp, Homo sapiens
tatgcccttacaatgagcacaa

SEQ ID NO: 6921622 - DNA, 22 bp, Homo sapiens
gactgggagggttcagctgggt

SEQ ID NO: 6921623 - DNA, 22 bp, Homo sapiens
gtgccaggcctattgttaaact

SEQ ID NO: 6921624 - DNA, 18 bp, Homo sapiens
gggatcaggctgcctagg

SEQ ID NO: 6921625 - DNA, 22 bp, Homo sapiens
cccaagccagaccctgaccctg

SEQ ID NO: 6921626 - DNA, 20 bp, Homo sapiens
tctcctggtctggtccgtgc

SEQ ID NO: 6921627 - DNA, 22 bp, Homo sapiens
ctgggcctaggatggaagggcc

SEQ ID NO: 6921628 - DNA, 22 bp, Homo sapiens
gtgggcctcccctttacgagcc

SEQ ID NO: 6921629 - DNA, 17 bp, Homo sapiens
caggctccttccagatt

SEQ ID NO: 6921630 - DNA, 17 bp, Homo sapiens
cagtgcttctgcttctt

SEQ ID NO: 6921631 - DNA, 22 bp, Homo sapiens
gacatatgatattaaatgagca

SEQ ID NO: 6921632 - DNA, 22 bp, Homo sapiens
tgtgacagcaataactacttaa

SEQ ID NO: 6921633 - DNA, 22 bp, Homo sapiens
ttaagacatgtgagcataactt

SEQ ID NO: 6921634 - DNA, 22 bp, Homo sapiens
ccacaggaggatgttcagacaa

SEQ ID NO: 6921635 - DNA, 22 bp, Homo sapiens
gtgtataatcctgcaaagggag

SEQ ID NO: 6921636 - DNA, 20 bp, Homo sapiens
ggagctgccctgggctggag

SEQ ID NO: 6921637 - DNA, 22 bp, Homo sapiens
tttgtacatatataaaatctgt

SEQ ID NO: 6921638 - DNA, 22 bp, Homo sapiens
tatggtaaatgagcatatgttc

SEQ ID NO: 6921639 - DNA, 22 bp, Homo sapiens
tctcatcacttaacatctgctt

SEQ ID NO: 6921640 - DNA, 22 bp, Homo sapiens
ggtcactttaccccttggagcc

SEQ ID NO: 6921641 - DNA, 21 bp, Homo sapiens
tcacaactttgaatttcaata

SEQ ID NO: 6921642 - DNA, 20 bp, Homo sapiens
tcttggaaaaagttcagaat

SEQ ID NO: 6921643 - DNA, 22 bp, Homo sapiens
tacctagttccctttggggcct

SEQ ID NO: 6921644 - DNA, 23 bp, Homo sapiens
acacttcacccattgtgatagga

SEQ ID NO: 6921645 - DNA, 16 bp, Homo sapiens
tcaggcctggacgagc

SEQ ID NO: 6921646 - DNA, 23 bp, Homo sapiens
cccagaccttgtgctgcccttgg

SEQ ID NO: 6921647 - DNA, 22 bp, Homo sapiens
catgacattttaaaaagaacat

SEQ ID NO: 6921648 - DNA, 22 bp, Homo sapiens
tttatccatgctcccgttgatg

SEQ ID NO: 6921649 - DNA, 22 bp, Homo sapiens
accaatgccattttctacacat

SEQ ID NO: 6921650 - DNA, 22 bp, Homo sapiens
tttcccagttccctgctctata

SEQ ID NO: 6921651 - DNA, 22 bp, Homo sapiens
tggaggccatacctcctgacat

SEQ ID NO: 6921652 - DNA, 22 bp, Homo sapiens
ggcagaaggttgaagtaatttg

SEQ ID NO: 6921653 - DNA, 22 bp, Homo sapiens
agtcaacacattaaacctaggg

SEQ ID NO: 6921654 - DNA, 23 bp, Homo sapiens
tcatggaatgaattcttctgtta

SEQ ID NO: 6921655 - DNA, 22 bp, Homo sapiens
ctagtcacacagtaaggacggg

SEQ ID NO: 6921656 - DNA, 22 bp, Homo sapiens
tgacagctttgcttggggaaga

SEQ ID NO: 6921657 - DNA, 22 bp, Homo sapiens
cagcttccataagagatggaga

SEQ ID NO: 6921658 - DNA, 22 bp, Homo sapiens
aaatggcagtgtcataaggctc

SEQ ID NO: 6921659 - DNA, 22 bp, Homo sapiens
cagttcttggacactctggagt

SEQ ID NO: 6921660 - DNA, 18 bp, Homo sapiens
gctcatcccacaatcagg

SEQ ID NO: 6921661 - DNA, 20 bp, Homo sapiens
catatatacctagaagtgga

SEQ ID NO: 6921662 - DNA, 22 bp, Homo sapiens
ttgagatgggctttatgttcag

SEQ ID NO: 6921663 - DNA, 17 bp, Homo sapiens
tgagttaagtttagatc

SEQ ID NO: 6921664 - DNA, 22 bp, Homo sapiens
aactgatttcaagttcagtttc

SEQ ID NO: 6921665 - DNA, 22 bp, Homo sapiens
gttccaaatttggatctttagg

SEQ ID NO: 6921666 - DNA, 22 bp, Homo sapiens
aaggctatacaaaatcctggca

SEQ ID NO: 6921667 - DNA, 22 bp, Homo sapiens
tcaggggcccttccctcagcag

SEQ ID NO: 6921668 - DNA, 22 bp, Homo sapiens
tccagctgcaaggggcacagct

SEQ ID NO: 6921669 - DNA, 23 bp, Homo sapiens
actgggaagtttggagagacgca

SEQ ID NO: 6921670 - DNA, 22 bp, Homo sapiens
acagtagtacacatctatgtcc

SEQ ID NO: 6921671 - DNA, 22 bp, Homo sapiens
actctcagggctccagggaaag

SEQ ID NO: 6921672 - DNA, 22 bp, Homo sapiens
ggagagtggattccagctgtat

SEQ ID NO: 6921673 - DNA, 22 bp, Homo sapiens
tcatttacacttcacaaatgga

SEQ ID NO: 6921674 - DNA, 22 bp, Homo sapiens
gggaccaggtcagggctctgac

SEQ ID NO: 6921675 - DNA, 22 bp, Homo sapiens
tttgtttcgcagcctctctctg

SEQ ID NO: 6921676 - DNA, 22 bp, Homo sapiens
tcccatgttaggtgtttctgtt

SEQ ID NO: 6921677 - DNA, 22 bp, Homo sapiens
tctctgcagctaagaaattaat

SEQ ID NO: 6921678 - DNA, 22 bp, Homo sapiens
gggtgggatggcaggagccgct

SEQ ID NO: 6921679 - DNA, 22 bp, Homo sapiens
ccaggctgctttattactctgt

SEQ ID NO: 6921680 - DNA, 22 bp, Homo sapiens
tgtggtcttggaagaagttgct

SEQ ID NO: 6921681 - DNA, 22 bp, Homo sapiens
gcagcagcggggcccctgcgcg

SEQ ID NO: 6921682 - DNA, 23 bp, Homo sapiens
ctgatttgagcagaataaaatag

SEQ ID NO: 6921683 - DNA, 22 bp, Homo sapiens
tcagcaggcacggacaggctgc

SEQ ID NO: 6921684 - DNA, 22 bp, Homo sapiens
agtacacacagtagaatagagt

SEQ ID NO: 6921685 - DNA, 22 bp, Homo sapiens
cagcacttcaatgagcatttca

SEQ ID NO: 6921686 - DNA, 22 bp, Homo sapiens
tatctgttggctcctagttgta

SEQ ID NO: 6921687 - DNA, 22 bp, Homo sapiens
atgaaacagtgtgtatagcaaa

SEQ ID NO: 6921688 - DNA, 22 bp, Homo sapiens
ttgtttgtgctatttaatgtag

SEQ ID NO: 6921689 - DNA, 22 bp, Homo sapiens
aggaagcctggggctgccctcg

SEQ ID NO: 6921690 - DNA, 22 bp, Homo sapiens
attttacttcatttgaaatgcc

SEQ ID NO: 6921691 - DNA, 22 bp, Homo sapiens
agctctggaagccctggtagtt

SEQ ID NO: 6921692 - DNA, 22 bp, Homo sapiens
gaggccaggggagtcagcgtcc

SEQ ID NO: 6921693 - DNA, 22 bp, Homo sapiens
gccaaagtccacttgctttctg

SEQ ID NO: 6921694 - DNA, 22 bp, Homo sapiens
ctgggccaaaagaagtgttctt

SEQ ID NO: 6921695 - DNA, 22 bp, Homo sapiens
caggcttgatgtgtctatactt

SEQ ID NO: 6921696 - DNA, 22 bp, Homo sapiens
gctactgattgaccttggagag

SEQ ID NO: 6921697 - DNA, 22 bp, Homo sapiens
gaccaggtccaaagctactgtc

SEQ ID NO: 6921698 - DNA, 22 bp, Homo sapiens
aggtctctggggaactccaggg

SEQ ID NO: 6921699 - DNA, 22 bp, Homo sapiens
gagaggtacggaaagagcgtgg

SEQ ID NO: 6921700 - DNA, 22 bp, Homo sapiens
aggtttataactttggagaatt

SEQ ID NO: 6921701 - DNA, 22 bp, Homo sapiens
tgtctgtctttagtgagattgc

SEQ ID NO: 6921702 - DNA, 22 bp, Homo sapiens
ttccttctggagcccggggagc

SEQ ID NO: 6921703 - DNA, 22 bp, Homo sapiens
ccaggagatgggagcatctaaa

SEQ ID NO: 6921704 - DNA, 22 bp, Homo sapiens
cttacacactagatggtaggtg

SEQ ID NO: 6921705 - DNA, 22 bp, Homo sapiens
ttaccataaagtttatctttct

SEQ ID NO: 6921706 - DNA, 22 bp, Homo sapiens
acactgaatatacaatgaatat

SEQ ID NO: 6921707 - DNA, 22 bp, Homo sapiens
ccttaagtacctgactagcatg

SEQ ID NO: 6921708 - DNA, 23 bp, Homo sapiens
tagggtgttaagtcagtgattga

SEQ ID NO: 6921709 - DNA, 22 bp, Homo sapiens
aggtccatggcagcgggtactt

SEQ ID NO: 6921710 - DNA, 20 bp, Homo sapiens
taatgtcaaagtcacaaggt

SEQ ID NO: 6921711 - DNA, 22 bp, Homo sapiens
catcagaattacttggggagct

SEQ ID NO: 6921712 - DNA, 22 bp, Homo sapiens
tcgagtacagttgagccaaaac

SEQ ID NO: 6921713 - DNA, 19 bp, Homo sapiens
tttgatgagaatttaagca

SEQ ID NO: 6921714 - DNA, 22 bp, Homo sapiens
aagcagcatgattgtaatacta

SEQ ID NO: 6921715 - DNA, 22 bp, Homo sapiens
aaattagtcggtttaggaattt

SEQ ID NO: 6921716 - DNA, 22 bp, Homo sapiens
ccagcactctgtcccagcttcc

SEQ ID NO: 6921717 - DNA, 22 bp, Homo sapiens
aaagtcatttagccttatctcc

SEQ ID NO: 6921718 - DNA, 22 bp, Homo sapiens
aggctgtgagaagtccttcagt

SEQ ID NO: 6921719 - DNA, 22 bp, Homo sapiens
ttatcgtatctcttggtcttca

SEQ ID NO: 6921720 - DNA, 22 bp, Homo sapiens
gtctgaggtcattagctctctt

SEQ ID NO: 6921721 - DNA, 22 bp, Homo sapiens
gaagcatgctaaggattctcag

SEQ ID NO: 6921722 - DNA, 22 bp, Homo sapiens
gagttatatttgcgatattgga

SEQ ID NO: 6921723 - DNA, 21 bp, Homo sapiens
cagcttcttctgtgacctggt

SEQ ID NO: 6921724 - DNA, 17 bp, Homo sapiens
gacagctgggcgcacgc

SEQ ID NO: 6921725 - DNA, 22 bp, Homo sapiens
aatgtctctatatctcataaga

SEQ ID NO: 6921726 - DNA, 22 bp, Homo sapiens
cctgcccaggccctaagttagg

SEQ ID NO: 6921727 - DNA, 22 bp, Homo sapiens
aggacattatgctaagtaaatg

SEQ ID NO: 6921728 - DNA, 22 bp, Homo sapiens
aagaatgtcgttggtattttaa

SEQ ID NO: 6921729 - DNA, 22 bp, Homo sapiens
acagtttattgcacaggtaacc

SEQ ID NO: 6921730 - DNA, 22 bp, Homo sapiens
tttctgagaaattaaacacttt

SEQ ID NO: 6921731 - DNA, 22 bp, Homo sapiens
cacagttgaggtctggttgttt

SEQ ID NO: 6921732 - DNA, 22 bp, Homo sapiens
ggtcacgtgacggttacgactg

SEQ ID NO: 6921733 - DNA, 22 bp, Homo sapiens
cttctttcaagaatggattagg

SEQ ID NO: 6921734 - DNA, 22 bp, Homo sapiens
actgcatcgctcgcttaggtcc

SEQ ID NO: 6921735 - DNA, 22 bp, Homo sapiens
tgctgcaggcagcccctctact

SEQ ID NO: 6921736 - DNA, 22 bp, Homo sapiens
aatctcatttttagtttaggtg

SEQ ID NO: 6921737 - DNA, 22 bp, Homo sapiens
caggcaccaatagggatcgtgg

SEQ ID NO: 6921738 - DNA, 22 bp, Homo sapiens
actgtgttcaattaaaaagctt

SEQ ID NO: 6921739 - DNA, 22 bp, Homo sapiens
agcagcttacatgtggcctatc

SEQ ID NO: 6921740 - DNA, 22 bp, Homo sapiens
ggtgccagaaaacttgaagagt

SEQ ID NO: 6921741 - DNA, 22 bp, Homo sapiens
gctggctgaggtctagctcttt

SEQ ID NO: 6921742 - DNA, 22 bp, Homo sapiens
tgtgctcagtctttggctggga

SEQ ID NO: 6921743 - DNA, 22 bp, Homo sapiens
tgagccatgggactccaaggga

SEQ ID NO: 6921744 - DNA, 22 bp, Homo sapiens
atgttttctagagtttaaaatc

SEQ ID NO: 6921745 - DNA, 22 bp, Homo sapiens
actgagcctctcttcccacctc

SEQ ID NO: 6921746 - DNA, 22 bp, Homo sapiens
atcagaagaaatggatgtgact

SEQ ID NO: 6921747 - DNA, 22 bp, Homo sapiens
tcagacaggcctctccagcctc

SEQ ID NO: 6921748 - DNA, 22 bp, Homo sapiens
ctgccaggcctcatcccagcca

SEQ ID NO: 6921749 - DNA, 22 bp, Homo sapiens
gtcttattaaaatgcagtttct

SEQ ID NO: 6921750 - DNA, 22 bp, Homo sapiens
aatgaaactagtagaatctttg

SEQ ID NO: 6921751 - DNA, 22 bp, Homo sapiens
atctggaagccagatactcagt

SEQ ID NO: 6921752 - DNA, 22 bp, Homo sapiens
tctagaacttctctaaaatgaa

SEQ ID NO: 6921753 - DNA, 22 bp, Homo sapiens
cgatgacagtgagttccttctt

SEQ ID NO: 6921754 - DNA, 22 bp, Homo sapiens
taagtggtaccaagctcagtga

SEQ ID NO: 6921755 - DNA, 22 bp, Homo sapiens
agtatgcagggtaggatcatct

SEQ ID NO: 6921756 - DNA, 22 bp, Homo sapiens
ggtaagattactttcttagcca

SEQ ID NO: 6921757 - DNA, 22 bp, Homo sapiens
tctgaaaatgttgactttgttt

SEQ ID NO: 6921758 - DNA, 22 bp, Homo sapiens
gaatattagtatcagttatacc

SEQ ID NO: 6921759 - DNA, 22 bp, Homo sapiens
accaatcaaaatgtatggagct

SEQ ID NO: 6921760 - DNA, 22 bp, Homo sapiens
tggttcctacgcacattgaatt

SEQ ID NO: 6921761 - DNA, 23 bp, Homo sapiens
acgctgggtggccagaacgacag

SEQ ID NO: 6921762 - DNA, 22 bp, Homo sapiens
taagtccactatatccttctct

SEQ ID NO: 6921763 - DNA, 22 bp, Homo sapiens
aacatgagtgataaaattacct

SEQ ID NO: 6921764 - DNA, 22 bp, Homo sapiens
aagtatgaatcaaagactatct

SEQ ID NO: 6921765 - DNA, 22 bp, Homo sapiens
ttctcttccagccgggcttgca

SEQ ID NO: 6921766 - DNA, 22 bp, Homo sapiens
cagtgattttctcagaacttga

SEQ ID NO: 6921767 - DNA, 22 bp, Homo sapiens
agtaagttccagtttcattatg

SEQ ID NO: 6921768 - DNA, 20 bp, Homo sapiens
gtctggcttcgtgattctgg

SEQ ID NO: 6921769 - DNA, 22 bp, Homo sapiens
acaagatggaatattgagaaaa

SEQ ID NO: 6921770 - DNA, 22 bp, Homo sapiens
tttatttcactctccggatact

SEQ ID NO: 6921771 - DNA, 22 bp, Homo sapiens
aagatttcctggatgtaattcc

SEQ ID NO: 6921772 - DNA, 22 bp, Homo sapiens
ctcaggctgtgccacctgtgtg

SEQ ID NO: 6921773 - DNA, 22 bp, Homo sapiens
tgtgtattaccattttacagct

SEQ ID NO: 6921774 - DNA, 22 bp, Homo sapiens
ttacagatgtttcaggaatact

SEQ ID NO: 6921775 - DNA, 22 bp, Homo sapiens
aaatgctctccaaaatgaaagt

SEQ ID NO: 6921776 - DNA, 22 bp, Homo sapiens
tcctttgttaaggaggtttgtt

SEQ ID NO: 6921777 - DNA, 22 bp, Homo sapiens
tctgggaagctggtcctgttct

SEQ ID NO: 6921778 - DNA, 22 bp, Homo sapiens
atgcatatagaacatttgacat

SEQ ID NO: 6921779 - DNA, 22 bp, Homo sapiens
aaaccatgctttgatgatttta

SEQ ID NO: 6921780 - DNA, 19 bp, Homo sapiens
tcactctccctgtctgtcc

SEQ ID NO: 6921781 - DNA, 22 bp, Homo sapiens
tttcagagtcagctcctctcta

SEQ ID NO: 6921782 - DNA, 22 bp, Homo sapiens
gatgttcagactctaggtcaga

SEQ ID NO: 6921783 - DNA, 22 bp, Homo sapiens
aaatgttctaaattacatgtga

SEQ ID NO: 6921784 - DNA, 22 bp, Homo sapiens
ttgcaaatctttgccagaaggc

SEQ ID NO: 6921785 - DNA, 22 bp, Homo sapiens
ggcaggtggaagttggcagagc

SEQ ID NO: 6921786 - DNA, 21 bp, Homo sapiens
tccagttgagactgaagatct

SEQ ID NO: 6921787 - DNA, 22 bp, Homo sapiens
tacagtaggattttcagggtct

SEQ ID NO: 6921788 - DNA, 22 bp, Homo sapiens
acttgggtcaagtagctcacag

SEQ ID NO: 6921789 - DNA, 22 bp, Homo sapiens
ctgtgtctaatcttatacatca

SEQ ID NO: 6921790 - DNA, 22 bp, Homo sapiens
agctgtggggaggaggctagca

SEQ ID NO: 6921791 - DNA, 22 bp, Homo sapiens
cgcagaagaggttgtctagtcc

SEQ ID NO: 6921792 - DNA, 22 bp, Homo sapiens
taaatgacccatgctgacctca

SEQ ID NO: 6921793 - DNA, 22 bp, Homo sapiens
cctagtccccaggaggtcagtg

SEQ ID NO: 6921794 - DNA, 22 bp, Homo sapiens
tgctcccatgtgtgggtacaga

SEQ ID NO: 6921795 - DNA, 22 bp, Homo sapiens
aacaaatttagctctgagtgct

SEQ ID NO: 6921796 - DNA, 22 bp, Homo sapiens
tcatttttctcttacacgtaga

SEQ ID NO: 6921797 - DNA, 22 bp, Homo sapiens
ggcatatttatgagaacttagt

SEQ ID NO: 6921798 - DNA, 22 bp, Homo sapiens
tctgtacctcacatgcaccatc

SEQ ID NO: 6921799 - DNA, 22 bp, Homo sapiens
aggctgaggcaggtggatcatt

SEQ ID NO: 6921800 - DNA, 22 bp, Homo sapiens
tggacacaatgttgccttaggg

SEQ ID NO: 6921801 - DNA, 22 bp, Homo sapiens
tgctatttggcacttttgacct

SEQ ID NO: 6921802 - DNA, 22 bp, Homo sapiens
tttatccaccttaccctgttcc

SEQ ID NO: 6921803 - DNA, 22 bp, Homo sapiens
gataagggccagtgggcagtag

SEQ ID NO: 6921804 - DNA, 22 bp, Homo sapiens
aataggaagcaccaaattctcc

SEQ ID NO: 6921805 - DNA, 22 bp, Homo sapiens
tctgacccgtggctctgcctcc

SEQ ID NO: 6921806 - DNA, 22 bp, Homo sapiens
ctcctgcggtactactgtgctt

SEQ ID NO: 6921807 - DNA, 22 bp, Homo sapiens
aagaactggttatgttatcttg

SEQ ID NO: 6921808 - DNA, 22 bp, Homo sapiens
tgggcagagtcgtggggaatag

SEQ ID NO: 6921809 - DNA, 23 bp, Homo sapiens
ttattgagggtgtagattggtgt

SEQ ID NO: 6921810 - DNA, 22 bp, Homo sapiens
ccttaaagaataagtcttatct

SEQ ID NO: 6921811 - DNA, 22 bp, Homo sapiens
gggtgtgtgcagggtggcactc

SEQ ID NO: 6921812 - DNA, 22 bp, Homo sapiens
gagaatattagagttagtttat

SEQ ID NO: 6921813 - DNA, 22 bp, Homo sapiens
tggagaagattggtcaccattc

SEQ ID NO: 6921814 - DNA, 22 bp, Homo sapiens
tcacatctccctggaggacaca

SEQ ID NO: 6921815 - DNA, 18 bp, Homo sapiens
ctctctggtctggatccc

SEQ ID NO: 6921816 - DNA, 22 bp, Homo sapiens
ggcctcagtttctccatgggtt

SEQ ID NO: 6921817 - DNA, 22 bp, Homo sapiens
ctggcagcttagcactctggtt

SEQ ID NO: 6921818 - DNA, 22 bp, Homo sapiens
cacattcagggaacattggagg

SEQ ID NO: 6921819 - DNA, 22 bp, Homo sapiens
tgggcacactgaatctgctatt

SEQ ID NO: 6921820 - DNA, 22 bp, Homo sapiens
gcggggttccgtgccccagagt

SEQ ID NO: 6921821 - DNA, 19 bp, Homo sapiens
cttctgtgatacatcagtc

SEQ ID NO: 6921822 - DNA, 22 bp, Homo sapiens
tgctaccttttttattaaatga

SEQ ID NO: 6921823 - DNA, 22 bp, Homo sapiens
tgctgcccactgtatttctcca

SEQ ID NO: 6921824 - DNA, 22 bp, Homo sapiens
gccttgggacggaggggtcacc

SEQ ID NO: 6921825 - DNA, 22 bp, Homo sapiens
aagatgctcttaatgggtttat

SEQ ID NO: 6921826 - DNA, 22 bp, Homo sapiens
ggcctgtggcaaggtgagaatg

SEQ ID NO: 6921827 - DNA, 21 bp, Homo sapiens
tcctggccagggcactaggca

SEQ ID NO: 6921828 - DNA, 22 bp, Homo sapiens
gagccaagctcttctccatgag

SEQ ID NO: 6921829 - DNA, 22 bp, Homo sapiens
tattaagtatcttgatgacaaa

SEQ ID NO: 6921830 - DNA, 22 bp, Homo sapiens
cagtttaaagaaggatgggagt

SEQ ID NO: 6921831 - DNA, 22 bp, Homo sapiens
agcttccttggcgctgaggcct

SEQ ID NO: 6921832 - DNA, 21 bp, Homo sapiens
agaagcctggggaatgtggct

SEQ ID NO: 6921833 - DNA, 22 bp, Homo sapiens
tttgctgtgaatccattactgt

SEQ ID NO: 6921834 - DNA, 22 bp, Homo sapiens
actctgtgccaggcactttggg

SEQ ID NO: 6921835 - DNA, 22 bp, Homo sapiens
tcagacatgttttaagacttat

SEQ ID NO: 6921836 - DNA, 22 bp, Homo sapiens
atgtctgtggcattatatgttt

SEQ ID NO: 6921837 - DNA, 22 bp, Homo sapiens
acgtgttcaatttccatctgac

SEQ ID NO: 6921838 - DNA, 22 bp, Homo sapiens
ttacacagcttctatccttgaa

SEQ ID NO: 6921839 - DNA, 22 bp, Homo sapiens
agaagggtgtatacatttcctg

SEQ ID NO: 6921840 - DNA, 22 bp, Homo sapiens
ggaaatgacttggtgcttcgtt

SEQ ID NO: 6921841 - DNA, 21 bp, Homo sapiens
agttttgagagtgggtagtgt

SEQ ID NO: 6921842 - DNA, 18 bp, Homo sapiens
ggagcccagaggacagga

SEQ ID NO: 6921843 - DNA, 22 bp, Homo sapiens
ccaggctacacatcagatgagt

SEQ ID NO: 6921844 - DNA, 22 bp, Homo sapiens
gggacctggcgagggtcacaca

SEQ ID NO: 6921845 - DNA, 22 bp, Homo sapiens
gctggctccaaaagcaggggct

SEQ ID NO: 6921846 - DNA, 22 bp, Homo sapiens
cccctgagattctggcttggga

SEQ ID NO: 6921847 - DNA, 22 bp, Homo sapiens
tctagggagaagctctgtctgt

SEQ ID NO: 6921848 - DNA, 22 bp, Homo sapiens
agctttatggtgcctcacttga

SEQ ID NO: 6921849 - DNA, 22 bp, Homo sapiens
gcctctctgggctgccgaggct

SEQ ID NO: 6921850 - DNA, 22 bp, Homo sapiens
aagccagatttcactcttaatt

SEQ ID NO: 6921851 - DNA, 22 bp, Homo sapiens
atgaggtcatcttgaagtaggg

SEQ ID NO: 6921852 - DNA, 22 bp, Homo sapiens
ctggaccagaaaggacatggct

SEQ ID NO: 6921853 - DNA, 22 bp, Homo sapiens
ccaggctttctcctgactcaca

SEQ ID NO: 6921854 - DNA, 22 bp, Homo sapiens
ctttgctaatgttgcattttca

SEQ ID NO: 6921855 - DNA, 22 bp, Homo sapiens
agtctggagctcagacttggga

SEQ ID NO: 6921856 - DNA, 22 bp, Homo sapiens
cactgtctattaatataactta

SEQ ID NO: 6921857 - DNA, 22 bp, Homo sapiens
ggctcctggcatctggtgggta

SEQ ID NO: 6921858 - DNA, 22 bp, Homo sapiens
gcatctaaataaacgtgggagt

SEQ ID NO: 6921859 - DNA, 22 bp, Homo sapiens
ggtcaagacgggctctgccctt

SEQ ID NO: 6921860 - DNA, 22 bp, Homo sapiens
ttggtttagtacctgccagcgt

SEQ ID NO: 6921861 - DNA, 22 bp, Homo sapiens
tcaggtgtaggttgttcagttt

SEQ ID NO: 6921862 - DNA, 22 bp, Homo sapiens
actggactgagttggaattgag

SEQ ID NO: 6921863 - DNA, 22 bp, Homo sapiens
aaaggtcattgaaaaggaggaa

SEQ ID NO: 6921864 - DNA, 22 bp, Homo sapiens
atgctgagattcacctgaatgt

SEQ ID NO: 6921865 - DNA, 22 bp, Homo sapiens
actctgaagaagacttccagac

SEQ ID NO: 6921866 - DNA, 22 bp, Homo sapiens
cttgaggagtttaatagggatc

SEQ ID NO: 6921867 - DNA, 22 bp, Homo sapiens
tgtaagaagggccagagctcca

SEQ ID NO: 6921868 - DNA, 22 bp, Homo sapiens
gagtccttttctctgtccactg

SEQ ID NO: 6921869 - DNA, 22 bp, Homo sapiens
gcgcagctcagtgagggaactt

SEQ ID NO: 6921870 - DNA, 22 bp, Homo sapiens
ggggtgcgggccccatctggct

SEQ ID NO: 6921871 - DNA, 20 bp, Homo sapiens
gcctctggagccaaggacca

SEQ ID NO: 6921872 - DNA, 22 bp, Homo sapiens
aaattcagtgttcttcccgtaa

SEQ ID NO: 6921873 - DNA, 22 bp, Homo sapiens
gcagctgccgtgagctcacgcc

SEQ ID NO: 6921874 - DNA, 22 bp, Homo sapiens
cactggctccctgatttgaagc

SEQ ID NO: 6921875 - DNA, 22 bp, Homo sapiens
gggatggagggtagagcaagtg

SEQ ID NO: 6921876 - DNA, 20 bp, Homo sapiens
tgcacccagagcctgaagat

SEQ ID NO: 6921877 - DNA, 22 bp, Homo sapiens
agtggagaagaggatggtctcc

SEQ ID NO: 6921878 - DNA, 22 bp, Homo sapiens
tcctggccttagcgaggcggtc

SEQ ID NO: 6921879 - DNA, 22 bp, Homo sapiens
cctggtggcgaatggtggtagg

SEQ ID NO: 6921880 - DNA, 22 bp, Homo sapiens
tctcagctcagcttccacagag

SEQ ID NO: 6921881 - DNA, 22 bp, Homo sapiens
tgagccagttcttcagatccat

SEQ ID NO: 6921882 - DNA, 22 bp, Homo sapiens
ctgcctttgaaagttctgttga

SEQ ID NO: 6921883 - DNA, 22 bp, Homo sapiens
cacataaatggtgccatgtttt

SEQ ID NO: 6921884 - DNA, 23 bp, Homo sapiens
aagtacatatatttagatagtga

SEQ ID NO: 6921885 - DNA, 22 bp, Homo sapiens
cttctaccttagtgtttagatg

SEQ ID NO: 6921886 - DNA, 20 bp, Homo sapiens
aagttgcagagagttgtctt

SEQ ID NO: 6921887 - DNA, 22 bp, Homo sapiens
acatttgtcttcctcctcagtg

SEQ ID NO: 6921888 - DNA, 22 bp, Homo sapiens
tatcactacacttcagctttaa

SEQ ID NO: 6921889 - DNA, 22 bp, Homo sapiens
ggcaaattaaattagtatggca

SEQ ID NO: 6921890 - DNA, 22 bp, Homo sapiens
tgtatgaaaaggaatagattga

SEQ ID NO: 6921891 - DNA, 22 bp, Homo sapiens
ggctgtacctgcctctcctcta

SEQ ID NO: 6921892 - DNA, 22 bp, Homo sapiens
gttcctggcattgtcagcggcc

SEQ ID NO: 6921893 - DNA, 22 bp, Homo sapiens
aagtggaggccgagttcacgca

SEQ ID NO: 6921894 - DNA, 22 bp, Homo sapiens
tatccatctatgtgtgtctgtg

SEQ ID NO: 6921895 - DNA, 22 bp, Homo sapiens
cagccccacacggtctagctct

SEQ ID NO: 6921896 - DNA, 22 bp, Homo sapiens
ttctgcaggagccctagtgtat

SEQ ID NO: 6921897 - DNA, 22 bp, Homo sapiens
ttcagtaaggataataaacaga

SEQ ID NO: 6921898 - DNA, 19 bp, Homo sapiens
gttccaaaggccagacctt

SEQ ID NO: 6921899 - DNA, 22 bp, Homo sapiens
tacagaagcttttgaaaagatg

SEQ ID NO: 6921900 - DNA, 22 bp, Homo sapiens
tatttgctttggtcctccaagc

SEQ ID NO: 6921901 - DNA, 22 bp, Homo sapiens
tggtgcaagtctctgaggaggg

SEQ ID NO: 6921902 - DNA, 22 bp, Homo sapiens
tcctggctctgctgcctcctag

SEQ ID NO: 6921903 - DNA, 22 bp, Homo sapiens
actccagatgataagggacagt

SEQ ID NO: 6921904 - DNA, 22 bp, Homo sapiens
gtgtggggctcagtgggaatgt

SEQ ID NO: 6921905 - DNA, 22 bp, Homo sapiens
tagcagctgtggaggggctgtg

SEQ ID NO: 6921906 - DNA, 20 bp, Homo sapiens
tgctgctgcttcacccccat

SEQ ID NO: 6921907 - DNA, 22 bp, Homo sapiens
agtgatgttgctctctttttct

SEQ ID NO: 6921908 - DNA, 22 bp, Homo sapiens
tgaagcagggtggccagattgt

SEQ ID NO: 6921909 - DNA, 22 bp, Homo sapiens
ggtctcctgggttgaccagctg

SEQ ID NO: 6921910 - DNA, 22 bp, Homo sapiens
tgggacacattagtcaccttac

SEQ ID NO: 6921911 - DNA, 22 bp, Homo sapiens
actgaacagaccattttgtcct

SEQ ID NO: 6921912 - DNA, 22 bp, Homo sapiens
ggaggccaattttctaactgca

SEQ ID NO: 6921913 - DNA, 22 bp, Homo sapiens
tggggtcagcaggcctggcctg

SEQ ID NO: 6921914 - DNA, 22 bp, Homo sapiens
tcagaggctcatctgccttgca

SEQ ID NO: 6921915 - DNA, 22 bp, Homo sapiens
tactggatgtaaatctggaagc

SEQ ID NO: 6921916 - DNA, 22 bp, Homo sapiens
agtttcccaagcagatatcatc

SEQ ID NO: 6921917 - DNA, 21 bp, Homo sapiens
cagcaggtggagcctcttgtc

SEQ ID NO: 6921918 - DNA, 19 bp, Homo sapiens
gtcaggcacgtgagagcat

SEQ ID NO: 6921919 - DNA, 22 bp, Homo sapiens
ggacatggagctccatggaggc

SEQ ID NO: 6921920 - DNA, 22 bp, Homo sapiens
tgaggtagctgctatttgtagt

SEQ ID NO: 6921921 - DNA, 22 bp, Homo sapiens
attcagcattcattatgcgcca

SEQ ID NO: 6921922 - DNA, 22 bp, Homo sapiens
ctggttttaagctgtcagagag

SEQ ID NO: 6921923 - DNA, 22 bp, Homo sapiens
tagtatctattagtaacaagag

SEQ ID NO: 6921924 - DNA, 22 bp, Homo sapiens
tggcaagttcatatggtttaag

SEQ ID NO: 6921925 - DNA, 22 bp, Homo sapiens
agactctgataagcaactcttg

SEQ ID NO: 6921926 - DNA, 22 bp, Homo sapiens
tcatacataaataagagtttag

SEQ ID NO: 6921927 - DNA, 19 bp, Homo sapiens
catttagaagtacatatta

SEQ ID NO: 6921928 - DNA, 22 bp, Homo sapiens
atgctgaagtgtgtttgaagta

SEQ ID NO: 6921929 - DNA, 22 bp, Homo sapiens
ttggaatttagtaaaataatgc

SEQ ID NO: 6921930 - DNA, 18 bp, Homo sapiens
actgcctggcgaagatag

SEQ ID NO: 6921931 - DNA, 22 bp, Homo sapiens
agcagcttagggaattctccct

SEQ ID NO: 6921932 - DNA, 22 bp, Homo sapiens
tgcctgggctcggtagccatcg

SEQ ID NO: 6921933 - DNA, 22 bp, Homo sapiens
agctgtggttctgggcagcgac

SEQ ID NO: 6921934 - DNA, 22 bp, Homo sapiens
gatttccttgcatattggtaat

SEQ ID NO: 6921935 - DNA, 22 bp, Homo sapiens
atgctaaactatgatcattttc

SEQ ID NO: 6921936 - DNA, 22 bp, Homo sapiens
ccttttgctctcccatccagaa

SEQ ID NO: 6921937 - DNA, 22 bp, Homo sapiens
tggcattttagacatgatggtg

SEQ ID NO: 6921938 - DNA, 18 bp, Homo sapiens
ggctgatccaggcagccc

SEQ ID NO: 6921939 - DNA, 22 bp, Homo sapiens
cccaggctggggctcctccagc

SEQ ID NO: 6921940 - DNA, 22 bp, Homo sapiens
tgatcagtgttggttctatcta

SEQ ID NO: 6921941 - DNA, 22 bp, Homo sapiens
ttgtatgaggatagcaagaagc

SEQ ID NO: 6921942 - DNA, 20 bp, Homo sapiens
agggcagcttgaggagccgg

SEQ ID NO: 6921943 - DNA, 22 bp, Homo sapiens
cgtgctaacgtttaaggttatg

SEQ ID NO: 6921944 - DNA, 22 bp, Homo sapiens
tccacgccaaaatttgtagctt

SEQ ID NO: 6921945 - DNA, 20 bp, Homo sapiens
atgggctggttaggaagtgt

SEQ ID NO: 6921946 - DNA, 22 bp, Homo sapiens
aggagccacctaggagctgttt

SEQ ID NO: 6921947 - DNA, 22 bp, Homo sapiens
aatagcagtttttcactgatat

SEQ ID NO: 6921948 - DNA, 22 bp, Homo sapiens
aacagatttaagaagccaaggt

SEQ ID NO: 6921949 - DNA, 22 bp, Homo sapiens
gttttttcatgagtagttatct

SEQ ID NO: 6921950 - DNA, 22 bp, Homo sapiens
accagctctggacaggcatttc

SEQ ID NO: 6921951 - DNA, 22 bp, Homo sapiens
gagcagcagttgttacaatgat

SEQ ID NO: 6921952 - DNA, 22 bp, Homo sapiens
gttcaaattctatgaaatatgt

SEQ ID NO: 6921953 - DNA, 22 bp, Homo sapiens
aatgatacaaagggttttattt

SEQ ID NO: 6921954 - DNA, 22 bp, Homo sapiens
tctttaatataaaggaatgaat

SEQ ID NO: 6921955 - DNA, 22 bp, Homo sapiens
gtcaataattgatagatattgg

SEQ ID NO: 6921956 - DNA, 22 bp, Homo sapiens
gagtgacggctcatctctggaa

SEQ ID NO: 6921957 - DNA, 22 bp, Homo sapiens
taaaaggcacttggatgctgag

SEQ ID NO: 6921958 - DNA, 22 bp, Homo sapiens
agccacatttttctgctcctga

SEQ ID NO: 6921959 - DNA, 22 bp, Homo sapiens
ggccatgctgttgcctgctggt

SEQ ID NO: 6921960 - DNA, 22 bp, Homo sapiens
aagtctaggacaggaagtctat

SEQ ID NO: 6921961 - DNA, 22 bp, Homo sapiens
cttccttggcttctggggtgtg

SEQ ID NO: 6921962 - DNA, 22 bp, Homo sapiens
ggcgcaggccttggatcctggt

SEQ ID NO: 6921963 - DNA, 22 bp, Homo sapiens
gattttcatttgcactctagaa

SEQ ID NO: 6921964 - DNA, 22 bp, Homo sapiens
atgcttggatgctgccatggga

SEQ ID NO: 6921965 - DNA, 22 bp, Homo sapiens
ttccaaggctaggttgtaaagg

SEQ ID NO: 6921966 - DNA, 22 bp, Homo sapiens
gctgcactttgactgctggggt

SEQ ID NO: 6921967 - DNA, 22 bp, Homo sapiens
acatgcataaactacttcttat

SEQ ID NO: 6921968 - DNA, 22 bp, Homo sapiens
tgtcatcagggtgcaagagtta

SEQ ID NO: 6921969 - DNA, 22 bp, Homo sapiens
ttcctggcctctctctgagcag

SEQ ID NO: 6921970 - DNA, 22 bp, Homo sapiens
cactggtatttgaaaatagatg

SEQ ID NO: 6921971 - DNA, 22 bp, Homo sapiens
taagttgattataaccactgga

SEQ ID NO: 6921972 - DNA, 22 bp, Homo sapiens
caggaaaatggaatcacctgta

SEQ ID NO: 6921973 - DNA, 21 bp, Homo sapiens
attagcttcaaaagcttgtct

SEQ ID NO: 6921974 - DNA, 22 bp, Homo sapiens
tactaggcaattatgtaaataa

SEQ ID NO: 6921975 - DNA, 22 bp, Homo sapiens
gtttcactgcaaactgactttt

SEQ ID NO: 6921976 - DNA, 22 bp, Homo sapiens
gcagaggctccattttacagat

SEQ ID NO: 6921977 - DNA, 22 bp, Homo sapiens
tgaagccctgtgataggtccag

SEQ ID NO: 6921978 - DNA, 22 bp, Homo sapiens
atagaatatgacttttagatcc

SEQ ID NO: 6921979 - DNA, 22 bp, Homo sapiens
gagctaagtttctggaggcaga

SEQ ID NO: 6921980 - DNA, 22 bp, Homo sapiens
ccagggcttcagttagtggtga

SEQ ID NO: 6921981 - DNA, 21 bp, Homo sapiens
gcatcgaggagcttcctgatg

SEQ ID NO: 6921982 - DNA, 22 bp, Homo sapiens
gggatctgggcctcacacacat

SEQ ID NO: 6921983 - DNA, 22 bp, Homo sapiens
tctgcctggatgatggcagggc

SEQ ID NO: 6921984 - DNA, 22 bp, Homo sapiens
tcaactgatttagtctgtgcca

SEQ ID NO: 6921985 - DNA, 22 bp, Homo sapiens
agatggtaggtggcaggactga

SEQ ID NO: 6921986 - DNA, 22 bp, Homo sapiens
acattagataactcagaaagga

SEQ ID NO: 6921987 - DNA, 22 bp, Homo sapiens
gacttaatttccactttctgct

SEQ ID NO: 6921988 - DNA, 22 bp, Homo sapiens
agactttataaatcttaatttc

SEQ ID NO: 6921989 - DNA, 17 bp, Homo sapiens
tgagcagtagaagatgc

SEQ ID NO: 6921990 - DNA, 22 bp, Homo sapiens
gagctgggtatatggctttatg

SEQ ID NO: 6921991 - DNA, 22 bp, Homo sapiens
tggtgtctccatcctgccctgc

SEQ ID NO: 6921992 - DNA, 21 bp, Homo sapiens
tttggtgctggaaatgccatt

SEQ ID NO: 6921993 - DNA, 22 bp, Homo sapiens
tagatagattctcctatagagt

SEQ ID NO: 6921994 - DNA, 21 bp, Homo sapiens
gggagctgacagcagcacggc

SEQ ID NO: 6921995 - DNA, 22 bp, Homo sapiens
tgctcctggcatctctgcgtcc

SEQ ID NO: 6921996 - DNA, 22 bp, Homo sapiens
ttgggctggcagaggtggtctt

SEQ ID NO: 6921997 - DNA, 22 bp, Homo sapiens
gaggccaggacatgaaagctga

SEQ ID NO: 6921998 - DNA, 22 bp, Homo sapiens
aggagcaaatgatgagacagca

SEQ ID NO: 6921999 - DNA, 22 bp, Homo sapiens
gtcctcaggaaggctttctgac

SEQ ID NO: 6922000 - DNA, 22 bp, Homo sapiens
gacaggtaaagtactgggtttt

SEQ ID NO: 6922001 - DNA, 18 bp, Homo sapiens
cctccaagtccccagcct

SEQ ID NO: 6922002 - DNA, 22 bp, Homo sapiens
tggttaaatgggaagagcaaca

SEQ ID NO: 6922003 - DNA, 22 bp, Homo sapiens
tgacccaggtgagctgtgacca

SEQ ID NO: 6922004 - DNA, 22 bp, Homo sapiens
ccagcaagccaggtctgtggct

SEQ ID NO: 6922005 - DNA, 22 bp, Homo sapiens
cagtcccatctcccaggtggct

SEQ ID NO: 6922006 - DNA, 22 bp, Homo sapiens
attattgccagctattacaaca

SEQ ID NO: 6922007 - DNA, 22 bp, Homo sapiens
tgccaggctgaacagggtctta

SEQ ID NO: 6922008 - DNA, 22 bp, Homo sapiens
ggatattctttatagatacagt

SEQ ID NO: 6922009 - DNA, 17 bp, Homo sapiens
atgtatattaactctga

SEQ ID NO: 6922010 - DNA, 22 bp, Homo sapiens
catgcaatcagaatctttaagg

SEQ ID NO: 6922011 - DNA, 22 bp, Homo sapiens
ctgcatgttttcttaattgtga

SEQ ID NO: 6922012 - DNA, 22 bp, Homo sapiens
tatagatcatagaaggtggtac

SEQ ID NO: 6922013 - DNA, 22 bp, Homo sapiens
atgccacttcattccagcctcg

SEQ ID NO: 6922014 - DNA, 22 bp, Homo sapiens
tgctggcctggttagaaagggg

SEQ ID NO: 6922015 - DNA, 22 bp, Homo sapiens
gaagcagtatcctgacagcacc

SEQ ID NO: 6922016 - DNA, 22 bp, Homo sapiens
gttctctgccggcacctacccg

SEQ ID NO: 6922017 - DNA, 22 bp, Homo sapiens
gcaaagcatcagtagaaatgtt

SEQ ID NO: 6922018 - DNA, 22 bp, Homo sapiens
cacagtgacagctatacagaga

SEQ ID NO: 6922019 - DNA, 18 bp, Homo sapiens
tgaatgttttctggaccc

SEQ ID NO: 6922020 - DNA, 22 bp, Homo sapiens
cagtttcttggatgccaatttc

SEQ ID NO: 6922021 - DNA, 22 bp, Homo sapiens
atgtgatcaagaatgtgggaga

SEQ ID NO: 6922022 - DNA, 23 bp, Homo sapiens
ttgcagaagcagacgaccataat

SEQ ID NO: 6922023 - DNA, 22 bp, Homo sapiens
ctatttgagaggtgaaggaatt

SEQ ID NO: 6922024 - DNA, 22 bp, Homo sapiens
agaaagggctattttgaggtag

SEQ ID NO: 6922025 - DNA, 22 bp, Homo sapiens
agagggaaaaactcatgtcatt

SEQ ID NO: 6922026 - DNA, 22 bp, Homo sapiens
tacatctttgtctatgaccagc

SEQ ID NO: 6922027 - DNA, 22 bp, Homo sapiens
tcctgggattaaggtggtgatt

SEQ ID NO: 6922028 - DNA, 21 bp, Homo sapiens
tatgagaaaactgaggtgcat

SEQ ID NO: 6922029 - DNA, 22 bp, Homo sapiens
tggcttcttactagggctcagt

SEQ ID NO: 6922030 - DNA, 22 bp, Homo sapiens
ctgagcccttgcttatgcttcc

SEQ ID NO: 6922031 - DNA, 18 bp, Homo sapiens
tccatgcacatagccccc

SEQ ID NO: 6922032 - DNA, 22 bp, Homo sapiens
gtatacaactattgttgggtaa

SEQ ID NO: 6922033 - DNA, 22 bp, Homo sapiens
tctttgaaaagatattcctcct

SEQ ID NO: 6922034 - DNA, 22 bp, Homo sapiens
gtggaaggaattaacagactag

SEQ ID NO: 6922035 - DNA, 22 bp, Homo sapiens
aagcagggctccctggggactc

SEQ ID NO: 6922036 - DNA, 22 bp, Homo sapiens
agttctggttgcccatgacatc

SEQ ID NO: 6922037 - DNA, 23 bp, Homo sapiens
cccattttcatgttaactcctgg

SEQ ID NO: 6922038 - DNA, 22 bp, Homo sapiens
catcaaatactacatgggttgg

SEQ ID NO: 6922039 - DNA, 22 bp, Homo sapiens
tagactatagctcacagtgctt

SEQ ID NO: 6922040 - DNA, 20 bp, Homo sapiens
gaagcagcttcatgtagaca

SEQ ID NO: 6922041 - DNA, 22 bp, Homo sapiens
aaatagctctggtcctcaccca

SEQ ID NO: 6922042 - DNA, 22 bp, Homo sapiens
tttgactcctgccttctcctgt

SEQ ID NO: 6922043 - DNA, 22 bp, Homo sapiens
cacagcagaaagtgtaggagga

SEQ ID NO: 6922044 - DNA, 20 bp, Homo sapiens
aggctcagagcagtagtaca

SEQ ID NO: 6922045 - DNA, 22 bp, Homo sapiens
tgcttctttatgatgtatgatt

SEQ ID NO: 6922046 - DNA, 22 bp, Homo sapiens
aagcagctggaagagtaagatg

SEQ ID NO: 6922047 - DNA, 22 bp, Homo sapiens
gtattttacttacgcatgactt

SEQ ID NO: 6922048 - DNA, 22 bp, Homo sapiens
ctttatgaaggaacaatgctcc

SEQ ID NO: 6922049 - DNA, 22 bp, Homo sapiens
ccaggcagagtgctccagaaag

SEQ ID NO: 6922050 - DNA, 22 bp, Homo sapiens
agattccttgagcaggttacaa

SEQ ID NO: 6922051 - DNA, 22 bp, Homo sapiens
gagagtccttagtttgcaggta

SEQ ID NO: 6922052 - DNA, 22 bp, Homo sapiens
actgcttacaaaaggaaagaat

SEQ ID NO: 6922053 - DNA, 22 bp, Homo sapiens
attgtccatctccacattaatg

SEQ ID NO: 6922054 - DNA, 22 bp, Homo sapiens
atttcatgtgaagaagagataa

SEQ ID NO: 6922055 - DNA, 22 bp, Homo sapiens
tagcagtctggtgggcagattc

SEQ ID NO: 6922056 - DNA, 22 bp, Homo sapiens
tccttggtgcaaatgatttaat

SEQ ID NO: 6922057 - DNA, 19 bp, Homo sapiens
acatttgtcaagagaaggt

SEQ ID NO: 6922058 - DNA, 22 bp, Homo sapiens
gaaggcatttcagagatctctg

SEQ ID NO: 6922059 - DNA, 22 bp, Homo sapiens
actctgtagcctgtaagagagc

SEQ ID NO: 6922060 - DNA, 22 bp, Homo sapiens
tgctgcctcaactgtcaggaac

SEQ ID NO: 6922061 - DNA, 18 bp, Homo sapiens
tggagagcagcagtgggg

SEQ ID NO: 6922062 - DNA, 22 bp, Homo sapiens
agttccctccacaacttctcac

SEQ ID NO: 6922063 - DNA, 22 bp, Homo sapiens
tttagggtgatgtatgtgcagc

SEQ ID NO: 6922064 - DNA, 22 bp, Homo sapiens
atgagagccaccatgcttctgt

SEQ ID NO: 6922065 - DNA, 22 bp, Homo sapiens
agctttatcacaatattggcta

SEQ ID NO: 6922066 - DNA, 17 bp, Homo sapiens
tggggaagctcagattt

SEQ ID NO: 6922067 - DNA, 22 bp, Homo sapiens
cacagattatgagacgagatac

SEQ ID NO: 6922068 - DNA, 21 bp, Homo sapiens
ggagatgttgtgcaggagggt

SEQ ID NO: 6922069 - DNA, 22 bp, Homo sapiens
ggtgggcagctcttggcaggca

SEQ ID NO: 6922070 - DNA, 22 bp, Homo sapiens
cctgctggctggtagagttccg

SEQ ID NO: 6922071 - DNA, 22 bp, Homo sapiens
tcagctgcactgttctgaccca

SEQ ID NO: 6922072 - DNA, 22 bp, Homo sapiens
agccaaggactcagtggtaggc

SEQ ID NO: 6922073 - DNA, 22 bp, Homo sapiens
ttctggaagtgttagaatctgg

SEQ ID NO: 6922074 - DNA, 22 bp, Homo sapiens
ctccaggctggatccaagtcaa

SEQ ID NO: 6922075 - DNA, 22 bp, Homo sapiens
aaagaatcacatccttcagcaa

SEQ ID NO: 6922076 - DNA, 22 bp, Homo sapiens
taattgaactaacatgcaaaca

SEQ ID NO: 6922077 - DNA, 22 bp, Homo sapiens
aggagactgtgaattgactgtc

SEQ ID NO: 6922078 - DNA, 22 bp, Homo sapiens
atcagcaagatgtaatttctat

SEQ ID NO: 6922079 - DNA, 22 bp, Homo sapiens
tagcccatatggtgcctttgtg

SEQ ID NO: 6922080 - DNA, 20 bp, Homo sapiens
agtgtacagacactagaaat

SEQ ID NO: 6922081 - DNA, 22 bp, Homo sapiens
agatggggtttcatcatgttgg

SEQ ID NO: 6922082 - DNA, 22 bp, Homo sapiens
agaacaattgccccaaagcttg

SEQ ID NO: 6922083 - DNA, 22 bp, Homo sapiens
tagggcctgacattcagtaggt

SEQ ID NO: 6922084 - DNA, 22 bp, Homo sapiens
tcttccttcgcccttgctgttt

SEQ ID NO: 6922085 - DNA, 22 bp, Homo sapiens
gtggtgtttgagctgccaggga

SEQ ID NO: 6922086 - DNA, 22 bp, Homo sapiens
ttgcccaggctggagtgcagtg

SEQ ID NO: 6922087 - DNA, 22 bp, Homo sapiens
atgtctgagtctgctccagttg

SEQ ID NO: 6922088 - DNA, 22 bp, Homo sapiens
aggaagcatgttggatccactt

SEQ ID NO: 6922089 - DNA, 22 bp, Homo sapiens
atgtaatttatgttatccataa

SEQ ID NO: 6922090 - DNA, 22 bp, Homo sapiens
cactctgctgaaatcgccttgt

SEQ ID NO: 6922091 - DNA, 22 bp, Homo sapiens
ttctgagccagagtcagttatg

SEQ ID NO: 6922092 - DNA, 22 bp, Homo sapiens
ttgtttaatatcgtgaagtact

SEQ ID NO: 6922093 - DNA, 20 bp, Homo sapiens
taacagggccctagaaagag

SEQ ID NO: 6922094 - DNA, 22 bp, Homo sapiens
cagtggcaagtccggtattgaa

SEQ ID NO: 6922095 - DNA, 22 bp, Homo sapiens
aaatggtaaattagtagtagct

SEQ ID NO: 6922096 - DNA, 22 bp, Homo sapiens
acatgaatgaagactttacaat

SEQ ID NO: 6922097 - DNA, 19 bp, Homo sapiens
cttatgcagctgagcttgg

SEQ ID NO: 6922098 - DNA, 22 bp, Homo sapiens
attgtctttaacctctgagggg

SEQ ID NO: 6922099 - DNA, 22 bp, Homo sapiens
cagtacacaagctttcatgtat

SEQ ID NO: 6922100 - DNA, 22 bp, Homo sapiens
agaaatgtcaggaaagaagtcc

SEQ ID NO: 6922101 - DNA, 22 bp, Homo sapiens
tcctccagtggcccagtccttc

SEQ ID NO: 6922102 - DNA, 16 bp, Homo sapiens
ccaggtggggctgtga

SEQ ID NO: 6922103 - DNA, 22 bp, Homo sapiens
actggcttgaagtagattcaaa

SEQ ID NO: 6922104 - DNA, 22 bp, Homo sapiens
tagcaaaggccttggacacgct

SEQ ID NO: 6922105 - DNA, 21 bp, Homo sapiens
tcacatgcttattcctggaat

SEQ ID NO: 6922106 - DNA, 22 bp, Homo sapiens
atacagcctattcttaccattg

SEQ ID NO: 6922107 - DNA, 22 bp, Homo sapiens
actgcttacccggcctgacttc

SEQ ID NO: 6922108 - DNA, 22 bp, Homo sapiens
ctttctctgtgtggtaaagggc

SEQ ID NO: 6922109 - DNA, 22 bp, Homo sapiens
agtaagtacctccacttgattg

SEQ ID NO: 6922110 - DNA, 22 bp, Homo sapiens
acagcagagtggagatgagcac

SEQ ID NO: 6922111 - DNA, 22 bp, Homo sapiens
ctaaaaactctacgatgcacag

SEQ ID NO: 6922112 - DNA, 22 bp, Homo sapiens
aagagctggattgtgctgcaga

SEQ ID NO: 6922113 - DNA, 22 bp, Homo sapiens
gccgaagctgccgtctggtcct

SEQ ID NO: 6922114 - DNA, 19 bp, Homo sapiens
tcacagacagagcaatcac

SEQ ID NO: 6922115 - DNA, 22 bp, Homo sapiens
aattactgtaattttctacagc

SEQ ID NO: 6922116 - DNA, 22 bp, Homo sapiens
aattgtctttatcacagttcaa

SEQ ID NO: 6922117 - DNA, 21 bp, Homo sapiens
atcagcatcacgtcagtgtcc

SEQ ID NO: 6922118 - DNA, 22 bp, Homo sapiens
acagatttttggtaaataattt

SEQ ID NO: 6922119 - DNA, 22 bp, Homo sapiens
tttcttgactgcttaggaatgc

SEQ ID NO: 6922120 - DNA, 22 bp, Homo sapiens
cccgtttgcctctttatttact

SEQ ID NO: 6922121 - DNA, 22 bp, Homo sapiens
gtgacatggtttgccgtccctg

SEQ ID NO: 6922122 - DNA, 22 bp, Homo sapiens
tgcaaatcatcctggattagag

SEQ ID NO: 6922123 - DNA, 22 bp, Homo sapiens
tgcaccttttagaagtcatttt

SEQ ID NO: 6922124 - DNA, 22 bp, Homo sapiens
tggggaaaacagaggaaattag

SEQ ID NO: 6922125 - DNA, 20 bp, Homo sapiens
ctgagcccagatcccaggtc

SEQ ID NO: 6922126 - DNA, 22 bp, Homo sapiens
tgggatagaaatttagaacaag

SEQ ID NO: 6922127 - DNA, 22 bp, Homo sapiens
gcaggtggatcaccacgtcagg

SEQ ID NO: 6922128 - DNA, 22 bp, Homo sapiens
agtagttgctggtgtcctttat

SEQ ID NO: 6922129 - DNA, 22 bp, Homo sapiens
ggctcgtgtccagtatagaaag

SEQ ID NO: 6922130 - DNA, 22 bp, Homo sapiens
taacctggggcctgaagaccat

SEQ ID NO: 6922131 - DNA, 22 bp, Homo sapiens
gaaatctcgccaagcacctggg

SEQ ID NO: 6922132 - DNA, 22 bp, Homo sapiens
ggaagctggcatatgtaatcct

SEQ ID NO: 6922133 - DNA, 19 bp, Homo sapiens
agtctgtctgctttccctc

SEQ ID NO: 6922134 - DNA, 22 bp, Homo sapiens
accattgcactctagcctgggc

SEQ ID NO: 6922135 - DNA, 22 bp, Homo sapiens
tctgagtggactgtcctgcagg

SEQ ID NO: 6922136 - DNA, 22 bp, Homo sapiens
tacaattctttgtaaggtggtc

SEQ ID NO: 6922137 - DNA, 22 bp, Homo sapiens
tgttcctgacggccaaagaggt

SEQ ID NO: 6922138 - DNA, 22 bp, Homo sapiens
ttcaactaatgtttattttatg

SEQ ID NO: 6922139 - DNA, 22 bp, Homo sapiens
caccccccaattctgccagctg

SEQ ID NO: 6922140 - DNA, 22 bp, Homo sapiens
ccagcccttgagatggaaggga

SEQ ID NO: 6922141 - DNA, 22 bp, Homo sapiens
gaggtcatcaccaatatatgcc

SEQ ID NO: 6922142 - DNA, 22 bp, Homo sapiens
tgcttgaacccaggaagtggag

SEQ ID NO: 6922143 - DNA, 22 bp, Homo sapiens
tctgggaacgaaggctaatatg

SEQ ID NO: 6922144 - DNA, 22 bp, Homo sapiens
gaaataacctcatgcaccatga

SEQ ID NO: 6922145 - DNA, 22 bp, Homo sapiens
aatggagatgtctagagggtgc

SEQ ID NO: 6922146 - DNA, 20 bp, Homo sapiens
ggcatgagatgtgagggagg

SEQ ID NO: 6922147 - DNA, 22 bp, Homo sapiens
tcttgagtgcgcttgggtgttc

SEQ ID NO: 6922148 - DNA, 22 bp, Homo sapiens
gtggaagggtcacagcccctac

SEQ ID NO: 6922149 - DNA, 16 bp, Homo sapiens
ggttaccataaccgcc

SEQ ID NO: 6922150 - DNA, 22 bp, Homo sapiens
tgccctcccacattatggctgt

SEQ ID NO: 6922151 - DNA, 22 bp, Homo sapiens
tgccaggccctgcggggtccca

SEQ ID NO: 6922152 - DNA, 22 bp, Homo sapiens
cagaagtaatgatgtcattcct

SEQ ID NO: 6922153 - DNA, 17 bp, Homo sapiens
gtcagtctcccactgcc

SEQ ID NO: 6922154 - DNA, 22 bp, Homo sapiens
gctgcccattccactggatggt

SEQ ID NO: 6922155 - DNA, 22 bp, Homo sapiens
gatgcagggaacttagtgggct

SEQ ID NO: 6922156 - DNA, 22 bp, Homo sapiens
tggctggctagtgggcaggatt

SEQ ID NO: 6922157 - DNA, 22 bp, Homo sapiens
gtatctttatccctcgttggag

SEQ ID NO: 6922158 - DNA, 21 bp, Homo sapiens
gtcctcagctgatgggagctg

SEQ ID NO: 6922159 - DNA, 22 bp, Homo sapiens
ggccaaggatggtggctctggt

SEQ ID NO: 6922160 - DNA, 22 bp, Homo sapiens
caaggtttactttatgatccag

SEQ ID NO: 6922161 - DNA, 18 bp, Homo sapiens
atggcagatgataagtgc

SEQ ID NO: 6922162 - DNA, 22 bp, Homo sapiens
acaggactctctgaaaatgtac

SEQ ID NO: 6922163 - DNA, 22 bp, Homo sapiens
tctcattggtatatacatgtgt

SEQ ID NO: 6922164 - DNA, 22 bp, Homo sapiens
aaggcccttggaaaatgcagta

SEQ ID NO: 6922165 - DNA, 22 bp, Homo sapiens
ccagtctgtactttgctctgtt

SEQ ID NO: 6922166 - DNA, 22 bp, Homo sapiens
tgctgtgctccattgtcttcac

SEQ ID NO: 6922167 - DNA, 22 bp, Homo sapiens
ggagggctgagactggggtctg

SEQ ID NO: 6922168 - DNA, 22 bp, Homo sapiens
ctcagacatttgtagaaagtgc

SEQ ID NO: 6922169 - DNA, 22 bp, Homo sapiens
tctcctggctcaccaggctgga

SEQ ID NO: 6922170 - DNA, 22 bp, Homo sapiens
atctgagtctctgacagcatgt

SEQ ID NO: 6922171 - DNA, 22 bp, Homo sapiens
ccaggactttaagtccagcact

SEQ ID NO: 6922172 - DNA, 22 bp, Homo sapiens
gacaggtgggtacctttatgga

SEQ ID NO: 6922173 - DNA, 18 bp, Homo sapiens
acctgctgagtctaagca

SEQ ID NO: 6922174 - DNA, 23 bp, Homo sapiens
agcaccattacagtttgattggg

SEQ ID NO: 6922175 - DNA, 22 bp, Homo sapiens
atgtgactccacagctgtgctg

SEQ ID NO: 6922176 - DNA, 22 bp, Homo sapiens
tgtggccactgtttcttttcct

SEQ ID NO: 6922177 - DNA, 22 bp, Homo sapiens
aaagctttgcatattcggcccg

SEQ ID NO: 6922178 - DNA, 22 bp, Homo sapiens
cactttggggtatgacaagttt

SEQ ID NO: 6922179 - DNA, 22 bp, Homo sapiens
tcagtagtgttagcaatgttaa

SEQ ID NO: 6922180 - DNA, 22 bp, Homo sapiens
ccaggagtctggatgaggtgtc

SEQ ID NO: 6922181 - DNA, 22 bp, Homo sapiens
gcgctctcttctcctggcccgc

SEQ ID NO: 6922182 - DNA, 22 bp, Homo sapiens
tttgagcagagaaaggacatga

SEQ ID NO: 6922183 - DNA, 22 bp, Homo sapiens
cttggcatgttcatctgcttgg

SEQ ID NO: 6922184 - DNA, 22 bp, Homo sapiens
agcagagcagatagtattatct

SEQ ID NO: 6922185 - DNA, 22 bp, Homo sapiens
tcccacagcttcgtgcttcccc

SEQ ID NO: 6922186 - DNA, 22 bp, Homo sapiens
taggtttcagaggtgccgggaa

SEQ ID NO: 6922187 - DNA, 22 bp, Homo sapiens
gcaaatgatggcttgctggctg

SEQ ID NO: 6922188 - DNA, 22 bp, Homo sapiens
ctgggcgtgtcttccagctggc

SEQ ID NO: 6922189 - DNA, 22 bp, Homo sapiens
gccaggagaaaaggcgaatgat

SEQ ID NO: 6922190 - DNA, 22 bp, Homo sapiens
gacagctatgtcccaaaaactg

SEQ ID NO: 6922191 - DNA, 22 bp, Homo sapiens
tcttaaaggcatgttagggtcc

SEQ ID NO: 6922192 - DNA, 22 bp, Homo sapiens
ttactgttcctctctcaaagag

SEQ ID NO: 6922193 - DNA, 22 bp, Homo sapiens
gaacgggtgcagccatgggccc

SEQ ID NO: 6922194 - DNA, 22 bp, Homo sapiens
tggtggggtcatcgtcagatgc

SEQ ID NO: 6922195 - DNA, 22 bp, Homo sapiens
aagtcacagctaaatagctaag

SEQ ID NO: 6922196 - DNA, 22 bp, Homo sapiens
gtgctgagcacagctgcccagg

SEQ ID NO: 6922197 - DNA, 22 bp, Homo sapiens
caaggctgctggcttctgagct

SEQ ID NO: 6922198 - DNA, 22 bp, Homo sapiens
gctcagaggccactgttggaaa

SEQ ID NO: 6922199 - DNA, 22 bp, Homo sapiens
aggctctgaaggagaacctgtt

SEQ ID NO: 6922200 - DNA, 20 bp, Homo sapiens
gtatataaccatagtgacta

SEQ ID NO: 6922201 - DNA, 22 bp, Homo sapiens
tttgtagaataatatctttctg

SEQ ID NO: 6922202 - DNA, 22 bp, Homo sapiens
gcacaaggagcagtgtatgaaa

SEQ ID NO: 6922203 - DNA, 22 bp, Homo sapiens
cccacaggtggaagcctcggaa

SEQ ID NO: 6922204 - DNA, 22 bp, Homo sapiens
ctgggagagaagcgaagctggg

SEQ ID NO: 6922205 - DNA, 22 bp, Homo sapiens
gcctgtggttgctttgggatcc

SEQ ID NO: 6922206 - DNA, 22 bp, Homo sapiens
gaacagatgcctgattcatagg

SEQ ID NO: 6922207 - DNA, 22 bp, Homo sapiens
gagcttcagctgccatgactgt

SEQ ID NO: 6922208 - DNA, 22 bp, Homo sapiens
aggaattatagtagtatttgtc

SEQ ID NO: 6922209 - DNA, 17 bp, Homo sapiens
ctgcctggagtcccatc

SEQ ID NO: 6922210 - DNA, 22 bp, Homo sapiens
atcccattcccataagtggaaa

SEQ ID NO: 6922211 - DNA, 22 bp, Homo sapiens
gctgggacggctcagtaagaag

SEQ ID NO: 6922212 - DNA, 22 bp, Homo sapiens
cagaggacaatagaatggaaag

SEQ ID NO: 6922213 - DNA, 22 bp, Homo sapiens
atttatgtatctgtgtagatca

SEQ ID NO: 6922214 - DNA, 22 bp, Homo sapiens
tcagccatgtcaggggaatgac

SEQ ID NO: 6922215 - DNA, 22 bp, Homo sapiens
ggctgggttatttatggccaag

SEQ ID NO: 6922216 - DNA, 22 bp, Homo sapiens
tagggctcagagaagtggggcc

SEQ ID NO: 6922217 - DNA, 22 bp, Homo sapiens
cagttacagagccagttagaga

SEQ ID NO: 6922218 - DNA, 22 bp, Homo sapiens
gcagctggagaaataccaccct

SEQ ID NO: 6922219 - DNA, 22 bp, Homo sapiens
cttcaagatatttctagaatca

SEQ ID NO: 6922220 - DNA, 22 bp, Homo sapiens
tgcttcactggctccacatagg

SEQ ID NO: 6922221 - DNA, 22 bp, Homo sapiens
agctgagccagcagcaacagga

SEQ ID NO: 6922222 - DNA, 22 bp, Homo sapiens
ctgacagctctggctagtagaa

SEQ ID NO: 6922223 - DNA, 19 bp, Homo sapiens
gctggcagatgtggccgtg

SEQ ID NO: 6922224 - DNA, 22 bp, Homo sapiens
aatgttgagaaatgactactct

SEQ ID NO: 6922225 - DNA, 22 bp, Homo sapiens
caaagctgtaccccaacctatg

SEQ ID NO: 6922226 - DNA, 22 bp, Homo sapiens
gaagaaatgtgttcaaggtagg

SEQ ID NO: 6922227 - DNA, 22 bp, Homo sapiens
tgctgtttcacctcccagcgat

SEQ ID NO: 6922228 - DNA, 22 bp, Homo sapiens
ccagaggtcctgtgatgctgca

SEQ ID NO: 6922229 - DNA, 22 bp, Homo sapiens
gtgcatttcaaggcacagctaa

SEQ ID NO: 6922230 - DNA, 22 bp, Homo sapiens
gctcttgaaaatcaaaagggaa

SEQ ID NO: 6922231 - DNA, 22 bp, Homo sapiens
gacattcaggtgttcaatgcca

SEQ ID NO: 6922232 - DNA, 22 bp, Homo sapiens
aatagtgaacaggaacatgctt

SEQ ID NO: 6922233 - DNA, 22 bp, Homo sapiens
aggcacttctcaaattcatgcc

SEQ ID NO: 6922234 - DNA, 22 bp, Homo sapiens
ggaaggggtcacctcctgatga

SEQ ID NO: 6922235 - DNA, 22 bp, Homo sapiens
acagactggcctgtctcgcacc

SEQ ID NO: 6922236 - DNA, 22 bp, Homo sapiens
tctctttaagtataatcttata

SEQ ID NO: 6922237 - DNA, 18 bp, Homo sapiens
cttcttgtttgatttggg

SEQ ID NO: 6922238 - DNA, 22 bp, Homo sapiens
tgaaatgtttgtatataaggtc

SEQ ID NO: 6922239 - DNA, 22 bp, Homo sapiens
tccaggagtctagcctcaggcc

SEQ ID NO: 6922240 - DNA, 23 bp, Homo sapiens
tcagtttgtataatccatatgca

SEQ ID NO: 6922241 - DNA, 22 bp, Homo sapiens
ggtagcacattgcattaggaga

SEQ ID NO: 6922242 - DNA, 22 bp, Homo sapiens
tggaatggggactttgggacat

SEQ ID NO: 6922243 - DNA, 22 bp, Homo sapiens
atgattccttgaagcctcatga

SEQ ID NO: 6922244 - DNA, 22 bp, Homo sapiens
acagtctacaaagtgatgtgtg

SEQ ID NO: 6922245 - DNA, 22 bp, Homo sapiens
aaatataccagttgcctgcatc

SEQ ID NO: 6922246 - DNA, 22 bp, Homo sapiens
atgccttattccaacaatctag

SEQ ID NO: 6922247 - DNA, 22 bp, Homo sapiens
aagttctaattttgcattcagg

SEQ ID NO: 6922248 - DNA, 22 bp, Homo sapiens
aatttaagaacatttcaggact

SEQ ID NO: 6922249 - DNA, 20 bp, Homo sapiens
tagtatttgcataaggatag

SEQ ID NO: 6922250 - DNA, 22 bp, Homo sapiens
tggtttcacggagtgccttgct

SEQ ID NO: 6922251 - DNA, 22 bp, Homo sapiens
ccagtgttttccagtttgccca

SEQ ID NO: 6922252 - DNA, 22 bp, Homo sapiens
cctctttgacaagtacctgccc

SEQ ID NO: 6922253 - DNA, 22 bp, Homo sapiens
cacaggaatataagtttgagtt

SEQ ID NO: 6922254 - DNA, 22 bp, Homo sapiens
agagcctgtacttttctgtgaa

SEQ ID NO: 6922255 - DNA, 22 bp, Homo sapiens
tatcaacgatagcctctgtcca

SEQ ID NO: 6922256 - DNA, 22 bp, Homo sapiens
ggtctgagtagagggctggcga

SEQ ID NO: 6922257 - DNA, 22 bp, Homo sapiens
ttcaagaaggtacatttacatc

SEQ ID NO: 6922258 - DNA, 22 bp, Homo sapiens
aagatacagtgaaagggcattg

SEQ ID NO: 6922259 - DNA, 18 bp, Homo sapiens
tccttcacagcaggaagg

SEQ ID NO: 6922260 - DNA, 22 bp, Homo sapiens
cacctactttgtgcagatttta

SEQ ID NO: 6922261 - DNA, 23 bp, Homo sapiens
tgagatctttgtagtatcaatga

SEQ ID NO: 6922262 - DNA, 22 bp, Homo sapiens
aatgtctacagcaaaccccaca

SEQ ID NO: 6922263 - DNA, 22 bp, Homo sapiens
aaaggcaagcatttatatagga

SEQ ID NO: 6922264 - DNA, 22 bp, Homo sapiens
acattcttaacagttaaaaact

SEQ ID NO: 6922265 - DNA, 22 bp, Homo sapiens
aaattacagatcaccaatgcat

SEQ ID NO: 6922266 - DNA, 20 bp, Homo sapiens
agaggctttcttgtagtcag

SEQ ID NO: 6922267 - DNA, 22 bp, Homo sapiens
caaagcaggaagctcctgacag

SEQ ID NO: 6922268 - DNA, 22 bp, Homo sapiens
gggaagcagatcataccagacc

SEQ ID NO: 6922269 - DNA, 22 bp, Homo sapiens
cagtccatatgccataattctt

SEQ ID NO: 6922270 - DNA, 22 bp, Homo sapiens
gtctgcctggaggcagctgctg

SEQ ID NO: 6922271 - DNA, 22 bp, Homo sapiens
atcttaagcttcatcaaccctg

SEQ ID NO: 6922272 - DNA, 22 bp, Homo sapiens
gtccagagtattcaagtaactt

SEQ ID NO: 6922273 - DNA, 22 bp, Homo sapiens
agcgagggaggtctgaggacag

SEQ ID NO: 6922274 - DNA, 22 bp, Homo sapiens
cctggcacagatccttcataca

SEQ ID NO: 6922275 - DNA, 22 bp, Homo sapiens
agccagccgggggaccacagtg

SEQ ID NO: 6922276 - DNA, 22 bp, Homo sapiens
agcatctgcatattgggagacc

SEQ ID NO: 6922277 - DNA, 22 bp, Homo sapiens
agtccataacttcagagtgtca

SEQ ID NO: 6922278 - DNA, 22 bp, Homo sapiens
aggaataacctcattgcttttt

SEQ ID NO: 6922279 - DNA, 21 bp, Homo sapiens
cagcaaatcattgggcagact

SEQ ID NO: 6922280 - DNA, 22 bp, Homo sapiens
tctagcagtagcccaaatccag

SEQ ID NO: 6922281 - DNA, 22 bp, Homo sapiens
cgagagttagctaggagtcaca

SEQ ID NO: 6922282 - DNA, 22 bp, Homo sapiens
ctgctgtcatagccatccctcc

SEQ ID NO: 6922283 - DNA, 20 bp, Homo sapiens
aggcaactcaagtttttgcc

SEQ ID NO: 6922284 - DNA, 22 bp, Homo sapiens
gagcacatgagaggaaatcaaa

SEQ ID NO: 6922285 - DNA, 21 bp, Homo sapiens
tcagcccaggtgtctttgccc

SEQ ID NO: 6922286 - DNA, 22 bp, Homo sapiens
aactttgcttttgtgggtaaag

SEQ ID NO: 6922287 - DNA, 22 bp, Homo sapiens
ctagagtgcaggtgtatggtta

SEQ ID NO: 6922288 - DNA, 22 bp, Homo sapiens
taatgcttaacagctggctttt

SEQ ID NO: 6922289 - DNA, 22 bp, Homo sapiens
tatttggaaatagggctttgta

SEQ ID NO: 6922290 - DNA, 22 bp, Homo sapiens
agacaggagagggaactgccgg

SEQ ID NO: 6922291 - DNA, 22 bp, Homo sapiens
acttggaatctgtttccctaga

SEQ ID NO: 6922292 - DNA, 22 bp, Homo sapiens
cttacttgaaattccaagcagg

SEQ ID NO: 6922293 - DNA, 20 bp, Homo sapiens
acgatgcaggggcttcacag

SEQ ID NO: 6922294 - DNA, 22 bp, Homo sapiens
actttcaaatatcatgattcta

SEQ ID NO: 6922295 - DNA, 22 bp, Homo sapiens
caagaaatctagaagtcagtgg

SEQ ID NO: 6922296 - DNA, 22 bp, Homo sapiens
tctctgtattctgatattcact

SEQ ID NO: 6922297 - DNA, 22 bp, Homo sapiens
taatccttcttgtgttcattag

SEQ ID NO: 6922298 - DNA, 22 bp, Homo sapiens
tctgggttcttcgattcttccc

SEQ ID NO: 6922299 - DNA, 20 bp, Homo sapiens
gggaagtcccgcctgtcttc

SEQ ID NO: 6922300 - DNA, 22 bp, Homo sapiens
acatgctcattaaatattagct

SEQ ID NO: 6922301 - DNA, 22 bp, Homo sapiens
tctggggttgagtctgggtcag

SEQ ID NO: 6922302 - DNA, 22 bp, Homo sapiens
tatgacagtttcgtaggggttg

SEQ ID NO: 6922303 - DNA, 22 bp, Homo sapiens
aggtcatgggctggagcactgc

SEQ ID NO: 6922304 - DNA, 22 bp, Homo sapiens
accatgttagttactgggaatg

SEQ ID NO: 6922305 - DNA, 22 bp, Homo sapiens
tggcattggaatttgtgttgca

SEQ ID NO: 6922306 - DNA, 22 bp, Homo sapiens
caggagatgacagggaagaacc

SEQ ID NO: 6922307 - DNA, 22 bp, Homo sapiens
tgttcccaagataagattatga

SEQ ID NO: 6922308 - DNA, 22 bp, Homo sapiens
tgtttcttatccaagtggtctg

SEQ ID NO: 6922309 - DNA, 22 bp, Homo sapiens
tggtgccaagtggtttttggct

SEQ ID NO: 6922310 - DNA, 22 bp, Homo sapiens
gatgtgtccccagaggattgaa

SEQ ID NO: 6922311 - DNA, 22 bp, Homo sapiens
tccaggagtcagacagatggtg

SEQ ID NO: 6922312 - DNA, 22 bp, Homo sapiens
aggaactccacggtcttgtcgg

SEQ ID NO: 6922313 - DNA, 22 bp, Homo sapiens
tggactggaatgctgatcctct

SEQ ID NO: 6922314 - DNA, 23 bp, Homo sapiens
agccatcatcctgctgctggggc

SEQ ID NO: 6922315 - DNA, 22 bp, Homo sapiens
caaagcagagccagagcttgtc

SEQ ID NO: 6922316 - DNA, 22 bp, Homo sapiens
gagatgagtgggggatctctca

SEQ ID NO: 6922317 - DNA, 22 bp, Homo sapiens
agtggcagagtgcactcaggca

SEQ ID NO: 6922318 - DNA, 22 bp, Homo sapiens
tggaggtctcctggtattgacc

SEQ ID NO: 6922319 - DNA, 22 bp, Homo sapiens
agttaccagcactctctccggc

SEQ ID NO: 6922320 - DNA, 22 bp, Homo sapiens
ttacagcttacattttaccttg

SEQ ID NO: 6922321 - DNA, 22 bp, Homo sapiens
atggccctggaaagagcttgag

SEQ ID NO: 6922322 - DNA, 22 bp, Homo sapiens
taactggtgagtaggatttata

SEQ ID NO: 6922323 - DNA, 22 bp, Homo sapiens
ctgtggaggtaggagcaggaca

SEQ ID NO: 6922324 - DNA, 22 bp, Homo sapiens
gagcaatggaagatagataaca

SEQ ID NO: 6922325 - DNA, 22 bp, Homo sapiens
gtggacgttaggattgtgtaga

SEQ ID NO: 6922326 - DNA, 22 bp, Homo sapiens
taggcaaggcatttggctcttg

SEQ ID NO: 6922327 - DNA, 18 bp, Homo sapiens
cgcatgtacacgtcatgc

SEQ ID NO: 6922328 - DNA, 22 bp, Homo sapiens
tttggggatgtctgagttgttg

SEQ ID NO: 6922329 - DNA, 22 bp, Homo sapiens
ggcagaggagctggaaacatgg

SEQ ID NO: 6922330 - DNA, 22 bp, Homo sapiens
acagtgatgagccggctgaggc

SEQ ID NO: 6922331 - DNA, 22 bp, Homo sapiens
aggcaagcccaggcacttggag

SEQ ID NO: 6922332 - DNA, 22 bp, Homo sapiens
tgaataatcatgtccatagtgt

SEQ ID NO: 6922333 - DNA, 22 bp, Homo sapiens
tgcctcgtgtctgagtctgttc

SEQ ID NO: 6922334 - DNA, 22 bp, Homo sapiens
ttttatctgtgacatctggcag

SEQ ID NO: 6922335 - DNA, 22 bp, Homo sapiens
tacaacaatttccacattagaa

SEQ ID NO: 6922336 - DNA, 22 bp, Homo sapiens
acgttagaaaagcaggagctca

SEQ ID NO: 6922337 - DNA, 22 bp, Homo sapiens
ctgcaggggtgtcctgtattgg

SEQ ID NO: 6922338 - DNA, 21 bp, Homo sapiens
aaagcagttcttcctgcctct

SEQ ID NO: 6922339 - DNA, 22 bp, Homo sapiens
tgctatacatgtacatattagt

SEQ ID NO: 6922340 - DNA, 22 bp, Homo sapiens
tcccagggacaccaagctgttt

SEQ ID NO: 6922341 - DNA, 19 bp, Homo sapiens
agcagcagaagtgtgcctt

SEQ ID NO: 6922342 - DNA, 21 bp, Homo sapiens
ctgagggctttgaatccagac

SEQ ID NO: 6922343 - DNA, 22 bp, Homo sapiens
ccctctccctgcagaatgtggc

SEQ ID NO: 6922344 - DNA, 22 bp, Homo sapiens
tctgagaaaataggaaacttga

SEQ ID NO: 6922345 - DNA, 22 bp, Homo sapiens
aatagtgtttgaagcatgatag

SEQ ID NO: 6922346 - DNA, 22 bp, Homo sapiens
acattctgaaatccatgtgggt

SEQ ID NO: 6922347 - DNA, 22 bp, Homo sapiens
aggatatttgcttaagatagct

SEQ ID NO: 6922348 - DNA, 22 bp, Homo sapiens
tcccagtggcttcataaggcag

SEQ ID NO: 6922349 - DNA, 16 bp, Homo sapiens
tcttccttttgatttt

SEQ ID NO: 6922350 - DNA, 22 bp, Homo sapiens
tggcatgagggaagtttgtggc

SEQ ID NO: 6922351 - DNA, 22 bp, Homo sapiens
ggccaaggctcttgagggctga

SEQ ID NO: 6922352 - DNA, 22 bp, Homo sapiens
gaaccagcagactttgacaggt

SEQ ID NO: 6922353 - DNA, 22 bp, Homo sapiens
cctgggtacgcagggctcctct

SEQ ID NO: 6922354 - DNA, 22 bp, Homo sapiens
aagcatctcattcttgcctgtc

SEQ ID NO: 6922355 - DNA, 22 bp, Homo sapiens
ctgctggaagtttgctgtggat

SEQ ID NO: 6922356 - DNA, 22 bp, Homo sapiens
ggccagggggcttcagactcca

SEQ ID NO: 6922357 - DNA, 22 bp, Homo sapiens
tctaccacttatcttggttaaa

SEQ ID NO: 6922358 - DNA, 22 bp, Homo sapiens
atacaactttacatgcaattcc

SEQ ID NO: 6922359 - DNA, 22 bp, Homo sapiens
gaaacatacgatttaggagaaa

SEQ ID NO: 6922360 - DNA, 20 bp, Homo sapiens
tccaggctcctccacttagt

SEQ ID NO: 6922361 - DNA, 22 bp, Homo sapiens
agtaatgacaatttttatctgt

SEQ ID NO: 6922362 - DNA, 22 bp, Homo sapiens
ctgtcagagatggggagtcaga

SEQ ID NO: 6922363 - DNA, 18 bp, Homo sapiens
ccgggctttggtgacaca

SEQ ID NO: 6922364 - DNA, 22 bp, Homo sapiens
agtcatttctgtagtcatgttt

SEQ ID NO: 6922365 - DNA, 23 bp, Homo sapiens
atgacaaacaggacatcttgtgc

SEQ ID NO: 6922366 - DNA, 22 bp, Homo sapiens
ccacggccacccgctcatgggc

SEQ ID NO: 6922367 - DNA, 22 bp, Homo sapiens
cagggctccctctggctcccag

SEQ ID NO: 6922368 - DNA, 22 bp, Homo sapiens
tggcagaggaggctcagattga

SEQ ID NO: 6922369 - DNA, 22 bp, Homo sapiens
ggctgtgggccagctagaccct

SEQ ID NO: 6922370 - DNA, 22 bp, Homo sapiens
tatatttgtgtgtgatttatga

SEQ ID NO: 6922371 - DNA, 22 bp, Homo sapiens
tatgacattatgtattacatgt

SEQ ID NO: 6922372 - DNA, 22 bp, Homo sapiens
cagctctgtctgtagaaacttc

SEQ ID NO: 6922373 - DNA, 22 bp, Homo sapiens
ggcctctgcctcatctgggcac

SEQ ID NO: 6922374 - DNA, 22 bp, Homo sapiens
tagtatttataatcatgcttaa

SEQ ID NO: 6922375 - DNA, 22 bp, Homo sapiens
tcacaggcccaaaccacgctta

SEQ ID NO: 6922376 - DNA, 22 bp, Homo sapiens
tggagctcagcgggtggtttct

SEQ ID NO: 6922377 - DNA, 22 bp, Homo sapiens
acactggactcagaggccagaa

SEQ ID NO: 6922378 - DNA, 22 bp, Homo sapiens
tgcagaggtgttgctgagataa

SEQ ID NO: 6922379 - DNA, 22 bp, Homo sapiens
ctggctcctctacacacccaaa

SEQ ID NO: 6922380 - DNA, 19 bp, Homo sapiens
gcaggccaggaggcggagg

SEQ ID NO: 6922381 - DNA, 22 bp, Homo sapiens
tatgttcttggactaagttgtt

SEQ ID NO: 6922382 - DNA, 22 bp, Homo sapiens
ttgatttgcagaaggtgtagag

SEQ ID NO: 6922383 - DNA, 22 bp, Homo sapiens
ggaaggtcacagatgagggaag

SEQ ID NO: 6922384 - DNA, 22 bp, Homo sapiens
ctagagaaaaagcttaggtacg

SEQ ID NO: 6922385 - DNA, 22 bp, Homo sapiens
tgacataaatctaaaggaaagg

SEQ ID NO: 6922386 - DNA, 22 bp, Homo sapiens
ctgggctgtcagttttgtttta

SEQ ID NO: 6922387 - DNA, 22 bp, Homo sapiens
gaatatcttgtacatctaagta

SEQ ID NO: 6922388 - DNA, 22 bp, Homo sapiens
ctggccacccatgcctccctga

SEQ ID NO: 6922389 - DNA, 22 bp, Homo sapiens
catcatcaaaacaaatggagtc

SEQ ID NO: 6922390 - DNA, 22 bp, Homo sapiens
tttgggcagaagctgaatgtct

SEQ ID NO: 6922391 - DNA, 21 bp, Homo sapiens
tgtgtcagtctttggaagcaa

SEQ ID NO: 6922392 - DNA, 22 bp, Homo sapiens
ttacttgcttataatcaaaaca

SEQ ID NO: 6922393 - DNA, 22 bp, Homo sapiens
cacagcctgctgcactcaagaa

SEQ ID NO: 6922394 - DNA, 22 bp, Homo sapiens
gagtgccaagagaagaggctgg

SEQ ID NO: 6922395 - DNA, 22 bp, Homo sapiens
ttaacatcctgtttaaatttgg

SEQ ID NO: 6922396 - DNA, 22 bp, Homo sapiens
tggcatcctttatctgcaggct

SEQ ID NO: 6922397 - DNA, 22 bp, Homo sapiens
agggccacctctctgggttccc

SEQ ID NO: 6922398 - DNA, 22 bp, Homo sapiens
aaagcactttgagactgacagg

SEQ ID NO: 6922399 - DNA, 22 bp, Homo sapiens
gctttgcccctttagtgggtgc

SEQ ID NO: 6922400 - DNA, 22 bp, Homo sapiens
agagactgcaaatcataagaat

SEQ ID NO: 6922401 - DNA, 22 bp, Homo sapiens
taaaggcatgcaggtgaatgta

SEQ ID NO: 6922402 - DNA, 22 bp, Homo sapiens
tttattgaattgtaaccctatt

SEQ ID NO: 6922403 - DNA, 22 bp, Homo sapiens
ctggccatgttgcctctgagac

SEQ ID NO: 6922404 - DNA, 22 bp, Homo sapiens
aagccaccctggctgcacatgc

SEQ ID NO: 6922405 - DNA, 22 bp, Homo sapiens
tcagctcactctgcttcctggg

SEQ ID NO: 6922406 - DNA, 22 bp, Homo sapiens
tggaagctagagcttagtctcg

SEQ ID NO: 6922407 - DNA, 22 bp, Homo sapiens
acatacttgaagcaagtgatca

SEQ ID NO: 6922408 - DNA, 22 bp, Homo sapiens
tcacagcattgtcacaaggctg

SEQ ID NO: 6922409 - DNA, 22 bp, Homo sapiens
atgcactactagatgcaaaagt

SEQ ID NO: 6922410 - DNA, 22 bp, Homo sapiens
gaattacagagttgttaagtca

SEQ ID NO: 6922411 - DNA, 22 bp, Homo sapiens
aatgtacaggctggctatgggg

SEQ ID NO: 6922412 - DNA, 22 bp, Homo sapiens
acatataagggatcagtgacag

SEQ ID NO: 6922413 - DNA, 22 bp, Homo sapiens
tgggtaaacaatgtttgcctaa

SEQ ID NO: 6922414 - DNA, 22 bp, Homo sapiens
ggtgccagcctagtgcagtggt

SEQ ID NO: 6922415 - DNA, 22 bp, Homo sapiens
taagttttaagcaatctgataa

SEQ ID NO: 6922416 - DNA, 22 bp, Homo sapiens
ttcagtttccctaaagccaatt

SEQ ID NO: 6922417 - DNA, 22 bp, Homo sapiens
gtgtatcatatctttggtggca

SEQ ID NO: 6922418 - DNA, 22 bp, Homo sapiens
tagaatatgtggtgtatacttt

SEQ ID NO: 6922419 - DNA, 22 bp, Homo sapiens
cctttacacatggaatgggtct

SEQ ID NO: 6922420 - DNA, 22 bp, Homo sapiens
ccaggaaggcgttgttcctctc

SEQ ID NO: 6922421 - DNA, 22 bp, Homo sapiens
tttgagctgggaggctgaagga

SEQ ID NO: 6922422 - DNA, 22 bp, Homo sapiens
agagcatctaacacataagcct

SEQ ID NO: 6922423 - DNA, 19 bp, Homo sapiens
gcaattcagtagtacaaaa

SEQ ID NO: 6922424 - DNA, 22 bp, Homo sapiens
aggcctgcagcaggagcaaacc

SEQ ID NO: 6922425 - DNA, 22 bp, Homo sapiens
acatctgacatgatcttcagta

SEQ ID NO: 6922426 - DNA, 23 bp, Homo sapiens
tggcaactagtggtgaagagcct

SEQ ID NO: 6922427 - DNA, 22 bp, Homo sapiens
ttcattgtgaacacattctgcc

SEQ ID NO: 6922428 - DNA, 22 bp, Homo sapiens
ccctagaaatgaaagcatacgt

SEQ ID NO: 6922429 - DNA, 22 bp, Homo sapiens
gctgcagagatgggtgcccttt

SEQ ID NO: 6922430 - DNA, 22 bp, Homo sapiens
cctgggagtggcactcacagca

SEQ ID NO: 6922431 - DNA, 22 bp, Homo sapiens
atcaagctacaccctttggaaa

SEQ ID NO: 6922432 - DNA, 22 bp, Homo sapiens
tgatggctcatgtttggggatg

SEQ ID NO: 6922433 - DNA, 22 bp, Homo sapiens
gtccttcatggagttacagcct

SEQ ID NO: 6922434 - DNA, 22 bp, Homo sapiens
gaacaatacaggctttattcct

SEQ ID NO: 6922435 - DNA, 15 bp, Homo sapiens
gcaggcagatcaccg

SEQ ID NO: 6922436 - DNA, 20 bp, Homo sapiens
tcctgctgccacctcttctt

SEQ ID NO: 6922437 - DNA, 22 bp, Homo sapiens
acacatgaggatgaggggatca

SEQ ID NO: 6922438 - DNA, 22 bp, Homo sapiens
ctgatgcatggttacatataca

SEQ ID NO: 6922439 - DNA, 22 bp, Homo sapiens
tcactcctcattgctgcccatt

SEQ ID NO: 6922440 - DNA, 23 bp, Homo sapiens
aggataaactaaactcattttgg

SEQ ID NO: 6922441 - DNA, 22 bp, Homo sapiens
gacagcaggagatcatgataga

SEQ ID NO: 6922442 - DNA, 22 bp, Homo sapiens
acagtgcgggctgcggtgggtc

SEQ ID NO: 6922443 - DNA, 22 bp, Homo sapiens
aggcaagcccccagtgaggctc

SEQ ID NO: 6922444 - DNA, 22 bp, Homo sapiens
tattgctgaaatgctgagttca

SEQ ID NO: 6922445 - DNA, 22 bp, Homo sapiens
tgctggaagagattggagcctc

SEQ ID NO: 6922446 - DNA, 22 bp, Homo sapiens
tggcttgcaaaattatttttct

SEQ ID NO: 6922447 - DNA, 22 bp, Homo sapiens
gcttcattttgccctctggtgg

SEQ ID NO: 6922448 - DNA, 22 bp, Homo sapiens
agaccattccctggaagaatat

SEQ ID NO: 6922449 - DNA, 22 bp, Homo sapiens
tggaggaaaattactggggtct

SEQ ID NO: 6922450 - DNA, 22 bp, Homo sapiens
tgctcctgggctgaagcacact

SEQ ID NO: 6922451 - DNA, 22 bp, Homo sapiens
cagaagtctttctgtttcacct

SEQ ID NO: 6922452 - DNA, 22 bp, Homo sapiens
aaagttagtttcttatatgtct

SEQ ID NO: 6922453 - DNA, 22 bp, Homo sapiens
tcacatttgttcttgaatctaa

SEQ ID NO: 6922454 - DNA, 22 bp, Homo sapiens
catacataccactgctgtcttt

SEQ ID NO: 6922455 - DNA, 22 bp, Homo sapiens
aacttctttgagctccagtttt

SEQ ID NO: 6922456 - DNA, 20 bp, Homo sapiens
tcactggccagagtagccct

SEQ ID NO: 6922457 - DNA, 22 bp, Homo sapiens
caaatacaaatacgggcagctt

SEQ ID NO: 6922458 - DNA, 22 bp, Homo sapiens
tatacacatttttacctatagt

SEQ ID NO: 6922459 - DNA, 21 bp, Homo sapiens
agagttgcagcaaatggggga

SEQ ID NO: 6922460 - DNA, 22 bp, Homo sapiens
agtgcagctgggactgtagggt

SEQ ID NO: 6922461 - DNA, 22 bp, Homo sapiens
aaattgtcagttatctgggata

SEQ ID NO: 6922462 - DNA, 22 bp, Homo sapiens
aggtataactttatgcatggaa

SEQ ID NO: 6922463 - DNA, 22 bp, Homo sapiens
ttcatggcgctgttctctccct

SEQ ID NO: 6922464 - DNA, 22 bp, Homo sapiens
gtgtgtacatatttttaatggg

SEQ ID NO: 6922465 - DNA, 22 bp, Homo sapiens
aggagctgacttgtaaagcatt

SEQ ID NO: 6922466 - DNA, 22 bp, Homo sapiens
ctgtttcaagtgaagtcagaca

SEQ ID NO: 6922467 - DNA, 17 bp, Homo sapiens
gccaaagggttccaatc

SEQ ID NO: 6922468 - DNA, 22 bp, Homo sapiens
ttgcaaatgaccattgccacat

SEQ ID NO: 6922469 - DNA, 22 bp, Homo sapiens
tctcaaataggccttggtcctg

SEQ ID NO: 6922470 - DNA, 22 bp, Homo sapiens
cccagtccaaaagtaggttcta

SEQ ID NO: 6922471 - DNA, 22 bp, Homo sapiens
cagtgcccttccaggactgcag

SEQ ID NO: 6922472 - DNA, 22 bp, Homo sapiens
aggtgccaagaagaataggttc

SEQ ID NO: 6922473 - DNA, 22 bp, Homo sapiens
ttcaaaattgttctaagctctg

SEQ ID NO: 6922474 - DNA, 22 bp, Homo sapiens
ttgagaactctgtatgtccagc

SEQ ID NO: 6922475 - DNA, 22 bp, Homo sapiens
tggcttcctgtgtaatgaggtg

SEQ ID NO: 6922476 - DNA, 22 bp, Homo sapiens
ggctctggctcctggctttgtg

SEQ ID NO: 6922477 - DNA, 22 bp, Homo sapiens
cgctggccatagcctcctgtgt

SEQ ID NO: 6922478 - DNA, 22 bp, Homo sapiens
agtcaaagatgaccgagttcct

SEQ ID NO: 6922479 - DNA, 22 bp, Homo sapiens
acacaaattgtaggataattgc

SEQ ID NO: 6922480 - DNA, 22 bp, Homo sapiens
gttgttaatccaactcagcttg

SEQ ID NO: 6922481 - DNA, 22 bp, Homo sapiens
tgtacctttttctgtgcatgct

SEQ ID NO: 6922482 - DNA, 22 bp, Homo sapiens
ggtcacatgagatgctgccctc

SEQ ID NO: 6922483 - DNA, 22 bp, Homo sapiens
taccccttctaatcatcctgtc

SEQ ID NO: 6922484 - DNA, 22 bp, Homo sapiens
attccaaaggttaatgcccatt

SEQ ID NO: 6922485 - DNA, 22 bp, Homo sapiens
tggcagggtggcaacttttggt

SEQ ID NO: 6922486 - DNA, 22 bp, Homo sapiens
tctattacttaccactaattca

SEQ ID NO: 6922487 - DNA, 21 bp, Homo sapiens
gggctggatattggaaagagg

SEQ ID NO: 6922488 - DNA, 22 bp, Homo sapiens
agtttagacaaagtcttgcatt

SEQ ID NO: 6922489 - DNA, 22 bp, Homo sapiens
tgctgaatatagagcaagaagt

SEQ ID NO: 6922490 - DNA, 22 bp, Homo sapiens
gtcatctctgtgaatgaggcag

SEQ ID NO: 6922491 - DNA, 22 bp, Homo sapiens
atgcacaattaggatatagctt

SEQ ID NO: 6922492 - DNA, 23 bp, Homo sapiens
gaaatgtttcttgattaatccta

SEQ ID NO: 6922493 - DNA, 22 bp, Homo sapiens
tgctttggcccaacattgatgc

SEQ ID NO: 6922494 - DNA, 22 bp, Homo sapiens
gagctgggcctcagaacacagt

SEQ ID NO: 6922495 - DNA, 22 bp, Homo sapiens
gcagtagaactgtcatgatgtt

SEQ ID NO: 6922496 - DNA, 22 bp, Homo sapiens
ccctgggattgccttggccttg

SEQ ID NO: 6922497 - DNA, 22 bp, Homo sapiens
tggtatgtaataagtgttctaa

SEQ ID NO: 6922498 - DNA, 20 bp, Homo sapiens
tccagccacttccgctggtc

SEQ ID NO: 6922499 - DNA, 22 bp, Homo sapiens
cttaacagagagaagtgttgct

SEQ ID NO: 6922500 - DNA, 22 bp, Homo sapiens
tctcctggccgggctgtcccct

SEQ ID NO: 6922501 - DNA, 22 bp, Homo sapiens
attagccttggtaagtctttca

SEQ ID NO: 6922502 - DNA, 22 bp, Homo sapiens
atggcacagtgggaaatgacct

SEQ ID NO: 6922503 - DNA, 22 bp, Homo sapiens
ctgagcagggaccaaaagcatt

SEQ ID NO: 6922504 - DNA, 22 bp, Homo sapiens
cctcaaataagttttatttatc

SEQ ID NO: 6922505 - DNA, 22 bp, Homo sapiens
aagcacagaccagatctccagg

SEQ ID NO: 6922506 - DNA, 22 bp, Homo sapiens
ttgaagtcctaactcccagtac

SEQ ID NO: 6922507 - DNA, 22 bp, Homo sapiens
agggaaggaggttagaacccac

SEQ ID NO: 6922508 - DNA, 22 bp, Homo sapiens
ttgcagaattaagcagagagcc

SEQ ID NO: 6922509 - DNA, 22 bp, Homo sapiens
gagtgtgggtctcagctttaag

SEQ ID NO: 6922510 - DNA, 22 bp, Homo sapiens
ttagggcaaagtttcaacagtt

SEQ ID NO: 6922511 - DNA, 22 bp, Homo sapiens
cttcagtccccagcaagctgtt

SEQ ID NO: 6922512 - DNA, 22 bp, Homo sapiens
cctctgagaggccatctctcct

SEQ ID NO: 6922513 - DNA, 22 bp, Homo sapiens
gttatacatatgtgttaacaaa

SEQ ID NO: 6922514 - DNA, 19 bp, Homo sapiens
cttctgatggaaagccaac

SEQ ID NO: 6922515 - DNA, 22 bp, Homo sapiens
atcctggacagtttcccctatt

SEQ ID NO: 6922516 - DNA, 22 bp, Homo sapiens
tgctgaggtaaccatatcctgc

SEQ ID NO: 6922517 - DNA, 22 bp, Homo sapiens
cagagacctcaaattatttcct

SEQ ID NO: 6922518 - DNA, 22 bp, Homo sapiens
tctgtccatttataagccccca

SEQ ID NO: 6922519 - DNA, 22 bp, Homo sapiens
tggctgtgggatatgtgactga

SEQ ID NO: 6922520 - DNA, 22 bp, Homo sapiens
tacctattttgcggggttacat

SEQ ID NO: 6922521 - DNA, 22 bp, Homo sapiens
ttgggaaatatggattgttatt

SEQ ID NO: 6922522 - DNA, 22 bp, Homo sapiens
cagacacagatatgcatatggc

SEQ ID NO: 6922523 - DNA, 22 bp, Homo sapiens
ctgctgcttagcatagcagagg

SEQ ID NO: 6922524 - DNA, 22 bp, Homo sapiens
gcttccagccttttctcctctg

SEQ ID NO: 6922525 - DNA, 22 bp, Homo sapiens
cagcaagaatcagacaacctca

SEQ ID NO: 6922526 - DNA, 22 bp, Homo sapiens
atgacatgattctttctttcat

SEQ ID NO: 6922527 - DNA, 22 bp, Homo sapiens
agggacatgaggatgatctaga

SEQ ID NO: 6922528 - DNA, 22 bp, Homo sapiens
tatgagctttggaatgagaaac

SEQ ID NO: 6922529 - DNA, 16 bp, Homo sapiens
tctgccagggacaggc

SEQ ID NO: 6922530 - DNA, 18 bp, Homo sapiens
agcaggtgctgtttcttt

SEQ ID NO: 6922531 - DNA, 22 bp, Homo sapiens
aactgcattgtactaaacttgt

SEQ ID NO: 6922532 - DNA, 22 bp, Homo sapiens
ttcaagtgaggctgtctttaga

SEQ ID NO: 6922533 - DNA, 22 bp, Homo sapiens
gactcggcacttgtcttggagt

SEQ ID NO: 6922534 - DNA, 22 bp, Homo sapiens
aagagccatttcatatcatctc

SEQ ID NO: 6922535 - DNA, 22 bp, Homo sapiens
cacctctttgatttgaggcaag

SEQ ID NO: 6922536 - DNA, 22 bp, Homo sapiens
ccaaagagctagaattataggc

SEQ ID NO: 6922537 - DNA, 22 bp, Homo sapiens
tctgccttggcaaccacagctt

SEQ ID NO: 6922538 - DNA, 22 bp, Homo sapiens
cttcatcaactctaacaaatgt

SEQ ID NO: 6922539 - DNA, 22 bp, Homo sapiens
gtgattgcccagcaccattgtt

SEQ ID NO: 6922540 - DNA, 22 bp, Homo sapiens
aggcgtgggaggatctgaggcc

SEQ ID NO: 6922541 - DNA, 22 bp, Homo sapiens
gaagctgacccaggagcgtgtg

SEQ ID NO: 6922542 - DNA, 22 bp, Homo sapiens
catcatcttgaatgactgtgat

SEQ ID NO: 6922543 - DNA, 22 bp, Homo sapiens
gttccagacttgccagtggaag

SEQ ID NO: 6922544 - DNA, 22 bp, Homo sapiens
aatacagatattcagtggtact

SEQ ID NO: 6922545 - DNA, 18 bp, Homo sapiens
ctgttcagctgaactaca

SEQ ID NO: 6922546 - DNA, 22 bp, Homo sapiens
tgatggttttattaataggacc

SEQ ID NO: 6922547 - DNA, 22 bp, Homo sapiens
tgcacctttaaattcagcagta

SEQ ID NO: 6922548 - DNA, 22 bp, Homo sapiens
gctgccttctggaggaagtgaa

SEQ ID NO: 6922549 - DNA, 22 bp, Homo sapiens
tctgtaggggccggcggagccc

SEQ ID NO: 6922550 - DNA, 22 bp, Homo sapiens
ggactgggattctggatctgct

SEQ ID NO: 6922551 - DNA, 22 bp, Homo sapiens
taaggttttgagaccagaacgt

SEQ ID NO: 6922552 - DNA, 22 bp, Homo sapiens
tggtctctccatgccctccacc

SEQ ID NO: 6922553 - DNA, 22 bp, Homo sapiens
aatgcaccttggcagggattca

SEQ ID NO: 6922554 - DNA, 19 bp, Homo sapiens
tgcatcttgcatgggtgag

SEQ ID NO: 6922555 - DNA, 22 bp, Homo sapiens
taaggcaggtagatgactacgg

SEQ ID NO: 6922556 - DNA, 23 bp, Homo sapiens
tgctggtgtttttgggaccaggg

SEQ ID NO: 6922557 - DNA, 22 bp, Homo sapiens
aagcctaaatgatgctattatg

SEQ ID NO: 6922558 - DNA, 22 bp, Homo sapiens
ttctgtgaatcttttttcccac

SEQ ID NO: 6922559 - DNA, 22 bp, Homo sapiens
tggcaggctgagttggcctggt

SEQ ID NO: 6922560 - DNA, 22 bp, Homo sapiens
tgttgctaaggggaatgagagc

SEQ ID NO: 6922561 - DNA, 22 bp, Homo sapiens
tcttcctagaaggaagaaatct

SEQ ID NO: 6922562 - DNA, 22 bp, Homo sapiens
tacagcactctggggagcatga

SEQ ID NO: 6922563 - DNA, 22 bp, Homo sapiens
tttcagactcagaacttagcaa

SEQ ID NO: 6922564 - DNA, 20 bp, Homo sapiens
gccctggacgtggcctcggc

SEQ ID NO: 6922565 - DNA, 22 bp, Homo sapiens
tgaaggtgacctgacagtggct

SEQ ID NO: 6922566 - DNA, 22 bp, Homo sapiens
tctagagattggacttcctaga

SEQ ID NO: 6922567 - DNA, 22 bp, Homo sapiens
ttatccaaactggtgaatcatt

SEQ ID NO: 6922568 - DNA, 22 bp, Homo sapiens
tgcctcagagtgggcttgctat

SEQ ID NO: 6922569 - DNA, 22 bp, Homo sapiens
caagctacttagaaagcacagt

SEQ ID NO: 6922570 - DNA, 23 bp, Homo sapiens
tgacagaccttcccagacagtca

SEQ ID NO: 6922571 - DNA, 22 bp, Homo sapiens
caagtttgctgatccttgtttt

SEQ ID NO: 6922572 - DNA, 22 bp, Homo sapiens
cccaggtctatgccagctctga

SEQ ID NO: 6922573 - DNA, 22 bp, Homo sapiens
acaaggcaatggcaggatttca

SEQ ID NO: 6922574 - DNA, 22 bp, Homo sapiens
ctgtctggtgtccctgtctaca

SEQ ID NO: 6922575 - DNA, 22 bp, Homo sapiens
gtgtgcgctggtgcttggtcaa

SEQ ID NO: 6922576 - DNA, 22 bp, Homo sapiens
agaatgtttctgtggttcacaa

SEQ ID NO: 6922577 - DNA, 19 bp, Homo sapiens
acagtttgggaaatgagca

SEQ ID NO: 6922578 - DNA, 18 bp, Homo sapiens
cctgccagtctggagcag

SEQ ID NO: 6922579 - DNA, 22 bp, Homo sapiens
ttccagtgggctgggagtaagg

SEQ ID NO: 6922580 - DNA, 22 bp, Homo sapiens
aatattcatttgcagaagaagt

SEQ ID NO: 6922581 - DNA, 22 bp, Homo sapiens
attggtatgtattctgaaaact

SEQ ID NO: 6922582 - DNA, 22 bp, Homo sapiens
tgtgaggagaggcccagctccc

SEQ ID NO: 6922583 - DNA, 22 bp, Homo sapiens
tggaagaccagacttcccgaac

SEQ ID NO: 6922584 - DNA, 21 bp, Homo sapiens
acaggctcacgatccatttct

SEQ ID NO: 6922585 - DNA, 19 bp, Homo sapiens
gctgggcttgggtttgtag

SEQ ID NO: 6922586 - DNA, 22 bp, Homo sapiens
gctctgaggctgggagcactct

SEQ ID NO: 6922587 - DNA, 22 bp, Homo sapiens
tgacagggaaaggtcctctttt

SEQ ID NO: 6922588 - DNA, 22 bp, Homo sapiens
gtgcatgtggtaaagaggagag

SEQ ID NO: 6922589 - DNA, 22 bp, Homo sapiens
ttagtcttctcatagtaaaact

SEQ ID NO: 6922590 - DNA, 21 bp, Homo sapiens
tgctggcattaccacaaaccc

SEQ ID NO: 6922591 - DNA, 22 bp, Homo sapiens
aaccttatcatgcataagtaga

SEQ ID NO: 6922592 - DNA, 22 bp, Homo sapiens
tggcacatagaaaaggatcaat

SEQ ID NO: 6922593 - DNA, 22 bp, Homo sapiens
ttaggaaacatcatttttgctg

SEQ ID NO: 6922594 - DNA, 22 bp, Homo sapiens
aattctaaatgtaatttagaat

SEQ ID NO: 6922595 - DNA, 23 bp, Homo sapiens
agctgtgtggccttgggcaagtt

SEQ ID NO: 6922596 - DNA, 21 bp, Homo sapiens
gctgaagaactctttattttc

SEQ ID NO: 6922597 - DNA, 22 bp, Homo sapiens
gcgtgcaacagcctcttccatt

SEQ ID NO: 6922598 - DNA, 22 bp, Homo sapiens
gccaggcaaattaaggaatgca

SEQ ID NO: 6922599 - DNA, 22 bp, Homo sapiens
taagtagtatgtttaacaaggg

SEQ ID NO: 6922600 - DNA, 22 bp, Homo sapiens
tataagtgtagtttcaaatgtt

SEQ ID NO: 6922601 - DNA, 22 bp, Homo sapiens
acattcccaccaacagtgtaaa

SEQ ID NO: 6922602 - DNA, 22 bp, Homo sapiens
tcttaaaggcacatagtgtcta

SEQ ID NO: 6922603 - DNA, 22 bp, Homo sapiens
ttcaatatctctaagaatgagg

SEQ ID NO: 6922604 - DNA, 22 bp, Homo sapiens
ccttggctaaactcaatccagc

SEQ ID NO: 6922605 - DNA, 18 bp, Homo sapiens
gtccatggcctccaccca

SEQ ID NO: 6922606 - DNA, 22 bp, Homo sapiens
ccaggagctggagggtgcagtg

SEQ ID NO: 6922607 - DNA, 22 bp, Homo sapiens
tctctagggatctgttttaatt

SEQ ID NO: 6922608 - DNA, 22 bp, Homo sapiens
cattgttgctgcttcaagatat

SEQ ID NO: 6922609 - DNA, 21 bp, Homo sapiens
cagttatcaagaggatgctga

SEQ ID NO: 6922610 - DNA, 22 bp, Homo sapiens
ttcttaagactgcaaatcaacc

SEQ ID NO: 6922611 - DNA, 22 bp, Homo sapiens
gtggccatataattttcttgaa

SEQ ID NO: 6922612 - DNA, 20 bp, Homo sapiens
tcagtgattttgaagaggaa

SEQ ID NO: 6922613 - DNA, 22 bp, Homo sapiens
cccaagatctttcgtgcactaa

SEQ ID NO: 6922614 - DNA, 22 bp, Homo sapiens
tcctgaaatgtgcacatgacat

SEQ ID NO: 6922615 - DNA, 22 bp, Homo sapiens
cagaggtgtacagagggaggcc

SEQ ID NO: 6922616 - DNA, 22 bp, Homo sapiens
aggttaggaaatagggctgtaa

SEQ ID NO: 6922617 - DNA, 22 bp, Homo sapiens
tgcttctgtttcattgatctta

SEQ ID NO: 6922618 - DNA, 20 bp, Homo sapiens
ctctgctgcccgccggctgc

SEQ ID NO: 6922619 - DNA, 22 bp, Homo sapiens
taagatggttgtagatggactg

SEQ ID NO: 6922620 - DNA, 22 bp, Homo sapiens
ttccttcttttacaccataaat

SEQ ID NO: 6922621 - DNA, 22 bp, Homo sapiens
ctctgcaccttgtaggaggcaa

SEQ ID NO: 6922622 - DNA, 22 bp, Homo sapiens
aacctgaaagtagtaaaagctg

SEQ ID NO: 6922623 - DNA, 22 bp, Homo sapiens
ggctcctctctggccgctcccg

SEQ ID NO: 6922624 - DNA, 19 bp, Homo sapiens
ttcataggtgagcatacag

SEQ ID NO: 6922625 - DNA, 18 bp, Homo sapiens
gttagcttcctgttgccc

SEQ ID NO: 6922626 - DNA, 22 bp, Homo sapiens
tcaggcagtctgactccggagg

SEQ ID NO: 6922627 - DNA, 22 bp, Homo sapiens
cgtccctacctggcagctgcgc

SEQ ID NO: 6922628 - DNA, 22 bp, Homo sapiens
taggaatggcagcagccggggg

SEQ ID NO: 6922629 - DNA, 22 bp, Homo sapiens
gagttctgtgagccatcctagc

SEQ ID NO: 6922630 - DNA, 22 bp, Homo sapiens
aactacagctcttgtctttctg

SEQ ID NO: 6922631 - DNA, 22 bp, Homo sapiens
caggaacagggtgtcctggcag

SEQ ID NO: 6922632 - DNA, 22 bp, Homo sapiens
ggagagtccggatatgtaatat

SEQ ID NO: 6922633 - DNA, 22 bp, Homo sapiens
tttaggaagacttgaatgagta

SEQ ID NO: 6922634 - DNA, 22 bp, Homo sapiens
cagcatctcatttgacttctgc

SEQ ID NO: 6922635 - DNA, 22 bp, Homo sapiens
tctgggcagttcggatcctctg

SEQ ID NO: 6922636 - DNA, 23 bp, Homo sapiens
cactgggcccagggtgtggaggc

SEQ ID NO: 6922637 - DNA, 22 bp, Homo sapiens
tgctcatttcaaagtgaataat

SEQ ID NO: 6922638 - DNA, 22 bp, Homo sapiens
gctgttagtcaaatcagttgag

SEQ ID NO: 6922639 - DNA, 21 bp, Homo sapiens
tgcatatataagtgcatacac

SEQ ID NO: 6922640 - DNA, 22 bp, Homo sapiens
tgagaatgagggggtagaaggt

SEQ ID NO: 6922641 - DNA, 22 bp, Homo sapiens
cttgcaggattttgctgctgta

SEQ ID NO: 6922642 - DNA, 22 bp, Homo sapiens
ttatttcatgtaaaatttatgt

SEQ ID NO: 6922643 - DNA, 22 bp, Homo sapiens
acaactctcagttaaataaaga

SEQ ID NO: 6922644 - DNA, 22 bp, Homo sapiens
gcctcaaaagtgttgtagaggg

SEQ ID NO: 6922645 - DNA, 22 bp, Homo sapiens
aaatttgtattccttttccgta

SEQ ID NO: 6922646 - DNA, 22 bp, Homo sapiens
ctctgtaaaactgtctgtcgat

SEQ ID NO: 6922647 - DNA, 22 bp, Homo sapiens
atcatgtgtaatttcaagctac

SEQ ID NO: 6922648 - DNA, 22 bp, Homo sapiens
acaaagtgaattgcatcgagtt

SEQ ID NO: 6922649 - DNA, 23 bp, Homo sapiens
aaactaagggagtagatgagatg

SEQ ID NO: 6922650 - DNA, 22 bp, Homo sapiens
tctggatcgggttcctcaggtc

SEQ ID NO: 6922651 - DNA, 22 bp, Homo sapiens
agaacacatagagaagttttat

SEQ ID NO: 6922652 - DNA, 21 bp, Homo sapiens
attctttgatgtgcaataagt

SEQ ID NO: 6922653 - DNA, 18 bp, Homo sapiens
tgtagagccaggtttgcc

SEQ ID NO: 6922654 - DNA, 22 bp, Homo sapiens
cactgagggcggagcccaggga

SEQ ID NO: 6922655 - DNA, 22 bp, Homo sapiens
agatttcctgcactgcctttga

SEQ ID NO: 6922656 - DNA, 22 bp, Homo sapiens
atacaatgagtgagtgaatggg

SEQ ID NO: 6922657 - DNA, 22 bp, Homo sapiens
agccagatccaggagacagctc

SEQ ID NO: 6922658 - DNA, 22 bp, Homo sapiens
tgagtaaatacaaaatcacctc

SEQ ID NO: 6922659 - DNA, 22 bp, Homo sapiens
gtgtttgctggagctctgggtc

SEQ ID NO: 6922660 - DNA, 22 bp, Homo sapiens
acagctgaacaagatagtgtca

SEQ ID NO: 6922661 - DNA, 22 bp, Homo sapiens
tgctcctgctggccctcgtgcc

SEQ ID NO: 6922662 - DNA, 18 bp, Homo sapiens
acagtggtttgatgtgct

SEQ ID NO: 6922663 - DNA, 22 bp, Homo sapiens
agctacaatcaatgtacatcat

SEQ ID NO: 6922664 - DNA, 22 bp, Homo sapiens
tacaaagcttgtactgtgtgac

SEQ ID NO: 6922665 - DNA, 22 bp, Homo sapiens
acaaggtatccacattaaatgt

SEQ ID NO: 6922666 - DNA, 22 bp, Homo sapiens
atgtgcacggtgtcaaacgggg

SEQ ID NO: 6922667 - DNA, 22 bp, Homo sapiens
agggttataaatcatcttacat

SEQ ID NO: 6922668 - DNA, 22 bp, Homo sapiens
ctacagaggacacaaagatctt

SEQ ID NO: 6922669 - DNA, 22 bp, Homo sapiens
tttaggagtcaaatgttttagg

SEQ ID NO: 6922670 - DNA, 22 bp, Homo sapiens
gtacagaggttgctggaggctc

SEQ ID NO: 6922671 - DNA, 22 bp, Homo sapiens
gttatttcagccacagagtgca

SEQ ID NO: 6922672 - DNA, 17 bp, Homo sapiens
aagaggtaactgtacta

SEQ ID NO: 6922673 - DNA, 19 bp, Homo sapiens
cactgttgtcctagtactt

SEQ ID NO: 6922674 - DNA, 22 bp, Homo sapiens
aattaacaaatgtagctgtgat

SEQ ID NO: 6922675 - DNA, 22 bp, Homo sapiens
acaatgttctctgagttgtgtg

SEQ ID NO: 6922676 - DNA, 22 bp, Homo sapiens
gctgatcacatttccaaaaccc

SEQ ID NO: 6922677 - DNA, 22 bp, Homo sapiens
gggagatgactcagtgacctcg

SEQ ID NO: 6922678 - DNA, 22 bp, Homo sapiens
tcatcacaattttatgaccctc

SEQ ID NO: 6922679 - DNA, 22 bp, Homo sapiens
cttccccgccggttcgctgagt

SEQ ID NO: 6922680 - DNA, 22 bp, Homo sapiens
cccagtgtttaggtcccatctc

SEQ ID NO: 6922681 - DNA, 22 bp, Homo sapiens
gaggaacctgggcttccatcct

SEQ ID NO: 6922682 - DNA, 22 bp, Homo sapiens
ccttggcaaaccagggcagctg

SEQ ID NO: 6922683 - DNA, 22 bp, Homo sapiens
gagatacttaagatggggctcc

SEQ ID NO: 6922684 - DNA, 22 bp, Homo sapiens
tgacccttagtgaacattagaa

SEQ ID NO: 6922685 - DNA, 22 bp, Homo sapiens
tgctttatggatttgtgtcctg

SEQ ID NO: 6922686 - DNA, 22 bp, Homo sapiens
agtcgcagacatggtccccttt

SEQ ID NO: 6922687 - DNA, 22 bp, Homo sapiens
ggcttatgtttgtcaagcaatc

SEQ ID NO: 6922688 - DNA, 22 bp, Homo sapiens
agagggtagaagacagggttgc

SEQ ID NO: 6922689 - DNA, 22 bp, Homo sapiens
gcttctgcagccaaagaagccg

SEQ ID NO: 6922690 - DNA, 22 bp, Homo sapiens
aacactgctgctgggttctgtg

SEQ ID NO: 6922691 - DNA, 22 bp, Homo sapiens
caaatgttaagacaggatcaag

SEQ ID NO: 6922692 - DNA, 22 bp, Homo sapiens
gtggcagccgcaggccctgtgt

SEQ ID NO: 6922693 - DNA, 22 bp, Homo sapiens
gaaatcttgctcattgtgacaa

SEQ ID NO: 6922694 - DNA, 22 bp, Homo sapiens
tgcatttttaacaaggctaatt

SEQ ID NO: 6922695 - DNA, 22 bp, Homo sapiens
ggcatcctccatataggtgaat

SEQ ID NO: 6922696 - DNA, 22 bp, Homo sapiens
cttagctttgtttaacacaggg

SEQ ID NO: 6922697 - DNA, 22 bp, Homo sapiens
cttcagggaggagcatgggttc

SEQ ID NO: 6922698 - DNA, 22 bp, Homo sapiens
atagttttaaaacctcaggaag

SEQ ID NO: 6922699 - DNA, 22 bp, Homo sapiens
agcagcagattcagcaggaatg

SEQ ID NO: 6922700 - DNA, 18 bp, Homo sapiens
gtatatctgcacatatac

SEQ ID NO: 6922701 - DNA, 22 bp, Homo sapiens
ctgtgggctcctgcagctcagg

SEQ ID NO: 6922702 - DNA, 22 bp, Homo sapiens
accaggagtagaatatctgtga

SEQ ID NO: 6922703 - DNA, 22 bp, Homo sapiens
atgcatatgtacccatgttctg

SEQ ID NO: 6922704 - DNA, 22 bp, Homo sapiens
tttatgttgaagagactgtgtt

SEQ ID NO: 6922705 - DNA, 22 bp, Homo sapiens
tgtgacagtaacttgggatgga

SEQ ID NO: 6922706 - DNA, 22 bp, Homo sapiens
tagtacagagacactggaggaa

SEQ ID NO: 6922707 - DNA, 22 bp, Homo sapiens
aagtccaagatgcagttgtcag

SEQ ID NO: 6922708 - DNA, 22 bp, Homo sapiens
tcctttttaagtcgttgtggta

SEQ ID NO: 6922709 - DNA, 22 bp, Homo sapiens
ttgatcaaatcagctactgagg

SEQ ID NO: 6922710 - DNA, 22 bp, Homo sapiens
gtagcttcaagtactctccctg

SEQ ID NO: 6922711 - DNA, 22 bp, Homo sapiens
ctcttatagacactcttctata

SEQ ID NO: 6922712 - DNA, 22 bp, Homo sapiens
agggacttcggagcagactcgt

SEQ ID NO: 6922713 - DNA, 22 bp, Homo sapiens
ggcctacgccagtatccccagg

SEQ ID NO: 6922714 - DNA, 21 bp, Homo sapiens
tagatcatggtattctttggc

SEQ ID NO: 6922715 - DNA, 22 bp, Homo sapiens
agctgatacatttcttgtagcc

SEQ ID NO: 6922716 - DNA, 22 bp, Homo sapiens
cctgggaaagtgaggtcattat

SEQ ID NO: 6922717 - DNA, 22 bp, Homo sapiens
attccagtccaaatgttttcct

SEQ ID NO: 6922718 - DNA, 17 bp, Homo sapiens
gtcaacaggatttcttt

SEQ ID NO: 6922719 - DNA, 22 bp, Homo sapiens
tttctcaacctcaacactattt

SEQ ID NO: 6922720 - DNA, 22 bp, Homo sapiens
cagcttcccagctcactcataa

SEQ ID NO: 6922721 - DNA, 22 bp, Homo sapiens
catagaatgtaataaagagtag

SEQ ID NO: 6922722 - DNA, 22 bp, Homo sapiens
tcaaacataaaactaaatcgag

SEQ ID NO: 6922723 - DNA, 22 bp, Homo sapiens
agtcacatggcagagagaagtt

SEQ ID NO: 6922724 - DNA, 22 bp, Homo sapiens
gccttgatctgctgtgtttgag

SEQ ID NO: 6922725 - DNA, 22 bp, Homo sapiens
gcttggggagctcagtgtcctt

SEQ ID NO: 6922726 - DNA, 22 bp, Homo sapiens
gaatacacgaaggcaagagtcc

SEQ ID NO: 6922727 - DNA, 22 bp, Homo sapiens
tgtcaggagccaccagcactcc

SEQ ID NO: 6922728 - DNA, 22 bp, Homo sapiens
actgtcacctaaattttcattg

SEQ ID NO: 6922729 - DNA, 22 bp, Homo sapiens
ttagcaccttgaacagaccctg

SEQ ID NO: 6922730 - DNA, 22 bp, Homo sapiens
tcaaaggagtttaagttactgg

SEQ ID NO: 6922731 - DNA, 22 bp, Homo sapiens
tcagaggaacactgtttcatgc

SEQ ID NO: 6922732 - DNA, 22 bp, Homo sapiens
gaggccagcgcgcagcactttt

SEQ ID NO: 6922733 - DNA, 18 bp, Homo sapiens
agcagagagtgaatggga

SEQ ID NO: 6922734 - DNA, 22 bp, Homo sapiens
tgctcagtagagtttttggaat

SEQ ID NO: 6922735 - DNA, 22 bp, Homo sapiens
tggggcagccacatagacaaca

SEQ ID NO: 6922736 - DNA, 22 bp, Homo sapiens
cacagtgctcgggttttatgtc

SEQ ID NO: 6922737 - DNA, 21 bp, Homo sapiens
atctcgggcttctcgcccagc

SEQ ID NO: 6922738 - DNA, 22 bp, Homo sapiens
gggcagctagccctctagccca

SEQ ID NO: 6922739 - DNA, 20 bp, Homo sapiens
ttctatacatatcactgaaa

SEQ ID NO: 6922740 - DNA, 18 bp, Homo sapiens
ggccagtagtgatgatag

SEQ ID NO: 6922741 - DNA, 22 bp, Homo sapiens
attcaaacctcatttattgttc

SEQ ID NO: 6922742 - DNA, 22 bp, Homo sapiens
tgatggcgggtggttggcactt

SEQ ID NO: 6922743 - DNA, 22 bp, Homo sapiens
agcctgtccagaggacagggct

SEQ ID NO: 6922744 - DNA, 20 bp, Homo sapiens
ggcttcttcaggtgtctatt

SEQ ID NO: 6922745 - DNA, 22 bp, Homo sapiens
tggctggcgccgggctagccac

SEQ ID NO: 6922746 - DNA, 22 bp, Homo sapiens
gtcactttcacactttattgct

SEQ ID NO: 6922747 - DNA, 22 bp, Homo sapiens
acatggatgaattgtctagtgg

SEQ ID NO: 6922748 - DNA, 22 bp, Homo sapiens
cacctagggcatccctgcccca

SEQ ID NO: 6922749 - DNA, 17 bp, Homo sapiens
tatatgtatgcctctcc

SEQ ID NO: 6922750 - DNA, 22 bp, Homo sapiens
gtggcagtcatcaaggacagat

SEQ ID NO: 6922751 - DNA, 22 bp, Homo sapiens
ggcatcagaggtgtgttctgct

SEQ ID NO: 6922752 - DNA, 22 bp, Homo sapiens
gcttagcagtcacacattgttc

SEQ ID NO: 6922753 - DNA, 22 bp, Homo sapiens
acactggtcatgcctgggtgtt

SEQ ID NO: 6922754 - DNA, 22 bp, Homo sapiens
gttgttctccctaacaattact

SEQ ID NO: 6922755 - DNA, 22 bp, Homo sapiens
tgagcagtaacagctcacaggg

SEQ ID NO: 6922756 - DNA, 22 bp, Homo sapiens
cagctgctctggtggtctctcc

SEQ ID NO: 6922757 - DNA, 22 bp, Homo sapiens
taactactaattgatgataatg

SEQ ID NO: 6922758 - DNA, 22 bp, Homo sapiens
agctacagtggacaagtgaact

SEQ ID NO: 6922759 - DNA, 22 bp, Homo sapiens
tcctttcttgtgtatcaaatgg

SEQ ID NO: 6922760 - DNA, 22 bp, Homo sapiens
gtttcattacctgacccatgag

SEQ ID NO: 6922761 - DNA, 22 bp, Homo sapiens
gccttccaggcagggggagcag

SEQ ID NO: 6922762 - DNA, 22 bp, Homo sapiens
tttgtgcagctaagaaaatggc

SEQ ID NO: 6922763 - DNA, 22 bp, Homo sapiens
gatccttgcacttgacttggca

SEQ ID NO: 6922764 - DNA, 22 bp, Homo sapiens
ggctttgggattcagcatgaga

SEQ ID NO: 6922765 - DNA, 22 bp, Homo sapiens
tcatgctatttcgaatgtaata

SEQ ID NO: 6922766 - DNA, 22 bp, Homo sapiens
attatttccttgctttgaggaa

SEQ ID NO: 6922767 - DNA, 22 bp, Homo sapiens
gctgaaaggggtgacattcttt

SEQ ID NO: 6922768 - DNA, 22 bp, Homo sapiens
gcagtagttgaaactcctgtag

SEQ ID NO: 6922769 - DNA, 22 bp, Homo sapiens
caaggcataacctttttagaat

SEQ ID NO: 6922770 - DNA, 22 bp, Homo sapiens
agtatgcatatttcaaagtaag

SEQ ID NO: 6922771 - DNA, 22 bp, Homo sapiens
tgggatctgcagtttaacaaaa

SEQ ID NO: 6922772 - DNA, 22 bp, Homo sapiens
acacagttggtggctcagtctg

SEQ ID NO: 6922773 - DNA, 22 bp, Homo sapiens
gcccatggaaaacctgtcctct

SEQ ID NO: 6922774 - DNA, 22 bp, Homo sapiens
taagcaatctaaaagccttacc

SEQ ID NO: 6922775 - DNA, 22 bp, Homo sapiens
ctgcagaggcctcgcctcctct

SEQ ID NO: 6922776 - DNA, 22 bp, Homo sapiens
caactcatgtccaactttcttt

SEQ ID NO: 6922777 - DNA, 22 bp, Homo sapiens
agaagccaaaggggccagatat

SEQ ID NO: 6922778 - DNA, 22 bp, Homo sapiens
aagctgtttttaggtggaggta

SEQ ID NO: 6922779 - DNA, 22 bp, Homo sapiens
gtttcctgggccccaacccaga

SEQ ID NO: 6922780 - DNA, 22 bp, Homo sapiens
agtgacttggcatgatgagaag

SEQ ID NO: 6922781 - DNA, 22 bp, Homo sapiens
taatggagcctgccttccaggg

SEQ ID NO: 6922782 - DNA, 22 bp, Homo sapiens
gcaagcaaattatttataggca

SEQ ID NO: 6922783 - DNA, 22 bp, Homo sapiens
actgaatagcccttctgtctcc

SEQ ID NO: 6922784 - DNA, 22 bp, Homo sapiens
acctttggtcatttacttttca

SEQ ID NO: 6922785 - DNA, 22 bp, Homo sapiens
ctcaccagatgtcgggctgagt

SEQ ID NO: 6922786 - DNA, 22 bp, Homo sapiens
agtggctggcataggaacagac

SEQ ID NO: 6922787 - DNA, 19 bp, Homo sapiens
ccccttgtgtaactagcct

SEQ ID NO: 6922788 - DNA, 22 bp, Homo sapiens
ttggcagctgttggaccttgac

SEQ ID NO: 6922789 - DNA, 22 bp, Homo sapiens
tttcaaagagttgtaaattact

SEQ ID NO: 6922790 - DNA, 22 bp, Homo sapiens
agctctggcactggcgcgggat

SEQ ID NO: 6922791 - DNA, 22 bp, Homo sapiens
acactgagctgagcattcttgt

SEQ ID NO: 6922792 - DNA, 22 bp, Homo sapiens
tttcacatgcagcagggaagtg

SEQ ID NO: 6922793 - DNA, 22 bp, Homo sapiens
gaattctttgatcttaatcttg

SEQ ID NO: 6922794 - DNA, 22 bp, Homo sapiens
tctctagacatggggaatgtca

SEQ ID NO: 6922795 - DNA, 20 bp, Homo sapiens
gaacggcaatggagctggca

SEQ ID NO: 6922796 - DNA, 22 bp, Homo sapiens
ggctcaggactgcagcgtagag

SEQ ID NO: 6922797 - DNA, 22 bp, Homo sapiens
ctctgctggcagcccccgggcc

SEQ ID NO: 6922798 - DNA, 22 bp, Homo sapiens
cacactgtccccttctccccag

SEQ ID NO: 6922799 - DNA, 22 bp, Homo sapiens
ctctgcactgtccggctttctt

SEQ ID NO: 6922800 - DNA, 22 bp, Homo sapiens
ccagggtggggcaggcccactg

SEQ ID NO: 6922801 - DNA, 19 bp, Homo sapiens
gccacatcttttccagagt

SEQ ID NO: 6922802 - DNA, 22 bp, Homo sapiens
atcctcacaataaaatcagcct

SEQ ID NO: 6922803 - DNA, 22 bp, Homo sapiens
acagggccaggtgagaggtgct

SEQ ID NO: 6922804 - DNA, 22 bp, Homo sapiens
tgaggcaagtctcaatctttga

SEQ ID NO: 6922805 - DNA, 22 bp, Homo sapiens
tgacatctgtcataaaatgtat

SEQ ID NO: 6922806 - DNA, 22 bp, Homo sapiens
taaagcatgtttcagtaaggtt

SEQ ID NO: 6922807 - DNA, 22 bp, Homo sapiens
gcaccctgtttatcctgagttc

SEQ ID NO: 6922808 - DNA, 22 bp, Homo sapiens
catcctagaaaaccctatggaa

SEQ ID NO: 6922809 - DNA, 22 bp, Homo sapiens
tctgctgacctttctctgacac

SEQ ID NO: 6922810 - DNA, 22 bp, Homo sapiens
ctccccaccttcgcggtccctg

SEQ ID NO: 6922811 - DNA, 22 bp, Homo sapiens
tttcttctatgtgtgatatttt

SEQ ID NO: 6922812 - DNA, 22 bp, Homo sapiens
ggtccctgccctacattttctt

SEQ ID NO: 6922813 - DNA, 22 bp, Homo sapiens
atcagtgcatcctgccacaaag

SEQ ID NO: 6922814 - DNA, 22 bp, Homo sapiens
tcacttcccagacggggtggca

SEQ ID NO: 6922815 - DNA, 21 bp, Homo sapiens
gctgttgcccgccgcctcttc

SEQ ID NO: 6922816 - DNA, 22 bp, Homo sapiens
gccagcaccttctcatatgttt

SEQ ID NO: 6922817 - DNA, 22 bp, Homo sapiens
ttccttcttccaaacccatcat

SEQ ID NO: 6922818 - DNA, 22 bp, Homo sapiens
cagcatttggaggagaggcttt

SEQ ID NO: 6922819 - DNA, 22 bp, Homo sapiens
tagtctctaggaggggaaaaga

SEQ ID NO: 6922820 - DNA, 22 bp, Homo sapiens
aactgtatacaattgtcagaca

SEQ ID NO: 6922821 - DNA, 22 bp, Homo sapiens
ctgatgctctggatgtagtcaa

SEQ ID NO: 6922822 - DNA, 22 bp, Homo sapiens
tccactggtaatacctagatcc

SEQ ID NO: 6922823 - DNA, 22 bp, Homo sapiens
gatttgcagctagagcaaaggt

SEQ ID NO: 6922824 - DNA, 22 bp, Homo sapiens
cagccagaaagtatgttaggga

SEQ ID NO: 6922825 - DNA, 22 bp, Homo sapiens
ccactgtttcctttctgctggc

SEQ ID NO: 6922826 - DNA, 21 bp, Homo sapiens
tctgggagtgggaaaatggtc

SEQ ID NO: 6922827 - DNA, 22 bp, Homo sapiens
cactgggtcaggatagagccca

SEQ ID NO: 6922828 - DNA, 22 bp, Homo sapiens
aacagcagtggcaggagaaggc

SEQ ID NO: 6922829 - DNA, 23 bp, Homo sapiens
acatgtggagagaacagatatct

SEQ ID NO: 6922830 - DNA, 22 bp, Homo sapiens
gtttgcataaagtggatgcagg

SEQ ID NO: 6922831 - DNA, 22 bp, Homo sapiens
gctaagggaccctttctaatgt

SEQ ID NO: 6922832 - DNA, 22 bp, Homo sapiens
tttgagaatggtaagtggatcg

SEQ ID NO: 6922833 - DNA, 22 bp, Homo sapiens
acagctgcatgatggtccagat

SEQ ID NO: 6922834 - DNA, 22 bp, Homo sapiens
atggctgcagccggccctgcgc

SEQ ID NO: 6922835 - DNA, 22 bp, Homo sapiens
ctgtgacccagttcctggcacc

SEQ ID NO: 6922836 - DNA, 18 bp, Homo sapiens
agcagtagcgccaggtgc

SEQ ID NO: 6922837 - DNA, 22 bp, Homo sapiens
atatagttgggtttcattctac

SEQ ID NO: 6922838 - DNA, 20 bp, Homo sapiens
tagcaatgagtgttccattt

SEQ ID NO: 6922839 - DNA, 22 bp, Homo sapiens
gtttgcattccaatttagggga

SEQ ID NO: 6922840 - DNA, 22 bp, Homo sapiens
aggagtgttgagttgggttttg

SEQ ID NO: 6922841 - DNA, 22 bp, Homo sapiens
ctgttttctagggctgaggtga

SEQ ID NO: 6922842 - DNA, 22 bp, Homo sapiens
ggctgtgctgagggggaagccc

SEQ ID NO: 6922843 - DNA, 22 bp, Homo sapiens
ccacaaattaggttttgcttgt

SEQ ID NO: 6922844 - DNA, 22 bp, Homo sapiens
ctgcatcctaacctccatgcag

SEQ ID NO: 6922845 - DNA, 22 bp, Homo sapiens
tttaagagctagtatgtcattt

SEQ ID NO: 6922846 - DNA, 22 bp, Homo sapiens
ggttcagtttacattaaaatct

SEQ ID NO: 6922847 - DNA, 22 bp, Homo sapiens
cattagcagtcattactgtgct

SEQ ID NO: 6922848 - DNA, 22 bp, Homo sapiens
caggagcagagggtggtcagca

SEQ ID NO: 6922849 - DNA, 18 bp, Homo sapiens
agtgttaagtaagtagca

SEQ ID NO: 6922850 - DNA, 23 bp, Homo sapiens
tgcaggggaggcttaaagcaggt

SEQ ID NO: 6922851 - DNA, 22 bp, Homo sapiens
acaaacttcccagacaagctcc

SEQ ID NO: 6922852 - DNA, 22 bp, Homo sapiens
tttaaacctatctaagaaatag

SEQ ID NO: 6922853 - DNA, 22 bp, Homo sapiens
cactagaaccaatgacatttct

SEQ ID NO: 6922854 - DNA, 22 bp, Homo sapiens
taaatgctcaataaatgttgct

SEQ ID NO: 6922855 - DNA, 22 bp, Homo sapiens
tcaaagatgggttttgtttgat

SEQ ID NO: 6922856 - DNA, 22 bp, Homo sapiens
aagctttggagaggcgggcagg

SEQ ID NO: 6922857 - DNA, 22 bp, Homo sapiens
tgcccacattctgaagctccct

SEQ ID NO: 6922858 - DNA, 22 bp, Homo sapiens
tgagaggatattttgggaggat

SEQ ID NO: 6922859 - DNA, 22 bp, Homo sapiens
tgcagagagatatggcaagagg

SEQ ID NO: 6922860 - DNA, 22 bp, Homo sapiens
aaggtgtcattgtttatggaga

SEQ ID NO: 6922861 - DNA, 22 bp, Homo sapiens
taagacagggtctattcttagt

SEQ ID NO: 6922862 - DNA, 22 bp, Homo sapiens
gggctgagaagttgatcccaag

SEQ ID NO: 6922863 - DNA, 22 bp, Homo sapiens
taaaactgcttggtatggtcta

SEQ ID NO: 6922864 - DNA, 22 bp, Homo sapiens
aggagccaaacatattgagaga

SEQ ID NO: 6922865 - DNA, 22 bp, Homo sapiens
cccttagatgtcttcctccgga

SEQ ID NO: 6922866 - DNA, 22 bp, Homo sapiens
gtgcggatcggtgtcctccaaa

SEQ ID NO: 6922867 - DNA, 22 bp, Homo sapiens
tctctgggacactgggtcagtt

SEQ ID NO: 6922868 - DNA, 22 bp, Homo sapiens
tatgctaatgacactctagaaa

SEQ ID NO: 6922869 - DNA, 22 bp, Homo sapiens
agctgttgaaaatggtgtccta

SEQ ID NO: 6922870 - DNA, 22 bp, Homo sapiens
aggcaagccgtgcctgtctcaa

SEQ ID NO: 6922871 - DNA, 20 bp, Homo sapiens
taagggctaccagtgtttgg

SEQ ID NO: 6922872 - DNA, 22 bp, Homo sapiens
atgtatcaagggaaagagagta

SEQ ID NO: 6922873 - DNA, 22 bp, Homo sapiens
gagctggactttcagatacatc

SEQ ID NO: 6922874 - DNA, 22 bp, Homo sapiens
ctgcaaaagtaattgcaggttt

SEQ ID NO: 6922875 - DNA, 22 bp, Homo sapiens
ggcttcccaggcggtccccaca

SEQ ID NO: 6922876 - DNA, 22 bp, Homo sapiens
tgccgtgtcccattgtgctctg

SEQ ID NO: 6922877 - DNA, 22 bp, Homo sapiens
ttacaagataacggagaaagca

SEQ ID NO: 6922878 - DNA, 22 bp, Homo sapiens
cagccctcaaaccacttccagg

SEQ ID NO: 6922879 - DNA, 22 bp, Homo sapiens
aaagccttggtcatctggttcc

SEQ ID NO: 6922880 - DNA, 22 bp, Homo sapiens
agagtccaggggcctggtgtgt

SEQ ID NO: 6922881 - DNA, 22 bp, Homo sapiens
tataggaagtattcaaagactg

SEQ ID NO: 6922882 - DNA, 21 bp, Homo sapiens
tctcactgtctgctttgttta

SEQ ID NO: 6922883 - DNA, 22 bp, Homo sapiens
tttctcctgtgaggtcagaagt

SEQ ID NO: 6922884 - DNA, 22 bp, Homo sapiens
ctgttatttctgccaggtgagt

SEQ ID NO: 6922885 - DNA, 16 bp, Homo sapiens
ccaggaacacacagct

SEQ ID NO: 6922886 - DNA, 21 bp, Homo sapiens
agcctgcaatgtaggtaccgg

SEQ ID NO: 6922887 - DNA, 23 bp, Homo sapiens
ggcatgcaatggacagagctgga

SEQ ID NO: 6922888 - DNA, 20 bp, Homo sapiens
ctgtggcatctgtcatggtg

SEQ ID NO: 6922889 - DNA, 22 bp, Homo sapiens
tggctgttactcttttcatttc

SEQ ID NO: 6922890 - DNA, 22 bp, Homo sapiens
ttttcaccatagacactggtcc

SEQ ID NO: 6922891 - DNA, 19 bp, Homo sapiens
atagagacagagtttaatc

SEQ ID NO: 6922892 - DNA, 19 bp, Homo sapiens
ctcttaaattgtctcttgc

SEQ ID NO: 6922893 - DNA, 22 bp, Homo sapiens
cagctgtttcagtagcgttact

SEQ ID NO: 6922894 - DNA, 22 bp, Homo sapiens
aaactgacaatctcagtcctat

SEQ ID NO: 6922895 - DNA, 20 bp, Homo sapiens
aggtccactgaggctgcctc

SEQ ID NO: 6922896 - DNA, 22 bp, Homo sapiens
tttgtgattaattttcaacctc

SEQ ID NO: 6922897 - DNA, 23 bp, Homo sapiens
tctatacatactgcagcctctgg

SEQ ID NO: 6922898 - DNA, 22 bp, Homo sapiens
acagagcatataaagtgctttg

SEQ ID NO: 6922899 - DNA, 22 bp, Homo sapiens
ctgctcagtaatagtcctatct

SEQ ID NO: 6922900 - DNA, 23 bp, Homo sapiens
agtgcatgcttgacttagcaagc

SEQ ID NO: 6922901 - DNA, 22 bp, Homo sapiens
acagatggtagcattatgttgg

SEQ ID NO: 6922902 - DNA, 22 bp, Homo sapiens
tttttgtctattcactgattca

SEQ ID NO: 6922903 - DNA, 22 bp, Homo sapiens
tttcacagatcctacagcttgt

SEQ ID NO: 6922904 - DNA, 22 bp, Homo sapiens
cttttagctgtttccatggcaa

SEQ ID NO: 6922905 - DNA, 22 bp, Homo sapiens
atcctcagacttcacgttccat

SEQ ID NO: 6922906 - DNA, 22 bp, Homo sapiens
gcagtgtgtctggagtacatgg

SEQ ID NO: 6922907 - DNA, 22 bp, Homo sapiens
atagaatcctgcagcaagcctt

SEQ ID NO: 6922908 - DNA, 22 bp, Homo sapiens
cctgggaatgatgaccttgcct

SEQ ID NO: 6922909 - DNA, 20 bp, Homo sapiens
attctgctttctgatagagc

SEQ ID NO: 6922910 - DNA, 22 bp, Homo sapiens
tacctgcagcgggaatccatta

SEQ ID NO: 6922911 - DNA, 21 bp, Homo sapiens
ttgtcctttagggcttgtctg

SEQ ID NO: 6922912 - DNA, 22 bp, Homo sapiens
ctctccagggcatgagttccac

SEQ ID NO: 6922913 - DNA, 22 bp, Homo sapiens
ccttggagacaggtttgctttc

SEQ ID NO: 6922914 - DNA, 22 bp, Homo sapiens
ttaggaatgagatttctagtga

SEQ ID NO: 6922915 - DNA, 22 bp, Homo sapiens
cataatgtgtgtcatacagact

SEQ ID NO: 6922916 - DNA, 22 bp, Homo sapiens
tccctgagctcacatggcagga

SEQ ID NO: 6922917 - DNA, 22 bp, Homo sapiens
cctggcttcagcattgccctct

SEQ ID NO: 6922918 - DNA, 22 bp, Homo sapiens
ccaggtctcgggtctgctcgtg

SEQ ID NO: 6922919 - DNA, 22 bp, Homo sapiens
tatagactgtgaaatttaggca

SEQ ID NO: 6922920 - DNA, 22 bp, Homo sapiens
ggtctgccctgggtggaggcgc

SEQ ID NO: 6922921 - DNA, 22 bp, Homo sapiens
cattagcacagtttcagtccac

SEQ ID NO: 6922922 - DNA, 22 bp, Homo sapiens
cagctctgcttccttgtacagg

SEQ ID NO: 6922923 - DNA, 22 bp, Homo sapiens
ggtgggagccaacacccttctg

SEQ ID NO: 6922924 - DNA, 22 bp, Homo sapiens
aggcttgtggggaatctgtgtg

SEQ ID NO: 6922925 - DNA, 22 bp, Homo sapiens
aaagccatctgctggttcgcat

SEQ ID NO: 6922926 - DNA, 22 bp, Homo sapiens
agtttgtatgccaacagcaaag

SEQ ID NO: 6922927 - DNA, 22 bp, Homo sapiens
ctgaaaagctttgaaccgttaa

SEQ ID NO: 6922928 - DNA, 19 bp, Homo sapiens
tctgaggcttctccccttg

SEQ ID NO: 6922929 - DNA, 22 bp, Homo sapiens
gcatggcaagatcaggagacca

SEQ ID NO: 6922930 - DNA, 22 bp, Homo sapiens
gacttcatgacattcaggtcag

SEQ ID NO: 6922931 - DNA, 22 bp, Homo sapiens
cagcctgcctcagtttccctct

SEQ ID NO: 6922932 - DNA, 22 bp, Homo sapiens
agatcagtaagaggaagaatgg

SEQ ID NO: 6922933 - DNA, 22 bp, Homo sapiens
tgacatgtgtctccttccgtct

SEQ ID NO: 6922934 - DNA, 22 bp, Homo sapiens
ttacagtcttaaactcctgggc

SEQ ID NO: 6922935 - DNA, 22 bp, Homo sapiens
agctgccccgaggcggcgggaa

SEQ ID NO: 6922936 - DNA, 22 bp, Homo sapiens
tgcccttaggaaggctcaccaa

SEQ ID NO: 6922937 - DNA, 22 bp, Homo sapiens
attctagctgagtatcagcccc

SEQ ID NO: 6922938 - DNA, 22 bp, Homo sapiens
agtcaggaagctggagctgggg

SEQ ID NO: 6922939 - DNA, 22 bp, Homo sapiens
aaatcatgttggcacaataaaa

SEQ ID NO: 6922940 - DNA, 22 bp, Homo sapiens
ccaagggcatcttgcatgctgg

SEQ ID NO: 6922941 - DNA, 22 bp, Homo sapiens
tcctctgaagaaaaggagcagg

SEQ ID NO: 6922942 - DNA, 22 bp, Homo sapiens
taacaagagcacctgggaatgg

SEQ ID NO: 6922943 - DNA, 23 bp, Homo sapiens
gggcagttatgttgtccttggct

SEQ ID NO: 6922944 - DNA, 23 bp, Homo sapiens
gaggaaagaatatagatgcaatc

SEQ ID NO: 6922945 - DNA, 22 bp, Homo sapiens
caggtttcattggcagcttcat

SEQ ID NO: 6922946 - DNA, 22 bp, Homo sapiens
gggaagtttgtttggactggga

SEQ ID NO: 6922947 - DNA, 22 bp, Homo sapiens
tctcacactatttcaggtgact

SEQ ID NO: 6922948 - DNA, 22 bp, Homo sapiens
tccaagcaacaactaatttaca

SEQ ID NO: 6922949 - DNA, 22 bp, Homo sapiens
atgtcagagcttccacaatagt

SEQ ID NO: 6922950 - DNA, 22 bp, Homo sapiens
tgctgatgctttcccgttcaca

SEQ ID NO: 6922951 - DNA, 20 bp, Homo sapiens
ttgttgagctcttcaaagaa

SEQ ID NO: 6922952 - DNA, 22 bp, Homo sapiens
tttatgtcaaaactacagttgg

SEQ ID NO: 6922953 - DNA, 18 bp, Homo sapiens
tgagagcattcgaggcaa

SEQ ID NO: 6922954 - DNA, 22 bp, Homo sapiens
gcagaattgatggagaacttaa

SEQ ID NO: 6922955 - DNA, 22 bp, Homo sapiens
tgacagagccaagatcagtact

SEQ ID NO: 6922956 - DNA, 22 bp, Homo sapiens
gtggccagccagggtgctgatg

SEQ ID NO: 6922957 - DNA, 22 bp, Homo sapiens
tgtcctgcaattaaggaagaca

SEQ ID NO: 6922958 - DNA, 19 bp, Homo sapiens
cagagtccttgaccagtcc

SEQ ID NO: 6922959 - DNA, 22 bp, Homo sapiens
aatctcaaagatggccagaaga

SEQ ID NO: 6922960 - DNA, 22 bp, Homo sapiens
agagatgaagggcattccccag

SEQ ID NO: 6922961 - DNA, 21 bp, Homo sapiens
agacagtaactcttctactcc

SEQ ID NO: 6922962 - DNA, 22 bp, Homo sapiens
gtgcagcaggggccctctcacc

SEQ ID NO: 6922963 - DNA, 21 bp, Homo sapiens
aacattgattcatttggctat

SEQ ID NO: 6922964 - DNA, 22 bp, Homo sapiens
ttctgagctacatagtactggg

SEQ ID NO: 6922965 - DNA, 22 bp, Homo sapiens
tagagcagtgttgtccatcaga

SEQ ID NO: 6922966 - DNA, 22 bp, Homo sapiens
tcacagtgtcgtccttgggtgt

SEQ ID NO: 6922967 - DNA, 22 bp, Homo sapiens
tgaatctcgaggctatagaagt

SEQ ID NO: 6922968 - DNA, 22 bp, Homo sapiens
agccacaggtgttggccagtgt

SEQ ID NO: 6922969 - DNA, 22 bp, Homo sapiens
gaggcctctgtcccgccaggga

SEQ ID NO: 6922970 - DNA, 22 bp, Homo sapiens
aacttgctggcacgtgtatgga

SEQ ID NO: 6922971 - DNA, 18 bp, Homo sapiens
agcttccctctgagaggg

SEQ ID NO: 6922972 - DNA, 22 bp, Homo sapiens
acagctgcaaattgttagagga

SEQ ID NO: 6922973 - DNA, 22 bp, Homo sapiens
cagccaatagcaagggaagctg

SEQ ID NO: 6922974 - DNA, 22 bp, Homo sapiens
ttttagcactaagtgatatgct

SEQ ID NO: 6922975 - DNA, 22 bp, Homo sapiens
ttagcaggaagagttggctgga

SEQ ID NO: 6922976 - DNA, 22 bp, Homo sapiens
gtggatctgatgtttttcgcca

SEQ ID NO: 6922977 - DNA, 22 bp, Homo sapiens
acgaggagcctgtggcctggta

SEQ ID NO: 6922978 - DNA, 22 bp, Homo sapiens
gccaaatcacagggccaaaagc

SEQ ID NO: 6922979 - DNA, 22 bp, Homo sapiens
tagaaacaaagacctgggtgct

SEQ ID NO: 6922980 - DNA, 22 bp, Homo sapiens
cagagcagtctggagatccagc

SEQ ID NO: 6922981 - DNA, 22 bp, Homo sapiens
aacaggaattgcaggcagatct

SEQ ID NO: 6922982 - DNA, 22 bp, Homo sapiens
cctgctgtgaaactggcatatg

SEQ ID NO: 6922983 - DNA, 22 bp, Homo sapiens
taggcaagttgcccaatctctc

SEQ ID NO: 6922984 - DNA, 22 bp, Homo sapiens
tgtgggtggtaaaatacaatga

SEQ ID NO: 6922985 - DNA, 18 bp, Homo sapiens
tgcctgccccgtaagggt

SEQ ID NO: 6922986 - DNA, 22 bp, Homo sapiens
agctgctatctccagatgtttg

SEQ ID NO: 6922987 - DNA, 22 bp, Homo sapiens
gctatgttcccttttgctataa

SEQ ID NO: 6922988 - DNA, 22 bp, Homo sapiens
aaatgctgtaactgatattctg

SEQ ID NO: 6922989 - DNA, 22 bp, Homo sapiens
tttcagaaggggagaaaggtca

SEQ ID NO: 6922990 - DNA, 22 bp, Homo sapiens
tcagtgtgttaacccaggggca

SEQ ID NO: 6922991 - DNA, 22 bp, Homo sapiens
tgacaagttctaataagaaatg

SEQ ID NO: 6922992 - DNA, 22 bp, Homo sapiens
gccgcggcactggcctggctcc

SEQ ID NO: 6922993 - DNA, 22 bp, Homo sapiens
atgtctgcaaatatctgccagt

SEQ ID NO: 6922994 - DNA, 22 bp, Homo sapiens
gaggcccagcagcgcaggtctt

SEQ ID NO: 6922995 - DNA, 22 bp, Homo sapiens
tttgttcattaaaagtgctgta

SEQ ID NO: 6922996 - DNA, 22 bp, Homo sapiens
gactgtgggctctgtttgtctt

SEQ ID NO: 6922997 - DNA, 22 bp, Homo sapiens
aacagccactgatactgaatag

SEQ ID NO: 6922998 - DNA, 22 bp, Homo sapiens
gtggaggagaggcgccttgcgg

SEQ ID NO: 6922999 - DNA, 22 bp, Homo sapiens
tgagatggggtcatgctttgtc

SEQ ID NO: 6923000 - DNA, 22 bp, Homo sapiens
aagtatatactaaatgttaatc

SEQ ID NO: 6923001 - DNA, 22 bp, Homo sapiens
gcctaggtaccagcagagagcc

SEQ ID NO: 6923002 - DNA, 22 bp, Homo sapiens
tcttaattgagaacagtgtagg

SEQ ID NO: 6923003 - DNA, 22 bp, Homo sapiens
gcctgcctgctgtcatctgcct

SEQ ID NO: 6923004 - DNA, 22 bp, Homo sapiens
tcctaacgctggttctatcaac

SEQ ID NO: 6923005 - DNA, 22 bp, Homo sapiens
tcttcaaagcatatgcaggcat

SEQ ID NO: 6923006 - DNA, 17 bp, Homo sapiens
ctctttataaagagtta

SEQ ID NO: 6923007 - DNA, 17 bp, Homo sapiens
ttgcagactttttatta

SEQ ID NO: 6923008 - DNA, 22 bp, Homo sapiens
aatcagtgtgtaaagtggctgc

SEQ ID NO: 6923009 - DNA, 22 bp, Homo sapiens
catctacctccaccctatatat

SEQ ID NO: 6923010 - DNA, 22 bp, Homo sapiens
ttattttggtaaatgtttgcct

SEQ ID NO: 6923011 - DNA, 19 bp, Homo sapiens
agacagtggctaggactta

SEQ ID NO: 6923012 - DNA, 22 bp, Homo sapiens
acttgggaaagaagtttcaccg

SEQ ID NO: 6923013 - DNA, 22 bp, Homo sapiens
tctcagctcttttttcacagaa

SEQ ID NO: 6923014 - DNA, 22 bp, Homo sapiens
acatagtaagtgctcagtaaat

SEQ ID NO: 6923015 - DNA, 22 bp, Homo sapiens
atgtctttcttatggtctgttg

SEQ ID NO: 6923016 - DNA, 22 bp, Homo sapiens
gcacagtgctgctaagattgag

SEQ ID NO: 6923017 - DNA, 22 bp, Homo sapiens
cccgacatgagacatggcacag

SEQ ID NO: 6923018 - DNA, 22 bp, Homo sapiens
tcaggaaaggcagagtgtctgt

SEQ ID NO: 6923019 - DNA, 22 bp, Homo sapiens
tccttggagtcatgatggaggt

SEQ ID NO: 6923020 - DNA, 22 bp, Homo sapiens
atcatgttggctctgacaaaaa

SEQ ID NO: 6923021 - DNA, 23 bp, Homo sapiens
ttgctttcatcatgagatgctcc

SEQ ID NO: 6923022 - DNA, 22 bp, Homo sapiens
tttgacactgggagtgtgggtg

SEQ ID NO: 6923023 - DNA, 22 bp, Homo sapiens
attaaattggatctgcatagtt

SEQ ID NO: 6923024 - DNA, 22 bp, Homo sapiens
ttggctttgtgagagggcttgg

SEQ ID NO: 6923025 - DNA, 22 bp, Homo sapiens
ctacatttacacagttaggctt

SEQ ID NO: 6923026 - DNA, 22 bp, Homo sapiens
tttagcttttgtgtcagataag

SEQ ID NO: 6923027 - DNA, 22 bp, Homo sapiens
atccagttccaaagatcattta

SEQ ID NO: 6923028 - DNA, 19 bp, Homo sapiens
ccactgaggcttggttctt

SEQ ID NO: 6923029 - DNA, 22 bp, Homo sapiens
cctagagccgcacctcctccac

SEQ ID NO: 6923030 - DNA, 22 bp, Homo sapiens
atcaaggctttggacatagcaa

SEQ ID NO: 6923031 - DNA, 22 bp, Homo sapiens
tgtcagtgatttgtagggaatt

SEQ ID NO: 6923032 - DNA, 22 bp, Homo sapiens
tttgcaaaatgaggtgaagagt

SEQ ID NO: 6923033 - DNA, 22 bp, Homo sapiens
cagccctgtccagcagagggtg

SEQ ID NO: 6923034 - DNA, 19 bp, Homo sapiens
gacaggacgaagggaagtt

SEQ ID NO: 6923035 - DNA, 22 bp, Homo sapiens
ggggcctccagcactaggcagc

SEQ ID NO: 6923036 - DNA, 22 bp, Homo sapiens
acccgccgcacgtccaggctga

SEQ ID NO: 6923037 - DNA, 22 bp, Homo sapiens
gctagtgagctctttgtcatct

SEQ ID NO: 6923038 - DNA, 20 bp, Homo sapiens
tctgcagataagggaaagac

SEQ ID NO: 6923039 - DNA, 22 bp, Homo sapiens
aggctctgacgtcacacgtggc

SEQ ID NO: 6923040 - DNA, 22 bp, Homo sapiens
accagccctcaggtcagatact

SEQ ID NO: 6923041 - DNA, 22 bp, Homo sapiens
acagttatatacatgtagctgt

SEQ ID NO: 6923042 - DNA, 22 bp, Homo sapiens
atacataattacttccgatgtt

SEQ ID NO: 6923043 - DNA, 18 bp, Homo sapiens
cctcaggggacctggcag

SEQ ID NO: 6923044 - DNA, 22 bp, Homo sapiens
atgggctgggaatacacagggg

SEQ ID NO: 6923045 - DNA, 22 bp, Homo sapiens
gtaatgaatgaaagaaactggg

SEQ ID NO: 6923046 - DNA, 21 bp, Homo sapiens
tttctaaggaggaagaaaaga

SEQ ID NO: 6923047 - DNA, 22 bp, Homo sapiens
gactccagggattggaagatgt

SEQ ID NO: 6923048 - DNA, 22 bp, Homo sapiens
ttggcattggagatgcaagaac

SEQ ID NO: 6923049 - DNA, 22 bp, Homo sapiens
ttggctgaaggaataaatggat

SEQ ID NO: 6923050 - DNA, 22 bp, Homo sapiens
cagtcttaggagaaactacaga

SEQ ID NO: 6923051 - DNA, 22 bp, Homo sapiens
atccatttttgcaaagttgttc

SEQ ID NO: 6923052 - DNA, 22 bp, Homo sapiens
cctggacttgatattctctttc

SEQ ID NO: 6923053 - DNA, 22 bp, Homo sapiens
ggagttcacgatgttggccagg

SEQ ID NO: 6923054 - DNA, 22 bp, Homo sapiens
ctgccatgtagtctatggggcg

SEQ ID NO: 6923055 - DNA, 22 bp, Homo sapiens
gcttccttccttacattggtgg

SEQ ID NO: 6923056 - DNA, 22 bp, Homo sapiens
gagaaagaaagggaagtttgtt

SEQ ID NO: 6923057 - DNA, 22 bp, Homo sapiens
tccttaagttctccaaggccag

SEQ ID NO: 6923058 - DNA, 22 bp, Homo sapiens
tgagttgaaagactgacttctg

SEQ ID NO: 6923059 - DNA, 23 bp, Homo sapiens
tgctgccctgccttcagctctcc

SEQ ID NO: 6923060 - DNA, 21 bp, Homo sapiens
gaacccagcagcagtgctctg

SEQ ID NO: 6923061 - DNA, 22 bp, Homo sapiens
ttgcaaggtgataaaagaatga

SEQ ID NO: 6923062 - DNA, 22 bp, Homo sapiens
caagattcagagtcttctaacc

SEQ ID NO: 6923063 - DNA, 22 bp, Homo sapiens
ttctgtgcgtaggcgatgcagt

SEQ ID NO: 6923064 - DNA, 21 bp, Homo sapiens
tgactaattgtgataaagtgc

SEQ ID NO: 6923065 - DNA, 22 bp, Homo sapiens
aaaggagttactcataaagctt

SEQ ID NO: 6923066 - DNA, 22 bp, Homo sapiens
tgtcatatagatattagacagg

SEQ ID NO: 6923067 - DNA, 22 bp, Homo sapiens
ggcagggaagctggcatcacgg

SEQ ID NO: 6923068 - DNA, 17 bp, Homo sapiens
gtgcaactactggaaga

SEQ ID NO: 6923069 - DNA, 23 bp, Homo sapiens
gagtgcagaatagacatgcagtg

SEQ ID NO: 6923070 - DNA, 22 bp, Homo sapiens
tgtttgcttacttgtatgctgc

SEQ ID NO: 6923071 - DNA, 22 bp, Homo sapiens
gcgcgacatttttaacactaca

SEQ ID NO: 6923072 - DNA, 22 bp, Homo sapiens
tacagtacagtctagactctgg

SEQ ID NO: 6923073 - DNA, 22 bp, Homo sapiens
aagagtcttatagtgtaattaa

SEQ ID NO: 6923074 - DNA, 22 bp, Homo sapiens
catgtgtgtggacgagcgtggc

SEQ ID NO: 6923075 - DNA, 22 bp, Homo sapiens
tacagaataaagcgtgaagctt

SEQ ID NO: 6923076 - DNA, 22 bp, Homo sapiens
aaactatccctgccataatttt

SEQ ID NO: 6923077 - DNA, 22 bp, Homo sapiens
cgaatcttgaggtttcatgagg

SEQ ID NO: 6923078 - DNA, 17 bp, Homo sapiens
catgtgtatgtgggagt

SEQ ID NO: 6923079 - DNA, 22 bp, Homo sapiens
gtcatcttcctagtgttaacta

SEQ ID NO: 6923080 - DNA, 22 bp, Homo sapiens
gttcttcctggaagtggatttc

SEQ ID NO: 6923081 - DNA, 22 bp, Homo sapiens
cagattctgaagtctagctgct

SEQ ID NO: 6923082 - DNA, 22 bp, Homo sapiens
aatggctgatgccaggtctagg

SEQ ID NO: 6923083 - DNA, 22 bp, Homo sapiens
agctatgtaacagtgccatgga

SEQ ID NO: 6923084 - DNA, 22 bp, Homo sapiens
actgttaagtatgaagtaaggc

SEQ ID NO: 6923085 - DNA, 22 bp, Homo sapiens
gcacagtgcaccactttgaaaa

SEQ ID NO: 6923086 - DNA, 22 bp, Homo sapiens
ctgttaattctagatggtgagt

SEQ ID NO: 6923087 - DNA, 23 bp, Homo sapiens
cccacatgtctgagtcagtgcca

SEQ ID NO: 6923088 - DNA, 19 bp, Homo sapiens
caggccagtgtcagggggc

SEQ ID NO: 6923089 - DNA, 22 bp, Homo sapiens
ttggcagagccccagccttgga

SEQ ID NO: 6923090 - DNA, 22 bp, Homo sapiens
aagcaattgagtgaaacctctt

SEQ ID NO: 6923091 - DNA, 20 bp, Homo sapiens
tgctgggtgggcagctgtaa

SEQ ID NO: 6923092 - DNA, 22 bp, Homo sapiens
tgaagcataagagggttctttt

SEQ ID NO: 6923093 - DNA, 22 bp, Homo sapiens
tgaggactttccatgttaatgt

SEQ ID NO: 6923094 - DNA, 22 bp, Homo sapiens
gggtctctgagcttccaagata

SEQ ID NO: 6923095 - DNA, 22 bp, Homo sapiens
gggtcccaggaaggagcagtgt

SEQ ID NO: 6923096 - DNA, 22 bp, Homo sapiens
cctgtgcctgcctgtgagttct

SEQ ID NO: 6923097 - DNA, 23 bp, Homo sapiens
actgctttattcatgaggctctc

SEQ ID NO: 6923098 - DNA, 22 bp, Homo sapiens
aaatgcagcagctaattgaaaa

SEQ ID NO: 6923099 - DNA, 22 bp, Homo sapiens
tttcctgcctcacctcagaagt

SEQ ID NO: 6923100 - DNA, 22 bp, Homo sapiens
tctttgtctgaacagggacatt

SEQ ID NO: 6923101 - DNA, 22 bp, Homo sapiens
ccaagtcctgctgccactctac

SEQ ID NO: 6923102 - DNA, 22 bp, Homo sapiens
agttctgcctatatagaaactc

SEQ ID NO: 6923103 - DNA, 22 bp, Homo sapiens
gagctcttagatagggcaggaa

SEQ ID NO: 6923104 - DNA, 22 bp, Homo sapiens
tgtgatctctataggattcaat

SEQ ID NO: 6923105 - DNA, 19 bp, Homo sapiens
ccagtgccggcgctgggga

SEQ ID NO: 6923106 - DNA, 22 bp, Homo sapiens
tgcgtctctgtcctcaaagacc

SEQ ID NO: 6923107 - DNA, 22 bp, Homo sapiens
ctggcttggcttattcatggaa

SEQ ID NO: 6923108 - DNA, 22 bp, Homo sapiens
tctgttctttccaacaagacag

SEQ ID NO: 6923109 - DNA, 22 bp, Homo sapiens
ttcatactgtgtttccaagttt

SEQ ID NO: 6923110 - DNA, 22 bp, Homo sapiens
ctattactgacttctgtattta

SEQ ID NO: 6923111 - DNA, 22 bp, Homo sapiens
ttactgctgttaggatattttt

SEQ ID NO: 6923112 - DNA, 22 bp, Homo sapiens
ttgacacaatgtatattttcaa

SEQ ID NO: 6923113 - DNA, 22 bp, Homo sapiens
ctgacatgtataagctttaagt

SEQ ID NO: 6923114 - DNA, 22 bp, Homo sapiens
acatccgcaggttataaagccc

SEQ ID NO: 6923115 - DNA, 22 bp, Homo sapiens
ttcctaagtcctgccagcagtc

SEQ ID NO: 6923116 - DNA, 22 bp, Homo sapiens
aaatgctgtcagtgttattgga

SEQ ID NO: 6923117 - DNA, 22 bp, Homo sapiens
gatacatttcaaggaggactgg

SEQ ID NO: 6923118 - DNA, 22 bp, Homo sapiens
acagcgggaatgtggtaggtgg

SEQ ID NO: 6923119 - DNA, 22 bp, Homo sapiens
gtgctgaatttgagaaactctg

SEQ ID NO: 6923120 - DNA, 22 bp, Homo sapiens
tttgctgagttttctcctaaga

SEQ ID NO: 6923121 - DNA, 22 bp, Homo sapiens
gctgtacagtttactaggtggg

SEQ ID NO: 6923122 - DNA, 22 bp, Homo sapiens
acactaatgagaaaggaattaa

SEQ ID NO: 6923123 - DNA, 22 bp, Homo sapiens
gtgaagcagggaaggaaaggat

SEQ ID NO: 6923124 - DNA, 18 bp, Homo sapiens
aggactcctgggagttgg

SEQ ID NO: 6923125 - DNA, 22 bp, Homo sapiens
ccagagctgatgggcccagggt

SEQ ID NO: 6923126 - DNA, 22 bp, Homo sapiens
ccagcctgggtgttagaagaca

SEQ ID NO: 6923127 - DNA, 22 bp, Homo sapiens
atcagaggtgagggagagcccc

SEQ ID NO: 6923128 - DNA, 22 bp, Homo sapiens
tcagtcctcctctcatagagag

SEQ ID NO: 6923129 - DNA, 23 bp, Homo sapiens
catggggagcagtgctcctgacc

SEQ ID NO: 6923130 - DNA, 22 bp, Homo sapiens
ggcactgattccattcatgaag

SEQ ID NO: 6923131 - DNA, 22 bp, Homo sapiens
catgagagacattctgtgtgaa

SEQ ID NO: 6923132 - DNA, 22 bp, Homo sapiens
gcagggtgtgtctcatacagtt

SEQ ID NO: 6923133 - DNA, 22 bp, Homo sapiens
tgaaggagaaatggaaagtggg

SEQ ID NO: 6923134 - DNA, 22 bp, Homo sapiens
tgacttgaagcaaaatagaatt

SEQ ID NO: 6923135 - DNA, 22 bp, Homo sapiens
taacatagtgctttatctggtg

SEQ ID NO: 6923136 - DNA, 22 bp, Homo sapiens
gtccagtcactgtcaatgttcc

SEQ ID NO: 6923137 - DNA, 22 bp, Homo sapiens
cagggccattggcgtggctgtc

SEQ ID NO: 6923138 - DNA, 22 bp, Homo sapiens
atgaggaggccagtaagagcct

SEQ ID NO: 6923139 - DNA, 22 bp, Homo sapiens
tgtatccatggtggtcaatgac

SEQ ID NO: 6923140 - DNA, 22 bp, Homo sapiens
agcccagccactattaaatgtt

SEQ ID NO: 6923141 - DNA, 22 bp, Homo sapiens
agctccaggtagtgccttatcg

SEQ ID NO: 6923142 - DNA, 22 bp, Homo sapiens
tgtgttcaatcaccaaaggtat

SEQ ID NO: 6923143 - DNA, 22 bp, Homo sapiens
tctgataggtggtagaaggagg

SEQ ID NO: 6923144 - DNA, 22 bp, Homo sapiens
taggaacccgcagcagtccgag

SEQ ID NO: 6923145 - DNA, 22 bp, Homo sapiens
ctagaatactcgtattattccc

SEQ ID NO: 6923146 - DNA, 22 bp, Homo sapiens
tcacagaataaattgagaagac

SEQ ID NO: 6923147 - DNA, 22 bp, Homo sapiens
tgaaggctgtcacctgcacctt

SEQ ID NO: 6923148 - DNA, 18 bp, Homo sapiens
gcagtaggcgcgcaggac

SEQ ID NO: 6923149 - DNA, 22 bp, Homo sapiens
acaggggacctaggaccctcgg

SEQ ID NO: 6923150 - DNA, 22 bp, Homo sapiens
gccagcccctccatcctgttca

SEQ ID NO: 6923151 - DNA, 22 bp, Homo sapiens
gcatgcaggaagttttttggga

SEQ ID NO: 6923152 - DNA, 22 bp, Homo sapiens
gaggccaggggtcagcaattgg

SEQ ID NO: 6923153 - DNA, 22 bp, Homo sapiens
acagggcagcaactttgtgcct

SEQ ID NO: 6923154 - DNA, 22 bp, Homo sapiens
ctcctggctttcccagaccagg

SEQ ID NO: 6923155 - DNA, 23 bp, Homo sapiens
tccttcctttgagaggctccatc

SEQ ID NO: 6923156 - DNA, 21 bp, Homo sapiens
gcatgcctgcatcttagtgtt

SEQ ID NO: 6923157 - DNA, 16 bp, Homo sapiens
gttctattttcgtcct

SEQ ID NO: 6923158 - DNA, 22 bp, Homo sapiens
tcttgcagagtggttcccctct

SEQ ID NO: 6923159 - DNA, 22 bp, Homo sapiens
gccaagctgtttttcagagacg

SEQ ID NO: 6923160 - DNA, 22 bp, Homo sapiens
cctgttggaaggtgtaggcccc

SEQ ID NO: 6923161 - DNA, 22 bp, Homo sapiens
ttcagtgccgtgctgggtcgct

SEQ ID NO: 6923162 - DNA, 22 bp, Homo sapiens
ctctgggttcagccccggccct

SEQ ID NO: 6923163 - DNA, 18 bp, Homo sapiens
gcagctagccaggggggc

SEQ ID NO: 6923164 - DNA, 22 bp, Homo sapiens
ggccagctccttggcagtgcct

SEQ ID NO: 6923165 - DNA, 22 bp, Homo sapiens
taaagatggagatgacctagga

SEQ ID NO: 6923166 - DNA, 22 bp, Homo sapiens
cgtgccttggtcccaaccccca

SEQ ID NO: 6923167 - DNA, 22 bp, Homo sapiens
ccggtctgtgtacttgctggcc

SEQ ID NO: 6923168 - DNA, 22 bp, Homo sapiens
ctctgtgattctcatgtaccac

SEQ ID NO: 6923169 - DNA, 22 bp, Homo sapiens
tgccaatgaagactaaaccgcc

SEQ ID NO: 6923170 - DNA, 22 bp, Homo sapiens
cagagctggagggaaccctggc

SEQ ID NO: 6923171 - DNA, 22 bp, Homo sapiens
ctgcaggcttccagggctgtgg

SEQ ID NO: 6923172 - DNA, 22 bp, Homo sapiens
tttggaaataattccatctcat

SEQ ID NO: 6923173 - DNA, 22 bp, Homo sapiens
agaccatgggctcctgggacat

SEQ ID NO: 6923174 - DNA, 22 bp, Homo sapiens
tcagattttgcacgaggttttg

SEQ ID NO: 6923175 - DNA, 22 bp, Homo sapiens
ttaggaagagctttcaatcact

SEQ ID NO: 6923176 - DNA, 15 bp, Homo sapiens
cacacagacagcttg

SEQ ID NO: 6923177 - DNA, 22 bp, Homo sapiens
tataagatacttggcatagtgc

SEQ ID NO: 6923178 - DNA, 17 bp, Homo sapiens
tacatgtgtatctgatt

SEQ ID NO: 6923179 - DNA, 22 bp, Homo sapiens
tctggatcccaccgccacacac

SEQ ID NO: 6923180 - DNA, 22 bp, Homo sapiens
tctagttttctcaaatgacttg

SEQ ID NO: 6923181 - DNA, 22 bp, Homo sapiens
tgaagcaagtctattgccctgg

SEQ ID NO: 6923182 - DNA, 22 bp, Homo sapiens
tcagtacgtgggcagttccttc

SEQ ID NO: 6923183 - DNA, 22 bp, Homo sapiens
tagtcaaaaggaaggatatgct

SEQ ID NO: 6923184 - DNA, 22 bp, Homo sapiens
tgtcattttctaatctgttgtc

SEQ ID NO: 6923185 - DNA, 22 bp, Homo sapiens
gtgctgaagtgaaattcatcaa

SEQ ID NO: 6923186 - DNA, 22 bp, Homo sapiens
cagcagagcatttggtaggagg

SEQ ID NO: 6923187 - DNA, 22 bp, Homo sapiens
ccacccatgtgactacctcatg

SEQ ID NO: 6923188 - DNA, 22 bp, Homo sapiens
acaagattcaatgaattgattg

SEQ ID NO: 6923189 - DNA, 20 bp, Homo sapiens
tgccaagctctttagatcga

SEQ ID NO: 6923190 - DNA, 22 bp, Homo sapiens
gaatgacattgagccataacat

SEQ ID NO: 6923191 - DNA, 22 bp, Homo sapiens
aagtcacagagttggaagtcag

SEQ ID NO: 6923192 - DNA, 22 bp, Homo sapiens
catgtccttctcattgcctcat

SEQ ID NO: 6923193 - DNA, 23 bp, Homo sapiens
tgagagcctggcagcctgggttc

SEQ ID NO: 6923194 - DNA, 22 bp, Homo sapiens
ccagctgcccactatgtgttct

SEQ ID NO: 6923195 - DNA, 22 bp, Homo sapiens
tggccttgtctctcagaaccgc

SEQ ID NO: 6923196 - DNA, 22 bp, Homo sapiens
cacagcttcccaaagtggacct

SEQ ID NO: 6923197 - DNA, 22 bp, Homo sapiens
aaatcatgtgcagagatcagga

SEQ ID NO: 6923198 - DNA, 22 bp, Homo sapiens
ttaggaaagttcttcagacatg

SEQ ID NO: 6923199 - DNA, 22 bp, Homo sapiens
tacagagagataagtgtaaaag

SEQ ID NO: 6923200 - DNA, 22 bp, Homo sapiens
ttgcccaggctggagtgcagta

SEQ ID NO: 6923201 - DNA, 22 bp, Homo sapiens
tccttcccaggtgtcgccgcct

SEQ ID NO: 6923202 - DNA, 22 bp, Homo sapiens
gcccaggggcagcgcatagtgg

SEQ ID NO: 6923203 - DNA, 22 bp, Homo sapiens
cacaaaggagaatgtcagcata

SEQ ID NO: 6923204 - DNA, 22 bp, Homo sapiens
agtgccaaaaaaaggacttaat

SEQ ID NO: 6923205 - DNA, 20 bp, Homo sapiens
ccagaaggtttgccactttc

SEQ ID NO: 6923206 - DNA, 22 bp, Homo sapiens
gagtccagtgatgttcctggtc

SEQ ID NO: 6923207 - DNA, 22 bp, Homo sapiens
tccctcgaagagcttattcttt

SEQ ID NO: 6923208 - DNA, 22 bp, Homo sapiens
acagtgttttgtctggcagggc

SEQ ID NO: 6923209 - DNA, 22 bp, Homo sapiens
atatgtgatttgacttctggca

SEQ ID NO: 6923210 - DNA, 20 bp, Homo sapiens
aagaaacttgaaagtacaag

SEQ ID NO: 6923211 - DNA, 22 bp, Homo sapiens
ttggctctttcctcacacagga

SEQ ID NO: 6923212 - DNA, 22 bp, Homo sapiens
ttaaacaccaagtgcaaaccac

SEQ ID NO: 6923213 - DNA, 22 bp, Homo sapiens
tccgttgacagggcacttgaca

SEQ ID NO: 6923214 - DNA, 22 bp, Homo sapiens
tgcccgttcattcatacttaac

SEQ ID NO: 6923215 - DNA, 22 bp, Homo sapiens
aaactcttttgcatattagagg

SEQ ID NO: 6923216 - DNA, 19 bp, Homo sapiens
agagatgctaagagtcttt

SEQ ID NO: 6923217 - DNA, 22 bp, Homo sapiens
tcaggctgcagtggcaaaagac

SEQ ID NO: 6923218 - DNA, 22 bp, Homo sapiens
atctgtctatgatatagtctgt

SEQ ID NO: 6923219 - DNA, 22 bp, Homo sapiens
agtgtctgctttgagtcaggtg

SEQ ID NO: 6923220 - DNA, 22 bp, Homo sapiens
attccacagtgtgtggtgagga

SEQ ID NO: 6923221 - DNA, 22 bp, Homo sapiens
tttgcacagatgggatacagca

SEQ ID NO: 6923222 - DNA, 22 bp, Homo sapiens
gatttctagtaagtcatgaagg

SEQ ID NO: 6923223 - DNA, 22 bp, Homo sapiens
gcactcaggactctcatcagta

SEQ ID NO: 6923224 - DNA, 22 bp, Homo sapiens
ggaggccaaggagggcggatca

SEQ ID NO: 6923225 - DNA, 22 bp, Homo sapiens
atccactctcccattcatgcat

SEQ ID NO: 6923226 - DNA, 22 bp, Homo sapiens
ccttcattcattaatttagccc

SEQ ID NO: 6923227 - DNA, 22 bp, Homo sapiens
ctctgggcccacttaaatctgg

SEQ ID NO: 6923228 - DNA, 22 bp, Homo sapiens
aaagtaagggttaatctacttt

SEQ ID NO: 6923229 - DNA, 22 bp, Homo sapiens
gcctcctgacttacactgagct

SEQ ID NO: 6923230 - DNA, 22 bp, Homo sapiens
atgtgagggctcaggctgactg

SEQ ID NO: 6923231 - DNA, 22 bp, Homo sapiens
gtacagaggtgatatttgagct

SEQ ID NO: 6923232 - DNA, 22 bp, Homo sapiens
acagtgtttaaaataatatgct

SEQ ID NO: 6923233 - DNA, 22 bp, Homo sapiens
aaagactagcatttatatgtac

SEQ ID NO: 6923234 - DNA, 22 bp, Homo sapiens
tccagtcaagcttgagaatttc

SEQ ID NO: 6923235 - DNA, 22 bp, Homo sapiens
agtcaccagggtttgctgggtt

SEQ ID NO: 6923236 - DNA, 22 bp, Homo sapiens
gccaggtacatttaagaagcct

SEQ ID NO: 6923237 - DNA, 22 bp, Homo sapiens
tgaggcctgacagaccaagcct

SEQ ID NO: 6923238 - DNA, 22 bp, Homo sapiens
attatgtaggttaggtggttgt

SEQ ID NO: 6923239 - DNA, 22 bp, Homo sapiens
tccagctggggcagtggctggg

SEQ ID NO: 6923240 - DNA, 22 bp, Homo sapiens
gcctgccctgaaagaggtgaag

SEQ ID NO: 6923241 - DNA, 22 bp, Homo sapiens
gtccaccttcttggtcaggccc

SEQ ID NO: 6923242 - DNA, 22 bp, Homo sapiens
cttcttttgaagggcgttgtgt

SEQ ID NO: 6923243 - DNA, 20 bp, Homo sapiens
tatcaatcagaaagaagact

SEQ ID NO: 6923244 - DNA, 22 bp, Homo sapiens
tttcagagaactgagtccttgc

SEQ ID NO: 6923245 - DNA, 22 bp, Homo sapiens
tgttcagcatcaggaaagcttt

SEQ ID NO: 6923246 - DNA, 22 bp, Homo sapiens
aggaagccacgagtggcacggg

SEQ ID NO: 6923247 - DNA, 22 bp, Homo sapiens
ttaaggctgagatctattacgc

SEQ ID NO: 6923248 - DNA, 22 bp, Homo sapiens
aggctgcaaagtgcttgggtgc

SEQ ID NO: 6923249 - DNA, 22 bp, Homo sapiens
tgtctgctacttggttctacca

SEQ ID NO: 6923250 - DNA, 22 bp, Homo sapiens
ttcttcagtcccactagccaca

SEQ ID NO: 6923251 - DNA, 22 bp, Homo sapiens
ctgaatgactgaagtcacaatt

SEQ ID NO: 6923252 - DNA, 21 bp, Homo sapiens
atctttattacgcagagaaga

SEQ ID NO: 6923253 - DNA, 20 bp, Homo sapiens
ggggcaggtttttatggcta

SEQ ID NO: 6923254 - DNA, 22 bp, Homo sapiens
tgacagctgaattccagggata

SEQ ID NO: 6923255 - DNA, 22 bp, Homo sapiens
ttcaggagctggctgcgaagga

SEQ ID NO: 6923256 - DNA, 22 bp, Homo sapiens
ttacacagtggttaagtctggg

SEQ ID NO: 6923257 - DNA, 22 bp, Homo sapiens
tatcagcaactcagagcagtct

SEQ ID NO: 6923258 - DNA, 22 bp, Homo sapiens
agtccagggcttagtcagcggg

SEQ ID NO: 6923259 - DNA, 20 bp, Homo sapiens
tgagggagtattgatttccc

SEQ ID NO: 6923260 - DNA, 22 bp, Homo sapiens
tcccttggaaagtagcctcaca

SEQ ID NO: 6923261 - DNA, 22 bp, Homo sapiens
ctgccagggaggctgggaagtt

SEQ ID NO: 6923262 - DNA, 22 bp, Homo sapiens
tttctattggcgtcactgttgt

SEQ ID NO: 6923263 - DNA, 22 bp, Homo sapiens
gagacaggatttaaccaaagct

SEQ ID NO: 6923264 - DNA, 22 bp, Homo sapiens
tgcctctgtgggccttcctggc

SEQ ID NO: 6923265 - DNA, 22 bp, Homo sapiens
actgtggctcagggaatgcatg

SEQ ID NO: 6923266 - DNA, 22 bp, Homo sapiens
gggcaaaacctgggcatcatga

SEQ ID NO: 6923267 - DNA, 21 bp, Homo sapiens
ggttacaacagttaaacagag

SEQ ID NO: 6923268 - DNA, 22 bp, Homo sapiens
tttctcttcactgtgtgcctca

SEQ ID NO: 6923269 - DNA, 22 bp, Homo sapiens
ccatcctgcaggacctccatat

SEQ ID NO: 6923270 - DNA, 22 bp, Homo sapiens
atctccaggcatttcaagagac

SEQ ID NO: 6923271 - DNA, 19 bp, Homo sapiens
agctgctgattggtggagg

SEQ ID NO: 6923272 - DNA, 22 bp, Homo sapiens
agctcacagggagaaacgacca

SEQ ID NO: 6923273 - DNA, 22 bp, Homo sapiens
ggaggctctgccatctgtcaca

SEQ ID NO: 6923274 - DNA, 20 bp, Homo sapiens
gttagcctcctaaggatttc

SEQ ID NO: 6923275 - DNA, 22 bp, Homo sapiens
agccctgttctgttttagtagc

SEQ ID NO: 6923276 - DNA, 22 bp, Homo sapiens
tgccagggctgctactggctga

SEQ ID NO: 6923277 - DNA, 22 bp, Homo sapiens
gaggagagcctgcactttgacc

SEQ ID NO: 6923278 - DNA, 21 bp, Homo sapiens
gcacatgagggagggcatgcc

SEQ ID NO: 6923279 - DNA, 22 bp, Homo sapiens
gcagctgcaggtggtcccatgc

SEQ ID NO: 6923280 - DNA, 22 bp, Homo sapiens
caggtgagtttgctattgtaca

SEQ ID NO: 6923281 - DNA, 22 bp, Homo sapiens
gcacacagtatatgctcattaa

SEQ ID NO: 6923282 - DNA, 22 bp, Homo sapiens
aactagctggattagtgttttc

SEQ ID NO: 6923283 - DNA, 22 bp, Homo sapiens
tgcaccctcatcagtcaaatgg

SEQ ID NO: 6923284 - DNA, 22 bp, Homo sapiens
tttagagttaattccattctgt

SEQ ID NO: 6923285 - DNA, 22 bp, Homo sapiens
agctttgaatcctggctctgtc

SEQ ID NO: 6923286 - DNA, 22 bp, Homo sapiens
acaggccacagtggagtctctg

SEQ ID NO: 6923287 - DNA, 22 bp, Homo sapiens
ttctgggctgtccagagggtga

SEQ ID NO: 6923288 - DNA, 22 bp, Homo sapiens
ttgtccttgttcctaacccctc

SEQ ID NO: 6923289 - DNA, 22 bp, Homo sapiens
gcagacctcaggacatcattag

SEQ ID NO: 6923290 - DNA, 22 bp, Homo sapiens
gcaaggctttgtgaattttaaa

SEQ ID NO: 6923291 - DNA, 19 bp, Homo sapiens
gatttaaacgtggctctat

SEQ ID NO: 6923292 - DNA, 22 bp, Homo sapiens
ccctttcttccgtgacttctgc

SEQ ID NO: 6923293 - DNA, 22 bp, Homo sapiens
ctctctgggcccagttggcacc

SEQ ID NO: 6923294 - DNA, 22 bp, Homo sapiens
cctctgtgacaaacagtcctgg

SEQ ID NO: 6923295 - DNA, 21 bp, Homo sapiens
tggtccttctttactgcctcc

SEQ ID NO: 6923296 - DNA, 22 bp, Homo sapiens
gctttgatgaatctgtgcttgg

SEQ ID NO: 6923297 - DNA, 22 bp, Homo sapiens
atatacacatgtgtatacattt

SEQ ID NO: 6923298 - DNA, 22 bp, Homo sapiens
tgcatcttagcaatgaccgagt

SEQ ID NO: 6923299 - DNA, 22 bp, Homo sapiens
gactctggtgacttgacctgta

SEQ ID NO: 6923300 - DNA, 22 bp, Homo sapiens
cgtgtatgataaatgttaataa

SEQ ID NO: 6923301 - DNA, 22 bp, Homo sapiens
gcttggttactgatggaaagga

SEQ ID NO: 6923302 - DNA, 22 bp, Homo sapiens
gtccagggccccgagcaccagg

SEQ ID NO: 6923303 - DNA, 22 bp, Homo sapiens
tacagaaaaacatctggagccg

SEQ ID NO: 6923304 - DNA, 22 bp, Homo sapiens
gctggtctagggatgggcgtat

SEQ ID NO: 6923305 - DNA, 22 bp, Homo sapiens
acagaattggggttcttgggga

SEQ ID NO: 6923306 - DNA, 22 bp, Homo sapiens
cctctgaattttggctatgtag

SEQ ID NO: 6923307 - DNA, 22 bp, Homo sapiens
aatggctgggagtgtattttgg

SEQ ID NO: 6923308 - DNA, 22 bp, Homo sapiens
atgcttttatgtcacatggtca

SEQ ID NO: 6923309 - DNA, 22 bp, Homo sapiens
tcagtgcaggaatttccttaga

SEQ ID NO: 6923310 - DNA, 22 bp, Homo sapiens
attggttactcaatttgactga

SEQ ID NO: 6923311 - DNA, 22 bp, Homo sapiens
gctcaagggatgggagtgggtg

SEQ ID NO: 6923312 - DNA, 22 bp, Homo sapiens
gggctgacagcacgccttctgt

SEQ ID NO: 6923313 - DNA, 22 bp, Homo sapiens
atggaagttggaaccattcata

SEQ ID NO: 6923314 - DNA, 22 bp, Homo sapiens
ttgcttgattctgcaaaagcat

SEQ ID NO: 6923315 - DNA, 22 bp, Homo sapiens
tatctgaatcagttaggactct

SEQ ID NO: 6923316 - DNA, 22 bp, Homo sapiens
gacagagaggctgagcagtaca

SEQ ID NO: 6923317 - DNA, 22 bp, Homo sapiens
agcttcttgtatgaagttagag

SEQ ID NO: 6923318 - DNA, 22 bp, Homo sapiens
atggtaccagcgagagtctctg

SEQ ID NO: 6923319 - DNA, 22 bp, Homo sapiens
ggctgcctgaggcagtgagaga

SEQ ID NO: 6923320 - DNA, 22 bp, Homo sapiens
agcaacgagaagcacaaaataa

SEQ ID NO: 6923321 - DNA, 22 bp, Homo sapiens
caggaacaatcttactactatt

SEQ ID NO: 6923322 - DNA, 22 bp, Homo sapiens
acatcattcagggcctcgttgg

SEQ ID NO: 6923323 - DNA, 22 bp, Homo sapiens
acatgatttgcatgatttgtaa

SEQ ID NO: 6923324 - DNA, 22 bp, Homo sapiens
atgatggaatattattcaggca

SEQ ID NO: 6923325 - DNA, 22 bp, Homo sapiens
aagtgcagagagctgacgaact

SEQ ID NO: 6923326 - DNA, 22 bp, Homo sapiens
tgcctgctgattggagttgaat

SEQ ID NO: 6923327 - DNA, 22 bp, Homo sapiens
tcagtatcaggctggaattaag

SEQ ID NO: 6923328 - DNA, 22 bp, Homo sapiens
cataacatccttgctactttga

SEQ ID NO: 6923329 - DNA, 22 bp, Homo sapiens
cattgcactccagccttggcaa

SEQ ID NO: 6923330 - DNA, 22 bp, Homo sapiens
gcagtacctgctatgttatacg

SEQ ID NO: 6923331 - DNA, 22 bp, Homo sapiens
gctgggcttgtggccagctggg

SEQ ID NO: 6923332 - DNA, 22 bp, Homo sapiens
ttccaggacaagatgtttcagg

SEQ ID NO: 6923333 - DNA, 22 bp, Homo sapiens
agcatctttaggaagagaaaga

SEQ ID NO: 6923334 - DNA, 22 bp, Homo sapiens
ctgaggcactaacaaggacaag

SEQ ID NO: 6923335 - DNA, 22 bp, Homo sapiens
caggcctgagtgtggaagtctt

SEQ ID NO: 6923336 - DNA, 22 bp, Homo sapiens
tttgacatgaagtagcttataa

SEQ ID NO: 6923337 - DNA, 22 bp, Homo sapiens
caggaaagagagctattcactt

SEQ ID NO: 6923338 - DNA, 20 bp, Homo sapiens
ggtcctgccttcatcacttc

SEQ ID NO: 6923339 - DNA, 21 bp, Homo sapiens
ctcagaccacagctcacaccc

SEQ ID NO: 6923340 - DNA, 22 bp, Homo sapiens
caggagtctctcttgagcccag

SEQ ID NO: 6923341 - DNA, 22 bp, Homo sapiens
agtagtttttaagaggtataaa

SEQ ID NO: 6923342 - DNA, 22 bp, Homo sapiens
gtgccactgataaatcagaatg

SEQ ID NO: 6923343 - DNA, 22 bp, Homo sapiens
cctctggcctaggccgggagag

SEQ ID NO: 6923344 - DNA, 23 bp, Homo sapiens
tgttttcttgtcctggtataatt

SEQ ID NO: 6923345 - DNA, 19 bp, Homo sapiens
agaagcaccagtcattcct

SEQ ID NO: 6923346 - DNA, 22 bp, Homo sapiens
agatccttaatttaatcacatc

SEQ ID NO: 6923347 - DNA, 22 bp, Homo sapiens
ttagaatctttagagtctcact

SEQ ID NO: 6923348 - DNA, 22 bp, Homo sapiens
cttggacccactcccagaattg

SEQ ID NO: 6923349 - DNA, 22 bp, Homo sapiens
tggtctgactacaataggaaga

SEQ ID NO: 6923350 - DNA, 22 bp, Homo sapiens
tttaacatgtgaattttggaag

SEQ ID NO: 6923351 - DNA, 23 bp, Homo sapiens
gcttcccagacaatactgcttcc

SEQ ID NO: 6923352 - DNA, 22 bp, Homo sapiens
ttttaagcaaaagaatggtgtg

SEQ ID NO: 6923353 - DNA, 22 bp, Homo sapiens
agggccaaagcaagcccaactg

SEQ ID NO: 6923354 - DNA, 22 bp, Homo sapiens
tcagtgtctagggacagtaatc

SEQ ID NO: 6923355 - DNA, 22 bp, Homo sapiens
acagatgagttaaagcagagtg

SEQ ID NO: 6923356 - DNA, 22 bp, Homo sapiens
ctatttaagaataaaaggggca

SEQ ID NO: 6923357 - DNA, 22 bp, Homo sapiens
ggtctccaaagcttaggactac

SEQ ID NO: 6923358 - DNA, 22 bp, Homo sapiens
ttagagccagttacaaggtcaa

SEQ ID NO: 6923359 - DNA, 22 bp, Homo sapiens
tgttaccataggtcagaacgtt

SEQ ID NO: 6923360 - DNA, 22 bp, Homo sapiens
tcctgagaatagagttgcatgt

SEQ ID NO: 6923361 - DNA, 22 bp, Homo sapiens
gaagttcacatagctggcaggt

SEQ ID NO: 6923362 - DNA, 22 bp, Homo sapiens
taggcacttggcgtgttggaga

SEQ ID NO: 6923363 - DNA, 22 bp, Homo sapiens
gattgctggggcaggctgtagc

SEQ ID NO: 6923364 - DNA, 22 bp, Homo sapiens
gaggtattgactatgggatggc

SEQ ID NO: 6923365 - DNA, 19 bp, Homo sapiens
gatatgaacgttactggcc

SEQ ID NO: 6923366 - DNA, 22 bp, Homo sapiens
tcaggctgggctcctctcccca

SEQ ID NO: 6923367 - DNA, 22 bp, Homo sapiens
tattgaaatgaatgacagtgat

SEQ ID NO: 6923368 - DNA, 22 bp, Homo sapiens
tctgagagcaaggcattagcag

SEQ ID NO: 6923369 - DNA, 22 bp, Homo sapiens
gggcagctgtatctgagcttat

SEQ ID NO: 6923370 - DNA, 22 bp, Homo sapiens
tctcccaggctggagtgcagtg

SEQ ID NO: 6923371 - DNA, 22 bp, Homo sapiens
ggaggtcaaatggagggctggg

SEQ ID NO: 6923372 - DNA, 22 bp, Homo sapiens
tcagcagggcatactgagccta

SEQ ID NO: 6923373 - DNA, 22 bp, Homo sapiens
atgaaagcaaattataggccat

SEQ ID NO: 6923374 - DNA, 22 bp, Homo sapiens
agcagagctttttggactcaga

SEQ ID NO: 6923375 - DNA, 22 bp, Homo sapiens
agggcctctgcctccccgttgt

SEQ ID NO: 6923376 - DNA, 22 bp, Homo sapiens
aaatgcctatttgttccttcag

SEQ ID NO: 6923377 - DNA, 22 bp, Homo sapiens
ttagctgtggaagcttcagcca

SEQ ID NO: 6923378 - DNA, 22 bp, Homo sapiens
tgcagctgcctccttcccttgt

SEQ ID NO: 6923379 - DNA, 22 bp, Homo sapiens
aggtatggcataaatcacaggg

SEQ ID NO: 6923380 - DNA, 22 bp, Homo sapiens
tgaggtacactaaatttgtctt

SEQ ID NO: 6923381 - DNA, 22 bp, Homo sapiens
gttcaaatggctgcagttacca

SEQ ID NO: 6923382 - DNA, 22 bp, Homo sapiens
gcagtatatactctttgagggg

SEQ ID NO: 6923383 - DNA, 22 bp, Homo sapiens
agccctgccctgccatgtggca

SEQ ID NO: 6923384 - DNA, 22 bp, Homo sapiens
agaggcaaaaatctatggcaac

SEQ ID NO: 6923385 - DNA, 22 bp, Homo sapiens
tgcagacaagtcgtgggatctt

SEQ ID NO: 6923386 - DNA, 22 bp, Homo sapiens
tgaggccaagaaaagctgggtg

SEQ ID NO: 6923387 - DNA, 23 bp, Homo sapiens
ctgggacatggtaggggcacaac

SEQ ID NO: 6923388 - DNA, 22 bp, Homo sapiens
ggaaaccttaattattacacca

SEQ ID NO: 6923389 - DNA, 22 bp, Homo sapiens
gggctgagtctgctgcctgtca

SEQ ID NO: 6923390 - DNA, 22 bp, Homo sapiens
tggctcagccattcgtgttgcc

SEQ ID NO: 6923391 - DNA, 22 bp, Homo sapiens
atgcatttatgtgtgtacattg

SEQ ID NO: 6923392 - DNA, 22 bp, Homo sapiens
agtgactcaactagtcttacta

SEQ ID NO: 6923393 - DNA, 22 bp, Homo sapiens
gtttagtgggacagtttaaagt

SEQ ID NO: 6923394 - DNA, 22 bp, Homo sapiens
ttgctttatctaagcatggcca

SEQ ID NO: 6923395 - DNA, 22 bp, Homo sapiens
aatggtttttagtgagatcgat

SEQ ID NO: 6923396 - DNA, 22 bp, Homo sapiens
gacaattgcttttgccgaataa

SEQ ID NO: 6923397 - DNA, 22 bp, Homo sapiens
tctatctcccttattcctggcc

SEQ ID NO: 6923398 - DNA, 22 bp, Homo sapiens
gttataaaggtgataatggtca

SEQ ID NO: 6923399 - DNA, 22 bp, Homo sapiens
ggagccagtatttagtggtctt

SEQ ID NO: 6923400 - DNA, 22 bp, Homo sapiens
gctgtggcccttggcatctgcg

SEQ ID NO: 6923401 - DNA, 22 bp, Homo sapiens
aactgctaagcaaagaagcagg

SEQ ID NO: 6923402 - DNA, 22 bp, Homo sapiens
tatgtgctttgcactgtgctat

SEQ ID NO: 6923403 - DNA, 22 bp, Homo sapiens
ggggtgggagtgccatccttga

SEQ ID NO: 6923404 - DNA, 22 bp, Homo sapiens
acaattttaagccagagtgggt

SEQ ID NO: 6923405 - DNA, 22 bp, Homo sapiens
tacaccaggtgttatggtcaat

SEQ ID NO: 6923406 - DNA, 22 bp, Homo sapiens
gctgtctgccgcaggctgccac

SEQ ID NO: 6923407 - DNA, 22 bp, Homo sapiens
tatgtttttcaagtgcacacta

SEQ ID NO: 6923408 - DNA, 22 bp, Homo sapiens
ttgcactttatagaaacttttg

SEQ ID NO: 6923409 - DNA, 22 bp, Homo sapiens
gtacaataactagtcttatagt

SEQ ID NO: 6923410 - DNA, 22 bp, Homo sapiens
actgttggagtcttgagtttct

SEQ ID NO: 6923411 - DNA, 16 bp, Homo sapiens
gcaggggtgggtggag

SEQ ID NO: 6923412 - DNA, 22 bp, Homo sapiens
tgaggccaagcctcctctgcca

SEQ ID NO: 6923413 - DNA, 20 bp, Homo sapiens
cctggggtacactggcatgt

SEQ ID NO: 6923414 - DNA, 22 bp, Homo sapiens
gccaggtcgtctccatgtccaa

SEQ ID NO: 6923415 - DNA, 22 bp, Homo sapiens
gatattcaagtggaattattct

SEQ ID NO: 6923416 - DNA, 21 bp, Homo sapiens
tgttcctgttctctaggatcc

SEQ ID NO: 6923417 - DNA, 21 bp, Homo sapiens
agagatctgaagaaccattag

SEQ ID NO: 6923418 - DNA, 22 bp, Homo sapiens
agccttctaggatgtcatctgc

SEQ ID NO: 6923419 - DNA, 23 bp, Homo sapiens
tgggagtgttgggatctctgctc

SEQ ID NO: 6923420 - DNA, 17 bp, Homo sapiens
tcctgccacctgtcagg

SEQ ID NO: 6923421 - DNA, 22 bp, Homo sapiens
tagacatttggagttttatgac

SEQ ID NO: 6923422 - DNA, 22 bp, Homo sapiens
agaaattctaagcatcaatagc

SEQ ID NO: 6923423 - DNA, 22 bp, Homo sapiens
gcccgcgccagcctctccatct

SEQ ID NO: 6923424 - DNA, 22 bp, Homo sapiens
ataagcctgattcacttgtcat

SEQ ID NO: 6923425 - DNA, 22 bp, Homo sapiens
tcatgctgtgaactgtatacat

SEQ ID NO: 6923426 - DNA, 22 bp, Homo sapiens
cctcacagcttgggcaaacggc

SEQ ID NO: 6923427 - DNA, 22 bp, Homo sapiens
tgatgccagtgcttagaccatt

SEQ ID NO: 6923428 - DNA, 22 bp, Homo sapiens
tttttctactgcccacattgta

SEQ ID NO: 6923429 - DNA, 22 bp, Homo sapiens
accaggcagctgggggtgatgt

SEQ ID NO: 6923430 - DNA, 22 bp, Homo sapiens
catgtccatttatgcacagaaa

SEQ ID NO: 6923431 - DNA, 22 bp, Homo sapiens
gaagagagccgcgggacatcag

SEQ ID NO: 6923432 - DNA, 22 bp, Homo sapiens
gccaacaggccttgctctgctc

SEQ ID NO: 6923433 - DNA, 19 bp, Homo sapiens
ctttgccaaaagaggccat

SEQ ID NO: 6923434 - DNA, 22 bp, Homo sapiens
aagtattatttaacaaatttgt

SEQ ID NO: 6923435 - DNA, 22 bp, Homo sapiens
gcctgtttccatcaacacatgc

SEQ ID NO: 6923436 - DNA, 22 bp, Homo sapiens
atagatgttttctcctaattgg

SEQ ID NO: 6923437 - DNA, 17 bp, Homo sapiens
cagttggagacaagtcc

SEQ ID NO: 6923438 - DNA, 22 bp, Homo sapiens
agtaaaaagttcagaatggttg

SEQ ID NO: 6923439 - DNA, 22 bp, Homo sapiens
tcaaggccagggaatgtagggg

SEQ ID NO: 6923440 - DNA, 22 bp, Homo sapiens
gggaaggaggtggcttgaagtg

SEQ ID NO: 6923441 - DNA, 22 bp, Homo sapiens
tggtgcagatgcaggtcactgg

SEQ ID NO: 6923442 - DNA, 22 bp, Homo sapiens
ctggggaacaatttgccacact

SEQ ID NO: 6923443 - DNA, 22 bp, Homo sapiens
gttcacattaactcaccggtgc

SEQ ID NO: 6923444 - DNA, 23 bp, Homo sapiens
tctgagaaggtttcagccagact

SEQ ID NO: 6923445 - DNA, 22 bp, Homo sapiens
tcctgagcttcagtttcttcat

SEQ ID NO: 6923446 - DNA, 22 bp, Homo sapiens
attcagctgactttgattcatt

SEQ ID NO: 6923447 - DNA, 20 bp, Homo sapiens
tttcaagtcagcaattctca

SEQ ID NO: 6923448 - DNA, 22 bp, Homo sapiens
ttggtttaccagagggaacgtg

SEQ ID NO: 6923449 - DNA, 22 bp, Homo sapiens
aggccaggatagcatggatcag

SEQ ID NO: 6923450 - DNA, 22 bp, Homo sapiens
ccatcattatcactgacaacct

SEQ ID NO: 6923451 - DNA, 22 bp, Homo sapiens
gctgtctccccgcacccgaccg

SEQ ID NO: 6923452 - DNA, 22 bp, Homo sapiens
ttccctccgaacctcagtgctg

SEQ ID NO: 6923453 - DNA, 22 bp, Homo sapiens
agaagatgtcactgcagacagc

SEQ ID NO: 6923454 - DNA, 22 bp, Homo sapiens
tggaggcctggtctctcttccc

SEQ ID NO: 6923455 - DNA, 22 bp, Homo sapiens
gtggggctcccatctcctggct

SEQ ID NO: 6923456 - DNA, 22 bp, Homo sapiens
ctccctggggctcctcctattt

SEQ ID NO: 6923457 - DNA, 22 bp, Homo sapiens
caacctctatcggtcaggaagc

SEQ ID NO: 6923458 - DNA, 22 bp, Homo sapiens
tgcaagactcctcactttctct

SEQ ID NO: 6923459 - DNA, 22 bp, Homo sapiens
taattataaactgcagtaggta

SEQ ID NO: 6923460 - DNA, 23 bp, Homo sapiens
tccctggccgcaatggccgcctt

SEQ ID NO: 6923461 - DNA, 19 bp, Homo sapiens
tgagctctccacaatttcc

SEQ ID NO: 6923462 - DNA, 22 bp, Homo sapiens
agacagaatttgtcagataaat

SEQ ID NO: 6923463 - DNA, 19 bp, Homo sapiens
ccttggagttccaggtgga

SEQ ID NO: 6923464 - DNA, 22 bp, Homo sapiens
ccacagccattccagggaggct

SEQ ID NO: 6923465 - DNA, 22 bp, Homo sapiens
gctcttgaaactggggtttcca

SEQ ID NO: 6923466 - DNA, 16 bp, Homo sapiens
ttttattgtgacagcc

SEQ ID NO: 6923467 - DNA, 22 bp, Homo sapiens
ctgaactgacagactgcctgct

SEQ ID NO: 6923468 - DNA, 22 bp, Homo sapiens
aaagcagtccttcccttaaggt

SEQ ID NO: 6923469 - DNA, 22 bp, Homo sapiens
ctgaggctcagcgtgaggaaag

SEQ ID NO: 6923470 - DNA, 22 bp, Homo sapiens
acaaattgttgggactcagccc

SEQ ID NO: 6923471 - DNA, 22 bp, Homo sapiens
gaaaggcaggcagggtgtccat

SEQ ID NO: 6923472 - DNA, 22 bp, Homo sapiens
atgccaggagatggagcagagt

SEQ ID NO: 6923473 - DNA, 22 bp, Homo sapiens
tattcagaaaactgagcgatga

SEQ ID NO: 6923474 - DNA, 22 bp, Homo sapiens
tccagctgacatctcctgaggg

SEQ ID NO: 6923475 - DNA, 22 bp, Homo sapiens
gtccatgcagtcacctccagct

SEQ ID NO: 6923476 - DNA, 22 bp, Homo sapiens
tttgcaaactttcctctggacc

SEQ ID NO: 6923477 - DNA, 22 bp, Homo sapiens
gctttgcctcttctccttccag

SEQ ID NO: 6923478 - DNA, 22 bp, Homo sapiens
actcctggggatccattccttt

SEQ ID NO: 6923479 - DNA, 22 bp, Homo sapiens
tggacagcaaacatggagagaa

SEQ ID NO: 6923480 - DNA, 22 bp, Homo sapiens
ttgtgcatggctactttttatg

SEQ ID NO: 6923481 - DNA, 22 bp, Homo sapiens
ctcctacagtgtttgagtccag

SEQ ID NO: 6923482 - DNA, 22 bp, Homo sapiens
tgtgaaggtaaggaggggcaag

SEQ ID NO: 6923483 - DNA, 22 bp, Homo sapiens
aggtcaccatggcatgctccac

SEQ ID NO: 6923484 - DNA, 22 bp, Homo sapiens
ttgatgatcttacggcagagga

SEQ ID NO: 6923485 - DNA, 22 bp, Homo sapiens
tctttgaacttggctgatctct

SEQ ID NO: 6923486 - DNA, 22 bp, Homo sapiens
catctattttctgtgaggtatc

SEQ ID NO: 6923487 - DNA, 22 bp, Homo sapiens
cagccccatggtgtgctccagc

SEQ ID NO: 6923488 - DNA, 22 bp, Homo sapiens
agcttgaacctaaaacaataat

SEQ ID NO: 6923489 - DNA, 18 bp, Homo sapiens
agattgtgtctacaaatc

SEQ ID NO: 6923490 - DNA, 22 bp, Homo sapiens
tatgtgcagtttgctcttaaca

SEQ ID NO: 6923491 - DNA, 20 bp, Homo sapiens
aagcttccttgggcgcccgg

SEQ ID NO: 6923492 - DNA, 22 bp, Homo sapiens
gtaggaacagcttccttggtat

SEQ ID NO: 6923493 - DNA, 19 bp, Homo sapiens
ttcagcagtgtctgctctt

SEQ ID NO: 6923494 - DNA, 22 bp, Homo sapiens
taggcagtgctctgtgcttcag

SEQ ID NO: 6923495 - DNA, 22 bp, Homo sapiens
actgttggtcagggatattgtg

SEQ ID NO: 6923496 - DNA, 22 bp, Homo sapiens
ccttggccctagcctcaggcaa

SEQ ID NO: 6923497 - DNA, 22 bp, Homo sapiens
agaaatgtaattgcaactgtct

SEQ ID NO: 6923498 - DNA, 21 bp, Homo sapiens
tgtctacatgttatccctgga

SEQ ID NO: 6923499 - DNA, 22 bp, Homo sapiens
gcttcccaggcgcctgaccttt

SEQ ID NO: 6923500 - DNA, 22 bp, Homo sapiens
tcaaagtaagaatttattacaa

SEQ ID NO: 6923501 - DNA, 22 bp, Homo sapiens
gtgatatttcaagagtggggca

SEQ ID NO: 6923502 - DNA, 22 bp, Homo sapiens
ggtctcaggagactggagagca

SEQ ID NO: 6923503 - DNA, 22 bp, Homo sapiens
ctcctgtgattcatttaacata

SEQ ID NO: 6923504 - DNA, 22 bp, Homo sapiens
aggtccctacttatctgaaggc

SEQ ID NO: 6923505 - DNA, 20 bp, Homo sapiens
ttccagccgccacttccgcc

SEQ ID NO: 6923506 - DNA, 20 bp, Homo sapiens
agaggttcagtctggagaag

SEQ ID NO: 6923507 - DNA, 22 bp, Homo sapiens
tcaaggttgcggggaggcacga

SEQ ID NO: 6923508 - DNA, 22 bp, Homo sapiens
atgactcttagctaaaggtaag

SEQ ID NO: 6923509 - DNA, 22 bp, Homo sapiens
tctctggttatgtcattaagca

SEQ ID NO: 6923510 - DNA, 22 bp, Homo sapiens
cacagttttgtcttggtttcca

SEQ ID NO: 6923511 - DNA, 22 bp, Homo sapiens
attcatgtagtgattgagtcac

SEQ ID NO: 6923512 - DNA, 22 bp, Homo sapiens
ttcaggaaggtcctatagcaga

SEQ ID NO: 6923513 - DNA, 20 bp, Homo sapiens
ttttggtgaattccagaata

SEQ ID NO: 6923514 - DNA, 22 bp, Homo sapiens
attgatgacacatgttagtttt

SEQ ID NO: 6923515 - DNA, 22 bp, Homo sapiens
gaaggaagccgtttctctccag

SEQ ID NO: 6923516 - DNA, 22 bp, Homo sapiens
cagagggatcatcttcctgaag

SEQ ID NO: 6923517 - DNA, 22 bp, Homo sapiens
tggtgtcactcaagcccggccg

SEQ ID NO: 6923518 - DNA, 22 bp, Homo sapiens
tttaatgtgagtccctttcaag

SEQ ID NO: 6923519 - DNA, 22 bp, Homo sapiens
acaaaacagtgttcctgcccct

SEQ ID NO: 6923520 - DNA, 22 bp, Homo sapiens
ttcagcatgaaaggatttgagt

SEQ ID NO: 6923521 - DNA, 22 bp, Homo sapiens
agatgatcccaagaagatgctg

SEQ ID NO: 6923522 - DNA, 22 bp, Homo sapiens
tgaggcctgccctggggaagtt

SEQ ID NO: 6923523 - DNA, 22 bp, Homo sapiens
cagtgggtcctaagtacagttc

SEQ ID NO: 6923524 - DNA, 22 bp, Homo sapiens
ttgtgtcctctaatctcaccac

SEQ ID NO: 6923525 - DNA, 22 bp, Homo sapiens
tccagggcttgacagggtgcct

SEQ ID NO: 6923526 - DNA, 22 bp, Homo sapiens
acacctttcaggtccagacagt

SEQ ID NO: 6923527 - DNA, 22 bp, Homo sapiens
ctcttcagatatacagtactct

SEQ ID NO: 6923528 - DNA, 22 bp, Homo sapiens
tgtggcagaggaggcagcgtcc

SEQ ID NO: 6923529 - DNA, 21 bp, Homo sapiens
aggtggccacaaatctgtttc

SEQ ID NO: 6923530 - DNA, 22 bp, Homo sapiens
ctgccagagtcacttgccacct

SEQ ID NO: 6923531 - DNA, 22 bp, Homo sapiens
gtccagagaagtcattacttca

SEQ ID NO: 6923532 - DNA, 22 bp, Homo sapiens
ggcactgcaggtaagtgctgtc

SEQ ID NO: 6923533 - DNA, 20 bp, Homo sapiens
agcaggtgacggggcctgct

SEQ ID NO: 6923534 - DNA, 22 bp, Homo sapiens
ctcagacacagccccacgaagt

SEQ ID NO: 6923535 - DNA, 22 bp, Homo sapiens
tatttgcaaagaactacactag

SEQ ID NO: 6923536 - DNA, 22 bp, Homo sapiens
aaaggagacagtcttacctgga

SEQ ID NO: 6923537 - DNA, 22 bp, Homo sapiens
aggcctgtaattttcctctttt

SEQ ID NO: 6923538 - DNA, 22 bp, Homo sapiens
tgggcagaggacagggaagatc

SEQ ID NO: 6923539 - DNA, 22 bp, Homo sapiens
gaagcctgggagggctgggcta

SEQ ID NO: 6923540 - DNA, 22 bp, Homo sapiens
ttttagattgggaaatgtaaag

SEQ ID NO: 6923541 - DNA, 22 bp, Homo sapiens
tatttgctgacagtgctggagc

SEQ ID NO: 6923542 - DNA, 22 bp, Homo sapiens
aacacttagatttttaaggttt

SEQ ID NO: 6923543 - DNA, 22 bp, Homo sapiens
tttctccaatgtatcagcacac

SEQ ID NO: 6923544 - DNA, 22 bp, Homo sapiens
ctgcttctccaaagtaggactt

SEQ ID NO: 6923545 - DNA, 19 bp, Homo sapiens
tgtgtgggtttagagtagt

SEQ ID NO: 6923546 - DNA, 22 bp, Homo sapiens
tcaaattagtggaataataatg

SEQ ID NO: 6923547 - DNA, 22 bp, Homo sapiens
atttatcatcagaccttttaaa

SEQ ID NO: 6923548 - DNA, 22 bp, Homo sapiens
ctgctcatcagccgagcagggc

SEQ ID NO: 6923549 - DNA, 22 bp, Homo sapiens
tgggatagtagctgagagacaa

SEQ ID NO: 6923550 - DNA, 22 bp, Homo sapiens
attaaatggtggtcattcattt

SEQ ID NO: 6923551 - DNA, 22 bp, Homo sapiens
agtgtttctcagaagggcctat

SEQ ID NO: 6923552 - DNA, 22 bp, Homo sapiens
attggtatataaaatgtgtact

SEQ ID NO: 6923553 - DNA, 22 bp, Homo sapiens
tgtttgaaagcacctacatttt

SEQ ID NO: 6923554 - DNA, 22 bp, Homo sapiens
cctctgtggccctgactctctt

SEQ ID NO: 6923555 - DNA, 22 bp, Homo sapiens
tcccttgtcctgtgggaagagc

SEQ ID NO: 6923556 - DNA, 22 bp, Homo sapiens
ctaggcacttgtaaggccgctc

SEQ ID NO: 6923557 - DNA, 22 bp, Homo sapiens
aattatacatgaaggcattata

SEQ ID NO: 6923558 - DNA, 22 bp, Homo sapiens
gttatcttagggtacaaaggac

SEQ ID NO: 6923559 - DNA, 20 bp, Homo sapiens
agcttcaggctcaagagaac

SEQ ID NO: 6923560 - DNA, 22 bp, Homo sapiens
ttcagtgtgaagcttctgaaag

SEQ ID NO: 6923561 - DNA, 22 bp, Homo sapiens
agctgcaggagtcgcctaggat

SEQ ID NO: 6923562 - DNA, 22 bp, Homo sapiens
tactttgaccaccatctgatta

SEQ ID NO: 6923563 - DNA, 22 bp, Homo sapiens
tagcagctatgccattttgaca

SEQ ID NO: 6923564 - DNA, 21 bp, Homo sapiens
tatttatctcaggctatcttt

SEQ ID NO: 6923565 - DNA, 22 bp, Homo sapiens
gccttgtttctctcccagataa

SEQ ID NO: 6923566 - DNA, 22 bp, Homo sapiens
caataatttacattggatacca

SEQ ID NO: 6923567 - DNA, 22 bp, Homo sapiens
cagggcttcgctcctggtgcac

SEQ ID NO: 6923568 - DNA, 22 bp, Homo sapiens
ctccaggtagttatttcaagaa

SEQ ID NO: 6923569 - DNA, 22 bp, Homo sapiens
atcatgcagctaatccaattca

SEQ ID NO: 6923570 - DNA, 22 bp, Homo sapiens
ttctggagaggaacagaaaggt

SEQ ID NO: 6923571 - DNA, 22 bp, Homo sapiens
ttctggaggccccttccttctc

SEQ ID NO: 6923572 - DNA, 22 bp, Homo sapiens
gtgctgggtgctgcagacaggt

SEQ ID NO: 6923573 - DNA, 22 bp, Homo sapiens
ctcagtactttatgtatatgat

SEQ ID NO: 6923574 - DNA, 22 bp, Homo sapiens
agagtgctaaaatcttatcttt

SEQ ID NO: 6923575 - DNA, 22 bp, Homo sapiens
gccatggggacttcatggattt

SEQ ID NO: 6923576 - DNA, 22 bp, Homo sapiens
tcaagccatcaggcagcgggtt

SEQ ID NO: 6923577 - DNA, 22 bp, Homo sapiens
gtgcctggaccctctttccgga

SEQ ID NO: 6923578 - DNA, 21 bp, Homo sapiens
gctcttgaataagcataataa

SEQ ID NO: 6923579 - DNA, 22 bp, Homo sapiens
ttcaccagacctgtgagcttcc

SEQ ID NO: 6923580 - DNA, 22 bp, Homo sapiens
gatcagtgttttgtgcattctt

SEQ ID NO: 6923581 - DNA, 22 bp, Homo sapiens
tgtcaaagacagaaggaaatgg

SEQ ID NO: 6923582 - DNA, 23 bp, Homo sapiens
tgcttggacaagactctattaag

SEQ ID NO: 6923583 - DNA, 22 bp, Homo sapiens
acttgcaggatcctctgcctga

SEQ ID NO: 6923584 - DNA, 23 bp, Homo sapiens
agattggtgtgtgcatcaaattg

SEQ ID NO: 6923585 - DNA, 22 bp, Homo sapiens
ttccagaggttctcagccctgt

SEQ ID NO: 6923586 - DNA, 22 bp, Homo sapiens
aagagcatcaatgactcgcagt

SEQ ID NO: 6923587 - DNA, 22 bp, Homo sapiens
ccctgtgtagttaactttccac

SEQ ID NO: 6923588 - DNA, 22 bp, Homo sapiens
tcagcagatgatttccatacaa

SEQ ID NO: 6923589 - DNA, 17 bp, Homo sapiens
agcaaggcttaagtaaa

SEQ ID NO: 6923590 - DNA, 22 bp, Homo sapiens
tcagtgtaagttatgtagatgt

SEQ ID NO: 6923591 - DNA, 22 bp, Homo sapiens
aaggtcagagcaggaaggagtc

SEQ ID NO: 6923592 - DNA, 22 bp, Homo sapiens
ttacaactctgaactacagagg

SEQ ID NO: 6923593 - DNA, 22 bp, Homo sapiens
ttcttataagataggcctcagg

SEQ ID NO: 6923594 - DNA, 22 bp, Homo sapiens
gaatctcattctaactagtagg

SEQ ID NO: 6923595 - DNA, 22 bp, Homo sapiens
agagctgtgttaagaacaggcc

SEQ ID NO: 6923596 - DNA, 22 bp, Homo sapiens
gacctggaagatggtcctcacc

SEQ ID NO: 6923597 - DNA, 22 bp, Homo sapiens
agcacctgtggctcatgctcgt

SEQ ID NO: 6923598 - DNA, 23 bp, Homo sapiens
tcagaagtttggttgtaacatgg

SEQ ID NO: 6923599 - DNA, 22 bp, Homo sapiens
agatgcatggaaatctcattac

SEQ ID NO: 6923600 - DNA, 22 bp, Homo sapiens
gagctggtgctgtgcctgttct

SEQ ID NO: 6923601 - DNA, 22 bp, Homo sapiens
cacagactccccgccatagtgg

SEQ ID NO: 6923602 - DNA, 22 bp, Homo sapiens
ttcaatcattagaatctcaggc

SEQ ID NO: 6923603 - DNA, 22 bp, Homo sapiens
cagaacattgttttctcatctg

SEQ ID NO: 6923604 - DNA, 22 bp, Homo sapiens
gggcagaggctctggcccatcc

SEQ ID NO: 6923605 - DNA, 22 bp, Homo sapiens
atgtgctcaccctatttatgga

SEQ ID NO: 6923606 - DNA, 22 bp, Homo sapiens
cagaggcctggcttggacacct

SEQ ID NO: 6923607 - DNA, 22 bp, Homo sapiens
cagagaaaaaatcctgctctca

SEQ ID NO: 6923608 - DNA, 22 bp, Homo sapiens
agcccaagaagagctttcttgc

SEQ ID NO: 6923609 - DNA, 22 bp, Homo sapiens
atgtaaaggcagactttaattt

SEQ ID NO: 6923610 - DNA, 17 bp, Homo sapiens
tggcatcttttgctcat

SEQ ID NO: 6923611 - DNA, 22 bp, Homo sapiens
tgccagcttttgactatcttag

SEQ ID NO: 6923612 - DNA, 22 bp, Homo sapiens
agatatcaccagttttacatac

SEQ ID NO: 6923613 - DNA, 22 bp, Homo sapiens
ctggcagcattaacagagagca

SEQ ID NO: 6923614 - DNA, 22 bp, Homo sapiens
tatggctgtggtgatctcattt

SEQ ID NO: 6923615 - DNA, 22 bp, Homo sapiens
cccagtgttccttgaggggctg

SEQ ID NO: 6923616 - DNA, 22 bp, Homo sapiens
gtggcacagccaagcctcactc

SEQ ID NO: 6923617 - DNA, 22 bp, Homo sapiens
gaagtacagttttatctagcca

SEQ ID NO: 6923618 - DNA, 22 bp, Homo sapiens
gtggtcaaagcatcagagacct

SEQ ID NO: 6923619 - DNA, 22 bp, Homo sapiens
caccaccaggcaggacaccgaa

SEQ ID NO: 6923620 - DNA, 22 bp, Homo sapiens
ttcaagtcagagcaagccaagt

SEQ ID NO: 6923621 - DNA, 22 bp, Homo sapiens
tgtgcccagactgcctcagtga

SEQ ID NO: 6923622 - DNA, 22 bp, Homo sapiens
ttaaggaaagccaaaatgaatt

SEQ ID NO: 6923623 - DNA, 22 bp, Homo sapiens
catggaactgtgctgaaaagtg

SEQ ID NO: 6923624 - DNA, 22 bp, Homo sapiens
cctcagaggtgtggcatctctg

SEQ ID NO: 6923625 - DNA, 22 bp, Homo sapiens
ctcagcaggtcttgggtagggg

SEQ ID NO: 6923626 - DNA, 22 bp, Homo sapiens
tcagcaggtctgaggcggggcc

SEQ ID NO: 6923627 - DNA, 22 bp, Homo sapiens
tccccattcctctcggtggtgg

SEQ ID NO: 6923628 - DNA, 22 bp, Homo sapiens
accctgggacttccgagttgag

SEQ ID NO: 6923629 - DNA, 22 bp, Homo sapiens
tcaggagaacttccttctaccc

SEQ ID NO: 6923630 - DNA, 22 bp, Homo sapiens
tggcatgtttcatggctgcaaa

SEQ ID NO: 6923631 - DNA, 22 bp, Homo sapiens
tgaacacatttgggaaaatctt

SEQ ID NO: 6923632 - DNA, 22 bp, Homo sapiens
gcaaacatccactgcccttgta

SEQ ID NO: 6923633 - DNA, 22 bp, Homo sapiens
ccaggtgaggtaggtatggtag

SEQ ID NO: 6923634 - DNA, 21 bp, Homo sapiens
tgttatgtgcttcaagaagtg

SEQ ID NO: 6923635 - DNA, 22 bp, Homo sapiens
ttgtttattagcaattatcctg

SEQ ID NO: 6923636 - DNA, 22 bp, Homo sapiens
tgtggggctccctggcagcctg

SEQ ID NO: 6923637 - DNA, 22 bp, Homo sapiens
tgagtgtctggtcatggcaggc

SEQ ID NO: 6923638 - DNA, 22 bp, Homo sapiens
cttatgtatatttggaacgtac

SEQ ID NO: 6923639 - DNA, 22 bp, Homo sapiens
tacagtgaggtggtttccttta

SEQ ID NO: 6923640 - DNA, 22 bp, Homo sapiens
ttgctaaaaggtgaaaagtgta

SEQ ID NO: 6923641 - DNA, 22 bp, Homo sapiens
tcaaacatatctgattttccat

SEQ ID NO: 6923642 - DNA, 22 bp, Homo sapiens
gcaatacagtaggtttattggt

SEQ ID NO: 6923643 - DNA, 22 bp, Homo sapiens
agaggtagaaaataatggagag

SEQ ID NO: 6923644 - DNA, 22 bp, Homo sapiens
tttgtttacaaaaataagcagt

SEQ ID NO: 6923645 - DNA, 22 bp, Homo sapiens
actgtgttaaatacagagatgg

SEQ ID NO: 6923646 - DNA, 22 bp, Homo sapiens
tggctcattctttagaatatac

SEQ ID NO: 6923647 - DNA, 22 bp, Homo sapiens
ggcctggacacctgaggtctta

SEQ ID NO: 6923648 - DNA, 22 bp, Homo sapiens
gcagtagtcgctggagatgagg

SEQ ID NO: 6923649 - DNA, 22 bp, Homo sapiens
tcactctgttttactcactgtt

SEQ ID NO: 6923650 - DNA, 22 bp, Homo sapiens
tatttgctccttaggcatattt

SEQ ID NO: 6923651 - DNA, 22 bp, Homo sapiens
tggggcctgtgacgggtccaga

SEQ ID NO: 6923652 - DNA, 22 bp, Homo sapiens
gaccctcctgtcttctaaccaa

SEQ ID NO: 6923653 - DNA, 22 bp, Homo sapiens
ctttgcgcaacaccttcgccat

SEQ ID NO: 6923654 - DNA, 19 bp, Homo sapiens
tgccatgtttaagcaattt

SEQ ID NO: 6923655 - DNA, 22 bp, Homo sapiens
acaggaacagcttgatggcatc

SEQ ID NO: 6923656 - DNA, 22 bp, Homo sapiens
ataaaatggtaaacgaagctga

SEQ ID NO: 6923657 - DNA, 18 bp, Homo sapiens
ggtctgagatcgtttttc

SEQ ID NO: 6923658 - DNA, 22 bp, Homo sapiens
agactgttaatttcaattaaaa

SEQ ID NO: 6923659 - DNA, 22 bp, Homo sapiens
taaagctgaaatgattatgaca

SEQ ID NO: 6923660 - DNA, 22 bp, Homo sapiens
aatctttgtaacagtgaggttt

SEQ ID NO: 6923661 - DNA, 22 bp, Homo sapiens
ccagaagagatcacagttcttg

SEQ ID NO: 6923662 - DNA, 20 bp, Homo sapiens
ggaaggggcaaagtgtgtga

SEQ ID NO: 6923663 - DNA, 22 bp, Homo sapiens
tacccagaagattgtcagcaaa

SEQ ID NO: 6923664 - DNA, 22 bp, Homo sapiens
tctctcctctagtcagggtggt

SEQ ID NO: 6923665 - DNA, 22 bp, Homo sapiens
attgattgggtatgtgcatgca

SEQ ID NO: 6923666 - DNA, 18 bp, Homo sapiens
ctcagacatgcttctttt

SEQ ID NO: 6923667 - DNA, 22 bp, Homo sapiens
gtttcacagatggggagacacg

SEQ ID NO: 6923668 - DNA, 22 bp, Homo sapiens
tgaccaaagactttagatgttc

SEQ ID NO: 6923669 - DNA, 22 bp, Homo sapiens
acatgtgaggtgtgagtgatac

SEQ ID NO: 6923670 - DNA, 21 bp, Homo sapiens
tggcaggggtagtagtacagc

SEQ ID NO: 6923671 - DNA, 22 bp, Homo sapiens
agatcctgccaatggaagcagg

SEQ ID NO: 6923672 - DNA, 22 bp, Homo sapiens
tgcttaggttggtctagaccat

SEQ ID NO: 6923673 - DNA, 21 bp, Homo sapiens
ggctgctgggagagctgcgtg

SEQ ID NO: 6923674 - DNA, 22 bp, Homo sapiens
tcctgggaggaacatttaccta

SEQ ID NO: 6923675 - DNA, 22 bp, Homo sapiens
ggtgcccacctgtcttcctgga

SEQ ID NO: 6923676 - DNA, 22 bp, Homo sapiens
ggtcagcagtttctttgaattt

SEQ ID NO: 6923677 - DNA, 22 bp, Homo sapiens
aaccctcagctgtttgaggaga

SEQ ID NO: 6923678 - DNA, 22 bp, Homo sapiens
cactgcagcaccatgcagggct

SEQ ID NO: 6923679 - DNA, 22 bp, Homo sapiens
gagctctgaaaaagcttgcctt

SEQ ID NO: 6923680 - DNA, 22 bp, Homo sapiens
ttgtgataaaacattagacatt

SEQ ID NO: 6923681 - DNA, 22 bp, Homo sapiens
agctgcagagaaaagaggctgg

SEQ ID NO: 6923682 - DNA, 22 bp, Homo sapiens
ttccaaacctcaaataattaat

SEQ ID NO: 6923683 - DNA, 22 bp, Homo sapiens
ggcaggggtcctggtgttgact

SEQ ID NO: 6923684 - DNA, 22 bp, Homo sapiens
cttggggaggacgcagtgtcct

SEQ ID NO: 6923685 - DNA, 22 bp, Homo sapiens
atacatagctgaaaacttgtag

SEQ ID NO: 6923686 - DNA, 21 bp, Homo sapiens
agccagatccattttgcatgg

SEQ ID NO: 6923687 - DNA, 22 bp, Homo sapiens
ttgttttatctttctacagact

SEQ ID NO: 6923688 - DNA, 22 bp, Homo sapiens
ggcatacaagagaaatataaga

SEQ ID NO: 6923689 - DNA, 19 bp, Homo sapiens
tggtcccatactgctggcc

SEQ ID NO: 6923690 - DNA, 23 bp, Homo sapiens
cctcccacctatttcactttctt

SEQ ID NO: 6923691 - DNA, 21 bp, Homo sapiens
tagcagagatcattttctcct

SEQ ID NO: 6923692 - DNA, 22 bp, Homo sapiens
ttctctttttgcatctcaacct

SEQ ID NO: 6923693 - DNA, 22 bp, Homo sapiens
gtctggcatatgcaaagtgcat

SEQ ID NO: 6923694 - DNA, 22 bp, Homo sapiens
ccaggtggtgaaagtgggccct

SEQ ID NO: 6923695 - DNA, 19 bp, Homo sapiens
ttgctcccaccccagtttt

SEQ ID NO: 6923696 - DNA, 22 bp, Homo sapiens
aaagagttggactttctcaggc

SEQ ID NO: 6923697 - DNA, 22 bp, Homo sapiens
cagtctaacttcacagcctgga

SEQ ID NO: 6923698 - DNA, 22 bp, Homo sapiens
actgagtgtaggactttgagtt

SEQ ID NO: 6923699 - DNA, 22 bp, Homo sapiens
gaggccagaagtgcctcgggct

SEQ ID NO: 6923700 - DNA, 22 bp, Homo sapiens
tctaacctttgaaactgctttc

SEQ ID NO: 6923701 - DNA, 22 bp, Homo sapiens
tccagccctcctgggatcacag

SEQ ID NO: 6923702 - DNA, 17 bp, Homo sapiens
atccttctgttctttct

SEQ ID NO: 6923703 - DNA, 22 bp, Homo sapiens
acctctgaggtgaggaggagct

SEQ ID NO: 6923704 - DNA, 21 bp, Homo sapiens
tgatgaggtcatagcaccctc

SEQ ID NO: 6923705 - DNA, 22 bp, Homo sapiens
ttcaggactaggggcttcaagg

SEQ ID NO: 6923706 - DNA, 22 bp, Homo sapiens
gtgaggagtctgaagcacataa

SEQ ID NO: 6923707 - DNA, 22 bp, Homo sapiens
tcattggtaattatttttgaca

SEQ ID NO: 6923708 - DNA, 22 bp, Homo sapiens
tgtgattactgaatagaaaata

SEQ ID NO: 6923709 - DNA, 20 bp, Homo sapiens
tctcttcaggaggtccatgt

SEQ ID NO: 6923710 - DNA, 22 bp, Homo sapiens
gtgtgcctcgccaagctgtcgg

SEQ ID NO: 6923711 - DNA, 22 bp, Homo sapiens
gagcctggcctcctgcctcagc

SEQ ID NO: 6923712 - DNA, 22 bp, Homo sapiens
atgcagttagcagtagctcccc

SEQ ID NO: 6923713 - DNA, 22 bp, Homo sapiens
agagaaatatttaggaaaggag

SEQ ID NO: 6923714 - DNA, 22 bp, Homo sapiens
acctaattgagaagggctttga

SEQ ID NO: 6923715 - DNA, 22 bp, Homo sapiens
tcagtagtttctgctttgtgtt

SEQ ID NO: 6923716 - DNA, 22 bp, Homo sapiens
tttttcctaagcagtggagctg

SEQ ID NO: 6923717 - DNA, 19 bp, Homo sapiens
ttcctagtagactgtgtgt

SEQ ID NO: 6923718 - DNA, 22 bp, Homo sapiens
ggaactcagacgatcctatgtt

SEQ ID NO: 6923719 - DNA, 22 bp, Homo sapiens
ttaaagggccgatttccaggcc

SEQ ID NO: 6923720 - DNA, 22 bp, Homo sapiens
tgaacattggcacaaggcagca

SEQ ID NO: 6923721 - DNA, 22 bp, Homo sapiens
ccactgtctgtgacatcagaaa

SEQ ID NO: 6923722 - DNA, 20 bp, Homo sapiens
agcaaaatgcaagattttca

SEQ ID NO: 6923723 - DNA, 22 bp, Homo sapiens
ctgctgaggccttccctgtcct

SEQ ID NO: 6923724 - DNA, 22 bp, Homo sapiens
gagtatataattaattggtctg

SEQ ID NO: 6923725 - DNA, 22 bp, Homo sapiens
gagcttttgtgggggccaaggt

SEQ ID NO: 6923726 - DNA, 22 bp, Homo sapiens
tggcaggttaacttacaactgt

SEQ ID NO: 6923727 - DNA, 22 bp, Homo sapiens
atgcattaggctctggaaataa

SEQ ID NO: 6923728 - DNA, 22 bp, Homo sapiens
tcgaaggcctcttgctcctcga

SEQ ID NO: 6923729 - DNA, 22 bp, Homo sapiens
tcctctgccccagatgaaattt

SEQ ID NO: 6923730 - DNA, 22 bp, Homo sapiens
tacatgttatttcactattggt

SEQ ID NO: 6923731 - DNA, 22 bp, Homo sapiens
tgccatctgaaaattacatcct

SEQ ID NO: 6923732 - DNA, 22 bp, Homo sapiens
actccaaggccacatgcattcc

SEQ ID NO: 6923733 - DNA, 22 bp, Homo sapiens
aaaggtttgcatggaatttacc

SEQ ID NO: 6923734 - DNA, 22 bp, Homo sapiens
tgtgtgttcagagatagatata

SEQ ID NO: 6923735 - DNA, 20 bp, Homo sapiens
agagaccctgtagcttgcag

SEQ ID NO: 6923736 - DNA, 22 bp, Homo sapiens
cacaagtcattttcagcaggct

SEQ ID NO: 6923737 - DNA, 19 bp, Homo sapiens
aggcttggttgcagcaagc

SEQ ID NO: 6923738 - DNA, 19 bp, Homo sapiens
gcctgcctgggtttctgag

SEQ ID NO: 6923739 - DNA, 22 bp, Homo sapiens
ctgtctgtttctgattcaacct

SEQ ID NO: 6923740 - DNA, 22 bp, Homo sapiens
tcaaagggtagcccagggaaga

SEQ ID NO: 6923741 - DNA, 22 bp, Homo sapiens
gaatgagtattctttataggat

SEQ ID NO: 6923742 - DNA, 22 bp, Homo sapiens
tttctaagacatttgtcatctt

SEQ ID NO: 6923743 - DNA, 22 bp, Homo sapiens
tctctagtattaagctccattt

SEQ ID NO: 6923744 - DNA, 19 bp, Homo sapiens
aaagtgttttcttttctgt

SEQ ID NO: 6923745 - DNA, 22 bp, Homo sapiens
gagtcaccttgggtcagcgata

SEQ ID NO: 6923746 - DNA, 22 bp, Homo sapiens
aggctctgaagcaaccctttga

SEQ ID NO: 6923747 - DNA, 22 bp, Homo sapiens
ccaggaagctctgctccacggg

SEQ ID NO: 6923748 - DNA, 22 bp, Homo sapiens
ttaaatagtcaaatcagtggca

SEQ ID NO: 6923749 - DNA, 22 bp, Homo sapiens
aatagcaaatgctcatttgaaa

SEQ ID NO: 6923750 - DNA, 18 bp, Homo sapiens
gctgcaggcgcctgcggt

SEQ ID NO: 6923751 - DNA, 22 bp, Homo sapiens
gatggcagcagcagccagggat

SEQ ID NO: 6923752 - DNA, 22 bp, Homo sapiens
taataagtctgttgtttaattg

SEQ ID NO: 6923753 - DNA, 22 bp, Homo sapiens
tcatctgtgaataatgaactgg

SEQ ID NO: 6923754 - DNA, 19 bp, Homo sapiens
tgctcatggggacttctcc

SEQ ID NO: 6923755 - DNA, 22 bp, Homo sapiens
taggaaggaggccatcttggcg

SEQ ID NO: 6923756 - DNA, 22 bp, Homo sapiens
atttacatttatttgagaaggt

SEQ ID NO: 6923757 - DNA, 22 bp, Homo sapiens
ttcctgggagctagccacatct

SEQ ID NO: 6923758 - DNA, 22 bp, Homo sapiens
tgaagcccaaggcactgtctga

SEQ ID NO: 6923759 - DNA, 22 bp, Homo sapiens
aaattgcagatgctaaatgact

SEQ ID NO: 6923760 - DNA, 22 bp, Homo sapiens
ctgcctgcgttgcctcgtgcct

SEQ ID NO: 6923761 - DNA, 22 bp, Homo sapiens
aaatagctacatgatctctagg

SEQ ID NO: 6923762 - DNA, 19 bp, Homo sapiens
ctgacatgtgggggatgtc

SEQ ID NO: 6923763 - DNA, 22 bp, Homo sapiens
cgggctcaggaggaaacaggag

SEQ ID NO: 6923764 - DNA, 22 bp, Homo sapiens
gccttctccctaaccaaatcct

SEQ ID NO: 6923765 - DNA, 19 bp, Homo sapiens
aacagcaacttcctagtca

SEQ ID NO: 6923766 - DNA, 22 bp, Homo sapiens
aaattttagactcctgggtcta

SEQ ID NO: 6923767 - DNA, 23 bp, Homo sapiens
gccagccagaatttctccactgt

SEQ ID NO: 6923768 - DNA, 22 bp, Homo sapiens
taaaggattttgtataatataa

SEQ ID NO: 6923769 - DNA, 22 bp, Homo sapiens
tgttactattagtttgagcata

SEQ ID NO: 6923770 - DNA, 21 bp, Homo sapiens
ggagatgggtatcgcctgggc

SEQ ID NO: 6923771 - DNA, 22 bp, Homo sapiens
atgctacaggattctccttatc

SEQ ID NO: 6923772 - DNA, 22 bp, Homo sapiens
acatgcaagcagccgtgcagat

SEQ ID NO: 6923773 - DNA, 22 bp, Homo sapiens
agccacagcacattgtaagaaa

SEQ ID NO: 6923774 - DNA, 22 bp, Homo sapiens
cttcaaatgtgattttaataac

SEQ ID NO: 6923775 - DNA, 22 bp, Homo sapiens
agcctgggcctggcttcccgcc

SEQ ID NO: 6923776 - DNA, 22 bp, Homo sapiens
gcctgcctgaaggctgtaccag

SEQ ID NO: 6923777 - DNA, 22 bp, Homo sapiens
acagggacctgtgagctccata

SEQ ID NO: 6923778 - DNA, 22 bp, Homo sapiens
aatgacaataatcattaacttt

SEQ ID NO: 6923779 - DNA, 22 bp, Homo sapiens
tctcttaagttaagtgtaattc

SEQ ID NO: 6923780 - DNA, 22 bp, Homo sapiens
aggcttggaaaatttacagtgt

SEQ ID NO: 6923781 - DNA, 22 bp, Homo sapiens
aggtcctggtcttgagtcttaa

SEQ ID NO: 6923782 - DNA, 22 bp, Homo sapiens
gagttattgggtggaaaggtag

SEQ ID NO: 6923783 - DNA, 22 bp, Homo sapiens
aacatgtttccagtgtaaggcc

SEQ ID NO: 6923784 - DNA, 22 bp, Homo sapiens
ctctgagctgccttttgagctt

SEQ ID NO: 6923785 - DNA, 22 bp, Homo sapiens
tgggaggacttgtgggcttcat

SEQ ID NO: 6923786 - DNA, 22 bp, Homo sapiens
agtgtatttgagcatctcctta

SEQ ID NO: 6923787 - DNA, 22 bp, Homo sapiens
ctgtgtgagtgactgcatctca

SEQ ID NO: 6923788 - DNA, 22 bp, Homo sapiens
cagtcacatggatgatggatag

SEQ ID NO: 6923789 - DNA, 22 bp, Homo sapiens
aattgagtgctagacatcatga

SEQ ID NO: 6923790 - DNA, 22 bp, Homo sapiens
acctggcttctaatcatggctc

SEQ ID NO: 6923791 - DNA, 22 bp, Homo sapiens
gagtatatttctctctcttaag

SEQ ID NO: 6923792 - DNA, 20 bp, Homo sapiens
atcctggaatccaaatggag

SEQ ID NO: 6923793 - DNA, 22 bp, Homo sapiens
tttttgtagtcattagaagagg

SEQ ID NO: 6923794 - DNA, 20 bp, Homo sapiens
tgcaggcttcgctctaggag

SEQ ID NO: 6923795 - DNA, 23 bp, Homo sapiens
aggagacagggaagtgcctggct

SEQ ID NO: 6923796 - DNA, 22 bp, Homo sapiens
caggatgtatgtcttattcttc

SEQ ID NO: 6923797 - DNA, 22 bp, Homo sapiens
taaggcagcctcagggtagggt

SEQ ID NO: 6923798 - DNA, 22 bp, Homo sapiens
cagtgggtggcctcttgagtca

SEQ ID NO: 6923799 - DNA, 21 bp, Homo sapiens
aagtcaatacagataagtctt

SEQ ID NO: 6923800 - DNA, 22 bp, Homo sapiens
tcacccagccttggcgggtttg

SEQ ID NO: 6923801 - DNA, 22 bp, Homo sapiens
tttcttgtaagatgtttattaa

SEQ ID NO: 6923802 - DNA, 22 bp, Homo sapiens
catgggcttgctctctgagctc

SEQ ID NO: 6923803 - DNA, 22 bp, Homo sapiens
tcagcaatgtgatactgtgcaa

SEQ ID NO: 6923804 - DNA, 22 bp, Homo sapiens
ttctgggagagaaagggccttg

SEQ ID NO: 6923805 - DNA, 22 bp, Homo sapiens
aatgtgcagatgaataaacaaa

SEQ ID NO: 6923806 - DNA, 22 bp, Homo sapiens
tctgggaggtgttttgagaact

SEQ ID NO: 6923807 - DNA, 22 bp, Homo sapiens
tgaggcctgcttggaattgaat

SEQ ID NO: 6923808 - DNA, 15 bp, Homo sapiens
gcctctgagagccac

SEQ ID NO: 6923809 - DNA, 21 bp, Homo sapiens
cttgtcttgcttagaatagac

SEQ ID NO: 6923810 - DNA, 22 bp, Homo sapiens
tctggctttcatttgtttaaag

SEQ ID NO: 6923811 - DNA, 18 bp, Homo sapiens
atggctcaggaatggctt

SEQ ID NO: 6923812 - DNA, 22 bp, Homo sapiens
gctcagctggaccatcgtgttt

SEQ ID NO: 6923813 - DNA, 22 bp, Homo sapiens
cagccatgagtctaagcagttt

SEQ ID NO: 6923814 - DNA, 22 bp, Homo sapiens
ttgcccagagtcacccagctca

SEQ ID NO: 6923815 - DNA, 22 bp, Homo sapiens
tccctggcctggaaggatatca

SEQ ID NO: 6923816 - DNA, 22 bp, Homo sapiens
aatcataattcaaataagctta

SEQ ID NO: 6923817 - DNA, 22 bp, Homo sapiens
ggctgcctgtgcccaggcacac

SEQ ID NO: 6923818 - DNA, 22 bp, Homo sapiens
gaacttagtagtctacttctta

SEQ ID NO: 6923819 - DNA, 22 bp, Homo sapiens
atccatgatcaatttattacta

SEQ ID NO: 6923820 - DNA, 22 bp, Homo sapiens
cctggtccccatcggcccagcg

SEQ ID NO: 6923821 - DNA, 22 bp, Homo sapiens
gtttacatgcatgcaagaatga

SEQ ID NO: 6923822 - DNA, 22 bp, Homo sapiens
gtcatcttgctgttttagatct

SEQ ID NO: 6923823 - DNA, 22 bp, Homo sapiens
tagcaatccgttgatcccttgc

SEQ ID NO: 6923824 - DNA, 22 bp, Homo sapiens
tcctgactctggtgtcctctac

SEQ ID NO: 6923825 - DNA, 22 bp, Homo sapiens
acagcagaccccagtgccatgg

SEQ ID NO: 6923826 - DNA, 22 bp, Homo sapiens
cctgtcatttttatcaatgtct

SEQ ID NO: 6923827 - DNA, 22 bp, Homo sapiens
tagtgcccaaatcccagctctg

SEQ ID NO: 6923828 - DNA, 22 bp, Homo sapiens
ccagctcaagcactgtgtgaag

SEQ ID NO: 6923829 - DNA, 22 bp, Homo sapiens
atgggaggcagacactaagttc

SEQ ID NO: 6923830 - DNA, 22 bp, Homo sapiens
ttttgtaatttcctgacgacta

SEQ ID NO: 6923831 - DNA, 22 bp, Homo sapiens
ctgtgaattaagtattgttatc

SEQ ID NO: 6923832 - DNA, 19 bp, Homo sapiens
ttttgtgtagctgctggtt

SEQ ID NO: 6923833 - DNA, 22 bp, Homo sapiens
caggtgttgtctaaagcttcag

SEQ ID NO: 6923834 - DNA, 23 bp, Homo sapiens
tggggagagttaccctggaagcg

SEQ ID NO: 6923835 - DNA, 22 bp, Homo sapiens
atgtctacctcgatggagccat

SEQ ID NO: 6923836 - DNA, 22 bp, Homo sapiens
ttactttcaagtggctgggggt

SEQ ID NO: 6923837 - DNA, 15 bp, Homo sapiens
atgcagatagtctac

SEQ ID NO: 6923838 - DNA, 22 bp, Homo sapiens
tagggtgcttagctgttaacta

SEQ ID NO: 6923839 - DNA, 22 bp, Homo sapiens
tggcatgttaaagtagtattaa

SEQ ID NO: 6923840 - DNA, 22 bp, Homo sapiens
ttctccaaggttcatatttatc

SEQ ID NO: 6923841 - DNA, 19 bp, Homo sapiens
gtacagtggtaagctatga

SEQ ID NO: 6923842 - DNA, 22 bp, Homo sapiens
tccaacatgcagtcaggcctag

SEQ ID NO: 6923843 - DNA, 22 bp, Homo sapiens
atggtgccaaagatttctaagc

SEQ ID NO: 6923844 - DNA, 22 bp, Homo sapiens
tcatttttgaccatgggtagga

SEQ ID NO: 6923845 - DNA, 22 bp, Homo sapiens
gagcagttttatttcatgagac

SEQ ID NO: 6923846 - DNA, 22 bp, Homo sapiens
tgttctgtacctgtcctggggc

SEQ ID NO: 6923847 - DNA, 22 bp, Homo sapiens
tgtggcatggcagaagggcaca

SEQ ID NO: 6923848 - DNA, 22 bp, Homo sapiens
ggttacatggaagaaatataat

SEQ ID NO: 6923849 - DNA, 22 bp, Homo sapiens
tgttggctattattattactgc

SEQ ID NO: 6923850 - DNA, 22 bp, Homo sapiens
tccagcctcatttctcctgctt

SEQ ID NO: 6923851 - DNA, 20 bp, Homo sapiens
gtgtcagtaaatattatgtg

SEQ ID NO: 6923852 - DNA, 22 bp, Homo sapiens
tctgttcagaagaggtgaaagt

SEQ ID NO: 6923853 - DNA, 22 bp, Homo sapiens
ctggcactggatcgtgcatatc

SEQ ID NO: 6923854 - DNA, 22 bp, Homo sapiens
aaacggatataacagcaaacgc

SEQ ID NO: 6923855 - DNA, 22 bp, Homo sapiens
aagagctgcacatatttatatc

SEQ ID NO: 6923856 - DNA, 22 bp, Homo sapiens
gtagaggcagaaactgaaggac

SEQ ID NO: 6923857 - DNA, 22 bp, Homo sapiens
gtacaattaagtgcacaaatag

SEQ ID NO: 6923858 - DNA, 22 bp, Homo sapiens
ttcagagggacattcaagggaa

SEQ ID NO: 6923859 - DNA, 22 bp, Homo sapiens
gaaatattacagtggaggggat

SEQ ID NO: 6923860 - DNA, 22 bp, Homo sapiens
gtacagaatgcttggtaaggca

SEQ ID NO: 6923861 - DNA, 22 bp, Homo sapiens
cagagccaggtcttgaactcag

SEQ ID NO: 6923862 - DNA, 20 bp, Homo sapiens
ctttggagaaagatgcaata

SEQ ID NO: 6923863 - DNA, 22 bp, Homo sapiens
gggactggagtagaggccggtg

SEQ ID NO: 6923864 - DNA, 22 bp, Homo sapiens
ccaggtgactgtcagaggtttt

SEQ ID NO: 6923865 - DNA, 20 bp, Homo sapiens
tggctgcccgaggcacacac

SEQ ID NO: 6923866 - DNA, 20 bp, Homo sapiens
ttatttgtttactttggtcc

SEQ ID NO: 6923867 - DNA, 22 bp, Homo sapiens
tccagctctgattctcactagc

SEQ ID NO: 6923868 - DNA, 21 bp, Homo sapiens
tcagtaaacctaaagattgta

SEQ ID NO: 6923869 - DNA, 22 bp, Homo sapiens
gaatctatgcctcatatagacc

SEQ ID NO: 6923870 - DNA, 22 bp, Homo sapiens
acactctagagggaagcgcttt

SEQ ID NO: 6923871 - DNA, 22 bp, Homo sapiens
agtggctcagagtctattgagg

SEQ ID NO: 6923872 - DNA, 18 bp, Homo sapiens
taaatctctctttagtca

SEQ ID NO: 6923873 - DNA, 19 bp, Homo sapiens
cctgggagtcagctgaagg

SEQ ID NO: 6923874 - DNA, 22 bp, Homo sapiens
tccctgttcaaagtcacatagc

SEQ ID NO: 6923875 - DNA, 22 bp, Homo sapiens
ctgcaggttgagcagccaggtt

SEQ ID NO: 6923876 - DNA, 22 bp, Homo sapiens
agttgtatctgaatgcatgtag

SEQ ID NO: 6923877 - DNA, 22 bp, Homo sapiens
aagcatctatattccactgtga

SEQ ID NO: 6923878 - DNA, 22 bp, Homo sapiens
tgacttccctgaatgacctagt

SEQ ID NO: 6923879 - DNA, 20 bp, Homo sapiens
ccagagcagccactgaagtt

SEQ ID NO: 6923880 - DNA, 22 bp, Homo sapiens
ttgaagtcctaatccctagcac

SEQ ID NO: 6923881 - DNA, 22 bp, Homo sapiens
tggacttgcagagaagcccttc

SEQ ID NO: 6923882 - DNA, 22 bp, Homo sapiens
tgattagtccactataatccta

SEQ ID NO: 6923883 - DNA, 22 bp, Homo sapiens
tgcccactggataatgcaaact

SEQ ID NO: 6923884 - DNA, 22 bp, Homo sapiens
atctaggtttggaagatagagt

SEQ ID NO: 6923885 - DNA, 22 bp, Homo sapiens
cagtggcagatcaccaactgga

SEQ ID NO: 6923886 - DNA, 22 bp, Homo sapiens
tgtatacatgtctgtgtgcaca

SEQ ID NO: 6923887 - DNA, 22 bp, Homo sapiens
ctgtactcaaggtaaaccagga

SEQ ID NO: 6923888 - DNA, 22 bp, Homo sapiens
ttcagacttaaaagatcccagc

SEQ ID NO: 6923889 - DNA, 22 bp, Homo sapiens
tgaagctggttgtatgactgga

SEQ ID NO: 6923890 - DNA, 22 bp, Homo sapiens
ccagccactgggccactgccag

SEQ ID NO: 6923891 - DNA, 22 bp, Homo sapiens
cctcaggtgtgggccagctgtc

SEQ ID NO: 6923892 - DNA, 18 bp, Homo sapiens
gagaaacctgtgaatgct

SEQ ID NO: 6923893 - DNA, 22 bp, Homo sapiens
gcttgcattctggatctatggt

SEQ ID NO: 6923894 - DNA, 22 bp, Homo sapiens
ccggagaaactggcaaacccta

SEQ ID NO: 6923895 - DNA, 22 bp, Homo sapiens
tgtgaaagcagccatgggcatt

SEQ ID NO: 6923896 - DNA, 22 bp, Homo sapiens
ttcatgtaattccataaggtaa

SEQ ID NO: 6923897 - DNA, 21 bp, Homo sapiens
gctcagctgcttggttcctgt

SEQ ID NO: 6923898 - DNA, 22 bp, Homo sapiens
tgctgtgttctcctgactcacc

SEQ ID NO: 6923899 - DNA, 22 bp, Homo sapiens
gcccatcatcactgtggaggct

SEQ ID NO: 6923900 - DNA, 22 bp, Homo sapiens
cctgtcctccggagcgggctgt

SEQ ID NO: 6923901 - DNA, 22 bp, Homo sapiens
agtttgggttctggagaaattt

SEQ ID NO: 6923902 - DNA, 22 bp, Homo sapiens
ctccacaggtgtactgtacctt

SEQ ID NO: 6923903 - DNA, 16 bp, Homo sapiens
cagagtgtaaacagga

SEQ ID NO: 6923904 - DNA, 22 bp, Homo sapiens
ctagaagttggggctagggata

SEQ ID NO: 6923905 - DNA, 22 bp, Homo sapiens
agggccatttgctggagctttg

SEQ ID NO: 6923906 - DNA, 22 bp, Homo sapiens
gcaaatagaagattctgttgac

SEQ ID NO: 6923907 - DNA, 22 bp, Homo sapiens
gtctgggcacctggcctgggaa

SEQ ID NO: 6923908 - DNA, 22 bp, Homo sapiens
ttctttgtgcatccaattttct

SEQ ID NO: 6923909 - DNA, 22 bp, Homo sapiens
ctgggcaggtatacaaaaaatg

SEQ ID NO: 6923910 - DNA, 21 bp, Homo sapiens
gctgccaccgcgtgctccagg

SEQ ID NO: 6923911 - DNA, 22 bp, Homo sapiens
ttgttagcatgcttaatggata

SEQ ID NO: 6923912 - DNA, 22 bp, Homo sapiens
tcattgttcctatttggcaaga

SEQ ID NO: 6923913 - DNA, 22 bp, Homo sapiens
tgtctaacccagtggcaggagg

SEQ ID NO: 6923914 - DNA, 22 bp, Homo sapiens
ataaagctcttagtagcagcct

SEQ ID NO: 6923915 - DNA, 22 bp, Homo sapiens
tatacaatggctgaatcatcca

SEQ ID NO: 6923916 - DNA, 22 bp, Homo sapiens
ttgcagctctctgaaggttgca

SEQ ID NO: 6923917 - DNA, 22 bp, Homo sapiens
ctagttattagctactcattga

SEQ ID NO: 6923918 - DNA, 20 bp, Homo sapiens
gtttctgattcagtaggtct

SEQ ID NO: 6923919 - DNA, 17 bp, Homo sapiens
aggggagagtgggaaga

SEQ ID NO: 6923920 - DNA, 22 bp, Homo sapiens
ttcagcactgttatggatttgc

SEQ ID NO: 6923921 - DNA, 22 bp, Homo sapiens
tcagatttccttgcagtttgga

SEQ ID NO: 6923922 - DNA, 22 bp, Homo sapiens
ctcaggctctgtactccctttg

SEQ ID NO: 6923923 - DNA, 22 bp, Homo sapiens
cactgaggtatctgtctctcct

SEQ ID NO: 6923924 - DNA, 20 bp, Homo sapiens
agggtcagtagcacagagct

SEQ ID NO: 6923925 - DNA, 22 bp, Homo sapiens
aattctgtaactttactgaatt

SEQ ID NO: 6923926 - DNA, 21 bp, Homo sapiens
aggaagctgcccagatagtag

SEQ ID NO: 6923927 - DNA, 22 bp, Homo sapiens
actgggagggtcttgaagaggg

SEQ ID NO: 6923928 - DNA, 22 bp, Homo sapiens
gagccaagcaccacattaagtt

SEQ ID NO: 6923929 - DNA, 22 bp, Homo sapiens
agtccagtctcactcttggcag

SEQ ID NO: 6923930 - DNA, 22 bp, Homo sapiens
atgtaaagggcatggtattggg

SEQ ID NO: 6923931 - DNA, 22 bp, Homo sapiens
cccagagttcaaaccctgcgtc

SEQ ID NO: 6923932 - DNA, 22 bp, Homo sapiens
taacattccatggatctgcaga

SEQ ID NO: 6923933 - DNA, 22 bp, Homo sapiens
agcagctggggcctgtgacgat

SEQ ID NO: 6923934 - DNA, 22 bp, Homo sapiens
gagtgcaggcctgagcaccatc

SEQ ID NO: 6923935 - DNA, 22 bp, Homo sapiens
ggagaaggaatattggagtagg

SEQ ID NO: 6923936 - DNA, 22 bp, Homo sapiens
agctcagggccaggcgcgtttc

SEQ ID NO: 6923937 - DNA, 22 bp, Homo sapiens
aaaggtggagttgtgcccattt

SEQ ID NO: 6923938 - DNA, 22 bp, Homo sapiens
ggctggcagttaatacctgaag

SEQ ID NO: 6923939 - DNA, 22 bp, Homo sapiens
cctggccagtttccaggccctg

SEQ ID NO: 6923940 - DNA, 22 bp, Homo sapiens
ctttatggagtgacacaatggg

SEQ ID NO: 6923941 - DNA, 21 bp, Homo sapiens
aataaccactaatatagtggc

SEQ ID NO: 6923942 - DNA, 22 bp, Homo sapiens
gagtcaggcactgctgctgctc

SEQ ID NO: 6923943 - DNA, 22 bp, Homo sapiens
attcagttccttgagggtatag

SEQ ID NO: 6923944 - DNA, 22 bp, Homo sapiens
taactgatgtgaacttaccatt

SEQ ID NO: 6923945 - DNA, 22 bp, Homo sapiens
acttgaataggaaagccacaaa

SEQ ID NO: 6923946 - DNA, 22 bp, Homo sapiens
agccctggcagagccaggtagt

SEQ ID NO: 6923947 - DNA, 22 bp, Homo sapiens
aagggcattgaggctgagagac

SEQ ID NO: 6923948 - DNA, 22 bp, Homo sapiens
tgcatattttataaagatggaa

SEQ ID NO: 6923949 - DNA, 22 bp, Homo sapiens
cttgtacaagtcagtgctgggg

SEQ ID NO: 6923950 - DNA, 22 bp, Homo sapiens
ttctgaagctcccttttgtagt

SEQ ID NO: 6923951 - DNA, 22 bp, Homo sapiens
aatactgcatacagtttctcat

SEQ ID NO: 6923952 - DNA, 22 bp, Homo sapiens
ttttccacctggttccagggct

SEQ ID NO: 6923953 - DNA, 22 bp, Homo sapiens
tataaattattaggctgctaaa

SEQ ID NO: 6923954 - DNA, 22 bp, Homo sapiens
cctgggtggttccggcaaggag

SEQ ID NO: 6923955 - DNA, 22 bp, Homo sapiens
tccagaaggggaaatttggctt

SEQ ID NO: 6923956 - DNA, 22 bp, Homo sapiens
tggctgcaggggtgtctgacat

SEQ ID NO: 6923957 - DNA, 22 bp, Homo sapiens
tggttcagagagttgctgacca

SEQ ID NO: 6923958 - DNA, 22 bp, Homo sapiens
tattggatagcttgtgcagaat

SEQ ID NO: 6923959 - DNA, 22 bp, Homo sapiens
gcttgggaggcaagcattccat

SEQ ID NO: 6923960 - DNA, 22 bp, Homo sapiens
tggttacccagtcgctggagtt

SEQ ID NO: 6923961 - DNA, 22 bp, Homo sapiens
gccacatagaggaggatattaa

SEQ ID NO: 6923962 - DNA, 22 bp, Homo sapiens
ggcatcgtcctgggcataggga

SEQ ID NO: 6923963 - DNA, 22 bp, Homo sapiens
tgataatgaaaggtatttggat

SEQ ID NO: 6923964 - DNA, 22 bp, Homo sapiens
gcttcctgtccctcagccatga

SEQ ID NO: 6923965 - DNA, 22 bp, Homo sapiens
atctaacttatgttttaccaaa

SEQ ID NO: 6923966 - DNA, 22 bp, Homo sapiens
tctggcttgtctcagggtctga

SEQ ID NO: 6923967 - DNA, 22 bp, Homo sapiens
aggcactgagaggctgtgttgc

SEQ ID NO: 6923968 - DNA, 23 bp, Homo sapiens
agaattccagtttcttatgtcac

SEQ ID NO: 6923969 - DNA, 22 bp, Homo sapiens
atcgaacagtgtatacacttag

SEQ ID NO: 6923970 - DNA, 22 bp, Homo sapiens
caaggtagttctggtcattgac

SEQ ID NO: 6923971 - DNA, 22 bp, Homo sapiens
tcaagcaaagtttagctggtta

SEQ ID NO: 6923972 - DNA, 22 bp, Homo sapiens
tggtagtttctgtatctcacag

SEQ ID NO: 6923973 - DNA, 22 bp, Homo sapiens
aggcattattagatgatgttat

SEQ ID NO: 6923974 - DNA, 17 bp, Homo sapiens
tgatgcaaagtcagctg

SEQ ID NO: 6923975 - DNA, 22 bp, Homo sapiens
gaagtcttcatctgatgctctg

SEQ ID NO: 6923976 - DNA, 22 bp, Homo sapiens
ccagctggaacggcagcccagc

SEQ ID NO: 6923977 - DNA, 22 bp, Homo sapiens
aagttcaagtgtaatctttatt

SEQ ID NO: 6923978 - DNA, 22 bp, Homo sapiens
tgcaaagaagcaacatccttgt

SEQ ID NO: 6923979 - DNA, 20 bp, Homo sapiens
cactgggctggagtcagggc

SEQ ID NO: 6923980 - DNA, 22 bp, Homo sapiens
cagggagaagtctggtcagtcc

SEQ ID NO: 6923981 - DNA, 22 bp, Homo sapiens
tttctctgccagttattttcct

SEQ ID NO: 6923982 - DNA, 22 bp, Homo sapiens
cattcggaggtagttgaggtta

SEQ ID NO: 6923983 - DNA, 22 bp, Homo sapiens
actctctgtggttctactttgc

SEQ ID NO: 6923984 - DNA, 22 bp, Homo sapiens
aatggaatcagtttctctaagt

SEQ ID NO: 6923985 - DNA, 22 bp, Homo sapiens
gcctgacttgtgtattttacat

SEQ ID NO: 6923986 - DNA, 22 bp, Homo sapiens
tgaggcaaggctgaatgaaggc

SEQ ID NO: 6923987 - DNA, 22 bp, Homo sapiens
tctcaaactgtgtattataatt

SEQ ID NO: 6923988 - DNA, 21 bp, Homo sapiens
tcagagaacccggcaggcaag

SEQ ID NO: 6923989 - DNA, 21 bp, Homo sapiens
agctcagccgggcacagtggc

SEQ ID NO: 6923990 - DNA, 22 bp, Homo sapiens
tcacagggtatctgggatggat

SEQ ID NO: 6923991 - DNA, 22 bp, Homo sapiens
agatttgttgtgagcaggaata

SEQ ID NO: 6923992 - DNA, 22 bp, Homo sapiens
ctgctttatagggcttccatgt

SEQ ID NO: 6923993 - DNA, 22 bp, Homo sapiens
ttttggaagccgcggctgggca

SEQ ID NO: 6923994 - DNA, 22 bp, Homo sapiens
gaggtagtaagcagagtggggt

SEQ ID NO: 6923995 - DNA, 22 bp, Homo sapiens
gcacagagggcagtgagcctct

SEQ ID NO: 6923996 - DNA, 22 bp, Homo sapiens
tcgaaataatttagaatataga

SEQ ID NO: 6923997 - DNA, 22 bp, Homo sapiens
attgtgtaattttcagctcata

SEQ ID NO: 6923998 - DNA, 22 bp, Homo sapiens
tgtggactctgagatccggaga

SEQ ID NO: 6923999 - DNA, 22 bp, Homo sapiens
ggctttctagatctagctctgt

SEQ ID NO: 6924000 - DNA, 22 bp, Homo sapiens
agtgacagattaccggcagagc

SEQ ID NO: 6924001 - DNA, 21 bp, Homo sapiens
gcgttcactttttattgtgct

SEQ ID NO: 6924002 - DNA, 22 bp, Homo sapiens
tgatggtgatggttgcacaatg

SEQ ID NO: 6924003 - DNA, 22 bp, Homo sapiens
gggcctcaggttctggagaagg

SEQ ID NO: 6924004 - DNA, 22 bp, Homo sapiens
tctcccattacttatggcccac

SEQ ID NO: 6924005 - DNA, 21 bp, Homo sapiens
tatagcagcatgatttataat

SEQ ID NO: 6924006 - DNA, 22 bp, Homo sapiens
tttgaaagtcaaccttccagtt

SEQ ID NO: 6924007 - DNA, 22 bp, Homo sapiens
aagtgacagtgaactgggactc

SEQ ID NO: 6924008 - DNA, 22 bp, Homo sapiens
tagccctcagcttggagcgtgg

SEQ ID NO: 6924009 - DNA, 22 bp, Homo sapiens
tctggactataggctgccaagt

SEQ ID NO: 6924010 - DNA, 22 bp, Homo sapiens
gtgcaggtgttttggctgccag

SEQ ID NO: 6924011 - DNA, 22 bp, Homo sapiens
ctcttaatgaggctgacttgta

SEQ ID NO: 6924012 - DNA, 22 bp, Homo sapiens
aggggcctcgcaggaccgctcc

SEQ ID NO: 6924013 - DNA, 22 bp, Homo sapiens
ttacagatgtaggaactgaagt

SEQ ID NO: 6924014 - DNA, 22 bp, Homo sapiens
tggctctggtgcgggctcctgc

SEQ ID NO: 6924015 - DNA, 22 bp, Homo sapiens
tatggctggaatactgaaaggc

SEQ ID NO: 6924016 - DNA, 22 bp, Homo sapiens
ctatccaaggagtttttgaaat

SEQ ID NO: 6924017 - DNA, 22 bp, Homo sapiens
agctgtggtgttttcaagccct

SEQ ID NO: 6924018 - DNA, 22 bp, Homo sapiens
cagagcttaaaactccatggaa

SEQ ID NO: 6924019 - DNA, 22 bp, Homo sapiens
tcttcagtgaatggcaagatct

SEQ ID NO: 6924020 - DNA, 22 bp, Homo sapiens
aagcagatctgatagggccctg

SEQ ID NO: 6924021 - DNA, 22 bp, Homo sapiens
atagtcttcagcactttgatca

SEQ ID NO: 6924022 - DNA, 22 bp, Homo sapiens
agtgtttacattgaagcttgta

SEQ ID NO: 6924023 - DNA, 22 bp, Homo sapiens
gagtgtcagtgcttggggctac

SEQ ID NO: 6924024 - DNA, 21 bp, Homo sapiens
cagtgcaattgattttttaga

SEQ ID NO: 6924025 - DNA, 21 bp, Homo sapiens
tagggctctatttttatttca

SEQ ID NO: 6924026 - DNA, 22 bp, Homo sapiens
tatgagaactgacagagtgcca

SEQ ID NO: 6924027 - DNA, 22 bp, Homo sapiens
tttagcagtatatttaaagcca

SEQ ID NO: 6924028 - DNA, 22 bp, Homo sapiens
ttgctgatctgaaacgttactg

SEQ ID NO: 6924029 - DNA, 22 bp, Homo sapiens
accatcagtcacatgtagagaa

SEQ ID NO: 6924030 - DNA, 22 bp, Homo sapiens
actgaaagaaccttcctgttgc

SEQ ID NO: 6924031 - DNA, 22 bp, Homo sapiens
cccaagcagggtgcagaggcat

SEQ ID NO: 6924032 - DNA, 21 bp, Homo sapiens
agccagtctgccagagaagcc

SEQ ID NO: 6924033 - DNA, 22 bp, Homo sapiens
tgccttgcacataatatacatt

SEQ ID NO: 6924034 - DNA, 22 bp, Homo sapiens
gaggcccacagggagtaccaag

SEQ ID NO: 6924035 - DNA, 19 bp, Homo sapiens
tgaatgacgggcatgagca

SEQ ID NO: 6924036 - DNA, 17 bp, Homo sapiens
agtctgtctttccttgt

SEQ ID NO: 6924037 - DNA, 22 bp, Homo sapiens
acacatttctaaatttttaccg

SEQ ID NO: 6924038 - DNA, 22 bp, Homo sapiens
ctcactgactgcaagtcaagtt

SEQ ID NO: 6924039 - DNA, 22 bp, Homo sapiens
tggaaaacataaagcttttcct

SEQ ID NO: 6924040 - DNA, 22 bp, Homo sapiens
tttcagtgggtttatttcatgt

SEQ ID NO: 6924041 - DNA, 22 bp, Homo sapiens
acatcagtccaccactgcagtt

SEQ ID NO: 6924042 - DNA, 22 bp, Homo sapiens
gaaaagagacagggtgggtgat

SEQ ID NO: 6924043 - DNA, 22 bp, Homo sapiens
ggcagccagcacgcagttgatg

SEQ ID NO: 6924044 - DNA, 22 bp, Homo sapiens
gcagagtgagatatgaacccag

SEQ ID NO: 6924045 - DNA, 22 bp, Homo sapiens
taaagacatggtgtaggtgaac

SEQ ID NO: 6924046 - DNA, 22 bp, Homo sapiens
gtagtagcagtaacaaggtata

SEQ ID NO: 6924047 - DNA, 22 bp, Homo sapiens
tttgacaaaattatgctaatat

SEQ ID NO: 6924048 - DNA, 22 bp, Homo sapiens
ttacagggatcccataaatgtc

SEQ ID NO: 6924049 - DNA, 22 bp, Homo sapiens
gctggcaatggtgtggtctggt

SEQ ID NO: 6924050 - DNA, 20 bp, Homo sapiens
ggcagcaaccatatgctaca

SEQ ID NO: 6924051 - DNA, 22 bp, Homo sapiens
tgtgaggacattggaggactca

SEQ ID NO: 6924052 - DNA, 22 bp, Homo sapiens
agagtgtgtgctgagaaacgag

SEQ ID NO: 6924053 - DNA, 22 bp, Homo sapiens
tcactgcaacctctgcctcttg

SEQ ID NO: 6924054 - DNA, 22 bp, Homo sapiens
tctcacacaacatgttactttg

SEQ ID NO: 6924055 - DNA, 22 bp, Homo sapiens
gcaggtgaaagtgagtagtgag

SEQ ID NO: 6924056 - DNA, 22 bp, Homo sapiens
tggtcataacatgattagtagg

SEQ ID NO: 6924057 - DNA, 22 bp, Homo sapiens
ttctgttttgcacagacttgaa

SEQ ID NO: 6924058 - DNA, 22 bp, Homo sapiens
aaggtctgtgaggctgtttgtc

SEQ ID NO: 6924059 - DNA, 22 bp, Homo sapiens
ctatcactctctatttgttctt

SEQ ID NO: 6924060 - DNA, 22 bp, Homo sapiens
aaaatgaagcaaaggcattcag

SEQ ID NO: 6924061 - DNA, 22 bp, Homo sapiens
gcagtgcaggaacatagcttct

SEQ ID NO: 6924062 - DNA, 22 bp, Homo sapiens
actttcaacttggtgggagagc

SEQ ID NO: 6924063 - DNA, 22 bp, Homo sapiens
tagcaactgctctattctagga

SEQ ID NO: 6924064 - DNA, 22 bp, Homo sapiens
actgtatagtatttattcttag

SEQ ID NO: 6924065 - DNA, 22 bp, Homo sapiens
cctcaggctagctactgtccct

SEQ ID NO: 6924066 - DNA, 22 bp, Homo sapiens
tgtaatggaagtgggattgcat

SEQ ID NO: 6924067 - DNA, 19 bp, Homo sapiens
tgaccccacgctccagagc

SEQ ID NO: 6924068 - DNA, 22 bp, Homo sapiens
aagcttgatgcagagtcaggga

SEQ ID NO: 6924069 - DNA, 22 bp, Homo sapiens
cttcactgggctcctgagaggg

SEQ ID NO: 6924070 - DNA, 22 bp, Homo sapiens
tgagttatatatactggctctg

SEQ ID NO: 6924071 - DNA, 22 bp, Homo sapiens
agctctgatctttacaacaaag

SEQ ID NO: 6924072 - DNA, 22 bp, Homo sapiens
gcagacaggattgggttaatag

SEQ ID NO: 6924073 - DNA, 19 bp, Homo sapiens
tgccccttaagagtttctc

SEQ ID NO: 6924074 - DNA, 19 bp, Homo sapiens
ttcactaattgtaagattt

SEQ ID NO: 6924075 - DNA, 22 bp, Homo sapiens
ctgttaaaagcactgccatcct

SEQ ID NO: 6924076 - DNA, 22 bp, Homo sapiens
ttgggtcctaaccccagagtct

SEQ ID NO: 6924077 - DNA, 22 bp, Homo sapiens
gtctccatggaaagtagccagt

SEQ ID NO: 6924078 - DNA, 22 bp, Homo sapiens
tgtgccttcctctgagcttgtc

SEQ ID NO: 6924079 - DNA, 21 bp, Homo sapiens
ttggacttttgcgtgattgag

SEQ ID NO: 6924080 - DNA, 22 bp, Homo sapiens
ttctgtaattctgttagtttca

SEQ ID NO: 6924081 - DNA, 23 bp, Homo sapiens
aagcttccttgactggcccctag

SEQ ID NO: 6924082 - DNA, 22 bp, Homo sapiens
ccaggaggtggcaggacttgcc

SEQ ID NO: 6924083 - DNA, 22 bp, Homo sapiens
tctctgtggcatccactcaact

SEQ ID NO: 6924084 - DNA, 22 bp, Homo sapiens
gctgggctgcgtcggggaagcc

SEQ ID NO: 6924085 - DNA, 22 bp, Homo sapiens
tccttaattggcttattggcat

SEQ ID NO: 6924086 - DNA, 22 bp, Homo sapiens
tgtgtcctatgaaagagggtta

SEQ ID NO: 6924087 - DNA, 22 bp, Homo sapiens
ttatagggtttctgggagtggg

SEQ ID NO: 6924088 - DNA, 22 bp, Homo sapiens
tctgttccagtagaaaggtgca

SEQ ID NO: 6924089 - DNA, 22 bp, Homo sapiens
ctgggctcagtggctcatggct

SEQ ID NO: 6924090 - DNA, 22 bp, Homo sapiens
tgcaagaaaggtggggccaggc

SEQ ID NO: 6924091 - DNA, 22 bp, Homo sapiens
agcattaggtgtgtttcagagg

SEQ ID NO: 6924092 - DNA, 22 bp, Homo sapiens
acactgcttctctggcagagcc

SEQ ID NO: 6924093 - DNA, 23 bp, Homo sapiens
tctgaagatgctgtttccagtga

SEQ ID NO: 6924094 - DNA, 22 bp, Homo sapiens
tgcaggctatcctttgctgcaa

SEQ ID NO: 6924095 - DNA, 22 bp, Homo sapiens
agtccttatgagatgctgcctt

SEQ ID NO: 6924096 - DNA, 22 bp, Homo sapiens
tctgagaatggagctaaaaatc

SEQ ID NO: 6924097 - DNA, 21 bp, Homo sapiens
gtgcggatgccgtcattgtca

SEQ ID NO: 6924098 - DNA, 22 bp, Homo sapiens
acacagtaggccaccatgtcat

SEQ ID NO: 6924099 - DNA, 22 bp, Homo sapiens
ttcaggattctttcagactggg

SEQ ID NO: 6924100 - DNA, 22 bp, Homo sapiens
caaagcttcatctgttgttttg

SEQ ID NO: 6924101 - DNA, 22 bp, Homo sapiens
taaggctttccttgtcatcttt

SEQ ID NO: 6924102 - DNA, 22 bp, Homo sapiens
aggctctgtatgaaggtttggg

SEQ ID NO: 6924103 - DNA, 22 bp, Homo sapiens
tggcagttattaatcaagtctt

SEQ ID NO: 6924104 - DNA, 22 bp, Homo sapiens
tgttgagtatatacctacaagt

SEQ ID NO: 6924105 - DNA, 22 bp, Homo sapiens
tgagaatgtgcaatatccttcc

SEQ ID NO: 6924106 - DNA, 22 bp, Homo sapiens
ttgtgccattaataaggagttg

SEQ ID NO: 6924107 - DNA, 22 bp, Homo sapiens
atggctatttagagttaagcat

SEQ ID NO: 6924108 - DNA, 22 bp, Homo sapiens
aggatcctgcgctttgggggag

SEQ ID NO: 6924109 - DNA, 22 bp, Homo sapiens
ccttcaaattctcttagctgaa

SEQ ID NO: 6924110 - DNA, 22 bp, Homo sapiens
ttgcaggtctccatgagtgcga

SEQ ID NO: 6924111 - DNA, 18 bp, Homo sapiens
gggctgtgttcatgccca

SEQ ID NO: 6924112 - DNA, 22 bp, Homo sapiens
attctgctcatgagctcccggg

SEQ ID NO: 6924113 - DNA, 22 bp, Homo sapiens
cttgctttcagtctcggcctca

SEQ ID NO: 6924114 - DNA, 22 bp, Homo sapiens
tcaatgtctgtctatctattta

SEQ ID NO: 6924115 - DNA, 22 bp, Homo sapiens
acatcccatgcgcatctggcaa

SEQ ID NO: 6924116 - DNA, 22 bp, Homo sapiens
tgttcaaatcttttgcttattt

SEQ ID NO: 6924117 - DNA, 22 bp, Homo sapiens
taaatcacaaattttctcattt

SEQ ID NO: 6924118 - DNA, 22 bp, Homo sapiens
cccaggctggagtgcagtggcg

SEQ ID NO: 6924119 - DNA, 22 bp, Homo sapiens
tcagtgtgaattcaggagccta

SEQ ID NO: 6924120 - DNA, 22 bp, Homo sapiens
ctgggacttgtagtctcggcgc

SEQ ID NO: 6924121 - DNA, 22 bp, Homo sapiens
tggctcctgtggctatttcagt

SEQ ID NO: 6924122 - DNA, 22 bp, Homo sapiens
gagatgttaactacatagctac

SEQ ID NO: 6924123 - DNA, 22 bp, Homo sapiens
tacgcgaagaaggacctgatgg

SEQ ID NO: 6924124 - DNA, 22 bp, Homo sapiens
tgggaatagaacaagatagaga

SEQ ID NO: 6924125 - DNA, 22 bp, Homo sapiens
cctcctgggacaggctggcaca

SEQ ID NO: 6924126 - DNA, 22 bp, Homo sapiens
cggctcactgcagctccgcctc

SEQ ID NO: 6924127 - DNA, 22 bp, Homo sapiens
cagggctgagaatttagagaca

SEQ ID NO: 6924128 - DNA, 21 bp, Homo sapiens
tgcttgcagaactttcaggct

SEQ ID NO: 6924129 - DNA, 22 bp, Homo sapiens
cagtgtataaactttaacatag

SEQ ID NO: 6924130 - DNA, 22 bp, Homo sapiens
ttctaattgaccttaggctgtg

SEQ ID NO: 6924131 - DNA, 22 bp, Homo sapiens
attatgtctttagatatttggt

SEQ ID NO: 6924132 - DNA, 19 bp, Homo sapiens
tttgcagtggttcctttgt

SEQ ID NO: 6924133 - DNA, 22 bp, Homo sapiens
tttggtttgaatgagcataaga

SEQ ID NO: 6924134 - DNA, 22 bp, Homo sapiens
tcaggggcagctgtgctttgtg

SEQ ID NO: 6924135 - DNA, 22 bp, Homo sapiens
attgacaaatctgaacatacgg

SEQ ID NO: 6924136 - DNA, 22 bp, Homo sapiens
cagtgattcaggtgcctgttgg

SEQ ID NO: 6924137 - DNA, 22 bp, Homo sapiens
agggaggaaggaactccttcta

SEQ ID NO: 6924138 - DNA, 22 bp, Homo sapiens
agtgctttcagtgtgctctttt

SEQ ID NO: 6924139 - DNA, 22 bp, Homo sapiens
ctagagaacaacattcatatgg

SEQ ID NO: 6924140 - DNA, 22 bp, Homo sapiens
gggctgcacagatcttcaaggg

SEQ ID NO: 6924141 - DNA, 22 bp, Homo sapiens
gaagtcttttagcaaaacgaac

SEQ ID NO: 6924142 - DNA, 22 bp, Homo sapiens
atggccctttattccttcttcc

SEQ ID NO: 6924143 - DNA, 22 bp, Homo sapiens
gatcatcttttcctgcttccag

SEQ ID NO: 6924144 - DNA, 22 bp, Homo sapiens
ttcctggcacactcctgaatgt

SEQ ID NO: 6924145 - DNA, 22 bp, Homo sapiens
aggcattttgttcaagatgaca

SEQ ID NO: 6924146 - DNA, 22 bp, Homo sapiens
agtctcagaaaagaagcatgga

SEQ ID NO: 6924147 - DNA, 22 bp, Homo sapiens
gcttgctttgtaaatatctgtg

SEQ ID NO: 6924148 - DNA, 22 bp, Homo sapiens
agcactcttctgtgatagttgt

SEQ ID NO: 6924149 - DNA, 22 bp, Homo sapiens
atgctgaaggtgaattgacaat

SEQ ID NO: 6924150 - DNA, 22 bp, Homo sapiens
ctgggtcagtggcaagctgggt

SEQ ID NO: 6924151 - DNA, 22 bp, Homo sapiens
gctctggaacctgccaggatgc

SEQ ID NO: 6924152 - DNA, 22 bp, Homo sapiens
tgggcacagaatagatggccca

SEQ ID NO: 6924153 - DNA, 18 bp, Homo sapiens
gggcatcattcacaaagt

SEQ ID NO: 6924154 - DNA, 20 bp, Homo sapiens
ggtgcaggtaacgctgtgct

SEQ ID NO: 6924155 - DNA, 22 bp, Homo sapiens
ccactctttactgttgggtttt

SEQ ID NO: 6924156 - DNA, 22 bp, Homo sapiens
gcaaattaaccaatcatgctcg

SEQ ID NO: 6924157 - DNA, 22 bp, Homo sapiens
ttccctcttttccaacagttgt

SEQ ID NO: 6924158 - DNA, 20 bp, Homo sapiens
gagcccaagtagggagaaat

SEQ ID NO: 6924159 - DNA, 22 bp, Homo sapiens
gggcccactggctgtctgaccc

SEQ ID NO: 6924160 - DNA, 22 bp, Homo sapiens
gtccggtgagggggctgcagag

SEQ ID NO: 6924161 - DNA, 22 bp, Homo sapiens
aattccacaaaaggttctcttc

SEQ ID NO: 6924162 - DNA, 22 bp, Homo sapiens
aagctctttccactaaaccact

SEQ ID NO: 6924163 - DNA, 23 bp, Homo sapiens
agaaaagcttggacacatggcct

SEQ ID NO: 6924164 - DNA, 22 bp, Homo sapiens
ttacccaggaaagaaatggtat

SEQ ID NO: 6924165 - DNA, 22 bp, Homo sapiens
tccctgcagctgtaggccggcg

SEQ ID NO: 6924166 - DNA, 22 bp, Homo sapiens
ttcgcccagctccaggctggcc

SEQ ID NO: 6924167 - DNA, 17 bp, Homo sapiens
ttatgcctgtgaggttg

SEQ ID NO: 6924168 - DNA, 22 bp, Homo sapiens
tccatgactaggaaaccagttt

SEQ ID NO: 6924169 - DNA, 22 bp, Homo sapiens
tctgggagcacacgcagtgatc

SEQ ID NO: 6924170 - DNA, 22 bp, Homo sapiens
tatcagtatggattcatggatt

SEQ ID NO: 6924171 - DNA, 22 bp, Homo sapiens
atgcaaacatgtttcctctaag

SEQ ID NO: 6924172 - DNA, 22 bp, Homo sapiens
taaggctttatttttacaatgc

SEQ ID NO: 6924173 - DNA, 22 bp, Homo sapiens
taaggctatcttttgagtgtgt

SEQ ID NO: 6924174 - DNA, 18 bp, Homo sapiens
tgtctcaggctgaaacag

SEQ ID NO: 6924175 - DNA, 22 bp, Homo sapiens
caaagttttagtaaacatatat

SEQ ID NO: 6924176 - DNA, 22 bp, Homo sapiens
aataagattactggttgtctga

SEQ ID NO: 6924177 - DNA, 22 bp, Homo sapiens
acatagagagcacttagaagtt

SEQ ID NO: 6924178 - DNA, 23 bp, Homo sapiens
gctaaattgaagtctcaggggaa

SEQ ID NO: 6924179 - DNA, 22 bp, Homo sapiens
gcatgtggcccaaggaggctgt

SEQ ID NO: 6924180 - DNA, 22 bp, Homo sapiens
ctctgggaagtggagacttcag

SEQ ID NO: 6924181 - DNA, 22 bp, Homo sapiens
agcagcatccccggcctccacc

SEQ ID NO: 6924182 - DNA, 22 bp, Homo sapiens
taggggtggagctaagagtccc

SEQ ID NO: 6924183 - DNA, 22 bp, Homo sapiens
agctgccatccgaggtgtcaga

SEQ ID NO: 6924184 - DNA, 22 bp, Homo sapiens
ttccaggaggaggtactagagg

SEQ ID NO: 6924185 - DNA, 22 bp, Homo sapiens
gttggcactactccttgcttaa

SEQ ID NO: 6924186 - DNA, 22 bp, Homo sapiens
gaggaaagctggtttaaagtat

SEQ ID NO: 6924187 - DNA, 22 bp, Homo sapiens
cccaggagccatctgtcttggc

SEQ ID NO: 6924188 - DNA, 22 bp, Homo sapiens
gcttggtagtgtgaactgtctc

SEQ ID NO: 6924189 - DNA, 22 bp, Homo sapiens
tgttcagtccaatgttggaaaa

SEQ ID NO: 6924190 - DNA, 22 bp, Homo sapiens
tcctgaggttttaaaactattc

SEQ ID NO: 6924191 - DNA, 22 bp, Homo sapiens
agccttctctgaaattctgttt

SEQ ID NO: 6924192 - DNA, 22 bp, Homo sapiens
atacatgttgtaccatatgttt

SEQ ID NO: 6924193 - DNA, 22 bp, Homo sapiens
ccaaaaagctcagagatatgtt

SEQ ID NO: 6924194 - DNA, 22 bp, Homo sapiens
cactgctgtttttaccacactg

SEQ ID NO: 6924195 - DNA, 22 bp, Homo sapiens
actgtaaaatacataagtattg

SEQ ID NO: 6924196 - DNA, 22 bp, Homo sapiens
acagagccaaaaggacatagta

SEQ ID NO: 6924197 - DNA, 22 bp, Homo sapiens
taacaatagtgtttgctagtca

SEQ ID NO: 6924198 - DNA, 22 bp, Homo sapiens
aaatagttcagccacggtgact

SEQ ID NO: 6924199 - DNA, 22 bp, Homo sapiens
tgaagtcctcctgaccactcct

SEQ ID NO: 6924200 - DNA, 18 bp, Homo sapiens
cagaagtccttcaaggcc

SEQ ID NO: 6924201 - DNA, 22 bp, Homo sapiens
acagtttccccctagggcagca

SEQ ID NO: 6924202 - DNA, 23 bp, Homo sapiens
taggccagggtgacctggggaga

SEQ ID NO: 6924203 - DNA, 22 bp, Homo sapiens
aagccaaggagaatggcctcag

SEQ ID NO: 6924204 - DNA, 22 bp, Homo sapiens
agaagcctcatcctctctagtg

SEQ ID NO: 6924205 - DNA, 17 bp, Homo sapiens
taaagatcagccatgta

SEQ ID NO: 6924206 - DNA, 22 bp, Homo sapiens
tccaggccccagcaccttggga

SEQ ID NO: 6924207 - DNA, 22 bp, Homo sapiens
agctcctgggagcaggtggtac

SEQ ID NO: 6924208 - DNA, 22 bp, Homo sapiens
tttcttcattgacaaggaaaaa

SEQ ID NO: 6924209 - DNA, 22 bp, Homo sapiens
gattagtagaggaaacagggct

SEQ ID NO: 6924210 - DNA, 22 bp, Homo sapiens
acttgcatttaaatattgaata

SEQ ID NO: 6924211 - DNA, 22 bp, Homo sapiens
tacttagagcgataatttatac

SEQ ID NO: 6924212 - DNA, 22 bp, Homo sapiens
tataggctgtgcttgtgtcttt

SEQ ID NO: 6924213 - DNA, 22 bp, Homo sapiens
ggctctggtcagtgaggggcct

SEQ ID NO: 6924214 - DNA, 22 bp, Homo sapiens
gggcagtggttacacagctgag

SEQ ID NO: 6924215 - DNA, 22 bp, Homo sapiens
tgtctgtcctgcttccttggac

SEQ ID NO: 6924216 - DNA, 22 bp, Homo sapiens
tcactacctgacaatacagtat

SEQ ID NO: 6924217 - DNA, 22 bp, Homo sapiens
tcagataagtgaagcaaagttt

SEQ ID NO: 6924218 - DNA, 20 bp, Homo sapiens
ctctgctttccacctttcag

SEQ ID NO: 6924219 - DNA, 22 bp, Homo sapiens
aatgtctgagtctctgtatccc

SEQ ID NO: 6924220 - DNA, 22 bp, Homo sapiens
ctggctttcatggcgcagttga

SEQ ID NO: 6924221 - DNA, 22 bp, Homo sapiens
agtgtctgccaactgcatggtc

SEQ ID NO: 6924222 - DNA, 22 bp, Homo sapiens
gcaaacagccaggcgcagaagt

SEQ ID NO: 6924223 - DNA, 22 bp, Homo sapiens
tcactttagatcttcatctctt

SEQ ID NO: 6924224 - DNA, 22 bp, Homo sapiens
cttggcagggtggaggatgcag

SEQ ID NO: 6924225 - DNA, 22 bp, Homo sapiens
gtgcaggcaaaagggccaggcc

SEQ ID NO: 6924226 - DNA, 22 bp, Homo sapiens
tgttagaaaggctattggacca

SEQ ID NO: 6924227 - DNA, 20 bp, Homo sapiens
atttgtttctactctctgac

SEQ ID NO: 6924228 - DNA, 22 bp, Homo sapiens
tcattgaatgctctgcaggttg

SEQ ID NO: 6924229 - DNA, 22 bp, Homo sapiens
gcaaggaggctggtggaggaag

SEQ ID NO: 6924230 - DNA, 22 bp, Homo sapiens
tcagcagtgtagtttatcattc

SEQ ID NO: 6924231 - DNA, 22 bp, Homo sapiens
tcagtgtgaggggctgggtcct

SEQ ID NO: 6924232 - DNA, 19 bp, Homo sapiens
ttttgaagtatgagacagg

SEQ ID NO: 6924233 - DNA, 22 bp, Homo sapiens
tcagaaggctttataccagtat

SEQ ID NO: 6924234 - DNA, 22 bp, Homo sapiens
atgtgtcaggcaatagaagcta

SEQ ID NO: 6924235 - DNA, 23 bp, Homo sapiens
caacagctgttagatatgggctt

SEQ ID NO: 6924236 - DNA, 22 bp, Homo sapiens
cctggagtgacaggtgtagcct

SEQ ID NO: 6924237 - DNA, 22 bp, Homo sapiens
tgctgggtggttgctcctcccg

SEQ ID NO: 6924238 - DNA, 23 bp, Homo sapiens
tccataatcccagaaagctcaga

SEQ ID NO: 6924239 - DNA, 22 bp, Homo sapiens
aaagagctatacaaccatgtcc

SEQ ID NO: 6924240 - DNA, 22 bp, Homo sapiens
atgtgtcttgagggggatggag

SEQ ID NO: 6924241 - DNA, 22 bp, Homo sapiens
taagcagcgtaaaagccaggga

SEQ ID NO: 6924242 - DNA, 20 bp, Homo sapiens
cagtgcaactgaagaactga

SEQ ID NO: 6924243 - DNA, 22 bp, Homo sapiens
gccctgcctgccggtgtgggtc

SEQ ID NO: 6924244 - DNA, 22 bp, Homo sapiens
atgctacattttggtttataaa

SEQ ID NO: 6924245 - DNA, 22 bp, Homo sapiens
ttgaatgaatttgagcagagat

SEQ ID NO: 6924246 - DNA, 22 bp, Homo sapiens
aaacacaggtactgcagaagtg

SEQ ID NO: 6924247 - DNA, 22 bp, Homo sapiens
tggcatggctactggaatggcg

SEQ ID NO: 6924248 - DNA, 22 bp, Homo sapiens
gagctggctgtggttgagtgca

SEQ ID NO: 6924249 - DNA, 22 bp, Homo sapiens
tcttcaagaatatattgctgtc

SEQ ID NO: 6924250 - DNA, 22 bp, Homo sapiens
gctgttcacatctggaccattt

SEQ ID NO: 6924251 - DNA, 22 bp, Homo sapiens
agagttgcgtccatgcagagtt

SEQ ID NO: 6924252 - DNA, 22 bp, Homo sapiens
ctggcaggtccagctggactca

SEQ ID NO: 6924253 - DNA, 22 bp, Homo sapiens
cactggttttgctgataaggca

SEQ ID NO: 6924254 - DNA, 22 bp, Homo sapiens
cagttactcaataattcttgcg

SEQ ID NO: 6924255 - DNA, 21 bp, Homo sapiens
gggccactctagagaaagaaa

SEQ ID NO: 6924256 - DNA, 22 bp, Homo sapiens
ctgtgagatgaccaactgactg

SEQ ID NO: 6924257 - DNA, 20 bp, Homo sapiens
accctgccaggcatgtgaat

SEQ ID NO: 6924258 - DNA, 22 bp, Homo sapiens
ggtctacattgagagagctgct

SEQ ID NO: 6924259 - DNA, 22 bp, Homo sapiens
tgcacaaatttgtgtatgctca

SEQ ID NO: 6924260 - DNA, 22 bp, Homo sapiens
cttgggcccccacacgagctcg

SEQ ID NO: 6924261 - DNA, 22 bp, Homo sapiens
gctggaagtaaaaacttactag

SEQ ID NO: 6924262 - DNA, 22 bp, Homo sapiens
agtcttggacatattctacttc

SEQ ID NO: 6924263 - DNA, 22 bp, Homo sapiens
catagaatggattgacaagatt

SEQ ID NO: 6924264 - DNA, 22 bp, Homo sapiens
tgacatgtatatcttacgctat

SEQ ID NO: 6924265 - DNA, 22 bp, Homo sapiens
gcctgggtccaccgctcgcgct

SEQ ID NO: 6924266 - DNA, 22 bp, Homo sapiens
gaggtggcttagtctctggaca

SEQ ID NO: 6924267 - DNA, 22 bp, Homo sapiens
ttgactcatacctgcctgaccc

SEQ ID NO: 6924268 - DNA, 22 bp, Homo sapiens
atgaggttttaagagcactagc

SEQ ID NO: 6924269 - DNA, 22 bp, Homo sapiens
ttgcatagtgctgaggttcggg

SEQ ID NO: 6924270 - DNA, 21 bp, Homo sapiens
tagaatcctggactgggactc

SEQ ID NO: 6924271 - DNA, 20 bp, Homo sapiens
gcatccttctcttccactcc

SEQ ID NO: 6924272 - DNA, 22 bp, Homo sapiens
gggccagacctcttctcaggga

SEQ ID NO: 6924273 - DNA, 22 bp, Homo sapiens
tgcttattgctttcaagactgt

SEQ ID NO: 6924274 - DNA, 22 bp, Homo sapiens
tgaggtgggtggcttctgttat

SEQ ID NO: 6924275 - DNA, 22 bp, Homo sapiens
gctctgggtagccactgcctgg

SEQ ID NO: 6924276 - DNA, 22 bp, Homo sapiens
ctatcacagagggttgttttga

SEQ ID NO: 6924277 - DNA, 22 bp, Homo sapiens
cagcttttaggactgtgagaaa

SEQ ID NO: 6924278 - DNA, 22 bp, Homo sapiens
tgcctgaatgatcagtcagatt

SEQ ID NO: 6924279 - DNA, 22 bp, Homo sapiens
taacttgacctgtataaaacac

SEQ ID NO: 6924280 - DNA, 22 bp, Homo sapiens
accaggcagtatggtgctgcaa

SEQ ID NO: 6924281 - DNA, 22 bp, Homo sapiens
tgtgtcagcaggggagggaact

SEQ ID NO: 6924282 - DNA, 22 bp, Homo sapiens
cggtgcccggtgccaggcgcgg

SEQ ID NO: 6924283 - DNA, 22 bp, Homo sapiens
ctagtgagtctgaatgagttgc

SEQ ID NO: 6924284 - DNA, 22 bp, Homo sapiens
caattctgaggcctgctttgtt

SEQ ID NO: 6924285 - DNA, 21 bp, Homo sapiens
agcagcaaccacatagttttt

SEQ ID NO: 6924286 - DNA, 22 bp, Homo sapiens
tgtttctagagaaaatatttac

SEQ ID NO: 6924287 - DNA, 22 bp, Homo sapiens
tttgcagttcatgttggaaaat

SEQ ID NO: 6924288 - DNA, 22 bp, Homo sapiens
cttggcagatccaaaaatgaca

SEQ ID NO: 6924289 - DNA, 22 bp, Homo sapiens
ctgggatcagcagtagtgatga

SEQ ID NO: 6924290 - DNA, 22 bp, Homo sapiens
ctgttcctccacctcaacaaac

SEQ ID NO: 6924291 - DNA, 22 bp, Homo sapiens
ggcagcctcaggttttctttga

SEQ ID NO: 6924292 - DNA, 22 bp, Homo sapiens
ttccttgggagaaaaaatatat

SEQ ID NO: 6924293 - DNA, 22 bp, Homo sapiens
cttatcatatcatacatggcta

SEQ ID NO: 6924294 - DNA, 19 bp, Homo sapiens
gcagacaggtccagagagg

SEQ ID NO: 6924295 - DNA, 22 bp, Homo sapiens
taacacttgaagccatttttgc

SEQ ID NO: 6924296 - DNA, 22 bp, Homo sapiens
gcctgtcaattttgtgtacaat

SEQ ID NO: 6924297 - DNA, 22 bp, Homo sapiens
tcaggagcagccttggagagcg

SEQ ID NO: 6924298 - DNA, 22 bp, Homo sapiens
cccaccagtacagatggtagat

SEQ ID NO: 6924299 - DNA, 22 bp, Homo sapiens
ctgtgcagtaggtcagggctgg

SEQ ID NO: 6924300 - DNA, 22 bp, Homo sapiens
ggcccagaggggttgagcatct

SEQ ID NO: 6924301 - DNA, 22 bp, Homo sapiens
caaacaatttgcatttccttag

SEQ ID NO: 6924302 - DNA, 22 bp, Homo sapiens
ttgctcattccgtgagaagatc

SEQ ID NO: 6924303 - DNA, 22 bp, Homo sapiens
cacaccagatggcagcgtggga

SEQ ID NO: 6924304 - DNA, 22 bp, Homo sapiens
tgagttcaggctcttggccagg

SEQ ID NO: 6924305 - DNA, 19 bp, Homo sapiens
agcaaggtgcctcctcccc

SEQ ID NO: 6924306 - DNA, 22 bp, Homo sapiens
aggctgagtcaagttagggtga

SEQ ID NO: 6924307 - DNA, 22 bp, Homo sapiens
taattcagtcattaatcttagc

SEQ ID NO: 6924308 - DNA, 22 bp, Homo sapiens
agagcacaaattttaaggaggc

SEQ ID NO: 6924309 - DNA, 18 bp, Homo sapiens
gctctggaggtagcatta

SEQ ID NO: 6924310 - DNA, 22 bp, Homo sapiens
atccttgagccaatgactgatt

SEQ ID NO: 6924311 - DNA, 22 bp, Homo sapiens
aaatccttgatagtttgcccta

SEQ ID NO: 6924312 - DNA, 22 bp, Homo sapiens
tgttccttttactgcatgcgta

SEQ ID NO: 6924313 - DNA, 22 bp, Homo sapiens
atactacactatgcatggatgt

SEQ ID NO: 6924314 - DNA, 22 bp, Homo sapiens
attctagcagttacaggctgat

SEQ ID NO: 6924315 - DNA, 22 bp, Homo sapiens
gcagggaggaagagatgcttcc

SEQ ID NO: 6924316 - DNA, 18 bp, Homo sapiens
tgttaaatgaagatttgc

SEQ ID NO: 6924317 - DNA, 22 bp, Homo sapiens
ctttctggcacagccgcgggat

SEQ ID NO: 6924318 - DNA, 22 bp, Homo sapiens
agggcagttcagccacaggctc

SEQ ID NO: 6924319 - DNA, 22 bp, Homo sapiens
atgtttttaaatagacttacag

SEQ ID NO: 6924320 - DNA, 22 bp, Homo sapiens
tgacaggcagtgctgggcatgt

SEQ ID NO: 6924321 - DNA, 22 bp, Homo sapiens
acagttcactttttatatcaaa

SEQ ID NO: 6924322 - DNA, 22 bp, Homo sapiens
ctggggtatctgccacaactct

SEQ ID NO: 6924323 - DNA, 22 bp, Homo sapiens
cactgtacccatttaaataaat

SEQ ID NO: 6924324 - DNA, 22 bp, Homo sapiens
tagaagatgggattcaagtccc

SEQ ID NO: 6924325 - DNA, 22 bp, Homo sapiens
aggctttactggatttttcgct

SEQ ID NO: 6924326 - DNA, 22 bp, Homo sapiens
gcaatgcatatgtgggtagcat

SEQ ID NO: 6924327 - DNA, 22 bp, Homo sapiens
gagttaaatagcttaggattca

SEQ ID NO: 6924328 - DNA, 22 bp, Homo sapiens
tctgagcactgggcagtcggtg

SEQ ID NO: 6924329 - DNA, 22 bp, Homo sapiens
ttatgtacccactcatattccc

SEQ ID NO: 6924330 - DNA, 22 bp, Homo sapiens
tattttacaaatgggaatgctg

SEQ ID NO: 6924331 - DNA, 22 bp, Homo sapiens
cctccaggtgttacatatgact

SEQ ID NO: 6924332 - DNA, 22 bp, Homo sapiens
atatgtcataattgtgtctgta

SEQ ID NO: 6924333 - DNA, 22 bp, Homo sapiens
agtggtataagtctgaagatca

SEQ ID NO: 6924334 - DNA, 22 bp, Homo sapiens
atttcctggttgcattggcttt

SEQ ID NO: 6924335 - DNA, 19 bp, Homo sapiens
ttgcatttcatgtttgatt

SEQ ID NO: 6924336 - DNA, 22 bp, Homo sapiens
tgtatacatgtgtgttcacgca

SEQ ID NO: 6924337 - DNA, 22 bp, Homo sapiens
agaggacaggttttccatgggc

SEQ ID NO: 6924338 - DNA, 22 bp, Homo sapiens
ctttatgactgagttgtcaatt

SEQ ID NO: 6924339 - DNA, 22 bp, Homo sapiens
agatgctgtcttgctggctttg

SEQ ID NO: 6924340 - DNA, 22 bp, Homo sapiens
actggccttgggtaaagcccct

SEQ ID NO: 6924341 - DNA, 22 bp, Homo sapiens
tcatttatcatttgtgctgtag

SEQ ID NO: 6924342 - DNA, 22 bp, Homo sapiens
ttacagaaaggaaggactgact

SEQ ID NO: 6924343 - DNA, 22 bp, Homo sapiens
tgccacagcagtgctttgacag

SEQ ID NO: 6924344 - DNA, 22 bp, Homo sapiens
tcaacattgagtccctgggtct

SEQ ID NO: 6924345 - DNA, 22 bp, Homo sapiens
ctgtccctgagcaactcctgtt

SEQ ID NO: 6924346 - DNA, 22 bp, Homo sapiens
tggccatagctcagctccttca

SEQ ID NO: 6924347 - DNA, 20 bp, Homo sapiens
caacatgagcaagtgaactg

SEQ ID NO: 6924348 - DNA, 22 bp, Homo sapiens
ggatcattaagaatagctacta

SEQ ID NO: 6924349 - DNA, 22 bp, Homo sapiens
tgagccagccttgcagctgtgc

SEQ ID NO: 6924350 - DNA, 22 bp, Homo sapiens
aagaattcactggtagagtcaa

SEQ ID NO: 6924351 - DNA, 22 bp, Homo sapiens
taaggtctttggtcactggtag

SEQ ID NO: 6924352 - DNA, 22 bp, Homo sapiens
gcactgggagtctgtgggggtt

SEQ ID NO: 6924353 - DNA, 22 bp, Homo sapiens
agcacagatgtactttgagggg

SEQ ID NO: 6924354 - DNA, 22 bp, Homo sapiens
ggtttattgttaataagtttga

SEQ ID NO: 6924355 - DNA, 22 bp, Homo sapiens
aggcttcccttcctctgggggt

SEQ ID NO: 6924356 - DNA, 22 bp, Homo sapiens
actgtcaaaagagattatatta

SEQ ID NO: 6924357 - DNA, 22 bp, Homo sapiens
catttccagctcctgcatcatg

SEQ ID NO: 6924358 - DNA, 17 bp, Homo sapiens
cagttgaaatgtttgga

SEQ ID NO: 6924359 - DNA, 22 bp, Homo sapiens
taatgaggcaagagtcatggct

SEQ ID NO: 6924360 - DNA, 22 bp, Homo sapiens
tttgttctaacttctgcagaca

SEQ ID NO: 6924361 - DNA, 22 bp, Homo sapiens
gatgaaggggctggtgccctct

SEQ ID NO: 6924362 - DNA, 22 bp, Homo sapiens
tcttacaccattcaaatatttt

SEQ ID NO: 6924363 - DNA, 22 bp, Homo sapiens
agaagcagaaggaagcagggcc

SEQ ID NO: 6924364 - DNA, 22 bp, Homo sapiens
gggatgacagctatggaactct

SEQ ID NO: 6924365 - DNA, 20 bp, Homo sapiens
gggtccaggactctgaattt

SEQ ID NO: 6924366 - DNA, 22 bp, Homo sapiens
cttcagccagctggggatgcgg

SEQ ID NO: 6924367 - DNA, 22 bp, Homo sapiens
tgcctccttcaggagggcccgg

SEQ ID NO: 6924368 - DNA, 22 bp, Homo sapiens
gtggccaggacattgccaggca

SEQ ID NO: 6924369 - DNA, 22 bp, Homo sapiens
agttggcattcctgcatcctat

SEQ ID NO: 6924370 - DNA, 16 bp, Homo sapiens
cccatgtgtagatgag

SEQ ID NO: 6924371 - DNA, 22 bp, Homo sapiens
ggagctgggaccctgtcatctg

SEQ ID NO: 6924372 - DNA, 22 bp, Homo sapiens
ggagtgcaggtagcacaggaaa

SEQ ID NO: 6924373 - DNA, 22 bp, Homo sapiens
aagaaaagatgtttggttttca

SEQ ID NO: 6924374 - DNA, 22 bp, Homo sapiens
tgtgcttcatcacttctcagtt

SEQ ID NO: 6924375 - DNA, 22 bp, Homo sapiens
attgtgcagcacagatcatgac

SEQ ID NO: 6924376 - DNA, 22 bp, Homo sapiens
ttaggaacttctgtctcagtgt

SEQ ID NO: 6924377 - DNA, 22 bp, Homo sapiens
agtaggcagaagtggcattcgg

SEQ ID NO: 6924378 - DNA, 19 bp, Homo sapiens
tctcagtatattcctgcct

SEQ ID NO: 6924379 - DNA, 21 bp, Homo sapiens
ccagctgctccttgaggttcc

SEQ ID NO: 6924380 - DNA, 19 bp, Homo sapiens
aatggcagatgccatatct

SEQ ID NO: 6924381 - DNA, 22 bp, Homo sapiens
ccttgctcaagctagtgacggg

SEQ ID NO: 6924382 - DNA, 22 bp, Homo sapiens
tggctctggccaccgggagggc

SEQ ID NO: 6924383 - DNA, 22 bp, Homo sapiens
tgggatgagttgttaggactga

SEQ ID NO: 6924384 - DNA, 22 bp, Homo sapiens
tgaagccataggacagaggata

SEQ ID NO: 6924385 - DNA, 22 bp, Homo sapiens
tgaggtggttcaagagccttgt

SEQ ID NO: 6924386 - DNA, 22 bp, Homo sapiens
gagggtgggtttcttgcacgtc

SEQ ID NO: 6924387 - DNA, 22 bp, Homo sapiens
tgccagagttacatgagggtca

SEQ ID NO: 6924388 - DNA, 22 bp, Homo sapiens
ctacaaatatgttaaggtgttt

SEQ ID NO: 6924389 - DNA, 19 bp, Homo sapiens
tggcagataatttgtgtta

SEQ ID NO: 6924390 - DNA, 22 bp, Homo sapiens
atatttagcaacatccttggcc

SEQ ID NO: 6924391 - DNA, 22 bp, Homo sapiens
agaaaccagacttggcccattt

SEQ ID NO: 6924392 - DNA, 22 bp, Homo sapiens
atagtatgtgtgtttatgtaca

SEQ ID NO: 6924393 - DNA, 22 bp, Homo sapiens
aatcattgctcctttctctggt

SEQ ID NO: 6924394 - DNA, 22 bp, Homo sapiens
agctgttttcctggttagagac

SEQ ID NO: 6924395 - DNA, 23 bp, Homo sapiens
acctgctccatgtcaccttcact

SEQ ID NO: 6924396 - DNA, 22 bp, Homo sapiens
tggcctgcccaagtcaatcgga

SEQ ID NO: 6924397 - DNA, 22 bp, Homo sapiens
aaatgtaccttgatagtttggt

SEQ ID NO: 6924398 - DNA, 22 bp, Homo sapiens
tgcttacattgcatctgtgcct

SEQ ID NO: 6924399 - DNA, 22 bp, Homo sapiens
atttacagaaacttaatcatag

SEQ ID NO: 6924400 - DNA, 22 bp, Homo sapiens
atgacaacacatggtgctgaat

SEQ ID NO: 6924401 - DNA, 22 bp, Homo sapiens
agggatggtggaggaatttcaa

SEQ ID NO: 6924402 - DNA, 22 bp, Homo sapiens
ttcctgcttcctggcctcacaa

SEQ ID NO: 6924403 - DNA, 22 bp, Homo sapiens
atgccagggtcatcccctgggt

SEQ ID NO: 6924404 - DNA, 22 bp, Homo sapiens
ttggaaactttcaagcataatg

SEQ ID NO: 6924405 - DNA, 22 bp, Homo sapiens
tggaaggtggatatcctagtca

SEQ ID NO: 6924406 - DNA, 22 bp, Homo sapiens
ctgccgtccatctacgtctcag

SEQ ID NO: 6924407 - DNA, 22 bp, Homo sapiens
tggggcctggtcagagctgcac

SEQ ID NO: 6924408 - DNA, 22 bp, Homo sapiens
actgagaggtgatagtgacatt

SEQ ID NO: 6924409 - DNA, 20 bp, Homo sapiens
ataattatttacttttgtgc

SEQ ID NO: 6924410 - DNA, 22 bp, Homo sapiens
aatccatagaataaaattgcag

SEQ ID NO: 6924411 - DNA, 22 bp, Homo sapiens
gccttgcctcagccatggaaac

SEQ ID NO: 6924412 - DNA, 22 bp, Homo sapiens
gaagtgttttagttcttcaggt

SEQ ID NO: 6924413 - DNA, 22 bp, Homo sapiens
tttgtgacttgcttctcagaat

SEQ ID NO: 6924414 - DNA, 22 bp, Homo sapiens
ccatgggagatgatggggagtg

SEQ ID NO: 6924415 - DNA, 22 bp, Homo sapiens
taatgggctatctgttgagact

SEQ ID NO: 6924416 - DNA, 22 bp, Homo sapiens
cctggagttgaaggaaggtggg

SEQ ID NO: 6924417 - DNA, 22 bp, Homo sapiens
ggcagggtttacaatagcaata

SEQ ID NO: 6924418 - DNA, 22 bp, Homo sapiens
agaacagcacaggaagtgtatc

SEQ ID NO: 6924419 - DNA, 22 bp, Homo sapiens
gataaaattcttattttacccg

SEQ ID NO: 6924420 - DNA, 22 bp, Homo sapiens
tccctgggaccggcagctcaca

SEQ ID NO: 6924421 - DNA, 22 bp, Homo sapiens
tgcagttttctcacccccacaa

SEQ ID NO: 6924422 - DNA, 22 bp, Homo sapiens
tagaatctgatggcccgtctgg

SEQ ID NO: 6924423 - DNA, 22 bp, Homo sapiens
aaggcttggtctagtcatgcca

SEQ ID NO: 6924424 - DNA, 22 bp, Homo sapiens
taccttgtgagctttctaacat

SEQ ID NO: 6924425 - DNA, 22 bp, Homo sapiens
ttctggaagctgcaggtggccg

SEQ ID NO: 6924426 - DNA, 22 bp, Homo sapiens
tggccctgggcagaggcaacat

SEQ ID NO: 6924427 - DNA, 22 bp, Homo sapiens
tatgcaaagccacccagggacg

SEQ ID NO: 6924428 - DNA, 22 bp, Homo sapiens
ctttgcagcaatttctgttaaa

SEQ ID NO: 6924429 - DNA, 22 bp, Homo sapiens
aagtgactatttgagtacatca

SEQ ID NO: 6924430 - DNA, 22 bp, Homo sapiens
ttgtacttaaatatgcaaatag

SEQ ID NO: 6924431 - DNA, 22 bp, Homo sapiens
gggccataactggctggacagt

SEQ ID NO: 6924432 - DNA, 22 bp, Homo sapiens
ccctctgcaggctggacctgcc

SEQ ID NO: 6924433 - DNA, 22 bp, Homo sapiens
tcctacagatactaaggagatc

SEQ ID NO: 6924434 - DNA, 22 bp, Homo sapiens
aggagctcagcctgcagggagc

SEQ ID NO: 6924435 - DNA, 22 bp, Homo sapiens
tgtcataagattaactttttgt

SEQ ID NO: 6924436 - DNA, 22 bp, Homo sapiens
gtttattgataaaagctggaca

SEQ ID NO: 6924437 - DNA, 22 bp, Homo sapiens
tgcacttggctgtgatctctag

SEQ ID NO: 6924438 - DNA, 22 bp, Homo sapiens
tctggattcacctttagtacct

SEQ ID NO: 6924439 - DNA, 21 bp, Homo sapiens
agtcagacttaagctctgcat

SEQ ID NO: 6924440 - DNA, 22 bp, Homo sapiens
atgggtaggatttactcagatg

SEQ ID NO: 6924441 - DNA, 22 bp, Homo sapiens
ctgagtgggtttctgcttgtca

SEQ ID NO: 6924442 - DNA, 22 bp, Homo sapiens
gaaatgtatttgacagtccttg

SEQ ID NO: 6924443 - DNA, 22 bp, Homo sapiens
ttgggagatattgttctttaca

SEQ ID NO: 6924444 - DNA, 22 bp, Homo sapiens
tttaggaacttaggtttatgga

SEQ ID NO: 6924445 - DNA, 19 bp, Homo sapiens
atgcagctcctgcctcctt

SEQ ID NO: 6924446 - DNA, 22 bp, Homo sapiens
ttctcagtagttagcatttgtg

SEQ ID NO: 6924447 - DNA, 22 bp, Homo sapiens
tgactagacctatatctttttg

SEQ ID NO: 6924448 - DNA, 22 bp, Homo sapiens
caggggctctgagattgtctaa

SEQ ID NO: 6924449 - DNA, 22 bp, Homo sapiens
ctccaggtattactgttttccc

SEQ ID NO: 6924450 - DNA, 22 bp, Homo sapiens
ctcctcagaacagccttggctg

SEQ ID NO: 6924451 - DNA, 22 bp, Homo sapiens
aagcagaaagaacaactgagtg

SEQ ID NO: 6924452 - DNA, 19 bp, Homo sapiens
ccatgccatcattttaaag

SEQ ID NO: 6924453 - DNA, 22 bp, Homo sapiens
tctcctgtcttctcagcacccc

SEQ ID NO: 6924454 - DNA, 22 bp, Homo sapiens
aagcacagggactcaggaccgg

SEQ ID NO: 6924455 - DNA, 22 bp, Homo sapiens
ttttcatgtcatgtccttgagg

SEQ ID NO: 6924456 - DNA, 20 bp, Homo sapiens
gggagctggaattgtcttag

SEQ ID NO: 6924457 - DNA, 22 bp, Homo sapiens
gtgtaattttgtggtcctgtac

SEQ ID NO: 6924458 - DNA, 22 bp, Homo sapiens
caggctgctgcctagaatgaca

SEQ ID NO: 6924459 - DNA, 23 bp, Homo sapiens
cctcctcatatctttgactagtg

SEQ ID NO: 6924460 - DNA, 22 bp, Homo sapiens
atgtttcagatacagatcaaat

SEQ ID NO: 6924461 - DNA, 22 bp, Homo sapiens
tgccagagcaaaatgcccttaa

SEQ ID NO: 6924462 - DNA, 22 bp, Homo sapiens
tgtgaatatccatttgtttcag

SEQ ID NO: 6924463 - DNA, 22 bp, Homo sapiens
tgtgcacctgagtcgcgcaggg

SEQ ID NO: 6924464 - DNA, 22 bp, Homo sapiens
tgtgtgcttatagtctagtagt

SEQ ID NO: 6924465 - DNA, 22 bp, Homo sapiens
aatatgcatgtatacatgtgta

SEQ ID NO: 6924466 - DNA, 22 bp, Homo sapiens
gctcgcatcacctttgttctcc

SEQ ID NO: 6924467 - DNA, 22 bp, Homo sapiens
ccttatagggtgtgatgaggat

SEQ ID NO: 6924468 - DNA, 19 bp, Homo sapiens
gctaggtgaccagctggat

SEQ ID NO: 6924469 - DNA, 22 bp, Homo sapiens
gaggggaaaacaggaattaaca

SEQ ID NO: 6924470 - DNA, 22 bp, Homo sapiens
gtgctaagtgcaggatattgaa

SEQ ID NO: 6924471 - DNA, 22 bp, Homo sapiens
aaagaacttaagaaattaggct

SEQ ID NO: 6924472 - DNA, 22 bp, Homo sapiens
ttgcattatttaatgagactct

SEQ ID NO: 6924473 - DNA, 22 bp, Homo sapiens
accaaagggcagaacatgagca

SEQ ID NO: 6924474 - DNA, 22 bp, Homo sapiens
tgggagcactctttgggaagca

SEQ ID NO: 6924475 - DNA, 22 bp, Homo sapiens
ctggcctcacctcagacttact

SEQ ID NO: 6924476 - DNA, 22 bp, Homo sapiens
aggctgaggcgggaggatcact

SEQ ID NO: 6924477 - DNA, 22 bp, Homo sapiens
ctcctccagctctccctggggg

SEQ ID NO: 6924478 - DNA, 22 bp, Homo sapiens
aatcataattgtatacattcat

SEQ ID NO: 6924479 - DNA, 22 bp, Homo sapiens
gtggagggtgagctcatgtttg

SEQ ID NO: 6924480 - DNA, 19 bp, Homo sapiens
tttgaaaggattgttattt

SEQ ID NO: 6924481 - DNA, 22 bp, Homo sapiens
ctcacaccagcttacaagactt

SEQ ID NO: 6924482 - DNA, 22 bp, Homo sapiens
atcattactcctgtaaaattgt

SEQ ID NO: 6924483 - DNA, 22 bp, Homo sapiens
gcaatatactttctggcagtga

SEQ ID NO: 6924484 - DNA, 22 bp, Homo sapiens
gagctcttttgccagtcactgc

SEQ ID NO: 6924485 - DNA, 22 bp, Homo sapiens
gcatacagtccttgtattcttc

SEQ ID NO: 6924486 - DNA, 22 bp, Homo sapiens
ttctccaaggatacagtcctgt

SEQ ID NO: 6924487 - DNA, 22 bp, Homo sapiens
gagttctaaaggcagaacataa

SEQ ID NO: 6924488 - DNA, 22 bp, Homo sapiens
gttggcctgaatggtcaagagg

SEQ ID NO: 6924489 - DNA, 22 bp, Homo sapiens
cctcagagcctccagaaggaat

SEQ ID NO: 6924490 - DNA, 22 bp, Homo sapiens
cactgggcgtgtcctgggtgag

SEQ ID NO: 6924491 - DNA, 22 bp, Homo sapiens
tgtttccttctgtctctttgga

SEQ ID NO: 6924492 - DNA, 23 bp, Homo sapiens
taatatcctgcaatgcacagaac

SEQ ID NO: 6924493 - DNA, 22 bp, Homo sapiens
ttctctgggatctggcaaaagg

SEQ ID NO: 6924494 - DNA, 22 bp, Homo sapiens
tcctgcgcgccagggccgtcga

SEQ ID NO: 6924495 - DNA, 22 bp, Homo sapiens
tgctatgtatatatctttaagc

SEQ ID NO: 6924496 - DNA, 22 bp, Homo sapiens
ctcaatatgccagaggggaaag

SEQ ID NO: 6924497 - DNA, 22 bp, Homo sapiens
ctgtgtttgctatgcaaagaca

SEQ ID NO: 6924498 - DNA, 22 bp, Homo sapiens
ttatacatgtttataaggttga

SEQ ID NO: 6924499 - DNA, 22 bp, Homo sapiens
gcacatactgcaaagattacta

SEQ ID NO: 6924500 - DNA, 22 bp, Homo sapiens
ccagggttggatgagtcactta

SEQ ID NO: 6924501 - DNA, 22 bp, Homo sapiens
agaaggcatcagaagtgtgtag

SEQ ID NO: 6924502 - DNA, 22 bp, Homo sapiens
acagaaggacttgagaaagaca

SEQ ID NO: 6924503 - DNA, 22 bp, Homo sapiens
cactgcttccattgttcacctg

SEQ ID NO: 6924504 - DNA, 20 bp, Homo sapiens
acagtgcatggggggacagc

SEQ ID NO: 6924505 - DNA, 22 bp, Homo sapiens
aaggcacttttctaaagacctt

SEQ ID NO: 6924506 - DNA, 22 bp, Homo sapiens
ggactttagcagctggagagga

SEQ ID NO: 6924507 - DNA, 22 bp, Homo sapiens
atacaactgctctcagataagt

SEQ ID NO: 6924508 - DNA, 22 bp, Homo sapiens
tcttattgtttaaaagtacaca

SEQ ID NO: 6924509 - DNA, 22 bp, Homo sapiens
ccatgtggctgctgacaacaga

SEQ ID NO: 6924510 - DNA, 22 bp, Homo sapiens
ggtcttctggaaagcagactgt

SEQ ID NO: 6924511 - DNA, 22 bp, Homo sapiens
tgagcaattaacagagtctaaa

SEQ ID NO: 6924512 - DNA, 22 bp, Homo sapiens
ttgattctggtgactgatggaa

SEQ ID NO: 6924513 - DNA, 22 bp, Homo sapiens
gctctgggtgaatggcagattg

SEQ ID NO: 6924514 - DNA, 21 bp, Homo sapiens
agttgcataggccagccatcc

SEQ ID NO: 6924515 - DNA, 23 bp, Homo sapiens
catgtacacacagctgtacagtg

SEQ ID NO: 6924516 - DNA, 22 bp, Homo sapiens
cggcaaagaacgctttttcaga

SEQ ID NO: 6924517 - DNA, 22 bp, Homo sapiens
tcagcctccgaaagtgctggga

SEQ ID NO: 6924518 - DNA, 18 bp, Homo sapiens
ctgtcagcagcttcacga

SEQ ID NO: 6924519 - DNA, 22 bp, Homo sapiens
tgtgttagatttgatcttgcat

SEQ ID NO: 6924520 - DNA, 22 bp, Homo sapiens
gcagcagtggttttatcatttt

SEQ ID NO: 6924521 - DNA, 22 bp, Homo sapiens
acagatgtacactcatatataa

SEQ ID NO: 6924522 - DNA, 22 bp, Homo sapiens
gggatctgatttaggatgggag

SEQ ID NO: 6924523 - DNA, 22 bp, Homo sapiens
ctctcgaagagacttcccagct

SEQ ID NO: 6924524 - DNA, 22 bp, Homo sapiens
tcacccatcctggatgagattc

SEQ ID NO: 6924525 - DNA, 22 bp, Homo sapiens
tacaagtatattctagtgatat

SEQ ID NO: 6924526 - DNA, 22 bp, Homo sapiens
tgaaatgacaaaggtttttctt

SEQ ID NO: 6924527 - DNA, 22 bp, Homo sapiens
gggctgctacgagaactgaata

SEQ ID NO: 6924528 - DNA, 22 bp, Homo sapiens
tttgggctgactgccaagggcc

SEQ ID NO: 6924529 - DNA, 22 bp, Homo sapiens
ctacttctgtggctctaagaga

SEQ ID NO: 6924530 - DNA, 16 bp, Homo sapiens
tcttagttgtgtggta

SEQ ID NO: 6924531 - DNA, 22 bp, Homo sapiens
tgtctgagctgcacagaagtaa

SEQ ID NO: 6924532 - DNA, 22 bp, Homo sapiens
aggtgtccggctgcataatctt

SEQ ID NO: 6924533 - DNA, 22 bp, Homo sapiens
agttgcatgtccaagggggtag

SEQ ID NO: 6924534 - DNA, 22 bp, Homo sapiens
ggaaggctacaggaatccagcg

SEQ ID NO: 6924535 - DNA, 22 bp, Homo sapiens
aggccagcttccagaggggcag

SEQ ID NO: 6924536 - DNA, 22 bp, Homo sapiens
cctgaccacccttggacaaggt

SEQ ID NO: 6924537 - DNA, 22 bp, Homo sapiens
agtgtcaataatttctttttgg

SEQ ID NO: 6924538 - DNA, 22 bp, Homo sapiens
tgataccctttggctgcgagca

SEQ ID NO: 6924539 - DNA, 22 bp, Homo sapiens
acatttcctaacgtatacactg

SEQ ID NO: 6924540 - DNA, 22 bp, Homo sapiens
gatctgaaatagctactgcaga

SEQ ID NO: 6924541 - DNA, 22 bp, Homo sapiens
gcaatgagcacccagagggcag

SEQ ID NO: 6924542 - DNA, 22 bp, Homo sapiens
ctaggcacctgggccctgtggc

SEQ ID NO: 6924543 - DNA, 22 bp, Homo sapiens
gatgggctggggagaaagcatg

SEQ ID NO: 6924544 - DNA, 22 bp, Homo sapiens
gaggcacatgactcaccaatgg

SEQ ID NO: 6924545 - DNA, 22 bp, Homo sapiens
agagcctgggcagctcctctgg

SEQ ID NO: 6924546 - DNA, 22 bp, Homo sapiens
tccaatcagggaaagccaggtc

SEQ ID NO: 6924547 - DNA, 22 bp, Homo sapiens
cttcactggaatctgtaatagt

SEQ ID NO: 6924548 - DNA, 22 bp, Homo sapiens
tgggagaacccagggtcaggct

SEQ ID NO: 6924549 - DNA, 23 bp, Homo sapiens
tctcagtgccgattgcatacaca

SEQ ID NO: 6924550 - DNA, 22 bp, Homo sapiens
caaggtctggttcctctgggtg

SEQ ID NO: 6924551 - DNA, 20 bp, Homo sapiens
gcctcagagggtttgagttt

SEQ ID NO: 6924552 - DNA, 22 bp, Homo sapiens
tgcagccctgtgcacatcccct

SEQ ID NO: 6924553 - DNA, 22 bp, Homo sapiens
tgtatgaaagaacaagggctta

SEQ ID NO: 6924554 - DNA, 22 bp, Homo sapiens
agcccagataaagtacaaccat

SEQ ID NO: 6924555 - DNA, 22 bp, Homo sapiens
ttagaagttcaggtctgtaatc

SEQ ID NO: 6924556 - DNA, 22 bp, Homo sapiens
tcagtatctactatcttgatga

SEQ ID NO: 6924557 - DNA, 22 bp, Homo sapiens
ttcaaacaggggtcagggagat

SEQ ID NO: 6924558 - DNA, 22 bp, Homo sapiens
tcttttctggactctgcatgga

SEQ ID NO: 6924559 - DNA, 22 bp, Homo sapiens
ctgttgagtaatttatatcagg

SEQ ID NO: 6924560 - DNA, 22 bp, Homo sapiens
agggctgacaaatggcagtgac

SEQ ID NO: 6924561 - DNA, 22 bp, Homo sapiens
ttgacagagaaaagtgtgactt

SEQ ID NO: 6924562 - DNA, 22 bp, Homo sapiens
gcctgagctactagggagtctg

SEQ ID NO: 6924563 - DNA, 22 bp, Homo sapiens
ctctttccagggtaccccaggt

SEQ ID NO: 6924564 - DNA, 22 bp, Homo sapiens
agtgagatattagctaatgtgt

SEQ ID NO: 6924565 - DNA, 22 bp, Homo sapiens
gtcctctggaagatgagttctt

SEQ ID NO: 6924566 - DNA, 22 bp, Homo sapiens
tttacagctgctggcaagcttg

SEQ ID NO: 6924567 - DNA, 22 bp, Homo sapiens
gtggcagcggtgtgcaaggagg

SEQ ID NO: 6924568 - DNA, 22 bp, Homo sapiens
aggaggtgctagagaagatgtt

SEQ ID NO: 6924569 - DNA, 22 bp, Homo sapiens
tgagtccatcgcagggaagtgg

SEQ ID NO: 6924570 - DNA, 22 bp, Homo sapiens
gaaggagaccctgaagatgctg

SEQ ID NO: 6924571 - DNA, 22 bp, Homo sapiens
tgccgcgcccgccaggtgtgtc

SEQ ID NO: 6924572 - DNA, 22 bp, Homo sapiens
gctatagaatttcatagagacc

SEQ ID NO: 6924573 - DNA, 18 bp, Homo sapiens
tgcatatactgcctatct

SEQ ID NO: 6924574 - DNA, 22 bp, Homo sapiens
gctgtccacggggttggtagag

SEQ ID NO: 6924575 - DNA, 22 bp, Homo sapiens
taagatgggggaaagaaatagt

SEQ ID NO: 6924576 - DNA, 22 bp, Homo sapiens
gttttacacacctatgaaagac

SEQ ID NO: 6924577 - DNA, 22 bp, Homo sapiens
ctgtgccatcctagggctgctg

SEQ ID NO: 6924578 - DNA, 22 bp, Homo sapiens
gctctgtgtccacagctggaaa

SEQ ID NO: 6924579 - DNA, 22 bp, Homo sapiens
ggtacaatgtcttacagaccca

SEQ ID NO: 6924580 - DNA, 22 bp, Homo sapiens
gccaaataagtgtccggccctc

SEQ ID NO: 6924581 - DNA, 22 bp, Homo sapiens
atattgcagggacagtctggat

SEQ ID NO: 6924582 - DNA, 22 bp, Homo sapiens
tgcagcatatagcttagtgatg

SEQ ID NO: 6924583 - DNA, 22 bp, Homo sapiens
agagcctgcatcaggcttgggg

SEQ ID NO: 6924584 - DNA, 22 bp, Homo sapiens
ttcagagcatctctaaagccag

SEQ ID NO: 6924585 - DNA, 22 bp, Homo sapiens
catttctaccaaatgtgactgg

SEQ ID NO: 6924586 - DNA, 22 bp, Homo sapiens
cgcagtgagtctgtaaaaggct

SEQ ID NO: 6924587 - DNA, 22 bp, Homo sapiens
cactttgatgcagggctcagta

SEQ ID NO: 6924588 - DNA, 22 bp, Homo sapiens
tacttgataggtctaatatgca

SEQ ID NO: 6924589 - DNA, 21 bp, Homo sapiens
tcaggaagagccagttcatgc

SEQ ID NO: 6924590 - DNA, 22 bp, Homo sapiens
aatctgtgctccctgcatttgt

SEQ ID NO: 6924591 - DNA, 22 bp, Homo sapiens
gagttagtgtaaccacaaccat

SEQ ID NO: 6924592 - DNA, 22 bp, Homo sapiens
gggacaatggaggcctctctcc

SEQ ID NO: 6924593 - DNA, 22 bp, Homo sapiens
tgaaccttgttcctgccctcct

SEQ ID NO: 6924594 - DNA, 22 bp, Homo sapiens
agagctactgtccagttgctac

SEQ ID NO: 6924595 - DNA, 22 bp, Homo sapiens
tgctgctgatggcacctaggca

SEQ ID NO: 6924596 - DNA, 22 bp, Homo sapiens
ttgcttgctcaactctgttgtt

SEQ ID NO: 6924597 - DNA, 22 bp, Homo sapiens
tgggtagggagctggaatccta

SEQ ID NO: 6924598 - DNA, 22 bp, Homo sapiens
acttggagggagctgggtggaa

SEQ ID NO: 6924599 - DNA, 22 bp, Homo sapiens
cacagtggtccccgaagcccct

SEQ ID NO: 6924600 - DNA, 22 bp, Homo sapiens
aggcagtttctgggacagcata

SEQ ID NO: 6924601 - DNA, 22 bp, Homo sapiens
atgagaatggtgattctgcaga

SEQ ID NO: 6924602 - DNA, 22 bp, Homo sapiens
atcatggaaaggttcagcaagc

SEQ ID NO: 6924603 - DNA, 22 bp, Homo sapiens
aggagccatgagcaggaggcaa

SEQ ID NO: 6924604 - DNA, 22 bp, Homo sapiens
gcttcctgtatcctcctgtacc

SEQ ID NO: 6924605 - DNA, 22 bp, Homo sapiens
cagataggaaaagctaggcata

SEQ ID NO: 6924606 - DNA, 22 bp, Homo sapiens
agagctatgatcaaggcagggt

SEQ ID NO: 6924607 - DNA, 22 bp, Homo sapiens
aagaactagtcttacagcctca

SEQ ID NO: 6924608 - DNA, 22 bp, Homo sapiens
aatgctctgtctctgacagtgg

SEQ ID NO: 6924609 - DNA, 22 bp, Homo sapiens
acgcagcacaaaggaaaggatc

SEQ ID NO: 6924610 - DNA, 22 bp, Homo sapiens
gggacgagatcttggcagtgtg

SEQ ID NO: 6924611 - DNA, 22 bp, Homo sapiens
aggtcacgtcctgtgatgtcat

SEQ ID NO: 6924612 - DNA, 23 bp, Homo sapiens
tgtaccaggagtttcagcagact

SEQ ID NO: 6924613 - DNA, 22 bp, Homo sapiens
tcagggaaattcaagggagatt

SEQ ID NO: 6924614 - DNA, 22 bp, Homo sapiens
agatctttaaaagttattatta

SEQ ID NO: 6924615 - DNA, 20 bp, Homo sapiens
aatggcttatagcatgctac

SEQ ID NO: 6924616 - DNA, 22 bp, Homo sapiens
agactataaaaagagagtgagg

SEQ ID NO: 6924617 - DNA, 22 bp, Homo sapiens
acagtgaatgcccaagaaaagt

SEQ ID NO: 6924618 - DNA, 22 bp, Homo sapiens
tgtctagaggccaacaggaaag

SEQ ID NO: 6924619 - DNA, 22 bp, Homo sapiens
tgccttttccagttcctagaag

SEQ ID NO: 6924620 - DNA, 22 bp, Homo sapiens
caggtctctcccaagctacaat

SEQ ID NO: 6924621 - DNA, 22 bp, Homo sapiens
aggggatgcctagtggagtctc

SEQ ID NO: 6924622 - DNA, 23 bp, Homo sapiens
tttattctcagatacataggtct

SEQ ID NO: 6924623 - DNA, 22 bp, Homo sapiens
caagatttggcattctgaggag

SEQ ID NO: 6924624 - DNA, 22 bp, Homo sapiens
aaggcctttaggctttcattgt

SEQ ID NO: 6924625 - DNA, 22 bp, Homo sapiens
agcagaaccacagcactgttga

SEQ ID NO: 6924626 - DNA, 22 bp, Homo sapiens
ctggctcagtgccttcagaagt

SEQ ID NO: 6924627 - DNA, 22 bp, Homo sapiens
ttcagagccacttcaagtctaa

SEQ ID NO: 6924628 - DNA, 23 bp, Homo sapiens
tcacacagctggtcaggtacaga

SEQ ID NO: 6924629 - DNA, 22 bp, Homo sapiens
gaagcctttcgtgcacctcacc

SEQ ID NO: 6924630 - DNA, 22 bp, Homo sapiens
tttacacaaaagatagcacacc

SEQ ID NO: 6924631 - DNA, 22 bp, Homo sapiens
tgagaagatttgctcttctgag

SEQ ID NO: 6924632 - DNA, 22 bp, Homo sapiens
ttttcttatagagcttaaagtt

SEQ ID NO: 6924633 - DNA, 22 bp, Homo sapiens
tgggcaggataatatctcatgt

SEQ ID NO: 6924634 - DNA, 23 bp, Homo sapiens
tactgtgctgaatatttgagagg

SEQ ID NO: 6924635 - DNA, 22 bp, Homo sapiens
tcagggaacatcgttaaactag

SEQ ID NO: 6924636 - DNA, 22 bp, Homo sapiens
cagagtgggctgtcagccacca

SEQ ID NO: 6924637 - DNA, 22 bp, Homo sapiens
ttcagctcagcactgacaagat

SEQ ID NO: 6924638 - DNA, 22 bp, Homo sapiens
ccagtgagaatgaagataaggc

SEQ ID NO: 6924639 - DNA, 22 bp, Homo sapiens
aagaagctatacataatttggg

SEQ ID NO: 6924640 - DNA, 22 bp, Homo sapiens
agtgatttggtgggagcgcgta

SEQ ID NO: 6924641 - DNA, 23 bp, Homo sapiens
atcattactttgataccttttct

SEQ ID NO: 6924642 - DNA, 22 bp, Homo sapiens
tagaacagaaggcaccttctct

SEQ ID NO: 6924643 - DNA, 22 bp, Homo sapiens
attctgcaggtggaggatggca

SEQ ID NO: 6924644 - DNA, 22 bp, Homo sapiens
cacagtgctcaaacacaagtgc

SEQ ID NO: 6924645 - DNA, 22 bp, Homo sapiens
agagttaagaggaatgtgaatt

SEQ ID NO: 6924646 - DNA, 22 bp, Homo sapiens
ttagtacagaatcaaaagcaat

SEQ ID NO: 6924647 - DNA, 22 bp, Homo sapiens
atttagtgacctgaactgaaac

SEQ ID NO: 6924648 - DNA, 22 bp, Homo sapiens
gtggcagagttgctgactagaa

SEQ ID NO: 6924649 - DNA, 16 bp, Homo sapiens
gttacccacccaaggc

SEQ ID NO: 6924650 - DNA, 22 bp, Homo sapiens
acagaactgggggcacagatag

SEQ ID NO: 6924651 - DNA, 22 bp, Homo sapiens
tcctgcagtctgcactctgcct

SEQ ID NO: 6924652 - DNA, 22 bp, Homo sapiens
ccagatgggctttagcaaatga

SEQ ID NO: 6924653 - DNA, 22 bp, Homo sapiens
gctcctgaaggctctgcagggt

SEQ ID NO: 6924654 - DNA, 22 bp, Homo sapiens
gctcgttgaacctgtccccgag

SEQ ID NO: 6924655 - DNA, 22 bp, Homo sapiens
agaatgaattaatcaactggaa

SEQ ID NO: 6924656 - DNA, 20 bp, Homo sapiens
tggaccaccctcctctttgc

SEQ ID NO: 6924657 - DNA, 22 bp, Homo sapiens
tggtggcaacattgctggagtg

SEQ ID NO: 6924658 - DNA, 22 bp, Homo sapiens
aatatatagaagtacccgttgt

SEQ ID NO: 6924659 - DNA, 17 bp, Homo sapiens
cagtcacaggtcttttc

SEQ ID NO: 6924660 - DNA, 21 bp, Homo sapiens
tgccaggcctgagctggggtc

SEQ ID NO: 6924661 - DNA, 22 bp, Homo sapiens
gggatttgtgggatggccagtg

SEQ ID NO: 6924662 - DNA, 22 bp, Homo sapiens
actatcaacatcattgctctag

SEQ ID NO: 6924663 - DNA, 22 bp, Homo sapiens
tagtgacaggaactgaatctct

SEQ ID NO: 6924664 - DNA, 22 bp, Homo sapiens
aacaataattgcggttctctat

SEQ ID NO: 6924665 - DNA, 22 bp, Homo sapiens
ttacacacagagctgggcctgg

SEQ ID NO: 6924666 - DNA, 22 bp, Homo sapiens
gcctggcttggggctcagtggt

SEQ ID NO: 6924667 - DNA, 22 bp, Homo sapiens
gctgcagggagctggaaggctc

SEQ ID NO: 6924668 - DNA, 22 bp, Homo sapiens
gtggagggtgattgccggctgt

SEQ ID NO: 6924669 - DNA, 22 bp, Homo sapiens
agactctgattccctcatgtca

SEQ ID NO: 6924670 - DNA, 22 bp, Homo sapiens
ctgggcctagaggaagctgaca

SEQ ID NO: 6924671 - DNA, 22 bp, Homo sapiens
aaaatatgaagttgtcagtatg

SEQ ID NO: 6924672 - DNA, 22 bp, Homo sapiens
atgtctgttaatcgaccctaat

SEQ ID NO: 6924673 - DNA, 22 bp, Homo sapiens
tcagcctgcgtcatggtgacac

SEQ ID NO: 6924674 - DNA, 22 bp, Homo sapiens
gcccaaagagctttgatctcag

SEQ ID NO: 6924675 - DNA, 22 bp, Homo sapiens
atcccttgtgctcagcctcttg

SEQ ID NO: 6924676 - DNA, 22 bp, Homo sapiens
ttcctttctgtcagcctgagtg

SEQ ID NO: 6924677 - DNA, 22 bp, Homo sapiens
caatacagcacacctgtatcag

SEQ ID NO: 6924678 - DNA, 22 bp, Homo sapiens
agcaccttgctcttggccttcc

SEQ ID NO: 6924679 - DNA, 22 bp, Homo sapiens
aaatgctagggagaaactctcc

SEQ ID NO: 6924680 - DNA, 22 bp, Homo sapiens
tctctgtggtgggaggctgagt

SEQ ID NO: 6924681 - DNA, 22 bp, Homo sapiens
actgatgtgatttcaaattcca

SEQ ID NO: 6924682 - DNA, 22 bp, Homo sapiens
ttaagtgtgtattatctcatta

SEQ ID NO: 6924683 - DNA, 22 bp, Homo sapiens
taatccaatggcacaatgtatg

SEQ ID NO: 6924684 - DNA, 22 bp, Homo sapiens
tgtcctgggaactcacagtcca

SEQ ID NO: 6924685 - DNA, 18 bp, Homo sapiens
gcagcttaaactaacaga

SEQ ID NO: 6924686 - DNA, 23 bp, Homo sapiens
aactgcaaggttgctgggaagta

SEQ ID NO: 6924687 - DNA, 20 bp, Homo sapiens
ttttcctcgtgtttgttcta

SEQ ID NO: 6924688 - DNA, 22 bp, Homo sapiens
agtagaggccaggcctccctgg

SEQ ID NO: 6924689 - DNA, 22 bp, Homo sapiens
tgaagccagggactgacacttc

SEQ ID NO: 6924690 - DNA, 22 bp, Homo sapiens
tgcagccatcgcagagtctgta

SEQ ID NO: 6924691 - DNA, 18 bp, Homo sapiens
agcagcaatttgggatga

SEQ ID NO: 6924692 - DNA, 19 bp, Homo sapiens
accctaggaggtctggtga

SEQ ID NO: 6924693 - DNA, 21 bp, Homo sapiens
taacaagtctgcatacattca

SEQ ID NO: 6924694 - DNA, 22 bp, Homo sapiens
cctatacaggcttctttacatg

SEQ ID NO: 6924695 - DNA, 22 bp, Homo sapiens
gaacagctgctagagatctgtg

SEQ ID NO: 6924696 - DNA, 22 bp, Homo sapiens
tgagtgccaatggaactccata

SEQ ID NO: 6924697 - DNA, 23 bp, Homo sapiens
ttaaggagcttgcactctgggtg

SEQ ID NO: 6924698 - DNA, 22 bp, Homo sapiens
tggctggaatggagctgagcct

SEQ ID NO: 6924699 - DNA, 22 bp, Homo sapiens
tgtgtgaatctattgaatatat

SEQ ID NO: 6924700 - DNA, 22 bp, Homo sapiens
gcaaagggaaagtggcagggtc

SEQ ID NO: 6924701 - DNA, 22 bp, Homo sapiens
gaccctggaactttcagcagag

SEQ ID NO: 6924702 - DNA, 20 bp, Homo sapiens
ttctgcttgcaaatatcaag

SEQ ID NO: 6924703 - DNA, 22 bp, Homo sapiens
tcagcccagaccacctcattgc

SEQ ID NO: 6924704 - DNA, 22 bp, Homo sapiens
aggagctgataaaagggggtca

SEQ ID NO: 6924705 - DNA, 22 bp, Homo sapiens
ctgtattagccaggtgcacaag

SEQ ID NO: 6924706 - DNA, 18 bp, Homo sapiens
gagtgcggtggtgcacac

SEQ ID NO: 6924707 - DNA, 22 bp, Homo sapiens
acagccagtgactggacaagct

SEQ ID NO: 6924708 - DNA, 22 bp, Homo sapiens
tctgcctcctgcttgtcccgac

SEQ ID NO: 6924709 - DNA, 22 bp, Homo sapiens
agatcactttgatgctacctgg

SEQ ID NO: 6924710 - DNA, 22 bp, Homo sapiens
tacacagtagagtataatgcgt

SEQ ID NO: 6924711 - DNA, 22 bp, Homo sapiens
ttggtcacctgctgtcctttgt

SEQ ID NO: 6924712 - DNA, 22 bp, Homo sapiens
gaggcctggctgtcagtcccca

SEQ ID NO: 6924713 - DNA, 22 bp, Homo sapiens
ggctgggtacagggcagtgtgc

SEQ ID NO: 6924714 - DNA, 22 bp, Homo sapiens
ttattgcactattgattttcta

SEQ ID NO: 6924715 - DNA, 22 bp, Homo sapiens
tggctgtgtgccaggctgtctg

SEQ ID NO: 6924716 - DNA, 22 bp, Homo sapiens
agtgttaaggctggttgctata

SEQ ID NO: 6924717 - DNA, 22 bp, Homo sapiens
agccacacagcttaatgacaga

SEQ ID NO: 6924718 - DNA, 22 bp, Homo sapiens
gctggtccaattatgaactgtt

SEQ ID NO: 6924719 - DNA, 22 bp, Homo sapiens
catgctttttgacaacaagctg

SEQ ID NO: 6924720 - DNA, 22 bp, Homo sapiens
accccaggtccaggttacagag

SEQ ID NO: 6924721 - DNA, 22 bp, Homo sapiens
ggggctctgcctctcccacgcc

SEQ ID NO: 6924722 - DNA, 22 bp, Homo sapiens
ggccatttcttccttctcaaca

SEQ ID NO: 6924723 - DNA, 22 bp, Homo sapiens
cagccactctcagacagtccca

SEQ ID NO: 6924724 - DNA, 22 bp, Homo sapiens
attaatatacactgttagcatg

SEQ ID NO: 6924725 - DNA, 22 bp, Homo sapiens
tctgctcactattacatggaca

SEQ ID NO: 6924726 - DNA, 22 bp, Homo sapiens
atctattatgctgagaaactgt

SEQ ID NO: 6924727 - DNA, 22 bp, Homo sapiens
tctcagctgcctgccctgctcc

SEQ ID NO: 6924728 - DNA, 22 bp, Homo sapiens
taatttaatccaagtgttacat

SEQ ID NO: 6924729 - DNA, 16 bp, Homo sapiens
agaggctgtaatggaa

SEQ ID NO: 6924730 - DNA, 22 bp, Homo sapiens
gtttggctatttattctcagtg

SEQ ID NO: 6924731 - DNA, 22 bp, Homo sapiens
atctgtgtccttataagagaca

SEQ ID NO: 6924732 - DNA, 23 bp, Homo sapiens
tgtaaaatggggtagtgttacca

SEQ ID NO: 6924733 - DNA, 22 bp, Homo sapiens
aagtttgtagctggatgtctgt

SEQ ID NO: 6924734 - DNA, 22 bp, Homo sapiens
caactgtaatattggaagatca

SEQ ID NO: 6924735 - DNA, 22 bp, Homo sapiens
tgtgaatgtctaggttttatgt

SEQ ID NO: 6924736 - DNA, 22 bp, Homo sapiens
tgggcctcagtttgcttaatgt

SEQ ID NO: 6924737 - DNA, 22 bp, Homo sapiens
tacatgtatgtttatcttgaga

SEQ ID NO: 6924738 - DNA, 22 bp, Homo sapiens
accttcaagattgtgggtcaat

SEQ ID NO: 6924739 - DNA, 22 bp, Homo sapiens
gacatgaatgttatactttatt

SEQ ID NO: 6924740 - DNA, 22 bp, Homo sapiens
agatgatgaccatgggaatgga

SEQ ID NO: 6924741 - DNA, 22 bp, Homo sapiens
gaagtcatccactatgggggag

SEQ ID NO: 6924742 - DNA, 22 bp, Homo sapiens
attgtgctgctgctgacgttta

SEQ ID NO: 6924743 - DNA, 22 bp, Homo sapiens
tagtttctagtcaatcttcttt

SEQ ID NO: 6924744 - DNA, 22 bp, Homo sapiens
gaagatacacagagctgtcttt

SEQ ID NO: 6924745 - DNA, 22 bp, Homo sapiens
tgggtaggccaggaagcagtgt

SEQ ID NO: 6924746 - DNA, 18 bp, Homo sapiens
ttctcagactttggaagt

SEQ ID NO: 6924747 - DNA, 22 bp, Homo sapiens
cagcatctcattcattcatgtt

SEQ ID NO: 6924748 - DNA, 22 bp, Homo sapiens
gcagatcaacactctctttcaa

SEQ ID NO: 6924749 - DNA, 22 bp, Homo sapiens
ccccagaagtttgcacaagaga

SEQ ID NO: 6924750 - DNA, 22 bp, Homo sapiens
tcaagatgtgatgtaacttttg

SEQ ID NO: 6924751 - DNA, 22 bp, Homo sapiens
gactctggaactcttggtaaga

SEQ ID NO: 6924752 - DNA, 22 bp, Homo sapiens
taggagctataatgtgaagtct

SEQ ID NO: 6924753 - DNA, 22 bp, Homo sapiens
ggaggcctggacttcctgatgg

SEQ ID NO: 6924754 - DNA, 22 bp, Homo sapiens
atggcattgagtaaagtcagta

SEQ ID NO: 6924755 - DNA, 22 bp, Homo sapiens
tccaggcccagacggggtgagg

SEQ ID NO: 6924756 - DNA, 22 bp, Homo sapiens
tctctcctccacaccgggtgct

SEQ ID NO: 6924757 - DNA, 22 bp, Homo sapiens
tagatttaagaccctgaatttg

SEQ ID NO: 6924758 - DNA, 22 bp, Homo sapiens
caggcatgatgggaagtgcctg

SEQ ID NO: 6924759 - DNA, 22 bp, Homo sapiens
attcagtttcaatcattgtagt

SEQ ID NO: 6924760 - DNA, 22 bp, Homo sapiens
acaggcagtgatttcctctggt

SEQ ID NO: 6924761 - DNA, 22 bp, Homo sapiens
ttatagaacggttctgtgcaaa

SEQ ID NO: 6924762 - DNA, 22 bp, Homo sapiens
tgcacagacaactctttctaga

SEQ ID NO: 6924763 - DNA, 22 bp, Homo sapiens
agccatgattttctcattttca

SEQ ID NO: 6924764 - DNA, 22 bp, Homo sapiens
attttcctcaagcctctggaag

SEQ ID NO: 6924765 - DNA, 22 bp, Homo sapiens
ttctcagaggagtcgggagctg

SEQ ID NO: 6924766 - DNA, 22 bp, Homo sapiens
gaagcctgtcatgtgacgctga

SEQ ID NO: 6924767 - DNA, 22 bp, Homo sapiens
aatctatatgcttttcacatac

SEQ ID NO: 6924768 - DNA, 22 bp, Homo sapiens
ggggtgtgagtagagctgggga

SEQ ID NO: 6924769 - DNA, 22 bp, Homo sapiens
tcttcagtaggtcctcagaatc

SEQ ID NO: 6924770 - DNA, 22 bp, Homo sapiens
tcaaaagtttcacatagagata

SEQ ID NO: 6924771 - DNA, 22 bp, Homo sapiens
gcctgcttcctagccttccaag

SEQ ID NO: 6924772 - DNA, 22 bp, Homo sapiens
tctcatggcttgtaggaggtga

SEQ ID NO: 6924773 - DNA, 22 bp, Homo sapiens
tgtgtattctgaggtaggtata

SEQ ID NO: 6924774 - DNA, 22 bp, Homo sapiens
ttatgggcagagggtaactgat

SEQ ID NO: 6924775 - DNA, 22 bp, Homo sapiens
cagagtgcatggtgctgttcat

SEQ ID NO: 6924776 - DNA, 22 bp, Homo sapiens
ctgagccagagggagtcgggtc

SEQ ID NO: 6924777 - DNA, 22 bp, Homo sapiens
gaggatggaggtgtgagctatg

SEQ ID NO: 6924778 - DNA, 22 bp, Homo sapiens
tagttgctaaaaagtgcctaac

SEQ ID NO: 6924779 - DNA, 22 bp, Homo sapiens
ctccaaggttttccctgtcctt

SEQ ID NO: 6924780 - DNA, 22 bp, Homo sapiens
gcgggggcagactgggcagttc

SEQ ID NO: 6924781 - DNA, 22 bp, Homo sapiens
ctgctgcctgacaatttaggtt

SEQ ID NO: 6924782 - DNA, 22 bp, Homo sapiens
ttatagcagcatgatttacaat

SEQ ID NO: 6924783 - DNA, 22 bp, Homo sapiens
tgcagtgagaagcagttatgat

SEQ ID NO: 6924784 - DNA, 22 bp, Homo sapiens
aagagaacagttgctgcccaag

SEQ ID NO: 6924785 - DNA, 22 bp, Homo sapiens
cctagtcttccgcgtccccacc

SEQ ID NO: 6924786 - DNA, 22 bp, Homo sapiens
atttgctagtggaattttcctg

SEQ ID NO: 6924787 - DNA, 22 bp, Homo sapiens
cacagggcttctcatggggtgc

SEQ ID NO: 6924788 - DNA, 22 bp, Homo sapiens
actgattgcattcatagggttt

SEQ ID NO: 6924789 - DNA, 22 bp, Homo sapiens
gcagcccagcagggcccggagc

SEQ ID NO: 6924790 - DNA, 22 bp, Homo sapiens
aactatgtgatatcatccttgc

SEQ ID NO: 6924791 - DNA, 22 bp, Homo sapiens
tatactgtccctctgcactcca

SEQ ID NO: 6924792 - DNA, 22 bp, Homo sapiens
ccagtacttgctacctcaattg

SEQ ID NO: 6924793 - DNA, 20 bp, Homo sapiens
agctcttactttgcagcagc

SEQ ID NO: 6924794 - DNA, 22 bp, Homo sapiens
tattcaggtcgagctaactgct

SEQ ID NO: 6924795 - DNA, 22 bp, Homo sapiens
aggtggctgtattcagctgtaa

SEQ ID NO: 6924796 - DNA, 22 bp, Homo sapiens
acaacacagctttcctcaagtt

SEQ ID NO: 6924797 - DNA, 22 bp, Homo sapiens
aggttatagaaactgaggctct

SEQ ID NO: 6924798 - DNA, 22 bp, Homo sapiens
gtcatttatcttcagaatttct

SEQ ID NO: 6924799 - DNA, 22 bp, Homo sapiens
atttcctggaggaatggaagca

SEQ ID NO: 6924800 - DNA, 22 bp, Homo sapiens
atcttcagttttcagtgagcca

SEQ ID NO: 6924801 - DNA, 22 bp, Homo sapiens
gagctttgtctcctggagaccc

SEQ ID NO: 6924802 - DNA, 20 bp, Homo sapiens
acaggcgctggggagatggc

SEQ ID NO: 6924803 - DNA, 22 bp, Homo sapiens
cagctgtgtctaattatggctg

SEQ ID NO: 6924804 - DNA, 22 bp, Homo sapiens
gggctgtgtactatgaggaggg

SEQ ID NO: 6924805 - DNA, 22 bp, Homo sapiens
ctttagtggtattttagcaagt

SEQ ID NO: 6924806 - DNA, 22 bp, Homo sapiens
ggctgcctctttcttagtgtct

SEQ ID NO: 6924807 - DNA, 22 bp, Homo sapiens
gccccacagcctgcggtctcag

SEQ ID NO: 6924808 - DNA, 21 bp, Homo sapiens
tcacatctatgttaagcaaac

SEQ ID NO: 6924809 - DNA, 22 bp, Homo sapiens
tatgttgtggggtgcatcaaaa

SEQ ID NO: 6924810 - DNA, 22 bp, Homo sapiens
attgcaggcaaagtgctgtgtc

SEQ ID NO: 6924811 - DNA, 22 bp, Homo sapiens
acgtcaacattttatgaatagt

SEQ ID NO: 6924812 - DNA, 22 bp, Homo sapiens
tgcagaggtttttaatacattt

SEQ ID NO: 6924813 - DNA, 22 bp, Homo sapiens
ggctggcattgctctattgcct

SEQ ID NO: 6924814 - DNA, 22 bp, Homo sapiens
acagctggagtgaggatggagt

SEQ ID NO: 6924815 - DNA, 22 bp, Homo sapiens
tcagagaagctgccaggcgagc

SEQ ID NO: 6924816 - DNA, 22 bp, Homo sapiens
gatcagaatcttcattttcagt

SEQ ID NO: 6924817 - DNA, 22 bp, Homo sapiens
caggtgttgcctaaattgacaa

SEQ ID NO: 6924818 - DNA, 20 bp, Homo sapiens
gcgttcagactcaactgtgg

SEQ ID NO: 6924819 - DNA, 22 bp, Homo sapiens
ggcttccccacaaagcacacaa

SEQ ID NO: 6924820 - DNA, 22 bp, Homo sapiens
tatactctggaattttattctt

SEQ ID NO: 6924821 - DNA, 21 bp, Homo sapiens
aggcagcgtgagggccactca

SEQ ID NO: 6924822 - DNA, 22 bp, Homo sapiens
ggctggcaggactcacacttgg

SEQ ID NO: 6924823 - DNA, 22 bp, Homo sapiens
ctgaagattcgcctttgtttat

SEQ ID NO: 6924824 - DNA, 22 bp, Homo sapiens
aggaggaaagaaggcccccagc

SEQ ID NO: 6924825 - DNA, 22 bp, Homo sapiens
tttgattctggcctctgagaag

SEQ ID NO: 6924826 - DNA, 22 bp, Homo sapiens
catgtgttttgtcatttcaata

SEQ ID NO: 6924827 - DNA, 18 bp, Homo sapiens
atgggaggggccaagaga

SEQ ID NO: 6924828 - DNA, 22 bp, Homo sapiens
atctaacactgtaaactgtctt

SEQ ID NO: 6924829 - DNA, 22 bp, Homo sapiens
atggagcacacgccatcacata

SEQ ID NO: 6924830 - DNA, 22 bp, Homo sapiens
cagcaggtcatgaaagaaaacc

SEQ ID NO: 6924831 - DNA, 22 bp, Homo sapiens
gataccttttgttggaatttcc

SEQ ID NO: 6924832 - DNA, 21 bp, Homo sapiens
agtctttgataaagacaaagt

SEQ ID NO: 6924833 - DNA, 22 bp, Homo sapiens
tgaatagatttttaacatataa

SEQ ID NO: 6924834 - DNA, 22 bp, Homo sapiens
aatggctgttatttcagcagat

SEQ ID NO: 6924835 - DNA, 22 bp, Homo sapiens
taagtttgaagtccatctgtac

SEQ ID NO: 6924836 - DNA, 21 bp, Homo sapiens
tgcttgtcatgaatgggccag

SEQ ID NO: 6924837 - DNA, 22 bp, Homo sapiens
atcagtgctaaagcaaatgccc

SEQ ID NO: 6924838 - DNA, 22 bp, Homo sapiens
cactcatattggaacaagcttg

SEQ ID NO: 6924839 - DNA, 20 bp, Homo sapiens
aggtggctcttcctgggctt

SEQ ID NO: 6924840 - DNA, 22 bp, Homo sapiens
cagggctttttattagctgcct

SEQ ID NO: 6924841 - DNA, 22 bp, Homo sapiens
aaaaccagacactgtttctggg

SEQ ID NO: 6924842 - DNA, 18 bp, Homo sapiens
tttctctgtcgtcttctg

SEQ ID NO: 6924843 - DNA, 22 bp, Homo sapiens
attgcacagctgaatattttgg

SEQ ID NO: 6924844 - DNA, 22 bp, Homo sapiens
tttgaatgagaattattgtcat

SEQ ID NO: 6924845 - DNA, 23 bp, Homo sapiens
tctctggttaggggagattggtg

SEQ ID NO: 6924846 - DNA, 22 bp, Homo sapiens
ctgaggcctctccttggcttgt

SEQ ID NO: 6924847 - DNA, 22 bp, Homo sapiens
tttgtacatatttgtggggcac

SEQ ID NO: 6924848 - DNA, 22 bp, Homo sapiens
cctgccactgtaggtgacagtt

SEQ ID NO: 6924849 - DNA, 22 bp, Homo sapiens
tggcagtcgatcatattcagca

SEQ ID NO: 6924850 - DNA, 20 bp, Homo sapiens
tacaaattttccatgtttcc

SEQ ID NO: 6924851 - DNA, 22 bp, Homo sapiens
aagttaagggtcccagtctgtt

SEQ ID NO: 6924852 - DNA, 22 bp, Homo sapiens
ttgctgaggacgcagtgcagtg

SEQ ID NO: 6924853 - DNA, 22 bp, Homo sapiens
gaggaactggagctttcatttt

SEQ ID NO: 6924854 - DNA, 23 bp, Homo sapiens
tgacaacagctctcagccatgtc

SEQ ID NO: 6924855 - DNA, 22 bp, Homo sapiens
actttcatggatctctgttcag

SEQ ID NO: 6924856 - DNA, 22 bp, Homo sapiens
ttcagagagaccaagtggcgtg

SEQ ID NO: 6924857 - DNA, 22 bp, Homo sapiens
gcttgagaacttcaactcagtg

SEQ ID NO: 6924858 - DNA, 22 bp, Homo sapiens
actgggctgcctggttcttcta

SEQ ID NO: 6924859 - DNA, 22 bp, Homo sapiens
acatttacctagttaagtcaat

SEQ ID NO: 6924860 - DNA, 22 bp, Homo sapiens
atgggcatgatattagtaccta

SEQ ID NO: 6924861 - DNA, 22 bp, Homo sapiens
cctggagacccacttctgccaa

SEQ ID NO: 6924862 - DNA, 22 bp, Homo sapiens
aaagctctgggaatgcttatct

SEQ ID NO: 6924863 - DNA, 22 bp, Homo sapiens
ggctgcttttgctgtaagccag

SEQ ID NO: 6924864 - DNA, 22 bp, Homo sapiens
aacaggctccatgaacaacgtg

SEQ ID NO: 6924865 - DNA, 22 bp, Homo sapiens
tactttctaagacatacaactt

SEQ ID NO: 6924866 - DNA, 22 bp, Homo sapiens
gttgccctggctctgcccagct

SEQ ID NO: 6924867 - DNA, 22 bp, Homo sapiens
ctgttctatcattaaaagctat

SEQ ID NO: 6924868 - DNA, 22 bp, Homo sapiens
tctctgggcctccctttccaag

SEQ ID NO: 6924869 - DNA, 18 bp, Homo sapiens
ctctgaacatctttctgg

SEQ ID NO: 6924870 - DNA, 22 bp, Homo sapiens
ggagcctgggcattagtaattt

SEQ ID NO: 6924871 - DNA, 18 bp, Homo sapiens
tgtgcaatattaaccacc

SEQ ID NO: 6924872 - DNA, 22 bp, Homo sapiens
aatgatcacctggtaaagagag

SEQ ID NO: 6924873 - DNA, 22 bp, Homo sapiens
tgcctggcaatgccagaagcca

SEQ ID NO: 6924874 - DNA, 21 bp, Homo sapiens
gcagggaccgcgacttctggg

SEQ ID NO: 6924875 - DNA, 22 bp, Homo sapiens
tctgttcagctgcctcagggta

SEQ ID NO: 6924876 - DNA, 22 bp, Homo sapiens
tataggtatgtcgagaaatgaa

SEQ ID NO: 6924877 - DNA, 22 bp, Homo sapiens
acaaaatagagttctcccctgg

SEQ ID NO: 6924878 - DNA, 22 bp, Homo sapiens
gtttcagaaatggtttatgcaa

SEQ ID NO: 6924879 - DNA, 22 bp, Homo sapiens
gcatatcatgacttctatctta

SEQ ID NO: 6924880 - DNA, 22 bp, Homo sapiens
tgctggggtcatggggcgcccg

SEQ ID NO: 6924881 - DNA, 21 bp, Homo sapiens
acagacagggccagtgtcccc

SEQ ID NO: 6924882 - DNA, 22 bp, Homo sapiens
ttgaaactgcttattgaatttg

SEQ ID NO: 6924883 - DNA, 22 bp, Homo sapiens
gtctggctcctggattttccgg

SEQ ID NO: 6924884 - DNA, 17 bp, Homo sapiens
tgcctccagcagggtga

SEQ ID NO: 6924885 - DNA, 22 bp, Homo sapiens
gaggccattcagctgggcagca

SEQ ID NO: 6924886 - DNA, 22 bp, Homo sapiens
ttgtatgaccacaatctgacgt

SEQ ID NO: 6924887 - DNA, 21 bp, Homo sapiens
tttgggactctgatgggagct

SEQ ID NO: 6924888 - DNA, 22 bp, Homo sapiens
ggcacacatagatctgcactgg

SEQ ID NO: 6924889 - DNA, 19 bp, Homo sapiens
ccacaaaattattttagtt

SEQ ID NO: 6924890 - DNA, 22 bp, Homo sapiens
agtctcaagcaccgaaagctgt

SEQ ID NO: 6924891 - DNA, 22 bp, Homo sapiens
actgctttgctctgcccccagg

SEQ ID NO: 6924892 - DNA, 22 bp, Homo sapiens
gcattctttttgactcctggtt

SEQ ID NO: 6924893 - DNA, 22 bp, Homo sapiens
aattttctgatgatgaagcacg

SEQ ID NO: 6924894 - DNA, 22 bp, Homo sapiens
ccctgagcgtgaggaggaagta

SEQ ID NO: 6924895 - DNA, 22 bp, Homo sapiens
gggtcaggctcagcagggcagc

SEQ ID NO: 6924896 - DNA, 20 bp, Homo sapiens
catcaacaccttgtcagcct

SEQ ID NO: 6924897 - DNA, 18 bp, Homo sapiens
gcagtgactatggggatc

SEQ ID NO: 6924898 - DNA, 22 bp, Homo sapiens
aagcccagggaatggtcgggag

SEQ ID NO: 6924899 - DNA, 22 bp, Homo sapiens
aggaagccaggcccttgggtgg

SEQ ID NO: 6924900 - DNA, 22 bp, Homo sapiens
gaaaaggaaatttatagagatc

SEQ ID NO: 6924901 - DNA, 22 bp, Homo sapiens
gttgctgaaggcatgccagaga

SEQ ID NO: 6924902 - DNA, 22 bp, Homo sapiens
ttctacatttaaaaggaaaatc

SEQ ID NO: 6924903 - DNA, 22 bp, Homo sapiens
tatgtatataggtgtgtgtctc

SEQ ID NO: 6924904 - DNA, 22 bp, Homo sapiens
ttgtcaaggcttttaatattct

SEQ ID NO: 6924905 - DNA, 22 bp, Homo sapiens
ggtccctggaaggccaagcttg

SEQ ID NO: 6924906 - DNA, 21 bp, Homo sapiens
acaatactatttgggggaagt

SEQ ID NO: 6924907 - DNA, 22 bp, Homo sapiens
ggcctatgttcctgggctaggg

SEQ ID NO: 6924908 - DNA, 22 bp, Homo sapiens
gagatgttctgattaggtttcc

SEQ ID NO: 6924909 - DNA, 22 bp, Homo sapiens
agaccctgaagttttctatgat

SEQ ID NO: 6924910 - DNA, 22 bp, Homo sapiens
atcaggaagcctgcactgagct

SEQ ID NO: 6924911 - DNA, 22 bp, Homo sapiens
acccacaacagctctaggaagt

SEQ ID NO: 6924912 - DNA, 22 bp, Homo sapiens
ctcaggatagctgcgcagcctg

SEQ ID NO: 6924913 - DNA, 22 bp, Homo sapiens
ctgcctggagcattctgaaggt

SEQ ID NO: 6924914 - DNA, 21 bp, Homo sapiens
cagatctgtaggtactaccat

SEQ ID NO: 6924915 - DNA, 22 bp, Homo sapiens
attagatatttgctgttggatt

SEQ ID NO: 6924916 - DNA, 22 bp, Homo sapiens
tctgccttttactagctggatg

SEQ ID NO: 6924917 - DNA, 22 bp, Homo sapiens
aaaggctccttctcccatgacc

SEQ ID NO: 6924918 - DNA, 22 bp, Homo sapiens
aaatgctacacaggaattctca

SEQ ID NO: 6924919 - DNA, 22 bp, Homo sapiens
tataaactttaaccaggatgtc

SEQ ID NO: 6924920 - DNA, 22 bp, Homo sapiens
tccaggtatctggcttccacat

SEQ ID NO: 6924921 - DNA, 22 bp, Homo sapiens
aagccaatgttgcctgggtttc

SEQ ID NO: 6924922 - DNA, 22 bp, Homo sapiens
gacccatatatacgtaatttgt

SEQ ID NO: 6924923 - DNA, 22 bp, Homo sapiens
tctgctgcagggaaagactttc

SEQ ID NO: 6924924 - DNA, 22 bp, Homo sapiens
ttgccttttgctctgggggcag

SEQ ID NO: 6924925 - DNA, 22 bp, Homo sapiens
ttttcctgttaaatctgggcac

SEQ ID NO: 6924926 - DNA, 22 bp, Homo sapiens
agcagccaaatgaagattttac

SEQ ID NO: 6924927 - DNA, 22 bp, Homo sapiens
cactggtcagagaaaaacgtta

SEQ ID NO: 6924928 - DNA, 22 bp, Homo sapiens
actttcatgctctgagcactgg

SEQ ID NO: 6924929 - DNA, 22 bp, Homo sapiens
agagaactactttttatatgtg

SEQ ID NO: 6924930 - DNA, 22 bp, Homo sapiens
taagaatctattaggaatatgt

SEQ ID NO: 6924931 - DNA, 22 bp, Homo sapiens
ccactggagactggtctctgtg

SEQ ID NO: 6924932 - DNA, 22 bp, Homo sapiens
tttcaaagtggagggatggtat

SEQ ID NO: 6924933 - DNA, 22 bp, Homo sapiens
acctctgaaggtttacatttcc

SEQ ID NO: 6924934 - DNA, 22 bp, Homo sapiens
accctccaggctgcagctcctg

SEQ ID NO: 6924935 - DNA, 22 bp, Homo sapiens
ttagctttcagcctttctcacc

SEQ ID NO: 6924936 - DNA, 21 bp, Homo sapiens
ttaaggtcacttctgagccta

SEQ ID NO: 6924937 - DNA, 22 bp, Homo sapiens
ctgggctgtcaatggccctctg

SEQ ID NO: 6924938 - DNA, 22 bp, Homo sapiens
cagggcctggagctgggcctgc

SEQ ID NO: 6924939 - DNA, 22 bp, Homo sapiens
gaagctgtgctgggggatctgt

SEQ ID NO: 6924940 - DNA, 22 bp, Homo sapiens
tcctttaactagttaccatgtt

SEQ ID NO: 6924941 - DNA, 22 bp, Homo sapiens
gaggaagggactttattatctg

SEQ ID NO: 6924942 - DNA, 22 bp, Homo sapiens
acagctgggtgctgctcagagc

SEQ ID NO: 6924943 - DNA, 22 bp, Homo sapiens
tgtggcattccaagacgcttaa

SEQ ID NO: 6924944 - DNA, 22 bp, Homo sapiens
gttgtacatgcgtctgcaagga

SEQ ID NO: 6924945 - DNA, 22 bp, Homo sapiens
cagccagctgtcccaagtgcct

SEQ ID NO: 6924946 - DNA, 22 bp, Homo sapiens
ttaggaagaatatatttagagc

SEQ ID NO: 6924947 - DNA, 22 bp, Homo sapiens
agcaagatgcattatttcttat

SEQ ID NO: 6924948 - DNA, 22 bp, Homo sapiens
aattgagtgactgctgcatgtc

SEQ ID NO: 6924949 - DNA, 22 bp, Homo sapiens
gagcaaggatggccggggccgt

SEQ ID NO: 6924950 - DNA, 22 bp, Homo sapiens
ccagttctgacacaagcacagt

SEQ ID NO: 6924951 - DNA, 21 bp, Homo sapiens
tgcaaaggtatttagggggta

SEQ ID NO: 6924952 - DNA, 22 bp, Homo sapiens
tatagtttcatgagctttttaa

SEQ ID NO: 6924953 - DNA, 22 bp, Homo sapiens
ctggaggaggaagtctacaatg

SEQ ID NO: 6924954 - DNA, 22 bp, Homo sapiens
gcttcaggaggtcggtctcctt

SEQ ID NO: 6924955 - DNA, 22 bp, Homo sapiens
cctggcactgctgaagtcctgg

SEQ ID NO: 6924956 - DNA, 22 bp, Homo sapiens
ctgggccatcagaggggctgga

SEQ ID NO: 6924957 - DNA, 18 bp, Homo sapiens
cttgttcttctcttggcg

SEQ ID NO: 6924958 - DNA, 22 bp, Homo sapiens
tcagattttccacagactggaa

SEQ ID NO: 6924959 - DNA, 22 bp, Homo sapiens
cacaggaatcgtcacttagcgc

SEQ ID NO: 6924960 - DNA, 22 bp, Homo sapiens
ggtgctgatgagttaggagagg

SEQ ID NO: 6924961 - DNA, 22 bp, Homo sapiens
ctagggagcactagctgccttg

SEQ ID NO: 6924962 - DNA, 16 bp, Homo sapiens
tgcagagagcatggtg

SEQ ID NO: 6924963 - DNA, 22 bp, Homo sapiens
cctggcagttcatcaaatggca

SEQ ID NO: 6924964 - DNA, 22 bp, Homo sapiens
tgggcttctgatgttgagtgct

SEQ ID NO: 6924965 - DNA, 18 bp, Homo sapiens
gagtctttgttactgctg

SEQ ID NO: 6924966 - DNA, 22 bp, Homo sapiens
gctggctgcgtcatcacagggc

SEQ ID NO: 6924967 - DNA, 22 bp, Homo sapiens
ctgtgccactgccccaggcctc

SEQ ID NO: 6924968 - DNA, 21 bp, Homo sapiens
cttattcactgttatttatca

SEQ ID NO: 6924969 - DNA, 22 bp, Homo sapiens
tccagagtgacaaatgactgat

SEQ ID NO: 6924970 - DNA, 22 bp, Homo sapiens
tcactacattttagacagtaaa

SEQ ID NO: 6924971 - DNA, 21 bp, Homo sapiens
atctcttcaaggctgatttac

SEQ ID NO: 6924972 - DNA, 22 bp, Homo sapiens
tttgaagtgctctggtgatctg

SEQ ID NO: 6924973 - DNA, 22 bp, Homo sapiens
attacagtggacagctatgcac

SEQ ID NO: 6924974 - DNA, 22 bp, Homo sapiens
ctctatgttatgcagaattaag

SEQ ID NO: 6924975 - DNA, 22 bp, Homo sapiens
ggcttcatttctgtccttgatt

SEQ ID NO: 6924976 - DNA, 22 bp, Homo sapiens
atacaagtgctgaccctgggat

SEQ ID NO: 6924977 - DNA, 22 bp, Homo sapiens
atggcctcagcatggagcttcg

SEQ ID NO: 6924978 - DNA, 22 bp, Homo sapiens
tttctacacttcgtggtgtttt

SEQ ID NO: 6924979 - DNA, 22 bp, Homo sapiens
tgtagaacctgtttattataga

SEQ ID NO: 6924980 - DNA, 22 bp, Homo sapiens
gtgctttaaagacagttatgct

SEQ ID NO: 6924981 - DNA, 22 bp, Homo sapiens
tgggtagacattcctgaaactc

SEQ ID NO: 6924982 - DNA, 22 bp, Homo sapiens
gacaaggcagaaagcttaaagg

SEQ ID NO: 6924983 - DNA, 22 bp, Homo sapiens
atcattcagcctaagcaagtac

SEQ ID NO: 6924984 - DNA, 22 bp, Homo sapiens
tactgaggctgaattcttagca

SEQ ID NO: 6924985 - DNA, 22 bp, Homo sapiens
ctgtggcctgtgccagaactgg

SEQ ID NO: 6924986 - DNA, 22 bp, Homo sapiens
ctcgagtttccacagtttgcat

SEQ ID NO: 6924987 - DNA, 22 bp, Homo sapiens
ctttgggcaaagggccaattcg

SEQ ID NO: 6924988 - DNA, 22 bp, Homo sapiens
gggcagtgattttccttagagg

SEQ ID NO: 6924989 - DNA, 22 bp, Homo sapiens
aaaatcttgactgtttttagaa

SEQ ID NO: 6924990 - DNA, 22 bp, Homo sapiens
taagaacagtgtctgtctcaca

SEQ ID NO: 6924991 - DNA, 23 bp, Homo sapiens
agctgaggctgtgggtgtcagag

SEQ ID NO: 6924992 - DNA, 22 bp, Homo sapiens
gcaacatgaagaaaacagaacc

SEQ ID NO: 6924993 - DNA, 22 bp, Homo sapiens
aagagtcactccataaatccca

SEQ ID NO: 6924994 - DNA, 22 bp, Homo sapiens
cccagccttccaccctggacta

SEQ ID NO: 6924995 - DNA, 22 bp, Homo sapiens
gctgtgggtccggaccccacgg

SEQ ID NO: 6924996 - DNA, 22 bp, Homo sapiens
caggcaaggactctggtaattt

SEQ ID NO: 6924997 - DNA, 22 bp, Homo sapiens
aagccctgttaggcactgggga

SEQ ID NO: 6924998 - DNA, 22 bp, Homo sapiens
cagggccagcgtctcgggctat

SEQ ID NO: 6924999 - DNA, 18 bp, Homo sapiens
aaagctgttattccagaa

SEQ ID NO: 6925000 - DNA, 22 bp, Homo sapiens
ttaattagagctgatgttcata

SEQ ID NO: 6925001 - DNA, 22 bp, Homo sapiens
tcagagagctggtgggcagagg

SEQ ID NO: 6925002 - DNA, 22 bp, Homo sapiens
gccactgtcctgtgcctgtgct

SEQ ID NO: 6925003 - DNA, 22 bp, Homo sapiens
agtctattttcagaagcagttt

SEQ ID NO: 6925004 - DNA, 22 bp, Homo sapiens
aatttagattgataaacatgga

SEQ ID NO: 6925005 - DNA, 23 bp, Homo sapiens
aaagtgacttttataccactaac

SEQ ID NO: 6925006 - DNA, 22 bp, Homo sapiens
gctccagctctgttctggggaa

SEQ ID NO: 6925007 - DNA, 21 bp, Homo sapiens
gctggctctctgacgtgcttt

SEQ ID NO: 6925008 - DNA, 19 bp, Homo sapiens
ggtgagccctcgcctgcct

SEQ ID NO: 6925009 - DNA, 22 bp, Homo sapiens
gatccgtttatactgagtttga

SEQ ID NO: 6925010 - DNA, 22 bp, Homo sapiens
agctaaggatgactagtacttc

SEQ ID NO: 6925011 - DNA, 22 bp, Homo sapiens
acactggagcttctagcccacg

SEQ ID NO: 6925012 - DNA, 22 bp, Homo sapiens
aaacatttttcttcatcatcct

SEQ ID NO: 6925013 - DNA, 22 bp, Homo sapiens
attggcctattttggaagactt

SEQ ID NO: 6925014 - DNA, 22 bp, Homo sapiens
aagtcttttgttcaggctggca

SEQ ID NO: 6925015 - DNA, 22 bp, Homo sapiens
caggatgagaggcccagggaag

SEQ ID NO: 6925016 - DNA, 22 bp, Homo sapiens
ctgtaggtgattgctatgttat

SEQ ID NO: 6925017 - DNA, 22 bp, Homo sapiens
gtagcacatgattttgatatgt

SEQ ID NO: 6925018 - DNA, 22 bp, Homo sapiens
gtcttctgcctccattagagtt

SEQ ID NO: 6925019 - DNA, 22 bp, Homo sapiens
acacccatgcttctgaggctct

SEQ ID NO: 6925020 - DNA, 22 bp, Homo sapiens
tctctgtgacagctgggtatgt

SEQ ID NO: 6925021 - DNA, 22 bp, Homo sapiens
ccagagcttcggggcggctgta

SEQ ID NO: 6925022 - DNA, 19 bp, Homo sapiens
taccatgttgactttcctg

SEQ ID NO: 6925023 - DNA, 22 bp, Homo sapiens
ctctgggctgccttttagctct

SEQ ID NO: 6925024 - DNA, 22 bp, Homo sapiens
tgtatgaagttactgagcctct

SEQ ID NO: 6925025 - DNA, 22 bp, Homo sapiens
tggcctcaccactagctgggtg

SEQ ID NO: 6925026 - DNA, 22 bp, Homo sapiens
tatctagagtcctgctgagaac

SEQ ID NO: 6925027 - DNA, 22 bp, Homo sapiens
taagtgaaatggtgcatcaaat

SEQ ID NO: 6925028 - DNA, 23 bp, Homo sapiens
ttcttatttactttggaatctcc

SEQ ID NO: 6925029 - DNA, 21 bp, Homo sapiens
gctggctttattctgcgtttg

SEQ ID NO: 6925030 - DNA, 22 bp, Homo sapiens
agtgcttttatatcattaatcc

SEQ ID NO: 6925031 - DNA, 22 bp, Homo sapiens
cagatgaggacagatgactggg

SEQ ID NO: 6925032 - DNA, 22 bp, Homo sapiens
aattatattgtggtgtgaatgt

SEQ ID NO: 6925033 - DNA, 22 bp, Homo sapiens
ggtgtgtgaggagtcacttagt

SEQ ID NO: 6925034 - DNA, 22 bp, Homo sapiens
ctttcttccatagggcccagtc

SEQ ID NO: 6925035 - DNA, 19 bp, Homo sapiens
agcaggccacagggccagc

SEQ ID NO: 6925036 - DNA, 22 bp, Homo sapiens
ctggcctggcaggggacctcta

SEQ ID NO: 6925037 - DNA, 22 bp, Homo sapiens
ttaaaagagacttcctttgttt

SEQ ID NO: 6925038 - DNA, 22 bp, Homo sapiens
gagctgcctgtgtgccatgatg

SEQ ID NO: 6925039 - DNA, 22 bp, Homo sapiens
acgcgcaaccaggcatgcacat

SEQ ID NO: 6925040 - DNA, 22 bp, Homo sapiens
agctgcccagataggaggaggc

SEQ ID NO: 6925041 - DNA, 22 bp, Homo sapiens
cttctcaaagttgtgaatcagg

SEQ ID NO: 6925042 - DNA, 22 bp, Homo sapiens
ctgctgggtccccctgctgatt

SEQ ID NO: 6925043 - DNA, 22 bp, Homo sapiens
agccaaaggcaccagagacact

SEQ ID NO: 6925044 - DNA, 22 bp, Homo sapiens
ttctggaaagcatttgaggccc

SEQ ID NO: 6925045 - DNA, 22 bp, Homo sapiens
tttttatcttgtatgtgtctct

SEQ ID NO: 6925046 - DNA, 22 bp, Homo sapiens
cttcaatttaaatggaagccac

SEQ ID NO: 6925047 - DNA, 22 bp, Homo sapiens
ctagggctagacagacgcatgt

SEQ ID NO: 6925048 - DNA, 22 bp, Homo sapiens
tgggacttgtgtggcagtattt

SEQ ID NO: 6925049 - DNA, 22 bp, Homo sapiens
ggcatttgaaactattcggaga

SEQ ID NO: 6925050 - DNA, 22 bp, Homo sapiens
aagtcacttgattgttgacaga

SEQ ID NO: 6925051 - DNA, 22 bp, Homo sapiens
ggtcactgcaggtttaacagag

SEQ ID NO: 6925052 - DNA, 22 bp, Homo sapiens
atgtctggtggtcgatgctaca

SEQ ID NO: 6925053 - DNA, 22 bp, Homo sapiens
tggccttgaactcatcacgtgg

SEQ ID NO: 6925054 - DNA, 22 bp, Homo sapiens
cagaagttggagctttccatca

SEQ ID NO: 6925055 - DNA, 22 bp, Homo sapiens
tgtcacatatataatgttcaat

SEQ ID NO: 6925056 - DNA, 22 bp, Homo sapiens
taagaacttggcagcaagaaat

SEQ ID NO: 6925057 - DNA, 22 bp, Homo sapiens
gtgtagctttggagtgggaggc

SEQ ID NO: 6925058 - DNA, 22 bp, Homo sapiens
ccttccttttactgtctccgga

SEQ ID NO: 6925059 - DNA, 22 bp, Homo sapiens
agtggcagagtcagggtttgga

SEQ ID NO: 6925060 - DNA, 22 bp, Homo sapiens
ctgaggtcaattaatcaacaac

SEQ ID NO: 6925061 - DNA, 22 bp, Homo sapiens
cagaccatgatggacagctctg

SEQ ID NO: 6925062 - DNA, 22 bp, Homo sapiens
gcggtggatggcccccggagag

SEQ ID NO: 6925063 - DNA, 22 bp, Homo sapiens
tagtcacctgttgtgtgatgcc

SEQ ID NO: 6925064 - DNA, 22 bp, Homo sapiens
tgcagtaggcacgtggctgtga

SEQ ID NO: 6925065 - DNA, 18 bp, Homo sapiens
aggcttcttggctcagtc

SEQ ID NO: 6925066 - DNA, 19 bp, Homo sapiens
ccagagttcttgccattct

SEQ ID NO: 6925067 - DNA, 22 bp, Homo sapiens
agtccagggctctctgtgggat

SEQ ID NO: 6925068 - DNA, 22 bp, Homo sapiens
acccctcagctcttcgtgcccc

SEQ ID NO: 6925069 - DNA, 22 bp, Homo sapiens
cttgaagttgcaaaacattaat

SEQ ID NO: 6925070 - DNA, 22 bp, Homo sapiens
ctctggctctgttgagatttgt

SEQ ID NO: 6925071 - DNA, 22 bp, Homo sapiens
tgtatgaggcatacatcaggca

SEQ ID NO: 6925072 - DNA, 22 bp, Homo sapiens
ggctggccagggccctcgctgg

SEQ ID NO: 6925073 - DNA, 22 bp, Homo sapiens
gcaaagcagaaccctctctatc

SEQ ID NO: 6925074 - DNA, 19 bp, Homo sapiens
ttttggctggagtgatctg

SEQ ID NO: 6925075 - DNA, 23 bp, Homo sapiens
cctggctgacctgaaggtgtagt

SEQ ID NO: 6925076 - DNA, 22 bp, Homo sapiens
attctctgtggtgatgctggtg

SEQ ID NO: 6925077 - DNA, 22 bp, Homo sapiens
ataacctgtttcagacatttgt

SEQ ID NO: 6925078 - DNA, 22 bp, Homo sapiens
atcaagtatccaggtagtgcta

SEQ ID NO: 6925079 - DNA, 22 bp, Homo sapiens
ctgcccccagcctgggcttcga

SEQ ID NO: 6925080 - DNA, 22 bp, Homo sapiens
tgcctggctgggctgctcatgg

SEQ ID NO: 6925081 - DNA, 22 bp, Homo sapiens
taaggacattggttttgagtaa

SEQ ID NO: 6925082 - DNA, 22 bp, Homo sapiens
atgaaagatgatttaaagtact

SEQ ID NO: 6925083 - DNA, 22 bp, Homo sapiens
gtagctgtgtataattgagaat

SEQ ID NO: 6925084 - DNA, 22 bp, Homo sapiens
tgccatcagctgactccaaggt

SEQ ID NO: 6925085 - DNA, 22 bp, Homo sapiens
ccactgcctctccagggccatc

SEQ ID NO: 6925086 - DNA, 22 bp, Homo sapiens
tgaccaggatactgcagggatg

SEQ ID NO: 6925087 - DNA, 22 bp, Homo sapiens
tagcataacaggtaagagtgag

SEQ ID NO: 6925088 - DNA, 21 bp, Homo sapiens
agtgccaaaacggaaggtggc

SEQ ID NO: 6925089 - DNA, 22 bp, Homo sapiens
agcaaaagatagattaacaaga

SEQ ID NO: 6925090 - DNA, 23 bp, Homo sapiens
accatgtttgaaaaggagtaaat

SEQ ID NO: 6925091 - DNA, 22 bp, Homo sapiens
agctggtttaggatggtctcca

SEQ ID NO: 6925092 - DNA, 22 bp, Homo sapiens
aagtggagagccctggaggtct

SEQ ID NO: 6925093 - DNA, 22 bp, Homo sapiens
agagccagttaagcacttacag

SEQ ID NO: 6925094 - DNA, 22 bp, Homo sapiens
agggaatgtgaaaacacctctc

SEQ ID NO: 6925095 - DNA, 22 bp, Homo sapiens
gctggctgggacagattccatt

SEQ ID NO: 6925096 - DNA, 22 bp, Homo sapiens
catcacagaaataaacatacct

SEQ ID NO: 6925097 - DNA, 22 bp, Homo sapiens
cttcctagcttcagagtctgtt

SEQ ID NO: 6925098 - DNA, 22 bp, Homo sapiens
tttgtttggcaacttggtaaag

SEQ ID NO: 6925099 - DNA, 22 bp, Homo sapiens
ttctctggaactgaaacaagat

SEQ ID NO: 6925100 - DNA, 22 bp, Homo sapiens
tgtccactttgtcagtgtcata

SEQ ID NO: 6925101 - DNA, 22 bp, Homo sapiens
ttcttactatgatttgagcctc

SEQ ID NO: 6925102 - DNA, 22 bp, Homo sapiens
atacccagctctttcgttttgg

SEQ ID NO: 6925103 - DNA, 22 bp, Homo sapiens
ttctggctttcttgtcaggatg

SEQ ID NO: 6925104 - DNA, 22 bp, Homo sapiens
tgactgaggtttgatatatacc

SEQ ID NO: 6925105 - DNA, 22 bp, Homo sapiens
tacagtaacatgttgtacaagc

SEQ ID NO: 6925106 - DNA, 22 bp, Homo sapiens
atcagtttggaacattcaggcc

SEQ ID NO: 6925107 - DNA, 22 bp, Homo sapiens
tttcattgtcagagctttgaat

SEQ ID NO: 6925108 - DNA, 22 bp, Homo sapiens
tggcttcagtttcccagtctgg

SEQ ID NO: 6925109 - DNA, 22 bp, Homo sapiens
tctcaacagtgcaagctgctcc

SEQ ID NO: 6925110 - DNA, 22 bp, Homo sapiens
tggggtgaatctttgttgtccg

SEQ ID NO: 6925111 - DNA, 22 bp, Homo sapiens
tgagaggtaggaaatgaacaag

SEQ ID NO: 6925112 - DNA, 20 bp, Homo sapiens
tccttcagacgacaagcaag

SEQ ID NO: 6925113 - DNA, 22 bp, Homo sapiens
taatctaccactattgcaatat

SEQ ID NO: 6925114 - DNA, 22 bp, Homo sapiens
gtattagaagaaattataggta

SEQ ID NO: 6925115 - DNA, 22 bp, Homo sapiens
cagttcagctgtcagcctccca

SEQ ID NO: 6925116 - DNA, 22 bp, Homo sapiens
ccagacctaaccagcttttgta

SEQ ID NO: 6925117 - DNA, 21 bp, Homo sapiens
agaacccagcagcactgttct

SEQ ID NO: 6925118 - DNA, 22 bp, Homo sapiens
agctaaggtgtcctggaggccc

SEQ ID NO: 6925119 - DNA, 22 bp, Homo sapiens
agttttcctctcatttatcaat

SEQ ID NO: 6925120 - DNA, 22 bp, Homo sapiens
atcagttatttttaagctataa

SEQ ID NO: 6925121 - DNA, 22 bp, Homo sapiens
cctggtgaatgttcatggactg

SEQ ID NO: 6925122 - DNA, 20 bp, Homo sapiens
gatggatttcaacacctttc

SEQ ID NO: 6925123 - DNA, 21 bp, Homo sapiens
ttgcattcctgttagtataag

SEQ ID NO: 6925124 - DNA, 22 bp, Homo sapiens
agctccaggcagcattaataaa

SEQ ID NO: 6925125 - DNA, 22 bp, Homo sapiens
tatcagccactggttctatgat

SEQ ID NO: 6925126 - DNA, 22 bp, Homo sapiens
tgctcagagactctccctgagc

SEQ ID NO: 6925127 - DNA, 22 bp, Homo sapiens
gaagagcatatgaagagcatat

SEQ ID NO: 6925128 - DNA, 17 bp, Homo sapiens
aagtccagagttgagca

SEQ ID NO: 6925129 - DNA, 20 bp, Homo sapiens
gaaacattggcagcaactga

SEQ ID NO: 6925130 - DNA, 22 bp, Homo sapiens
gcagaagctgggcagcgaggtg

SEQ ID NO: 6925131 - DNA, 22 bp, Homo sapiens
gagccctcgggcgagcccgcgc

SEQ ID NO: 6925132 - DNA, 22 bp, Homo sapiens
gatgtacatggattcctttcct

SEQ ID NO: 6925133 - DNA, 19 bp, Homo sapiens
gtaacagtggacattttag

SEQ ID NO: 6925134 - DNA, 21 bp, Homo sapiens
ataagcatgctgattacattt

SEQ ID NO: 6925135 - DNA, 22 bp, Homo sapiens
tccacaggtatgaggccccacc

SEQ ID NO: 6925136 - DNA, 22 bp, Homo sapiens
ggctgtccacctaccatgccgg

SEQ ID NO: 6925137 - DNA, 22 bp, Homo sapiens
acaggcctgagattttgcattt

SEQ ID NO: 6925138 - DNA, 22 bp, Homo sapiens
cacattgggatgaagtctaaaa

SEQ ID NO: 6925139 - DNA, 16 bp, Homo sapiens
gcttccagtttagtgg

SEQ ID NO: 6925140 - DNA, 22 bp, Homo sapiens
agggggaggctgtgctgcgtct

SEQ ID NO: 6925141 - DNA, 19 bp, Homo sapiens
ggctgtctacgaaccagtc

SEQ ID NO: 6925142 - DNA, 21 bp, Homo sapiens
aatagctgaggtcacccagcc

SEQ ID NO: 6925143 - DNA, 22 bp, Homo sapiens
caccagggcagcagcctagtct

SEQ ID NO: 6925144 - DNA, 22 bp, Homo sapiens
aagaccataatgtaagatgaat

SEQ ID NO: 6925145 - DNA, 23 bp, Homo sapiens
taagtgattccaagtttcaggga

SEQ ID NO: 6925146 - DNA, 22 bp, Homo sapiens
tcagatgttcacacttttagct

SEQ ID NO: 6925147 - DNA, 22 bp, Homo sapiens
cactgccctcactgtggttctc

SEQ ID NO: 6925148 - DNA, 22 bp, Homo sapiens
aggacctgactggctcctgctt

SEQ ID NO: 6925149 - DNA, 22 bp, Homo sapiens
tgacccttcccctctgggttct

SEQ ID NO: 6925150 - DNA, 22 bp, Homo sapiens
tgtggaaaaaccacaagtttgg

SEQ ID NO: 6925151 - DNA, 22 bp, Homo sapiens
caaattgtgtttgcttttctct

SEQ ID NO: 6925152 - DNA, 22 bp, Homo sapiens
ggcagggtccacacctgggaaa

SEQ ID NO: 6925153 - DNA, 22 bp, Homo sapiens
tatattccttttggcagggact

SEQ ID NO: 6925154 - DNA, 22 bp, Homo sapiens
ttccttcccctagctgagaaac

SEQ ID NO: 6925155 - DNA, 22 bp, Homo sapiens
tggaaggctttgctgtccttgc

SEQ ID NO: 6925156 - DNA, 22 bp, Homo sapiens
gctggagttaggtgggcttgaa

SEQ ID NO: 6925157 - DNA, 22 bp, Homo sapiens
ggccagggccaaggctttccca

SEQ ID NO: 6925158 - DNA, 22 bp, Homo sapiens
tgcaaggggtttatgcagatga

SEQ ID NO: 6925159 - DNA, 22 bp, Homo sapiens
ttcacctgtcactgcacaactg

SEQ ID NO: 6925160 - DNA, 22 bp, Homo sapiens
ctgagggagaagtcacgggcag

SEQ ID NO: 6925161 - DNA, 22 bp, Homo sapiens
agctggtgtgccagttccagtt

SEQ ID NO: 6925162 - DNA, 22 bp, Homo sapiens
agaagcagactctgaggcaagg

SEQ ID NO: 6925163 - DNA, 22 bp, Homo sapiens
gggcctcacctctccaccgcct

SEQ ID NO: 6925164 - DNA, 22 bp, Homo sapiens
ggctgctgagttggccaggaga

SEQ ID NO: 6925165 - DNA, 22 bp, Homo sapiens
aagcttaggtacagaagttaag

SEQ ID NO: 6925166 - DNA, 22 bp, Homo sapiens
cctgtctgcaaggggtggatcc

SEQ ID NO: 6925167 - DNA, 22 bp, Homo sapiens
acattgttagtagaccagtggc

SEQ ID NO: 6925168 - DNA, 22 bp, Homo sapiens
taaggcaagtttttagtggaca

SEQ ID NO: 6925169 - DNA, 17 bp, Homo sapiens
tgagacagggcaggccc

SEQ ID NO: 6925170 - DNA, 22 bp, Homo sapiens
cctggcagctccgtggccttcc

SEQ ID NO: 6925171 - DNA, 18 bp, Homo sapiens
gctgaatgtctgctttgc

SEQ ID NO: 6925172 - DNA, 22 bp, Homo sapiens
gaccacaggtatgggcttggca

SEQ ID NO: 6925173 - DNA, 22 bp, Homo sapiens
agggatgctaataaatcaaaga

SEQ ID NO: 6925174 - DNA, 22 bp, Homo sapiens
tctctagtattaaatatagtgt

SEQ ID NO: 6925175 - DNA, 22 bp, Homo sapiens
gggctgcctgagcatctcctcc

SEQ ID NO: 6925176 - DNA, 21 bp, Homo sapiens
aatctttctaaccctggtggc

SEQ ID NO: 6925177 - DNA, 22 bp, Homo sapiens
taactgaaaatccctcttctcc

SEQ ID NO: 6925178 - DNA, 20 bp, Homo sapiens
agcctgccagctggcccaga

SEQ ID NO: 6925179 - DNA, 22 bp, Homo sapiens
atagaactcgggctttggaatc

SEQ ID NO: 6925180 - DNA, 22 bp, Homo sapiens
taagagaatgttgtggctaggt

SEQ ID NO: 6925181 - DNA, 22 bp, Homo sapiens
agctgtggccagatgtgagcgg

SEQ ID NO: 6925182 - DNA, 22 bp, Homo sapiens
cacctttaatgagcaccagccg

SEQ ID NO: 6925183 - DNA, 22 bp, Homo sapiens
atgatacatcttgtttatttca

SEQ ID NO: 6925184 - DNA, 22 bp, Homo sapiens
atgatttgttaacagacttaat

SEQ ID NO: 6925185 - DNA, 22 bp, Homo sapiens
gtttcctttgccagtaaatggg

SEQ ID NO: 6925186 - DNA, 22 bp, Homo sapiens
tgtctggattgctgagccccag

SEQ ID NO: 6925187 - DNA, 22 bp, Homo sapiens
gcaggctaactcataggctgtg

SEQ ID NO: 6925188 - DNA, 22 bp, Homo sapiens
ttggttgtgatgtcattgttac

SEQ ID NO: 6925189 - DNA, 22 bp, Homo sapiens
aagatgtgtccattctttgctc

SEQ ID NO: 6925190 - DNA, 22 bp, Homo sapiens
cccaggactaatgagctctacg

SEQ ID NO: 6925191 - DNA, 20 bp, Homo sapiens
ggcagagctatgtctgttgc

SEQ ID NO: 6925192 - DNA, 22 bp, Homo sapiens
ggcaggaataaattatggactt

SEQ ID NO: 6925193 - DNA, 21 bp, Homo sapiens
tctctgagcccaccaggatct

SEQ ID NO: 6925194 - DNA, 22 bp, Homo sapiens
gctgctctgggtctgcccagct

SEQ ID NO: 6925195 - DNA, 22 bp, Homo sapiens
ttggccctgaggttatcatcta

SEQ ID NO: 6925196 - DNA, 22 bp, Homo sapiens
ctgatcccattggcagtccagt

SEQ ID NO: 6925197 - DNA, 22 bp, Homo sapiens
tcacagtgcacagcaggcgtgg

SEQ ID NO: 6925198 - DNA, 22 bp, Homo sapiens
gagcgcacagaaggaagcagcc

SEQ ID NO: 6925199 - DNA, 16 bp, Homo sapiens
ttagccatggcattct

SEQ ID NO: 6925200 - DNA, 22 bp, Homo sapiens
atagacagatgatagataaatc

SEQ ID NO: 6925201 - DNA, 22 bp, Homo sapiens
ttgcctaggctggagtgcagtg

SEQ ID NO: 6925202 - DNA, 19 bp, Homo sapiens
tgatggctggaactatact

SEQ ID NO: 6925203 - DNA, 22 bp, Homo sapiens
gtccttggccttcttgtaggca

SEQ ID NO: 6925204 - DNA, 22 bp, Homo sapiens
gctgtcactctccggccttccc

SEQ ID NO: 6925205 - DNA, 22 bp, Homo sapiens
ttttctgagctcagtgacttac

SEQ ID NO: 6925206 - DNA, 22 bp, Homo sapiens
aggctgtatgtttccatttgaa

SEQ ID NO: 6925207 - DNA, 22 bp, Homo sapiens
cacatccttcatactcagctct

SEQ ID NO: 6925208 - DNA, 20 bp, Homo sapiens
acaggttcattctgtgtgac

SEQ ID NO: 6925209 - DNA, 22 bp, Homo sapiens
aaatacacgtacatgtgtaaaa

SEQ ID NO: 6925210 - DNA, 22 bp, Homo sapiens
ctgcctattccctgggccgaga

SEQ ID NO: 6925211 - DNA, 22 bp, Homo sapiens
tatcatcagttcaggtattgat

SEQ ID NO: 6925212 - DNA, 22 bp, Homo sapiens
agatgcagtggttaacaataca

SEQ ID NO: 6925213 - DNA, 22 bp, Homo sapiens
gaatagttctatggctgcaggg

SEQ ID NO: 6925214 - DNA, 22 bp, Homo sapiens
ggcatgctgtaggcattcagta

SEQ ID NO: 6925215 - DNA, 22 bp, Homo sapiens
actgtgttttcctgctgaggca

SEQ ID NO: 6925216 - DNA, 20 bp, Homo sapiens
gaggctgcggactgctggac

SEQ ID NO: 6925217 - DNA, 22 bp, Homo sapiens
tgttttaagagcgcactttata

SEQ ID NO: 6925218 - DNA, 22 bp, Homo sapiens
ttagagctagatgaggtcatga

SEQ ID NO: 6925219 - DNA, 22 bp, Homo sapiens
tagcaagaagtagctctggatt

SEQ ID NO: 6925220 - DNA, 22 bp, Homo sapiens
ctcagggcggcgggcagcccag

SEQ ID NO: 6925221 - DNA, 21 bp, Homo sapiens
gtcttggcaccaggagagaga

SEQ ID NO: 6925222 - DNA, 22 bp, Homo sapiens
gagaatgatgatttccaatttc

SEQ ID NO: 6925223 - DNA, 22 bp, Homo sapiens
tgctaaataacttacatagtgg

SEQ ID NO: 6925224 - DNA, 22 bp, Homo sapiens
tcagtgaagtaatggtgagaga

SEQ ID NO: 6925225 - DNA, 22 bp, Homo sapiens
tcaatagattaggtattagatt

SEQ ID NO: 6925226 - DNA, 22 bp, Homo sapiens
ttacagaaaaggggttgtcctt

SEQ ID NO: 6925227 - DNA, 22 bp, Homo sapiens
ttgtacattctgaatctgtcct

SEQ ID NO: 6925228 - DNA, 22 bp, Homo sapiens
taagtccagtgttctctctgtg

SEQ ID NO: 6925229 - DNA, 22 bp, Homo sapiens
atagtggtgagctgcatttatg

SEQ ID NO: 6925230 - DNA, 20 bp, Homo sapiens
ctggggacagcaatggctgt

SEQ ID NO: 6925231 - DNA, 22 bp, Homo sapiens
acactgcagatgtaatttgagt

SEQ ID NO: 6925232 - DNA, 22 bp, Homo sapiens
atatcacaggaaaggaagatac

SEQ ID NO: 6925233 - DNA, 22 bp, Homo sapiens
ctggataagagttttacttcct

SEQ ID NO: 6925234 - DNA, 20 bp, Homo sapiens
tgctctggaaatggtctgag

SEQ ID NO: 6925235 - DNA, 22 bp, Homo sapiens
ctgcctgtattgtctgcttggg

SEQ ID NO: 6925236 - DNA, 22 bp, Homo sapiens
tacaggctcttgtcagacgtat

SEQ ID NO: 6925237 - DNA, 22 bp, Homo sapiens
acctggaggcagaggttgcagt

SEQ ID NO: 6925238 - DNA, 22 bp, Homo sapiens
ctgcaaatcctcagaaagggtt

SEQ ID NO: 6925239 - DNA, 22 bp, Homo sapiens
acaggcaggcgggacagcccga

SEQ ID NO: 6925240 - DNA, 22 bp, Homo sapiens
tatgtggccttttatgtctgac

SEQ ID NO: 6925241 - DNA, 22 bp, Homo sapiens
tagagacaccagtaccattctg

SEQ ID NO: 6925242 - DNA, 22 bp, Homo sapiens
aaccagaggcagcagtacctga

SEQ ID NO: 6925243 - DNA, 22 bp, Homo sapiens
atcagtatacaggggacattca

SEQ ID NO: 6925244 - DNA, 21 bp, Homo sapiens
tttctgaaggcaacatctatc

SEQ ID NO: 6925245 - DNA, 21 bp, Homo sapiens
ttaagtgtttctccattgtta

SEQ ID NO: 6925246 - DNA, 22 bp, Homo sapiens
aagagcatatggttctcaaagc

SEQ ID NO: 6925247 - DNA, 21 bp, Homo sapiens
ttcctggggacttccgtggga

SEQ ID NO: 6925248 - DNA, 22 bp, Homo sapiens
atgctgggacgtacttgttcat

SEQ ID NO: 6925249 - DNA, 22 bp, Homo sapiens
gccctgagctagtgtgggcagg

SEQ ID NO: 6925250 - DNA, 22 bp, Homo sapiens
ctggcatgtgtttggctcctgt

SEQ ID NO: 6925251 - DNA, 22 bp, Homo sapiens
agtccaggcctcctcttttcct

SEQ ID NO: 6925252 - DNA, 22 bp, Homo sapiens
ttcctggctgaactgaactcct

SEQ ID NO: 6925253 - DNA, 22 bp, Homo sapiens
tgcccaaacctctcctagctct

SEQ ID NO: 6925254 - DNA, 20 bp, Homo sapiens
ctcagtgtattctgggtgct

SEQ ID NO: 6925255 - DNA, 22 bp, Homo sapiens
gtgaagcacgctgccgcactgg

SEQ ID NO: 6925256 - DNA, 22 bp, Homo sapiens
tgtatacatacatatgtgtgtg

SEQ ID NO: 6925257 - DNA, 22 bp, Homo sapiens
tacatgctcagtaactttcagt

SEQ ID NO: 6925258 - DNA, 22 bp, Homo sapiens
aataacttcatcttcaggatag

SEQ ID NO: 6925259 - DNA, 22 bp, Homo sapiens
aacttccaacccagaagcctaa

SEQ ID NO: 6925260 - DNA, 22 bp, Homo sapiens
agctttttcactttggatggga

SEQ ID NO: 6925261 - DNA, 22 bp, Homo sapiens
tagccactacctataccataag

SEQ ID NO: 6925262 - DNA, 22 bp, Homo sapiens
taactggtcctgaacagcccag

SEQ ID NO: 6925263 - DNA, 22 bp, Homo sapiens
agaaactctaggtcaattgagg

SEQ ID NO: 6925264 - DNA, 22 bp, Homo sapiens
tgaggatggaatgctgtgcaag

SEQ ID NO: 6925265 - DNA, 22 bp, Homo sapiens
gtaaagctccttggccagtgcc

SEQ ID NO: 6925266 - DNA, 22 bp, Homo sapiens
ctgccatctgagggtccagcct

SEQ ID NO: 6925267 - DNA, 22 bp, Homo sapiens
aagatctagtggatggtgagtg

SEQ ID NO: 6925268 - DNA, 22 bp, Homo sapiens
gctgtctgctgggtcgctcagg

SEQ ID NO: 6925269 - DNA, 22 bp, Homo sapiens
cctgatggagccctgctgcatg

SEQ ID NO: 6925270 - DNA, 22 bp, Homo sapiens
gctgctggagctttgcagaagg

SEQ ID NO: 6925271 - DNA, 21 bp, Homo sapiens
tggaaatgagcgttcagcttt

SEQ ID NO: 6925272 - DNA, 22 bp, Homo sapiens
taaattgcataagtacaaatga

SEQ ID NO: 6925273 - DNA, 22 bp, Homo sapiens
cagagcccctcgtctccaccac

SEQ ID NO: 6925274 - DNA, 22 bp, Homo sapiens
gataacattttgaagtgctagt

SEQ ID NO: 6925275 - DNA, 22 bp, Homo sapiens
agactacattatgacagcattt

SEQ ID NO: 6925276 - DNA, 20 bp, Homo sapiens
atagacaaagacatgccaga

SEQ ID NO: 6925277 - DNA, 22 bp, Homo sapiens
ttacaactggtgaattttatgg

SEQ ID NO: 6925278 - DNA, 22 bp, Homo sapiens
aagagcatcggtggagccccca

SEQ ID NO: 6925279 - DNA, 22 bp, Homo sapiens
cctttggcattttgaggatgcg

SEQ ID NO: 6925280 - DNA, 19 bp, Homo sapiens
gctcagacattaagcagct

SEQ ID NO: 6925281 - DNA, 22 bp, Homo sapiens
agagtgttatttgctctgtatt

SEQ ID NO: 6925282 - DNA, 22 bp, Homo sapiens
tttgaactgataatcttctgtt

SEQ ID NO: 6925283 - DNA, 22 bp, Homo sapiens
tcttggagaagggattgtgctc

SEQ ID NO: 6925284 - DNA, 22 bp, Homo sapiens
aattactgatgcctgtgttcca

SEQ ID NO: 6925285 - DNA, 21 bp, Homo sapiens
caaaggactgtagctcactga

SEQ ID NO: 6925286 - DNA, 22 bp, Homo sapiens
catatcatggcactgagggaat

SEQ ID NO: 6925287 - DNA, 22 bp, Homo sapiens
gggccctggctttcctgttctt

SEQ ID NO: 6925288 - DNA, 21 bp, Homo sapiens
gactggagagaggaagtctgg

SEQ ID NO: 6925289 - DNA, 22 bp, Homo sapiens
ggctgcaggcagaggctgtctg

SEQ ID NO: 6925290 - DNA, 22 bp, Homo sapiens
gccaagaaggtggggacatgca

SEQ ID NO: 6925291 - DNA, 22 bp, Homo sapiens
attaggttagtgtgcaagagaa

SEQ ID NO: 6925292 - DNA, 22 bp, Homo sapiens
catgggagctatctccatcact

SEQ ID NO: 6925293 - DNA, 22 bp, Homo sapiens
caaggcagcccgctgaaccaca

SEQ ID NO: 6925294 - DNA, 22 bp, Homo sapiens
gcccttaggtactacttattct

SEQ ID NO: 6925295 - DNA, 22 bp, Homo sapiens
tctgagccacagatgtcctgtt

SEQ ID NO: 6925296 - DNA, 22 bp, Homo sapiens
attagcctgctctttagtgaaa

SEQ ID NO: 6925297 - DNA, 22 bp, Homo sapiens
gcttctctggctggtctgccac

SEQ ID NO: 6925298 - DNA, 22 bp, Homo sapiens
gctcagaggcacgacctcttgg

SEQ ID NO: 6925299 - DNA, 22 bp, Homo sapiens
gaaacccttcctagagggcaag

SEQ ID NO: 6925300 - DNA, 22 bp, Homo sapiens
catagcggtattccacgtggtt

SEQ ID NO: 6925301 - DNA, 22 bp, Homo sapiens
agagatatgagtagttgtgaca

SEQ ID NO: 6925302 - DNA, 22 bp, Homo sapiens
gctgtcactcaccaggcctgca

SEQ ID NO: 6925303 - DNA, 22 bp, Homo sapiens
ttccaagtccagccaggccaaa

SEQ ID NO: 6925304 - DNA, 22 bp, Homo sapiens
acagatgaattttaattgtgtt

SEQ ID NO: 6925305 - DNA, 22 bp, Homo sapiens
gcctggtggacactgggcatca

SEQ ID NO: 6925306 - DNA, 22 bp, Homo sapiens
gcctggagacctgctcctctac

SEQ ID NO: 6925307 - DNA, 22 bp, Homo sapiens
aaacaacaatccaatgggagct

SEQ ID NO: 6925308 - DNA, 22 bp, Homo sapiens
gtccagaggtccaggatcaagg

SEQ ID NO: 6925309 - DNA, 22 bp, Homo sapiens
aggcggctccgggagtgtgggc

SEQ ID NO: 6925310 - DNA, 22 bp, Homo sapiens
atgtacatctttataacaagct

SEQ ID NO: 6925311 - DNA, 22 bp, Homo sapiens
tctctgtggtatgtcatagcaa

SEQ ID NO: 6925312 - DNA, 22 bp, Homo sapiens
ggcatgagcacgaagtggtacc

SEQ ID NO: 6925313 - DNA, 22 bp, Homo sapiens
gtgacatttcgtgacgtgagaa

SEQ ID NO: 6925314 - DNA, 22 bp, Homo sapiens
gtgtggcaaggtgagaagtggg

SEQ ID NO: 6925315 - DNA, 22 bp, Homo sapiens
tcagagaatgtccttcttcatt

SEQ ID NO: 6925316 - DNA, 22 bp, Homo sapiens
tgcattcaatgtgccagggaaa

SEQ ID NO: 6925317 - DNA, 22 bp, Homo sapiens
gtttatgcacttggtttgtgtc

SEQ ID NO: 6925318 - DNA, 21 bp, Homo sapiens
ttctttccccagaggactaaa

SEQ ID NO: 6925319 - DNA, 22 bp, Homo sapiens
ctgcctctccccagagtggccc

SEQ ID NO: 6925320 - DNA, 22 bp, Homo sapiens
cactgaatctcaaggggagggt

SEQ ID NO: 6925321 - DNA, 22 bp, Homo sapiens
tgaaatcaactaggagacacca

SEQ ID NO: 6925322 - DNA, 22 bp, Homo sapiens
taactttcttcatatgtgaacc

SEQ ID NO: 6925323 - DNA, 22 bp, Homo sapiens
ctggctcaatttgtactgctgt

SEQ ID NO: 6925324 - DNA, 16 bp, Homo sapiens
acagcttgaagctagg

SEQ ID NO: 6925325 - DNA, 22 bp, Homo sapiens
gaaggagagagacatcgtccct

SEQ ID NO: 6925326 - DNA, 22 bp, Homo sapiens
tcctggtgcctggagctctcca

SEQ ID NO: 6925327 - DNA, 22 bp, Homo sapiens
tggtgtcatataaggggctctg

SEQ ID NO: 6925328 - DNA, 22 bp, Homo sapiens
agacctgttgggttcattggct

SEQ ID NO: 6925329 - DNA, 22 bp, Homo sapiens
tcacagagagaatattgtgttt

SEQ ID NO: 6925330 - DNA, 22 bp, Homo sapiens
ggcacagacttttgcttgcgtt

SEQ ID NO: 6925331 - DNA, 22 bp, Homo sapiens
ttcaagtaatgctactcctatg

SEQ ID NO: 6925332 - DNA, 20 bp, Homo sapiens
atccaggatgttgatttgaa

SEQ ID NO: 6925333 - DNA, 22 bp, Homo sapiens
atgttcttgttcaaatgtcagt

SEQ ID NO: 6925334 - DNA, 22 bp, Homo sapiens
caaagctcatgctcttagccat

SEQ ID NO: 6925335 - DNA, 22 bp, Homo sapiens
tgagtgcctaccaagtgctgga

SEQ ID NO: 6925336 - DNA, 22 bp, Homo sapiens
actcatgttttctctagctgga

SEQ ID NO: 6925337 - DNA, 22 bp, Homo sapiens
tgtatatacatacacacatgaa

SEQ ID NO: 6925338 - DNA, 22 bp, Homo sapiens
tgaggtcctagagagtgtgtgg

SEQ ID NO: 6925339 - DNA, 21 bp, Homo sapiens
tgaggctgttgtaccagggag

SEQ ID NO: 6925340 - DNA, 22 bp, Homo sapiens
tcatcatccttttttgaagagt

SEQ ID NO: 6925341 - DNA, 22 bp, Homo sapiens
tcagcaggcacaccaaaaactg

SEQ ID NO: 6925342 - DNA, 22 bp, Homo sapiens
acacccagagcgccagtgccga

SEQ ID NO: 6925343 - DNA, 22 bp, Homo sapiens
tcaaaaagttgaagagttgggg

SEQ ID NO: 6925344 - DNA, 22 bp, Homo sapiens
atgttatgtaacacttgtttct

SEQ ID NO: 6925345 - DNA, 22 bp, Homo sapiens
gaggctggggtctgcctttctg

SEQ ID NO: 6925346 - DNA, 22 bp, Homo sapiens
ccccctctgccggggtccttca

SEQ ID NO: 6925347 - DNA, 22 bp, Homo sapiens
ctggtcacatctctactaccca

SEQ ID NO: 6925348 - DNA, 22 bp, Homo sapiens
aattgcttttgggggcagttac

SEQ ID NO: 6925349 - DNA, 22 bp, Homo sapiens
atgtacaattctccttggtagg

SEQ ID NO: 6925350 - DNA, 22 bp, Homo sapiens
cccagagaatctttcagaaagg

SEQ ID NO: 6925351 - DNA, 22 bp, Homo sapiens
catccaataccagtttgcaggc

SEQ ID NO: 6925352 - DNA, 22 bp, Homo sapiens
aagttaccttcttcccagtgat

SEQ ID NO: 6925353 - DNA, 22 bp, Homo sapiens
actcccaggttgcctggcaggc

SEQ ID NO: 6925354 - DNA, 22 bp, Homo sapiens
tctggcccagcccctgatccca

SEQ ID NO: 6925355 - DNA, 22 bp, Homo sapiens
tttgcagtgtcagcttctgtgt

SEQ ID NO: 6925356 - DNA, 22 bp, Homo sapiens
taaaccttggtagcatcttgct

SEQ ID NO: 6925357 - DNA, 20 bp, Homo sapiens
tttgaatgtaaagcatgtca

SEQ ID NO: 6925358 - DNA, 22 bp, Homo sapiens
ccaggagagctctcgttcagtg

SEQ ID NO: 6925359 - DNA, 22 bp, Homo sapiens
ttaaggctgttggtatttcaga

SEQ ID NO: 6925360 - DNA, 22 bp, Homo sapiens
atggctgggtcaccatcagggt

SEQ ID NO: 6925361 - DNA, 22 bp, Homo sapiens
agctgcctgctgcactcggtgc

SEQ ID NO: 6925362 - DNA, 22 bp, Homo sapiens
ggcttgaactcccaatcattta

SEQ ID NO: 6925363 - DNA, 22 bp, Homo sapiens
acacagggtctagagttaggcc

SEQ ID NO: 6925364 - DNA, 22 bp, Homo sapiens
tgtcatttcctgaatgctgagt

SEQ ID NO: 6925365 - DNA, 20 bp, Homo sapiens
caggtcttcatgtggctgtc

SEQ ID NO: 6925366 - DNA, 22 bp, Homo sapiens
tgaatagtccttggaataactg

SEQ ID NO: 6925367 - DNA, 22 bp, Homo sapiens
acaggaactgttatctcagatg

SEQ ID NO: 6925368 - DNA, 22 bp, Homo sapiens
aacatcttcagagaagctaagt

SEQ ID NO: 6925369 - DNA, 22 bp, Homo sapiens
gccaggccctgggcacttcgtg

SEQ ID NO: 6925370 - DNA, 22 bp, Homo sapiens
tagaggattttgcatttcatat

SEQ ID NO: 6925371 - DNA, 22 bp, Homo sapiens
tcagagtctgtgcattctgcta

SEQ ID NO: 6925372 - DNA, 23 bp, Homo sapiens
acagacaacactgatgagagaaa

SEQ ID NO: 6925373 - DNA, 22 bp, Homo sapiens
ccctcccttccaagttgaggac

SEQ ID NO: 6925374 - DNA, 22 bp, Homo sapiens
aaagtgatgaactctgtgacct

SEQ ID NO: 6925375 - DNA, 19 bp, Homo sapiens
actctgagcttgctctatc

SEQ ID NO: 6925376 - DNA, 19 bp, Homo sapiens
cctcttctctggcagcaga

SEQ ID NO: 6925377 - DNA, 22 bp, Homo sapiens
agccttcccttagagaatgagc

SEQ ID NO: 6925378 - DNA, 22 bp, Homo sapiens
catgtgtcttgctgccctccat

SEQ ID NO: 6925379 - DNA, 22 bp, Homo sapiens
atcatctggcattcagattggc

SEQ ID NO: 6925380 - DNA, 22 bp, Homo sapiens
ggcagggtgcctggctcctgtt

SEQ ID NO: 6925381 - DNA, 22 bp, Homo sapiens
gtgctgttttgagtgctacccc

SEQ ID NO: 6925382 - DNA, 22 bp, Homo sapiens
acaggcctacgaagtcaggtgc

SEQ ID NO: 6925383 - DNA, 22 bp, Homo sapiens
atcagcttggaccaataagatg

SEQ ID NO: 6925384 - DNA, 22 bp, Homo sapiens
catccttctcaaagagtgcatg

SEQ ID NO: 6925385 - DNA, 17 bp, Homo sapiens
tgcataaagggtgagca

SEQ ID NO: 6925386 - DNA, 22 bp, Homo sapiens
ggataagaaaattgtaataact

SEQ ID NO: 6925387 - DNA, 22 bp, Homo sapiens
aaatatcctcagggcagaggtg

SEQ ID NO: 6925388 - DNA, 22 bp, Homo sapiens
cataatcccaggcttgcattca

SEQ ID NO: 6925389 - DNA, 22 bp, Homo sapiens
ccggcgtctcttccacttccta

SEQ ID NO: 6925390 - DNA, 22 bp, Homo sapiens
atgtttcaggaaatcagctaga

SEQ ID NO: 6925391 - DNA, 22 bp, Homo sapiens
ttctgcacccatagctgatgat

SEQ ID NO: 6925392 - DNA, 23 bp, Homo sapiens
caggaaatgcttggaggggctgg

SEQ ID NO: 6925393 - DNA, 22 bp, Homo sapiens
tggcactatggatgagactgat

SEQ ID NO: 6925394 - DNA, 22 bp, Homo sapiens
tggcttcttgggatgggtcatt

SEQ ID NO: 6925395 - DNA, 22 bp, Homo sapiens
aatatccacactgtgtccctgc

SEQ ID NO: 6925396 - DNA, 22 bp, Homo sapiens
actctgtgttttggtggcagca

SEQ ID NO: 6925397 - DNA, 22 bp, Homo sapiens
acctgccaagcatcagtggcag

SEQ ID NO: 6925398 - DNA, 22 bp, Homo sapiens
gacccagaggcctgacagtgtg

SEQ ID NO: 6925399 - DNA, 22 bp, Homo sapiens
tcccagccggtgcctgggtccc

SEQ ID NO: 6925400 - DNA, 22 bp, Homo sapiens
tgcaggaaaacacctatcaccc

SEQ ID NO: 6925401 - DNA, 22 bp, Homo sapiens
ccaagtgatacacccgcctcgg

SEQ ID NO: 6925402 - DNA, 22 bp, Homo sapiens
tcacagctattctcatgtattt

SEQ ID NO: 6925403 - DNA, 22 bp, Homo sapiens
ctcaggactttcaaatagaaat

SEQ ID NO: 6925404 - DNA, 22 bp, Homo sapiens
tcatttgtgtgagtgatttgac

SEQ ID NO: 6925405 - DNA, 22 bp, Homo sapiens
ttaattcagtcaaagaaaccat

SEQ ID NO: 6925406 - DNA, 22 bp, Homo sapiens
tacaacaggaatttcaactttg

SEQ ID NO: 6925407 - DNA, 22 bp, Homo sapiens
cacatgtgcagttacatgaatt

SEQ ID NO: 6925408 - DNA, 20 bp, Homo sapiens
tcctttactgttggggttgg

SEQ ID NO: 6925409 - DNA, 22 bp, Homo sapiens
ttggagagtgatattcagatgc

SEQ ID NO: 6925410 - DNA, 21 bp, Homo sapiens
tccctcagacagggtgcctat

SEQ ID NO: 6925411 - DNA, 22 bp, Homo sapiens
atggacagaaggtagcacctat

SEQ ID NO: 6925412 - DNA, 22 bp, Homo sapiens
ctgcctgctgattagtattgtc

SEQ ID NO: 6925413 - DNA, 22 bp, Homo sapiens
tactgcattatcaaggggaagg

SEQ ID NO: 6925414 - DNA, 22 bp, Homo sapiens
tatattacctgcctgatctata

SEQ ID NO: 6925415 - DNA, 22 bp, Homo sapiens
gctcagagggttttggccaagt

SEQ ID NO: 6925416 - DNA, 20 bp, Homo sapiens
atctgctgagaatgaaaggc

SEQ ID NO: 6925417 - DNA, 22 bp, Homo sapiens
agccaatctacaacaaaggata

SEQ ID NO: 6925418 - DNA, 22 bp, Homo sapiens
ctggcagacttaccatcagaca

SEQ ID NO: 6925419 - DNA, 22 bp, Homo sapiens
tcagttacttgcttgtttgaaa

SEQ ID NO: 6925420 - DNA, 22 bp, Homo sapiens
cattaaacaaccttgaatcaat

SEQ ID NO: 6925421 - DNA, 22 bp, Homo sapiens
gctctgagagctacacagggta

SEQ ID NO: 6925422 - DNA, 22 bp, Homo sapiens
gaaaggctatgagtttggtata

SEQ ID NO: 6925423 - DNA, 21 bp, Homo sapiens
ccagcctcagatcagggagct

SEQ ID NO: 6925424 - DNA, 22 bp, Homo sapiens
attctgggactccttcctcccc

SEQ ID NO: 6925425 - DNA, 21 bp, Homo sapiens
aaatccaaacactagtccaca

SEQ ID NO: 6925426 - DNA, 23 bp, Homo sapiens
tcacactatgaagtgtgttatcc

SEQ ID NO: 6925427 - DNA, 22 bp, Homo sapiens
atggcagcatagtggcaagtta

SEQ ID NO: 6925428 - DNA, 22 bp, Homo sapiens
tgtcttggctctggagggggat

SEQ ID NO: 6925429 - DNA, 22 bp, Homo sapiens
cctggcagcctcagccaattct

SEQ ID NO: 6925430 - DNA, 22 bp, Homo sapiens
aggaatttgctggaacacagat

SEQ ID NO: 6925431 - DNA, 18 bp, Homo sapiens
gcctgtgttcagcctttc

SEQ ID NO: 6925432 - DNA, 23 bp, Homo sapiens
agctggaggctgtctactcccaa

SEQ ID NO: 6925433 - DNA, 22 bp, Homo sapiens
actgaaacactgagtgaattgt

SEQ ID NO: 6925434 - DNA, 22 bp, Homo sapiens
gtggcagaaatattcttgctct

SEQ ID NO: 6925435 - DNA, 22 bp, Homo sapiens
caggtctggcatcagctgtgtg

SEQ ID NO: 6925436 - DNA, 22 bp, Homo sapiens
cagaggctgctctgggtggcat

SEQ ID NO: 6925437 - DNA, 23 bp, Homo sapiens
atctaatttctccaaatctctac

SEQ ID NO: 6925438 - DNA, 22 bp, Homo sapiens
ctccccccacagtgttcttgcc

SEQ ID NO: 6925439 - DNA, 22 bp, Homo sapiens
ttcagcaactcaaacctattag

SEQ ID NO: 6925440 - DNA, 22 bp, Homo sapiens
tcccagagaagagctggatgga

SEQ ID NO: 6925441 - DNA, 22 bp, Homo sapiens
atctcttgccagtcagaatggt

SEQ ID NO: 6925442 - DNA, 22 bp, Homo sapiens
tgctgcaggcaatagaaaacct

SEQ ID NO: 6925443 - DNA, 22 bp, Homo sapiens
ttaactctccctccttacatcc

SEQ ID NO: 6925444 - DNA, 20 bp, Homo sapiens
ggaaaagtactcctccttaa

SEQ ID NO: 6925445 - DNA, 22 bp, Homo sapiens
gccaatttgaattggttttctg

SEQ ID NO: 6925446 - DNA, 22 bp, Homo sapiens
atccacttcactggaatgtagg

SEQ ID NO: 6925447 - DNA, 22 bp, Homo sapiens
atcttccttcactttctcccac

SEQ ID NO: 6925448 - DNA, 20 bp, Homo sapiens
agcagtgtttcttgactcta

SEQ ID NO: 6925449 - DNA, 22 bp, Homo sapiens
atagcatacatgttgttacttg

SEQ ID NO: 6925450 - DNA, 23 bp, Homo sapiens
gcaagagacagagcatcctgttc

SEQ ID NO: 6925451 - DNA, 17 bp, Homo sapiens
catccgtgagctcggca

SEQ ID NO: 6925452 - DNA, 22 bp, Homo sapiens
cccctgccatagtcaaatctaa

SEQ ID NO: 6925453 - DNA, 22 bp, Homo sapiens
ttgcacagggctggaatgtcct

SEQ ID NO: 6925454 - DNA, 22 bp, Homo sapiens
gaagcagggagcagtctttgca

SEQ ID NO: 6925455 - DNA, 22 bp, Homo sapiens
acagttcttaaaacttgaatta

SEQ ID NO: 6925456 - DNA, 22 bp, Homo sapiens
aatagactccagggtctatttt

SEQ ID NO: 6925457 - DNA, 22 bp, Homo sapiens
caaactgcaacatgaagtgtcc

SEQ ID NO: 6925458 - DNA, 22 bp, Homo sapiens
ttgtgcatgactgtgaatagct

SEQ ID NO: 6925459 - DNA, 22 bp, Homo sapiens
ctggtggcatcttgagatggtt

SEQ ID NO: 6925460 - DNA, 22 bp, Homo sapiens
ctggggcatctgacagataaat

SEQ ID NO: 6925461 - DNA, 21 bp, Homo sapiens
actggaagtgggtcaggaagt

SEQ ID NO: 6925462 - DNA, 22 bp, Homo sapiens
tgtgtgtggggaggcagcagat

SEQ ID NO: 6925463 - DNA, 21 bp, Homo sapiens
tcatgtgctgaggatgatgcc

SEQ ID NO: 6925464 - DNA, 17 bp, Homo sapiens
ttcaagatattgaaatg

SEQ ID NO: 6925465 - DNA, 17 bp, Homo sapiens
tgaaggaaggatgatgt

SEQ ID NO: 6925466 - DNA, 22 bp, Homo sapiens
atagttgtgtggggattctggt

SEQ ID NO: 6925467 - DNA, 22 bp, Homo sapiens
aggttcaaattgttgcagtttc

SEQ ID NO: 6925468 - DNA, 22 bp, Homo sapiens
gctctggaggctggaagaccat

SEQ ID NO: 6925469 - DNA, 22 bp, Homo sapiens
aattgtacaggaagttgctgga

SEQ ID NO: 6925470 - DNA, 22 bp, Homo sapiens
tcattaatcccggggtccaggg

SEQ ID NO: 6925471 - DNA, 19 bp, Homo sapiens
aggagtcaggaacttcctt

SEQ ID NO: 6925472 - DNA, 22 bp, Homo sapiens
atctggggcctgggctagccat

SEQ ID NO: 6925473 - DNA, 22 bp, Homo sapiens
gatcctgttagatcccattaga

SEQ ID NO: 6925474 - DNA, 22 bp, Homo sapiens
agggctgaggcgagggagatgc

SEQ ID NO: 6925475 - DNA, 22 bp, Homo sapiens
aggtggggaggagtgtctcttt

SEQ ID NO: 6925476 - DNA, 22 bp, Homo sapiens
actctttacttaaactctaagt

SEQ ID NO: 6925477 - DNA, 22 bp, Homo sapiens
aaaaggcttggaacctttccct

SEQ ID NO: 6925478 - DNA, 22 bp, Homo sapiens
gctgctccagtgttctgtctag

SEQ ID NO: 6925479 - DNA, 20 bp, Homo sapiens
ttcacagaggactcaggtca

SEQ ID NO: 6925480 - DNA, 22 bp, Homo sapiens
actatgaaagtataatattgaa

SEQ ID NO: 6925481 - DNA, 20 bp, Homo sapiens
gaatctggtcaaatgtctat

SEQ ID NO: 6925482 - DNA, 22 bp, Homo sapiens
gagaaaatgtcagacttggtcg

SEQ ID NO: 6925483 - DNA, 21 bp, Homo sapiens
gacagcaactgtagtcctctt

SEQ ID NO: 6925484 - DNA, 22 bp, Homo sapiens
tatgagcaagagtttgtgaagg

SEQ ID NO: 6925485 - DNA, 22 bp, Homo sapiens
gcagagggggtacttcggccct

SEQ ID NO: 6925486 - DNA, 22 bp, Homo sapiens
acacagagccaaaccatatcac

SEQ ID NO: 6925487 - DNA, 22 bp, Homo sapiens
gagcaacttcaatagtactatt

SEQ ID NO: 6925488 - DNA, 22 bp, Homo sapiens
gtggcagagccgtgcaggtagg

SEQ ID NO: 6925489 - DNA, 22 bp, Homo sapiens
tttggctgtgtgctcccttttc

SEQ ID NO: 6925490 - DNA, 22 bp, Homo sapiens
atggaatgggaagcagagccat

SEQ ID NO: 6925491 - DNA, 22 bp, Homo sapiens
atctctaagtacctccaagggt

SEQ ID NO: 6925492 - DNA, 22 bp, Homo sapiens
atctttggatcgctcccccttc

SEQ ID NO: 6925493 - DNA, 22 bp, Homo sapiens
aatcagttgttcactctgaaaa

SEQ ID NO: 6925494 - DNA, 22 bp, Homo sapiens
gacaatatagttgaatgagcaa

SEQ ID NO: 6925495 - DNA, 22 bp, Homo sapiens
tagtattttagaaaaccatgaa

SEQ ID NO: 6925496 - DNA, 22 bp, Homo sapiens
ctccctcgagaacgcccctctc

SEQ ID NO: 6925497 - DNA, 22 bp, Homo sapiens
cagttagaggaggtaaagatgc

SEQ ID NO: 6925498 - DNA, 22 bp, Homo sapiens
gaaatgtctcttgatttttgga

SEQ ID NO: 6925499 - DNA, 22 bp, Homo sapiens
ctggccccatctggagtctgag

SEQ ID NO: 6925500 - DNA, 18 bp, Homo sapiens
tgcaggctgttgaaactg

SEQ ID NO: 6925501 - DNA, 22 bp, Homo sapiens
aacgagctctccttctttcatt

SEQ ID NO: 6925502 - DNA, 20 bp, Homo sapiens
ttgggcctgtcagcactccc

SEQ ID NO: 6925503 - DNA, 22 bp, Homo sapiens
tttatagctgtgagaccttggg

SEQ ID NO: 6925504 - DNA, 22 bp, Homo sapiens
aaactctagtaaaatgtattca

SEQ ID NO: 6925505 - DNA, 22 bp, Homo sapiens
ggactggccggcgctgaggccc

SEQ ID NO: 6925506 - DNA, 22 bp, Homo sapiens
agctcagcttcctctccatgct

SEQ ID NO: 6925507 - DNA, 22 bp, Homo sapiens
ccagctgattcggtggtggttg

SEQ ID NO: 6925508 - DNA, 22 bp, Homo sapiens
tctttcttggtattctgagcta

SEQ ID NO: 6925509 - DNA, 22 bp, Homo sapiens
ggtcatagaatcacaggatctt

SEQ ID NO: 6925510 - DNA, 22 bp, Homo sapiens
catcactacaaatttaagaaat

SEQ ID NO: 6925511 - DNA, 22 bp, Homo sapiens
tgaagcagttactgggtgttaa

SEQ ID NO: 6925512 - DNA, 23 bp, Homo sapiens
ggccactgaattttctgcatctt

SEQ ID NO: 6925513 - DNA, 22 bp, Homo sapiens
ccctgagcattcatgtgagctt

SEQ ID NO: 6925514 - DNA, 22 bp, Homo sapiens
gtatactcatgtctcagaggac

SEQ ID NO: 6925515 - DNA, 22 bp, Homo sapiens
catgccatttcttctctttatg

SEQ ID NO: 6925516 - DNA, 22 bp, Homo sapiens
ctgtattttttaagtgatctgg

SEQ ID NO: 6925517 - DNA, 22 bp, Homo sapiens
atgcagatttctttgctgcacc

SEQ ID NO: 6925518 - DNA, 19 bp, Homo sapiens
actttggtgattagaggga

SEQ ID NO: 6925519 - DNA, 22 bp, Homo sapiens
tttggtctcattcactcatggg

SEQ ID NO: 6925520 - DNA, 22 bp, Homo sapiens
tattgttgttgtgagggggatg

SEQ ID NO: 6925521 - DNA, 22 bp, Homo sapiens
gcacatacatattagtgtcaca

SEQ ID NO: 6925522 - DNA, 22 bp, Homo sapiens
tagcagtactgggcatgtgttt

SEQ ID NO: 6925523 - DNA, 22 bp, Homo sapiens
gtccatccagaggccaccatgg

SEQ ID NO: 6925524 - DNA, 22 bp, Homo sapiens
tcctgaagaaggcagatatttg

SEQ ID NO: 6925525 - DNA, 22 bp, Homo sapiens
tgggacctgttacattgagtta

SEQ ID NO: 6925526 - DNA, 22 bp, Homo sapiens
tgggcacagagtcccatctgcc

SEQ ID NO: 6925527 - DNA, 22 bp, Homo sapiens
cggcacagtggctcacgcctgt

SEQ ID NO: 6925528 - DNA, 22 bp, Homo sapiens
tgcacaaacacagagaatagat

SEQ ID NO: 6925529 - DNA, 22 bp, Homo sapiens
tagcttctaatacttaccaatt

SEQ ID NO: 6925530 - DNA, 22 bp, Homo sapiens
ttatgaaagacatttctgttgg

SEQ ID NO: 6925531 - DNA, 22 bp, Homo sapiens
actgatgtgaacattgattact

SEQ ID NO: 6925532 - DNA, 22 bp, Homo sapiens
atcagcaaaaatgccttcagaa

SEQ ID NO: 6925533 - DNA, 22 bp, Homo sapiens
tacatgtagttcactggtggca

SEQ ID NO: 6925534 - DNA, 22 bp, Homo sapiens
tttatatggttgactatgagtt

SEQ ID NO: 6925535 - DNA, 21 bp, Homo sapiens
gtggccagtgactacttattg

SEQ ID NO: 6925536 - DNA, 22 bp, Homo sapiens
atgcatgtgcatggctctatct

SEQ ID NO: 6925537 - DNA, 22 bp, Homo sapiens
cgccccagtctgtaggtgcccc

SEQ ID NO: 6925538 - DNA, 22 bp, Homo sapiens
gtaggggccagaaagacttaga

SEQ ID NO: 6925539 - DNA, 22 bp, Homo sapiens
ggcccaggctggagtgcggtgg

SEQ ID NO: 6925540 - DNA, 22 bp, Homo sapiens
tagttacagaagataagggtat

SEQ ID NO: 6925541 - DNA, 18 bp, Homo sapiens
gttctagaaattaggtac

SEQ ID NO: 6925542 - DNA, 22 bp, Homo sapiens
ttccaggatggagacactagta

SEQ ID NO: 6925543 - DNA, 22 bp, Homo sapiens
gattatcactgggtgtcttgag

SEQ ID NO: 6925544 - DNA, 22 bp, Homo sapiens
gagggccaggcggagacaggcg

SEQ ID NO: 6925545 - DNA, 22 bp, Homo sapiens
catgaacaaatcctgcgagtat

SEQ ID NO: 6925546 - DNA, 22 bp, Homo sapiens
gcagacggagtatcttgtacat

SEQ ID NO: 6925547 - DNA, 22 bp, Homo sapiens
ctctgggacatcccttggccta

SEQ ID NO: 6925548 - DNA, 22 bp, Homo sapiens
ctctccaggagctcagagtcta

SEQ ID NO: 6925549 - DNA, 20 bp, Homo sapiens
actggtggactgttcattga

SEQ ID NO: 6925550 - DNA, 22 bp, Homo sapiens
acctacatggctttaagtaagt

SEQ ID NO: 6925551 - DNA, 22 bp, Homo sapiens
ttcctaggtgtttacattcaac

SEQ ID NO: 6925552 - DNA, 22 bp, Homo sapiens
gccctgcttggtcatggccttc

SEQ ID NO: 6925553 - DNA, 22 bp, Homo sapiens
tgtcctggggacaagaggccct

SEQ ID NO: 6925554 - DNA, 22 bp, Homo sapiens
cattgtacagttattttaaaat

SEQ ID NO: 6925555 - DNA, 22 bp, Homo sapiens
gtaagcaaacagcaaatgattt

SEQ ID NO: 6925556 - DNA, 22 bp, Homo sapiens
tctgctgagtcagacctctggg

SEQ ID NO: 6925557 - DNA, 19 bp, Homo sapiens
tagtgtttttctggagcag

SEQ ID NO: 6925558 - DNA, 22 bp, Homo sapiens
gaacagtttccctgtagaaaat

SEQ ID NO: 6925559 - DNA, 22 bp, Homo sapiens
ttttacagttccatgcaaagcg

SEQ ID NO: 6925560 - DNA, 22 bp, Homo sapiens
ggcatatgtagcgtgtgttctg

SEQ ID NO: 6925561 - DNA, 22 bp, Homo sapiens
tgcagggccttgggtctttctt

SEQ ID NO: 6925562 - DNA, 22 bp, Homo sapiens
tctgagccgtatggcttggcta

SEQ ID NO: 6925563 - DNA, 23 bp, Homo sapiens
tgcagccactcaggagctcagtg

SEQ ID NO: 6925564 - DNA, 22 bp, Homo sapiens
agtcgatgtcttaattaagcct

SEQ ID NO: 6925565 - DNA, 22 bp, Homo sapiens
cggagatatttaaggttctctc

SEQ ID NO: 6925566 - DNA, 22 bp, Homo sapiens
aagtgaaacatgtatctcttta

SEQ ID NO: 6925567 - DNA, 22 bp, Homo sapiens
atgcaaagcaccacactaagat

SEQ ID NO: 6925568 - DNA, 22 bp, Homo sapiens
acatttgatggagttagtaggt

SEQ ID NO: 6925569 - DNA, 20 bp, Homo sapiens
gcttggcaggttttgttgcc

SEQ ID NO: 6925570 - DNA, 22 bp, Homo sapiens
agtacctgatttcacagaccag

SEQ ID NO: 6925571 - DNA, 21 bp, Homo sapiens
gcagagaatgaactttggctt

SEQ ID NO: 6925572 - DNA, 22 bp, Homo sapiens
ttgccatcccttacctcagtca

SEQ ID NO: 6925573 - DNA, 22 bp, Homo sapiens
tggtcttaaaaacatcaaatgg

SEQ ID NO: 6925574 - DNA, 22 bp, Homo sapiens
ttacaagctaattgtttcagct

SEQ ID NO: 6925575 - DNA, 22 bp, Homo sapiens
agtcaggtgggggctgcagtgg

SEQ ID NO: 6925576 - DNA, 22 bp, Homo sapiens
gtagctatttatgatactcatg

SEQ ID NO: 6925577 - DNA, 22 bp, Homo sapiens
tgaggaagttgtttctcttcta

SEQ ID NO: 6925578 - DNA, 22 bp, Homo sapiens
ctgggtggttttgatgtgaatt

SEQ ID NO: 6925579 - DNA, 22 bp, Homo sapiens
tgacagagacttcagagccaaa

SEQ ID NO: 6925580 - DNA, 22 bp, Homo sapiens
ctggctggtcatcagcagtacg

SEQ ID NO: 6925581 - DNA, 22 bp, Homo sapiens
gagggtggggaatagactgcta

SEQ ID NO: 6925582 - DNA, 22 bp, Homo sapiens
aaagacatgacacattggagag

SEQ ID NO: 6925583 - DNA, 22 bp, Homo sapiens
cacagagcaggggtctgtgtca

SEQ ID NO: 6925584 - DNA, 22 bp, Homo sapiens
cctccccacccacggctggtgg

SEQ ID NO: 6925585 - DNA, 16 bp, Homo sapiens
gagcagagcggttcca

SEQ ID NO: 6925586 - DNA, 22 bp, Homo sapiens
ttaaattaggactctagttctg

SEQ ID NO: 6925587 - DNA, 22 bp, Homo sapiens
tggcagcagccatggaaggccc

SEQ ID NO: 6925588 - DNA, 19 bp, Homo sapiens
accagcccactcccagttt

SEQ ID NO: 6925589 - DNA, 22 bp, Homo sapiens
aggcatttggctgtcatttgta

SEQ ID NO: 6925590 - DNA, 22 bp, Homo sapiens
aatgccgtgtttcttacgttca

SEQ ID NO: 6925591 - DNA, 22 bp, Homo sapiens
tgaaaggtgacatttcttggat

SEQ ID NO: 6925592 - DNA, 22 bp, Homo sapiens
ggtgggtcttgcggggcagctt

SEQ ID NO: 6925593 - DNA, 22 bp, Homo sapiens
gtgtggctgattgacatggtca

SEQ ID NO: 6925594 - DNA, 22 bp, Homo sapiens
ctagccatgggcattaaaggta

SEQ ID NO: 6925595 - DNA, 22 bp, Homo sapiens
acagggttgaagagcataaagt

SEQ ID NO: 6925596 - DNA, 22 bp, Homo sapiens
tgtgctttcaaagttaagtaaa

SEQ ID NO: 6925597 - DNA, 22 bp, Homo sapiens
attttgaaaagcatttgagtaa

SEQ ID NO: 6925598 - DNA, 22 bp, Homo sapiens
aggtttctgcactgtcactggt

SEQ ID NO: 6925599 - DNA, 22 bp, Homo sapiens
agtatattttgattgtatgtgt

SEQ ID NO: 6925600 - DNA, 22 bp, Homo sapiens
aagccacaatctgcatcagcat

SEQ ID NO: 6925601 - DNA, 22 bp, Homo sapiens
atttctctgcctcagcttctgc

SEQ ID NO: 6925602 - DNA, 22 bp, Homo sapiens
ttcatttgtaactctgttaggg

SEQ ID NO: 6925603 - DNA, 22 bp, Homo sapiens
taagaacaagatgttcctgttt

SEQ ID NO: 6925604 - DNA, 22 bp, Homo sapiens
cagaggtagggagctatgttat

SEQ ID NO: 6925605 - DNA, 22 bp, Homo sapiens
actctttattgtttgtggctag

SEQ ID NO: 6925606 - DNA, 22 bp, Homo sapiens
tcctgcagctgaagctcatgtg

SEQ ID NO: 6925607 - DNA, 22 bp, Homo sapiens
tgtttaagtagtctcagggcct

SEQ ID NO: 6925608 - DNA, 22 bp, Homo sapiens
agtggctagatcatgagtgagc

SEQ ID NO: 6925609 - DNA, 22 bp, Homo sapiens
gctcagtgagatattgactcca

SEQ ID NO: 6925610 - DNA, 22 bp, Homo sapiens
taagttctgatgtctgttgcca

SEQ ID NO: 6925611 - DNA, 22 bp, Homo sapiens
tagcaaaggatgactatgtacc

SEQ ID NO: 6925612 - DNA, 22 bp, Homo sapiens
ttggacagttgtagccagcaga

SEQ ID NO: 6925613 - DNA, 22 bp, Homo sapiens
cggtctcccgtgtgtgtgcgct

SEQ ID NO: 6925614 - DNA, 22 bp, Homo sapiens
gtactctcttgaaggcctttct

SEQ ID NO: 6925615 - DNA, 22 bp, Homo sapiens
cagtgctggagatgggtggaac

SEQ ID NO: 6925616 - DNA, 22 bp, Homo sapiens
tggctttttctcagctctggct

SEQ ID NO: 6925617 - DNA, 22 bp, Homo sapiens
tatgcataggtatctatactca

SEQ ID NO: 6925618 - DNA, 22 bp, Homo sapiens
aggaagcctggagtcctgccca

SEQ ID NO: 6925619 - DNA, 22 bp, Homo sapiens
tcccaggacttccagttggagg

SEQ ID NO: 6925620 - DNA, 22 bp, Homo sapiens
catgcaggtgaccaggtgtggg

SEQ ID NO: 6925621 - DNA, 21 bp, Homo sapiens
atgaagcaagggtcacacgtg

SEQ ID NO: 6925622 - DNA, 22 bp, Homo sapiens
acagggtgaatgtgacattatc

SEQ ID NO: 6925623 - DNA, 22 bp, Homo sapiens
gcagatggaaagtgcttgaggg

SEQ ID NO: 6925624 - DNA, 22 bp, Homo sapiens
aggctctgaggcagattttcgt

SEQ ID NO: 6925625 - DNA, 22 bp, Homo sapiens
tgtttcattagtactgacaata

SEQ ID NO: 6925626 - DNA, 23 bp, Homo sapiens
aaatatgtctgagggcaaagaat

SEQ ID NO: 6925627 - DNA, 22 bp, Homo sapiens
atagatgtcattgtcatccatc

SEQ ID NO: 6925628 - DNA, 22 bp, Homo sapiens
cagtggtctgtgcttctgtaca

SEQ ID NO: 6925629 - DNA, 22 bp, Homo sapiens
agtgttcttcttcaaagctctg

SEQ ID NO: 6925630 - DNA, 22 bp, Homo sapiens
caggcagtggccatgttgggag

SEQ ID NO: 6925631 - DNA, 22 bp, Homo sapiens
cagatggcagggcagctctgca

SEQ ID NO: 6925632 - DNA, 22 bp, Homo sapiens
agcgctggtgatctctattttg

SEQ ID NO: 6925633 - DNA, 22 bp, Homo sapiens
ttgttgtcattgtagaggattt

SEQ ID NO: 6925634 - DNA, 22 bp, Homo sapiens
tccttgactgtgaggaactagc

SEQ ID NO: 6925635 - DNA, 22 bp, Homo sapiens
cagtaaattttatttgtgggtg

SEQ ID NO: 6925636 - DNA, 22 bp, Homo sapiens
gctgtcacaaatatttctcagc

SEQ ID NO: 6925637 - DNA, 22 bp, Homo sapiens
cctgggcttgcatctgtgctgg

SEQ ID NO: 6925638 - DNA, 22 bp, Homo sapiens
aagctgttatcttctggcggac

SEQ ID NO: 6925639 - DNA, 22 bp, Homo sapiens
tgattttctccattgtaaattc

SEQ ID NO: 6925640 - DNA, 22 bp, Homo sapiens
tggctcagcttacttttgaggg

SEQ ID NO: 6925641 - DNA, 22 bp, Homo sapiens
ctaaacatcttgcaatgcacag

SEQ ID NO: 6925642 - DNA, 22 bp, Homo sapiens
ctctgtgcgggccatggtcagg

SEQ ID NO: 6925643 - DNA, 20 bp, Homo sapiens
tggaaggcatctgcattatt

SEQ ID NO: 6925644 - DNA, 22 bp, Homo sapiens
tattgtactgaggaataaagct

SEQ ID NO: 6925645 - DNA, 18 bp, Homo sapiens
catcagtatccactaggt

SEQ ID NO: 6925646 - DNA, 22 bp, Homo sapiens
acaggctttatgtagtgactta

SEQ ID NO: 6925647 - DNA, 22 bp, Homo sapiens
aatgtgttttcactgaagattc

SEQ ID NO: 6925648 - DNA, 22 bp, Homo sapiens
gagcagtgactggagcatgaga

SEQ ID NO: 6925649 - DNA, 23 bp, Homo sapiens
acatagaacagaatatatttgtg

SEQ ID NO: 6925650 - DNA, 22 bp, Homo sapiens
aggcaatagaatatgcctgagg

SEQ ID NO: 6925651 - DNA, 22 bp, Homo sapiens
cttctgggtaattcttcttcat

SEQ ID NO: 6925652 - DNA, 22 bp, Homo sapiens
tagaaactactagaataagaga

SEQ ID NO: 6925653 - DNA, 22 bp, Homo sapiens
ggagctgatggtagaagaatga

SEQ ID NO: 6925654 - DNA, 22 bp, Homo sapiens
atcagaggacctagttgggcag

SEQ ID NO: 6925655 - DNA, 22 bp, Homo sapiens
ctttcctagtagttacagaatg

SEQ ID NO: 6925656 - DNA, 22 bp, Homo sapiens
catttctgcagaattgctcttc

SEQ ID NO: 6925657 - DNA, 22 bp, Homo sapiens
agtgaaatggatgctgctactg

SEQ ID NO: 6925658 - DNA, 22 bp, Homo sapiens
acagttattttcccagcattta

SEQ ID NO: 6925659 - DNA, 22 bp, Homo sapiens
cacatgtttcaggccatatttg

SEQ ID NO: 6925660 - DNA, 21 bp, Homo sapiens
atggtggcacaaatttgatct

SEQ ID NO: 6925661 - DNA, 19 bp, Homo sapiens
atgtgcatttgtgtgaggt

SEQ ID NO: 6925662 - DNA, 22 bp, Homo sapiens
atcttatttaacacagcaaaac

SEQ ID NO: 6925663 - DNA, 22 bp, Homo sapiens
ctggctggttccctgctccagg

SEQ ID NO: 6925664 - DNA, 22 bp, Homo sapiens
gattctgggtcctgtgtcttgc

SEQ ID NO: 6925665 - DNA, 22 bp, Homo sapiens
tgttagaatattgtaatattcg

SEQ ID NO: 6925666 - DNA, 22 bp, Homo sapiens
tccagctttgcctgatcatata

SEQ ID NO: 6925667 - DNA, 22 bp, Homo sapiens
ttacatggtttatttacctaag

SEQ ID NO: 6925668 - DNA, 19 bp, Homo sapiens
agctgtctgctgcttttgt

SEQ ID NO: 6925669 - DNA, 22 bp, Homo sapiens
tgctaattcaaagggtagttag

SEQ ID NO: 6925670 - DNA, 22 bp, Homo sapiens
tcctgatggttctctggttctt

SEQ ID NO: 6925671 - DNA, 22 bp, Homo sapiens
agtggctgctatgatcaggaca

SEQ ID NO: 6925672 - DNA, 22 bp, Homo sapiens
gaatgcaaatatatggatcagt

SEQ ID NO: 6925673 - DNA, 22 bp, Homo sapiens
tctcatcttcattgtctcccat

SEQ ID NO: 6925674 - DNA, 22 bp, Homo sapiens
tttccacaatgtttttgcagga

SEQ ID NO: 6925675 - DNA, 22 bp, Homo sapiens
gctgttggggccagcaggtcat

SEQ ID NO: 6925676 - DNA, 22 bp, Homo sapiens
aacccattaatccttgcaagca

SEQ ID NO: 6925677 - DNA, 22 bp, Homo sapiens
ctgtatgtcttgtgaattgtag

SEQ ID NO: 6925678 - DNA, 22 bp, Homo sapiens
cagccctgagagaaccatctat

SEQ ID NO: 6925679 - DNA, 22 bp, Homo sapiens
tctgagaatggtggatgtggtg

SEQ ID NO: 6925680 - DNA, 22 bp, Homo sapiens
gcagggctcattctagtacaat

SEQ ID NO: 6925681 - DNA, 22 bp, Homo sapiens
aattccaggcagaaatgtgagt

SEQ ID NO: 6925682 - DNA, 22 bp, Homo sapiens
agtctggacctgctgggtctcc

SEQ ID NO: 6925683 - DNA, 19 bp, Homo sapiens
aggtcattgatagtgcagg

SEQ ID NO: 6925684 - DNA, 22 bp, Homo sapiens
gagcttcatgattgctttgctt

SEQ ID NO: 6925685 - DNA, 19 bp, Homo sapiens
tttggctctggtcagagag

SEQ ID NO: 6925686 - DNA, 22 bp, Homo sapiens
atcacagacaattgtcagacca

SEQ ID NO: 6925687 - DNA, 22 bp, Homo sapiens
ccagctgctgtgcagggaggct

SEQ ID NO: 6925688 - DNA, 22 bp, Homo sapiens
catcttgctgggttttatcata

SEQ ID NO: 6925689 - DNA, 22 bp, Homo sapiens
aagtcctagacagagccttggc

SEQ ID NO: 6925690 - DNA, 22 bp, Homo sapiens
gttactcttccccggggtctgg

SEQ ID NO: 6925691 - DNA, 22 bp, Homo sapiens
attagttgatctatatccaaag

SEQ ID NO: 6925692 - DNA, 22 bp, Homo sapiens
ccccatcatctttgaggtcatt

SEQ ID NO: 6925693 - DNA, 22 bp, Homo sapiens
tggaagcatcacttcttgcctg

SEQ ID NO: 6925694 - DNA, 22 bp, Homo sapiens
acatgttagggacagagtatgt

SEQ ID NO: 6925695 - DNA, 22 bp, Homo sapiens
catgaaattgtattggcctcaa

SEQ ID NO: 6925696 - DNA, 22 bp, Homo sapiens
tttcatgcctgtggtgcagtgt

SEQ ID NO: 6925697 - DNA, 22 bp, Homo sapiens
aatggcttaccctggattgtgt

SEQ ID NO: 6925698 - DNA, 22 bp, Homo sapiens
ttttggatgagcccagatttct

SEQ ID NO: 6925699 - DNA, 22 bp, Homo sapiens
ctccaagtcggctgcagctgga

SEQ ID NO: 6925700 - DNA, 22 bp, Homo sapiens
tgcagagccccagattggagag

SEQ ID NO: 6925701 - DNA, 18 bp, Homo sapiens
cttccctcttcctttgtc

SEQ ID NO: 6925702 - DNA, 22 bp, Homo sapiens
cttcttatcaagtggcaaatct

SEQ ID NO: 6925703 - DNA, 22 bp, Homo sapiens
taaacagtgatacgttccagct

SEQ ID NO: 6925704 - DNA, 22 bp, Homo sapiens
ggccagtggctctgtgcttggg

SEQ ID NO: 6925705 - DNA, 23 bp, Homo sapiens
gccctgctgggacctcctgctac

SEQ ID NO: 6925706 - DNA, 22 bp, Homo sapiens
tctacttctccttcatttccca

SEQ ID NO: 6925707 - DNA, 22 bp, Homo sapiens
gaaccctagcatgtcctttagg

SEQ ID NO: 6925708 - DNA, 18 bp, Homo sapiens
ccatttcatgattattac

SEQ ID NO: 6925709 - DNA, 22 bp, Homo sapiens
tcagggagagtgacccatccac

SEQ ID NO: 6925710 - DNA, 22 bp, Homo sapiens
ttgcagtttatgttcctgcagt

SEQ ID NO: 6925711 - DNA, 22 bp, Homo sapiens
aaggaaagattctctctctaga

SEQ ID NO: 6925712 - DNA, 22 bp, Homo sapiens
aacaaggctggtatcttaaaga

SEQ ID NO: 6925713 - DNA, 22 bp, Homo sapiens
ggcgggacggggcgtgcacaga

SEQ ID NO: 6925714 - DNA, 22 bp, Homo sapiens
tcagtttcctcatctacaaaag

SEQ ID NO: 6925715 - DNA, 22 bp, Homo sapiens
catcatgccccgctacagtgca

SEQ ID NO: 6925716 - DNA, 22 bp, Homo sapiens
ttgcatcaattccttgtcctga

SEQ ID NO: 6925717 - DNA, 22 bp, Homo sapiens
ctatgcatctgaacaatagaga

SEQ ID NO: 6925718 - DNA, 18 bp, Homo sapiens
tgttaggaagggcacaca

SEQ ID NO: 6925719 - DNA, 22 bp, Homo sapiens
ctcagtttcttactctgtataa

SEQ ID NO: 6925720 - DNA, 22 bp, Homo sapiens
catctctggttcagtctctgtg

SEQ ID NO: 6925721 - DNA, 22 bp, Homo sapiens
ctgcctagggtctggtaccaca

SEQ ID NO: 6925722 - DNA, 20 bp, Homo sapiens
tccagacatctagctcagtt

SEQ ID NO: 6925723 - DNA, 22 bp, Homo sapiens
ttgcaaaatcatttctcaggat

SEQ ID NO: 6925724 - DNA, 21 bp, Homo sapiens
cccgcatcttcctctccagca

SEQ ID NO: 6925725 - DNA, 22 bp, Homo sapiens
taaaccaggtaaagaagctctc

SEQ ID NO: 6925726 - DNA, 22 bp, Homo sapiens
aattatctgtaaatggcaattt

SEQ ID NO: 6925727 - DNA, 22 bp, Homo sapiens
taaatgttgtaagtacatctaa

SEQ ID NO: 6925728 - DNA, 22 bp, Homo sapiens
atccaggagtcgtggcgctcag

SEQ ID NO: 6925729 - DNA, 22 bp, Homo sapiens
ttacacattgcagatcaaaatg

SEQ ID NO: 6925730 - DNA, 22 bp, Homo sapiens
ggtgggcgactgagaggggttt

SEQ ID NO: 6925731 - DNA, 22 bp, Homo sapiens
attgcaaagcgtagactctaaa

SEQ ID NO: 6925732 - DNA, 22 bp, Homo sapiens
cccaggtctccttctttagctg

SEQ ID NO: 6925733 - DNA, 22 bp, Homo sapiens
atgctgtgaaaaagaaggctga

SEQ ID NO: 6925734 - DNA, 22 bp, Homo sapiens
ccatccctcctactcacagtca

SEQ ID NO: 6925735 - DNA, 22 bp, Homo sapiens
agacttctaaatagcagcttct

SEQ ID NO: 6925736 - DNA, 22 bp, Homo sapiens
agacgcagatttatttcagttt

SEQ ID NO: 6925737 - DNA, 22 bp, Homo sapiens
ctccagtgggggtgagcctaga

SEQ ID NO: 6925738 - DNA, 22 bp, Homo sapiens
tgatagaagcagaagcatacca

SEQ ID NO: 6925739 - DNA, 22 bp, Homo sapiens
ccaggctgaatatgttccaggg

SEQ ID NO: 6925740 - DNA, 22 bp, Homo sapiens
ctctttggatagaattacaaag

SEQ ID NO: 6925741 - DNA, 20 bp, Homo sapiens
agggaagtgcgccatcaggg

SEQ ID NO: 6925742 - DNA, 22 bp, Homo sapiens
ctgtgagggtcacagccatgcc

SEQ ID NO: 6925743 - DNA, 23 bp, Homo sapiens
ataactgagccgaggcttaagaa

SEQ ID NO: 6925744 - DNA, 22 bp, Homo sapiens
aggggaagattatacttttgaa

SEQ ID NO: 6925745 - DNA, 22 bp, Homo sapiens
gtctgcaaagattggaagccac

SEQ ID NO: 6925746 - DNA, 22 bp, Homo sapiens
agtgtttggggtgattgtaacc

SEQ ID NO: 6925747 - DNA, 22 bp, Homo sapiens
gcaggggctgctgggaactcgg

SEQ ID NO: 6925748 - DNA, 22 bp, Homo sapiens
cagattaagtgctcaacagtgt

SEQ ID NO: 6925749 - DNA, 22 bp, Homo sapiens
tccactggcttggaaaatcatt

SEQ ID NO: 6925750 - DNA, 22 bp, Homo sapiens
tctttgatgtctcttcctgtaa

SEQ ID NO: 6925751 - DNA, 22 bp, Homo sapiens
ttatgtctcaaccgggcacggt

SEQ ID NO: 6925752 - DNA, 22 bp, Homo sapiens
gggcagatggggcacaggctga

SEQ ID NO: 6925753 - DNA, 22 bp, Homo sapiens
agatccattttggtgtcaactc

SEQ ID NO: 6925754 - DNA, 22 bp, Homo sapiens
cacatctgggttctcttcttca

SEQ ID NO: 6925755 - DNA, 22 bp, Homo sapiens
tgagccctccaaacccaggatt

SEQ ID NO: 6925756 - DNA, 22 bp, Homo sapiens
aaggactccaattctttcatct

SEQ ID NO: 6925757 - DNA, 22 bp, Homo sapiens
ctgtctgtgacctctgcatgtc

SEQ ID NO: 6925758 - DNA, 21 bp, Homo sapiens
aggtactaatgaaaagtgatt

SEQ ID NO: 6925759 - DNA, 22 bp, Homo sapiens
cccaggaggtggagcttgcagt

SEQ ID NO: 6925760 - DNA, 22 bp, Homo sapiens
acatgctatgagagattacttc

SEQ ID NO: 6925761 - DNA, 20 bp, Homo sapiens
aggagcacagggtttagtgg

SEQ ID NO: 6925762 - DNA, 22 bp, Homo sapiens
aggaatgatagtaaaagagaat

SEQ ID NO: 6925763 - DNA, 22 bp, Homo sapiens
tggatggctggggaagagcagg

SEQ ID NO: 6925764 - DNA, 22 bp, Homo sapiens
tcagaattctacaatagatcag

SEQ ID NO: 6925765 - DNA, 22 bp, Homo sapiens
actgctggcatgcatatacaaa

SEQ ID NO: 6925766 - DNA, 22 bp, Homo sapiens
gtgcatctgggggcgcccgtgc

SEQ ID NO: 6925767 - DNA, 22 bp, Homo sapiens
tgaagcctcacctgctcagtat

SEQ ID NO: 6925768 - DNA, 22 bp, Homo sapiens
ctttcaatcaaagtttctagtg

SEQ ID NO: 6925769 - DNA, 22 bp, Homo sapiens
tgctgggttacctaagcctaaa

SEQ ID NO: 6925770 - DNA, 22 bp, Homo sapiens
ccaggctctgagaggaatgtga

SEQ ID NO: 6925771 - DNA, 21 bp, Homo sapiens
tggtttatgtgcttagggtct

SEQ ID NO: 6925772 - DNA, 19 bp, Homo sapiens
ctttttcaccttctagaag

SEQ ID NO: 6925773 - DNA, 22 bp, Homo sapiens
cccttctgtaaatgctgactgg

SEQ ID NO: 6925774 - DNA, 22 bp, Homo sapiens
gtggtggatgtctgtaatctca

SEQ ID NO: 6925775 - DNA, 22 bp, Homo sapiens
tcactacaaccgctacctgaca

SEQ ID NO: 6925776 - DNA, 22 bp, Homo sapiens
aaagttttctgccttcattaga

SEQ ID NO: 6925777 - DNA, 22 bp, Homo sapiens
tgtttactagccaacatggaga

SEQ ID NO: 6925778 - DNA, 22 bp, Homo sapiens
attcagattggtttaagctagt

SEQ ID NO: 6925779 - DNA, 22 bp, Homo sapiens
atcacaatccctctctctgata

SEQ ID NO: 6925780 - DNA, 22 bp, Homo sapiens
atgggaggaagagaagatgtct

SEQ ID NO: 6925781 - DNA, 22 bp, Homo sapiens
aaaaacagaatgtgtctaactc

SEQ ID NO: 6925782 - DNA, 22 bp, Homo sapiens
ttgaaagatagtgaagccagcc

SEQ ID NO: 6925783 - DNA, 22 bp, Homo sapiens
acagcagtggtgcactgagcca

SEQ ID NO: 6925784 - DNA, 22 bp, Homo sapiens
tgtccatctgtcttagtacaaa

SEQ ID NO: 6925785 - DNA, 22 bp, Homo sapiens
atgggccagcaccatgttaagc

SEQ ID NO: 6925786 - DNA, 20 bp, Homo sapiens
ttggctcatgcaacacctac

SEQ ID NO: 6925787 - DNA, 22 bp, Homo sapiens
gtggcttccaagactaagtcac

SEQ ID NO: 6925788 - DNA, 22 bp, Homo sapiens
ggccggaaaggtcagattctga

SEQ ID NO: 6925789 - DNA, 20 bp, Homo sapiens
ggcaatcctaacgtgttcca

SEQ ID NO: 6925790 - DNA, 22 bp, Homo sapiens
gaacttcacgatagccaaagct

SEQ ID NO: 6925791 - DNA, 22 bp, Homo sapiens
tggaagagaaaatccaccctta

SEQ ID NO: 6925792 - DNA, 22 bp, Homo sapiens
agggcacaagactctgagcccc

SEQ ID NO: 6925793 - DNA, 22 bp, Homo sapiens
tgcattcctttgtctgttaaag

SEQ ID NO: 6925794 - DNA, 22 bp, Homo sapiens
gctctgtggcaggaggtcttgt

SEQ ID NO: 6925795 - DNA, 22 bp, Homo sapiens
ctggcagtgagctggccactca

SEQ ID NO: 6925796 - DNA, 21 bp, Homo sapiens
actgaggttagatgccttgcc

SEQ ID NO: 6925797 - DNA, 19 bp, Homo sapiens
actggcagggctgcggtgg

SEQ ID NO: 6925798 - DNA, 18 bp, Homo sapiens
agtcagtcattgatagat

SEQ ID NO: 6925799 - DNA, 22 bp, Homo sapiens
atgagattttaaaacttcactt

SEQ ID NO: 6925800 - DNA, 22 bp, Homo sapiens
catgtattgaagtgtgcatctg

SEQ ID NO: 6925801 - DNA, 22 bp, Homo sapiens
tcagggaacctctcctgtttct

SEQ ID NO: 6925802 - DNA, 22 bp, Homo sapiens
aaagtgttgaagaaaatgttca

SEQ ID NO: 6925803 - DNA, 22 bp, Homo sapiens
tagaaatcaggtttttagaaag

SEQ ID NO: 6925804 - DNA, 22 bp, Homo sapiens
tgcccatggcaggatttctgaa

SEQ ID NO: 6925805 - DNA, 22 bp, Homo sapiens
aattgctagactatactgtaat

SEQ ID NO: 6925806 - DNA, 22 bp, Homo sapiens
ttacaggaggtgctaggtgttt

SEQ ID NO: 6925807 - DNA, 22 bp, Homo sapiens
cctggattctcactggactcca

SEQ ID NO: 6925808 - DNA, 22 bp, Homo sapiens
agacccacactttgagtagcaa

SEQ ID NO: 6925809 - DNA, 22 bp, Homo sapiens
ctggcccttaggaaaacaaagt

SEQ ID NO: 6925810 - DNA, 22 bp, Homo sapiens
ggaaactaaagaggtgtttttg

SEQ ID NO: 6925811 - DNA, 15 bp, Homo sapiens
ggtgtctgcagtgtg

SEQ ID NO: 6925812 - DNA, 23 bp, Homo sapiens
tgcagtaggatggggctgggcct

SEQ ID NO: 6925813 - DNA, 22 bp, Homo sapiens
cttcaaattcgaggagtagatg

SEQ ID NO: 6925814 - DNA, 22 bp, Homo sapiens
gatgcagtgcttaaatcatttg

SEQ ID NO: 6925815 - DNA, 22 bp, Homo sapiens
ccagaatgttctagagccaccc

SEQ ID NO: 6925816 - DNA, 22 bp, Homo sapiens
ttagaggaaagtgactccgatg

SEQ ID NO: 6925817 - DNA, 22 bp, Homo sapiens
gcagagttcctggaaagcaacc

SEQ ID NO: 6925818 - DNA, 22 bp, Homo sapiens
acaggcactttgacatgccatc

SEQ ID NO: 6925819 - DNA, 22 bp, Homo sapiens
agagccaaggcctcagtctcaa

SEQ ID NO: 6925820 - DNA, 22 bp, Homo sapiens
cagagcatgaataaaagttaca

SEQ ID NO: 6925821 - DNA, 22 bp, Homo sapiens
cctccagggcagacggggagca

SEQ ID NO: 6925822 - DNA, 22 bp, Homo sapiens
ctgtattcaagcttctgcccaa

SEQ ID NO: 6925823 - DNA, 22 bp, Homo sapiens
attagatgtgaccttagataaa

SEQ ID NO: 6925824 - DNA, 22 bp, Homo sapiens
cctagggatacagcagagtaca

SEQ ID NO: 6925825 - DNA, 22 bp, Homo sapiens
cttctcagaggccagaagctat

SEQ ID NO: 6925826 - DNA, 22 bp, Homo sapiens
attacagagggtcggtcgtttt

SEQ ID NO: 6925827 - DNA, 22 bp, Homo sapiens
aaatcccatcggagaggaggat

SEQ ID NO: 6925828 - DNA, 22 bp, Homo sapiens
ataggcataacactgatgtcct

SEQ ID NO: 6925829 - DNA, 22 bp, Homo sapiens
ggctgctgacttcatccagctt

SEQ ID NO: 6925830 - DNA, 22 bp, Homo sapiens
ttaatgatttggaaccctttaa

SEQ ID NO: 6925831 - DNA, 22 bp, Homo sapiens
ttctggaagccccagagtcaga

SEQ ID NO: 6925832 - DNA, 22 bp, Homo sapiens
agtttagtttgttcttggctca

SEQ ID NO: 6925833 - DNA, 22 bp, Homo sapiens
ttggtccaggatggcgtgggtg

SEQ ID NO: 6925834 - DNA, 22 bp, Homo sapiens
actgggtctgaaggacagagca

SEQ ID NO: 6925835 - DNA, 22 bp, Homo sapiens
tgtcggactatggttcacagtg

SEQ ID NO: 6925836 - DNA, 19 bp, Homo sapiens
gctggcacttcaagggagc

SEQ ID NO: 6925837 - DNA, 22 bp, Homo sapiens
gggctctgggattcagagcaag

SEQ ID NO: 6925838 - DNA, 22 bp, Homo sapiens
aaattcagatggctttcttttc

SEQ ID NO: 6925839 - DNA, 22 bp, Homo sapiens
cacagtgacattagtgagaaaa

SEQ ID NO: 6925840 - DNA, 22 bp, Homo sapiens
ttttgtgttgtaatgtcagcta

SEQ ID NO: 6925841 - DNA, 22 bp, Homo sapiens
tatttgttgaatacccctgtct

SEQ ID NO: 6925842 - DNA, 22 bp, Homo sapiens
tcaggggaaatctctcagcgaa

SEQ ID NO: 6925843 - DNA, 22 bp, Homo sapiens
gacagttttgctaaaaggttga

SEQ ID NO: 6925844 - DNA, 22 bp, Homo sapiens
tggctttaggccaaagcctaac

SEQ ID NO: 6925845 - DNA, 22 bp, Homo sapiens
gtgtctgcttggtcatctttca

SEQ ID NO: 6925846 - DNA, 22 bp, Homo sapiens
tggcatgccttgtcagacagtg

SEQ ID NO: 6925847 - DNA, 22 bp, Homo sapiens
agcccaggtgaggggttcgaaa

SEQ ID NO: 6925848 - DNA, 22 bp, Homo sapiens
acttcatgcagaagagagctgt

SEQ ID NO: 6925849 - DNA, 22 bp, Homo sapiens
cctggaaggcaggcatggattg

SEQ ID NO: 6925850 - DNA, 22 bp, Homo sapiens
ccagtgttggaggatggcttgc

SEQ ID NO: 6925851 - DNA, 22 bp, Homo sapiens
ttgcaatgttgtgaggatttgt

SEQ ID NO: 6925852 - DNA, 22 bp, Homo sapiens
attccaggcatgcaggaacaag

SEQ ID NO: 6925853 - DNA, 22 bp, Homo sapiens
catactaaactatccagttact

SEQ ID NO: 6925854 - DNA, 20 bp, Homo sapiens
tctgtaggcaagttagcagg

SEQ ID NO: 6925855 - DNA, 22 bp, Homo sapiens
atttcagaatgtcctaatttag

SEQ ID NO: 6925856 - DNA, 22 bp, Homo sapiens
gcagagtggtttcagagttgag

SEQ ID NO: 6925857 - DNA, 22 bp, Homo sapiens
ctgctgtgtttcacacctctgg

SEQ ID NO: 6925858 - DNA, 22 bp, Homo sapiens
gagatgctatggctattcccct

SEQ ID NO: 6925859 - DNA, 22 bp, Homo sapiens
agtggcaagtcaatgatagtga

SEQ ID NO: 6925860 - DNA, 22 bp, Homo sapiens
ccctggatttacatcattctga

SEQ ID NO: 6925861 - DNA, 23 bp, Homo sapiens
gggagcacagcctggtgggcgcg

SEQ ID NO: 6925862 - DNA, 22 bp, Homo sapiens
ctgggccatggaagtctctgcc

SEQ ID NO: 6925863 - DNA, 22 bp, Homo sapiens
agacacagaacacaaaagcata

SEQ ID NO: 6925864 - DNA, 22 bp, Homo sapiens
cacattcaggtggcatgttaga

SEQ ID NO: 6925865 - DNA, 22 bp, Homo sapiens
ctatatgccagtggcaccctct

SEQ ID NO: 6925866 - DNA, 22 bp, Homo sapiens
cagcccttgtttgggaaggatg

SEQ ID NO: 6925867 - DNA, 22 bp, Homo sapiens
ccactgcccaccccgacgtcta

SEQ ID NO: 6925868 - DNA, 21 bp, Homo sapiens
catgaagccggttccctgttt

SEQ ID NO: 6925869 - DNA, 22 bp, Homo sapiens
cttgggctcagacttgaggaca

SEQ ID NO: 6925870 - DNA, 21 bp, Homo sapiens
ctggatctgtcatcgagtttt

SEQ ID NO: 6925871 - DNA, 22 bp, Homo sapiens
ctgggctgtttgttctggtctc

SEQ ID NO: 6925872 - DNA, 22 bp, Homo sapiens
cagctatggtgacaaggtcagg

SEQ ID NO: 6925873 - DNA, 22 bp, Homo sapiens
tattatttttattcgagggaaa

SEQ ID NO: 6925874 - DNA, 22 bp, Homo sapiens
agaggtcaatgggacttggatc

SEQ ID NO: 6925875 - DNA, 22 bp, Homo sapiens
gcagtgaagatggcaggttggg

SEQ ID NO: 6925876 - DNA, 22 bp, Homo sapiens
gaagagagagccctggggtccg

SEQ ID NO: 6925877 - DNA, 22 bp, Homo sapiens
tcttggaacttattattgtaga

SEQ ID NO: 6925878 - DNA, 22 bp, Homo sapiens
actgggctcccaggcttgtcat

SEQ ID NO: 6925879 - DNA, 22 bp, Homo sapiens
catgagaaggggtggagttaga

SEQ ID NO: 6925880 - DNA, 22 bp, Homo sapiens
ttaggcaaagctggaatccagg

SEQ ID NO: 6925881 - DNA, 22 bp, Homo sapiens
tcacaaagagaattgtgggtgt

SEQ ID NO: 6925882 - DNA, 22 bp, Homo sapiens
atattgcaatagatgcatcatt

SEQ ID NO: 6925883 - DNA, 22 bp, Homo sapiens
gcagagctgggatttgtactgg

SEQ ID NO: 6925884 - DNA, 22 bp, Homo sapiens
ttaaatgaacgagatatgcaac

SEQ ID NO: 6925885 - DNA, 22 bp, Homo sapiens
tgtctctgaacagcttactaaa

SEQ ID NO: 6925886 - DNA, 22 bp, Homo sapiens
acagtacagctaatgtcattag

SEQ ID NO: 6925887 - DNA, 22 bp, Homo sapiens
ttgagtacaaactcagcctgag

SEQ ID NO: 6925888 - DNA, 22 bp, Homo sapiens
ctttttcccaggtggagagagg

SEQ ID NO: 6925889 - DNA, 22 bp, Homo sapiens
tttgctctgctgttgccaggtg

SEQ ID NO: 6925890 - DNA, 22 bp, Homo sapiens
tgagaataggcatagaacctgg

SEQ ID NO: 6925891 - DNA, 22 bp, Homo sapiens
gagcagtggtggtgtgttagag

SEQ ID NO: 6925892 - DNA, 22 bp, Homo sapiens
cactggaaccatccacatagtg

SEQ ID NO: 6925893 - DNA, 22 bp, Homo sapiens
ccaggctagcccagaccacagg

SEQ ID NO: 6925894 - DNA, 22 bp, Homo sapiens
atgagagctctatgatctgttt

SEQ ID NO: 6925895 - DNA, 22 bp, Homo sapiens
tgtctcttttcaagctaccctt

SEQ ID NO: 6925896 - DNA, 21 bp, Homo sapiens
agggagtctggaggaagcgtt

SEQ ID NO: 6925897 - DNA, 22 bp, Homo sapiens
tggcagtcttgctctctaagag

SEQ ID NO: 6925898 - DNA, 22 bp, Homo sapiens
caaatgttttttagtataagta

SEQ ID NO: 6925899 - DNA, 22 bp, Homo sapiens
ctacatctcaccttccaggaca

SEQ ID NO: 6925900 - DNA, 22 bp, Homo sapiens
tacacagttccatttaagccag

SEQ ID NO: 6925901 - DNA, 22 bp, Homo sapiens
tggaatgtggtatcagtagaaa

SEQ ID NO: 6925902 - DNA, 19 bp, Homo sapiens
tgaggcaagctttttcttg

SEQ ID NO: 6925903 - DNA, 22 bp, Homo sapiens
cagaggcatataattgctgggg

SEQ ID NO: 6925904 - DNA, 22 bp, Homo sapiens
tctcttaggagaaattcataaa

SEQ ID NO: 6925905 - DNA, 22 bp, Homo sapiens
tgtctttacttagaagttcagg

SEQ ID NO: 6925906 - DNA, 22 bp, Homo sapiens
tgggttgtaagagagtgcactt

SEQ ID NO: 6925907 - DNA, 21 bp, Homo sapiens
tataccacagccatcaaatat

SEQ ID NO: 6925908 - DNA, 22 bp, Homo sapiens
gaaatgtcaagatatgtttgga

SEQ ID NO: 6925909 - DNA, 22 bp, Homo sapiens
atggcttatgaataacagtagg

SEQ ID NO: 6925910 - DNA, 19 bp, Homo sapiens
agtacagaaaagagccctg

SEQ ID NO: 6925911 - DNA, 22 bp, Homo sapiens
ggttccagagtatttcatttca

SEQ ID NO: 6925912 - DNA, 22 bp, Homo sapiens
tggcatatgattcttggcatcc

SEQ ID NO: 6925913 - DNA, 22 bp, Homo sapiens
ggcttctcccctttgagtcttc

SEQ ID NO: 6925914 - DNA, 22 bp, Homo sapiens
caaggaatcccatttctaactc

SEQ ID NO: 6925915 - DNA, 22 bp, Homo sapiens
gccactattttcccacctttct

SEQ ID NO: 6925916 - DNA, 21 bp, Homo sapiens
agaggtctaagattctagctt

SEQ ID NO: 6925917 - DNA, 22 bp, Homo sapiens
aggatgtctctccagcctggag

SEQ ID NO: 6925918 - DNA, 22 bp, Homo sapiens
ctgtggctttgcagggcttgtt

SEQ ID NO: 6925919 - DNA, 22 bp, Homo sapiens
ttcacataaatagatcacatca

SEQ ID NO: 6925920 - DNA, 22 bp, Homo sapiens
ctgggagctagctctgagctga

SEQ ID NO: 6925921 - DNA, 22 bp, Homo sapiens
atcaaagtaattaacactgaga

SEQ ID NO: 6925922 - DNA, 22 bp, Homo sapiens
aagatactttgcatgcatgaag

SEQ ID NO: 6925923 - DNA, 18 bp, Homo sapiens
acagacaaaatggaaatg

SEQ ID NO: 6925924 - DNA, 22 bp, Homo sapiens
gtcacagtgcctgccactcaga

SEQ ID NO: 6925925 - DNA, 22 bp, Homo sapiens
aaccgttttaccatttgtaact

SEQ ID NO: 6925926 - DNA, 20 bp, Homo sapiens
actttgcatttcctgatttt

SEQ ID NO: 6925927 - DNA, 22 bp, Homo sapiens
aatgcagattcttattctgtag

SEQ ID NO: 6925928 - DNA, 22 bp, Homo sapiens
ggctgcacgcctctcagcttgc

SEQ ID NO: 6925929 - DNA, 22 bp, Homo sapiens
tggctggctttcttgtatttac

SEQ ID NO: 6925930 - DNA, 22 bp, Homo sapiens
cctccccacaggccaaataggc

SEQ ID NO: 6925931 - DNA, 22 bp, Homo sapiens
catcttgtgaatttctgattct

SEQ ID NO: 6925932 - DNA, 22 bp, Homo sapiens
aatcgcttggtaattttaaaag

SEQ ID NO: 6925933 - DNA, 22 bp, Homo sapiens
atgaggcaatagaatattgaat

SEQ ID NO: 6925934 - DNA, 22 bp, Homo sapiens
atacaagttaatgagaatgaca

SEQ ID NO: 6925935 - DNA, 22 bp, Homo sapiens
ctttcttctccctcaatattac

SEQ ID NO: 6925936 - DNA, 22 bp, Homo sapiens
gccctgaataatagagtgggga

SEQ ID NO: 6925937 - DNA, 22 bp, Homo sapiens
gagattctgagaagttaagtcc

SEQ ID NO: 6925938 - DNA, 23 bp, Homo sapiens
ctggggctcattgcagtagccat

SEQ ID NO: 6925939 - DNA, 22 bp, Homo sapiens
ttacatgctctgtgtgtctccg

SEQ ID NO: 6925940 - DNA, 22 bp, Homo sapiens
catgccacgccgctgcaaggac

SEQ ID NO: 6925941 - DNA, 22 bp, Homo sapiens
ttaattactaagcacaatgcaa

SEQ ID NO: 6925942 - DNA, 20 bp, Homo sapiens
aggcactggggataggtaag

SEQ ID NO: 6925943 - DNA, 23 bp, Homo sapiens
tggccaggtagaggaggtagtga

SEQ ID NO: 6925944 - DNA, 22 bp, Homo sapiens
tttcataatactgtacatgaaa

SEQ ID NO: 6925945 - DNA, 22 bp, Homo sapiens
gtgtgttccatggggacaacag

SEQ ID NO: 6925946 - DNA, 22 bp, Homo sapiens
ccaagcatttctagccagtcac

SEQ ID NO: 6925947 - DNA, 22 bp, Homo sapiens
ttctaccagaccccagacttgt

SEQ ID NO: 6925948 - DNA, 22 bp, Homo sapiens
gttgtccttcttatttgtagtg

SEQ ID NO: 6925949 - DNA, 22 bp, Homo sapiens
cagcagttgtttcggattggga

SEQ ID NO: 6925950 - DNA, 22 bp, Homo sapiens
gggatcagattccctgtcccaa

SEQ ID NO: 6925951 - DNA, 22 bp, Homo sapiens
actggctgcgttcctgtgagac

SEQ ID NO: 6925952 - DNA, 22 bp, Homo sapiens
cagtacataatgcgcaaaaccg

SEQ ID NO: 6925953 - DNA, 22 bp, Homo sapiens
atgccactgtactcaacaatag

SEQ ID NO: 6925954 - DNA, 22 bp, Homo sapiens
acccagagccagggtcaggagc

SEQ ID NO: 6925955 - DNA, 22 bp, Homo sapiens
gtcagagacaaacttcctctct

SEQ ID NO: 6925956 - DNA, 22 bp, Homo sapiens
agcagtgccgcatcttgtgacc

SEQ ID NO: 6925957 - DNA, 20 bp, Homo sapiens
ggcctgagcatggctggcag

SEQ ID NO: 6925958 - DNA, 20 bp, Homo sapiens
gctcctgtcctggtggaggg

SEQ ID NO: 6925959 - DNA, 22 bp, Homo sapiens
cacccctcgccactgcccttgt

SEQ ID NO: 6925960 - DNA, 22 bp, Homo sapiens
cactgtttttatgtaatcagtg

SEQ ID NO: 6925961 - DNA, 22 bp, Homo sapiens
acagagcccttccttgcaccat

SEQ ID NO: 6925962 - DNA, 22 bp, Homo sapiens
tcagtaaaggctaggttatgct

SEQ ID NO: 6925963 - DNA, 22 bp, Homo sapiens
agggctgacacaccttatcctc

SEQ ID NO: 6925964 - DNA, 22 bp, Homo sapiens
gaggggctcttgggcatgaagg

SEQ ID NO: 6925965 - DNA, 18 bp, Homo sapiens
taagtaaggtcatatggg

SEQ ID NO: 6925966 - DNA, 22 bp, Homo sapiens
ggcagctcctctcagcaaaaga

SEQ ID NO: 6925967 - DNA, 22 bp, Homo sapiens
tgcagcttctctgcaacaggag

SEQ ID NO: 6925968 - DNA, 22 bp, Homo sapiens
agacccagaaagcagctgcatt

SEQ ID NO: 6925969 - DNA, 22 bp, Homo sapiens
tcagaacatttgggactttggg

SEQ ID NO: 6925970 - DNA, 22 bp, Homo sapiens
tagatacagtgttaagtgtgga

SEQ ID NO: 6925971 - DNA, 22 bp, Homo sapiens
tgggtggttatagagatcaact

SEQ ID NO: 6925972 - DNA, 22 bp, Homo sapiens
ctggcaggaaggcatttagaca

SEQ ID NO: 6925973 - DNA, 22 bp, Homo sapiens
aaaagcaagaggctggattaaa

SEQ ID NO: 6925974 - DNA, 21 bp, Homo sapiens
gcagaaaggaatcttaggtcc

SEQ ID NO: 6925975 - DNA, 22 bp, Homo sapiens
ctgcaggaaggggacggagtgg

SEQ ID NO: 6925976 - DNA, 22 bp, Homo sapiens
ctggtgcctcctccctgtgctt

SEQ ID NO: 6925977 - DNA, 22 bp, Homo sapiens
cttccactactcttagatctgc

SEQ ID NO: 6925978 - DNA, 22 bp, Homo sapiens
tgaattcatacagtggatacca

SEQ ID NO: 6925979 - DNA, 22 bp, Homo sapiens
aagttggtcgcaattagtcaca

SEQ ID NO: 6925980 - DNA, 22 bp, Homo sapiens
acctgccctggaggaagatatt

SEQ ID NO: 6925981 - DNA, 22 bp, Homo sapiens
agtggccatggcaggtgagcat

SEQ ID NO: 6925982 - DNA, 22 bp, Homo sapiens
ctctcagaagtttatgtcagaa

SEQ ID NO: 6925983 - DNA, 22 bp, Homo sapiens
gcagttttattatgatggaaat

SEQ ID NO: 6925984 - DNA, 23 bp, Homo sapiens
catttgatcctcacaataaatgg

SEQ ID NO: 6925985 - DNA, 22 bp, Homo sapiens
gccaagaatgtggcatagctta

SEQ ID NO: 6925986 - DNA, 22 bp, Homo sapiens
gtgaggtcctaatagacatcga

SEQ ID NO: 6925987 - DNA, 22 bp, Homo sapiens
ccagccagaagtccgggcttct

SEQ ID NO: 6925988 - DNA, 22 bp, Homo sapiens
ctacagttcttaattaagtagt

SEQ ID NO: 6925989 - DNA, 17 bp, Homo sapiens
tgaaatcagcacccagg

SEQ ID NO: 6925990 - DNA, 22 bp, Homo sapiens
tccagtgtggacccctgcagtc

SEQ ID NO: 6925991 - DNA, 22 bp, Homo sapiens
aactctatttaccctactaaac

SEQ ID NO: 6925992 - DNA, 22 bp, Homo sapiens
atacattattgttaaagaacat

SEQ ID NO: 6925993 - DNA, 22 bp, Homo sapiens
aagtgcagtggcgtgatcttgg

SEQ ID NO: 6925994 - DNA, 22 bp, Homo sapiens
gtgctgttttaagtgttcttat

SEQ ID NO: 6925995 - DNA, 22 bp, Homo sapiens
gattcattctcagtttctagag

SEQ ID NO: 6925996 - DNA, 22 bp, Homo sapiens
tagtagaccaagtatgctctca

SEQ ID NO: 6925997 - DNA, 22 bp, Homo sapiens
tatttgacatggtggatttgct

SEQ ID NO: 6925998 - DNA, 22 bp, Homo sapiens
atgcttccttaccagaagatga

SEQ ID NO: 6925999 - DNA, 22 bp, Homo sapiens
gtttaggaggctaagtggtttg

SEQ ID NO: 6926000 - DNA, 22 bp, Homo sapiens
gtctgggggtccgggtgcctgc

SEQ ID NO: 6926001 - DNA, 22 bp, Homo sapiens
ccagagaaagtgaagcaaatgt

SEQ ID NO: 6926002 - DNA, 22 bp, Homo sapiens
ttctctcttactgccatgctgt

SEQ ID NO: 6926003 - DNA, 22 bp, Homo sapiens
aatgtgtactttttcatgctca

SEQ ID NO: 6926004 - DNA, 22 bp, Homo sapiens
gtgcagttgatagttttagtga

SEQ ID NO: 6926005 - DNA, 22 bp, Homo sapiens
ggcaaagccctgcctggttcaa

SEQ ID NO: 6926006 - DNA, 22 bp, Homo sapiens
tgaatcaatgaattgcacttca

SEQ ID NO: 6926007 - DNA, 21 bp, Homo sapiens
acctttgggtgtttataatag

SEQ ID NO: 6926008 - DNA, 22 bp, Homo sapiens
tgcccagcctaaacttggcaag

SEQ ID NO: 6926009 - DNA, 22 bp, Homo sapiens
tgagctgagtttaaaagctgct

SEQ ID NO: 6926010 - DNA, 22 bp, Homo sapiens
aagcagaatttcccactagttg

SEQ ID NO: 6926011 - DNA, 22 bp, Homo sapiens
aaggattccagttttacttgcc

SEQ ID NO: 6926012 - DNA, 22 bp, Homo sapiens
ttagagaaattctggtaatgta

SEQ ID NO: 6926013 - DNA, 18 bp, Homo sapiens
aaggcacaggagaacatt

SEQ ID NO: 6926014 - DNA, 22 bp, Homo sapiens
gtggtcagcagcagtgggagtg

SEQ ID NO: 6926015 - DNA, 17 bp, Homo sapiens
agtccctaggtcctggg

SEQ ID NO: 6926016 - DNA, 22 bp, Homo sapiens
tttggtatttgatgggggtcct

SEQ ID NO: 6926017 - DNA, 22 bp, Homo sapiens
aggctcaggcaggaatggcgga

SEQ ID NO: 6926018 - DNA, 22 bp, Homo sapiens
ttacagttgcccccagcctcgc

SEQ ID NO: 6926019 - DNA, 22 bp, Homo sapiens
tattcagagggttgaattttta

SEQ ID NO: 6926020 - DNA, 22 bp, Homo sapiens
atgccactgcgctctagcctgg

SEQ ID NO: 6926021 - DNA, 22 bp, Homo sapiens
ctggaaggtgactgtcttgaat

SEQ ID NO: 6926022 - DNA, 22 bp, Homo sapiens
agaatgggggctacaggccaca

SEQ ID NO: 6926023 - DNA, 22 bp, Homo sapiens
gtgtgagagcaaaactgcagga

SEQ ID NO: 6926024 - DNA, 22 bp, Homo sapiens
tgaatgcactgctctcctagga

SEQ ID NO: 6926025 - DNA, 17 bp, Homo sapiens
atgaggtcattaagata

SEQ ID NO: 6926026 - DNA, 22 bp, Homo sapiens
ggggctcagttcggacagcctg

SEQ ID NO: 6926027 - DNA, 22 bp, Homo sapiens
atacatgtttgctggataaaca

SEQ ID NO: 6926028 - DNA, 22 bp, Homo sapiens
ctcagtgtgaatgctcagtaaa

SEQ ID NO: 6926029 - DNA, 22 bp, Homo sapiens
gacaacacatgtatgccactct

SEQ ID NO: 6926030 - DNA, 22 bp, Homo sapiens
cacatgaagattcaactggatg

SEQ ID NO: 6926031 - DNA, 22 bp, Homo sapiens
taggaatgtggcaggcagaaca

SEQ ID NO: 6926032 - DNA, 21 bp, Homo sapiens
tggatttgagcagtgcctcgg

SEQ ID NO: 6926033 - DNA, 18 bp, Homo sapiens
tctggagggaagctttga

SEQ ID NO: 6926034 - DNA, 22 bp, Homo sapiens
gcagcagaagtagaagtacagg

SEQ ID NO: 6926035 - DNA, 19 bp, Homo sapiens
tcaatgcatgaaatcagcc

SEQ ID NO: 6926036 - DNA, 21 bp, Homo sapiens
agctatttcagatttgagagc

SEQ ID NO: 6926037 - DNA, 22 bp, Homo sapiens
cagaggttgagcaaaaatgata

SEQ ID NO: 6926038 - DNA, 22 bp, Homo sapiens
tgtctctgggtgattcagtcct

SEQ ID NO: 6926039 - DNA, 22 bp, Homo sapiens
ttgtggaatgtggctgtcaatt

SEQ ID NO: 6926040 - DNA, 19 bp, Homo sapiens
ctagatccagaaagtggta

SEQ ID NO: 6926041 - DNA, 22 bp, Homo sapiens
tgagcagcaggatcttctggta

SEQ ID NO: 6926042 - DNA, 22 bp, Homo sapiens
tccagtatcaaagtcctagtcc

SEQ ID NO: 6926043 - DNA, 21 bp, Homo sapiens
tccctgagcccaaggggctcc

SEQ ID NO: 6926044 - DNA, 22 bp, Homo sapiens
ttcctcagctggcctgattggg

SEQ ID NO: 6926045 - DNA, 19 bp, Homo sapiens
tccagccctgttccctttt

SEQ ID NO: 6926046 - DNA, 21 bp, Homo sapiens
cctgaaattctcactagctta

SEQ ID NO: 6926047 - DNA, 21 bp, Homo sapiens
cttgtcacttcctcactgacc

SEQ ID NO: 6926048 - DNA, 22 bp, Homo sapiens
ctgttcagcgttggcgttaggg

SEQ ID NO: 6926049 - DNA, 22 bp, Homo sapiens
aatgttcagaggacaatataaa

SEQ ID NO: 6926050 - DNA, 22 bp, Homo sapiens
tcacagaagcatcatacccgga

SEQ ID NO: 6926051 - DNA, 22 bp, Homo sapiens
cgctaggattaggattaatcct

SEQ ID NO: 6926052 - DNA, 19 bp, Homo sapiens
tcaagatggatggctccca

SEQ ID NO: 6926053 - DNA, 22 bp, Homo sapiens
gatggcagcatattgacagcat

SEQ ID NO: 6926054 - DNA, 22 bp, Homo sapiens
atattgggatgtttggaaatgc

SEQ ID NO: 6926055 - DNA, 22 bp, Homo sapiens
tgtggtttactgtggcgctgct

SEQ ID NO: 6926056 - DNA, 22 bp, Homo sapiens
ttggattcctgggaaccatgca

SEQ ID NO: 6926057 - DNA, 19 bp, Homo sapiens
tccctcagtctgccaggcc

SEQ ID NO: 6926058 - DNA, 22 bp, Homo sapiens
ctgaggcatgggaagttgggtg

SEQ ID NO: 6926059 - DNA, 22 bp, Homo sapiens
agtccgtcctgtcaagcagctg

SEQ ID NO: 6926060 - DNA, 22 bp, Homo sapiens
gggtgctcttgggaaacgtagt

SEQ ID NO: 6926061 - DNA, 22 bp, Homo sapiens
cctgctcatgggtccctggcag

SEQ ID NO: 6926062 - DNA, 22 bp, Homo sapiens
catttgttgggacaatgaaaag

SEQ ID NO: 6926063 - DNA, 22 bp, Homo sapiens
ctggtttactctgcactgctca

SEQ ID NO: 6926064 - DNA, 22 bp, Homo sapiens
aacagcttactcaatggtgatt

SEQ ID NO: 6926065 - DNA, 22 bp, Homo sapiens
gccaagaagggccatgtggatt

SEQ ID NO: 6926066 - DNA, 21 bp, Homo sapiens
tgtgcagtccaatgtgctagc

SEQ ID NO: 6926067 - DNA, 22 bp, Homo sapiens
tcttttatctgttgtgtaacaa

SEQ ID NO: 6926068 - DNA, 22 bp, Homo sapiens
gatatacagagcattctttgat

SEQ ID NO: 6926069 - DNA, 18 bp, Homo sapiens
tcctttctccctcatctt

SEQ ID NO: 6926070 - DNA, 22 bp, Homo sapiens
taaattctacaacttcaaagat

SEQ ID NO: 6926071 - DNA, 22 bp, Homo sapiens
cagtctctgtgccagatcctgg

SEQ ID NO: 6926072 - DNA, 18 bp, Homo sapiens
cctgcagcccaggaggcc

SEQ ID NO: 6926073 - DNA, 22 bp, Homo sapiens
agtgcagttaggatggggaatt

SEQ ID NO: 6926074 - DNA, 22 bp, Homo sapiens
tcactgatttgcccttatcctg

SEQ ID NO: 6926075 - DNA, 22 bp, Homo sapiens
ccaaggggattgcagaagcagc

SEQ ID NO: 6926076 - DNA, 22 bp, Homo sapiens
gactttggagcagctacttcct

SEQ ID NO: 6926077 - DNA, 22 bp, Homo sapiens
tatctgttgtagtacagatgat

SEQ ID NO: 6926078 - DNA, 22 bp, Homo sapiens
gaattcacttgtcttccatttt

SEQ ID NO: 6926079 - DNA, 22 bp, Homo sapiens
aggcaataggttcctcatcttt

SEQ ID NO: 6926080 - DNA, 22 bp, Homo sapiens
ggagagcctccacggcttctgt

SEQ ID NO: 6926081 - DNA, 22 bp, Homo sapiens
ctttcagttaatgactccatag

SEQ ID NO: 6926082 - DNA, 22 bp, Homo sapiens
tcccaaaaaaggtatgttgaag

SEQ ID NO: 6926083 - DNA, 22 bp, Homo sapiens
atatgcatgtacgtgtgcacaa

SEQ ID NO: 6926084 - DNA, 22 bp, Homo sapiens
tagatcagtgcataaaggaatg

SEQ ID NO: 6926085 - DNA, 17 bp, Homo sapiens
ccagatgccctgtctcc

SEQ ID NO: 6926086 - DNA, 22 bp, Homo sapiens
aggaatgattcaagacttggct

SEQ ID NO: 6926087 - DNA, 22 bp, Homo sapiens
tggctgctgctcactcagcctc

SEQ ID NO: 6926088 - DNA, 22 bp, Homo sapiens
agttctttctagacacgtagac

SEQ ID NO: 6926089 - DNA, 22 bp, Homo sapiens
agggctgccccagtccagccgg

SEQ ID NO: 6926090 - DNA, 22 bp, Homo sapiens
ccaggggctgcagatccatggt

SEQ ID NO: 6926091 - DNA, 22 bp, Homo sapiens
gcacagaagagctttggaatga

SEQ ID NO: 6926092 - DNA, 22 bp, Homo sapiens
aaccagcactgctggggcctgc

SEQ ID NO: 6926093 - DNA, 22 bp, Homo sapiens
tagatgaccttgtgttaggcaa

SEQ ID NO: 6926094 - DNA, 22 bp, Homo sapiens
agtcagagtcgccgacagtcaa

SEQ ID NO: 6926095 - DNA, 22 bp, Homo sapiens
aagtcagagatcaaggtgtcta

SEQ ID NO: 6926096 - DNA, 19 bp, Homo sapiens
ctgctgaattagctctgga

SEQ ID NO: 6926097 - DNA, 22 bp, Homo sapiens
gttccaaagtctctgagctgag

SEQ ID NO: 6926098 - DNA, 22 bp, Homo sapiens
gcccttacagggtggtcagcca

SEQ ID NO: 6926099 - DNA, 22 bp, Homo sapiens
taagaaacatttttatgacagt

SEQ ID NO: 6926100 - DNA, 22 bp, Homo sapiens
attccacaagaccataaattag

SEQ ID NO: 6926101 - DNA, 22 bp, Homo sapiens
ggcccaggctggagtgcagtgg

SEQ ID NO: 6926102 - DNA, 22 bp, Homo sapiens
gggctccaactacatcagcctt

SEQ ID NO: 6926103 - DNA, 19 bp, Homo sapiens
ttccagtagattagatagc

SEQ ID NO: 6926104 - DNA, 22 bp, Homo sapiens
actcaggaagaaagcagctggt

SEQ ID NO: 6926105 - DNA, 23 bp, Homo sapiens
tcctaactcaattcaggggtgtc

SEQ ID NO: 6926106 - DNA, 22 bp, Homo sapiens
cttgagctctcagccactagct

SEQ ID NO: 6926107 - DNA, 19 bp, Homo sapiens
tggcagaggcagtttgtac

SEQ ID NO: 6926108 - DNA, 20 bp, Homo sapiens
caggcctctgggggccctgg

SEQ ID NO: 6926109 - DNA, 22 bp, Homo sapiens
gactttatcttgtccttcctgc

SEQ ID NO: 6926110 - DNA, 21 bp, Homo sapiens
gccactgcactccagcctggg

SEQ ID NO: 6926111 - DNA, 22 bp, Homo sapiens
gcagcaagaggtgccatcttga

SEQ ID NO: 6926112 - DNA, 22 bp, Homo sapiens
gggagctatgacactagcacca

SEQ ID NO: 6926113 - DNA, 22 bp, Homo sapiens
tgtgatcttagacaactcactg

SEQ ID NO: 6926114 - DNA, 22 bp, Homo sapiens
gtgagaaaattgcctaattttg

SEQ ID NO: 6926115 - DNA, 22 bp, Homo sapiens
ctgacctgcccttaggcttctc

SEQ ID NO: 6926116 - DNA, 22 bp, Homo sapiens
ctcagagtctgcatttctgtca

SEQ ID NO: 6926117 - DNA, 22 bp, Homo sapiens
tttttgttctgattatactggt

SEQ ID NO: 6926118 - DNA, 22 bp, Homo sapiens
gatcaataagaactggccctaa

SEQ ID NO: 6926119 - DNA, 22 bp, Homo sapiens
tccttcactccctctgcatcca

SEQ ID NO: 6926120 - DNA, 20 bp, Homo sapiens
atctttggctcagaagcctt

SEQ ID NO: 6926121 - DNA, 22 bp, Homo sapiens
cttcatggtaaatctgccttta

SEQ ID NO: 6926122 - DNA, 22 bp, Homo sapiens
ctcagcttctacctcctgagtg

SEQ ID NO: 6926123 - DNA, 22 bp, Homo sapiens
caggatgaggtagaggcagata

SEQ ID NO: 6926124 - DNA, 22 bp, Homo sapiens
acagataattagcataaatgct

SEQ ID NO: 6926125 - DNA, 22 bp, Homo sapiens
attcttcttgagtcttggactc

SEQ ID NO: 6926126 - DNA, 22 bp, Homo sapiens
aagttcttgagccctattctag

SEQ ID NO: 6926127 - DNA, 20 bp, Homo sapiens
gaatgcacacaactgctttc

SEQ ID NO: 6926128 - DNA, 21 bp, Homo sapiens
tcagggaagtgtgcagaaggg

SEQ ID NO: 6926129 - DNA, 22 bp, Homo sapiens
cactgagaggtctcatttccaa

SEQ ID NO: 6926130 - DNA, 22 bp, Homo sapiens
ggcagctgagatcatgctgttg

SEQ ID NO: 6926131 - DNA, 22 bp, Homo sapiens
cacagtggattgggtgatgccc

SEQ ID NO: 6926132 - DNA, 22 bp, Homo sapiens
ggcctgatgtgggatcctctgc

SEQ ID NO: 6926133 - DNA, 22 bp, Homo sapiens
atttgtcagtggaagtgattca

SEQ ID NO: 6926134 - DNA, 22 bp, Homo sapiens
agtgtcatgaatcaaagattat

SEQ ID NO: 6926135 - DNA, 19 bp, Homo sapiens
gtccctgggcagaggcacc

SEQ ID NO: 6926136 - DNA, 22 bp, Homo sapiens
ttgagcatttgttttgaaagag

SEQ ID NO: 6926137 - DNA, 22 bp, Homo sapiens
tgtcagggctggacacagctgc

SEQ ID NO: 6926138 - DNA, 21 bp, Homo sapiens
ttcttggcaggtgtatcataa

SEQ ID NO: 6926139 - DNA, 22 bp, Homo sapiens
tgcatttgttaccttattgcag

SEQ ID NO: 6926140 - DNA, 23 bp, Homo sapiens
gggaagctccatggaggtgctgg

SEQ ID NO: 6926141 - DNA, 23 bp, Homo sapiens
agaggctgcagggtattgagaat

SEQ ID NO: 6926142 - DNA, 22 bp, Homo sapiens
gtcctgtgtgacttcccaaatg

SEQ ID NO: 6926143 - DNA, 22 bp, Homo sapiens
gagaaacaacacttgatgcctt

SEQ ID NO: 6926144 - DNA, 22 bp, Homo sapiens
ttccagagcagttttcagatca

SEQ ID NO: 6926145 - DNA, 22 bp, Homo sapiens
atttgcaagcatgcacaaaagc

SEQ ID NO: 6926146 - DNA, 22 bp, Homo sapiens
ttgccatttcgtaagccgggag

SEQ ID NO: 6926147 - DNA, 20 bp, Homo sapiens
atatgctaatttttagtggg

SEQ ID NO: 6926148 - DNA, 22 bp, Homo sapiens
tttgactctagtcatagaagtg

SEQ ID NO: 6926149 - DNA, 22 bp, Homo sapiens
atacaaatcctctgggatggta

SEQ ID NO: 6926150 - DNA, 22 bp, Homo sapiens
tcagaatgtgcagaggaacagt

SEQ ID NO: 6926151 - DNA, 22 bp, Homo sapiens
actctgccctaggcctctgggg

SEQ ID NO: 6926152 - DNA, 22 bp, Homo sapiens
aatgaacaagagagagaacttt

SEQ ID NO: 6926153 - DNA, 22 bp, Homo sapiens
caggtttacaaagtaaagtgtg

SEQ ID NO: 6926154 - DNA, 22 bp, Homo sapiens
atggagttctgccagcgctgct

SEQ ID NO: 6926155 - DNA, 22 bp, Homo sapiens
ttagcaccttaactgtggagat

SEQ ID NO: 6926156 - DNA, 22 bp, Homo sapiens
aaactagctgcaggcagtcatg

SEQ ID NO: 6926157 - DNA, 22 bp, Homo sapiens
atgtgtaaattgttaggtttaa

SEQ ID NO: 6926158 - DNA, 22 bp, Homo sapiens
aagtaacatctgaacatgatgt

SEQ ID NO: 6926159 - DNA, 22 bp, Homo sapiens
atacagattgctatacttacaa

SEQ ID NO: 6926160 - DNA, 22 bp, Homo sapiens
acacaaaatcaaagtcctaggc

SEQ ID NO: 6926161 - DNA, 22 bp, Homo sapiens
tggaggaaaaaaccaggcagag

SEQ ID NO: 6926162 - DNA, 22 bp, Homo sapiens
atacagaagacccctccgtcat

SEQ ID NO: 6926163 - DNA, 22 bp, Homo sapiens
tgtgttcaatccctagtctcag

SEQ ID NO: 6926164 - DNA, 22 bp, Homo sapiens
ttcattgatgtggtttaatgta

SEQ ID NO: 6926165 - DNA, 22 bp, Homo sapiens
ccctggcaaaatccctggtaca

SEQ ID NO: 6926166 - DNA, 22 bp, Homo sapiens
tagccaaagtagctgttatagc

SEQ ID NO: 6926167 - DNA, 22 bp, Homo sapiens
ctcagtcttctcctccaatgga

SEQ ID NO: 6926168 - DNA, 22 bp, Homo sapiens
ttaggcttttttaaagcacaga

SEQ ID NO: 6926169 - DNA, 22 bp, Homo sapiens
tctgctgtcactcatttgcttc

SEQ ID NO: 6926170 - DNA, 22 bp, Homo sapiens
taggtacagctaaaaattatct

SEQ ID NO: 6926171 - DNA, 22 bp, Homo sapiens
tcagaatttaaaatgtgtagat

SEQ ID NO: 6926172 - DNA, 22 bp, Homo sapiens
ctacagaattcaacaaatggtt

SEQ ID NO: 6926173 - DNA, 19 bp, Homo sapiens
ctctggagtcattgctccc

SEQ ID NO: 6926174 - DNA, 22 bp, Homo sapiens
tgcaggacattagttatgaatt

SEQ ID NO: 6926175 - DNA, 20 bp, Homo sapiens
tagatgctgccataagattc

SEQ ID NO: 6926176 - DNA, 22 bp, Homo sapiens
gaaggcttttctaccagatctt

SEQ ID NO: 6926177 - DNA, 22 bp, Homo sapiens
cgcaggtgggcccttcattgat

SEQ ID NO: 6926178 - DNA, 22 bp, Homo sapiens
tctggcagttgccgcttcagtc

SEQ ID NO: 6926179 - DNA, 21 bp, Homo sapiens
tctttgcatcagttgttttct

SEQ ID NO: 6926180 - DNA, 22 bp, Homo sapiens
gccagagggattcctggtgtgt

SEQ ID NO: 6926181 - DNA, 22 bp, Homo sapiens
acatgtaacatatatgtagcat

SEQ ID NO: 6926182 - DNA, 22 bp, Homo sapiens
gtctcagtttgaagtgatgcca

SEQ ID NO: 6926183 - DNA, 22 bp, Homo sapiens
gtttggtcatttgtaaaatgtg

SEQ ID NO: 6926184 - DNA, 22 bp, Homo sapiens
caagatttgtattgggcctctg

SEQ ID NO: 6926185 - DNA, 23 bp, Homo sapiens
tgtaggtctgccttatctgctgc

SEQ ID NO: 6926186 - DNA, 22 bp, Homo sapiens
acagagtgtttttaagtatatt

SEQ ID NO: 6926187 - DNA, 22 bp, Homo sapiens
tctttgggctaggagtttggat

SEQ ID NO: 6926188 - DNA, 22 bp, Homo sapiens
tttaatgggatccatctggtta

SEQ ID NO: 6926189 - DNA, 22 bp, Homo sapiens
ctctgggagaggacacttggag

SEQ ID NO: 6926190 - DNA, 22 bp, Homo sapiens
taagttctcaatacattgtagc

SEQ ID NO: 6926191 - DNA, 22 bp, Homo sapiens
taaggtttggctgtctcttggt

SEQ ID NO: 6926192 - DNA, 22 bp, Homo sapiens
aggctggacccgacacctgccc

SEQ ID NO: 6926193 - DNA, 22 bp, Homo sapiens
tgagcgtgcagtagtgttggta

SEQ ID NO: 6926194 - DNA, 22 bp, Homo sapiens
taattgttttcaatgttaatga

SEQ ID NO: 6926195 - DNA, 22 bp, Homo sapiens
gagtgctgtatctgagaaagca

SEQ ID NO: 6926196 - DNA, 22 bp, Homo sapiens
tggatctcggcaatgcgggact

SEQ ID NO: 6926197 - DNA, 22 bp, Homo sapiens
agctttgcacaacagagaggtg

SEQ ID NO: 6926198 - DNA, 22 bp, Homo sapiens
cagcctttgtgaacatcaggtg

SEQ ID NO: 6926199 - DNA, 22 bp, Homo sapiens
cttcatctttctgagcctcagt

SEQ ID NO: 6926200 - DNA, 22 bp, Homo sapiens
agcaactagccaggatgcagag

SEQ ID NO: 6926201 - DNA, 22 bp, Homo sapiens
tactgaaagaatacataatttc

SEQ ID NO: 6926202 - DNA, 22 bp, Homo sapiens
acttgcatgtcaggaaattaac

SEQ ID NO: 6926203 - DNA, 22 bp, Homo sapiens
acaaagtaggaagattagctga

SEQ ID NO: 6926204 - DNA, 22 bp, Homo sapiens
ggacctgatgtttagtcttgtt

SEQ ID NO: 6926205 - DNA, 23 bp, Homo sapiens
tgagatctacagatctcagatct

SEQ ID NO: 6926206 - DNA, 22 bp, Homo sapiens
aagtgacacatttgtgatgaat

SEQ ID NO: 6926207 - DNA, 22 bp, Homo sapiens
taggctttggaagatcaagcaa

SEQ ID NO: 6926208 - DNA, 22 bp, Homo sapiens
caagcaccatgtgctccatgtt

SEQ ID NO: 6926209 - DNA, 22 bp, Homo sapiens
ggaaatctggtggtagatggga

SEQ ID NO: 6926210 - DNA, 22 bp, Homo sapiens
cttggagctcccgcactgatta

SEQ ID NO: 6926211 - DNA, 22 bp, Homo sapiens
actcagagttttacccagagac

SEQ ID NO: 6926212 - DNA, 22 bp, Homo sapiens
gcagtggcatgatgtgggctca

SEQ ID NO: 6926213 - DNA, 22 bp, Homo sapiens
agagcccaggtcctggagaggg

SEQ ID NO: 6926214 - DNA, 22 bp, Homo sapiens
aacaataggagtgatgcagtat

SEQ ID NO: 6926215 - DNA, 22 bp, Homo sapiens
cactgtttggctcctgtactta

SEQ ID NO: 6926216 - DNA, 22 bp, Homo sapiens
gacacaggtagaataaagtact

SEQ ID NO: 6926217 - DNA, 22 bp, Homo sapiens
ctccctcagaggagcacctgtt

SEQ ID NO: 6926218 - DNA, 22 bp, Homo sapiens
tgtgcctaatgtttccattttc

SEQ ID NO: 6926219 - DNA, 22 bp, Homo sapiens
aaatgtctttcttctgctacgt

SEQ ID NO: 6926220 - DNA, 17 bp, Homo sapiens
tgcgatgtctgtgtttg

SEQ ID NO: 6926221 - DNA, 22 bp, Homo sapiens
gctggcctgcaaagcccggctg

SEQ ID NO: 6926222 - DNA, 22 bp, Homo sapiens
cagaaattcccatttcagattc

SEQ ID NO: 6926223 - DNA, 22 bp, Homo sapiens
taaacatcagtacaaagactaa

SEQ ID NO: 6926224 - DNA, 22 bp, Homo sapiens
ttctaagctctgaaataaatct

SEQ ID NO: 6926225 - DNA, 22 bp, Homo sapiens
tggctatgcaatttaggagttc

SEQ ID NO: 6926226 - DNA, 22 bp, Homo sapiens
agtggctctccaagaagtcaca

SEQ ID NO: 6926227 - DNA, 22 bp, Homo sapiens
taggccaagttgatcagacatc

SEQ ID NO: 6926228 - DNA, 22 bp, Homo sapiens
attgtttacactaacttcataa

SEQ ID NO: 6926229 - DNA, 22 bp, Homo sapiens
ttcccacagttcagaacaaagg

SEQ ID NO: 6926230 - DNA, 22 bp, Homo sapiens
ttctagttttcagtccaccagg

SEQ ID NO: 6926231 - DNA, 19 bp, Homo sapiens
tggtggaggtgcacctgac

SEQ ID NO: 6926232 - DNA, 22 bp, Homo sapiens
ttggaaggaagaaccgcggtag

SEQ ID NO: 6926233 - DNA, 22 bp, Homo sapiens
atgaggttcagtgtttatttcc

SEQ ID NO: 6926234 - DNA, 22 bp, Homo sapiens
tggagaaagctgcatatggaaa

SEQ ID NO: 6926235 - DNA, 22 bp, Homo sapiens
catggctggcacacagcaacca

SEQ ID NO: 6926236 - DNA, 22 bp, Homo sapiens
ttctggtagcctcaaatttgag

SEQ ID NO: 6926237 - DNA, 22 bp, Homo sapiens
ggaggcttcctggctcttgatt

SEQ ID NO: 6926238 - DNA, 22 bp, Homo sapiens
gccctctgttttgtaagcaacg

SEQ ID NO: 6926239 - DNA, 20 bp, Homo sapiens
tgggtgaagacagctgtagc

SEQ ID NO: 6926240 - DNA, 22 bp, Homo sapiens
tgtgctgggaaatggcaggata

SEQ ID NO: 6926241 - DNA, 22 bp, Homo sapiens
acctgctttgtagtgtttgctg

SEQ ID NO: 6926242 - DNA, 22 bp, Homo sapiens
tcctctgggctccctgcaacag

SEQ ID NO: 6926243 - DNA, 20 bp, Homo sapiens
cagcaaaatgaaaatggatt

SEQ ID NO: 6926244 - DNA, 22 bp, Homo sapiens
aggcttatagcttatatttaag

SEQ ID NO: 6926245 - DNA, 22 bp, Homo sapiens
ttaacagatgtttatggagcat

SEQ ID NO: 6926246 - DNA, 22 bp, Homo sapiens
agtccagtctcttctggtgagt

SEQ ID NO: 6926247 - DNA, 22 bp, Homo sapiens
cttctgaagtgtttgatgattg

SEQ ID NO: 6926248 - DNA, 22 bp, Homo sapiens
tttagggatgtcagaacaggga

SEQ ID NO: 6926249 - DNA, 22 bp, Homo sapiens
cagatggagtcccgtggagttc

SEQ ID NO: 6926250 - DNA, 21 bp, Homo sapiens
atgaggcatgagagggtttct

SEQ ID NO: 6926251 - DNA, 22 bp, Homo sapiens
ggaccacattgagagtcattaa

SEQ ID NO: 6926252 - DNA, 22 bp, Homo sapiens
ggcacatggagacttggcatca

SEQ ID NO: 6926253 - DNA, 23 bp, Homo sapiens
cagaaataaactggtttgtagat

SEQ ID NO: 6926254 - DNA, 22 bp, Homo sapiens
agttataggtggttttgagaat

SEQ ID NO: 6926255 - DNA, 22 bp, Homo sapiens
agtgtgcccagtaattggctga

SEQ ID NO: 6926256 - DNA, 22 bp, Homo sapiens
ttgtacttgccatagaacaaca

SEQ ID NO: 6926257 - DNA, 22 bp, Homo sapiens
gacatgtgctgtctcttaaatt

SEQ ID NO: 6926258 - DNA, 22 bp, Homo sapiens
gattatggtagaaacaagaagt

SEQ ID NO: 6926259 - DNA, 22 bp, Homo sapiens
aatatcttctaaggatagaact

SEQ ID NO: 6926260 - DNA, 22 bp, Homo sapiens
cagaggccagggggctcacaaa

SEQ ID NO: 6926261 - DNA, 22 bp, Homo sapiens
gcagctgggccccagcctctcc

SEQ ID NO: 6926262 - DNA, 22 bp, Homo sapiens
ttttacaggtgaaaaatgaaga

SEQ ID NO: 6926263 - DNA, 22 bp, Homo sapiens
agtgactcacacaaacatgtgt

SEQ ID NO: 6926264 - DNA, 22 bp, Homo sapiens
gtgccttttcttcatagttact

SEQ ID NO: 6926265 - DNA, 20 bp, Homo sapiens
gaacctctcccagcccctgg

SEQ ID NO: 6926266 - DNA, 20 bp, Homo sapiens
tcccagtcagccagagtgag

SEQ ID NO: 6926267 - DNA, 22 bp, Homo sapiens
acacaagaataatgatgaaggt

SEQ ID NO: 6926268 - DNA, 22 bp, Homo sapiens
atctgaaatagtcttatctgag

SEQ ID NO: 6926269 - DNA, 22 bp, Homo sapiens
acagtctggaggctgcttcatt

SEQ ID NO: 6926270 - DNA, 20 bp, Homo sapiens
ggtacaacttgaatgataac

SEQ ID NO: 6926271 - DNA, 22 bp, Homo sapiens
gagctctttgaacctgggcagt

SEQ ID NO: 6926272 - DNA, 22 bp, Homo sapiens
agtcagctgcagcagctttggt

SEQ ID NO: 6926273 - DNA, 22 bp, Homo sapiens
tcttccagctgtaggacctagg

SEQ ID NO: 6926274 - DNA, 17 bp, Homo sapiens
ggcagggtgctgggtat

SEQ ID NO: 6926275 - DNA, 22 bp, Homo sapiens
gcagggacctcactacccccag

SEQ ID NO: 6926276 - DNA, 22 bp, Homo sapiens
gagtggagatcgtgccactgca

SEQ ID NO: 6926277 - DNA, 16 bp, Homo sapiens
gtctttattcacttag

SEQ ID NO: 6926278 - DNA, 19 bp, Homo sapiens
ttcctggctcttctgtttt

SEQ ID NO: 6926279 - DNA, 22 bp, Homo sapiens
gagagccctacaaggcgttttg

SEQ ID NO: 6926280 - DNA, 22 bp, Homo sapiens
accctgccctctccagctcagg

SEQ ID NO: 6926281 - DNA, 22 bp, Homo sapiens
tcccaggaggtgcttcctagga

SEQ ID NO: 6926282 - DNA, 22 bp, Homo sapiens
ttgggacaagagatagctctga

SEQ ID NO: 6926283 - DNA, 22 bp, Homo sapiens
aatgaagcagttttcatcaagt

SEQ ID NO: 6926284 - DNA, 22 bp, Homo sapiens
ctgggctgaaagtgttccttga

SEQ ID NO: 6926285 - DNA, 22 bp, Homo sapiens
taatcatatgggtaatccaatg

SEQ ID NO: 6926286 - DNA, 22 bp, Homo sapiens
tccagggtgtgtttactggggt

SEQ ID NO: 6926287 - DNA, 22 bp, Homo sapiens
agagccctggagggcagtcccg

SEQ ID NO: 6926288 - DNA, 22 bp, Homo sapiens
ctctaccttcctgtccactgaa

SEQ ID NO: 6926289 - DNA, 22 bp, Homo sapiens
tagatgtatcttctcttatcgt

SEQ ID NO: 6926290 - DNA, 22 bp, Homo sapiens
aggacacaccaggtccagctgt

SEQ ID NO: 6926291 - DNA, 23 bp, Homo sapiens
ccaggctaaatgttagagtctga

SEQ ID NO: 6926292 - DNA, 22 bp, Homo sapiens
actcctgggttctaaatttgaa

SEQ ID NO: 6926293 - DNA, 22 bp, Homo sapiens
aagctggatgtaggatccccct

SEQ ID NO: 6926294 - DNA, 22 bp, Homo sapiens
catttggaccaaaatagccaac

SEQ ID NO: 6926295 - DNA, 22 bp, Homo sapiens
ggactgtctactaacaagaagc

SEQ ID NO: 6926296 - DNA, 22 bp, Homo sapiens
atacttcctgcttccctgatct

SEQ ID NO: 6926297 - DNA, 22 bp, Homo sapiens
agaaagtttgagaactgtagat

SEQ ID NO: 6926298 - DNA, 22 bp, Homo sapiens
aaccatgtactttattctgttt

SEQ ID NO: 6926299 - DNA, 22 bp, Homo sapiens
gttcttaaagattcatcaagca

SEQ ID NO: 6926300 - DNA, 22 bp, Homo sapiens
tggagagtaaatggcagaatca

SEQ ID NO: 6926301 - DNA, 22 bp, Homo sapiens
ctcccaggtgtcccttctgcca

SEQ ID NO: 6926302 - DNA, 22 bp, Homo sapiens
tagggtagtaccatgctgccag

SEQ ID NO: 6926303 - DNA, 22 bp, Homo sapiens
gcaaaggcttcttttattctcc

SEQ ID NO: 6926304 - DNA, 22 bp, Homo sapiens
aaggcaatttcagggctctcta

SEQ ID NO: 6926305 - DNA, 22 bp, Homo sapiens
gggaaactcaggcatttccact

SEQ ID NO: 6926306 - DNA, 22 bp, Homo sapiens
aagagttttctctgatggcatt

SEQ ID NO: 6926307 - DNA, 18 bp, Homo sapiens
tcctgcctgcgggctccc

SEQ ID NO: 6926308 - DNA, 20 bp, Homo sapiens
ggcttcactctgcaccacca

SEQ ID NO: 6926309 - DNA, 22 bp, Homo sapiens
ccgcccacactaaatatgagcg

SEQ ID NO: 6926310 - DNA, 22 bp, Homo sapiens
gcccatggtccaggaagacaga

SEQ ID NO: 6926311 - DNA, 22 bp, Homo sapiens
ccgaggcagggtggagccgcct

SEQ ID NO: 6926312 - DNA, 22 bp, Homo sapiens
agagttcagctactgcaaatgt

SEQ ID NO: 6926313 - DNA, 22 bp, Homo sapiens
tgccaggcaggaccctagaacc

SEQ ID NO: 6926314 - DNA, 22 bp, Homo sapiens
gctttggagtcagaaagaccta

SEQ ID NO: 6926315 - DNA, 22 bp, Homo sapiens
ctcttgaagggcatctgagtta

SEQ ID NO: 6926316 - DNA, 22 bp, Homo sapiens
atgcaacaatgtatttatgtat

SEQ ID NO: 6926317 - DNA, 23 bp, Homo sapiens
tccctgagctggagagactgcac

SEQ ID NO: 6926318 - DNA, 22 bp, Homo sapiens
agtctgcaggaccgcgtcacat

SEQ ID NO: 6926319 - DNA, 22 bp, Homo sapiens
tcacccaggctggtatgcagtg

SEQ ID NO: 6926320 - DNA, 22 bp, Homo sapiens
cctggaccaaacactggcctgg

SEQ ID NO: 6926321 - DNA, 20 bp, Homo sapiens
cccatgcatcttcacaacct

SEQ ID NO: 6926322 - DNA, 22 bp, Homo sapiens
tccctgggaattaatatttgga

SEQ ID NO: 6926323 - DNA, 22 bp, Homo sapiens
acatctttgctcttatagagct

SEQ ID NO: 6926324 - DNA, 22 bp, Homo sapiens
gacagaactcaaacatgagaag

SEQ ID NO: 6926325 - DNA, 22 bp, Homo sapiens
tggcaattgtccactgtctgcc

SEQ ID NO: 6926326 - DNA, 22 bp, Homo sapiens
agcagtaagacttttttctgtg

SEQ ID NO: 6926327 - DNA, 20 bp, Homo sapiens
gctgaaggggtgggtttgtt

SEQ ID NO: 6926328 - DNA, 22 bp, Homo sapiens
aggagccaaattttagactctg

SEQ ID NO: 6926329 - DNA, 22 bp, Homo sapiens
cagggctttgtaatatgagcac

SEQ ID NO: 6926330 - DNA, 22 bp, Homo sapiens
catcatactgtttacactcaaa

SEQ ID NO: 6926331 - DNA, 22 bp, Homo sapiens
aggcagctttctggtgcaccat

SEQ ID NO: 6926332 - DNA, 21 bp, Homo sapiens
ctgatcccaaacctctgccct

SEQ ID NO: 6926333 - DNA, 22 bp, Homo sapiens
agtgcttagttccatgctggaa

SEQ ID NO: 6926334 - DNA, 22 bp, Homo sapiens
aggaagtcagctgccatgctgt

SEQ ID NO: 6926335 - DNA, 22 bp, Homo sapiens
acagtttgagaaccactagcct

SEQ ID NO: 6926336 - DNA, 22 bp, Homo sapiens
gaggctctttaaatcttttgga

SEQ ID NO: 6926337 - DNA, 22 bp, Homo sapiens
agctcaggtagactcagcatct

SEQ ID NO: 6926338 - DNA, 22 bp, Homo sapiens
ctggctggttactatttctggt

SEQ ID NO: 6926339 - DNA, 22 bp, Homo sapiens
acatttgagcatatttcttgtc

SEQ ID NO: 6926340 - DNA, 21 bp, Homo sapiens
tcttttaacaccaggaattcc

SEQ ID NO: 6926341 - DNA, 22 bp, Homo sapiens
tgagtaattcacaaaacagatg

SEQ ID NO: 6926342 - DNA, 22 bp, Homo sapiens
tgggggagattagagcttctta

SEQ ID NO: 6926343 - DNA, 22 bp, Homo sapiens
gcacacatatatatgagcatgt

SEQ ID NO: 6926344 - DNA, 22 bp, Homo sapiens
gtctggtcctcttcacagtggc

SEQ ID NO: 6926345 - DNA, 22 bp, Homo sapiens
actgcaagaatggtaatatttg

SEQ ID NO: 6926346 - DNA, 22 bp, Homo sapiens
agggaaaggctgatgctgtggg

SEQ ID NO: 6926347 - DNA, 22 bp, Homo sapiens
tcatggacgatgccgtgtacgt

SEQ ID NO: 6926348 - DNA, 22 bp, Homo sapiens
ttccatttttctaactctcaga

SEQ ID NO: 6926349 - DNA, 22 bp, Homo sapiens
agagctccaagaagtcctgcag

SEQ ID NO: 6926350 - DNA, 22 bp, Homo sapiens
tggtctgcatttattcaagact

SEQ ID NO: 6926351 - DNA, 22 bp, Homo sapiens
ggcaataaaagtatccagtttc

SEQ ID NO: 6926352 - DNA, 22 bp, Homo sapiens
ttaccttgtaaaacatattcct

SEQ ID NO: 6926353 - DNA, 22 bp, Homo sapiens
ttctagatatctagtgtataac

SEQ ID NO: 6926354 - DNA, 16 bp, Homo sapiens
ccttttctcatctcta

SEQ ID NO: 6926355 - DNA, 22 bp, Homo sapiens
aagaacatacagtggcggagtc

SEQ ID NO: 6926356 - DNA, 22 bp, Homo sapiens
gagctttggtgccaagtatttg

SEQ ID NO: 6926357 - DNA, 22 bp, Homo sapiens
agagatggtagaacagtcataa

SEQ ID NO: 6926358 - DNA, 22 bp, Homo sapiens
ctgtgggagaggtgcctggatt

SEQ ID NO: 6926359 - DNA, 22 bp, Homo sapiens
tggctctcagctcccagcagcc

SEQ ID NO: 6926360 - DNA, 22 bp, Homo sapiens
cccaggctgcgtatccacaata

SEQ ID NO: 6926361 - DNA, 22 bp, Homo sapiens
ggggctgctggtatttccagtt

SEQ ID NO: 6926362 - DNA, 22 bp, Homo sapiens
tcagatggaaaggttactgtcc

SEQ ID NO: 6926363 - DNA, 22 bp, Homo sapiens
tcaacactctttggcacagtta

SEQ ID NO: 6926364 - DNA, 22 bp, Homo sapiens
aggcttcaccagactcttaatc

SEQ ID NO: 6926365 - DNA, 19 bp, Homo sapiens
tggggatgctgatgaccaa

SEQ ID NO: 6926366 - DNA, 22 bp, Homo sapiens
tgacccaagggcttagcagttt

SEQ ID NO: 6926367 - DNA, 22 bp, Homo sapiens
gaggcagtgcattgtctagggg

SEQ ID NO: 6926368 - DNA, 22 bp, Homo sapiens
tttctgatattcatttagaaga

SEQ ID NO: 6926369 - DNA, 22 bp, Homo sapiens
agctcccagagctcgagagtaa

SEQ ID NO: 6926370 - DNA, 22 bp, Homo sapiens
acagatactataatgtaaagtg

SEQ ID NO: 6926371 - DNA, 22 bp, Homo sapiens
gatttcctaatgtggatctctg

SEQ ID NO: 6926372 - DNA, 22 bp, Homo sapiens
tggcattgtagggtgtttagcg

SEQ ID NO: 6926373 - DNA, 22 bp, Homo sapiens
tctctgggtattcactgccttc

SEQ ID NO: 6926374 - DNA, 22 bp, Homo sapiens
atagaataaggcacagattctt

SEQ ID NO: 6926375 - DNA, 22 bp, Homo sapiens
taagataatccattataatgtt

SEQ ID NO: 6926376 - DNA, 22 bp, Homo sapiens
aattcagttggcaaacatgctg

SEQ ID NO: 6926377 - DNA, 17 bp, Homo sapiens
atcagtagcatatcaga

SEQ ID NO: 6926378 - DNA, 20 bp, Homo sapiens
tctctcacgggttggtttct

SEQ ID NO: 6926379 - DNA, 21 bp, Homo sapiens
ggaaatgtggtctttacttct

SEQ ID NO: 6926380 - DNA, 22 bp, Homo sapiens
agcaatcagcttctttgtgttt

SEQ ID NO: 6926381 - DNA, 22 bp, Homo sapiens
tagcatggggagcagaaagtca

SEQ ID NO: 6926382 - DNA, 22 bp, Homo sapiens
taatagaatagtggaaacattg

SEQ ID NO: 6926383 - DNA, 22 bp, Homo sapiens
aactgcaattacttttgcacta

SEQ ID NO: 6926384 - DNA, 22 bp, Homo sapiens
ttttctaactttacactcgaaa

SEQ ID NO: 6926385 - DNA, 22 bp, Homo sapiens
aaactgaaacatcatcatgttg

SEQ ID NO: 6926386 - DNA, 22 bp, Homo sapiens
agaggcactgttcttagcgact

SEQ ID NO: 6926387 - DNA, 22 bp, Homo sapiens
aacacagttttccaaaatagag

SEQ ID NO: 6926388 - DNA, 19 bp, Homo sapiens
atctgccttagtgctgctg

SEQ ID NO: 6926389 - DNA, 22 bp, Homo sapiens
tgtggctgtgccgtcacacgtg

SEQ ID NO: 6926390 - DNA, 22 bp, Homo sapiens
tggcccagggtctacagcctca

SEQ ID NO: 6926391 - DNA, 20 bp, Homo sapiens
attccacttgtttgaggtac

SEQ ID NO: 6926392 - DNA, 22 bp, Homo sapiens
tttgccaggcttgcatgaattt

SEQ ID NO: 6926393 - DNA, 22 bp, Homo sapiens
tgggaagatgaggtgccatggg

SEQ ID NO: 6926394 - DNA, 22 bp, Homo sapiens
acagatacagggacttggtatt

SEQ ID NO: 6926395 - DNA, 22 bp, Homo sapiens
gtctccagtgttcaggtgactg

SEQ ID NO: 6926396 - DNA, 22 bp, Homo sapiens
aaatactctcaataaagaaagt

SEQ ID NO: 6926397 - DNA, 22 bp, Homo sapiens
gcagagattggtgcactgatga

SEQ ID NO: 6926398 - DNA, 22 bp, Homo sapiens
aatagcatcttctgagacaaag

SEQ ID NO: 6926399 - DNA, 22 bp, Homo sapiens
actgggctaccccaccattacc

SEQ ID NO: 6926400 - DNA, 22 bp, Homo sapiens
tgtaccagtgttgagaatgaga

SEQ ID NO: 6926401 - DNA, 22 bp, Homo sapiens
aagggggccacacctggtgtga

SEQ ID NO: 6926402 - DNA, 22 bp, Homo sapiens
cattgtttgagcatctgggatc

SEQ ID NO: 6926403 - DNA, 22 bp, Homo sapiens
gtaggcaaattatggaacattg

SEQ ID NO: 6926404 - DNA, 22 bp, Homo sapiens
ttcatgttgtagtatgtatcag

SEQ ID NO: 6926405 - DNA, 22 bp, Homo sapiens
gtgctgcttgggggcagagcag

SEQ ID NO: 6926406 - DNA, 22 bp, Homo sapiens
taacctgactgctctttagaat

SEQ ID NO: 6926407 - DNA, 22 bp, Homo sapiens
gaccagttttctgctttggaag

SEQ ID NO: 6926408 - DNA, 22 bp, Homo sapiens
acagtactctaatgaaaagtgc

SEQ ID NO: 6926409 - DNA, 22 bp, Homo sapiens
gcctgagatcaggagaaagcca

SEQ ID NO: 6926410 - DNA, 22 bp, Homo sapiens
ctggataaatgctttagttgga

SEQ ID NO: 6926411 - DNA, 20 bp, Homo sapiens
gcacagctgagttcagggtc

SEQ ID NO: 6926412 - DNA, 22 bp, Homo sapiens
cagcctttgggtcagaagattc

SEQ ID NO: 6926413 - DNA, 22 bp, Homo sapiens
tgccagcccaccttggggcctc

SEQ ID NO: 6926414 - DNA, 22 bp, Homo sapiens
ttattgacacatctggatgttt

SEQ ID NO: 6926415 - DNA, 21 bp, Homo sapiens
ttttatgcataggaaatatat

SEQ ID NO: 6926416 - DNA, 22 bp, Homo sapiens
attctctggtcattgagtataa

SEQ ID NO: 6926417 - DNA, 22 bp, Homo sapiens
tccagagctaattcagcagctg

SEQ ID NO: 6926418 - DNA, 22 bp, Homo sapiens
ggctccttgagaggcctagcag

SEQ ID NO: 6926419 - DNA, 22 bp, Homo sapiens
ccagagagagaggtcaatggca

SEQ ID NO: 6926420 - DNA, 22 bp, Homo sapiens
tgtgccagaaaatatgctgagg

SEQ ID NO: 6926421 - DNA, 22 bp, Homo sapiens
gacatttattagaaaactatca

SEQ ID NO: 6926422 - DNA, 20 bp, Homo sapiens
aggcagttagaaggagatga

SEQ ID NO: 6926423 - DNA, 22 bp, Homo sapiens
gtgtgtctgaagttgagtagac

SEQ ID NO: 6926424 - DNA, 22 bp, Homo sapiens
tcactaaagttggagaagagct

SEQ ID NO: 6926425 - DNA, 22 bp, Homo sapiens
ttccctggcatgagtgtaagat

SEQ ID NO: 6926426 - DNA, 22 bp, Homo sapiens
tggcagtgggaagctggaagtc

SEQ ID NO: 6926427 - DNA, 22 bp, Homo sapiens
ttggctgaagactagatgttta

SEQ ID NO: 6926428 - DNA, 22 bp, Homo sapiens
aacatcttgtctaatgtcagct

SEQ ID NO: 6926429 - DNA, 22 bp, Homo sapiens
gagctgagtagaggctgctccc

SEQ ID NO: 6926430 - DNA, 21 bp, Homo sapiens
aagcaacgtaaatctggcttg

SEQ ID NO: 6926431 - DNA, 22 bp, Homo sapiens
acactctttcactaccttaatt

SEQ ID NO: 6926432 - DNA, 22 bp, Homo sapiens
tgattagctgaagaatatgctg

SEQ ID NO: 6926433 - DNA, 22 bp, Homo sapiens
gcagacatacttctttttgtac

SEQ ID NO: 6926434 - DNA, 22 bp, Homo sapiens
ctcccaggccatgctctagcca

SEQ ID NO: 6926435 - DNA, 22 bp, Homo sapiens
ttcttacaaacaagatcattga

SEQ ID NO: 6926436 - DNA, 22 bp, Homo sapiens
agcctgcgcggcctggggcgaa

SEQ ID NO: 6926437 - DNA, 22 bp, Homo sapiens
aacgtcttctctccaagtaaat

SEQ ID NO: 6926438 - DNA, 22 bp, Homo sapiens
ttgcaaatatgttctcctattc

SEQ ID NO: 6926439 - DNA, 22 bp, Homo sapiens
ctggctttgtatagttccctga

SEQ ID NO: 6926440 - DNA, 22 bp, Homo sapiens
gcagggacaactgtgcacctga

SEQ ID NO: 6926441 - DNA, 22 bp, Homo sapiens
ttcaaagtcctgtcaggtagcc

SEQ ID NO: 6926442 - DNA, 22 bp, Homo sapiens
gcctgttccttagtggcttcac

SEQ ID NO: 6926443 - DNA, 22 bp, Homo sapiens
tactgaaatagcactctgatgc

SEQ ID NO: 6926444 - DNA, 22 bp, Homo sapiens
accccaaaagagtaatagaatt

SEQ ID NO: 6926445 - DNA, 22 bp, Homo sapiens
accaggaaatttggcaacaaag

SEQ ID NO: 6926446 - DNA, 17 bp, Homo sapiens
aggctggctcacaggga

SEQ ID NO: 6926447 - DNA, 22 bp, Homo sapiens
taaagcaagacacacccatagc

SEQ ID NO: 6926448 - DNA, 22 bp, Homo sapiens
acagctgcattcttaacaggaa

SEQ ID NO: 6926449 - DNA, 23 bp, Homo sapiens
ccttaaatatctaccctgtggca

SEQ ID NO: 6926450 - DNA, 22 bp, Homo sapiens
agccaaggacacggagcctcct

SEQ ID NO: 6926451 - DNA, 22 bp, Homo sapiens
ccagaaatggccctagtcagag

SEQ ID NO: 6926452 - DNA, 22 bp, Homo sapiens
tgttgcctggggaagctctgat

SEQ ID NO: 6926453 - DNA, 22 bp, Homo sapiens
gactgtattacaattggcagca

SEQ ID NO: 6926454 - DNA, 22 bp, Homo sapiens
ctttattcctacaagattttct

SEQ ID NO: 6926455 - DNA, 22 bp, Homo sapiens
cccaaggcagggattttctgct

SEQ ID NO: 6926456 - DNA, 22 bp, Homo sapiens
gacacagcttgatgagggcttt

SEQ ID NO: 6926457 - DNA, 22 bp, Homo sapiens
aagcagtgatgcatacagctgt

SEQ ID NO: 6926458 - DNA, 22 bp, Homo sapiens
gaaggtgtctacgcgccttgag

SEQ ID NO: 6926459 - DNA, 22 bp, Homo sapiens
tcacgtgagggacctgtgtctg

SEQ ID NO: 6926460 - DNA, 22 bp, Homo sapiens
ccatgctgaccctgtgcaggca

SEQ ID NO: 6926461 - DNA, 22 bp, Homo sapiens
tgatgagggcagttcttgttgc

SEQ ID NO: 6926462 - DNA, 22 bp, Homo sapiens
tatgtgtacagtatactggttt

SEQ ID NO: 6926463 - DNA, 22 bp, Homo sapiens
ctttcctccactccctaggctt

SEQ ID NO: 6926464 - DNA, 22 bp, Homo sapiens
ttattcagggataacatccagg

SEQ ID NO: 6926465 - DNA, 22 bp, Homo sapiens
aatcttgagtatcagaccaaga

SEQ ID NO: 6926466 - DNA, 22 bp, Homo sapiens
gtgaaattgtatttggcattga

SEQ ID NO: 6926467 - DNA, 22 bp, Homo sapiens
tagtatagtgaatattttggtg

SEQ ID NO: 6926468 - DNA, 17 bp, Homo sapiens
cacaactgaaaccacta

SEQ ID NO: 6926469 - DNA, 22 bp, Homo sapiens
ctgccctgcctggccagtgtgg

SEQ ID NO: 6926470 - DNA, 22 bp, Homo sapiens
gctgactggttcaggtcccgct

SEQ ID NO: 6926471 - DNA, 22 bp, Homo sapiens
agaggccaaagaatctacaaga

SEQ ID NO: 6926472 - DNA, 22 bp, Homo sapiens
aaattgctatatgtgaatgtga

SEQ ID NO: 6926473 - DNA, 22 bp, Homo sapiens
gataccagacagggagggagaa

SEQ ID NO: 6926474 - DNA, 22 bp, Homo sapiens
ttagaagcatcacctgttctgg

SEQ ID NO: 6926475 - DNA, 22 bp, Homo sapiens
gcttgcaagtgtcaagctatta

SEQ ID NO: 6926476 - DNA, 16 bp, Homo sapiens
tcacatacttccttgc

SEQ ID NO: 6926477 - DNA, 22 bp, Homo sapiens
catcagtaaggcaacatagctt

SEQ ID NO: 6926478 - DNA, 22 bp, Homo sapiens
tcattttgcctgccatttgagt

SEQ ID NO: 6926479 - DNA, 22 bp, Homo sapiens
ataagctgtactctataaatgt

SEQ ID NO: 6926480 - DNA, 22 bp, Homo sapiens
agcacagcaagtgggttattaa

SEQ ID NO: 6926481 - DNA, 22 bp, Homo sapiens
ggttaaaactgatattatgggt

SEQ ID NO: 6926482 - DNA, 22 bp, Homo sapiens
ggctctggcgagctttagtaca

SEQ ID NO: 6926483 - DNA, 18 bp, Homo sapiens
ttagtgtaataccattgc

SEQ ID NO: 6926484 - DNA, 22 bp, Homo sapiens
aatcaagtcaaccatcatgtgc

SEQ ID NO: 6926485 - DNA, 22 bp, Homo sapiens
cccagctcgccgccgatgtgcg

SEQ ID NO: 6926486 - DNA, 22 bp, Homo sapiens
ctggagctaataatccatctga

SEQ ID NO: 6926487 - DNA, 15 bp, Homo sapiens
tcagctatcatttta

SEQ ID NO: 6926488 - DNA, 22 bp, Homo sapiens
ctggctttcattcattcaggcc

SEQ ID NO: 6926489 - DNA, 22 bp, Homo sapiens
cagcatctgttcccaacgagat

SEQ ID NO: 6926490 - DNA, 22 bp, Homo sapiens
tcttagcatttcataacaactg

SEQ ID NO: 6926491 - DNA, 22 bp, Homo sapiens
atctgagctccgcctcctgtca

SEQ ID NO: 6926492 - DNA, 22 bp, Homo sapiens
caagtagaaggatgtgattgta

SEQ ID NO: 6926493 - DNA, 22 bp, Homo sapiens
cagtgaagtttaaagtgtagat

SEQ ID NO: 6926494 - DNA, 23 bp, Homo sapiens
tggtggggtcttggagacagcac

SEQ ID NO: 6926495 - DNA, 22 bp, Homo sapiens
agcagcagtgttctggaattct

SEQ ID NO: 6926496 - DNA, 22 bp, Homo sapiens
cctgagccaagagtcagaatct

SEQ ID NO: 6926497 - DNA, 22 bp, Homo sapiens
gggctgtgaggtgagaacttac

SEQ ID NO: 6926498 - DNA, 22 bp, Homo sapiens
gtgctgaattggagatgctcct

SEQ ID NO: 6926499 - DNA, 22 bp, Homo sapiens
ctgtgcttcgcaactccaaggt

SEQ ID NO: 6926500 - DNA, 22 bp, Homo sapiens
tagattctgtttcctctggttt

SEQ ID NO: 6926501 - DNA, 22 bp, Homo sapiens
cctctatagatgtgtgcatcta

SEQ ID NO: 6926502 - DNA, 22 bp, Homo sapiens
acctgaatccaaactcaacaat

SEQ ID NO: 6926503 - DNA, 22 bp, Homo sapiens
agagataattaggttaaatgag

SEQ ID NO: 6926504 - DNA, 22 bp, Homo sapiens
agagagcccgggccagggcaca

SEQ ID NO: 6926505 - DNA, 22 bp, Homo sapiens
gcagtctccatatacatttaca

SEQ ID NO: 6926506 - DNA, 22 bp, Homo sapiens
tctcaggtttcaagacaggaaa

SEQ ID NO: 6926507 - DNA, 22 bp, Homo sapiens
atcagaagttgtgcatgcatgg

SEQ ID NO: 6926508 - DNA, 22 bp, Homo sapiens
acttatttattcattcagctca

SEQ ID NO: 6926509 - DNA, 22 bp, Homo sapiens
tctgcctttgctttggctgtca

SEQ ID NO: 6926510 - DNA, 22 bp, Homo sapiens
ttgaggtagagaaaggaaatga

SEQ ID NO: 6926511 - DNA, 22 bp, Homo sapiens
aggcacacagaccccagcaagt

SEQ ID NO: 6926512 - DNA, 22 bp, Homo sapiens
ggacctttgagggggaattggt

SEQ ID NO: 6926513 - DNA, 22 bp, Homo sapiens
agagtgatcagatatcaggtgt

SEQ ID NO: 6926514 - DNA, 22 bp, Homo sapiens
aggatgttgctattggcagtct

SEQ ID NO: 6926515 - DNA, 22 bp, Homo sapiens
agcacagggacaatgccaggtg

SEQ ID NO: 6926516 - DNA, 22 bp, Homo sapiens
accaggaacaagccatggagga

SEQ ID NO: 6926517 - DNA, 23 bp, Homo sapiens
gaggcttgatcagcttcctccac

SEQ ID NO: 6926518 - DNA, 22 bp, Homo sapiens
tactgaaagtctgtgggtcctc

SEQ ID NO: 6926519 - DNA, 22 bp, Homo sapiens
tgacagtgtgcccggaggttag

SEQ ID NO: 6926520 - DNA, 21 bp, Homo sapiens
tggattgaggtgacagtgtgc

SEQ ID NO: 6926521 - DNA, 22 bp, Homo sapiens
gcaaatcctcctgcctgaagaa

SEQ ID NO: 6926522 - DNA, 22 bp, Homo sapiens
ccactgctagagatgcatcccc

SEQ ID NO: 6926523 - DNA, 22 bp, Homo sapiens
tttcagatcttctttgggttaa

SEQ ID NO: 6926524 - DNA, 22 bp, Homo sapiens
ttcatttggatgcgtgtttaag

SEQ ID NO: 6926525 - DNA, 22 bp, Homo sapiens
gagcagctgtccccaaagcttc

SEQ ID NO: 6926526 - DNA, 22 bp, Homo sapiens
tatctggttcctttgaggagat

SEQ ID NO: 6926527 - DNA, 22 bp, Homo sapiens
ttggaaaacttacacagagctg

SEQ ID NO: 6926528 - DNA, 22 bp, Homo sapiens
tttattatccagtgttgtcatg

SEQ ID NO: 6926529 - DNA, 22 bp, Homo sapiens
actgtctagttctcttttctaa

SEQ ID NO: 6926530 - DNA, 22 bp, Homo sapiens
gtgacagggagtgatatagcag

SEQ ID NO: 6926531 - DNA, 20 bp, Homo sapiens
taccacttatttgaataatt

SEQ ID NO: 6926532 - DNA, 22 bp, Homo sapiens
tgcccaaactgacattggcagt

SEQ ID NO: 6926533 - DNA, 22 bp, Homo sapiens
aaggcctccgccaatggcagag

SEQ ID NO: 6926534 - DNA, 22 bp, Homo sapiens
tgtaagaataatgatttctaag

SEQ ID NO: 6926535 - DNA, 22 bp, Homo sapiens
gagatgtttagggtggggagag

SEQ ID NO: 6926536 - DNA, 22 bp, Homo sapiens
gcttttgttccacagttttgaa

SEQ ID NO: 6926537 - DNA, 22 bp, Homo sapiens
agggcttgccattgcctgttag

SEQ ID NO: 6926538 - DNA, 22 bp, Homo sapiens
tgcctttataagccagcagcaa

SEQ ID NO: 6926539 - DNA, 22 bp, Homo sapiens
acagcaattttgtgcacaagtg

SEQ ID NO: 6926540 - DNA, 22 bp, Homo sapiens
tcaaactgttagatttcagctc

SEQ ID NO: 6926541 - DNA, 22 bp, Homo sapiens
ttactaagttttatgcaactta

SEQ ID NO: 6926542 - DNA, 22 bp, Homo sapiens
cagagactggagtgcagtggcg

SEQ ID NO: 6926543 - DNA, 22 bp, Homo sapiens
aatcaagaggcgatggatggaa

SEQ ID NO: 6926544 - DNA, 22 bp, Homo sapiens
aaatgccaggattattagaggc

SEQ ID NO: 6926545 - DNA, 22 bp, Homo sapiens
tcattgtacaattgcatgtgcg

SEQ ID NO: 6926546 - DNA, 22 bp, Homo sapiens
gctggagagtgaggggagcaag

SEQ ID NO: 6926547 - DNA, 22 bp, Homo sapiens
agagctggctggtagccctgat

SEQ ID NO: 6926548 - DNA, 22 bp, Homo sapiens
tgacagtaccactgaaagtctg

SEQ ID NO: 6926549 - DNA, 21 bp, Homo sapiens
tgatcctttcccccatgttgc

SEQ ID NO: 6926550 - DNA, 22 bp, Homo sapiens
gagccagtgatcagacagggag

SEQ ID NO: 6926551 - DNA, 22 bp, Homo sapiens
ctattgggtcagaaatgagaaa

SEQ ID NO: 6926552 - DNA, 22 bp, Homo sapiens
atactgtacgctcctggcattt

SEQ ID NO: 6926553 - DNA, 22 bp, Homo sapiens
ggagaacatatctcccacattg

SEQ ID NO: 6926554 - DNA, 22 bp, Homo sapiens
cattcatttatgaaatatctat

SEQ ID NO: 6926555 - DNA, 22 bp, Homo sapiens
gtgcttaaggcagtctgtcaaa

SEQ ID NO: 6926556 - DNA, 19 bp, Homo sapiens
tcttccagcatctgggggc

SEQ ID NO: 6926557 - DNA, 20 bp, Homo sapiens
atgcatgcatgcacatgcac

SEQ ID NO: 6926558 - DNA, 22 bp, Homo sapiens
cagacctgaggagcactgagcc

SEQ ID NO: 6926559 - DNA, 22 bp, Homo sapiens
ctgggctcaagaagtcttccct

SEQ ID NO: 6926560 - DNA, 22 bp, Homo sapiens
actgagggcataaaagtactgt

SEQ ID NO: 6926561 - DNA, 19 bp, Homo sapiens
aaatcctgaggttcaaaag

SEQ ID NO: 6926562 - DNA, 22 bp, Homo sapiens
gtgaggtgcctaataccgtgac

SEQ ID NO: 6926563 - DNA, 22 bp, Homo sapiens
cagcagctagaggaagggcaga

SEQ ID NO: 6926564 - DNA, 22 bp, Homo sapiens
tgatgtcaggcaagatacttaa

SEQ ID NO: 6926565 - DNA, 22 bp, Homo sapiens
tatgtaagttgcaaatgaagga

SEQ ID NO: 6926566 - DNA, 22 bp, Homo sapiens
agtatttgagaggtccaggtgt

SEQ ID NO: 6926567 - DNA, 22 bp, Homo sapiens
cacagccttgagcgaggacaag

SEQ ID NO: 6926568 - DNA, 22 bp, Homo sapiens
gccaggctggtgcaaggatatt

SEQ ID NO: 6926569 - DNA, 22 bp, Homo sapiens
attaagagcctactatgtgccg

SEQ ID NO: 6926570 - DNA, 21 bp, Homo sapiens
gagtaacatttcctctccaca

SEQ ID NO: 6926571 - DNA, 22 bp, Homo sapiens
ttgcttgagacttaagaggtca

SEQ ID NO: 6926572 - DNA, 22 bp, Homo sapiens
ttagttattaggtggcagagct

SEQ ID NO: 6926573 - DNA, 17 bp, Homo sapiens
gacctcaggtgatctgc

SEQ ID NO: 6926574 - DNA, 22 bp, Homo sapiens
agtgaaacagagcacagcatgc

SEQ ID NO: 6926575 - DNA, 22 bp, Homo sapiens
gccttcttcttgcaagggaatg

SEQ ID NO: 6926576 - DNA, 22 bp, Homo sapiens
gctctcccgcagcctggtgggc

SEQ ID NO: 6926577 - DNA, 22 bp, Homo sapiens
cctcctgcggcgtccgcgctct

SEQ ID NO: 6926578 - DNA, 22 bp, Homo sapiens
ttttatcaatcattaagacatt

SEQ ID NO: 6926579 - DNA, 22 bp, Homo sapiens
ttgattatagaatcttggcttt

SEQ ID NO: 6926580 - DNA, 22 bp, Homo sapiens
ggagccagcagggtgacactga

SEQ ID NO: 6926581 - DNA, 22 bp, Homo sapiens
taagtgttggtaattacaatga

SEQ ID NO: 6926582 - DNA, 22 bp, Homo sapiens
gagcagcaggccaggttgcagg

SEQ ID NO: 6926583 - DNA, 22 bp, Homo sapiens
cttgtaaacttgagcagggcat

SEQ ID NO: 6926584 - DNA, 22 bp, Homo sapiens
aacaggacatttcagaagcagg

SEQ ID NO: 6926585 - DNA, 22 bp, Homo sapiens
aaacaggtagccctagccttct

SEQ ID NO: 6926586 - DNA, 22 bp, Homo sapiens
tgtggtcctctcaactgaaggt

SEQ ID NO: 6926587 - DNA, 22 bp, Homo sapiens
tattaaagagagaatcatcatc

SEQ ID NO: 6926588 - DNA, 22 bp, Homo sapiens
tattgcctaggttaacgaggtt

SEQ ID NO: 6926589 - DNA, 22 bp, Homo sapiens
gctcctgtcttggggcactggc

SEQ ID NO: 6926590 - DNA, 22 bp, Homo sapiens
atggagtacttttttggattag

SEQ ID NO: 6926591 - DNA, 22 bp, Homo sapiens
atccttcaatgggaagttttag

SEQ ID NO: 6926592 - DNA, 22 bp, Homo sapiens
ttttcctttggaagatgcatat

SEQ ID NO: 6926593 - DNA, 22 bp, Homo sapiens
ctcagactggggctccctgagt

SEQ ID NO: 6926594 - DNA, 22 bp, Homo sapiens
gcagtgttggcaggatggggct

SEQ ID NO: 6926595 - DNA, 22 bp, Homo sapiens
aggggctgcctggcttggcact

SEQ ID NO: 6926596 - DNA, 22 bp, Homo sapiens
atgctggtggttgatggcagga

SEQ ID NO: 6926597 - DNA, 22 bp, Homo sapiens
accagggcggcttgaggaggca

SEQ ID NO: 6926598 - DNA, 22 bp, Homo sapiens
tgggctggcgtggagagtttag

SEQ ID NO: 6926599 - DNA, 22 bp, Homo sapiens
ggctgtgtccccacctgagcag

SEQ ID NO: 6926600 - DNA, 22 bp, Homo sapiens
aagagtgacttttcagctgtga

SEQ ID NO: 6926601 - DNA, 22 bp, Homo sapiens
ctacaatgacagaattgagtag

SEQ ID NO: 6926602 - DNA, 22 bp, Homo sapiens
aacagtgctgttataaatgtac

SEQ ID NO: 6926603 - DNA, 22 bp, Homo sapiens
ccctgaggctgaggataggtgg

SEQ ID NO: 6926604 - DNA, 22 bp, Homo sapiens
tgccgaggctggagtgcagtgg

SEQ ID NO: 6926605 - DNA, 22 bp, Homo sapiens
ctcatattcagtcactgatgca

SEQ ID NO: 6926606 - DNA, 22 bp, Homo sapiens
ggaggctccactgctcttcctg

SEQ ID NO: 6926607 - DNA, 19 bp, Homo sapiens
gctagaagatagaatgaaa

SEQ ID NO: 6926608 - DNA, 21 bp, Homo sapiens
taaaagatgacaagacagctc

SEQ ID NO: 6926609 - DNA, 20 bp, Homo sapiens
tactgggtctgggtcctgga

SEQ ID NO: 6926610 - DNA, 22 bp, Homo sapiens
tatttgatggttctaaaacagc

SEQ ID NO: 6926611 - DNA, 22 bp, Homo sapiens
tgagctaggtcctgtgtcagct

SEQ ID NO: 6926612 - DNA, 22 bp, Homo sapiens
ggttgagacagcagggatgtgt

SEQ ID NO: 6926613 - DNA, 18 bp, Homo sapiens
tggagccagctctaggat

SEQ ID NO: 6926614 - DNA, 22 bp, Homo sapiens
ctgcctggaatgccagcttctc

SEQ ID NO: 6926615 - DNA, 22 bp, Homo sapiens
tcaaagtagagttcagtgcagc

SEQ ID NO: 6926616 - DNA, 22 bp, Homo sapiens
ggggcaaagtggttgctattgg

SEQ ID NO: 6926617 - DNA, 22 bp, Homo sapiens
acctttctgcaagttctgggac

SEQ ID NO: 6926618 - DNA, 22 bp, Homo sapiens
atgtgactagcccttcatgacc

SEQ ID NO: 6926619 - DNA, 22 bp, Homo sapiens
tcattcactgcccagcagtgta

SEQ ID NO: 6926620 - DNA, 22 bp, Homo sapiens
ctgtcaaatggaaacttatcct

SEQ ID NO: 6926621 - DNA, 22 bp, Homo sapiens
gacagcttctatgtgacgagca

SEQ ID NO: 6926622 - DNA, 22 bp, Homo sapiens
ccgaggaagggacagggctctg

SEQ ID NO: 6926623 - DNA, 22 bp, Homo sapiens
aggacctgtacctcagcatcta

SEQ ID NO: 6926624 - DNA, 22 bp, Homo sapiens
ctgagcacgtagttagggtcca

SEQ ID NO: 6926625 - DNA, 22 bp, Homo sapiens
tcagattgttggagccaaacag

SEQ ID NO: 6926626 - DNA, 18 bp, Homo sapiens
caggatgagtgatgggga

SEQ ID NO: 6926627 - DNA, 22 bp, Homo sapiens
ttttgcttgagtgcacaaaatg

SEQ ID NO: 6926628 - DNA, 22 bp, Homo sapiens
tgtattcagtgcctagcatatg

SEQ ID NO: 6926629 - DNA, 22 bp, Homo sapiens
tgcagagccagtcttgtgcttc

SEQ ID NO: 6926630 - DNA, 22 bp, Homo sapiens
cagagggtggaggccaggctct

SEQ ID NO: 6926631 - DNA, 22 bp, Homo sapiens
tcagggaatcagactctgcagc

SEQ ID NO: 6926632 - DNA, 22 bp, Homo sapiens
aggagggacctaggaatattgc

SEQ ID NO: 6926633 - DNA, 22 bp, Homo sapiens
tatcaggaagaacacgtgaaat

SEQ ID NO: 6926634 - DNA, 22 bp, Homo sapiens
ctacagaagaaactatcactat

SEQ ID NO: 6926635 - DNA, 22 bp, Homo sapiens
attccacagtgccttccgtgaa

SEQ ID NO: 6926636 - DNA, 18 bp, Homo sapiens
agagaagaggtgttagtc

SEQ ID NO: 6926637 - DNA, 21 bp, Homo sapiens
taagcaaggaaagggcagccc

SEQ ID NO: 6926638 - DNA, 22 bp, Homo sapiens
ctagggaaggacaacctcttcc

SEQ ID NO: 6926639 - DNA, 22 bp, Homo sapiens
tatgtagtcaagtggatatatg

SEQ ID NO: 6926640 - DNA, 22 bp, Homo sapiens
gtcagattttcaagacgagagg

SEQ ID NO: 6926641 - DNA, 19 bp, Homo sapiens
gcctgccagatagtaatga

SEQ ID NO: 6926642 - DNA, 22 bp, Homo sapiens
tgtgcattaactccacaagcag

SEQ ID NO: 6926643 - DNA, 22 bp, Homo sapiens
catcaaagggcctgtggtgcag

SEQ ID NO: 6926644 - DNA, 22 bp, Homo sapiens
tctagggaattgtggttttctt

SEQ ID NO: 6926645 - DNA, 22 bp, Homo sapiens
tgcaaattccatttaaacacta

SEQ ID NO: 6926646 - DNA, 22 bp, Homo sapiens
ttcagaaggattttaacacatg

SEQ ID NO: 6926647 - DNA, 22 bp, Homo sapiens
gaggagccctgttccccaggcc

SEQ ID NO: 6926648 - DNA, 22 bp, Homo sapiens
cagtgtgctatctggaagtctc

SEQ ID NO: 6926649 - DNA, 22 bp, Homo sapiens
tgacaggcgtttttctctagta

SEQ ID NO: 6926650 - DNA, 18 bp, Homo sapiens
gttagtcttttcagggca

SEQ ID NO: 6926651 - DNA, 22 bp, Homo sapiens
tctggagacctagccctgttgt

SEQ ID NO: 6926652 - DNA, 18 bp, Homo sapiens
ctgtccagtagactctgc

SEQ ID NO: 6926653 - DNA, 22 bp, Homo sapiens
agccatcctactacctcagcat

SEQ ID NO: 6926654 - DNA, 22 bp, Homo sapiens
acatgccagaacttgtaccaat

SEQ ID NO: 6926655 - DNA, 22 bp, Homo sapiens
cagcaggtctgcatttgaggtc

SEQ ID NO: 6926656 - DNA, 20 bp, Homo sapiens
tgtcattgtttctaggacct

SEQ ID NO: 6926657 - DNA, 22 bp, Homo sapiens
catgatcaccacttgacagccc

SEQ ID NO: 6926658 - DNA, 22 bp, Homo sapiens
tggcaggagacacatggcatag

SEQ ID NO: 6926659 - DNA, 22 bp, Homo sapiens
tgaaggacagcagtggctccaa

SEQ ID NO: 6926660 - DNA, 22 bp, Homo sapiens
ccatgacccctggcatccaggg

SEQ ID NO: 6926661 - DNA, 22 bp, Homo sapiens
aattgcttagagaatccaggta

SEQ ID NO: 6926662 - DNA, 22 bp, Homo sapiens
tgaaatgtctgaaagccaatct

SEQ ID NO: 6926663 - DNA, 18 bp, Homo sapiens
ggcaaatgcaattcaaag

SEQ ID NO: 6926664 - DNA, 22 bp, Homo sapiens
ggctggtttgacaaactgacaa

SEQ ID NO: 6926665 - DNA, 22 bp, Homo sapiens
ctagagaaaatgttaatacagt

SEQ ID NO: 6926666 - DNA, 22 bp, Homo sapiens
acatgaacattatatcagcaag

SEQ ID NO: 6926667 - DNA, 22 bp, Homo sapiens
cctgtaactccttggctcaagt

SEQ ID NO: 6926668 - DNA, 23 bp, Homo sapiens
tgtaactttgggcatgttgcttc

SEQ ID NO: 6926669 - DNA, 22 bp, Homo sapiens
taaagtttattggcaccaccat

SEQ ID NO: 6926670 - DNA, 22 bp, Homo sapiens
ttacctaaaatagctcaattta

SEQ ID NO: 6926671 - DNA, 22 bp, Homo sapiens
agcaagactcagcaggatacca

SEQ ID NO: 6926672 - DNA, 22 bp, Homo sapiens
ttcctcagctgtgtcctggcga

SEQ ID NO: 6926673 - DNA, 22 bp, Homo sapiens
ctagtccagtctcaaaatgcta

SEQ ID NO: 6926674 - DNA, 22 bp, Homo sapiens
agtaacaaagtgggagaatgat

SEQ ID NO: 6926675 - DNA, 22 bp, Homo sapiens
tttgacaattaggtagaaaaag

SEQ ID NO: 6926676 - DNA, 22 bp, Homo sapiens
agttgaaattagagtcctggct

SEQ ID NO: 6926677 - DNA, 22 bp, Homo sapiens
ctggctccatctttgcttcctg

SEQ ID NO: 6926678 - DNA, 22 bp, Homo sapiens
acactgagccatacaactggaa

SEQ ID NO: 6926679 - DNA, 22 bp, Homo sapiens
gctctgccagacactgtggcca

SEQ ID NO: 6926680 - DNA, 23 bp, Homo sapiens
ttacaagttctgaaatttccttc

SEQ ID NO: 6926681 - DNA, 22 bp, Homo sapiens
atgttcatgtggctgctggcag

SEQ ID NO: 6926682 - DNA, 22 bp, Homo sapiens
ctggccaggctctcacgtggtc

SEQ ID NO: 6926683 - DNA, 22 bp, Homo sapiens
caaatagaaggtactcagagaa

SEQ ID NO: 6926684 - DNA, 22 bp, Homo sapiens
acagcgccgattctccggggct

SEQ ID NO: 6926685 - DNA, 22 bp, Homo sapiens
tggctttctcccccagcttctc

SEQ ID NO: 6926686 - DNA, 22 bp, Homo sapiens
aagtcacactgctgggaactct

SEQ ID NO: 6926687 - DNA, 22 bp, Homo sapiens
tgctttgcaaataatagaatgt

SEQ ID NO: 6926688 - DNA, 20 bp, Homo sapiens
gtgggcatcagtcacagtgt

SEQ ID NO: 6926689 - DNA, 17 bp, Homo sapiens
ccacagctgggtgcctt

SEQ ID NO: 6926690 - DNA, 22 bp, Homo sapiens
gggagtgggtttggcctaggcc

SEQ ID NO: 6926691 - DNA, 22 bp, Homo sapiens
tggctgagggggctctgctcag

SEQ ID NO: 6926692 - DNA, 18 bp, Homo sapiens
cctagagcagatggaagt

SEQ ID NO: 6926693 - DNA, 22 bp, Homo sapiens
tcctgagcttcaaaacactttg

SEQ ID NO: 6926694 - DNA, 22 bp, Homo sapiens
acaggcagattaagggtaggca

SEQ ID NO: 6926695 - DNA, 22 bp, Homo sapiens
gggacctggggactccttgttc

SEQ ID NO: 6926696 - DNA, 22 bp, Homo sapiens
caagatcaagtgtagtatcaaa

SEQ ID NO: 6926697 - DNA, 22 bp, Homo sapiens
ttagaaaaaacgtcttctagtg

SEQ ID NO: 6926698 - DNA, 20 bp, Homo sapiens
aatagctgagggcaagagta

SEQ ID NO: 6926699 - DNA, 19 bp, Homo sapiens
attcttcagcagtgagacc

SEQ ID NO: 6926700 - DNA, 22 bp, Homo sapiens
gtgtgcctcccattagggtgta

SEQ ID NO: 6926701 - DNA, 22 bp, Homo sapiens
atttggttatggtcatggacac

SEQ ID NO: 6926702 - DNA, 22 bp, Homo sapiens
atctggctctctcatttacaaa

SEQ ID NO: 6926703 - DNA, 22 bp, Homo sapiens
tgtatgcatctttgataaatag

SEQ ID NO: 6926704 - DNA, 22 bp, Homo sapiens
tctgaaggcatcctcactgcaa

SEQ ID NO: 6926705 - DNA, 22 bp, Homo sapiens
tattttatctgccagagtggag

SEQ ID NO: 6926706 - DNA, 22 bp, Homo sapiens
tgccaggagtgtagagtggttt

SEQ ID NO: 6926707 - DNA, 22 bp, Homo sapiens
actagtgtccttatataagagg

SEQ ID NO: 6926708 - DNA, 22 bp, Homo sapiens
ctgattgctaacctgttagaat

SEQ ID NO: 6926709 - DNA, 22 bp, Homo sapiens
tttgatgaaagctactatttac

SEQ ID NO: 6926710 - DNA, 22 bp, Homo sapiens
atatttctccaaatgttttcaa

SEQ ID NO: 6926711 - DNA, 22 bp, Homo sapiens
tagctgtgagcacccaggctgt

SEQ ID NO: 6926712 - DNA, 22 bp, Homo sapiens
ttgacaggagccaaaataggat

SEQ ID NO: 6926713 - DNA, 22 bp, Homo sapiens
gtaagacaagcggactgccgtt

SEQ ID NO: 6926714 - DNA, 22 bp, Homo sapiens
ttgctaaatgtttgtttccaga

SEQ ID NO: 6926715 - DNA, 22 bp, Homo sapiens
gccctccaccagagcccttctc

SEQ ID NO: 6926716 - DNA, 22 bp, Homo sapiens
actgaggtataattgacataac

SEQ ID NO: 6926717 - DNA, 22 bp, Homo sapiens
ttcaagatcttccaaaggatac

SEQ ID NO: 6926718 - DNA, 22 bp, Homo sapiens
gacatacagaatctgcagactt

SEQ ID NO: 6926719 - DNA, 22 bp, Homo sapiens
agcaggcaggcccagcggctgg

SEQ ID NO: 6926720 - DNA, 22 bp, Homo sapiens
tgagctctcagggacagactat

SEQ ID NO: 6926721 - DNA, 22 bp, Homo sapiens
tgggcttaggtcggaggcggcc

SEQ ID NO: 6926722 - DNA, 22 bp, Homo sapiens
catggtactgccacagaagagt

SEQ ID NO: 6926723 - DNA, 16 bp, Homo sapiens
gtttaggcacattaag

SEQ ID NO: 6926724 - DNA, 22 bp, Homo sapiens
agcagcatctggttctgatgtg

SEQ ID NO: 6926725 - DNA, 22 bp, Homo sapiens
ttatgctagttgaaataacaca

SEQ ID NO: 6926726 - DNA, 22 bp, Homo sapiens
agtgaggggcagctgagtgggc

SEQ ID NO: 6926727 - DNA, 22 bp, Homo sapiens
tcaaaggcggtccaggaataaa

SEQ ID NO: 6926728 - DNA, 22 bp, Homo sapiens
tgtcattatgaggattacaata

SEQ ID NO: 6926729 - DNA, 22 bp, Homo sapiens
cattgctgttaattgtctctag

SEQ ID NO: 6926730 - DNA, 22 bp, Homo sapiens
atgagacttgagggcctcaagt

SEQ ID NO: 6926731 - DNA, 22 bp, Homo sapiens
aggcaggagcaagccctacaag

SEQ ID NO: 6926732 - DNA, 22 bp, Homo sapiens
gtggtcaccatgaatgtgggtt

SEQ ID NO: 6926733 - DNA, 22 bp, Homo sapiens
ggtaatggcttctataattcta

SEQ ID NO: 6926734 - DNA, 22 bp, Homo sapiens
ccaccagaccaccaagagcaac

SEQ ID NO: 6926735 - DNA, 22 bp, Homo sapiens
gctctgtatctgtggggcttcc

SEQ ID NO: 6926736 - DNA, 22 bp, Homo sapiens
ggccttgcttgggttatatgcc

SEQ ID NO: 6926737 - DNA, 22 bp, Homo sapiens
accagagaggctgcagtgtgtg

SEQ ID NO: 6926738 - DNA, 22 bp, Homo sapiens
ttgtgccctcaaagggtgcgtc

SEQ ID NO: 6926739 - DNA, 22 bp, Homo sapiens
tttcatgaggggcaaaatctca

SEQ ID NO: 6926740 - DNA, 22 bp, Homo sapiens
tctgcattacatgccatagaca

SEQ ID NO: 6926741 - DNA, 19 bp, Homo sapiens
tcagtatataattacacca

SEQ ID NO: 6926742 - DNA, 22 bp, Homo sapiens
ttttttgtcttgaagaaatggt

SEQ ID NO: 6926743 - DNA, 22 bp, Homo sapiens
aactccttaatgcatttcagag

SEQ ID NO: 6926744 - DNA, 22 bp, Homo sapiens
cactgaagcctgggagtaagac

SEQ ID NO: 6926745 - DNA, 22 bp, Homo sapiens
gggagggaaggaggcgccgtgt

SEQ ID NO: 6926746 - DNA, 22 bp, Homo sapiens
ccagcagagtctaggaaggagg

SEQ ID NO: 6926747 - DNA, 22 bp, Homo sapiens
actgggccaactatttgttcta

SEQ ID NO: 6926748 - DNA, 22 bp, Homo sapiens
ctttgcattttgcccaactgtg

SEQ ID NO: 6926749 - DNA, 22 bp, Homo sapiens
gcctgtttggctgctgacattg

SEQ ID NO: 6926750 - DNA, 22 bp, Homo sapiens
agctggattaaatatagctttc

SEQ ID NO: 6926751 - DNA, 22 bp, Homo sapiens
tataggaagtaattgttgcctg

SEQ ID NO: 6926752 - DNA, 22 bp, Homo sapiens
tatggcttttaactgtcgtatg

SEQ ID NO: 6926753 - DNA, 22 bp, Homo sapiens
ccagcaaggtccagcataggga

SEQ ID NO: 6926754 - DNA, 19 bp, Homo sapiens
agattggttccttttgagg

SEQ ID NO: 6926755 - DNA, 22 bp, Homo sapiens
atgagtgcaacagatcagcatg

SEQ ID NO: 6926756 - DNA, 19 bp, Homo sapiens
ctctggcttccaaagcatc

SEQ ID NO: 6926757 - DNA, 22 bp, Homo sapiens
agcaggtttaaactctaatgca

SEQ ID NO: 6926758 - DNA, 22 bp, Homo sapiens
tcctcaggatgtggggtagaat

SEQ ID NO: 6926759 - DNA, 22 bp, Homo sapiens
aagttcaagatcaaggttccag

SEQ ID NO: 6926760 - DNA, 22 bp, Homo sapiens
ttgtctgaagtcacacagatgc

SEQ ID NO: 6926761 - DNA, 22 bp, Homo sapiens
gaatttcaaaagccagaacggg

SEQ ID NO: 6926762 - DNA, 22 bp, Homo sapiens
tatcttttgagttctcaagatg

SEQ ID NO: 6926763 - DNA, 22 bp, Homo sapiens
tgacagagctggagaataattt

SEQ ID NO: 6926764 - DNA, 20 bp, Homo sapiens
gctcaggtgacagtcaggag

SEQ ID NO: 6926765 - DNA, 22 bp, Homo sapiens
tgtgtctgtcctcggttgatgc

SEQ ID NO: 6926766 - DNA, 22 bp, Homo sapiens
ccactctgattttggctccact

SEQ ID NO: 6926767 - DNA, 22 bp, Homo sapiens
agtttaatatccttcaactttc

SEQ ID NO: 6926768 - DNA, 22 bp, Homo sapiens
cagcagttctgtactttagagt

SEQ ID NO: 6926769 - DNA, 22 bp, Homo sapiens
ttcaactagaggtgattttgcc

SEQ ID NO: 6926770 - DNA, 22 bp, Homo sapiens
ccgagacactgagcagggtggg

SEQ ID NO: 6926771 - DNA, 22 bp, Homo sapiens
tgtagaagtaggagtcatctca

SEQ ID NO: 6926772 - DNA, 22 bp, Homo sapiens
ctcggtgaatttttctagcgta

SEQ ID NO: 6926773 - DNA, 22 bp, Homo sapiens
ttatcagtcggcttaggttatg

SEQ ID NO: 6926774 - DNA, 22 bp, Homo sapiens
gctccctccatgaggcagaccg

SEQ ID NO: 6926775 - DNA, 22 bp, Homo sapiens
cacccagcagcacttaagacta

SEQ ID NO: 6926776 - DNA, 22 bp, Homo sapiens
tggcaaagtatctgtcccagct

SEQ ID NO: 6926777 - DNA, 22 bp, Homo sapiens
aaagtgttttgatttagtggta

SEQ ID NO: 6926778 - DNA, 20 bp, Homo sapiens
tagaggtgggatttgggttt

SEQ ID NO: 6926779 - DNA, 22 bp, Homo sapiens
tccatgttttctctgacaccta

SEQ ID NO: 6926780 - DNA, 23 bp, Homo sapiens
ggcttgagctggaacagcttggt

SEQ ID NO: 6926781 - DNA, 22 bp, Homo sapiens
gctggagaggatcccaaagcca

SEQ ID NO: 6926782 - DNA, 22 bp, Homo sapiens
tcagaaggtttttagcaaagga

SEQ ID NO: 6926783 - DNA, 22 bp, Homo sapiens
aagtgagattatatgtacggga

SEQ ID NO: 6926784 - DNA, 20 bp, Homo sapiens
acagtttatccagttagcag

SEQ ID NO: 6926785 - DNA, 22 bp, Homo sapiens
cacataataaatgttcctgatg

SEQ ID NO: 6926786 - DNA, 22 bp, Homo sapiens
tcctgtgacggagcgccagagg

SEQ ID NO: 6926787 - DNA, 22 bp, Homo sapiens
ggggtgctagagtggggccact

SEQ ID NO: 6926788 - DNA, 23 bp, Homo sapiens
tgaagccgccctagggtataggt

SEQ ID NO: 6926789 - DNA, 22 bp, Homo sapiens
atttggcacagcttttcctacc

SEQ ID NO: 6926790 - DNA, 22 bp, Homo sapiens
ctaaacaggaaggagcacctga

SEQ ID NO: 6926791 - DNA, 19 bp, Homo sapiens
cagaggcaccaggtataga

SEQ ID NO: 6926792 - DNA, 22 bp, Homo sapiens
ttcataatcaccaaaaactgga

SEQ ID NO: 6926793 - DNA, 19 bp, Homo sapiens
attatgtgttttaatccat

SEQ ID NO: 6926794 - DNA, 22 bp, Homo sapiens
atgcagttgcaatggaggactc

SEQ ID NO: 6926795 - DNA, 22 bp, Homo sapiens
aagtgtctgctggctctaccct

SEQ ID NO: 6926796 - DNA, 22 bp, Homo sapiens
atcatacactcacataaacaga

SEQ ID NO: 6926797 - DNA, 22 bp, Homo sapiens
aggctatgtaaagactagcttg

SEQ ID NO: 6926798 - DNA, 22 bp, Homo sapiens
caagccagcagtttaatgactc

SEQ ID NO: 6926799 - DNA, 22 bp, Homo sapiens
aaagtagaggcattgatcaggt

SEQ ID NO: 6926800 - DNA, 22 bp, Homo sapiens
tgcagaaacagagttttgccat

SEQ ID NO: 6926801 - DNA, 22 bp, Homo sapiens
atgggcaggcctctcatttctg

SEQ ID NO: 6926802 - DNA, 22 bp, Homo sapiens
aaaacacaagaagcagggtaca

SEQ ID NO: 6926803 - DNA, 22 bp, Homo sapiens
gagctcagtgtagtcatggctt

SEQ ID NO: 6926804 - DNA, 22 bp, Homo sapiens
ttagtgcttctgtccaaatata

SEQ ID NO: 6926805 - DNA, 22 bp, Homo sapiens
tattgaccagactgacacacat

SEQ ID NO: 6926806 - DNA, 22 bp, Homo sapiens
atgcaagtcttaatagtttagg

SEQ ID NO: 6926807 - DNA, 22 bp, Homo sapiens
ttctttctcagtgggcagatac

SEQ ID NO: 6926808 - DNA, 19 bp, Homo sapiens
actggcagctgtagtctgt

SEQ ID NO: 6926809 - DNA, 22 bp, Homo sapiens
atctactttacaaatcatctcc

SEQ ID NO: 6926810 - DNA, 22 bp, Homo sapiens
tgaatgatttgggtgcattcag

SEQ ID NO: 6926811 - DNA, 22 bp, Homo sapiens
actgccattggttctggaaaat

SEQ ID NO: 6926812 - DNA, 22 bp, Homo sapiens
actactagtggctacaataatg

SEQ ID NO: 6926813 - DNA, 22 bp, Homo sapiens
ggcctggacaaatgcaccaagg

SEQ ID NO: 6926814 - DNA, 22 bp, Homo sapiens
ctcccagaaaattctcagacaa

SEQ ID NO: 6926815 - DNA, 22 bp, Homo sapiens
caaggtgccatgctgggcgggg

SEQ ID NO: 6926816 - DNA, 22 bp, Homo sapiens
gttgtacaattgtttcacatgc

SEQ ID NO: 6926817 - DNA, 22 bp, Homo sapiens
aggctgaggcaagaggatcact

SEQ ID NO: 6926818 - DNA, 22 bp, Homo sapiens
ccatgcaagggtctggtcctgc

SEQ ID NO: 6926819 - DNA, 22 bp, Homo sapiens
aacactccgtggaggcatgcag

SEQ ID NO: 6926820 - DNA, 22 bp, Homo sapiens
tttgtgaatggaatccacagac

SEQ ID NO: 6926821 - DNA, 22 bp, Homo sapiens
gccaggactcttcctagaaggt

SEQ ID NO: 6926822 - DNA, 22 bp, Homo sapiens
agctgtgtaggatcataacacg

SEQ ID NO: 6926823 - DNA, 22 bp, Homo sapiens
cttttctctgcgggtctttcat

SEQ ID NO: 6926824 - DNA, 20 bp, Homo sapiens
tccttcaggcagggcctagt

SEQ ID NO: 6926825 - DNA, 22 bp, Homo sapiens
aagatgttaaattgggggcatt

SEQ ID NO: 6926826 - DNA, 22 bp, Homo sapiens
tcatgcagatttggaggtattt

SEQ ID NO: 6926827 - DNA, 22 bp, Homo sapiens
aaggccacgtctccttccagag

SEQ ID NO: 6926828 - DNA, 16 bp, Homo sapiens
gaggggagcagtaggc

SEQ ID NO: 6926829 - DNA, 22 bp, Homo sapiens
agtcaattcttttcaactcaag

SEQ ID NO: 6926830 - DNA, 22 bp, Homo sapiens
ggactggactctcaggctcaca

SEQ ID NO: 6926831 - DNA, 22 bp, Homo sapiens
tgaaatgtagattaggcattct

SEQ ID NO: 6926832 - DNA, 22 bp, Homo sapiens
agagagctgtcctgggacaccc

SEQ ID NO: 6926833 - DNA, 22 bp, Homo sapiens
gatcagtaagtgaataatgagt

SEQ ID NO: 6926834 - DNA, 22 bp, Homo sapiens
tagatgctgtgggcacatggaa

SEQ ID NO: 6926835 - DNA, 22 bp, Homo sapiens
ggcatttagattgaatttctgt

SEQ ID NO: 6926836 - DNA, 22 bp, Homo sapiens
aatgttcagtagaataggaatg

SEQ ID NO: 6926837 - DNA, 22 bp, Homo sapiens
aggctctataccgctgggagtt

SEQ ID NO: 6926838 - DNA, 22 bp, Homo sapiens
gaaactgtttctggctttggtg

SEQ ID NO: 6926839 - DNA, 22 bp, Homo sapiens
ggtggttgcataggccagcagc

SEQ ID NO: 6926840 - DNA, 22 bp, Homo sapiens
tcagattctggatagatcttca

SEQ ID NO: 6926841 - DNA, 22 bp, Homo sapiens
gaaagtgcttttgagtgtgtgc

SEQ ID NO: 6926842 - DNA, 22 bp, Homo sapiens
gcaagcagttcgcagcccgcct

SEQ ID NO: 6926843 - DNA, 22 bp, Homo sapiens
ttggattctgttaggcaccttc

SEQ ID NO: 6926844 - DNA, 22 bp, Homo sapiens
aattccagctacttggaaggtt

SEQ ID NO: 6926845 - DNA, 22 bp, Homo sapiens
gaacctgagcgggcagcaagcg

SEQ ID NO: 6926846 - DNA, 22 bp, Homo sapiens
gctgaagagagatgcgtccagc

SEQ ID NO: 6926847 - DNA, 17 bp, Homo sapiens
cctgcagtgcctgtcgg

SEQ ID NO: 6926848 - DNA, 22 bp, Homo sapiens
acttgcctaaggtcatgcaact

SEQ ID NO: 6926849 - DNA, 22 bp, Homo sapiens
tgatgctgagcctgggactgac

SEQ ID NO: 6926850 - DNA, 22 bp, Homo sapiens
gctggctggctgtgcaaaggca

SEQ ID NO: 6926851 - DNA, 22 bp, Homo sapiens
gcaaggctgcccacttcaaaag

SEQ ID NO: 6926852 - DNA, 22 bp, Homo sapiens
ccattaaaattgtgacatagga

SEQ ID NO: 6926853 - DNA, 23 bp, Homo sapiens
gtcagcttgaccagtggagagtc

SEQ ID NO: 6926854 - DNA, 21 bp, Homo sapiens
gtctcttaaggctttggctca

SEQ ID NO: 6926855 - DNA, 22 bp, Homo sapiens
actgcgggaacccgcggccggc

SEQ ID NO: 6926856 - DNA, 22 bp, Homo sapiens
ggaaagagaagttgggaggaat

SEQ ID NO: 6926857 - DNA, 22 bp, Homo sapiens
ttctaaagagaatgcgtttctg

SEQ ID NO: 6926858 - DNA, 22 bp, Homo sapiens
tctttggatctcaaggtggcag

SEQ ID NO: 6926859 - DNA, 22 bp, Homo sapiens
ccagtaacacctcgcagactcc

SEQ ID NO: 6926860 - DNA, 22 bp, Homo sapiens
tctgaatttgcattttaacaag

SEQ ID NO: 6926861 - DNA, 23 bp, Homo sapiens
aaactgcttccaattcctgccat

SEQ ID NO: 6926862 - DNA, 17 bp, Homo sapiens
tgaccctgttgggtgtt

SEQ ID NO: 6926863 - DNA, 22 bp, Homo sapiens
tctccttcgaggcccagctccc

SEQ ID NO: 6926864 - DNA, 21 bp, Homo sapiens
ctccggagtgagctgtgggta

SEQ ID NO: 6926865 - DNA, 22 bp, Homo sapiens
cccatgagtgctgctcagaggc

SEQ ID NO: 6926866 - DNA, 22 bp, Homo sapiens
tcttcacaggagcctgcctgcc

SEQ ID NO: 6926867 - DNA, 19 bp, Homo sapiens
cctggccctgctgcgcggg

SEQ ID NO: 6926868 - DNA, 22 bp, Homo sapiens
cgtttattttgaagattccact

SEQ ID NO: 6926869 - DNA, 19 bp, Homo sapiens
tctcacagctctactatgt

SEQ ID NO: 6926870 - DNA, 20 bp, Homo sapiens
gcctaagagctagctgtcac

SEQ ID NO: 6926871 - DNA, 22 bp, Homo sapiens
ctggcctggtctggcctctcca

SEQ ID NO: 6926872 - DNA, 22 bp, Homo sapiens
tagtgtggtaaataaatgtttt

SEQ ID NO: 6926873 - DNA, 22 bp, Homo sapiens
agcaacctgccaccacaggcaa

SEQ ID NO: 6926874 - DNA, 22 bp, Homo sapiens
ttcataggaaaaatgtgaggtg

SEQ ID NO: 6926875 - DNA, 22 bp, Homo sapiens
tagctattgttggtagttaccc

SEQ ID NO: 6926876 - DNA, 22 bp, Homo sapiens
tgaatttaccttgcctatattt

SEQ ID NO: 6926877 - DNA, 22 bp, Homo sapiens
tgaggtatgctgaactctgttt

SEQ ID NO: 6926878 - DNA, 22 bp, Homo sapiens
tggggggatacttgctactggc

SEQ ID NO: 6926879 - DNA, 22 bp, Homo sapiens
gctgctttaaaatcagcatagc

SEQ ID NO: 6926880 - DNA, 22 bp, Homo sapiens
ttgcaaatggtaccaagggtct

SEQ ID NO: 6926881 - DNA, 22 bp, Homo sapiens
tccaggcagagcaacaaaatat

SEQ ID NO: 6926882 - DNA, 22 bp, Homo sapiens
ggtaggcagatcactgtctatg

SEQ ID NO: 6926883 - DNA, 22 bp, Homo sapiens
atgtggctattttaatgttaat

SEQ ID NO: 6926884 - DNA, 22 bp, Homo sapiens
ctgtccacatggagaacctggt

SEQ ID NO: 6926885 - DNA, 22 bp, Homo sapiens
ggcttctttcactaagtagaga

SEQ ID NO: 6926886 - DNA, 22 bp, Homo sapiens
catgcatagccagcattgtatg

SEQ ID NO: 6926887 - DNA, 20 bp, Homo sapiens
agctggcccacaggtgtggg

SEQ ID NO: 6926888 - DNA, 22 bp, Homo sapiens
gacccagggtggtcacctgaaa

SEQ ID NO: 6926889 - DNA, 22 bp, Homo sapiens
gacagcatggtgtctgttcagg

SEQ ID NO: 6926890 - DNA, 22 bp, Homo sapiens
ggaggccaaggcgggcggatca

SEQ ID NO: 6926891 - DNA, 22 bp, Homo sapiens
gaagacacaattggtgggtcca

SEQ ID NO: 6926892 - DNA, 22 bp, Homo sapiens
attgcaagtgctagctaaaata

SEQ ID NO: 6926893 - DNA, 22 bp, Homo sapiens
tctgggaggtaaccatgctgat

SEQ ID NO: 6926894 - DNA, 22 bp, Homo sapiens
aagggttggggaagagcaaatt

SEQ ID NO: 6926895 - DNA, 22 bp, Homo sapiens
tcaaactggcagacttctactt

SEQ ID NO: 6926896 - DNA, 22 bp, Homo sapiens
tacagcatgtccttagcaaggc

SEQ ID NO: 6926897 - DNA, 22 bp, Homo sapiens
taactctgaatcctcacagcag

SEQ ID NO: 6926898 - DNA, 19 bp, Homo sapiens
tagctgatagctactttat

SEQ ID NO: 6926899 - DNA, 22 bp, Homo sapiens
gactcccaagcttggaggaagg

SEQ ID NO: 6926900 - DNA, 17 bp, Homo sapiens
tgtgacattgggacatt

SEQ ID NO: 6926901 - DNA, 19 bp, Homo sapiens
tgcctggacaaatgtgggg

SEQ ID NO: 6926902 - DNA, 22 bp, Homo sapiens
tcttgatttactctaatagctt

SEQ ID NO: 6926903 - DNA, 22 bp, Homo sapiens
attatagagggttacagttaat

SEQ ID NO: 6926904 - DNA, 22 bp, Homo sapiens
ctgttctctggcggtggctgtt

SEQ ID NO: 6926905 - DNA, 22 bp, Homo sapiens
actagaaagcactaagctaggc

SEQ ID NO: 6926906 - DNA, 21 bp, Homo sapiens
ggtcagtggctttcttgcacc

SEQ ID NO: 6926907 - DNA, 22 bp, Homo sapiens
gcctttatatccctgatatcta

SEQ ID NO: 6926908 - DNA, 22 bp, Homo sapiens
ccgccgtgtcgacaggccctgg

SEQ ID NO: 6926909 - DNA, 22 bp, Homo sapiens
gtgcctttgagaagtttctctg

SEQ ID NO: 6926910 - DNA, 22 bp, Homo sapiens
tcttctgagacttctctttggt

SEQ ID NO: 6926911 - DNA, 23 bp, Homo sapiens
cctggcacacagttgacatggaa

SEQ ID NO: 6926912 - DNA, 22 bp, Homo sapiens
gctcgaccgccagaaacttcct

SEQ ID NO: 6926913 - DNA, 22 bp, Homo sapiens
tggggtcccaactctgattgat

SEQ ID NO: 6926914 - DNA, 22 bp, Homo sapiens
gccctgtcctcctgactgagtg

SEQ ID NO: 6926915 - DNA, 22 bp, Homo sapiens
gcgagatatgatagcacaaggg

SEQ ID NO: 6926916 - DNA, 19 bp, Homo sapiens
tcatcacctaattctctat

SEQ ID NO: 6926917 - DNA, 22 bp, Homo sapiens
atcctaaagcagacagcaggtt

SEQ ID NO: 6926918 - DNA, 22 bp, Homo sapiens
tgttctaggcaaaagctgattt

SEQ ID NO: 6926919 - DNA, 22 bp, Homo sapiens
actgtgaacggactgaagccca

SEQ ID NO: 6926920 - DNA, 22 bp, Homo sapiens
caacagagggaatggatctcat

SEQ ID NO: 6926921 - DNA, 22 bp, Homo sapiens
ttaggcttcatgtgcagaggat

SEQ ID NO: 6926922 - DNA, 22 bp, Homo sapiens
gagatcatggcttctgctgata

SEQ ID NO: 6926923 - DNA, 22 bp, Homo sapiens
tggctgaggagagggcggaagt

SEQ ID NO: 6926924 - DNA, 21 bp, Homo sapiens
gctgtctctggctcctgggaa

SEQ ID NO: 6926925 - DNA, 19 bp, Homo sapiens
tatgacaagtactagttct

SEQ ID NO: 6926926 - DNA, 22 bp, Homo sapiens
gggttggggcccagcagtctgc

SEQ ID NO: 6926927 - DNA, 22 bp, Homo sapiens
tttatgcagatttgtacagtga

SEQ ID NO: 6926928 - DNA, 22 bp, Homo sapiens
aggatgtggatggagtatttat

SEQ ID NO: 6926929 - DNA, 22 bp, Homo sapiens
agaggcaagattatcagggcat

SEQ ID NO: 6926930 - DNA, 22 bp, Homo sapiens
ttatttaaaatgtaggttggga

SEQ ID NO: 6926931 - DNA, 22 bp, Homo sapiens
tctgttgaccaagtcttcttcc

SEQ ID NO: 6926932 - DNA, 19 bp, Homo sapiens
caggacagacttcaaagcc

SEQ ID NO: 6926933 - DNA, 22 bp, Homo sapiens
gccggggctggggagagacatg

SEQ ID NO: 6926934 - DNA, 22 bp, Homo sapiens
gatcattagcttttcaaaggag

SEQ ID NO: 6926935 - DNA, 22 bp, Homo sapiens
gtatctttgtcttcatgttgga

SEQ ID NO: 6926936 - DNA, 22 bp, Homo sapiens
gtcctctccaggaggctctgat

SEQ ID NO: 6926937 - DNA, 22 bp, Homo sapiens
tttcctttccaaaattctgcct

SEQ ID NO: 6926938 - DNA, 22 bp, Homo sapiens
aggtcagccctctctgggcagg

SEQ ID NO: 6926939 - DNA, 20 bp, Homo sapiens
cactacttgtttttgtcaat

SEQ ID NO: 6926940 - DNA, 22 bp, Homo sapiens
ttggctggtttcaagaaggcat

SEQ ID NO: 6926941 - DNA, 22 bp, Homo sapiens
cctaggctggctgtcttcaggt

SEQ ID NO: 6926942 - DNA, 22 bp, Homo sapiens
ggcttctgaaccaggccctgga

SEQ ID NO: 6926943 - DNA, 22 bp, Homo sapiens
aggccctgagaaaatccctgca

SEQ ID NO: 6926944 - DNA, 22 bp, Homo sapiens
cagagtaaacctgtcatcaaga

SEQ ID NO: 6926945 - DNA, 23 bp, Homo sapiens
gagatttagcagacaaagctctt

SEQ ID NO: 6926946 - DNA, 22 bp, Homo sapiens
gagggatgcagaaacagaggcc

SEQ ID NO: 6926947 - DNA, 22 bp, Homo sapiens
aaaccatggagtaagttcacat

SEQ ID NO: 6926948 - DNA, 22 bp, Homo sapiens
ggaaggaagtgaccaggatatc

SEQ ID NO: 6926949 - DNA, 22 bp, Homo sapiens
tgatggcttcggacctgggcag

SEQ ID NO: 6926950 - DNA, 17 bp, Homo sapiens
gagatgggtggatcacc

SEQ ID NO: 6926951 - DNA, 19 bp, Homo sapiens
atatacatactgtgtgcat

SEQ ID NO: 6926952 - DNA, 22 bp, Homo sapiens
gtatcatatgcatcaggcttgc

SEQ ID NO: 6926953 - DNA, 22 bp, Homo sapiens
tctccttgtaagtaaattttac

SEQ ID NO: 6926954 - DNA, 22 bp, Homo sapiens
agcttagaagtgtgctgagagg

SEQ ID NO: 6926955 - DNA, 22 bp, Homo sapiens
gctagttctctgtattgtgtaa

SEQ ID NO: 6926956 - DNA, 22 bp, Homo sapiens
gtatatgagaaccatggaggtg

SEQ ID NO: 6926957 - DNA, 22 bp, Homo sapiens
cagccagctgaatgtaccatga

SEQ ID NO: 6926958 - DNA, 22 bp, Homo sapiens
tggctcagtgaagagataactt

SEQ ID NO: 6926959 - DNA, 22 bp, Homo sapiens
cttctctatgatgttctaaggt

SEQ ID NO: 6926960 - DNA, 22 bp, Homo sapiens
agtgtaatactcatgacaaaaa

SEQ ID NO: 6926961 - DNA, 22 bp, Homo sapiens
ctgggcactttggggagcctac

SEQ ID NO: 6926962 - DNA, 22 bp, Homo sapiens
tcctgcttccttgtctttagac

SEQ ID NO: 6926963 - DNA, 22 bp, Homo sapiens
tcagaagtcacttaggaaaggg

SEQ ID NO: 6926964 - DNA, 22 bp, Homo sapiens
gcttctccagaccttcatcccc

SEQ ID NO: 6926965 - DNA, 22 bp, Homo sapiens
actgggccaggtgtgggtgagt

SEQ ID NO: 6926966 - DNA, 18 bp, Homo sapiens
gggatatatcagtgaaga

SEQ ID NO: 6926967 - DNA, 22 bp, Homo sapiens
aggatttcccatatagctccat

SEQ ID NO: 6926968 - DNA, 22 bp, Homo sapiens
caggaacctaatgaaggctcac

SEQ ID NO: 6926969 - DNA, 22 bp, Homo sapiens
agcttggccagcagccgcgacg

SEQ ID NO: 6926970 - DNA, 22 bp, Homo sapiens
ttctgtcatcctttctagatgt

SEQ ID NO: 6926971 - DNA, 22 bp, Homo sapiens
tgctatgtgtgggctcatcctg

SEQ ID NO: 6926972 - DNA, 22 bp, Homo sapiens
tatttcacatctatgaagtgag

SEQ ID NO: 6926973 - DNA, 22 bp, Homo sapiens
ccaagtctgtaacctctgcgta

SEQ ID NO: 6926974 - DNA, 22 bp, Homo sapiens
tgactaagggtgtttataaggt

SEQ ID NO: 6926975 - DNA, 22 bp, Homo sapiens
cctcagacgcaggcctatgggc

SEQ ID NO: 6926976 - DNA, 22 bp, Homo sapiens
ttggtatacaaatatttagcac

SEQ ID NO: 6926977 - DNA, 22 bp, Homo sapiens
gtgtggaagcagatgggtgagc

SEQ ID NO: 6926978 - DNA, 17 bp, Homo sapiens
acatggcagttcacgct

SEQ ID NO: 6926979 - DNA, 22 bp, Homo sapiens
ttaggaagtgtgtccagaagcg

SEQ ID NO: 6926980 - DNA, 22 bp, Homo sapiens
gaggccagagttccccgagtca

SEQ ID NO: 6926981 - DNA, 22 bp, Homo sapiens
caaggctaccctttcaccaaaa

SEQ ID NO: 6926982 - DNA, 21 bp, Homo sapiens
taaacataaccttgtatggct

SEQ ID NO: 6926983 - DNA, 22 bp, Homo sapiens
gacttgggtggattgtgactct

SEQ ID NO: 6926984 - DNA, 22 bp, Homo sapiens
ctgttactgaaatgcaccgtgc

SEQ ID NO: 6926985 - DNA, 22 bp, Homo sapiens
tatttgtcactagaaagggtaa

SEQ ID NO: 6926986 - DNA, 22 bp, Homo sapiens
tctgtagggtagtagtggagat

SEQ ID NO: 6926987 - DNA, 22 bp, Homo sapiens
gcagacaatttattagcagatt

SEQ ID NO: 6926988 - DNA, 22 bp, Homo sapiens
attcaacttacaaaggagaaga

SEQ ID NO: 6926989 - DNA, 22 bp, Homo sapiens
aaggtaatgaaacagcagctaa

SEQ ID NO: 6926990 - DNA, 22 bp, Homo sapiens
actctacagaatgaatacctgt

SEQ ID NO: 6926991 - DNA, 22 bp, Homo sapiens
gttgcacaacttgaatggctgg

SEQ ID NO: 6926992 - DNA, 22 bp, Homo sapiens
tgttcactccatgggaattgtg

SEQ ID NO: 6926993 - DNA, 22 bp, Homo sapiens
aagctctgaggtgagcaatcgg

SEQ ID NO: 6926994 - DNA, 22 bp, Homo sapiens
tggcttcaaaatctagtggtct

SEQ ID NO: 6926995 - DNA, 22 bp, Homo sapiens
gtgcagagaaggagcagtagtt

SEQ ID NO: 6926996 - DNA, 22 bp, Homo sapiens
cagagcagcctccagggggagc

SEQ ID NO: 6926997 - DNA, 22 bp, Homo sapiens
cctggaggtggaggttgcagtg

SEQ ID NO: 6926998 - DNA, 22 bp, Homo sapiens
ctccttcctggttagcacctta

SEQ ID NO: 6926999 - DNA, 22 bp, Homo sapiens
tccaggtccagaggttcaactg

SEQ ID NO: 6927000 - DNA, 22 bp, Homo sapiens
ttctttattagtttagtgagct

SEQ ID NO: 6927001 - DNA, 23 bp, Homo sapiens
aagaatctcagaattagaaatac

SEQ ID NO: 6927002 - DNA, 22 bp, Homo sapiens
ctggcccagagctctggccttt

SEQ ID NO: 6927003 - DNA, 22 bp, Homo sapiens
atctggaattgaagaggtttga

SEQ ID NO: 6927004 - DNA, 22 bp, Homo sapiens
gtttatctagtgaagtgaagaa

SEQ ID NO: 6927005 - DNA, 22 bp, Homo sapiens
ggttagaggtggagcctggact

SEQ ID NO: 6927006 - DNA, 22 bp, Homo sapiens
cagcagctacctgctcttgtgg

SEQ ID NO: 6927007 - DNA, 22 bp, Homo sapiens
tgggttttccacatatgccatg

SEQ ID NO: 6927008 - DNA, 23 bp, Homo sapiens
agaagctgggagcctggggatgg

SEQ ID NO: 6927009 - DNA, 22 bp, Homo sapiens
ggctgagcctggagcatctggt

SEQ ID NO: 6927010 - DNA, 22 bp, Homo sapiens
atccaggctgcgggtctcaagt

SEQ ID NO: 6927011 - DNA, 22 bp, Homo sapiens
tccctgtatatcacaagggcta

SEQ ID NO: 6927012 - DNA, 22 bp, Homo sapiens
actcatcagtggttttaatcaa

SEQ ID NO: 6927013 - DNA, 22 bp, Homo sapiens
gcctgctgttaactgcaggaat

SEQ ID NO: 6927014 - DNA, 22 bp, Homo sapiens
gcagctggtgcaaatgtcactc

SEQ ID NO: 6927015 - DNA, 23 bp, Homo sapiens
tggacactgtgcggggactaggt

SEQ ID NO: 6927016 - DNA, 22 bp, Homo sapiens
tccacaggtccggcatgaacag

SEQ ID NO: 6927017 - DNA, 22 bp, Homo sapiens
tgtttcaaagaaagaaaatata

SEQ ID NO: 6927018 - DNA, 22 bp, Homo sapiens
tcagccagggctctggcctcag

SEQ ID NO: 6927019 - DNA, 22 bp, Homo sapiens
gtatttctggttaaatgtgcta

SEQ ID NO: 6927020 - DNA, 22 bp, Homo sapiens
tggctggggcctgaatcctgca

SEQ ID NO: 6927021 - DNA, 22 bp, Homo sapiens
tattcccatgaagaggtagaga

SEQ ID NO: 6927022 - DNA, 22 bp, Homo sapiens
tgttctggtgaggccatggggt

SEQ ID NO: 6927023 - DNA, 22 bp, Homo sapiens
cacttgaagtttgggggactct

SEQ ID NO: 6927024 - DNA, 20 bp, Homo sapiens
tacaacaagtagagacatac

SEQ ID NO: 6927025 - DNA, 22 bp, Homo sapiens
ttctgtcaaatttgccatatgg

SEQ ID NO: 6927026 - DNA, 22 bp, Homo sapiens
ttacaggtctgtgtcatcatct

SEQ ID NO: 6927027 - DNA, 22 bp, Homo sapiens
ccattcatttgttgtcagcctt

SEQ ID NO: 6927028 - DNA, 18 bp, Homo sapiens
cctctacctacccctaga

SEQ ID NO: 6927029 - DNA, 22 bp, Homo sapiens
gtcttagatttcaccgataatg

SEQ ID NO: 6927030 - DNA, 22 bp, Homo sapiens
tgaattcaggtagcacctcccc

SEQ ID NO: 6927031 - DNA, 22 bp, Homo sapiens
cacaccagaggttacctgcaaa

SEQ ID NO: 6927032 - DNA, 22 bp, Homo sapiens
gagcatggatagaaggtgggat

SEQ ID NO: 6927033 - DNA, 22 bp, Homo sapiens
tcaggagacaaagggtgcggag

SEQ ID NO: 6927034 - DNA, 22 bp, Homo sapiens
ctggcaggagttgggattttga

SEQ ID NO: 6927035 - DNA, 19 bp, Homo sapiens
acaaatgatgttgcactga

SEQ ID NO: 6927036 - DNA, 22 bp, Homo sapiens
gaacccggggaggttgcagtga

SEQ ID NO: 6927037 - DNA, 22 bp, Homo sapiens
agggtatgttttaggctgagtt

SEQ ID NO: 6927038 - DNA, 22 bp, Homo sapiens
gtgctcatgtcctttcactgca

SEQ ID NO: 6927039 - DNA, 23 bp, Homo sapiens
ttgtacagcccagattcctcttc

SEQ ID NO: 6927040 - DNA, 22 bp, Homo sapiens
ttggccaaacagagttcaacag

SEQ ID NO: 6927041 - DNA, 22 bp, Homo sapiens
accacaaacttagtggtgcaaa

SEQ ID NO: 6927042 - DNA, 23 bp, Homo sapiens
aggcagtgggggccactttgctt

SEQ ID NO: 6927043 - DNA, 22 bp, Homo sapiens
atgatggatgtcacagtctgta

SEQ ID NO: 6927044 - DNA, 22 bp, Homo sapiens
aagttttgaaatactgaagtgt

SEQ ID NO: 6927045 - DNA, 22 bp, Homo sapiens
tgttggtgaagtctctctgctg

SEQ ID NO: 6927046 - DNA, 22 bp, Homo sapiens
cacaggaggaggccagagcgta

SEQ ID NO: 6927047 - DNA, 22 bp, Homo sapiens
ccaggaggctcttgtccctggt

SEQ ID NO: 6927048 - DNA, 22 bp, Homo sapiens
tgagaagtgacattattgaatg

SEQ ID NO: 6927049 - DNA, 22 bp, Homo sapiens
tgacagttttttgatgaggaat

SEQ ID NO: 6927050 - DNA, 22 bp, Homo sapiens
aacacatatttatatatgcaca

SEQ ID NO: 6927051 - DNA, 22 bp, Homo sapiens
ttctgctttcagttcttctggg

SEQ ID NO: 6927052 - DNA, 22 bp, Homo sapiens
aaccccaacacaggaaatatct

SEQ ID NO: 6927053 - DNA, 22 bp, Homo sapiens
tgtgttgttttaagctgctgca

SEQ ID NO: 6927054 - DNA, 22 bp, Homo sapiens
aagatcaagtgtactttatgta

SEQ ID NO: 6927055 - DNA, 22 bp, Homo sapiens
ccttcagcctcaagatccttca

SEQ ID NO: 6927056 - DNA, 22 bp, Homo sapiens
attaatattggttcattagctg

SEQ ID NO: 6927057 - DNA, 22 bp, Homo sapiens
ttctaaagactcatggaagtgg

SEQ ID NO: 6927058 - DNA, 22 bp, Homo sapiens
caactttagaccccaagtagct

SEQ ID NO: 6927059 - DNA, 22 bp, Homo sapiens
tccacagctgtcctgtaacagg

SEQ ID NO: 6927060 - DNA, 22 bp, Homo sapiens
agcttgtaacagacataaaaat

SEQ ID NO: 6927061 - DNA, 18 bp, Homo sapiens
tcagctggggctgcagcc

SEQ ID NO: 6927062 - DNA, 22 bp, Homo sapiens
agggctgtttttggcacctggg

SEQ ID NO: 6927063 - DNA, 22 bp, Homo sapiens
tgtagtgtagcagggtgggaca

SEQ ID NO: 6927064 - DNA, 22 bp, Homo sapiens
tgcttctgcaggagctcctgat

SEQ ID NO: 6927065 - DNA, 22 bp, Homo sapiens
ttaagaaggctgtttgctagac

SEQ ID NO: 6927066 - DNA, 22 bp, Homo sapiens
gtacaaatgtacacttgtataa

SEQ ID NO: 6927067 - DNA, 22 bp, Homo sapiens
catttaatgcctttgccatcca

SEQ ID NO: 6927068 - DNA, 22 bp, Homo sapiens
caaatactgggtaagttaattt

SEQ ID NO: 6927069 - DNA, 22 bp, Homo sapiens
gaaattgtctgtgcccaagtct

SEQ ID NO: 6927070 - DNA, 19 bp, Homo sapiens
cctacttgtttgagggaag

SEQ ID NO: 6927071 - DNA, 22 bp, Homo sapiens
tcccaagagctactcaatggaa

SEQ ID NO: 6927072 - DNA, 22 bp, Homo sapiens
tggcttctattgctgtggcatt

SEQ ID NO: 6927073 - DNA, 22 bp, Homo sapiens
tacagtttttcactgaagatgt

SEQ ID NO: 6927074 - DNA, 20 bp, Homo sapiens
cacaggctatatgagagcca

SEQ ID NO: 6927075 - DNA, 23 bp, Homo sapiens
tcctcagcatgttttgtcatgta

SEQ ID NO: 6927076 - DNA, 22 bp, Homo sapiens
tgtagtctcagggagctgcttc

SEQ ID NO: 6927077 - DNA, 22 bp, Homo sapiens
attgcactccggcctgggtgac

SEQ ID NO: 6927078 - DNA, 22 bp, Homo sapiens
tttgggaaccagaagttcaaaa

SEQ ID NO: 6927079 - DNA, 22 bp, Homo sapiens
ctccttctgggcctggcagtgg

SEQ ID NO: 6927080 - DNA, 22 bp, Homo sapiens
tgtgcctgttcccactttgcct

SEQ ID NO: 6927081 - DNA, 22 bp, Homo sapiens
tgaggatggttaaagaacattg

SEQ ID NO: 6927082 - DNA, 22 bp, Homo sapiens
atgaggtatgaagtgtgggata

SEQ ID NO: 6927083 - DNA, 22 bp, Homo sapiens
acacatatattatttgtggctc

SEQ ID NO: 6927084 - DNA, 22 bp, Homo sapiens
tcccgggcaggtcgagcgagcc

SEQ ID NO: 6927085 - DNA, 19 bp, Homo sapiens
aatctctgacatctggctc

SEQ ID NO: 6927086 - DNA, 22 bp, Homo sapiens
ctgtgtgctgttagggagctgc

SEQ ID NO: 6927087 - DNA, 22 bp, Homo sapiens
ggctgccacgtcgagggtccaa

SEQ ID NO: 6927088 - DNA, 20 bp, Homo sapiens
agggtggcaagttagtgaca

SEQ ID NO: 6927089 - DNA, 22 bp, Homo sapiens
tctgccagtattcacggcccgt

SEQ ID NO: 6927090 - DNA, 22 bp, Homo sapiens
atgggcagcagctgtcattttc

SEQ ID NO: 6927091 - DNA, 22 bp, Homo sapiens
tgctcagggagcttcctggtgg

SEQ ID NO: 6927092 - DNA, 18 bp, Homo sapiens
gatcaggatcaatcaccc

SEQ ID NO: 6927093 - DNA, 22 bp, Homo sapiens
gtgacatttattagatgcttac

SEQ ID NO: 6927094 - DNA, 22 bp, Homo sapiens
acctctggccaagactcgtgtt

SEQ ID NO: 6927095 - DNA, 22 bp, Homo sapiens
gcctaggatcaaccacatgaaa

SEQ ID NO: 6927096 - DNA, 22 bp, Homo sapiens
actggctgcctccaaagtgtgc

SEQ ID NO: 6927097 - DNA, 22 bp, Homo sapiens
tcctagagatgcaatttgattt

SEQ ID NO: 6927098 - DNA, 22 bp, Homo sapiens
ctgttgtatttccaactatgta

SEQ ID NO: 6927099 - DNA, 22 bp, Homo sapiens
attaccacttaatcaacatatg

SEQ ID NO: 6927100 - DNA, 20 bp, Homo sapiens
cctgttccattccctcaacc

SEQ ID NO: 6927101 - DNA, 22 bp, Homo sapiens
ttaaatttctacgtgatccagg

SEQ ID NO: 6927102 - DNA, 20 bp, Homo sapiens
gtttagcatggcagtgaaag

SEQ ID NO: 6927103 - DNA, 22 bp, Homo sapiens
aggcatttcctatgggcagaga

SEQ ID NO: 6927104 - DNA, 22 bp, Homo sapiens
cttgacagtcccaggaaaatag

SEQ ID NO: 6927105 - DNA, 23 bp, Homo sapiens
agagtttgtttctaatgagtgag

SEQ ID NO: 6927106 - DNA, 22 bp, Homo sapiens
tgtcctcaaggagcttcagtct

SEQ ID NO: 6927107 - DNA, 23 bp, Homo sapiens
aggttctcttatcatctctgccc

SEQ ID NO: 6927108 - DNA, 22 bp, Homo sapiens
gagcatggatcatgtgctgggt

SEQ ID NO: 6927109 - DNA, 22 bp, Homo sapiens
aaattgtgtctcaggcagtggt

SEQ ID NO: 6927110 - DNA, 22 bp, Homo sapiens
ccattactgaaataaagagaat

SEQ ID NO: 6927111 - DNA, 22 bp, Homo sapiens
agattccaggcctggggccaag

SEQ ID NO: 6927112 - DNA, 21 bp, Homo sapiens
cctctctcattgtaatgaagt

SEQ ID NO: 6927113 - DNA, 22 bp, Homo sapiens
ccaatcctcatgttcaacaacc

SEQ ID NO: 6927114 - DNA, 22 bp, Homo sapiens
gtaaacatcgacccaacagggg

SEQ ID NO: 6927115 - DNA, 22 bp, Homo sapiens
gctcaagagagatgcagttctt

SEQ ID NO: 6927116 - DNA, 22 bp, Homo sapiens
tttgtgctaatgctagattact

SEQ ID NO: 6927117 - DNA, 22 bp, Homo sapiens
gtcggcagcgcggctgccaggg

SEQ ID NO: 6927118 - DNA, 22 bp, Homo sapiens
gtagtcccagctaccccggagg

SEQ ID NO: 6927119 - DNA, 22 bp, Homo sapiens
tggagctggaagacagtgatat

SEQ ID NO: 6927120 - DNA, 22 bp, Homo sapiens
ttgaaatgcatcatcatttaga

SEQ ID NO: 6927121 - DNA, 22 bp, Homo sapiens
atccaaatatattttattcact

SEQ ID NO: 6927122 - DNA, 22 bp, Homo sapiens
aaatagaaaccaacaaggtcag

SEQ ID NO: 6927123 - DNA, 22 bp, Homo sapiens
ttttctgtgattctgaggttgg

SEQ ID NO: 6927124 - DNA, 22 bp, Homo sapiens
aggagaaggaagtgcatcacta

SEQ ID NO: 6927125 - DNA, 22 bp, Homo sapiens
cgggcagcggcgtggccatggt

SEQ ID NO: 6927126 - DNA, 22 bp, Homo sapiens
ggtcacaggggagaagagtgat

SEQ ID NO: 6927127 - DNA, 22 bp, Homo sapiens
ctgggccagaccttgtggtctt

SEQ ID NO: 6927128 - DNA, 20 bp, Homo sapiens
tttctcccaagtgcaagggt

SEQ ID NO: 6927129 - DNA, 22 bp, Homo sapiens
ggtggctgaatcaaatcaggcc

SEQ ID NO: 6927130 - DNA, 22 bp, Homo sapiens
aatgttttttggtctgatgaat

SEQ ID NO: 6927131 - DNA, 22 bp, Homo sapiens
aactaaaagtgtgtctcttgta

SEQ ID NO: 6927132 - DNA, 22 bp, Homo sapiens
tcagtggaactgtctgggtgag

SEQ ID NO: 6927133 - DNA, 22 bp, Homo sapiens
tgtaggtagatcccatgtaaga

SEQ ID NO: 6927134 - DNA, 22 bp, Homo sapiens
gcaacattgagtctaagtacca

SEQ ID NO: 6927135 - DNA, 22 bp, Homo sapiens
ggtggatgctgactgttctgct

SEQ ID NO: 6927136 - DNA, 22 bp, Homo sapiens
taaatgtataggcactaaacct

SEQ ID NO: 6927137 - DNA, 22 bp, Homo sapiens
aaattattctcatgtgtttctt

SEQ ID NO: 6927138 - DNA, 20 bp, Homo sapiens
acatggcattcccacgtggt

SEQ ID NO: 6927139 - DNA, 22 bp, Homo sapiens
cttcacaaaatatttcattata

SEQ ID NO: 6927140 - DNA, 22 bp, Homo sapiens
taggcagaggtatggtaaggac

SEQ ID NO: 6927141 - DNA, 22 bp, Homo sapiens
tcatatgcatatgaaatttttg

SEQ ID NO: 6927142 - DNA, 22 bp, Homo sapiens
tctgagaggcagaccttcctaa

SEQ ID NO: 6927143 - DNA, 19 bp, Homo sapiens
tcctggtgcttgacactga

SEQ ID NO: 6927144 - DNA, 23 bp, Homo sapiens
tctgaaagggatgctgggcagga

SEQ ID NO: 6927145 - DNA, 22 bp, Homo sapiens
tggtgtcttggaagtaggtgct

SEQ ID NO: 6927146 - DNA, 22 bp, Homo sapiens
actgctctctgcaagtagatgg

SEQ ID NO: 6927147 - DNA, 22 bp, Homo sapiens
gtatgcataattgtgtattcat

SEQ ID NO: 6927148 - DNA, 22 bp, Homo sapiens
accacttcctttaggaccttgt

SEQ ID NO: 6927149 - DNA, 22 bp, Homo sapiens
gtctgccctggggcatcagttt

SEQ ID NO: 6927150 - DNA, 22 bp, Homo sapiens
atgagataattcatgtggaatg

SEQ ID NO: 6927151 - DNA, 22 bp, Homo sapiens
gtttccattgtcctatctatag

SEQ ID NO: 6927152 - DNA, 22 bp, Homo sapiens
ttgaaatatggattgaccttga

SEQ ID NO: 6927153 - DNA, 22 bp, Homo sapiens
ttcataggtttgctgtgaacat

SEQ ID NO: 6927154 - DNA, 19 bp, Homo sapiens
actccagggatgacagaag

SEQ ID NO: 6927155 - DNA, 22 bp, Homo sapiens
caaaattgattgtggtgatggt

SEQ ID NO: 6927156 - DNA, 22 bp, Homo sapiens
tcacagttcaactagttcagat

SEQ ID NO: 6927157 - DNA, 19 bp, Homo sapiens
atggtacagtgtacacttg

SEQ ID NO: 6927158 - DNA, 18 bp, Homo sapiens
tgctccaggcccatgggc

SEQ ID NO: 6927159 - DNA, 19 bp, Homo sapiens
ggtccagacttcagactag

SEQ ID NO: 6927160 - DNA, 22 bp, Homo sapiens
atggtcacaccactgtactcca

SEQ ID NO: 6927161 - DNA, 22 bp, Homo sapiens
actcatcagattagattagggc

SEQ ID NO: 6927162 - DNA, 22 bp, Homo sapiens
tctctcctaatttcaggtgctt

SEQ ID NO: 6927163 - DNA, 22 bp, Homo sapiens
tcgctcatggaatattatatct

SEQ ID NO: 6927164 - DNA, 22 bp, Homo sapiens
agcgccaagtgtgtggaggagg

SEQ ID NO: 6927165 - DNA, 22 bp, Homo sapiens
tggggtgaggcagccacattta

SEQ ID NO: 6927166 - DNA, 22 bp, Homo sapiens
atcacctgggagcatattaaat

SEQ ID NO: 6927167 - DNA, 18 bp, Homo sapiens
attaaggaattctttaga

SEQ ID NO: 6927168 - DNA, 20 bp, Homo sapiens
ccctctgctacactgggagc

SEQ ID NO: 6927169 - DNA, 20 bp, Homo sapiens
acagataccctgtgctggtg

SEQ ID NO: 6927170 - DNA, 22 bp, Homo sapiens
ccatccctgccattatagccca

SEQ ID NO: 6927171 - DNA, 22 bp, Homo sapiens
acacagagcttctcaactggga

SEQ ID NO: 6927172 - DNA, 22 bp, Homo sapiens
ctgtgaatgttatatctcaatg

SEQ ID NO: 6927173 - DNA, 22 bp, Homo sapiens
cctggagagctcgggccaggca

SEQ ID NO: 6927174 - DNA, 22 bp, Homo sapiens
gggcggcgtcggcgaggccatc

SEQ ID NO: 6927175 - DNA, 22 bp, Homo sapiens
tgtcttcagaattaagagtatg

SEQ ID NO: 6927176 - DNA, 22 bp, Homo sapiens
ttaactgcctgccttcagcagg

SEQ ID NO: 6927177 - DNA, 19 bp, Homo sapiens
attagcagacttcctttca

SEQ ID NO: 6927178 - DNA, 22 bp, Homo sapiens
agatgagtacagagctgtactc

SEQ ID NO: 6927179 - DNA, 22 bp, Homo sapiens
tgatggccagtcgcactggagg

SEQ ID NO: 6927180 - DNA, 22 bp, Homo sapiens
aggctggcgtcaggggctgtac

SEQ ID NO: 6927181 - DNA, 23 bp, Homo sapiens
tggccaagataatctcagttttc

SEQ ID NO: 6927182 - DNA, 22 bp, Homo sapiens
acatgcatggctgcttaaatta

SEQ ID NO: 6927183 - DNA, 22 bp, Homo sapiens
acgtagcactgagagatgcagg

SEQ ID NO: 6927184 - DNA, 22 bp, Homo sapiens
tcctgcctcttttcttattcca

SEQ ID NO: 6927185 - DNA, 22 bp, Homo sapiens
tgcccccaggccctgtggttag

SEQ ID NO: 6927186 - DNA, 22 bp, Homo sapiens
aggatttattatatgccctcat

SEQ ID NO: 6927187 - DNA, 22 bp, Homo sapiens
ataaagatagaatgctttcctg

SEQ ID NO: 6927188 - DNA, 22 bp, Homo sapiens
atggggttcacctgacagagaa

SEQ ID NO: 6927189 - DNA, 22 bp, Homo sapiens
tggtaaagttgattggtgctct

SEQ ID NO: 6927190 - DNA, 22 bp, Homo sapiens
taggccagtaaaatgtttcagt

SEQ ID NO: 6927191 - DNA, 22 bp, Homo sapiens
tacaatgcaaaatactgtctgc

SEQ ID NO: 6927192 - DNA, 17 bp, Homo sapiens
accttgcagtgtgccgg

SEQ ID NO: 6927193 - DNA, 22 bp, Homo sapiens
agaccctgcacctctcgtgggc

SEQ ID NO: 6927194 - DNA, 20 bp, Homo sapiens
cagaacatgagcatcgagcc

SEQ ID NO: 6927195 - DNA, 22 bp, Homo sapiens
tcagccatggtgagagtgagag

SEQ ID NO: 6927196 - DNA, 22 bp, Homo sapiens
tggctgtcagtaccttgacatc

SEQ ID NO: 6927197 - DNA, 19 bp, Homo sapiens
cttgatcttggacttccag

SEQ ID NO: 6927198 - DNA, 22 bp, Homo sapiens
gggctggagtcttctgaaagcc

SEQ ID NO: 6927199 - DNA, 22 bp, Homo sapiens
gtcctcagagtgggcaggtcct

SEQ ID NO: 6927200 - DNA, 22 bp, Homo sapiens
tcctcagtctctaaggcctcag

SEQ ID NO: 6927201 - DNA, 22 bp, Homo sapiens
gagaatctgggttttggctatc

SEQ ID NO: 6927202 - DNA, 22 bp, Homo sapiens
actgcgtggggagctgtgacta

SEQ ID NO: 6927203 - DNA, 22 bp, Homo sapiens
gtctgcagcctccacctcctgg

SEQ ID NO: 6927204 - DNA, 22 bp, Homo sapiens
agttagtatgcattaccctcca

SEQ ID NO: 6927205 - DNA, 22 bp, Homo sapiens
agaccagtagtatggattatga

SEQ ID NO: 6927206 - DNA, 22 bp, Homo sapiens
caaagtcagggaagagtggctg

SEQ ID NO: 6927207 - DNA, 22 bp, Homo sapiens
acttgcagatagtttacctttg

SEQ ID NO: 6927208 - DNA, 22 bp, Homo sapiens
cagatgtggttaacatgtacat

SEQ ID NO: 6927209 - DNA, 22 bp, Homo sapiens
ggttgctctttggaccctgctg

SEQ ID NO: 6927210 - DNA, 22 bp, Homo sapiens
cttagcaaggctgcctggagaa

SEQ ID NO: 6927211 - DNA, 22 bp, Homo sapiens
tagatgcttcagaaggcctgca

SEQ ID NO: 6927212 - DNA, 22 bp, Homo sapiens
gtgaggtcaaagccttgggtat

SEQ ID NO: 6927213 - DNA, 22 bp, Homo sapiens
gcagggcatagaggcacggagg

SEQ ID NO: 6927214 - DNA, 22 bp, Homo sapiens
gaagcacagataattcaagtat

SEQ ID NO: 6927215 - DNA, 22 bp, Homo sapiens
agtctggattagttgggggcaa

SEQ ID NO: 6927216 - DNA, 22 bp, Homo sapiens
gaggcttttctctaaatagtgg

SEQ ID NO: 6927217 - DNA, 22 bp, Homo sapiens
gctgctgtgtgggagacaggcg

SEQ ID NO: 6927218 - DNA, 22 bp, Homo sapiens
tctgtaaatctactaagagctc

SEQ ID NO: 6927219 - DNA, 22 bp, Homo sapiens
agaagctgcctacatgaccagc

SEQ ID NO: 6927220 - DNA, 22 bp, Homo sapiens
ccttcaaggcaaggagggctgg

SEQ ID NO: 6927221 - DNA, 22 bp, Homo sapiens
aaggaagatgctggcctgggga

SEQ ID NO: 6927222 - DNA, 22 bp, Homo sapiens
actctcactagctctgtgacct

SEQ ID NO: 6927223 - DNA, 22 bp, Homo sapiens
gctgttcacagactctgctctg

SEQ ID NO: 6927224 - DNA, 22 bp, Homo sapiens
aggcagtggctgagaccagggg

SEQ ID NO: 6927225 - DNA, 22 bp, Homo sapiens
tgtttctgtatgatcaatattg

SEQ ID NO: 6927226 - DNA, 22 bp, Homo sapiens
tcctccaagcctttgtgaagtg

SEQ ID NO: 6927227 - DNA, 21 bp, Homo sapiens
aggcttgtaatatctcaggca

SEQ ID NO: 6927228 - DNA, 22 bp, Homo sapiens
tggtgcagatagtggtgtagta

SEQ ID NO: 6927229 - DNA, 22 bp, Homo sapiens
tgccattacccaagagtaagat

SEQ ID NO: 6927230 - DNA, 23 bp, Homo sapiens
tttggcatgttaacttcacttac

SEQ ID NO: 6927231 - DNA, 23 bp, Homo sapiens
aggcgagctcttctccagcacgt

SEQ ID NO: 6927232 - DNA, 22 bp, Homo sapiens
agtttaattggaggcgtggctc

SEQ ID NO: 6927233 - DNA, 22 bp, Homo sapiens
aggcattgtcatgggagcctag

SEQ ID NO: 6927234 - DNA, 22 bp, Homo sapiens
tccacatccattgcttgacttt

SEQ ID NO: 6927235 - DNA, 22 bp, Homo sapiens
agttggaccttgtagagtttcc

SEQ ID NO: 6927236 - DNA, 22 bp, Homo sapiens
ggagagaccctggagaaggtcc

SEQ ID NO: 6927237 - DNA, 20 bp, Homo sapiens
aactcctagcctcaagtgat

SEQ ID NO: 6927238 - DNA, 22 bp, Homo sapiens
tgagccaagatcatgccgttgt

SEQ ID NO: 6927239 - DNA, 22 bp, Homo sapiens
cttgttcagtcctgacttcctg

SEQ ID NO: 6927240 - DNA, 22 bp, Homo sapiens
atgtcccttctttggtgctcag

SEQ ID NO: 6927241 - DNA, 20 bp, Homo sapiens
ttggacagacgcattgacac

SEQ ID NO: 6927242 - DNA, 22 bp, Homo sapiens
caatgtttgttagagctctaga

SEQ ID NO: 6927243 - DNA, 21 bp, Homo sapiens
caagatctcggcttgcttcct

SEQ ID NO: 6927244 - DNA, 22 bp, Homo sapiens
cagagcccagggcctacgtccc

SEQ ID NO: 6927245 - DNA, 22 bp, Homo sapiens
cctgcctatgtaagtggtttct

SEQ ID NO: 6927246 - DNA, 20 bp, Homo sapiens
agccctcttccagatgaagg

SEQ ID NO: 6927247 - DNA, 22 bp, Homo sapiens
aatgatgtttttaaagaacata

SEQ ID NO: 6927248 - DNA, 22 bp, Homo sapiens
caacaggctttatgtttaaagt

SEQ ID NO: 6927249 - DNA, 21 bp, Homo sapiens
aggcagccagtcatgctccct

SEQ ID NO: 6927250 - DNA, 22 bp, Homo sapiens
catgtatagttggaactacatc

SEQ ID NO: 6927251 - DNA, 22 bp, Homo sapiens
agaatcttcagtctaattccta

SEQ ID NO: 6927252 - DNA, 22 bp, Homo sapiens
acctggtgggagataattgaat

SEQ ID NO: 6927253 - DNA, 22 bp, Homo sapiens
tcctctgaggtcctctcggcca

SEQ ID NO: 6927254 - DNA, 22 bp, Homo sapiens
gtcctgtgtcccagagaaagag

SEQ ID NO: 6927255 - DNA, 22 bp, Homo sapiens
gagtaaaagttggattacaaag

SEQ ID NO: 6927256 - DNA, 23 bp, Homo sapiens
cttcggaatatgataagggacct

SEQ ID NO: 6927257 - DNA, 22 bp, Homo sapiens
ctgcaaataggggtgtgaataa

SEQ ID NO: 6927258 - DNA, 22 bp, Homo sapiens
aagagtaaatgtctaattagga

SEQ ID NO: 6927259 - DNA, 22 bp, Homo sapiens
tctagggtgtgcggcagggcta

SEQ ID NO: 6927260 - DNA, 21 bp, Homo sapiens
gtatatcagcagtgaattcaa

SEQ ID NO: 6927261 - DNA, 22 bp, Homo sapiens
gaacccaggaggcagaggttgc

SEQ ID NO: 6927262 - DNA, 22 bp, Homo sapiens
atatgaagttacaggtaagaaa

SEQ ID NO: 6927263 - DNA, 22 bp, Homo sapiens
ttccaaggcaacagcctaggct

SEQ ID NO: 6927264 - DNA, 22 bp, Homo sapiens
aaccttgtataaaactttgaga

SEQ ID NO: 6927265 - DNA, 22 bp, Homo sapiens
ggttggacactaggtaggagcg

SEQ ID NO: 6927266 - DNA, 22 bp, Homo sapiens
aggacctgctaatgtgccaagt

SEQ ID NO: 6927267 - DNA, 20 bp, Homo sapiens
agatacagtggtttctttag

SEQ ID NO: 6927268 - DNA, 21 bp, Homo sapiens
ttctcctccaagttgctcctg

SEQ ID NO: 6927269 - DNA, 22 bp, Homo sapiens
ttcagactggctacattttcat

SEQ ID NO: 6927270 - DNA, 22 bp, Homo sapiens
ctgccctgtgcacaggaaactg

SEQ ID NO: 6927271 - DNA, 22 bp, Homo sapiens
tgaaggagctcaggagatagtc

SEQ ID NO: 6927272 - DNA, 22 bp, Homo sapiens
ctagtctagactatctggcaga

SEQ ID NO: 6927273 - DNA, 22 bp, Homo sapiens
ggctcagattccgagtggccct

SEQ ID NO: 6927274 - DNA, 22 bp, Homo sapiens
tcaccttaacaatctgaccatc

SEQ ID NO: 6927275 - DNA, 22 bp, Homo sapiens
tctgggtgctacaaacagtatt

SEQ ID NO: 6927276 - DNA, 22 bp, Homo sapiens
ccatggcagccatgggagccac

SEQ ID NO: 6927277 - DNA, 22 bp, Homo sapiens
tccagcccatccctagcctggg

SEQ ID NO: 6927278 - DNA, 22 bp, Homo sapiens
tagctcttctaatggtaaagag

SEQ ID NO: 6927279 - DNA, 22 bp, Homo sapiens
ctgagaatgttttctgattgat

SEQ ID NO: 6927280 - DNA, 22 bp, Homo sapiens
agagtggcttgctcagctagca

SEQ ID NO: 6927281 - DNA, 22 bp, Homo sapiens
agggctcccgtgaggtgactgc

SEQ ID NO: 6927282 - DNA, 22 bp, Homo sapiens
agttctataattaaaatgaagg

SEQ ID NO: 6927283 - DNA, 22 bp, Homo sapiens
atgtacagtggaaactaacaaa

SEQ ID NO: 6927284 - DNA, 22 bp, Homo sapiens
tttctcatctggaaacagtgct

SEQ ID NO: 6927285 - DNA, 22 bp, Homo sapiens
ggacactgaagaatctcagatg

SEQ ID NO: 6927286 - DNA, 22 bp, Homo sapiens
acacaatttcataaacaccatg

SEQ ID NO: 6927287 - DNA, 22 bp, Homo sapiens
ccctgtgcctagttggcctaaa

SEQ ID NO: 6927288 - DNA, 22 bp, Homo sapiens
tggagaggaaagtgcagttttg

SEQ ID NO: 6927289 - DNA, 22 bp, Homo sapiens
tctgctacaaatacgctgggag

SEQ ID NO: 6927290 - DNA, 22 bp, Homo sapiens
atatgctttgggattagatcat

SEQ ID NO: 6927291 - DNA, 22 bp, Homo sapiens
tcacagctttcagattgttccc

SEQ ID NO: 6927292 - DNA, 22 bp, Homo sapiens
tcctgggaagagacctgagcat

SEQ ID NO: 6927293 - DNA, 22 bp, Homo sapiens
aggcctagagctttggagggca

SEQ ID NO: 6927294 - DNA, 22 bp, Homo sapiens
ggtggccatggtcaggtagcgg

SEQ ID NO: 6927295 - DNA, 22 bp, Homo sapiens
tgggagatgctcattctatgtt

SEQ ID NO: 6927296 - DNA, 22 bp, Homo sapiens
gcactggacaggagtgaaatta

SEQ ID NO: 6927297 - DNA, 22 bp, Homo sapiens
atgtgagaactcaggaaatact

SEQ ID NO: 6927298 - DNA, 22 bp, Homo sapiens
tgtgcagctttctggctttaag

SEQ ID NO: 6927299 - DNA, 23 bp, Homo sapiens
ttgtccagctggtttgggccaca

SEQ ID NO: 6927300 - DNA, 22 bp, Homo sapiens
tgtgaggatgtgagcgtgaacc

SEQ ID NO: 6927301 - DNA, 22 bp, Homo sapiens
agttccctggatgagctaaaaa

SEQ ID NO: 6927302 - DNA, 22 bp, Homo sapiens
acacagttctcttcttgtaact

SEQ ID NO: 6927303 - DNA, 21 bp, Homo sapiens
ttctcatgggataagtacatg

SEQ ID NO: 6927304 - DNA, 22 bp, Homo sapiens
tcctgaacattatgcaagcttc

SEQ ID NO: 6927305 - DNA, 22 bp, Homo sapiens
tggcagtgctgcagtgccctta

SEQ ID NO: 6927306 - DNA, 22 bp, Homo sapiens
gctggagtgagggaccatattt

SEQ ID NO: 6927307 - DNA, 22 bp, Homo sapiens
atatggctgtttcactagctga

SEQ ID NO: 6927308 - DNA, 22 bp, Homo sapiens
atacatagcagggtagtagatc

SEQ ID NO: 6927309 - DNA, 22 bp, Homo sapiens
tacagcctgttacctatatttg

SEQ ID NO: 6927310 - DNA, 22 bp, Homo sapiens
aggaattggttcaaggtttatc

SEQ ID NO: 6927311 - DNA, 22 bp, Homo sapiens
tgtataactcttgttggagttt

SEQ ID NO: 6927312 - DNA, 22 bp, Homo sapiens
ttccaattgcagatcagataca

SEQ ID NO: 6927313 - DNA, 23 bp, Homo sapiens
tgtcctatgcagctaaaattcct

SEQ ID NO: 6927314 - DNA, 22 bp, Homo sapiens
acccagggccacagcccgcagt

SEQ ID NO: 6927315 - DNA, 22 bp, Homo sapiens
ggcctctgccctcactcctgtc

SEQ ID NO: 6927316 - DNA, 22 bp, Homo sapiens
tacatcattttggagatgagca

SEQ ID NO: 6927317 - DNA, 22 bp, Homo sapiens
cacagctgccatgcagtcagtg

SEQ ID NO: 6927318 - DNA, 22 bp, Homo sapiens
catacaagcgtgcatgtgcttg

SEQ ID NO: 6927319 - DNA, 22 bp, Homo sapiens
gccgtgtgggcaacatggtcat

SEQ ID NO: 6927320 - DNA, 22 bp, Homo sapiens
acagcacagagtggtatggctg

SEQ ID NO: 6927321 - DNA, 20 bp, Homo sapiens
agggctctgccttgctgatg

SEQ ID NO: 6927322 - DNA, 22 bp, Homo sapiens
ggtggcattcagaagagctggc

SEQ ID NO: 6927323 - DNA, 22 bp, Homo sapiens
tctggcagcaagataacaatgg

SEQ ID NO: 6927324 - DNA, 22 bp, Homo sapiens
ctcctgggctcatatcattcag

SEQ ID NO: 6927325 - DNA, 22 bp, Homo sapiens
tcagggccacgcggaggtgacg

SEQ ID NO: 6927326 - DNA, 22 bp, Homo sapiens
gagactttctgatctcactcat

SEQ ID NO: 6927327 - DNA, 23 bp, Homo sapiens
aggatgtcgaatgttagagtgag

SEQ ID NO: 6927328 - DNA, 23 bp, Homo sapiens
gagagcccattggcaggggtacc

SEQ ID NO: 6927329 - DNA, 22 bp, Homo sapiens
tgtatgtatgaataagcaagat

SEQ ID NO: 6927330 - DNA, 22 bp, Homo sapiens
gataagctaacccaagcccttt

SEQ ID NO: 6927331 - DNA, 20 bp, Homo sapiens
ctcaggattgtctagcccct

SEQ ID NO: 6927332 - DNA, 22 bp, Homo sapiens
gcctggcagtgatgtcttttgg

SEQ ID NO: 6927333 - DNA, 20 bp, Homo sapiens
gcaggctccgggcttgggag

SEQ ID NO: 6927334 - DNA, 22 bp, Homo sapiens
aggtaaggagtcccaaccatcc

SEQ ID NO: 6927335 - DNA, 22 bp, Homo sapiens
tgagggctccccgctgctgtgt

SEQ ID NO: 6927336 - DNA, 22 bp, Homo sapiens
agatacacttgttccttccact

SEQ ID NO: 6927337 - DNA, 22 bp, Homo sapiens
aaatgcctcattttctctcact

SEQ ID NO: 6927338 - DNA, 22 bp, Homo sapiens
ttggctcacctggagcctgttg

SEQ ID NO: 6927339 - DNA, 22 bp, Homo sapiens
atttctgataaacgtaagctgc

SEQ ID NO: 6927340 - DNA, 22 bp, Homo sapiens
ctgtctgtttcaaaagtggtta

SEQ ID NO: 6927341 - DNA, 22 bp, Homo sapiens
aaaatgaggtcaatatcctttt

SEQ ID NO: 6927342 - DNA, 22 bp, Homo sapiens
ctgagagatggtgtgtttataa

SEQ ID NO: 6927343 - DNA, 19 bp, Homo sapiens
tgttgtctaccatgaagtc

SEQ ID NO: 6927344 - DNA, 22 bp, Homo sapiens
ctgtggcctggggacactatct

SEQ ID NO: 6927345 - DNA, 22 bp, Homo sapiens
attgttagttagtgtggggaga

SEQ ID NO: 6927346 - DNA, 22 bp, Homo sapiens
tgcaaaaacagccttgaggcct

SEQ ID NO: 6927347 - DNA, 22 bp, Homo sapiens
ttacaggtgtgagccaccccac

SEQ ID NO: 6927348 - DNA, 21 bp, Homo sapiens
ctctttgggatctttggaaag

SEQ ID NO: 6927349 - DNA, 22 bp, Homo sapiens
catgctttgggtcagaaatgcc

SEQ ID NO: 6927350 - DNA, 22 bp, Homo sapiens
gatggacacctcctgaggttct

SEQ ID NO: 6927351 - DNA, 23 bp, Homo sapiens
ttcatgtggacctagaggcctgt

SEQ ID NO: 6927352 - DNA, 22 bp, Homo sapiens
ccatttatagatgtatttggct

SEQ ID NO: 6927353 - DNA, 22 bp, Homo sapiens
aatttcacagctggtctatggg

SEQ ID NO: 6927354 - DNA, 22 bp, Homo sapiens
ttgtagcatcaatcagtacttt

SEQ ID NO: 6927355 - DNA, 22 bp, Homo sapiens
tgggctcttggaccccaacgct

SEQ ID NO: 6927356 - DNA, 22 bp, Homo sapiens
ccagctggtaagtgatggagcc

SEQ ID NO: 6927357 - DNA, 21 bp, Homo sapiens
tcaggctgtctgctggttcca

SEQ ID NO: 6927358 - DNA, 22 bp, Homo sapiens
cacgaggccatctccttctgga

SEQ ID NO: 6927359 - DNA, 22 bp, Homo sapiens
atatatgaagaagtcttgatta

SEQ ID NO: 6927360 - DNA, 22 bp, Homo sapiens
tgcccgtggcctggggcagctt

SEQ ID NO: 6927361 - DNA, 23 bp, Homo sapiens
tcctggagaaaagaaacatttct

SEQ ID NO: 6927362 - DNA, 22 bp, Homo sapiens
gtttcttaagttacaaaatctt

SEQ ID NO: 6927363 - DNA, 22 bp, Homo sapiens
tgccgcaagtactgctgcctgt

SEQ ID NO: 6927364 - DNA, 22 bp, Homo sapiens
attgtgctcacagcttgtttct

SEQ ID NO: 6927365 - DNA, 22 bp, Homo sapiens
tcatgcatatttgtagtagttc

SEQ ID NO: 6927366 - DNA, 22 bp, Homo sapiens
gatcctgggcccttctgggtca

SEQ ID NO: 6927367 - DNA, 22 bp, Homo sapiens
gagtgaaaaaggaagggccata

SEQ ID NO: 6927368 - DNA, 22 bp, Homo sapiens
gaactggtcttttaggttttct

SEQ ID NO: 6927369 - DNA, 22 bp, Homo sapiens
ttatgtaagtggagtcatatag

SEQ ID NO: 6927370 - DNA, 22 bp, Homo sapiens
tcaaaggcccattgtcccgttg

SEQ ID NO: 6927371 - DNA, 22 bp, Homo sapiens
aggcaagttattggctcagagc

SEQ ID NO: 6927372 - DNA, 22 bp, Homo sapiens
cacatctgctctgggcagcact

SEQ ID NO: 6927373 - DNA, 22 bp, Homo sapiens
tagttcttcatgaattcagctt

SEQ ID NO: 6927374 - DNA, 22 bp, Homo sapiens
agccagctgtgggctcaggcgg

SEQ ID NO: 6927375 - DNA, 22 bp, Homo sapiens
aagcaaagtgaattttgccaag

SEQ ID NO: 6927376 - DNA, 23 bp, Homo sapiens
tgccgtgttagaaatgttttaca

SEQ ID NO: 6927377 - DNA, 22 bp, Homo sapiens
acatgagatggtggggatccct

SEQ ID NO: 6927378 - DNA, 22 bp, Homo sapiens
aaatgctctggggataagactg

SEQ ID NO: 6927379 - DNA, 22 bp, Homo sapiens
ataaggtagcaagcacagtcct

SEQ ID NO: 6927380 - DNA, 22 bp, Homo sapiens
acagtactgtgttaactgaacc

SEQ ID NO: 6927381 - DNA, 22 bp, Homo sapiens
atcttgttaaaaagcagattct

SEQ ID NO: 6927382 - DNA, 22 bp, Homo sapiens
tcctgggactctttatcagaga

SEQ ID NO: 6927383 - DNA, 22 bp, Homo sapiens
gtgagttactctggttctcatt

SEQ ID NO: 6927384 - DNA, 22 bp, Homo sapiens
cagatgcttgttggctggtctc

SEQ ID NO: 6927385 - DNA, 22 bp, Homo sapiens
aaagacatggaactagagatgg

SEQ ID NO: 6927386 - DNA, 22 bp, Homo sapiens
tctctgcatccccagggctctc

SEQ ID NO: 6927387 - DNA, 22 bp, Homo sapiens
taggtagggaaatggttcctgt

SEQ ID NO: 6927388 - DNA, 22 bp, Homo sapiens
agaggggcgggaactcaacctc

SEQ ID NO: 6927389 - DNA, 22 bp, Homo sapiens
tcaggatgacttcaaggaggaa

SEQ ID NO: 6927390 - DNA, 21 bp, Homo sapiens
atgcccttcactcaaggccag

SEQ ID NO: 6927391 - DNA, 22 bp, Homo sapiens
tgcagggccttgttgatgtgct

SEQ ID NO: 6927392 - DNA, 22 bp, Homo sapiens
agtttgccccgtcaccctggtg

SEQ ID NO: 6927393 - DNA, 22 bp, Homo sapiens
cctcaccttcccagagacgatc

SEQ ID NO: 6927394 - DNA, 22 bp, Homo sapiens
gctcttcagacaacgactccat

SEQ ID NO: 6927395 - DNA, 19 bp, Homo sapiens
tactttttcaggacagagt

SEQ ID NO: 6927396 - DNA, 22 bp, Homo sapiens
tccatcaccacagaggacagag

SEQ ID NO: 6927397 - DNA, 22 bp, Homo sapiens
atgcagatggtggatggagaaa

SEQ ID NO: 6927398 - DNA, 22 bp, Homo sapiens
ttacaggattctttggatatgc

SEQ ID NO: 6927399 - DNA, 22 bp, Homo sapiens
taggaagtagataggttgttct

SEQ ID NO: 6927400 - DNA, 22 bp, Homo sapiens
aaccattcactgaacagttcaa

SEQ ID NO: 6927401 - DNA, 22 bp, Homo sapiens
aagtactaaggctattatgatg

SEQ ID NO: 6927402 - DNA, 22 bp, Homo sapiens
taagacttcattagtaatatgg

SEQ ID NO: 6927403 - DNA, 21 bp, Homo sapiens
acagaggcatacagcttaagg

SEQ ID NO: 6927404 - DNA, 22 bp, Homo sapiens
ttgtaagactgtagaatgcaaa

SEQ ID NO: 6927405 - DNA, 22 bp, Homo sapiens
agcagaatgcttaaagctagtg

SEQ ID NO: 6927406 - DNA, 22 bp, Homo sapiens
gtgctgtgcgctttttctgtat

SEQ ID NO: 6927407 - DNA, 22 bp, Homo sapiens
tatgggtattattggtaagaat

SEQ ID NO: 6927408 - DNA, 22 bp, Homo sapiens
ctcagcagcagggaagaggtca

SEQ ID NO: 6927409 - DNA, 22 bp, Homo sapiens
tgcaggagcccaggaatactat

SEQ ID NO: 6927410 - DNA, 22 bp, Homo sapiens
ttgccatttcaagtggccactg

SEQ ID NO: 6927411 - DNA, 22 bp, Homo sapiens
ttgtaaactgctgcaggagtgc

SEQ ID NO: 6927412 - DNA, 22 bp, Homo sapiens
tgcaggtgcgttttcaagcctc

SEQ ID NO: 6927413 - DNA, 22 bp, Homo sapiens
tctgccttgaggtcctcagctc

SEQ ID NO: 6927414 - DNA, 22 bp, Homo sapiens
tttgtgcacttctgtagctgcc

SEQ ID NO: 6927415 - DNA, 22 bp, Homo sapiens
cctgagaaatagcatcattttt

SEQ ID NO: 6927416 - DNA, 22 bp, Homo sapiens
tgtcctctgttaggggatagcg

SEQ ID NO: 6927417 - DNA, 22 bp, Homo sapiens
agtgggctgagcttgctgggtg

SEQ ID NO: 6927418 - DNA, 22 bp, Homo sapiens
atctggcttacctagggtgcct

SEQ ID NO: 6927419 - DNA, 22 bp, Homo sapiens
tattcagaataaagactacatt

SEQ ID NO: 6927420 - DNA, 22 bp, Homo sapiens
gagctgcttgcccagaagcaga

SEQ ID NO: 6927421 - DNA, 22 bp, Homo sapiens
ttctggctttgaccaagttcaa

SEQ ID NO: 6927422 - DNA, 22 bp, Homo sapiens
tctactttataagtatataagt

SEQ ID NO: 6927423 - DNA, 22 bp, Homo sapiens
ccagaggggcacaaaagtagaa

SEQ ID NO: 6927424 - DNA, 22 bp, Homo sapiens
cccttggaggaagctctaggct

SEQ ID NO: 6927425 - DNA, 22 bp, Homo sapiens
ctgggcacctttgcagcaggct

SEQ ID NO: 6927426 - DNA, 22 bp, Homo sapiens
tttatagttatatacagatgtt

SEQ ID NO: 6927427 - DNA, 22 bp, Homo sapiens
cttggagtcaataagatctaga

SEQ ID NO: 6927428 - DNA, 22 bp, Homo sapiens
ttcctaatcacgaacattattt

SEQ ID NO: 6927429 - DNA, 22 bp, Homo sapiens
aactcagatgtttggctacctt

SEQ ID NO: 6927430 - DNA, 22 bp, Homo sapiens
tggcttcccctaccttccaatt

SEQ ID NO: 6927431 - DNA, 20 bp, Homo sapiens
agcacctcccatatgctaga

SEQ ID NO: 6927432 - DNA, 22 bp, Homo sapiens
aggcagatgtgtcttctaaaat

SEQ ID NO: 6927433 - DNA, 22 bp, Homo sapiens
gtactgttggatgttgcagttt

SEQ ID NO: 6927434 - DNA, 22 bp, Homo sapiens
tggagcctgagtcagcggaggc

SEQ ID NO: 6927435 - DNA, 22 bp, Homo sapiens
gattttaattataggaggtcct

SEQ ID NO: 6927436 - DNA, 22 bp, Homo sapiens
tccatgagctagggattcatca

SEQ ID NO: 6927437 - DNA, 21 bp, Homo sapiens
tacagaatgcgcttcagtctg

SEQ ID NO: 6927438 - DNA, 22 bp, Homo sapiens
agctttatgggagcttagataa

SEQ ID NO: 6927439 - DNA, 20 bp, Homo sapiens
atatgggtgatgatgtctgt

SEQ ID NO: 6927440 - DNA, 22 bp, Homo sapiens
tagttacagagaaatgatttga

SEQ ID NO: 6927441 - DNA, 22 bp, Homo sapiens
gaggctggcagaaaagcacagg

SEQ ID NO: 6927442 - DNA, 22 bp, Homo sapiens
attttctagatagatgatgcat

SEQ ID NO: 6927443 - DNA, 22 bp, Homo sapiens
ctttgaattccagtacaataac

SEQ ID NO: 6927444 - DNA, 22 bp, Homo sapiens
attcacaaatgctgccccattc

SEQ ID NO: 6927445 - DNA, 22 bp, Homo sapiens
gtcctcaggaaagcagataaca

SEQ ID NO: 6927446 - DNA, 22 bp, Homo sapiens
gaatcaattgtgaagactatga

SEQ ID NO: 6927447 - DNA, 17 bp, Homo sapiens
cattcagagtaattaca

SEQ ID NO: 6927448 - DNA, 22 bp, Homo sapiens
atgcaaatgcagccattgcaga

SEQ ID NO: 6927449 - DNA, 22 bp, Homo sapiens
ctgaggcctcgttggctggaac

SEQ ID NO: 6927450 - DNA, 22 bp, Homo sapiens
tttcttccccaagtgaatttta

SEQ ID NO: 6927451 - DNA, 22 bp, Homo sapiens
gtaaattatttcaagatcatct

SEQ ID NO: 6927452 - DNA, 22 bp, Homo sapiens
cctgtttattgtgaagaaccca

SEQ ID NO: 6927453 - DNA, 22 bp, Homo sapiens
cagatccacccttgtagtgaca

SEQ ID NO: 6927454 - DNA, 22 bp, Homo sapiens
ctgagggccttctatgctgagc

SEQ ID NO: 6927455 - DNA, 22 bp, Homo sapiens
aaagcttctaggcctattgctt

SEQ ID NO: 6927456 - DNA, 22 bp, Homo sapiens
gaagtagcatgttgctgccaga

SEQ ID NO: 6927457 - DNA, 22 bp, Homo sapiens
tttgcataccctccctgtgctg

SEQ ID NO: 6927458 - DNA, 22 bp, Homo sapiens
aacttgatcctgctgggtacta

SEQ ID NO: 6927459 - DNA, 22 bp, Homo sapiens
tacaagtctcagttttggattc

SEQ ID NO: 6927460 - DNA, 22 bp, Homo sapiens
cttgctgtgtggtgttctcaga

SEQ ID NO: 6927461 - DNA, 22 bp, Homo sapiens
ctgactttgacttggtcattga

SEQ ID NO: 6927462 - DNA, 22 bp, Homo sapiens
ggagctgtgctgggtgatcagg

SEQ ID NO: 6927463 - DNA, 21 bp, Homo sapiens
ggaaaattcagagtgcaattt

SEQ ID NO: 6927464 - DNA, 22 bp, Homo sapiens
gggctcatcatctgtgggggat

SEQ ID NO: 6927465 - DNA, 22 bp, Homo sapiens
ccttgcctcattgtgcttctcc

SEQ ID NO: 6927466 - DNA, 22 bp, Homo sapiens
taggcagaaaggaaggcaagtt

SEQ ID NO: 6927467 - DNA, 20 bp, Homo sapiens
ttctatggaccagtatattt

SEQ ID NO: 6927468 - DNA, 18 bp, Homo sapiens
ggtcctgaatgcctgcta

SEQ ID NO: 6927469 - DNA, 22 bp, Homo sapiens
ctgtcagtaggctcccatcatt

SEQ ID NO: 6927470 - DNA, 22 bp, Homo sapiens
tcctggtcttcaggttgcaaaa

SEQ ID NO: 6927471 - DNA, 23 bp, Homo sapiens
tttcagaagtggtcctaggaagc

SEQ ID NO: 6927472 - DNA, 22 bp, Homo sapiens
ctgagcactgggcacatagctg

SEQ ID NO: 6927473 - DNA, 20 bp, Homo sapiens
tgtatattttctggtgtaaa

SEQ ID NO: 6927474 - DNA, 22 bp, Homo sapiens
cactgagcagtggtgaaaatct

SEQ ID NO: 6927475 - DNA, 22 bp, Homo sapiens
gtgctaggattacaggcatggg

SEQ ID NO: 6927476 - DNA, 22 bp, Homo sapiens
ggtcgagtcacttgttgccttt

SEQ ID NO: 6927477 - DNA, 22 bp, Homo sapiens
aagggcatttgtattccctgca

SEQ ID NO: 6927478 - DNA, 22 bp, Homo sapiens
agcattgaaccagatgttacat

SEQ ID NO: 6927479 - DNA, 22 bp, Homo sapiens
cacataatacatgttccactta

SEQ ID NO: 6927480 - DNA, 22 bp, Homo sapiens
atgattgagaaaacttgcaatt

SEQ ID NO: 6927481 - DNA, 22 bp, Homo sapiens
gcagcccagagcgcaggacccc

SEQ ID NO: 6927482 - DNA, 22 bp, Homo sapiens
ttgcagaggcaaaaatgaactc

SEQ ID NO: 6927483 - DNA, 22 bp, Homo sapiens
tctctctactggggcactagga

SEQ ID NO: 6927484 - DNA, 22 bp, Homo sapiens
cagtgtctcagtttcacttgaa

SEQ ID NO: 6927485 - DNA, 22 bp, Homo sapiens
actaagatgcaggaaatgctag

SEQ ID NO: 6927486 - DNA, 23 bp, Homo sapiens
tctcaagaggaagcagggctcat

SEQ ID NO: 6927487 - DNA, 22 bp, Homo sapiens
gcagaaatatgatgcataaagg

SEQ ID NO: 6927488 - DNA, 22 bp, Homo sapiens
tgaacagatggcccagcagagg

SEQ ID NO: 6927489 - DNA, 22 bp, Homo sapiens
gaagggggagctcttcctaatt

SEQ ID NO: 6927490 - DNA, 18 bp, Homo sapiens
gacacaggagagagtccc

SEQ ID NO: 6927491 - DNA, 20 bp, Homo sapiens
tgtaaataggcattgtagtt

SEQ ID NO: 6927492 - DNA, 22 bp, Homo sapiens
agtgggcaaaacagctcagagc

SEQ ID NO: 6927493 - DNA, 22 bp, Homo sapiens
caggcatggatctggaatcatt

SEQ ID NO: 6927494 - DNA, 22 bp, Homo sapiens
gcagctttcttgccctaatctt

SEQ ID NO: 6927495 - DNA, 22 bp, Homo sapiens
atgttattaaagtacagattct

SEQ ID NO: 6927496 - DNA, 22 bp, Homo sapiens
tgcagggaacttggacagctag

SEQ ID NO: 6927497 - DNA, 22 bp, Homo sapiens
tctctcttgaagtattagctag

SEQ ID NO: 6927498 - DNA, 22 bp, Homo sapiens
agatgaaatttgtgttgagttg

SEQ ID NO: 6927499 - DNA, 19 bp, Homo sapiens
tcatttacggttttgatga

SEQ ID NO: 6927500 - DNA, 22 bp, Homo sapiens
tcttggaagtagaacacagtct

SEQ ID NO: 6927501 - DNA, 22 bp, Homo sapiens
atccatgattgcccagaggtgt

SEQ ID NO: 6927502 - DNA, 22 bp, Homo sapiens
caactcgatgggtggagaaaat

SEQ ID NO: 6927503 - DNA, 19 bp, Homo sapiens
attctccctagaattttga

SEQ ID NO: 6927504 - DNA, 22 bp, Homo sapiens
agggccctctggcaggccaggc

SEQ ID NO: 6927505 - DNA, 22 bp, Homo sapiens
gagagctctaagatcaaagcca

SEQ ID NO: 6927506 - DNA, 21 bp, Homo sapiens
tctatgaacatggagaagggc

SEQ ID NO: 6927507 - DNA, 22 bp, Homo sapiens
ttcatgctagtatgtgctgttc

SEQ ID NO: 6927508 - DNA, 22 bp, Homo sapiens
gttggtcctttgagcaagatcc

SEQ ID NO: 6927509 - DNA, 22 bp, Homo sapiens
aagtgcaaatttaagaaggcat

SEQ ID NO: 6927510 - DNA, 22 bp, Homo sapiens
acttagatttccttactgggtg

SEQ ID NO: 6927511 - DNA, 22 bp, Homo sapiens
ttaagtcactggacttgcctag

SEQ ID NO: 6927512 - DNA, 22 bp, Homo sapiens
cagttggtgatgaggctagtag

SEQ ID NO: 6927513 - DNA, 22 bp, Homo sapiens
cctgtttaccactgaggggcag

SEQ ID NO: 6927514 - DNA, 22 bp, Homo sapiens
aaggaattctagaaggttttgt

SEQ ID NO: 6927515 - DNA, 22 bp, Homo sapiens
ttcattgcagttcttcaggtta

SEQ ID NO: 6927516 - DNA, 22 bp, Homo sapiens
tcagggcagaatccaaagaatt

SEQ ID NO: 6927517 - DNA, 22 bp, Homo sapiens
aagtctcatccgtgtagctcca

SEQ ID NO: 6927518 - DNA, 22 bp, Homo sapiens
acttacctaatagtccatagca

SEQ ID NO: 6927519 - DNA, 22 bp, Homo sapiens
aggccatgaggtcatgggagat

SEQ ID NO: 6927520 - DNA, 20 bp, Homo sapiens
tactgggcaagcccacagac

SEQ ID NO: 6927521 - DNA, 18 bp, Homo sapiens
gcaaacattcttccagtc

SEQ ID NO: 6927522 - DNA, 22 bp, Homo sapiens
cagcttcaactgcacagtcaac

SEQ ID NO: 6927523 - DNA, 22 bp, Homo sapiens
tctgcaggagagtgccctagag

SEQ ID NO: 6927524 - DNA, 22 bp, Homo sapiens
gctgccagctgcggcccacgcg

SEQ ID NO: 6927525 - DNA, 22 bp, Homo sapiens
aagtgtctttatatttgagaaa

SEQ ID NO: 6927526 - DNA, 22 bp, Homo sapiens
tactttctttcccaagaggtgg

SEQ ID NO: 6927527 - DNA, 22 bp, Homo sapiens
tagggtgcttaatactagattt

SEQ ID NO: 6927528 - DNA, 22 bp, Homo sapiens
gatttctaagttttaccacaaa

SEQ ID NO: 6927529 - DNA, 22 bp, Homo sapiens
tgagtcctggctttgggatgta

SEQ ID NO: 6927530 - DNA, 22 bp, Homo sapiens
cactatatctctttcatctttt

SEQ ID NO: 6927531 - DNA, 22 bp, Homo sapiens
tgagttcatttgagtgaacact

SEQ ID NO: 6927532 - DNA, 19 bp, Homo sapiens
agccagttctagacaatgg

SEQ ID NO: 6927533 - DNA, 22 bp, Homo sapiens
taggaccaggggctgccaggaa

SEQ ID NO: 6927534 - DNA, 22 bp, Homo sapiens
tctttgcatgagttccctctgt

SEQ ID NO: 6927535 - DNA, 22 bp, Homo sapiens
agcccaagccagtgcttctaga

SEQ ID NO: 6927536 - DNA, 22 bp, Homo sapiens
atctccgaaagtcttgtcaccc

SEQ ID NO: 6927537 - DNA, 22 bp, Homo sapiens
ggtagggaaggctctgcgggga

SEQ ID NO: 6927538 - DNA, 22 bp, Homo sapiens
tggtggtcatagcagaggccgt

SEQ ID NO: 6927539 - DNA, 22 bp, Homo sapiens
tagaagtgtctgtgaaatatac

SEQ ID NO: 6927540 - DNA, 22 bp, Homo sapiens
cagggctagggagccctcctgg

SEQ ID NO: 6927541 - DNA, 22 bp, Homo sapiens
ctacactgagagctcttcaggg

SEQ ID NO: 6927542 - DNA, 22 bp, Homo sapiens
tccagcagagtctctgaggggg

SEQ ID NO: 6927543 - DNA, 22 bp, Homo sapiens
agtctgggtggctgagctacag

SEQ ID NO: 6927544 - DNA, 22 bp, Homo sapiens
gtccctggatctgggacagctg

SEQ ID NO: 6927545 - DNA, 22 bp, Homo sapiens
tgaagcagcttctttctgtcaa

SEQ ID NO: 6927546 - DNA, 20 bp, Homo sapiens
ttactcagttcctgccatgc

SEQ ID NO: 6927547 - DNA, 22 bp, Homo sapiens
cacagaggaaatgactttctta

SEQ ID NO: 6927548 - DNA, 22 bp, Homo sapiens
acagagcaattcttgggtgttt

SEQ ID NO: 6927549 - DNA, 23 bp, Homo sapiens
agtaatgagtgatgcagatattc

SEQ ID NO: 6927550 - DNA, 22 bp, Homo sapiens
agtgtcaatgccaacagtatat

SEQ ID NO: 6927551 - DNA, 22 bp, Homo sapiens
catgtatattttatgtggagag

SEQ ID NO: 6927552 - DNA, 22 bp, Homo sapiens
tctgtcttcatcagcatgtgat

SEQ ID NO: 6927553 - DNA, 21 bp, Homo sapiens
tgctgccatcatgcagagatg

SEQ ID NO: 6927554 - DNA, 22 bp, Homo sapiens
ttctcactatgtatgtagattg

SEQ ID NO: 6927555 - DNA, 22 bp, Homo sapiens
gaatatattggtgaaaatagtt

SEQ ID NO: 6927556 - DNA, 22 bp, Homo sapiens
tgatgaggacctggtctctgct

SEQ ID NO: 6927557 - DNA, 22 bp, Homo sapiens
cttccaggttctggttgggaag

SEQ ID NO: 6927558 - DNA, 22 bp, Homo sapiens
gggcagcatttgaaaaacagat

SEQ ID NO: 6927559 - DNA, 22 bp, Homo sapiens
tggaggcaggttagccagacga

SEQ ID NO: 6927560 - DNA, 22 bp, Homo sapiens
aaaatgcatgagaatgtgctcg

SEQ ID NO: 6927561 - DNA, 22 bp, Homo sapiens
atagacgcggccgctgatgcag

SEQ ID NO: 6927562 - DNA, 20 bp, Homo sapiens
ttaagcattattactcccag

SEQ ID NO: 6927563 - DNA, 22 bp, Homo sapiens
ttacatagttaaatagtacagc

SEQ ID NO: 6927564 - DNA, 22 bp, Homo sapiens
acagctgtgaaaatccacagga

SEQ ID NO: 6927565 - DNA, 22 bp, Homo sapiens
agccctctgagctagtcaccat

SEQ ID NO: 6927566 - DNA, 22 bp, Homo sapiens
tttgttcaaattttcctatctg

SEQ ID NO: 6927567 - DNA, 22 bp, Homo sapiens
agtgccctggttataggtgtgg

SEQ ID NO: 6927568 - DNA, 22 bp, Homo sapiens
tgtgaacttactgtccccacag

SEQ ID NO: 6927569 - DNA, 22 bp, Homo sapiens
agcactattttccagaatgtag

SEQ ID NO: 6927570 - DNA, 23 bp, Homo sapiens
gtgtgtggaaagtgcatgggcct

SEQ ID NO: 6927571 - DNA, 22 bp, Homo sapiens
gaaatctgaatcttctgttggt

SEQ ID NO: 6927572 - DNA, 22 bp, Homo sapiens
actctccacccactcactctgt

SEQ ID NO: 6927573 - DNA, 22 bp, Homo sapiens
cgtcatgattcagagtagggat

SEQ ID NO: 6927574 - DNA, 22 bp, Homo sapiens
tagtaaatgtgaaatgtgggga

SEQ ID NO: 6927575 - DNA, 22 bp, Homo sapiens
tgaggaggtgggcacacagagt

SEQ ID NO: 6927576 - DNA, 22 bp, Homo sapiens
tctgagggatttgtcccttatc

SEQ ID NO: 6927577 - DNA, 19 bp, Homo sapiens
gtaacagctctgggttcac

SEQ ID NO: 6927578 - DNA, 22 bp, Homo sapiens
ctacagaaacctttttcataca

SEQ ID NO: 6927579 - DNA, 22 bp, Homo sapiens
ccaccagaagctgggagaagct

SEQ ID NO: 6927580 - DNA, 22 bp, Homo sapiens
cagcagctcaggctgcttccca

SEQ ID NO: 6927581 - DNA, 22 bp, Homo sapiens
gtgcctccttaaattctgcacc

SEQ ID NO: 6927582 - DNA, 22 bp, Homo sapiens
ggaagccccagcatggccttgg

SEQ ID NO: 6927583 - DNA, 22 bp, Homo sapiens
actgccttatatgctgtgtgtg

SEQ ID NO: 6927584 - DNA, 22 bp, Homo sapiens
caggggacactcctgcttgggc

SEQ ID NO: 6927585 - DNA, 22 bp, Homo sapiens
tagctggctaatagtatgaata

SEQ ID NO: 6927586 - DNA, 16 bp, Homo sapiens
tagctttttcctatgt

SEQ ID NO: 6927587 - DNA, 21 bp, Homo sapiens
tagtttctacccagttaatgg

SEQ ID NO: 6927588 - DNA, 17 bp, Homo sapiens
tcctggcctggtgtgtg

SEQ ID NO: 6927589 - DNA, 22 bp, Homo sapiens
atctttttatctgtttggaaca

SEQ ID NO: 6927590 - DNA, 22 bp, Homo sapiens
cgcagctgaccttttacaaaac

SEQ ID NO: 6927591 - DNA, 22 bp, Homo sapiens
tttggaaagacacacagtttta

SEQ ID NO: 6927592 - DNA, 22 bp, Homo sapiens
ggaggaccatcctggtttcacc

SEQ ID NO: 6927593 - DNA, 22 bp, Homo sapiens
attttcaggttttgccattgta

SEQ ID NO: 6927594 - DNA, 20 bp, Homo sapiens
tcacagaaacaaatagagaa

SEQ ID NO: 6927595 - DNA, 22 bp, Homo sapiens
aacgataaccccgagatcaaag

SEQ ID NO: 6927596 - DNA, 17 bp, Homo sapiens
tggttcttttcattccc

SEQ ID NO: 6927597 - DNA, 23 bp, Homo sapiens
actggtacaggtttactggtgtc

SEQ ID NO: 6927598 - DNA, 22 bp, Homo sapiens
gccctctaccttggctatagaa

SEQ ID NO: 6927599 - DNA, 22 bp, Homo sapiens
agccaggtctaaggacatcagg

SEQ ID NO: 6927600 - DNA, 22 bp, Homo sapiens
gtgaatatgatcttatttggaa

SEQ ID NO: 6927601 - DNA, 22 bp, Homo sapiens
ttagaagtcatctagtctaaaa

SEQ ID NO: 6927602 - DNA, 22 bp, Homo sapiens
cgggcactgccaggcttcccag

SEQ ID NO: 6927603 - DNA, 22 bp, Homo sapiens
ttatagcagcatgatttataat

SEQ ID NO: 6927604 - DNA, 22 bp, Homo sapiens
tgcataaacagatacttcatgt

SEQ ID NO: 6927605 - DNA, 22 bp, Homo sapiens
tgggggagtatagtctggcctc

SEQ ID NO: 6927606 - DNA, 22 bp, Homo sapiens
atgcaaataaacagtctagttg

SEQ ID NO: 6927607 - DNA, 22 bp, Homo sapiens
acttagaattagtgtagaatga

SEQ ID NO: 6927608 - DNA, 22 bp, Homo sapiens
ggctgcaagcctttggggctgg

SEQ ID NO: 6927609 - DNA, 22 bp, Homo sapiens
gctttgtgaattattactcaca

SEQ ID NO: 6927610 - DNA, 22 bp, Homo sapiens
ctgaggtattgaagtatcttct

SEQ ID NO: 6927611 - DNA, 22 bp, Homo sapiens
tactattgaatcattgtcaatc

SEQ ID NO: 6927612 - DNA, 22 bp, Homo sapiens
aatatgtctctgtggttaagta

SEQ ID NO: 6927613 - DNA, 22 bp, Homo sapiens
tcttgatttgaattgcagttgt

SEQ ID NO: 6927614 - DNA, 21 bp, Homo sapiens
ggagtcattagtcatttcctt

SEQ ID NO: 6927615 - DNA, 22 bp, Homo sapiens
gcatggctattatgaggcagaa

SEQ ID NO: 6927616 - DNA, 22 bp, Homo sapiens
atgttttcaaagtaaacttgta

SEQ ID NO: 6927617 - DNA, 21 bp, Homo sapiens
aggttccagcagccagagaat

SEQ ID NO: 6927618 - DNA, 22 bp, Homo sapiens
tctgggaacactttgtgagctc

SEQ ID NO: 6927619 - DNA, 22 bp, Homo sapiens
aatgcctcagcagttattattc

SEQ ID NO: 6927620 - DNA, 23 bp, Homo sapiens
gcacatactacacagaaaatggc

SEQ ID NO: 6927621 - DNA, 22 bp, Homo sapiens
tctggtcccttttcctgcagtc

SEQ ID NO: 6927622 - DNA, 22 bp, Homo sapiens
ttagaacatagcaacagaatta

SEQ ID NO: 6927623 - DNA, 20 bp, Homo sapiens
ggaatctttgcaggaaaata

SEQ ID NO: 6927624 - DNA, 22 bp, Homo sapiens
ccaaggctgtggggctgtgcag

SEQ ID NO: 6927625 - DNA, 22 bp, Homo sapiens
tgctactaggggagtccacgcc

SEQ ID NO: 6927626 - DNA, 22 bp, Homo sapiens
tttggctaagttgtaatgtaaa

SEQ ID NO: 6927627 - DNA, 22 bp, Homo sapiens
tgctaggtgctcctccctaatt

SEQ ID NO: 6927628 - DNA, 22 bp, Homo sapiens
ccacagagagtgtcagcctttg

SEQ ID NO: 6927629 - DNA, 22 bp, Homo sapiens
ctgtgcctcagtgtcctcgagt

SEQ ID NO: 6927630 - DNA, 22 bp, Homo sapiens
aagtacagaaggagcgaacaat

SEQ ID NO: 6927631 - DNA, 22 bp, Homo sapiens
agtggcagtaacattccacaat

SEQ ID NO: 6927632 - DNA, 18 bp, Homo sapiens
atttgcaggcatgcaggc

SEQ ID NO: 6927633 - DNA, 23 bp, Homo sapiens
tctgaggatgaaggatagcaagt

SEQ ID NO: 6927634 - DNA, 22 bp, Homo sapiens
aggacactttgtggttgttgat

SEQ ID NO: 6927635 - DNA, 22 bp, Homo sapiens
atgacaaaataaatggtctctg

SEQ ID NO: 6927636 - DNA, 21 bp, Homo sapiens
tcagttcctaagggaggccgc

SEQ ID NO: 6927637 - DNA, 22 bp, Homo sapiens
taggacctggagcccagcaccg

SEQ ID NO: 6927638 - DNA, 22 bp, Homo sapiens
gaccttgtgctccgaggcgggc

SEQ ID NO: 6927639 - DNA, 22 bp, Homo sapiens
cctgtgacaaacccgcctattc

SEQ ID NO: 6927640 - DNA, 22 bp, Homo sapiens
cagcagtctgtttcaacaggtc

SEQ ID NO: 6927641 - DNA, 22 bp, Homo sapiens
agtcccattgcaagttatgcga

SEQ ID NO: 6927642 - DNA, 22 bp, Homo sapiens
aacatttgcagaggaaagctat

SEQ ID NO: 6927643 - DNA, 22 bp, Homo sapiens
aggaagtggggttctctcactg

SEQ ID NO: 6927644 - DNA, 22 bp, Homo sapiens
gtatatctcttacatacacaca

SEQ ID NO: 6927645 - DNA, 22 bp, Homo sapiens
tcaggaagttttgaatcaactg

SEQ ID NO: 6927646 - DNA, 22 bp, Homo sapiens
gcgcaggtgatgcgtctgcctt

SEQ ID NO: 6927647 - DNA, 22 bp, Homo sapiens
atgtgttggatattagtgggga

SEQ ID NO: 6927648 - DNA, 22 bp, Homo sapiens
aggggtgtgcatcctggaggat

SEQ ID NO: 6927649 - DNA, 22 bp, Homo sapiens
gagtgctttgtcttgtaattct

SEQ ID NO: 6927650 - DNA, 22 bp, Homo sapiens
tgtaccaggaggaggacaaatt

SEQ ID NO: 6927651 - DNA, 22 bp, Homo sapiens
tccttacatgcttccttataca

SEQ ID NO: 6927652 - DNA, 22 bp, Homo sapiens
aggaggtgagcggtcatgtggt

SEQ ID NO: 6927653 - DNA, 22 bp, Homo sapiens
agtcccttctcaaagtgtgcgg

SEQ ID NO: 6927654 - DNA, 22 bp, Homo sapiens
ggcgagggagcagtgcggtggg

SEQ ID NO: 6927655 - DNA, 22 bp, Homo sapiens
aaggctgtcttttcctcttccc

SEQ ID NO: 6927656 - DNA, 22 bp, Homo sapiens
gggagctgaggagccccgtcgg

SEQ ID NO: 6927657 - DNA, 22 bp, Homo sapiens
gctgtggccgggcccaggccgc

SEQ ID NO: 6927658 - DNA, 22 bp, Homo sapiens
tcactggggagcactgacatgt

SEQ ID NO: 6927659 - DNA, 22 bp, Homo sapiens
tgaactctcccccattgccctc

SEQ ID NO: 6927660 - DNA, 22 bp, Homo sapiens
cgcttgttagatgccgttagcc

SEQ ID NO: 6927661 - DNA, 22 bp, Homo sapiens
aggatcatgaagtataaatagg

SEQ ID NO: 6927662 - DNA, 23 bp, Homo sapiens
tgtggctgagaaattgacaactt

SEQ ID NO: 6927663 - DNA, 22 bp, Homo sapiens
tcatccatcctcgcctttgctt

SEQ ID NO: 6927664 - DNA, 22 bp, Homo sapiens
ccttttctaatcttaagaatgt

SEQ ID NO: 6927665 - DNA, 22 bp, Homo sapiens
acttaaatagaactcctcaata

SEQ ID NO: 6927666 - DNA, 22 bp, Homo sapiens
ttcagcaaatggcttgagataa

SEQ ID NO: 6927667 - DNA, 22 bp, Homo sapiens
acattctaacattgtacagata

SEQ ID NO: 6927668 - DNA, 22 bp, Homo sapiens
tccctgcacagccgagccatgc

SEQ ID NO: 6927669 - DNA, 22 bp, Homo sapiens
cagtgaggtagacagctttttc

SEQ ID NO: 6927670 - DNA, 23 bp, Homo sapiens
agttaatgtgcatgaagtgctgc

SEQ ID NO: 6927671 - DNA, 22 bp, Homo sapiens
gtccaagagctcattatccgga

SEQ ID NO: 6927672 - DNA, 22 bp, Homo sapiens
tacatttgctttgattttcagc

SEQ ID NO: 6927673 - DNA, 22 bp, Homo sapiens
gcctgtttggcatcattggttg

SEQ ID NO: 6927674 - DNA, 22 bp, Homo sapiens
tatgccctgaattacccacaag

SEQ ID NO: 6927675 - DNA, 21 bp, Homo sapiens
catttcatgattatagaaatg

SEQ ID NO: 6927676 - DNA, 22 bp, Homo sapiens
agaagcaaggtctgtcagtata

SEQ ID NO: 6927677 - DNA, 22 bp, Homo sapiens
catcttctgggacttctcagtt

SEQ ID NO: 6927678 - DNA, 22 bp, Homo sapiens
catcagaatctgagtctctgcc

SEQ ID NO: 6927679 - DNA, 22 bp, Homo sapiens
gcctgaggaattgagggggtaa

SEQ ID NO: 6927680 - DNA, 22 bp, Homo sapiens
gagggccaactagcaccacttt

SEQ ID NO: 6927681 - DNA, 22 bp, Homo sapiens
gctcccagcaattgaggcagcc

SEQ ID NO: 6927682 - DNA, 22 bp, Homo sapiens
aactggtcttatgcaagcacta

SEQ ID NO: 6927683 - DNA, 22 bp, Homo sapiens
agaagtgtttatttcagcaaca

SEQ ID NO: 6927684 - DNA, 22 bp, Homo sapiens
aaggtcaagacacaggaatcta

SEQ ID NO: 6927685 - DNA, 22 bp, Homo sapiens
aatgatcactgcagttgatgag

SEQ ID NO: 6927686 - DNA, 21 bp, Homo sapiens
atccgtttaataatactgaat

SEQ ID NO: 6927687 - DNA, 22 bp, Homo sapiens
accaggtggccccagcgtggtt

SEQ ID NO: 6927688 - DNA, 22 bp, Homo sapiens
aggaaacattgatattgggaaa

SEQ ID NO: 6927689 - DNA, 22 bp, Homo sapiens
aaatgctcgccttggccgagac

SEQ ID NO: 6927690 - DNA, 22 bp, Homo sapiens
gaagtttatggtgcttgtaagg

SEQ ID NO: 6927691 - DNA, 22 bp, Homo sapiens
attgcaatctggtgaaaacagt

SEQ ID NO: 6927692 - DNA, 22 bp, Homo sapiens
ctgcaactctctccagaggctg

SEQ ID NO: 6927693 - DNA, 22 bp, Homo sapiens
tcatgtttctcttacagcagct

SEQ ID NO: 6927694 - DNA, 22 bp, Homo sapiens
ccagcatccatgctccctcggg

SEQ ID NO: 6927695 - DNA, 22 bp, Homo sapiens
tttactgtgcattagaatcacc

SEQ ID NO: 6927696 - DNA, 20 bp, Homo sapiens
tccaggaatggtagaggact

SEQ ID NO: 6927697 - DNA, 22 bp, Homo sapiens
agtgttggagtcttggctgcag

SEQ ID NO: 6927698 - DNA, 22 bp, Homo sapiens
actgcctggcctggcctcactg

SEQ ID NO: 6927699 - DNA, 22 bp, Homo sapiens
ctgaggtgggagtttttctcat

SEQ ID NO: 6927700 - DNA, 22 bp, Homo sapiens
ttagagattggttgacagattt

SEQ ID NO: 6927701 - DNA, 22 bp, Homo sapiens
ccgctgtctcatcagtgcccgg

SEQ ID NO: 6927702 - DNA, 22 bp, Homo sapiens
ttatctagatgtgttatcagac

SEQ ID NO: 6927703 - DNA, 22 bp, Homo sapiens
atgggacaatttgaacacagtg

SEQ ID NO: 6927704 - DNA, 22 bp, Homo sapiens
tggagaggagcaccatggccat

SEQ ID NO: 6927705 - DNA, 19 bp, Homo sapiens
gggcccagcatggagggtt

SEQ ID NO: 6927706 - DNA, 16 bp, Homo sapiens
tggtagtcacttagag

SEQ ID NO: 6927707 - DNA, 22 bp, Homo sapiens
gtaacactggcaccgtctcaca

SEQ ID NO: 6927708 - DNA, 22 bp, Homo sapiens
acttgtttggagccagctgtaa

SEQ ID NO: 6927709 - DNA, 22 bp, Homo sapiens
ttgcatttgtggcatgggtgtt

SEQ ID NO: 6927710 - DNA, 22 bp, Homo sapiens
acaagcatcaggttcagcaata

SEQ ID NO: 6927711 - DNA, 22 bp, Homo sapiens
tgagctgcattctctttatcat

SEQ ID NO: 6927712 - DNA, 22 bp, Homo sapiens
ctggccctgcctaatgtacttg

SEQ ID NO: 6927713 - DNA, 23 bp, Homo sapiens
cagctcagcacataggaggtact

SEQ ID NO: 6927714 - DNA, 22 bp, Homo sapiens
ttccttgtaagacctatttttg

SEQ ID NO: 6927715 - DNA, 21 bp, Homo sapiens
ctcagagacaaatgccatccc

SEQ ID NO: 6927716 - DNA, 22 bp, Homo sapiens
tattcctcccagtaagtacaac

SEQ ID NO: 6927717 - DNA, 22 bp, Homo sapiens
atgcaagagggaaaaggaaata

SEQ ID NO: 6927718 - DNA, 22 bp, Homo sapiens
tggactgctttgtaatttaaaa

SEQ ID NO: 6927719 - DNA, 22 bp, Homo sapiens
tttgaatgagggaaccacagtt

SEQ ID NO: 6927720 - DNA, 21 bp, Homo sapiens
taagtttggaagctgtcagca

SEQ ID NO: 6927721 - DNA, 22 bp, Homo sapiens
atactacatttgaaaattgcag

SEQ ID NO: 6927722 - DNA, 22 bp, Homo sapiens
gttgattgattgattgactggt

SEQ ID NO: 6927723 - DNA, 22 bp, Homo sapiens
ctagacttgcagcgtcaccatt

SEQ ID NO: 6927724 - DNA, 19 bp, Homo sapiens
ggacacagaaagctgcatt

SEQ ID NO: 6927725 - DNA, 22 bp, Homo sapiens
gtgaccagttggcaggggtggg

SEQ ID NO: 6927726 - DNA, 22 bp, Homo sapiens
tggctcctatcaaggagtgggt

SEQ ID NO: 6927727 - DNA, 22 bp, Homo sapiens
gacaggctgtgatggccgggag

SEQ ID NO: 6927728 - DNA, 22 bp, Homo sapiens
tggtaagggctctctttctggc

SEQ ID NO: 6927729 - DNA, 22 bp, Homo sapiens
ctttgaaagctcccaggactta

SEQ ID NO: 6927730 - DNA, 22 bp, Homo sapiens
tttggaaagtgtacaaatttga

SEQ ID NO: 6927731 - DNA, 22 bp, Homo sapiens
ccagtctgcagcccctggggac

SEQ ID NO: 6927732 - DNA, 22 bp, Homo sapiens
gaaagcacccaagatttccttc

SEQ ID NO: 6927733 - DNA, 22 bp, Homo sapiens
ggcctgctattggtgggcagac

SEQ ID NO: 6927734 - DNA, 22 bp, Homo sapiens
tgtggcagtaaaattgggcaac

SEQ ID NO: 6927735 - DNA, 22 bp, Homo sapiens
tcatcataatatggaatcttgt

SEQ ID NO: 6927736 - DNA, 22 bp, Homo sapiens
accctgggcttggcctgctcag

SEQ ID NO: 6927737 - DNA, 22 bp, Homo sapiens
ggtctgagtggggcctgagatt

SEQ ID NO: 6927738 - DNA, 22 bp, Homo sapiens
gcacagctagacggtagccaaa

SEQ ID NO: 6927739 - DNA, 22 bp, Homo sapiens
attagcaatctgcaatggctgt

SEQ ID NO: 6927740 - DNA, 22 bp, Homo sapiens
gcctcctgaaaggaagagctcc

SEQ ID NO: 6927741 - DNA, 22 bp, Homo sapiens
accctgggagggagaaatcaga

SEQ ID NO: 6927742 - DNA, 22 bp, Homo sapiens
gagctgctggatatgtggcctg

SEQ ID NO: 6927743 - DNA, 22 bp, Homo sapiens
cagggtagggcaagggaacctg

SEQ ID NO: 6927744 - DNA, 22 bp, Homo sapiens
aaagtcctgttaactgttaaca

SEQ ID NO: 6927745 - DNA, 22 bp, Homo sapiens
ggactgctacaatatacaatta

SEQ ID NO: 6927746 - DNA, 15 bp, Homo sapiens
atctgcccagatgct

SEQ ID NO: 6927747 - DNA, 20 bp, Homo sapiens
taccttgaacctccacctgg

SEQ ID NO: 6927748 - DNA, 22 bp, Homo sapiens
ctctttggccagaaaatgtttt

SEQ ID NO: 6927749 - DNA, 22 bp, Homo sapiens
ttactgaaccctacttttacag

SEQ ID NO: 6927750 - DNA, 20 bp, Homo sapiens
actgtgtgatctggaaagct

SEQ ID NO: 6927751 - DNA, 22 bp, Homo sapiens
cattttacctagaagctgaaag

SEQ ID NO: 6927752 - DNA, 22 bp, Homo sapiens
agccaaggcagctagagctctg

SEQ ID NO: 6927753 - DNA, 22 bp, Homo sapiens
tctgaagatggaggaacttaga

SEQ ID NO: 6927754 - DNA, 22 bp, Homo sapiens
atggctggcatgtgcataacgg

SEQ ID NO: 6927755 - DNA, 22 bp, Homo sapiens
actacattcatgctcgtgttgg

SEQ ID NO: 6927756 - DNA, 22 bp, Homo sapiens
gtccctgcatctgcaggccatg

SEQ ID NO: 6927757 - DNA, 22 bp, Homo sapiens
tgctggcacgtggaccaggaga

SEQ ID NO: 6927758 - DNA, 22 bp, Homo sapiens
gcaaactggcaaacctgtctgt

SEQ ID NO: 6927759 - DNA, 22 bp, Homo sapiens
tctcagagcctaactaacctaa

SEQ ID NO: 6927760 - DNA, 22 bp, Homo sapiens
tgagtccaacttccatttgacc

SEQ ID NO: 6927761 - DNA, 22 bp, Homo sapiens
aggcagcctatggggagctcag

SEQ ID NO: 6927762 - DNA, 22 bp, Homo sapiens
agtgtgtgaccttttaatttaa

SEQ ID NO: 6927763 - DNA, 22 bp, Homo sapiens
tcaaagcatggttttgaaagac

SEQ ID NO: 6927764 - DNA, 22 bp, Homo sapiens
ctagggagggatgttggcatga

SEQ ID NO: 6927765 - DNA, 22 bp, Homo sapiens
gctgggctcttatcacctgtac

SEQ ID NO: 6927766 - DNA, 22 bp, Homo sapiens
ttaagtgcacaatgaggtcaca

SEQ ID NO: 6927767 - DNA, 22 bp, Homo sapiens
gctacagagctctgtgaagaga

SEQ ID NO: 6927768 - DNA, 22 bp, Homo sapiens
ttagcacaggcaactccacata

SEQ ID NO: 6927769 - DNA, 22 bp, Homo sapiens
aagtttgttcagggcttacatt

SEQ ID NO: 6927770 - DNA, 22 bp, Homo sapiens
atatatgtatgtggcggagagg

SEQ ID NO: 6927771 - DNA, 22 bp, Homo sapiens
acagtaaataatgcatgttgat

SEQ ID NO: 6927772 - DNA, 22 bp, Homo sapiens
ctgggaatcagaatgaacgtct

SEQ ID NO: 6927773 - DNA, 22 bp, Homo sapiens
tctggatgacagaatggtcata

SEQ ID NO: 6927774 - DNA, 22 bp, Homo sapiens
atgcaggttgtatctgaagcca

SEQ ID NO: 6927775 - DNA, 22 bp, Homo sapiens
tgttcatttggcccttttgtat

SEQ ID NO: 6927776 - DNA, 22 bp, Homo sapiens
aacataaatttgaagtggcaaa

SEQ ID NO: 6927777 - DNA, 22 bp, Homo sapiens
ggtgctgtggcagctcctcctc

SEQ ID NO: 6927778 - DNA, 22 bp, Homo sapiens
gtccatgattctgtgtagtaga

SEQ ID NO: 6927779 - DNA, 16 bp, Homo sapiens
cctttctctgccttcc

SEQ ID NO: 6927780 - DNA, 22 bp, Homo sapiens
tggcaaggaagagcctggtgca

SEQ ID NO: 6927781 - DNA, 22 bp, Homo sapiens
ggtgctgggaacgaggaattca

SEQ ID NO: 6927782 - DNA, 22 bp, Homo sapiens
caagtcctctggtttcaaatag

SEQ ID NO: 6927783 - DNA, 20 bp, Homo sapiens
tgaggcgacgaagaggcggc

SEQ ID NO: 6927784 - DNA, 22 bp, Homo sapiens
cacagctgggaaaatttgtaca

SEQ ID NO: 6927785 - DNA, 22 bp, Homo sapiens
gacctggaagaactgaggcctt

SEQ ID NO: 6927786 - DNA, 22 bp, Homo sapiens
agaagtttgggggcgaaggcag

SEQ ID NO: 6927787 - DNA, 22 bp, Homo sapiens
ttccaaggtgttctgctggttt

SEQ ID NO: 6927788 - DNA, 22 bp, Homo sapiens
ggagctcagtggggggactgtg

SEQ ID NO: 6927789 - DNA, 22 bp, Homo sapiens
ttgacccaaggccctggaattg

SEQ ID NO: 6927790 - DNA, 22 bp, Homo sapiens
gctacaggggtcagtcctttgc

SEQ ID NO: 6927791 - DNA, 22 bp, Homo sapiens
gaaggcatcagcaggcaccgat

SEQ ID NO: 6927792 - DNA, 22 bp, Homo sapiens
aatctttccctattaaatgtgg

SEQ ID NO: 6927793 - DNA, 22 bp, Homo sapiens
gagggtgctgtgccaagatgac

SEQ ID NO: 6927794 - DNA, 22 bp, Homo sapiens
cccagtacctctgttccctgct

SEQ ID NO: 6927795 - DNA, 17 bp, Homo sapiens
gctgaccctggagaagt

SEQ ID NO: 6927796 - DNA, 22 bp, Homo sapiens
tcactgggcatcggagctgaaa

SEQ ID NO: 6927797 - DNA, 22 bp, Homo sapiens
ttgcaaagactggcttaacagt

SEQ ID NO: 6927798 - DNA, 22 bp, Homo sapiens
actcctggtgctgatgaagaga

SEQ ID NO: 6927799 - DNA, 22 bp, Homo sapiens
agctggtgagggttgaggggta

SEQ ID NO: 6927800 - DNA, 22 bp, Homo sapiens
gtcacccactccctgctgctgt

SEQ ID NO: 6927801 - DNA, 22 bp, Homo sapiens
agacaaggaatgtagcttactc

SEQ ID NO: 6927802 - DNA, 22 bp, Homo sapiens
agctgcttagagtcctcaggat

SEQ ID NO: 6927803 - DNA, 22 bp, Homo sapiens
ttcttacactcttaaaaatcat

SEQ ID NO: 6927804 - DNA, 22 bp, Homo sapiens
tgagctgcattacagcctctgt

SEQ ID NO: 6927805 - DNA, 22 bp, Homo sapiens
tcaggtccagctcctgtgcctc

SEQ ID NO: 6927806 - DNA, 22 bp, Homo sapiens
gcagtgacagggctgctgcctt

SEQ ID NO: 6927807 - DNA, 22 bp, Homo sapiens
tccatgcagagtccaggcctca

SEQ ID NO: 6927808 - DNA, 22 bp, Homo sapiens
atgaagcagatttattactcac

SEQ ID NO: 6927809 - DNA, 21 bp, Homo sapiens
cttgttccaagcatgtctgag

SEQ ID NO: 6927810 - DNA, 22 bp, Homo sapiens
tcatctgtcaaattgcaataag

SEQ ID NO: 6927811 - DNA, 20 bp, Homo sapiens
accccagcccctctatctga

SEQ ID NO: 6927812 - DNA, 22 bp, Homo sapiens
aagaaatattgggccttataaa

SEQ ID NO: 6927813 - DNA, 22 bp, Homo sapiens
tgggccacagttcaccaatccc

SEQ ID NO: 6927814 - DNA, 22 bp, Homo sapiens
gctgggaacacagccatgagag

SEQ ID NO: 6927815 - DNA, 22 bp, Homo sapiens
tcaaataatgccattcatcatc

SEQ ID NO: 6927816 - DNA, 22 bp, Homo sapiens
ttctcctaggatcaggggtcct

SEQ ID NO: 6927817 - DNA, 22 bp, Homo sapiens
gcttagagcagctcacaacatg

SEQ ID NO: 6927818 - DNA, 22 bp, Homo sapiens
taccctcacgagacttcaagtc

SEQ ID NO: 6927819 - DNA, 22 bp, Homo sapiens
tgaacacattttcttcagtaga

SEQ ID NO: 6927820 - DNA, 18 bp, Homo sapiens
ctatccctggagcttggg

SEQ ID NO: 6927821 - DNA, 22 bp, Homo sapiens
tgcttgctccctcacactgtcc

SEQ ID NO: 6927822 - DNA, 22 bp, Homo sapiens
atttatcaacatgtaccattgg

SEQ ID NO: 6927823 - DNA, 22 bp, Homo sapiens
acatccctcagtcagactgtaa

SEQ ID NO: 6927824 - DNA, 22 bp, Homo sapiens
ttatttggttgctgacttggaa

SEQ ID NO: 6927825 - DNA, 23 bp, Homo sapiens
tttcaactcctgccattatttct

SEQ ID NO: 6927826 - DNA, 22 bp, Homo sapiens
gttctggagtggtgccaggcct

SEQ ID NO: 6927827 - DNA, 22 bp, Homo sapiens
tgcacattgaatgagcaaactg

SEQ ID NO: 6927828 - DNA, 22 bp, Homo sapiens
atattttggggtgatgtgcatc

SEQ ID NO: 6927829 - DNA, 22 bp, Homo sapiens
agttgggtttgtgtcagttgca

SEQ ID NO: 6927830 - DNA, 22 bp, Homo sapiens
tgagcttgctacatagatcaga

SEQ ID NO: 6927831 - DNA, 22 bp, Homo sapiens
ttcccccacctggggtacagga

SEQ ID NO: 6927832 - DNA, 22 bp, Homo sapiens
aacttttcacaggctagctctt

SEQ ID NO: 6927833 - DNA, 22 bp, Homo sapiens
tgcatggaggaagatgaatgca

SEQ ID NO: 6927834 - DNA, 22 bp, Homo sapiens
ttaaagtaatctgtgtgaattt

SEQ ID NO: 6927835 - DNA, 22 bp, Homo sapiens
aagcaattcagcaaacctagaa

SEQ ID NO: 6927836 - DNA, 22 bp, Homo sapiens
tttgaagtggatcccttcagtg

SEQ ID NO: 6927837 - DNA, 22 bp, Homo sapiens
caagggacctgagatggtctct

SEQ ID NO: 6927838 - DNA, 22 bp, Homo sapiens
ggcccagaatacatgaagtata

SEQ ID NO: 6927839 - DNA, 22 bp, Homo sapiens
ctggaccctgtttccctaggtc

SEQ ID NO: 6927840 - DNA, 22 bp, Homo sapiens
aatgttttcccagtgcagacga

SEQ ID NO: 6927841 - DNA, 22 bp, Homo sapiens
gtgcctgggggtaatgtaggat

SEQ ID NO: 6927842 - DNA, 22 bp, Homo sapiens
tgcagctgtgcctgaaaagtac

SEQ ID NO: 6927843 - DNA, 22 bp, Homo sapiens
ttccaaggagaacactctgtag

SEQ ID NO: 6927844 - DNA, 22 bp, Homo sapiens
tacaggcactgaaatgcttatt

SEQ ID NO: 6927845 - DNA, 22 bp, Homo sapiens
cctgtgtagcaaaattgccccc

SEQ ID NO: 6927846 - DNA, 22 bp, Homo sapiens
aggctcagtgcaaatcattctg

SEQ ID NO: 6927847 - DNA, 19 bp, Homo sapiens
ctatctcaaatcttttccc

SEQ ID NO: 6927848 - DNA, 22 bp, Homo sapiens
cttcatagtgagtttaatgatg

SEQ ID NO: 6927849 - DNA, 22 bp, Homo sapiens
ttacatattatccaaaactgct

SEQ ID NO: 6927850 - DNA, 22 bp, Homo sapiens
ggagttcactgtgcaggctctg

SEQ ID NO: 6927851 - DNA, 22 bp, Homo sapiens
tcctcatggtagaatccaaaga

SEQ ID NO: 6927852 - DNA, 22 bp, Homo sapiens
ggtccctggttccctctgagct

SEQ ID NO: 6927853 - DNA, 22 bp, Homo sapiens
tggcaaactggaggaagccctg

SEQ ID NO: 6927854 - DNA, 22 bp, Homo sapiens
tctggctccacacctcactgca

SEQ ID NO: 6927855 - DNA, 22 bp, Homo sapiens
caaaattagggagtgagctgga

SEQ ID NO: 6927856 - DNA, 22 bp, Homo sapiens
ctccagcagaaagggcgagtgg

SEQ ID NO: 6927857 - DNA, 18 bp, Homo sapiens
cgggcgggcgcctggccc

SEQ ID NO: 6927858 - DNA, 22 bp, Homo sapiens
ctgcttcacccaactttgggat

SEQ ID NO: 6927859 - DNA, 22 bp, Homo sapiens
acaggcagggaccttggctaag

SEQ ID NO: 6927860 - DNA, 22 bp, Homo sapiens
gcaacattaaaccaataattgt

SEQ ID NO: 6927861 - DNA, 23 bp, Homo sapiens
agtgaagctggttagtgatgacc

SEQ ID NO: 6927862 - DNA, 22 bp, Homo sapiens
ttgtagagggctactttgtgct

SEQ ID NO: 6927863 - DNA, 22 bp, Homo sapiens
agccacctcacctgctgccgtt

SEQ ID NO: 6927864 - DNA, 22 bp, Homo sapiens
tgcaagggtgtttgagctgccc

SEQ ID NO: 6927865 - DNA, 22 bp, Homo sapiens
gtgatagctattcaattaatat

SEQ ID NO: 6927866 - DNA, 23 bp, Homo sapiens
agaaagtcatggccaggtttgat

SEQ ID NO: 6927867 - DNA, 22 bp, Homo sapiens
aacctgaatttaattgaaatga

SEQ ID NO: 6927868 - DNA, 22 bp, Homo sapiens
gcagcccaggtgtagctctttg

SEQ ID NO: 6927869 - DNA, 22 bp, Homo sapiens
tgctgcaaattctttaattctt

SEQ ID NO: 6927870 - DNA, 22 bp, Homo sapiens
tattccaaaatagttaagcact

SEQ ID NO: 6927871 - DNA, 19 bp, Homo sapiens
agctctggattaaatttct

SEQ ID NO: 6927872 - DNA, 22 bp, Homo sapiens
ccccaggcctgttggatggcgc

SEQ ID NO: 6927873 - DNA, 22 bp, Homo sapiens
ctgctggcctcggccatgcctg

SEQ ID NO: 6927874 - DNA, 22 bp, Homo sapiens
ggaagctgcataactagcgtgg

SEQ ID NO: 6927875 - DNA, 19 bp, Homo sapiens
ggctgtctggcgtgtggat

SEQ ID NO: 6927876 - DNA, 23 bp, Homo sapiens
gctcagcctcagcaggcccagga

SEQ ID NO: 6927877 - DNA, 22 bp, Homo sapiens
tacctggatatcattcattctc

SEQ ID NO: 6927878 - DNA, 22 bp, Homo sapiens
agggaggagtcctcaaagtcat

SEQ ID NO: 6927879 - DNA, 22 bp, Homo sapiens
tgaactctaatggtgcttttct

SEQ ID NO: 6927880 - DNA, 17 bp, Homo sapiens
ggaacaaatactatgca

SEQ ID NO: 6927881 - DNA, 20 bp, Homo sapiens
aattaggctgtgtaagtctt

SEQ ID NO: 6927882 - DNA, 23 bp, Homo sapiens
aatctggctgatgttttttctct

SEQ ID NO: 6927883 - DNA, 22 bp, Homo sapiens
atggcttttgatcaaaagaaat

SEQ ID NO: 6927884 - DNA, 14 bp, Homo sapiens
caggaagactcagc

SEQ ID NO: 6927885 - DNA, 22 bp, Homo sapiens
gtggctctctggtcccctgcca

SEQ ID NO: 6927886 - DNA, 22 bp, Homo sapiens
tgaaaggaagagggctactcct

SEQ ID NO: 6927887 - DNA, 22 bp, Homo sapiens
ctctggcttctaccttgcagtt

SEQ ID NO: 6927888 - DNA, 22 bp, Homo sapiens
aggcttctgctgtattaacact

SEQ ID NO: 6927889 - DNA, 20 bp, Homo sapiens
tcatgaagcctacaaacatc

SEQ ID NO: 6927890 - DNA, 20 bp, Homo sapiens
tacaatacacatgcatatga

SEQ ID NO: 6927891 - DNA, 22 bp, Homo sapiens
tctgagaagggtaggctccatt

SEQ ID NO: 6927892 - DNA, 22 bp, Homo sapiens
tgcagccttgcctcctcccagc

SEQ ID NO: 6927893 - DNA, 22 bp, Homo sapiens
gtcaagcagaagataatttaaa

SEQ ID NO: 6927894 - DNA, 22 bp, Homo sapiens
atccagttctcagtgcttacag

SEQ ID NO: 6927895 - DNA, 22 bp, Homo sapiens
tgtgggcaggagcacaagtcag

SEQ ID NO: 6927896 - DNA, 22 bp, Homo sapiens
aggtatgtatgtgtgtatattt

SEQ ID NO: 6927897 - DNA, 22 bp, Homo sapiens
ctgcatcagtggatatgatggt

SEQ ID NO: 6927898 - DNA, 22 bp, Homo sapiens
tgcttcctatccacacaatgcc

SEQ ID NO: 6927899 - DNA, 22 bp, Homo sapiens
tcttttcaggaatggctctagt

SEQ ID NO: 6927900 - DNA, 22 bp, Homo sapiens
aggtgggcggatcacaaggtca

SEQ ID NO: 6927901 - DNA, 22 bp, Homo sapiens
tctggctgttaggcctgacctt

SEQ ID NO: 6927902 - DNA, 22 bp, Homo sapiens
attccttctttgagaataagca

SEQ ID NO: 6927903 - DNA, 18 bp, Homo sapiens
gcagagtgcgtctctgtg

SEQ ID NO: 6927904 - DNA, 22 bp, Homo sapiens
tcagagtatttcattcttaggt

SEQ ID NO: 6927905 - DNA, 22 bp, Homo sapiens
tacatcatgtaagcagaatcat

SEQ ID NO: 6927906 - DNA, 22 bp, Homo sapiens
gatcctgtctgtggagtcagca

SEQ ID NO: 6927907 - DNA, 22 bp, Homo sapiens
tttaaattatagttaatgtctg

SEQ ID NO: 6927908 - DNA, 22 bp, Homo sapiens
ccacagtgggcacagcaggact

SEQ ID NO: 6927909 - DNA, 20 bp, Homo sapiens
gttataggagagggaattat

SEQ ID NO: 6927910 - DNA, 22 bp, Homo sapiens
gaacagagttgaaacaaggctg

SEQ ID NO: 6927911 - DNA, 22 bp, Homo sapiens
gtgtggggagctgcagccacat

SEQ ID NO: 6927912 - DNA, 22 bp, Homo sapiens
tcagttctaacagtttagaaca

SEQ ID NO: 6927913 - DNA, 22 bp, Homo sapiens
gccaagctcaccttctgatgga

SEQ ID NO: 6927914 - DNA, 22 bp, Homo sapiens
ccaggaagcggtgagggctgcc

SEQ ID NO: 6927915 - DNA, 22 bp, Homo sapiens
tttggtcatttgcactgccaat

SEQ ID NO: 6927916 - DNA, 22 bp, Homo sapiens
gaacctggaatctattacaagg

SEQ ID NO: 6927917 - DNA, 22 bp, Homo sapiens
cctgccatcagaaacactcaaa

SEQ ID NO: 6927918 - DNA, 22 bp, Homo sapiens
cctggcccagggactttcgcct

SEQ ID NO: 6927919 - DNA, 22 bp, Homo sapiens
tacatgcacatgaacatgtgtg

SEQ ID NO: 6927920 - DNA, 22 bp, Homo sapiens
cacatagaaaacttagcaggga

SEQ ID NO: 6927921 - DNA, 22 bp, Homo sapiens
gccctgcagtgcggaggtggca

SEQ ID NO: 6927922 - DNA, 22 bp, Homo sapiens
tcttagcagtgctgagaagaat

SEQ ID NO: 6927923 - DNA, 22 bp, Homo sapiens
gtgtccagagaaactcacagct

SEQ ID NO: 6927924 - DNA, 22 bp, Homo sapiens
aaaggctaattaaccacctggt

SEQ ID NO: 6927925 - DNA, 21 bp, Homo sapiens
ggtgtcagttttggtcattag

SEQ ID NO: 6927926 - DNA, 22 bp, Homo sapiens
gagcacctcaatttgctatttg

SEQ ID NO: 6927927 - DNA, 22 bp, Homo sapiens
cactaagaatacagacagggat

SEQ ID NO: 6927928 - DNA, 22 bp, Homo sapiens
aagtcccaatccctggcctgct

SEQ ID NO: 6927929 - DNA, 22 bp, Homo sapiens
ttatggcaagggttttaatttg

SEQ ID NO: 6927930 - DNA, 22 bp, Homo sapiens
tgtgtgtatatgcatttatcta

SEQ ID NO: 6927931 - DNA, 22 bp, Homo sapiens
gtgtgccttaagctctatagac

SEQ ID NO: 6927932 - DNA, 22 bp, Homo sapiens
caatgcttttagcttcagcttg

SEQ ID NO: 6927933 - DNA, 22 bp, Homo sapiens
gaagaagagataatggggagca

SEQ ID NO: 6927934 - DNA, 22 bp, Homo sapiens
gccctgtgctataggttagggc

SEQ ID NO: 6927935 - DNA, 22 bp, Homo sapiens
taacatgcagagtttagctttt

SEQ ID NO: 6927936 - DNA, 22 bp, Homo sapiens
acaatcacacatgcaattatac

SEQ ID NO: 6927937 - DNA, 22 bp, Homo sapiens
tgcaccttgttgcttttacgaa

SEQ ID NO: 6927938 - DNA, 22 bp, Homo sapiens
ttctgaaccattgagcactgcc

SEQ ID NO: 6927939 - DNA, 22 bp, Homo sapiens
taaaatcattctggtgtcagta

SEQ ID NO: 6927940 - DNA, 22 bp, Homo sapiens
cagctagcttccctgcagtgct

SEQ ID NO: 6927941 - DNA, 22 bp, Homo sapiens
tgtgtgcagacagatattactt

SEQ ID NO: 6927942 - DNA, 22 bp, Homo sapiens
tagcagctgtcagtttcacata

SEQ ID NO: 6927943 - DNA, 22 bp, Homo sapiens
tttagcagcaaataagtagtgc

SEQ ID NO: 6927944 - DNA, 22 bp, Homo sapiens
gagggtggaaagggtgtacctg

SEQ ID NO: 6927945 - DNA, 22 bp, Homo sapiens
tggatatgggccatggaaaaaa

SEQ ID NO: 6927946 - DNA, 22 bp, Homo sapiens
ttctgattgttggaggatgctt

SEQ ID NO: 6927947 - DNA, 22 bp, Homo sapiens
agacacagtgctgggtgctgag

SEQ ID NO: 6927948 - DNA, 22 bp, Homo sapiens
gaccactggcgctgcgagaccc

SEQ ID NO: 6927949 - DNA, 22 bp, Homo sapiens
ccagtcaagttgacacaccaag

SEQ ID NO: 6927950 - DNA, 22 bp, Homo sapiens
tgcttccaggaatccatctggc

SEQ ID NO: 6927951 - DNA, 22 bp, Homo sapiens
ctgagccctcctgcttgctgag

SEQ ID NO: 6927952 - DNA, 22 bp, Homo sapiens
tggaagggagtgacagtcagag

SEQ ID NO: 6927953 - DNA, 22 bp, Homo sapiens
tctggccaatgttgtgatcaca

SEQ ID NO: 6927954 - DNA, 22 bp, Homo sapiens
gggttagttggtagttaattga

SEQ ID NO: 6927955 - DNA, 22 bp, Homo sapiens
gagttatttcagaaggaaagat

SEQ ID NO: 6927956 - DNA, 20 bp, Homo sapiens
cagtccaatcagaggccacc

SEQ ID NO: 6927957 - DNA, 22 bp, Homo sapiens
gctttagagcccagcttggtgg

SEQ ID NO: 6927958 - DNA, 22 bp, Homo sapiens
catcacaccacaggcattttct

SEQ ID NO: 6927959 - DNA, 22 bp, Homo sapiens
tcatttacagactgtgtgggtg

SEQ ID NO: 6927960 - DNA, 22 bp, Homo sapiens
agtcagtgggagaagtgtgaag

SEQ ID NO: 6927961 - DNA, 17 bp, Homo sapiens
ttcctctcacatttttt

SEQ ID NO: 6927962 - DNA, 22 bp, Homo sapiens
cctggggtatataggtgaatat

SEQ ID NO: 6927963 - DNA, 22 bp, Homo sapiens
actgtcaggatggcagcttgtt

SEQ ID NO: 6927964 - DNA, 19 bp, Homo sapiens
ggctcctggggctcagccc

SEQ ID NO: 6927965 - DNA, 22 bp, Homo sapiens
ggtttaatgggtgaaggcatga

SEQ ID NO: 6927966 - DNA, 22 bp, Homo sapiens
ggccagctttgagctgcaggaa

SEQ ID NO: 6927967 - DNA, 18 bp, Homo sapiens
actgcaggagaggtgagg

SEQ ID NO: 6927968 - DNA, 22 bp, Homo sapiens
ttggaatttcatgtaagtgact

SEQ ID NO: 6927969 - DNA, 22 bp, Homo sapiens
aagtcagagatgccaaagatta

SEQ ID NO: 6927970 - DNA, 22 bp, Homo sapiens
attagtgttcttatcttctagg

SEQ ID NO: 6927971 - DNA, 22 bp, Homo sapiens
cttgcttctgctgcactatcct

SEQ ID NO: 6927972 - DNA, 22 bp, Homo sapiens
gcagccagccctagtcccactt

SEQ ID NO: 6927973 - DNA, 20 bp, Homo sapiens
gtggcctctcacattctgag

SEQ ID NO: 6927974 - DNA, 22 bp, Homo sapiens
acacagctcacaacgtgtgcat

SEQ ID NO: 6927975 - DNA, 22 bp, Homo sapiens
ccttgttttcaaggtaggttct

SEQ ID NO: 6927976 - DNA, 22 bp, Homo sapiens
ctctgacagccttcattatgca

SEQ ID NO: 6927977 - DNA, 22 bp, Homo sapiens
aggttccaggttcgaatcccat

SEQ ID NO: 6927978 - DNA, 18 bp, Homo sapiens
tcccctgctctggtgctc

SEQ ID NO: 6927979 - DNA, 22 bp, Homo sapiens
agatggttgtcgcaaatgaatg

SEQ ID NO: 6927980 - DNA, 22 bp, Homo sapiens
cctgggaagttgtggctgcagt

SEQ ID NO: 6927981 - DNA, 22 bp, Homo sapiens
agccattcattgtgctctcaga

SEQ ID NO: 6927982 - DNA, 21 bp, Homo sapiens
atacagaaggcagactctctc

SEQ ID NO: 6927983 - DNA, 22 bp, Homo sapiens
agaggcctaaccaagatgtcct

SEQ ID NO: 6927984 - DNA, 22 bp, Homo sapiens
cctgagagggggccctagaaat

SEQ ID NO: 6927985 - DNA, 22 bp, Homo sapiens
aggaggcctggctggggagatc

SEQ ID NO: 6927986 - DNA, 22 bp, Homo sapiens
gtttggcatctcacttaaaccg

SEQ ID NO: 6927987 - DNA, 22 bp, Homo sapiens
tgtcatggtctgtaaggagccc

SEQ ID NO: 6927988 - DNA, 22 bp, Homo sapiens
atttggaattctatttcagtag

SEQ ID NO: 6927989 - DNA, 22 bp, Homo sapiens
gggcttctcagagaggctttag

SEQ ID NO: 6927990 - DNA, 22 bp, Homo sapiens
aatccagatgagcaatcatact

SEQ ID NO: 6927991 - DNA, 20 bp, Homo sapiens
taagatgagctataagaagt

SEQ ID NO: 6927992 - DNA, 22 bp, Homo sapiens
taggcttggttattggggtgct

SEQ ID NO: 6927993 - DNA, 22 bp, Homo sapiens
actgcctgagctattggaaaag

SEQ ID NO: 6927994 - DNA, 22 bp, Homo sapiens
gtaaaatcatttagttacttaa

SEQ ID NO: 6927995 - DNA, 22 bp, Homo sapiens
taagagcattgtaaaataatct

SEQ ID NO: 6927996 - DNA, 22 bp, Homo sapiens
tacatcatggtgagcaggaggc

SEQ ID NO: 6927997 - DNA, 22 bp, Homo sapiens
ggcttagcaactcctgaggctc

SEQ ID NO: 6927998 - DNA, 18 bp, Homo sapiens
ggatgtgattttggtttt

SEQ ID NO: 6927999 - DNA, 22 bp, Homo sapiens
tccagtgttataatatgcgtct

SEQ ID NO: 6928000 - DNA, 22 bp, Homo sapiens
ggcgagcagttcccagggaggt

SEQ ID NO: 6928001 - DNA, 22 bp, Homo sapiens
tacatggtggtggcacttgact

SEQ ID NO: 6928002 - DNA, 22 bp, Homo sapiens
gactgtggctaatggtgttagg

SEQ ID NO: 6928003 - DNA, 22 bp, Homo sapiens
gaaaaggctctcactccctccg

SEQ ID NO: 6928004 - DNA, 22 bp, Homo sapiens
ccatgcatctaccagccccaga

SEQ ID NO: 6928005 - DNA, 22 bp, Homo sapiens
gtttattcttcagcaacatctg

SEQ ID NO: 6928006 - DNA, 22 bp, Homo sapiens
tctatacaagtttcactttgac

SEQ ID NO: 6928007 - DNA, 22 bp, Homo sapiens
gccgctggaaggtgagtgacgt

SEQ ID NO: 6928008 - DNA, 20 bp, Homo sapiens
ttcagagtcagcaaatgcag

SEQ ID NO: 6928009 - DNA, 22 bp, Homo sapiens
caaagcaagggctgaagactcc

SEQ ID NO: 6928010 - DNA, 22 bp, Homo sapiens
tgtgttaaggtgcatctagtgc

SEQ ID NO: 6928011 - DNA, 23 bp, Homo sapiens
ccaagactgttaggagtggggag

SEQ ID NO: 6928012 - DNA, 22 bp, Homo sapiens
gtgtccagggctggaagtgagg

SEQ ID NO: 6928013 - DNA, 22 bp, Homo sapiens
tataacactcagaaagaatcat

SEQ ID NO: 6928014 - DNA, 22 bp, Homo sapiens
ctttctgatgtaaggaactagg

SEQ ID NO: 6928015 - DNA, 22 bp, Homo sapiens
atgatggaccatcccaatgtga

SEQ ID NO: 6928016 - DNA, 23 bp, Homo sapiens
tacaatgcaaacttggcccatgg

SEQ ID NO: 6928017 - DNA, 22 bp, Homo sapiens
agtcttctcatttcacatgctt

SEQ ID NO: 6928018 - DNA, 16 bp, Homo sapiens
gtggaacacattttgg

SEQ ID NO: 6928019 - DNA, 22 bp, Homo sapiens
agtaggctgttttatgggccaa

SEQ ID NO: 6928020 - DNA, 22 bp, Homo sapiens
ttacaggtattttattgagcag

SEQ ID NO: 6928021 - DNA, 22 bp, Homo sapiens
gccctgtggattaatgagcagg

SEQ ID NO: 6928022 - DNA, 22 bp, Homo sapiens
agtaaagcttagtagtaggaaa

SEQ ID NO: 6928023 - DNA, 22 bp, Homo sapiens
cctcagccttggccccaggcag

SEQ ID NO: 6928024 - DNA, 22 bp, Homo sapiens
tgccagagccaggctttaggaa

SEQ ID NO: 6928025 - DNA, 22 bp, Homo sapiens
ccaggccctgcctgtggttcct

SEQ ID NO: 6928026 - DNA, 22 bp, Homo sapiens
actgagggtttggaatttcacc

SEQ ID NO: 6928027 - DNA, 22 bp, Homo sapiens
ccacaggacacaactgctgacc

SEQ ID NO: 6928028 - DNA, 22 bp, Homo sapiens
cttggattgtacctagtatggt

SEQ ID NO: 6928029 - DNA, 22 bp, Homo sapiens
ctcagtttttgtgggcatcagc

SEQ ID NO: 6928030 - DNA, 22 bp, Homo sapiens
ttgcttgctatccagatcagtc

SEQ ID NO: 6928031 - DNA, 22 bp, Homo sapiens
gcctcctgggttcatgccattc

SEQ ID NO: 6928032 - DNA, 22 bp, Homo sapiens
taaacatcaggaatgaaaacct

SEQ ID NO: 6928033 - DNA, 22 bp, Homo sapiens
gcaggctcttctttctgcccag

SEQ ID NO: 6928034 - DNA, 22 bp, Homo sapiens
ggtggctctcttaagggcagcg

SEQ ID NO: 6928035 - DNA, 22 bp, Homo sapiens
ttacataactttaaaatgccgt

SEQ ID NO: 6928036 - DNA, 22 bp, Homo sapiens
cagtgttccaggcggcagtgaa

SEQ ID NO: 6928037 - DNA, 22 bp, Homo sapiens
taaggcattctcatgctgtgaa

SEQ ID NO: 6928038 - DNA, 22 bp, Homo sapiens
taagtagtagggccagaatttg

SEQ ID NO: 6928039 - DNA, 22 bp, Homo sapiens
gcaaggactccctgggtcattc

SEQ ID NO: 6928040 - DNA, 22 bp, Homo sapiens
atgaatgcatggtagactctgt

SEQ ID NO: 6928041 - DNA, 17 bp, Homo sapiens
agatggcctctaagatt

SEQ ID NO: 6928042 - DNA, 22 bp, Homo sapiens
ggctctttggcgggccttgaac

SEQ ID NO: 6928043 - DNA, 23 bp, Homo sapiens
ggatacaaagattaatagtagag

SEQ ID NO: 6928044 - DNA, 22 bp, Homo sapiens
cctgcccagcttcccgagtgca

SEQ ID NO: 6928045 - DNA, 22 bp, Homo sapiens
tgtagcactatttggtcattga

SEQ ID NO: 6928046 - DNA, 22 bp, Homo sapiens
agcaggcatttgatatatattt

SEQ ID NO: 6928047 - DNA, 22 bp, Homo sapiens
aggcttctgataccatgagaga

SEQ ID NO: 6928048 - DNA, 22 bp, Homo sapiens
actgcacagaaccttagaatat

SEQ ID NO: 6928049 - DNA, 16 bp, Homo sapiens
tggcaggtttttatct

SEQ ID NO: 6928050 - DNA, 23 bp, Homo sapiens
acctagaaatacgttttacatgg

SEQ ID NO: 6928051 - DNA, 22 bp, Homo sapiens
tctctggcagaggccctatccc

SEQ ID NO: 6928052 - DNA, 22 bp, Homo sapiens
ttctgtaagctaccaagtttgt

SEQ ID NO: 6928053 - DNA, 22 bp, Homo sapiens
atgtaatgattgcaatgctgct

SEQ ID NO: 6928054 - DNA, 22 bp, Homo sapiens
aggtggccaataaatgttggag

SEQ ID NO: 6928055 - DNA, 22 bp, Homo sapiens
cttagaaggatgtttgctgttt

SEQ ID NO: 6928056 - DNA, 22 bp, Homo sapiens
gtgttacttgccatacagaaaa

SEQ ID NO: 6928057 - DNA, 22 bp, Homo sapiens
cttattgtgataccatgcagta

SEQ ID NO: 6928058 - DNA, 22 bp, Homo sapiens
ttagcatttcagtacacatgtt

SEQ ID NO: 6928059 - DNA, 22 bp, Homo sapiens
tctcaaggtaaaatttgtcaca

SEQ ID NO: 6928060 - DNA, 22 bp, Homo sapiens
ctggaattatgaccaaaggtcc

SEQ ID NO: 6928061 - DNA, 22 bp, Homo sapiens
ggggctctgtgacagtaaccct

SEQ ID NO: 6928062 - DNA, 22 bp, Homo sapiens
tctgcaagcgtcacatgattct

SEQ ID NO: 6928063 - DNA, 22 bp, Homo sapiens
gcatggctgtgagcaccctgcc

SEQ ID NO: 6928064 - DNA, 22 bp, Homo sapiens
actggcagggggagccccgaga

SEQ ID NO: 6928065 - DNA, 19 bp, Homo sapiens
ttttccacagaaatatgtt

SEQ ID NO: 6928066 - DNA, 22 bp, Homo sapiens
gtttatgaaatttcaggcattt

SEQ ID NO: 6928067 - DNA, 22 bp, Homo sapiens
gatttctttaggtgtaatagtg

SEQ ID NO: 6928068 - DNA, 22 bp, Homo sapiens
gaggaatgttattaaaggagct

SEQ ID NO: 6928069 - DNA, 22 bp, Homo sapiens
ttaaatattttcagcagggtca

SEQ ID NO: 6928070 - DNA, 20 bp, Homo sapiens
tggaatgtagtcggtgagag

SEQ ID NO: 6928071 - DNA, 22 bp, Homo sapiens
ttctcacaggaagtaggacttt

SEQ ID NO: 6928072 - DNA, 22 bp, Homo sapiens
agactggtttttaacttcacct

SEQ ID NO: 6928073 - DNA, 22 bp, Homo sapiens
agtcctgttcctagagtttctg

SEQ ID NO: 6928074 - DNA, 22 bp, Homo sapiens
ttatttaaaagtggtaagattc

SEQ ID NO: 6928075 - DNA, 22 bp, Homo sapiens
ctctttggcgttggcagagcca

SEQ ID NO: 6928076 - DNA, 22 bp, Homo sapiens
taaatcttgtggcaatgcttct

SEQ ID NO: 6928077 - DNA, 22 bp, Homo sapiens
cctggctcagagtatgtcatcg

SEQ ID NO: 6928078 - DNA, 22 bp, Homo sapiens
tgagtgtgcagggaagtggcgg

SEQ ID NO: 6928079 - DNA, 22 bp, Homo sapiens
aggcacctgaggtggccagcct

SEQ ID NO: 6928080 - DNA, 22 bp, Homo sapiens
aatacaatcaaattcactagca

SEQ ID NO: 6928081 - DNA, 23 bp, Homo sapiens
tcccaggaatctgcatttttaac

SEQ ID NO: 6928082 - DNA, 22 bp, Homo sapiens
caggtattaataaatggagagt

SEQ ID NO: 6928083 - DNA, 22 bp, Homo sapiens
tgaggggccagaccccacctag

SEQ ID NO: 6928084 - DNA, 22 bp, Homo sapiens
cctctacttaccactcagccag

SEQ ID NO: 6928085 - DNA, 22 bp, Homo sapiens
cagagtgatggcacctgctggg

SEQ ID NO: 6928086 - DNA, 22 bp, Homo sapiens
ttgctctaccctgatcagttaa

SEQ ID NO: 6928087 - DNA, 22 bp, Homo sapiens
atgcatgtaacagtgttatgaa

SEQ ID NO: 6928088 - DNA, 22 bp, Homo sapiens
tgtgactgaggctccaagctag

SEQ ID NO: 6928089 - DNA, 22 bp, Homo sapiens
gggtcagcgatttcaggggcag

SEQ ID NO: 6928090 - DNA, 22 bp, Homo sapiens
tagattctgtaaataatcaagg

SEQ ID NO: 6928091 - DNA, 22 bp, Homo sapiens
aggtgccaacagtatttctgcc

SEQ ID NO: 6928092 - DNA, 22 bp, Homo sapiens
tctggaattttattgatcaaaa

SEQ ID NO: 6928093 - DNA, 22 bp, Homo sapiens
ctgttactggacgcacgcagct

SEQ ID NO: 6928094 - DNA, 22 bp, Homo sapiens
aggagtggtgcaggacctgcca

SEQ ID NO: 6928095 - DNA, 22 bp, Homo sapiens
gtctcagataacatgtattcta

SEQ ID NO: 6928096 - DNA, 22 bp, Homo sapiens
atttgtcatatataatactctt

SEQ ID NO: 6928097 - DNA, 23 bp, Homo sapiens
tgcagctcaaagatgggtaaatg

SEQ ID NO: 6928098 - DNA, 22 bp, Homo sapiens
ctggcagcagagctcaacatag

SEQ ID NO: 6928099 - DNA, 22 bp, Homo sapiens
gaactgaagacttttactgtac

SEQ ID NO: 6928100 - DNA, 18 bp, Homo sapiens
caggtcagcctggcctca

SEQ ID NO: 6928101 - DNA, 21 bp, Homo sapiens
caagggccagtgagatgggat

SEQ ID NO: 6928102 - DNA, 22 bp, Homo sapiens
tgctgccagccaggccatggag

SEQ ID NO: 6928103 - DNA, 22 bp, Homo sapiens
tttagagtccttgctcttattc

SEQ ID NO: 6928104 - DNA, 22 bp, Homo sapiens
tgggaaatattctaaaagtctt

SEQ ID NO: 6928105 - DNA, 22 bp, Homo sapiens
ggaatcgcatagtatatatttc

SEQ ID NO: 6928106 - DNA, 22 bp, Homo sapiens
attgacttaaaggctctggtta

SEQ ID NO: 6928107 - DNA, 20 bp, Homo sapiens
gttttaaggcacaggccttt

SEQ ID NO: 6928108 - DNA, 22 bp, Homo sapiens
gcctatctgtcaaatttctctg

SEQ ID NO: 6928109 - DNA, 22 bp, Homo sapiens
acagaagtgtgtgtgtaggaat

SEQ ID NO: 6928110 - DNA, 20 bp, Homo sapiens
ttctttacgacctttctgca

SEQ ID NO: 6928111 - DNA, 22 bp, Homo sapiens
tgctggggtctctccggtgccc

SEQ ID NO: 6928112 - DNA, 22 bp, Homo sapiens
tatgccagcccatgaatatggc

SEQ ID NO: 6928113 - DNA, 22 bp, Homo sapiens
ggaagcaggaggctggggtaaa

SEQ ID NO: 6928114 - DNA, 22 bp, Homo sapiens
atttgaaccactcagaactcat

SEQ ID NO: 6928115 - DNA, 21 bp, Homo sapiens
ttagaaagctcactacagtta

SEQ ID NO: 6928116 - DNA, 22 bp, Homo sapiens
ggaaggaagaggaccgagctgg

SEQ ID NO: 6928117 - DNA, 22 bp, Homo sapiens
tcagaggttcttctcagtggcc

SEQ ID NO: 6928118 - DNA, 17 bp, Homo sapiens
agcccccactcccaagt

SEQ ID NO: 6928119 - DNA, 22 bp, Homo sapiens
ttgggtcatgggatcccagcat

SEQ ID NO: 6928120 - DNA, 22 bp, Homo sapiens
tttcagagatgcagaattcagg

SEQ ID NO: 6928121 - DNA, 22 bp, Homo sapiens
tgtttccatggtgatccaagtg

SEQ ID NO: 6928122 - DNA, 22 bp, Homo sapiens
cagatatattttccttattagg

SEQ ID NO: 6928123 - DNA, 22 bp, Homo sapiens
gctcagagggaacaaggggctg

SEQ ID NO: 6928124 - DNA, 22 bp, Homo sapiens
tgcaaatgtgtaggtttacata

SEQ ID NO: 6928125 - DNA, 22 bp, Homo sapiens
gtgggacagctttccgttgagg

SEQ ID NO: 6928126 - DNA, 17 bp, Homo sapiens
tttgttcgttagtccgg

SEQ ID NO: 6928127 - DNA, 22 bp, Homo sapiens
gggcaggagagaacagtcatgg

SEQ ID NO: 6928128 - DNA, 22 bp, Homo sapiens
aggctgaggcgggtagatcacc

SEQ ID NO: 6928129 - DNA, 22 bp, Homo sapiens
acttgactttgtcatttgtgct

SEQ ID NO: 6928130 - DNA, 22 bp, Homo sapiens
ccatgccccaccaggacgctgc

SEQ ID NO: 6928131 - DNA, 22 bp, Homo sapiens
gatggtctgtattaaacagatg

SEQ ID NO: 6928132 - DNA, 23 bp, Homo sapiens
tcagttattggtgataaagctgg

SEQ ID NO: 6928133 - DNA, 17 bp, Homo sapiens
ctcagagagggtaagta

SEQ ID NO: 6928134 - DNA, 22 bp, Homo sapiens
acatactttttaaaagattgct

SEQ ID NO: 6928135 - DNA, 22 bp, Homo sapiens
caagagttgagggatgtcagtt

SEQ ID NO: 6928136 - DNA, 22 bp, Homo sapiens
tagaggagaacacaaattatag

SEQ ID NO: 6928137 - DNA, 22 bp, Homo sapiens
tcctgggcgaggtactggggct

SEQ ID NO: 6928138 - DNA, 22 bp, Homo sapiens
gacggagctggttgctgcggct

SEQ ID NO: 6928139 - DNA, 22 bp, Homo sapiens
ctcagggaagctatggtgaggg

SEQ ID NO: 6928140 - DNA, 22 bp, Homo sapiens
aactgcttcaagtctgtgggga

SEQ ID NO: 6928141 - DNA, 22 bp, Homo sapiens
tctagaaagtttgtactgattt

SEQ ID NO: 6928142 - DNA, 22 bp, Homo sapiens
gcagagaccccgcagtgaggcc

SEQ ID NO: 6928143 - DNA, 22 bp, Homo sapiens
aaacatttgcaactcggtttgg

SEQ ID NO: 6928144 - DNA, 22 bp, Homo sapiens
tggatttaatggatgaggggca

SEQ ID NO: 6928145 - DNA, 22 bp, Homo sapiens
gggtaagctgctttatctctct

SEQ ID NO: 6928146 - DNA, 22 bp, Homo sapiens
aatcttcagggtcctggggctc

SEQ ID NO: 6928147 - DNA, 22 bp, Homo sapiens
gtcttcttgttttgaaggaaat

SEQ ID NO: 6928148 - DNA, 22 bp, Homo sapiens
tgcagaacaatgagagctgaga

SEQ ID NO: 6928149 - DNA, 22 bp, Homo sapiens
ttccaggaccaggaagagggga

SEQ ID NO: 6928150 - DNA, 22 bp, Homo sapiens
acagagatgggaacattcaggt

SEQ ID NO: 6928151 - DNA, 20 bp, Homo sapiens
cccagagccatagccagaca

SEQ ID NO: 6928152 - DNA, 22 bp, Homo sapiens
aagataagagggaggtgcctca

SEQ ID NO: 6928153 - DNA, 22 bp, Homo sapiens
ggcacctgatgactgcttccct

SEQ ID NO: 6928154 - DNA, 22 bp, Homo sapiens
atgtttccatgttcaatttact

SEQ ID NO: 6928155 - DNA, 22 bp, Homo sapiens
gaggtgtcctcagccaactctg

SEQ ID NO: 6928156 - DNA, 22 bp, Homo sapiens
ggctgcagagctggtgccctgg

SEQ ID NO: 6928157 - DNA, 22 bp, Homo sapiens
tcgcgcagtgcacggcactggg

SEQ ID NO: 6928158 - DNA, 22 bp, Homo sapiens
tatttaataaaactatggcatg

SEQ ID NO: 6928159 - DNA, 22 bp, Homo sapiens
ttgttgcaagggttaaatgaga

SEQ ID NO: 6928160 - DNA, 22 bp, Homo sapiens
agtggccccacagtagggctta

SEQ ID NO: 6928161 - DNA, 22 bp, Homo sapiens
ttacaatgtaaggcatggttct

SEQ ID NO: 6928162 - DNA, 22 bp, Homo sapiens
aatcagaactcctaccacagag

SEQ ID NO: 6928163 - DNA, 22 bp, Homo sapiens
gccctgaaatatttccacggcc

SEQ ID NO: 6928164 - DNA, 22 bp, Homo sapiens
aaagccataagcctaatactaa

SEQ ID NO: 6928165 - DNA, 22 bp, Homo sapiens
ttatctgttgttttagtacaat

SEQ ID NO: 6928166 - DNA, 22 bp, Homo sapiens
aagtagaaaaccgcactggact

SEQ ID NO: 6928167 - DNA, 22 bp, Homo sapiens
ctggggaccagtgtctgtttgt

SEQ ID NO: 6928168 - DNA, 22 bp, Homo sapiens
tgtgaaaggagccatagacagt

SEQ ID NO: 6928169 - DNA, 18 bp, Homo sapiens
gagtccaataaatttctg

SEQ ID NO: 6928170 - DNA, 22 bp, Homo sapiens
attctgctcccaggtgatgctg

SEQ ID NO: 6928171 - DNA, 22 bp, Homo sapiens
atgttatggctcaaacatttgg

SEQ ID NO: 6928172 - DNA, 22 bp, Homo sapiens
gagggagggaaagtttaacact

SEQ ID NO: 6928173 - DNA, 22 bp, Homo sapiens
acagaaagaaggtgtatttgag

SEQ ID NO: 6928174 - DNA, 22 bp, Homo sapiens
tatttcatctggaacaaggtaa

SEQ ID NO: 6928175 - DNA, 22 bp, Homo sapiens
tatgccgcagccggatttcccc

SEQ ID NO: 6928176 - DNA, 22 bp, Homo sapiens
tcagaaagctgattcttgatac

SEQ ID NO: 6928177 - DNA, 22 bp, Homo sapiens
tgagcagatttgttctaggggt

SEQ ID NO: 6928178 - DNA, 22 bp, Homo sapiens
ctggaggtaatgttatttttgt

SEQ ID NO: 6928179 - DNA, 22 bp, Homo sapiens
aagtcacactagacaactgagg

SEQ ID NO: 6928180 - DNA, 22 bp, Homo sapiens
cagctgtgtatgagagcatgct

SEQ ID NO: 6928181 - DNA, 22 bp, Homo sapiens
agcatgcgcttgatcagctcca

SEQ ID NO: 6928182 - DNA, 22 bp, Homo sapiens
gaggactaacttggcagacgca

SEQ ID NO: 6928183 - DNA, 22 bp, Homo sapiens
tcttccaaaattagtctcagtt

SEQ ID NO: 6928184 - DNA, 22 bp, Homo sapiens
ccctccctttgcagcagtgcat

SEQ ID NO: 6928185 - DNA, 23 bp, Homo sapiens
tttctgatgagggatgtggtatg

SEQ ID NO: 6928186 - DNA, 22 bp, Homo sapiens
actggagtcagggaaaaagtgt

SEQ ID NO: 6928187 - DNA, 22 bp, Homo sapiens
gtgaacaaggagactacaactt

SEQ ID NO: 6928188 - DNA, 22 bp, Homo sapiens
ggcgggcagatgcggacacgcg

SEQ ID NO: 6928189 - DNA, 22 bp, Homo sapiens
actgcgttcctgggaagggctg

SEQ ID NO: 6928190 - DNA, 22 bp, Homo sapiens
tgcttttaagaacaatgctgct

SEQ ID NO: 6928191 - DNA, 22 bp, Homo sapiens
aatcacaaatttagacagagct

SEQ ID NO: 6928192 - DNA, 22 bp, Homo sapiens
ctgccctgactgaccttttgaa

SEQ ID NO: 6928193 - DNA, 22 bp, Homo sapiens
acactacttttcataaaagtaa

SEQ ID NO: 6928194 - DNA, 22 bp, Homo sapiens
agtgtttacatataaggccctt

SEQ ID NO: 6928195 - DNA, 22 bp, Homo sapiens
ctgtatacatggtccatgttat

SEQ ID NO: 6928196 - DNA, 22 bp, Homo sapiens
tccttaatgtccagggcgttgg

SEQ ID NO: 6928197 - DNA, 22 bp, Homo sapiens
atgcattctgtagagcatttat

SEQ ID NO: 6928198 - DNA, 19 bp, Homo sapiens
gcagagtggggtggagggt

SEQ ID NO: 6928199 - DNA, 22 bp, Homo sapiens
cgggttttccacaggagtcttt

SEQ ID NO: 6928200 - DNA, 19 bp, Homo sapiens
ggcactggggccaggacca

SEQ ID NO: 6928201 - DNA, 22 bp, Homo sapiens
aaaggttctacttttaaagaat

SEQ ID NO: 6928202 - DNA, 22 bp, Homo sapiens
ttctttatcctatttgtaggtg

SEQ ID NO: 6928203 - DNA, 22 bp, Homo sapiens
ggtggttcatgcctggaatccc

SEQ ID NO: 6928204 - DNA, 22 bp, Homo sapiens
tgccctggcacacacacagctg

SEQ ID NO: 6928205 - DNA, 22 bp, Homo sapiens
aacactgtgcagtgtaatgctg

SEQ ID NO: 6928206 - DNA, 22 bp, Homo sapiens
tcagtacttcagtagatggagc

SEQ ID NO: 6928207 - DNA, 18 bp, Homo sapiens
ttcaccaggtagataggg

SEQ ID NO: 6928208 - DNA, 22 bp, Homo sapiens
gaagcagaaggtttggacgtgc

SEQ ID NO: 6928209 - DNA, 22 bp, Homo sapiens
ttgtacacaattcttaacatac

SEQ ID NO: 6928210 - DNA, 22 bp, Homo sapiens
agtcctctgctgtgcgtctttg

SEQ ID NO: 6928211 - DNA, 22 bp, Homo sapiens
gagttgactcctccagaggagt

SEQ ID NO: 6928212 - DNA, 22 bp, Homo sapiens
aagaggacagtattcaatatga

SEQ ID NO: 6928213 - DNA, 22 bp, Homo sapiens
tggtgagatgcagcaacagaca

SEQ ID NO: 6928214 - DNA, 22 bp, Homo sapiens
acaagataggttgagtctagcc

SEQ ID NO: 6928215 - DNA, 22 bp, Homo sapiens
tatgaagtgagttatggttgct

SEQ ID NO: 6928216 - DNA, 22 bp, Homo sapiens
gcagggcagctgaagctaggtg

SEQ ID NO: 6928217 - DNA, 22 bp, Homo sapiens
atctgggtagtgcaagacatga

SEQ ID NO: 6928218 - DNA, 21 bp, Homo sapiens
tttatgcagataatgctattt

SEQ ID NO: 6928219 - DNA, 22 bp, Homo sapiens
tgacagtgtttgcacttcaggt

SEQ ID NO: 6928220 - DNA, 22 bp, Homo sapiens
ggtcactgatgtgttccctggg

SEQ ID NO: 6928221 - DNA, 22 bp, Homo sapiens
caggcacaattatttccctttc

SEQ ID NO: 6928222 - DNA, 22 bp, Homo sapiens
ttggcccagggtcagcggcgct

SEQ ID NO: 6928223 - DNA, 22 bp, Homo sapiens
agcttctccatctgcccagaga

SEQ ID NO: 6928224 - DNA, 22 bp, Homo sapiens
tggcagagcccagactccagtc

SEQ ID NO: 6928225 - DNA, 22 bp, Homo sapiens
tgtaaacaaatgcattcttgct

SEQ ID NO: 6928226 - DNA, 22 bp, Homo sapiens
tacatagttccatttacaggaa

SEQ ID NO: 6928227 - DNA, 22 bp, Homo sapiens
agtgccctcgtgcccagggcct

SEQ ID NO: 6928228 - DNA, 22 bp, Homo sapiens
agaaggctggccatggtgccct

SEQ ID NO: 6928229 - DNA, 22 bp, Homo sapiens
tctgacatgagggctgtggaga

SEQ ID NO: 6928230 - DNA, 22 bp, Homo sapiens
aggacatgtttgtatcttcctt

SEQ ID NO: 6928231 - DNA, 22 bp, Homo sapiens
ggaggtgggattaggacctaaa

SEQ ID NO: 6928232 - DNA, 22 bp, Homo sapiens
cattgaaagagataaagccttt

SEQ ID NO: 6928233 - DNA, 22 bp, Homo sapiens
gagaatcatggcaacagaatga

SEQ ID NO: 6928234 - DNA, 22 bp, Homo sapiens
tgacacttggaagcttggcaac

SEQ ID NO: 6928235 - DNA, 21 bp, Homo sapiens
agtccgctgagatcggagctt

SEQ ID NO: 6928236 - DNA, 19 bp, Homo sapiens
aggacttctgaacccgtcc

SEQ ID NO: 6928237 - DNA, 22 bp, Homo sapiens
gagcacacagtgtgcctgtgta

SEQ ID NO: 6928238 - DNA, 22 bp, Homo sapiens
agtctagggaatactgaaaggt

SEQ ID NO: 6928239 - DNA, 21 bp, Homo sapiens
atgtacattcggcaacagata

SEQ ID NO: 6928240 - DNA, 22 bp, Homo sapiens
aacaatcaagtttctaaatgac

SEQ ID NO: 6928241 - DNA, 22 bp, Homo sapiens
tacaagaggtatatagaaacag

SEQ ID NO: 6928242 - DNA, 22 bp, Homo sapiens
tggtctgaacacattttaggta

SEQ ID NO: 6928243 - DNA, 21 bp, Homo sapiens
ccatgtcagatgtgggctgtg

SEQ ID NO: 6928244 - DNA, 22 bp, Homo sapiens
ttgcaagatgttaccattgtta

SEQ ID NO: 6928245 - DNA, 22 bp, Homo sapiens
tctgagactttaacctggggcc

SEQ ID NO: 6928246 - DNA, 22 bp, Homo sapiens
tggactcccagagctgctctcc

SEQ ID NO: 6928247 - DNA, 22 bp, Homo sapiens
gcctggcaggcctgggccagca

SEQ ID NO: 6928248 - DNA, 22 bp, Homo sapiens
taactggtttcatatcatttcc

SEQ ID NO: 6928249 - DNA, 22 bp, Homo sapiens
cagttcaaagttaagcagcagt

SEQ ID NO: 6928250 - DNA, 22 bp, Homo sapiens
tatctacattcttgtatcttct

SEQ ID NO: 6928251 - DNA, 22 bp, Homo sapiens
tttgcaattttctgtccttgta

SEQ ID NO: 6928252 - DNA, 22 bp, Homo sapiens
gattgtctttattttatggcta

SEQ ID NO: 6928253 - DNA, 22 bp, Homo sapiens
atgagcaattaaattgcaccag

SEQ ID NO: 6928254 - DNA, 22 bp, Homo sapiens
tgcatctgttcagagctgtcga

SEQ ID NO: 6928255 - DNA, 22 bp, Homo sapiens
tagaggcacagtctatgtagag

SEQ ID NO: 6928256 - DNA, 22 bp, Homo sapiens
actcttgtctcaacttttgtat

SEQ ID NO: 6928257 - DNA, 22 bp, Homo sapiens
cagcagtttcctatggttcagc

SEQ ID NO: 6928258 - DNA, 22 bp, Homo sapiens
gtgggctcaggcctctgtgggg

SEQ ID NO: 6928259 - DNA, 22 bp, Homo sapiens
cccttgaattttcagagagggg

SEQ ID NO: 6928260 - DNA, 22 bp, Homo sapiens
gacagtttggatgggggtttgc

SEQ ID NO: 6928261 - DNA, 22 bp, Homo sapiens
aatgaataccgtttcactcagt

SEQ ID NO: 6928262 - DNA, 22 bp, Homo sapiens
tgctctgggggaagccagctgt

SEQ ID NO: 6928263 - DNA, 22 bp, Homo sapiens
tggaggtcctgcaggatggcac

SEQ ID NO: 6928264 - DNA, 22 bp, Homo sapiens
gttgccttcactggtcttggca

SEQ ID NO: 6928265 - DNA, 22 bp, Homo sapiens
ccctgccaatcccgtctctctg

SEQ ID NO: 6928266 - DNA, 20 bp, Homo sapiens
atgaagtccccatctgatgt

SEQ ID NO: 6928267 - DNA, 19 bp, Homo sapiens
gcagatccaaaagtcacat

SEQ ID NO: 6928268 - DNA, 22 bp, Homo sapiens
tcaatgactggtccaaggtggc

SEQ ID NO: 6928269 - DNA, 22 bp, Homo sapiens
gcatccttctcattcccaagct

SEQ ID NO: 6928270 - DNA, 22 bp, Homo sapiens
ggctcctgttatttaatgagga

SEQ ID NO: 6928271 - DNA, 19 bp, Homo sapiens
tcagggcagtccggtcccc

SEQ ID NO: 6928272 - DNA, 22 bp, Homo sapiens
agcttcttgtagaactcaaaag

SEQ ID NO: 6928273 - DNA, 21 bp, Homo sapiens
ccaagagcaatgctaaggaga

SEQ ID NO: 6928274 - DNA, 22 bp, Homo sapiens
atcctgtggccctgcctctgct

SEQ ID NO: 6928275 - DNA, 22 bp, Homo sapiens
cctgagcctgcagccgagcaga

SEQ ID NO: 6928276 - DNA, 22 bp, Homo sapiens
actgctggggctcattcatctc

SEQ ID NO: 6928277 - DNA, 22 bp, Homo sapiens
ctgtctggccggcccagcttcc

SEQ ID NO: 6928278 - DNA, 22 bp, Homo sapiens
ccttttcttgccactgactcgg

SEQ ID NO: 6928279 - DNA, 22 bp, Homo sapiens
aaggccaactaggatgagctag

SEQ ID NO: 6928280 - DNA, 22 bp, Homo sapiens
cagggtctgaaactgatcacag

SEQ ID NO: 6928281 - DNA, 22 bp, Homo sapiens
ttctcaggcctttgggatggga

SEQ ID NO: 6928282 - DNA, 22 bp, Homo sapiens
atgtccttggggctggggaact

SEQ ID NO: 6928283 - DNA, 22 bp, Homo sapiens
tagcataggaaagtactgggaa

SEQ ID NO: 6928284 - DNA, 22 bp, Homo sapiens
cttgccaggatcagagtcacag

SEQ ID NO: 6928285 - DNA, 22 bp, Homo sapiens
aaatggcagtagaaaagaatcc

SEQ ID NO: 6928286 - DNA, 23 bp, Homo sapiens
gaggcagctcctgcagtgccctg

SEQ ID NO: 6928287 - DNA, 20 bp, Homo sapiens
tgctgcctactaagccctca

SEQ ID NO: 6928288 - DNA, 22 bp, Homo sapiens
ctccagtgcttctagaaaatac

SEQ ID NO: 6928289 - DNA, 22 bp, Homo sapiens
tgccctggcattgggttggata

SEQ ID NO: 6928290 - DNA, 22 bp, Homo sapiens
aaagtccttgcagtttcctctt

SEQ ID NO: 6928291 - DNA, 22 bp, Homo sapiens
gctgaggatatagcaggaacaa

SEQ ID NO: 6928292 - DNA, 22 bp, Homo sapiens
ttgccttactgcattcagtaaa

SEQ ID NO: 6928293 - DNA, 22 bp, Homo sapiens
aaggctggtttccttgatgttt

SEQ ID NO: 6928294 - DNA, 22 bp, Homo sapiens
catctttcttagaactttcagt

SEQ ID NO: 6928295 - DNA, 22 bp, Homo sapiens
atgagacaggactgtatgcagg

SEQ ID NO: 6928296 - DNA, 22 bp, Homo sapiens
tagaatctccagcattggttgt

SEQ ID NO: 6928297 - DNA, 22 bp, Homo sapiens
atgtcacatggcctgtactttg

SEQ ID NO: 6928298 - DNA, 22 bp, Homo sapiens
cgtggcctttgagtgagctccc

SEQ ID NO: 6928299 - DNA, 22 bp, Homo sapiens
gcagctgtcagaagttggaatc

SEQ ID NO: 6928300 - DNA, 22 bp, Homo sapiens
gacacagatatctctgagatta

SEQ ID NO: 6928301 - DNA, 22 bp, Homo sapiens
ttgtaaggaatgcagaatctca

SEQ ID NO: 6928302 - DNA, 22 bp, Homo sapiens
gtctggcccagcaatttgctca

SEQ ID NO: 6928303 - DNA, 21 bp, Homo sapiens
tttaccacatggtcctcattt

SEQ ID NO: 6928304 - DNA, 22 bp, Homo sapiens
tctgcagcgtgcaggctggtgc

SEQ ID NO: 6928305 - DNA, 22 bp, Homo sapiens
cctcttctaccatttacatttt

SEQ ID NO: 6928306 - DNA, 22 bp, Homo sapiens
aaggcaaggccaagccatcagt

SEQ ID NO: 6928307 - DNA, 22 bp, Homo sapiens
acatttgtcttctttcagatta

SEQ ID NO: 6928308 - DNA, 22 bp, Homo sapiens
aagctcttcttgccaccattca

SEQ ID NO: 6928309 - DNA, 22 bp, Homo sapiens
ccatcagagggctgctctgcaa

SEQ ID NO: 6928310 - DNA, 22 bp, Homo sapiens
gcactgtgctagaagccagggg

SEQ ID NO: 6928311 - DNA, 22 bp, Homo sapiens
tcccagtctgtgtcctttacag

SEQ ID NO: 6928312 - DNA, 21 bp, Homo sapiens
aggaggagagcttggcctacc

SEQ ID NO: 6928313 - DNA, 22 bp, Homo sapiens
tgggcccacatgcctttctgcc

SEQ ID NO: 6928314 - DNA, 22 bp, Homo sapiens
tctgaggctgtctctgggctcc

SEQ ID NO: 6928315 - DNA, 22 bp, Homo sapiens
tacctagtcacggggtggctgt

SEQ ID NO: 6928316 - DNA, 22 bp, Homo sapiens
ctttcagcatccctgggattac

SEQ ID NO: 6928317 - DNA, 22 bp, Homo sapiens
atctttgcccagagactcagcc

SEQ ID NO: 6928318 - DNA, 22 bp, Homo sapiens
tgagctcaagcaattcacccgc

SEQ ID NO: 6928319 - DNA, 22 bp, Homo sapiens
aagagtcctgttacacatgagt

SEQ ID NO: 6928320 - DNA, 22 bp, Homo sapiens
gatgatttttgccagtgtgatg

SEQ ID NO: 6928321 - DNA, 22 bp, Homo sapiens
agtcaaatgagtaaatatataa

SEQ ID NO: 6928322 - DNA, 22 bp, Homo sapiens
gcatgcatttcactaggtatgt

SEQ ID NO: 6928323 - DNA, 22 bp, Homo sapiens
tcttcatgccaaatgagttttg

SEQ ID NO: 6928324 - DNA, 22 bp, Homo sapiens
tttgtcatgtccttaactgtct

SEQ ID NO: 6928325 - DNA, 22 bp, Homo sapiens
acagagatgagtcaacacagct

SEQ ID NO: 6928326 - DNA, 22 bp, Homo sapiens
agtactcaggaaatgctgagta

SEQ ID NO: 6928327 - DNA, 21 bp, Homo sapiens
agcaggcaaaggtgaagtctt

SEQ ID NO: 6928328 - DNA, 22 bp, Homo sapiens
tttggagaaatggctgatcaaa

SEQ ID NO: 6928329 - DNA, 22 bp, Homo sapiens
gtgattcctattagtacatgca

SEQ ID NO: 6928330 - DNA, 22 bp, Homo sapiens
aaagactgggactgcagcaggc

SEQ ID NO: 6928331 - DNA, 22 bp, Homo sapiens
gtgagcaatttggtattaattt

SEQ ID NO: 6928332 - DNA, 22 bp, Homo sapiens
gcccacagttagtttgcatggc

SEQ ID NO: 6928333 - DNA, 22 bp, Homo sapiens
cacaggagaaaggggaagctcg

SEQ ID NO: 6928334 - DNA, 22 bp, Homo sapiens
gatgtatagtatgtaatttctg

SEQ ID NO: 6928335 - DNA, 22 bp, Homo sapiens
atagggctgttgtgaggattaa

SEQ ID NO: 6928336 - DNA, 22 bp, Homo sapiens
actccagggaggtgagtgtgcg

SEQ ID NO: 6928337 - DNA, 22 bp, Homo sapiens
acaggcaaagggtcagtagcag

SEQ ID NO: 6928338 - DNA, 22 bp, Homo sapiens
aaacaccagtcccagtatacac

SEQ ID NO: 6928339 - DNA, 22 bp, Homo sapiens
acttatatttgctttatgcttc

SEQ ID NO: 6928340 - DNA, 16 bp, Homo sapiens
atttccttgtgagttt

SEQ ID NO: 6928341 - DNA, 21 bp, Homo sapiens
gctctgccacttaccagattt

SEQ ID NO: 6928342 - DNA, 22 bp, Homo sapiens
gtgaaggagttatcagtggtta

SEQ ID NO: 6928343 - DNA, 22 bp, Homo sapiens
atgaggataccgcagggggcag

SEQ ID NO: 6928344 - DNA, 22 bp, Homo sapiens
agagaagacttacagccacagt

SEQ ID NO: 6928345 - DNA, 22 bp, Homo sapiens
ctgttcttctagtccactgaca

SEQ ID NO: 6928346 - DNA, 22 bp, Homo sapiens
aagaaatgcagaaatgtgctgg

SEQ ID NO: 6928347 - DNA, 22 bp, Homo sapiens
ttgtgctgtatcatatttgtat

SEQ ID NO: 6928348 - DNA, 22 bp, Homo sapiens
agtcatgtaatcacaatgacct

SEQ ID NO: 6928349 - DNA, 22 bp, Homo sapiens
aaattattaaacagtgggatgc

SEQ ID NO: 6928350 - DNA, 22 bp, Homo sapiens
caaggccataagagatacaaaa

SEQ ID NO: 6928351 - DNA, 22 bp, Homo sapiens
tgtaacatatgtaaaagcacct

SEQ ID NO: 6928352 - DNA, 20 bp, Homo sapiens
tctagggatggcatatgtct

SEQ ID NO: 6928353 - DNA, 19 bp, Homo sapiens
agtcaggtggctggtgcca

SEQ ID NO: 6928354 - DNA, 22 bp, Homo sapiens
tacatccaaagttgaggtgcct

SEQ ID NO: 6928355 - DNA, 22 bp, Homo sapiens
agagctgcacctatgcagacct

SEQ ID NO: 6928356 - DNA, 22 bp, Homo sapiens
tcaggatgagctcataactatg

SEQ ID NO: 6928357 - DNA, 18 bp, Homo sapiens
tatatttcacacatattc

SEQ ID NO: 6928358 - DNA, 22 bp, Homo sapiens
ggcagtgcccggtgcctcctct

SEQ ID NO: 6928359 - DNA, 22 bp, Homo sapiens
gtggagctggacccaggcctct

SEQ ID NO: 6928360 - DNA, 22 bp, Homo sapiens
ctctggcctgcttcctcaggta

SEQ ID NO: 6928361 - DNA, 22 bp, Homo sapiens
atgtagggaactaaattcactg

SEQ ID NO: 6928362 - DNA, 23 bp, Homo sapiens
ggttcctgagcagggatctggaa

SEQ ID NO: 6928363 - DNA, 22 bp, Homo sapiens
cttgcacagaactcttagaggt

SEQ ID NO: 6928364 - DNA, 22 bp, Homo sapiens
acataacaatcataggacatag

SEQ ID NO: 6928365 - DNA, 22 bp, Homo sapiens
tgtgacatcgctgtgtctgttt

SEQ ID NO: 6928366 - DNA, 22 bp, Homo sapiens
gcacatttctcaaagaattgtc

SEQ ID NO: 6928367 - DNA, 19 bp, Homo sapiens
attcatgaaggcttgaagg

SEQ ID NO: 6928368 - DNA, 22 bp, Homo sapiens
gtggcatctcagaggccaagaa

SEQ ID NO: 6928369 - DNA, 22 bp, Homo sapiens
gaggcaacattgagcttctgta

SEQ ID NO: 6928370 - DNA, 22 bp, Homo sapiens
caagaggagcaggcaggtgtgc

SEQ ID NO: 6928371 - DNA, 21 bp, Homo sapiens
taacttttgtgcctatcttgt

SEQ ID NO: 6928372 - DNA, 22 bp, Homo sapiens
gggtcaggcctcaaggtgggct

SEQ ID NO: 6928373 - DNA, 22 bp, Homo sapiens
atgattctggcaaatttattat

SEQ ID NO: 6928374 - DNA, 22 bp, Homo sapiens
ggctggctacattggaggaagg

SEQ ID NO: 6928375 - DNA, 22 bp, Homo sapiens
tggtccttgctatagagtgata

SEQ ID NO: 6928376 - DNA, 22 bp, Homo sapiens
tgattacaattgtcttagattt

SEQ ID NO: 6928377 - DNA, 22 bp, Homo sapiens
ctgtattcaaagtgaggatgta

SEQ ID NO: 6928378 - DNA, 22 bp, Homo sapiens
tcagtgctgtaaacaaaaggaa

SEQ ID NO: 6928379 - DNA, 23 bp, Homo sapiens
tgcaggtgtgcagagggctcttg

SEQ ID NO: 6928380 - DNA, 22 bp, Homo sapiens
actgagagttgtgcattcatgc

SEQ ID NO: 6928381 - DNA, 22 bp, Homo sapiens
actggctgaaagtaaagaacac

SEQ ID NO: 6928382 - DNA, 22 bp, Homo sapiens
tggcaccctgaagttggtcact

SEQ ID NO: 6928383 - DNA, 22 bp, Homo sapiens
agccattttcctgaaatataac

SEQ ID NO: 6928384 - DNA, 22 bp, Homo sapiens
aaacacacagaaatgaatgagg

SEQ ID NO: 6928385 - DNA, 22 bp, Homo sapiens
attttgtatcttacggggacta

SEQ ID NO: 6928386 - DNA, 22 bp, Homo sapiens
aagaaatgtagagcctagtaaa

SEQ ID NO: 6928387 - DNA, 22 bp, Homo sapiens
gtgctctgggctgcctgacatg

SEQ ID NO: 6928388 - DNA, 22 bp, Homo sapiens
gatggcttacagacagttagga

SEQ ID NO: 6928389 - DNA, 22 bp, Homo sapiens
tggaggtcttacccagggctat

SEQ ID NO: 6928390 - DNA, 22 bp, Homo sapiens
ttggctcagctgggactgttga

SEQ ID NO: 6928391 - DNA, 22 bp, Homo sapiens
agttacacagtgtcacttctac

SEQ ID NO: 6928392 - DNA, 22 bp, Homo sapiens
tgtgtgcatacacacggtaaca

SEQ ID NO: 6928393 - DNA, 22 bp, Homo sapiens
aaggcaaaagaggtgtcatcac

SEQ ID NO: 6928394 - DNA, 22 bp, Homo sapiens
gatgagctgtgtgtgagggtca

SEQ ID NO: 6928395 - DNA, 22 bp, Homo sapiens
cctggctgtcgttttgtgaaat

SEQ ID NO: 6928396 - DNA, 18 bp, Homo sapiens
cttattgtttaaatggcc

SEQ ID NO: 6928397 - DNA, 22 bp, Homo sapiens
actaagtgattctaagcatctt

SEQ ID NO: 6928398 - DNA, 22 bp, Homo sapiens
ggggccgccagagagagccttg

SEQ ID NO: 6928399 - DNA, 19 bp, Homo sapiens
tgcaagggtggtctcctgg

SEQ ID NO: 6928400 - DNA, 22 bp, Homo sapiens
tatattaaatgaccagttttaa

SEQ ID NO: 6928401 - DNA, 22 bp, Homo sapiens
tcagagtttctgatttagtagg

SEQ ID NO: 6928402 - DNA, 22 bp, Homo sapiens
taatagctgttattgttataac

SEQ ID NO: 6928403 - DNA, 22 bp, Homo sapiens
gctgtgatccttgagagaaggt

SEQ ID NO: 6928404 - DNA, 18 bp, Homo sapiens
atcagtcctgggagggta

SEQ ID NO: 6928405 - DNA, 22 bp, Homo sapiens
atgacttgctgtgcttgggagc

SEQ ID NO: 6928406 - DNA, 21 bp, Homo sapiens
cctctgtagttaagtttccta

SEQ ID NO: 6928407 - DNA, 22 bp, Homo sapiens
ttgtgccatgaactgtatgaag

SEQ ID NO: 6928408 - DNA, 22 bp, Homo sapiens
cagaaaaggaagagctatgtaa

SEQ ID NO: 6928409 - DNA, 22 bp, Homo sapiens
ccatttgtttcccttgggaaac

SEQ ID NO: 6928410 - DNA, 22 bp, Homo sapiens
aattcaatctgtagattgtgat

SEQ ID NO: 6928411 - DNA, 22 bp, Homo sapiens
gtgctggtatatgactgagttt

SEQ ID NO: 6928412 - DNA, 22 bp, Homo sapiens
acagtgttctgctttttaatcc

SEQ ID NO: 6928413 - DNA, 22 bp, Homo sapiens
accctctgccttgagcagtgcc

SEQ ID NO: 6928414 - DNA, 22 bp, Homo sapiens
aatagcttattgacagtgaatt

SEQ ID NO: 6928415 - DNA, 22 bp, Homo sapiens
aggctggtagtatttagtcaca

SEQ ID NO: 6928416 - DNA, 22 bp, Homo sapiens
gtgaccacttcaaattctagat

SEQ ID NO: 6928417 - DNA, 17 bp, Homo sapiens
tctgtctgtggtccact

SEQ ID NO: 6928418 - DNA, 22 bp, Homo sapiens
agtccagagaggaggctgtgtg

SEQ ID NO: 6928419 - DNA, 22 bp, Homo sapiens
acgccagtagactgaacctttc

SEQ ID NO: 6928420 - DNA, 22 bp, Homo sapiens
tgggcatggactgtggagccgc

SEQ ID NO: 6928421 - DNA, 22 bp, Homo sapiens
ttaacagcttgtaatagaaggg

SEQ ID NO: 6928422 - DNA, 22 bp, Homo sapiens
cagccccagcacttagctgagt

SEQ ID NO: 6928423 - DNA, 22 bp, Homo sapiens
catttatgaagcactttagagt

SEQ ID NO: 6928424 - DNA, 22 bp, Homo sapiens
ggtgtccttgtcctttggtacc

SEQ ID NO: 6928425 - DNA, 22 bp, Homo sapiens
tggtctctgtgctcgggcatgg

SEQ ID NO: 6928426 - DNA, 22 bp, Homo sapiens
attgcacggactaaatttacag

SEQ ID NO: 6928427 - DNA, 22 bp, Homo sapiens
ggccagaagctggggcatagga

SEQ ID NO: 6928428 - DNA, 22 bp, Homo sapiens
gcaacacagatcttctttgttg

SEQ ID NO: 6928429 - DNA, 22 bp, Homo sapiens
gatagtgagttgattaggtgat

SEQ ID NO: 6928430 - DNA, 17 bp, Homo sapiens
ggcaccagacggagagt

SEQ ID NO: 6928431 - DNA, 22 bp, Homo sapiens
agagatgtctgaccactagact

SEQ ID NO: 6928432 - DNA, 22 bp, Homo sapiens
tcaggccttgtcctgacctcct

SEQ ID NO: 6928433 - DNA, 20 bp, Homo sapiens
aactttagacataatctctt

SEQ ID NO: 6928434 - DNA, 22 bp, Homo sapiens
cctggcacaagagcagcattgg

SEQ ID NO: 6928435 - DNA, 19 bp, Homo sapiens
accaggcctcagaggccct

SEQ ID NO: 6928436 - DNA, 20 bp, Homo sapiens
catgatacttggaagggctt

SEQ ID NO: 6928437 - DNA, 22 bp, Homo sapiens
gtagatattaaaaatggcagtg

SEQ ID NO: 6928438 - DNA, 22 bp, Homo sapiens
aacgaatagggatttttctaac

SEQ ID NO: 6928439 - DNA, 22 bp, Homo sapiens
tctgaattttccacagatttgg

SEQ ID NO: 6928440 - DNA, 22 bp, Homo sapiens
gagtggcttttttatggtaatg

SEQ ID NO: 6928441 - DNA, 22 bp, Homo sapiens
atctggggccccggaagttcct

SEQ ID NO: 6928442 - DNA, 22 bp, Homo sapiens
aaatgcaggaaattatgctttt

SEQ ID NO: 6928443 - DNA, 21 bp, Homo sapiens
agcaagcagaatccatctaga

SEQ ID NO: 6928444 - DNA, 22 bp, Homo sapiens
atagttggtccatgaaaaaagt

SEQ ID NO: 6928445 - DNA, 22 bp, Homo sapiens
gccagcaggtggagagatcaag

SEQ ID NO: 6928446 - DNA, 22 bp, Homo sapiens
ctacaagaggaatggaggtctg

SEQ ID NO: 6928447 - DNA, 19 bp, Homo sapiens
agcatggaagctggtgcca

SEQ ID NO: 6928448 - DNA, 19 bp, Homo sapiens
aaaagtctattcaattaca

SEQ ID NO: 6928449 - DNA, 22 bp, Homo sapiens
ttcctggcagaggccccgacag

SEQ ID NO: 6928450 - DNA, 22 bp, Homo sapiens
caggtgaactcagttttgtatt

SEQ ID NO: 6928451 - DNA, 22 bp, Homo sapiens
atcaaagtgaaaagtgctgatg

SEQ ID NO: 6928452 - DNA, 22 bp, Homo sapiens
agctaagtggaaaatgcagtta

SEQ ID NO: 6928453 - DNA, 22 bp, Homo sapiens
acaagtggctacctagattata

SEQ ID NO: 6928454 - DNA, 22 bp, Homo sapiens
tctgtggcacgattgcactgca

SEQ ID NO: 6928455 - DNA, 22 bp, Homo sapiens
agggtggccatgagggagagat

SEQ ID NO: 6928456 - DNA, 22 bp, Homo sapiens
ttctcaagaacatatgtagggt

SEQ ID NO: 6928457 - DNA, 22 bp, Homo sapiens
aagttacagttaggggtgatga

SEQ ID NO: 6928458 - DNA, 22 bp, Homo sapiens
tttcagacagattcttctcagt

SEQ ID NO: 6928459 - DNA, 22 bp, Homo sapiens
gctgcagagacagctgccgatg

SEQ ID NO: 6928460 - DNA, 21 bp, Homo sapiens
gggtctgaatatctggtgctg

SEQ ID NO: 6928461 - DNA, 16 bp, Homo sapiens
ttgtggcttttgcaca

SEQ ID NO: 6928462 - DNA, 22 bp, Homo sapiens
ctcagggaggccctgggaccct

SEQ ID NO: 6928463 - DNA, 22 bp, Homo sapiens
tgcatattgtgaaaatgtagat

SEQ ID NO: 6928464 - DNA, 22 bp, Homo sapiens
acgggaatagggaataggcaga

SEQ ID NO: 6928465 - DNA, 22 bp, Homo sapiens
tgcaatcaggtaccatttgatt

SEQ ID NO: 6928466 - DNA, 22 bp, Homo sapiens
ggcttatatattttcacttgcc

SEQ ID NO: 6928467 - DNA, 22 bp, Homo sapiens
tctcagaaaaactttgagggta

SEQ ID NO: 6928468 - DNA, 18 bp, Homo sapiens
tagattaaaattgaattc

SEQ ID NO: 6928469 - DNA, 23 bp, Homo sapiens
tgtaaagatgatgctctagacac

SEQ ID NO: 6928470 - DNA, 22 bp, Homo sapiens
gcactggtgtgttagtaaggga

SEQ ID NO: 6928471 - DNA, 22 bp, Homo sapiens
ccagcaggtgtagggctcatgg

SEQ ID NO: 6928472 - DNA, 22 bp, Homo sapiens
atttggctgtagtaactggatc

SEQ ID NO: 6928473 - DNA, 22 bp, Homo sapiens
tcactactgacagagatgtgta

SEQ ID NO: 6928474 - DNA, 22 bp, Homo sapiens
tctgagtgatgttgagtcagaa

SEQ ID NO: 6928475 - DNA, 22 bp, Homo sapiens
tgagctctgttagggctggaac

SEQ ID NO: 6928476 - DNA, 21 bp, Homo sapiens
gggtgggaggacacagcaggc

SEQ ID NO: 6928477 - DNA, 23 bp, Homo sapiens
ggacttcatgcattaacagcatc

SEQ ID NO: 6928478 - DNA, 22 bp, Homo sapiens
cagggtggggctggctatcaaa

SEQ ID NO: 6928479 - DNA, 22 bp, Homo sapiens
gaattaggtgcatgtttacaaa

SEQ ID NO: 6928480 - DNA, 22 bp, Homo sapiens
tggctggagtataggagtagga

SEQ ID NO: 6928481 - DNA, 22 bp, Homo sapiens
ggagaaagaagacgaacattgt

SEQ ID NO: 6928482 - DNA, 22 bp, Homo sapiens
tagctggtctttaagcatgtaa

SEQ ID NO: 6928483 - DNA, 22 bp, Homo sapiens
gtggccttttagaataaactct

SEQ ID NO: 6928484 - DNA, 22 bp, Homo sapiens
tcccatgtgactcagctgcctg

SEQ ID NO: 6928485 - DNA, 22 bp, Homo sapiens
tctcagagaggggccgggcctt

SEQ ID NO: 6928486 - DNA, 22 bp, Homo sapiens
cagaagtttgacatgtttagct

SEQ ID NO: 6928487 - DNA, 22 bp, Homo sapiens
ctgaggcttgtcctctcagctt

SEQ ID NO: 6928488 - DNA, 22 bp, Homo sapiens
gcacagaagtaaaatacaagtc

SEQ ID NO: 6928489 - DNA, 22 bp, Homo sapiens
tgcctagttctgtatttacagt

SEQ ID NO: 6928490 - DNA, 22 bp, Homo sapiens
gtcattccttatgttgattcag

SEQ ID NO: 6928491 - DNA, 22 bp, Homo sapiens
aagagactttgcagtgtcccta

SEQ ID NO: 6928492 - DNA, 22 bp, Homo sapiens
ggcgggtgcacagacccttccc

SEQ ID NO: 6928493 - DNA, 23 bp, Homo sapiens
gcctgccgcctggctgagaactg

SEQ ID NO: 6928494 - DNA, 22 bp, Homo sapiens
agggcctcctagagaatctcca

SEQ ID NO: 6928495 - DNA, 22 bp, Homo sapiens
gcccagcctccaagctccaagg

SEQ ID NO: 6928496 - DNA, 22 bp, Homo sapiens
ctttctgattttaagctctaat

SEQ ID NO: 6928497 - DNA, 18 bp, Homo sapiens
gcctccctggctacactt

SEQ ID NO: 6928498 - DNA, 17 bp, Homo sapiens
gaggacagggaagtagg

SEQ ID NO: 6928499 - DNA, 22 bp, Homo sapiens
tttctgaaaactgaagtagtgc

SEQ ID NO: 6928500 - DNA, 22 bp, Homo sapiens
atgaatgaaatacagagtactt

SEQ ID NO: 6928501 - DNA, 22 bp, Homo sapiens
cagaaagcaaaatggatctctg

SEQ ID NO: 6928502 - DNA, 22 bp, Homo sapiens
ggagtcaccaagtaggagtctt

SEQ ID NO: 6928503 - DNA, 22 bp, Homo sapiens
ctggaaggttcctcccagctcc

SEQ ID NO: 6928504 - DNA, 22 bp, Homo sapiens
tcaaagcctgtggatagtttgg

SEQ ID NO: 6928505 - DNA, 22 bp, Homo sapiens
tagtcctggcagccctcctggc

SEQ ID NO: 6928506 - DNA, 22 bp, Homo sapiens
gcacgtggaatgctcatgagcc

SEQ ID NO: 6928507 - DNA, 21 bp, Homo sapiens
agaagccatttgttaggactt

SEQ ID NO: 6928508 - DNA, 21 bp, Homo sapiens
ccagagcctgagaggattatg

SEQ ID NO: 6928509 - DNA, 22 bp, Homo sapiens
cctatggctcctgccctggagt

SEQ ID NO: 6928510 - DNA, 22 bp, Homo sapiens
tcagagtcattgcaagtagaag

SEQ ID NO: 6928511 - DNA, 22 bp, Homo sapiens
tagcacctggtcaattcagtca

SEQ ID NO: 6928512 - DNA, 22 bp, Homo sapiens
agaaagttttgtgctatatatg

SEQ ID NO: 6928513 - DNA, 19 bp, Homo sapiens
tcttgatgaggtttctcca

SEQ ID NO: 6928514 - DNA, 22 bp, Homo sapiens
tgtctactgagaagctatgcaa

SEQ ID NO: 6928515 - DNA, 22 bp, Homo sapiens
tcccatcacatggagagtgaag

SEQ ID NO: 6928516 - DNA, 22 bp, Homo sapiens
aatgaagataaaatgggatgga

SEQ ID NO: 6928517 - DNA, 20 bp, Homo sapiens
tgcagtttgtcaaggttcct

SEQ ID NO: 6928518 - DNA, 23 bp, Homo sapiens
tttatccaactctgtaatctctc

SEQ ID NO: 6928519 - DNA, 22 bp, Homo sapiens
aagacattttgaaattggaagc

SEQ ID NO: 6928520 - DNA, 22 bp, Homo sapiens
gacttcacaataatgtgacact

SEQ ID NO: 6928521 - DNA, 22 bp, Homo sapiens
atgtctcagagtggtcactggg

SEQ ID NO: 6928522 - DNA, 18 bp, Homo sapiens
agaattgctgcttcttct

SEQ ID NO: 6928523 - DNA, 23 bp, Homo sapiens
tcagtcctgtaggggctccaggt

SEQ ID NO: 6928524 - DNA, 22 bp, Homo sapiens
agtctgaggtaatatttttctc

SEQ ID NO: 6928525 - DNA, 22 bp, Homo sapiens
ttactttgcagatgtgtatgtc

SEQ ID NO: 6928526 - DNA, 22 bp, Homo sapiens
tgagccaggttaagacaggagc

SEQ ID NO: 6928527 - DNA, 22 bp, Homo sapiens
attggtctctagagtctattgt

SEQ ID NO: 6928528 - DNA, 22 bp, Homo sapiens
ggagatggtctgttctcatatt

SEQ ID NO: 6928529 - DNA, 22 bp, Homo sapiens
tggcagttggaaaaacggtttg

SEQ ID NO: 6928530 - DNA, 22 bp, Homo sapiens
ttcctcagctttagactatgaa

SEQ ID NO: 6928531 - DNA, 22 bp, Homo sapiens
agaaagtacagatgagacactt

SEQ ID NO: 6928532 - DNA, 23 bp, Homo sapiens
catgatgttaactttgttatgct

SEQ ID NO: 6928533 - DNA, 22 bp, Homo sapiens
gcccagctttttgaggcaggca

SEQ ID NO: 6928534 - DNA, 22 bp, Homo sapiens
ctctgtcctatgcttgatagaa

SEQ ID NO: 6928535 - DNA, 22 bp, Homo sapiens
catggtttttaccctacaccat

SEQ ID NO: 6928536 - DNA, 22 bp, Homo sapiens
atcgctgtcctgaggtgcagct

SEQ ID NO: 6928537 - DNA, 22 bp, Homo sapiens
gccagggaaactgcagaccagc

SEQ ID NO: 6928538 - DNA, 22 bp, Homo sapiens
ccagctcttggtgcacttacat

SEQ ID NO: 6928539 - DNA, 22 bp, Homo sapiens
atttactcgtgtctccagtgct

SEQ ID NO: 6928540 - DNA, 22 bp, Homo sapiens
ttctcacagtacctaacatgta

SEQ ID NO: 6928541 - DNA, 22 bp, Homo sapiens
ccactgtatagccactgccggt

SEQ ID NO: 6928542 - DNA, 22 bp, Homo sapiens
aatcctaagcatccttttctgc

SEQ ID NO: 6928543 - DNA, 22 bp, Homo sapiens
atctagctagatcctgtccacc

SEQ ID NO: 6928544 - DNA, 22 bp, Homo sapiens
atgcatcactaaatagtgccgt

SEQ ID NO: 6928545 - DNA, 22 bp, Homo sapiens
ttcttgtatgtatgcaaaatca

SEQ ID NO: 6928546 - DNA, 22 bp, Homo sapiens
tgggaagaagcagagaactgga

SEQ ID NO: 6928547 - DNA, 22 bp, Homo sapiens
tgcactccaggctgggtgacag

SEQ ID NO: 6928548 - DNA, 22 bp, Homo sapiens
acagagatgtcagattggcagc

SEQ ID NO: 6928549 - DNA, 22 bp, Homo sapiens
tgagtatatgatttgtgtttgc

SEQ ID NO: 6928550 - DNA, 22 bp, Homo sapiens
tgtccttatctccaaacaatca

SEQ ID NO: 6928551 - DNA, 22 bp, Homo sapiens
tgaattccctgcaggcatcctc

SEQ ID NO: 6928552 - DNA, 22 bp, Homo sapiens
aaggtgttattggaggcatcag

SEQ ID NO: 6928553 - DNA, 22 bp, Homo sapiens
cttcactggatctttgatttca

SEQ ID NO: 6928554 - DNA, 22 bp, Homo sapiens
gatggtgcaggtgaagtgctgg

SEQ ID NO: 6928555 - DNA, 22 bp, Homo sapiens
gttcctcagttgtaaaaaatgt

SEQ ID NO: 6928556 - DNA, 22 bp, Homo sapiens
agcctgggcaacagagcaaaac

SEQ ID NO: 6928557 - DNA, 22 bp, Homo sapiens
tcccaggatgtttatggctggt

SEQ ID NO: 6928558 - DNA, 22 bp, Homo sapiens
tgcaaagttgcatcaaaaccca

SEQ ID NO: 6928559 - DNA, 22 bp, Homo sapiens
atttgtatatttaagagggtag

SEQ ID NO: 6928560 - DNA, 18 bp, Homo sapiens
acatttctccttctgacc

SEQ ID NO: 6928561 - DNA, 21 bp, Homo sapiens
cccaggtgggatggttgcctc

SEQ ID NO: 6928562 - DNA, 22 bp, Homo sapiens
attattattttagagagaggcc

SEQ ID NO: 6928563 - DNA, 22 bp, Homo sapiens
tccagtttatttttggcagggt

SEQ ID NO: 6928564 - DNA, 22 bp, Homo sapiens
tagctgtgaaacagcagaagag

SEQ ID NO: 6928565 - DNA, 22 bp, Homo sapiens
tcttctgtcctaagtcaaagca

SEQ ID NO: 6928566 - DNA, 18 bp, Homo sapiens
agcaggtggcgtctgcag

SEQ ID NO: 6928567 - DNA, 22 bp, Homo sapiens
ttagaaaggttttgctctgaaa

SEQ ID NO: 6928568 - DNA, 23 bp, Homo sapiens
tgacccttgatggttgacgtgca

SEQ ID NO: 6928569 - DNA, 22 bp, Homo sapiens
ttcctgtgtgactcaagtggtt

SEQ ID NO: 6928570 - DNA, 23 bp, Homo sapiens
cctctccagacactgggccttgt

SEQ ID NO: 6928571 - DNA, 22 bp, Homo sapiens
caggtgcagggagttcaggatg

SEQ ID NO: 6928572 - DNA, 22 bp, Homo sapiens
agccagtgcaacagcagtgaag

SEQ ID NO: 6928573 - DNA, 22 bp, Homo sapiens
atggatgcttctttctagtttt

SEQ ID NO: 6928574 - DNA, 22 bp, Homo sapiens
tcacacattgttgcttaagttg

SEQ ID NO: 6928575 - DNA, 22 bp, Homo sapiens
gtgggggctggctcgtcctgtg

SEQ ID NO: 6928576 - DNA, 22 bp, Homo sapiens
agtgaacaaggatgccacctct

SEQ ID NO: 6928577 - DNA, 22 bp, Homo sapiens
caaggctctggaccaaatccca

SEQ ID NO: 6928578 - DNA, 22 bp, Homo sapiens
gctgggactgagacagtgacct

SEQ ID NO: 6928579 - DNA, 22 bp, Homo sapiens
tgccaggaggcggcttgggaaa

SEQ ID NO: 6928580 - DNA, 19 bp, Homo sapiens
agagtttaggtctatcagg

SEQ ID NO: 6928581 - DNA, 22 bp, Homo sapiens
tcagcttcctctgtggttccag

SEQ ID NO: 6928582 - DNA, 22 bp, Homo sapiens
tcaaagtaccagagtgaactga

SEQ ID NO: 6928583 - DNA, 22 bp, Homo sapiens
cacaggaatcagcattaatggc

SEQ ID NO: 6928584 - DNA, 22 bp, Homo sapiens
cagctgcagttcaatgcttgct

SEQ ID NO: 6928585 - DNA, 22 bp, Homo sapiens
ttaaaagacctgttgaggttag

SEQ ID NO: 6928586 - DNA, 22 bp, Homo sapiens
gttcacagtgttttctttgcat

SEQ ID NO: 6928587 - DNA, 22 bp, Homo sapiens
tggcagctgttaatgttttgtt

SEQ ID NO: 6928588 - DNA, 22 bp, Homo sapiens
taaggcttatatacttagacat

SEQ ID NO: 6928589 - DNA, 22 bp, Homo sapiens
tctgaggccctaccctgagcct

SEQ ID NO: 6928590 - DNA, 22 bp, Homo sapiens
tttctataatctaccatgccag

SEQ ID NO: 6928591 - DNA, 22 bp, Homo sapiens
tactagaaattaccttctcact

SEQ ID NO: 6928592 - DNA, 22 bp, Homo sapiens
ctgcgcagcaatcagagaggag

SEQ ID NO: 6928593 - DNA, 22 bp, Homo sapiens
tctgggtctttacccatggaat

SEQ ID NO: 6928594 - DNA, 22 bp, Homo sapiens
tttcatcttccttggcataggt

SEQ ID NO: 6928595 - DNA, 22 bp, Homo sapiens
tctggctgaattagccttgggt

SEQ ID NO: 6928596 - DNA, 22 bp, Homo sapiens
atgcaggagttcgaggctgtat

SEQ ID NO: 6928597 - DNA, 22 bp, Homo sapiens
tctggacttgaatcagagtaga

SEQ ID NO: 6928598 - DNA, 22 bp, Homo sapiens
gaatatgtttgacatttagttg

SEQ ID NO: 6928599 - DNA, 22 bp, Homo sapiens
gcagagccaggagagacccttg

SEQ ID NO: 6928600 - DNA, 22 bp, Homo sapiens
tcaaggttttatcctagatcac

SEQ ID NO: 6928601 - DNA, 22 bp, Homo sapiens
actcctggtttgtgtcctggct

SEQ ID NO: 6928602 - DNA, 22 bp, Homo sapiens
tagaaaatggccaagcaggact

SEQ ID NO: 6928603 - DNA, 22 bp, Homo sapiens
aggtattcagagagatgctttt

SEQ ID NO: 6928604 - DNA, 22 bp, Homo sapiens
tgccagctcccttttctcctcc

SEQ ID NO: 6928605 - DNA, 22 bp, Homo sapiens
gagtcagaagaaactatttaca

SEQ ID NO: 6928606 - DNA, 22 bp, Homo sapiens
ccaggagaatgggattacccta

SEQ ID NO: 6928607 - DNA, 22 bp, Homo sapiens
tgtgcctgtcaccctcagagag

SEQ ID NO: 6928608 - DNA, 22 bp, Homo sapiens
tggattcatgctgggatttttc

SEQ ID NO: 6928609 - DNA, 22 bp, Homo sapiens
ctcttcactgagataatcctag

SEQ ID NO: 6928610 - DNA, 22 bp, Homo sapiens
taattataacagttacatctta

SEQ ID NO: 6928611 - DNA, 22 bp, Homo sapiens
tgtaaaggtaggtgcaaaatga

SEQ ID NO: 6928612 - DNA, 22 bp, Homo sapiens
gataggctgaaagactatggcg

SEQ ID NO: 6928613 - DNA, 22 bp, Homo sapiens
tgaagccacagagcatctgcct

SEQ ID NO: 6928614 - DNA, 22 bp, Homo sapiens
cagcacagtgttaggtaatttg

SEQ ID NO: 6928615 - DNA, 22 bp, Homo sapiens
ccaggctctgtgtgggctagag

SEQ ID NO: 6928616 - DNA, 22 bp, Homo sapiens
actattcacagattcagtgttc

SEQ ID NO: 6928617 - DNA, 22 bp, Homo sapiens
ttctgcttattctgtagccttt

SEQ ID NO: 6928618 - DNA, 22 bp, Homo sapiens
tcctggcaggtcagcaggagca

SEQ ID NO: 6928619 - DNA, 22 bp, Homo sapiens
cagttaaaggcccaatatctgg

SEQ ID NO: 6928620 - DNA, 22 bp, Homo sapiens
tctggctcctggctccactgcc

SEQ ID NO: 6928621 - DNA, 22 bp, Homo sapiens
cacagtgcgaaagaaacccagc

SEQ ID NO: 6928622 - DNA, 22 bp, Homo sapiens
gccatgggcaaatgcagagctg

SEQ ID NO: 6928623 - DNA, 22 bp, Homo sapiens
ggaagaaatctggttaagagat

SEQ ID NO: 6928624 - DNA, 22 bp, Homo sapiens
gctggcttccctacctgcacct

SEQ ID NO: 6928625 - DNA, 22 bp, Homo sapiens
actgtggggggctttgctcagt

SEQ ID NO: 6928626 - DNA, 22 bp, Homo sapiens
cttcaggaaaatctctaaggat

SEQ ID NO: 6928627 - DNA, 18 bp, Homo sapiens
tagggctctagggagtga

SEQ ID NO: 6928628 - DNA, 19 bp, Homo sapiens
tgctggaacatcagtagct

SEQ ID NO: 6928629 - DNA, 22 bp, Homo sapiens
ccaaggtcttggacagctaatg

SEQ ID NO: 6928630 - DNA, 18 bp, Homo sapiens
aaaaagtgctcaggccta

SEQ ID NO: 6928631 - DNA, 22 bp, Homo sapiens
ctttgaaaaatggtttcctaga

SEQ ID NO: 6928632 - DNA, 22 bp, Homo sapiens
gcacagttgtgacaaccatcgc

SEQ ID NO: 6928633 - DNA, 22 bp, Homo sapiens
cagggtgtggtctgcattcgga

SEQ ID NO: 6928634 - DNA, 22 bp, Homo sapiens
attccactgccgaatgatacat

SEQ ID NO: 6928635 - DNA, 22 bp, Homo sapiens
tcccactattatcctatgtggg

SEQ ID NO: 6928636 - DNA, 22 bp, Homo sapiens
atggccctgctaccacttttct

SEQ ID NO: 6928637 - DNA, 22 bp, Homo sapiens
aaaagggactactctcagctcc

SEQ ID NO: 6928638 - DNA, 22 bp, Homo sapiens
gccctcagtgaccactgattca

SEQ ID NO: 6928639 - DNA, 22 bp, Homo sapiens
gcagaggtgtagccccctccat

SEQ ID NO: 6928640 - DNA, 22 bp, Homo sapiens
tatgcctggggtgctcaggcca

SEQ ID NO: 6928641 - DNA, 22 bp, Homo sapiens
aacatacatatttcagtgtcca

SEQ ID NO: 6928642 - DNA, 22 bp, Homo sapiens
gaaaggtcagttccacttccat

SEQ ID NO: 6928643 - DNA, 22 bp, Homo sapiens
gagtaattccaatataaatcac

SEQ ID NO: 6928644 - DNA, 22 bp, Homo sapiens
tgaggcacagaaaatggtaggg

SEQ ID NO: 6928645 - DNA, 22 bp, Homo sapiens
gccatgggtctgctggctcagc

SEQ ID NO: 6928646 - DNA, 22 bp, Homo sapiens
agtgatgccacacaatgctttg

SEQ ID NO: 6928647 - DNA, 22 bp, Homo sapiens
ctgtcaatttatgttgacatgc

SEQ ID NO: 6928648 - DNA, 22 bp, Homo sapiens
tctaggggtgcagaagggatcc

SEQ ID NO: 6928649 - DNA, 22 bp, Homo sapiens
ttattaatgagtacaagttatt

SEQ ID NO: 6928650 - DNA, 22 bp, Homo sapiens
ccaggggggcgtagatgctggg

SEQ ID NO: 6928651 - DNA, 22 bp, Homo sapiens
gagggctttttatgaatggagg

SEQ ID NO: 6928652 - DNA, 22 bp, Homo sapiens
ttgaggaaaggaatttatttta

SEQ ID NO: 6928653 - DNA, 22 bp, Homo sapiens
ggggcctcgccgccgcctctgc

SEQ ID NO: 6928654 - DNA, 22 bp, Homo sapiens
acacagaggctccagagataga

SEQ ID NO: 6928655 - DNA, 22 bp, Homo sapiens
ctgggagcgcagcaggcacaac

SEQ ID NO: 6928656 - DNA, 22 bp, Homo sapiens
ctggtggcatcttgagacggtt

SEQ ID NO: 6928657 - DNA, 22 bp, Homo sapiens
aaagtgttgattttatagtgca

SEQ ID NO: 6928658 - DNA, 22 bp, Homo sapiens
acttaaaaagaatcttttcacg

SEQ ID NO: 6928659 - DNA, 22 bp, Homo sapiens
tgctggcatttcaggactcacc

SEQ ID NO: 6928660 - DNA, 22 bp, Homo sapiens
agagcctggtctgagataggac

SEQ ID NO: 6928661 - DNA, 23 bp, Homo sapiens
cttttcattgccttagcgcagag

SEQ ID NO: 6928662 - DNA, 22 bp, Homo sapiens
caggccagcgtccagaacaagc

SEQ ID NO: 6928663 - DNA, 22 bp, Homo sapiens
ggacagtacaaaaagtgtctaa

SEQ ID NO: 6928664 - DNA, 22 bp, Homo sapiens
tgttagatacacgaaaaaactt

SEQ ID NO: 6928665 - DNA, 23 bp, Homo sapiens
tggctctgtggatccctcaggag

SEQ ID NO: 6928666 - DNA, 22 bp, Homo sapiens
tagcaaagaggagacctaggca

SEQ ID NO: 6928667 - DNA, 23 bp, Homo sapiens
ctgcatgtccactggtgtaaatg

SEQ ID NO: 6928668 - DNA, 22 bp, Homo sapiens
gctttatgtgagtagcactgtc

SEQ ID NO: 6928669 - DNA, 22 bp, Homo sapiens
aaggccttctcttgtgtctgtg

SEQ ID NO: 6928670 - DNA, 22 bp, Homo sapiens
acagctcctaacaaaggctctc

SEQ ID NO: 6928671 - DNA, 22 bp, Homo sapiens
tggcctgcctcccggcttcttt

SEQ ID NO: 6928672 - DNA, 19 bp, Homo sapiens
acctggccagagttcaata

SEQ ID NO: 6928673 - DNA, 22 bp, Homo sapiens
atgctacaggaagacgtcaggc

SEQ ID NO: 6928674 - DNA, 22 bp, Homo sapiens
tctggcatctgttttcatattt

SEQ ID NO: 6928675 - DNA, 20 bp, Homo sapiens
agaattcttaccctttgatg

SEQ ID NO: 6928676 - DNA, 22 bp, Homo sapiens
acccaggctagaagtgaattat

SEQ ID NO: 6928677 - DNA, 22 bp, Homo sapiens
agtctggagtgcggcggcagga

SEQ ID NO: 6928678 - DNA, 22 bp, Homo sapiens
gagttcatattcagagatcgct

SEQ ID NO: 6928679 - DNA, 22 bp, Homo sapiens
ctagcaagcctaccacgaaact

SEQ ID NO: 6928680 - DNA, 22 bp, Homo sapiens
gcaggacacagatgcaaggcca

SEQ ID NO: 6928681 - DNA, 22 bp, Homo sapiens
aggagatcagcctccctgcaac

SEQ ID NO: 6928682 - DNA, 22 bp, Homo sapiens
tgggtaaaatgagttaggagaa

SEQ ID NO: 6928683 - DNA, 22 bp, Homo sapiens
tgtcaggtcattgccatggaaa

SEQ ID NO: 6928684 - DNA, 17 bp, Homo sapiens
tcatttctaggcactcc

SEQ ID NO: 6928685 - DNA, 22 bp, Homo sapiens
tctcaggcattcccacatagaa

SEQ ID NO: 6928686 - DNA, 22 bp, Homo sapiens
acagatatgcaaagcaaatgga

SEQ ID NO: 6928687 - DNA, 22 bp, Homo sapiens
catctgttcactcggcatgtat

SEQ ID NO: 6928688 - DNA, 22 bp, Homo sapiens
aagctatgttcctgcactgctc

SEQ ID NO: 6928689 - DNA, 22 bp, Homo sapiens
ttattagatctgttagggatcc

SEQ ID NO: 6928690 - DNA, 22 bp, Homo sapiens
gcagcgtggggacaggagctca

SEQ ID NO: 6928691 - DNA, 22 bp, Homo sapiens
agcaggtgggcatgaaagctga

SEQ ID NO: 6928692 - DNA, 22 bp, Homo sapiens
agatgtgggtgtcaggcagtga

SEQ ID NO: 6928693 - DNA, 22 bp, Homo sapiens
gctggcctgacctgaggctggg

SEQ ID NO: 6928694 - DNA, 22 bp, Homo sapiens
aacaggctcttcatttccagag

SEQ ID NO: 6928695 - DNA, 22 bp, Homo sapiens
aggatttaccgtcatttagtct

SEQ ID NO: 6928696 - DNA, 22 bp, Homo sapiens
tcttggccagatgcacttcctc

SEQ ID NO: 6928697 - DNA, 22 bp, Homo sapiens
ggattgaaggcccttaactgat

SEQ ID NO: 6928698 - DNA, 22 bp, Homo sapiens
tagcccagcttggcctatttct

SEQ ID NO: 6928699 - DNA, 22 bp, Homo sapiens
aaattctttcatggctaataag

SEQ ID NO: 6928700 - DNA, 22 bp, Homo sapiens
acatcacagagcccagataaag

SEQ ID NO: 6928701 - DNA, 22 bp, Homo sapiens
ccatggctctagagattgaaaa

SEQ ID NO: 6928702 - DNA, 18 bp, Homo sapiens
gcaggccctgtttctggg

SEQ ID NO: 6928703 - DNA, 23 bp, Homo sapiens
tggctttattcacatatctgacc

SEQ ID NO: 6928704 - DNA, 22 bp, Homo sapiens
tctgattccagtgaccctagga

SEQ ID NO: 6928705 - DNA, 22 bp, Homo sapiens
aggcttaaagatagtaagaaac

SEQ ID NO: 6928706 - DNA, 22 bp, Homo sapiens
tagtaagcacatggacaagtgg

SEQ ID NO: 6928707 - DNA, 22 bp, Homo sapiens
tgcctagcatagtatttgtcac

SEQ ID NO: 6928708 - DNA, 22 bp, Homo sapiens
gttcccatgcctccaagcttca

SEQ ID NO: 6928709 - DNA, 22 bp, Homo sapiens
tgtggagactatagccataaca

SEQ ID NO: 6928710 - DNA, 22 bp, Homo sapiens
ggtctgaatatagaacttaagt

SEQ ID NO: 6928711 - DNA, 22 bp, Homo sapiens
aaattttaaggctggaacttaa

SEQ ID NO: 6928712 - DNA, 22 bp, Homo sapiens
tctcattcatccaaggatttat

SEQ ID NO: 6928713 - DNA, 22 bp, Homo sapiens
tctttgcagtctgggcttgttt

SEQ ID NO: 6928714 - DNA, 22 bp, Homo sapiens
taatgtataacaaatactcatc

SEQ ID NO: 6928715 - DNA, 22 bp, Homo sapiens
tgagattctgttcagaaaaatg

SEQ ID NO: 6928716 - DNA, 22 bp, Homo sapiens
taaggcaggaactggctgtttt

SEQ ID NO: 6928717 - DNA, 22 bp, Homo sapiens
tctgtgtcactgaggcctgtgt

SEQ ID NO: 6928718 - DNA, 22 bp, Homo sapiens
atagcaatttgcccaattacct

SEQ ID NO: 6928719 - DNA, 22 bp, Homo sapiens
taatgtgttgaatatttgtaca

SEQ ID NO: 6928720 - DNA, 22 bp, Homo sapiens
tatggcattgttggtgatgata

SEQ ID NO: 6928721 - DNA, 22 bp, Homo sapiens
tttcatgttattaatagtgctg

SEQ ID NO: 6928722 - DNA, 22 bp, Homo sapiens
atctggaatccttgtggacaat

SEQ ID NO: 6928723 - DNA, 22 bp, Homo sapiens
tgaaactaggccaatcaaatta

SEQ ID NO: 6928724 - DNA, 22 bp, Homo sapiens
agctgctatgacaacaccagcc

SEQ ID NO: 6928725 - DNA, 22 bp, Homo sapiens
cttcctggctcggtgcctcacc

SEQ ID NO: 6928726 - DNA, 22 bp, Homo sapiens
tcctgggatactaagaaatttt

SEQ ID NO: 6928727 - DNA, 22 bp, Homo sapiens
ttagacatcaagaagccaatgt

SEQ ID NO: 6928728 - DNA, 22 bp, Homo sapiens
atgttccttccagagagcagaa

SEQ ID NO: 6928729 - DNA, 22 bp, Homo sapiens
tgcttgtgacagaactgtgtcc

SEQ ID NO: 6928730 - DNA, 22 bp, Homo sapiens
aggctagctgtttcagggctag

SEQ ID NO: 6928731 - DNA, 22 bp, Homo sapiens
aaatgttccattattgtgtaat

SEQ ID NO: 6928732 - DNA, 22 bp, Homo sapiens
gggcacagagggtcttgaagaa

SEQ ID NO: 6928733 - DNA, 22 bp, Homo sapiens
agagggagcccagtcatagctg

SEQ ID NO: 6928734 - DNA, 22 bp, Homo sapiens
aagggagaggagggtcttgttg

SEQ ID NO: 6928735 - DNA, 22 bp, Homo sapiens
gaacagactttgccaattacag

SEQ ID NO: 6928736 - DNA, 23 bp, Homo sapiens
ccagggaggttgattggttaccc

SEQ ID NO: 6928737 - DNA, 22 bp, Homo sapiens
cctctgacacttgtcccacaca

SEQ ID NO: 6928738 - DNA, 17 bp, Homo sapiens
caaggccagcatcttca

SEQ ID NO: 6928739 - DNA, 22 bp, Homo sapiens
acagggccattggaggattata

SEQ ID NO: 6928740 - DNA, 22 bp, Homo sapiens
gctcccagttcccaaagtgacc

SEQ ID NO: 6928741 - DNA, 21 bp, Homo sapiens
tcactgcaatgctaggagaaa

SEQ ID NO: 6928742 - DNA, 22 bp, Homo sapiens
tggtcccagcacaaaccttgct

SEQ ID NO: 6928743 - DNA, 22 bp, Homo sapiens
gataacatacttgcatgtgtat

SEQ ID NO: 6928744 - DNA, 22 bp, Homo sapiens
tatttccaagctgaatccaatg

SEQ ID NO: 6928745 - DNA, 22 bp, Homo sapiens
ctggtccctgcagtgtgctggg

SEQ ID NO: 6928746 - DNA, 22 bp, Homo sapiens
gtcaaatatactaagaggtaaa

SEQ ID NO: 6928747 - DNA, 22 bp, Homo sapiens
tgaggcactccaggatgctgtt

SEQ ID NO: 6928748 - DNA, 22 bp, Homo sapiens
ctctgactgacctggaatgaat

SEQ ID NO: 6928749 - DNA, 22 bp, Homo sapiens
taagacatcctggatgttcaaa

SEQ ID NO: 6928750 - DNA, 22 bp, Homo sapiens
tgaaatctcctctttatatatc

SEQ ID NO: 6928751 - DNA, 22 bp, Homo sapiens
tgctcactgaactcttgctgtc

SEQ ID NO: 6928752 - DNA, 22 bp, Homo sapiens
ggggaatgagtgcccagaaagc

SEQ ID NO: 6928753 - DNA, 22 bp, Homo sapiens
tccagcatgactagttccccat

SEQ ID NO: 6928754 - DNA, 22 bp, Homo sapiens
cctggcaggtggaggttgcagt

SEQ ID NO: 6928755 - DNA, 22 bp, Homo sapiens
aggatgttatctgtgcaggtgg

SEQ ID NO: 6928756 - DNA, 22 bp, Homo sapiens
gccaaatataattctccacctt

SEQ ID NO: 6928757 - DNA, 22 bp, Homo sapiens
ctttggcagcctcagctgcagg

SEQ ID NO: 6928758 - DNA, 22 bp, Homo sapiens
tcaagaaatgtgcttggatata

SEQ ID NO: 6928759 - DNA, 22 bp, Homo sapiens
tgctaggtgattttattacttg

SEQ ID NO: 6928760 - DNA, 22 bp, Homo sapiens
cagctctgccatcatctgcctt

SEQ ID NO: 6928761 - DNA, 22 bp, Homo sapiens
aacatgaaaacctccacagcaa

SEQ ID NO: 6928762 - DNA, 22 bp, Homo sapiens
taagtacatttgggaccacctg

SEQ ID NO: 6928763 - DNA, 22 bp, Homo sapiens
tgtactgtatgccaggcactat

SEQ ID NO: 6928764 - DNA, 22 bp, Homo sapiens
gtgcttcctgcctggtgccttt

SEQ ID NO: 6928765 - DNA, 22 bp, Homo sapiens
agtctgaaggcaatctgctgac

SEQ ID NO: 6928766 - DNA, 18 bp, Homo sapiens
caaagctcacgttccatc

SEQ ID NO: 6928767 - DNA, 22 bp, Homo sapiens
ggttttggaagtataaagatgt

SEQ ID NO: 6928768 - DNA, 22 bp, Homo sapiens
acctgaattgtcatatcttatt

SEQ ID NO: 6928769 - DNA, 22 bp, Homo sapiens
atgaaatttgctgctaagttcc

SEQ ID NO: 6928770 - DNA, 22 bp, Homo sapiens
ttctttcttagcaatctatggt

SEQ ID NO: 6928771 - DNA, 21 bp, Homo sapiens
tgggcgcttgacctctgcact

SEQ ID NO: 6928772 - DNA, 19 bp, Homo sapiens
aagtattctttgttagcag

SEQ ID NO: 6928773 - DNA, 22 bp, Homo sapiens
tcaggacaacatgttgctaatc

SEQ ID NO: 6928774 - DNA, 22 bp, Homo sapiens
tggggccacactgatctcccag

SEQ ID NO: 6928775 - DNA, 22 bp, Homo sapiens
atcatttatgccccaattagat

SEQ ID NO: 6928776 - DNA, 21 bp, Homo sapiens
gtgcttttccttaatgttctt

SEQ ID NO: 6928777 - DNA, 20 bp, Homo sapiens
cttcttcattaaccctactg

SEQ ID NO: 6928778 - DNA, 19 bp, Homo sapiens
tgtgaaagctagtgttctt

SEQ ID NO: 6928779 - DNA, 22 bp, Homo sapiens
ctagatcagattgctgtttcta

SEQ ID NO: 6928780 - DNA, 22 bp, Homo sapiens
atatgtatgtgttttctttgga

SEQ ID NO: 6928781 - DNA, 22 bp, Homo sapiens
agaaatactttgtaaatctcac

SEQ ID NO: 6928782 - DNA, 22 bp, Homo sapiens
tacatccaaatgaattagaatt

SEQ ID NO: 6928783 - DNA, 20 bp, Homo sapiens
tgtctttccatggctggatc

SEQ ID NO: 6928784 - DNA, 18 bp, Homo sapiens
taaatgcatgttaataac

SEQ ID NO: 6928785 - DNA, 22 bp, Homo sapiens
cggctgagacggccatagacac

SEQ ID NO: 6928786 - DNA, 22 bp, Homo sapiens
tggctgtgaacaaagagaataa

SEQ ID NO: 6928787 - DNA, 22 bp, Homo sapiens
tactttagaaggaaataagttc

SEQ ID NO: 6928788 - DNA, 22 bp, Homo sapiens
cacttgcctacccttagaacgt

SEQ ID NO: 6928789 - DNA, 22 bp, Homo sapiens
tcctcacagagtggcaggcaat

SEQ ID NO: 6928790 - DNA, 22 bp, Homo sapiens
aagcatttctgtttatctatcg

SEQ ID NO: 6928791 - DNA, 22 bp, Homo sapiens
attgtatgatgtgcttcacttt

SEQ ID NO: 6928792 - DNA, 22 bp, Homo sapiens
atgctgaaggccatcctgcatc

SEQ ID NO: 6928793 - DNA, 22 bp, Homo sapiens
agctgctctttgaaggacactt

SEQ ID NO: 6928794 - DNA, 22 bp, Homo sapiens
gttcacagttaggacaactgct

SEQ ID NO: 6928795 - DNA, 22 bp, Homo sapiens
gccaggctcagcagtcaacctg

SEQ ID NO: 6928796 - DNA, 22 bp, Homo sapiens
catgccatttttctagattgag

SEQ ID NO: 6928797 - DNA, 22 bp, Homo sapiens
agtaacaaagaaagcctttgga

SEQ ID NO: 6928798 - DNA, 22 bp, Homo sapiens
ccagtgtgaaaggtcatttatc

SEQ ID NO: 6928799 - DNA, 22 bp, Homo sapiens
tgggctcttcctatagtttata

SEQ ID NO: 6928800 - DNA, 22 bp, Homo sapiens
acagtggaatttgtagatgtgt

SEQ ID NO: 6928801 - DNA, 22 bp, Homo sapiens
agaatagttttacttttctatg

SEQ ID NO: 6928802 - DNA, 22 bp, Homo sapiens
ggtagactgtcaaacactagcc

SEQ ID NO: 6928803 - DNA, 22 bp, Homo sapiens
tccagcttggcagagctacctg

SEQ ID NO: 6928804 - DNA, 22 bp, Homo sapiens
tacaggctgaactcaatgatga

SEQ ID NO: 6928805 - DNA, 22 bp, Homo sapiens
gtgccattgcactccagcctgg

SEQ ID NO: 6928806 - DNA, 22 bp, Homo sapiens
aaagcagctgctctggccttga

SEQ ID NO: 6928807 - DNA, 22 bp, Homo sapiens
cccccactaagttgagggccct

SEQ ID NO: 6928808 - DNA, 22 bp, Homo sapiens
tggttagatgaggctggtttca

SEQ ID NO: 6928809 - DNA, 22 bp, Homo sapiens
aggtaagcctggaggcttctat

SEQ ID NO: 6928810 - DNA, 22 bp, Homo sapiens
aggaaacagttggtaatgcata

SEQ ID NO: 6928811 - DNA, 22 bp, Homo sapiens
gtgtgctgagtgactgtcatca

SEQ ID NO: 6928812 - DNA, 22 bp, Homo sapiens
aggttcttggtgagcatttggt

SEQ ID NO: 6928813 - DNA, 22 bp, Homo sapiens
gcagaagcagggcaggggcaaa

SEQ ID NO: 6928814 - DNA, 22 bp, Homo sapiens
ctgagcttccagttcctccagg

SEQ ID NO: 6928815 - DNA, 22 bp, Homo sapiens
gtacagcacagagcatcgcaca

SEQ ID NO: 6928816 - DNA, 22 bp, Homo sapiens
ggcaaagaaccacaccacgtgt

SEQ ID NO: 6928817 - DNA, 19 bp, Homo sapiens
ggcatctccactcctaccc

SEQ ID NO: 6928818 - DNA, 22 bp, Homo sapiens
ttaaatgatgcatatcatttag

SEQ ID NO: 6928819 - DNA, 22 bp, Homo sapiens
cttggcctgacatgtggcaggg

SEQ ID NO: 6928820 - DNA, 22 bp, Homo sapiens
tgagcagatgtgccaaactgta

SEQ ID NO: 6928821 - DNA, 22 bp, Homo sapiens
agattcaaagtgaagaacttaa

SEQ ID NO: 6928822 - DNA, 22 bp, Homo sapiens
caattttattggtccaaataca

SEQ ID NO: 6928823 - DNA, 22 bp, Homo sapiens
agatgtgcctccaaggggtgca

SEQ ID NO: 6928824 - DNA, 22 bp, Homo sapiens
aatagcaaacactggtaaagtt

SEQ ID NO: 6928825 - DNA, 22 bp, Homo sapiens
tggcttctctgttttagtattt

SEQ ID NO: 6928826 - DNA, 22 bp, Homo sapiens
tctgtgataggtggcatagtga

SEQ ID NO: 6928827 - DNA, 19 bp, Homo sapiens
accctctcagtgcctgagg

SEQ ID NO: 6928828 - DNA, 22 bp, Homo sapiens
gtcggccacgcaggtgcggtag

SEQ ID NO: 6928829 - DNA, 22 bp, Homo sapiens
ctgggaagtggtgagggcctga

SEQ ID NO: 6928830 - DNA, 21 bp, Homo sapiens
aaggagcctaggaggctcagg

SEQ ID NO: 6928831 - DNA, 22 bp, Homo sapiens
cagatgctaaacaaaggacttt

SEQ ID NO: 6928832 - DNA, 22 bp, Homo sapiens
tggccaggcattcagataagac

SEQ ID NO: 6928833 - DNA, 22 bp, Homo sapiens
cagcaggcaggtgggccaagtc

SEQ ID NO: 6928834 - DNA, 22 bp, Homo sapiens
tgcatatttgattgagatacct

SEQ ID NO: 6928835 - DNA, 22 bp, Homo sapiens
atccttaagaaagttttctata

SEQ ID NO: 6928836 - DNA, 22 bp, Homo sapiens
cctgtattatttgtatgtgctg

SEQ ID NO: 6928837 - DNA, 21 bp, Homo sapiens
tcagagtctcaggagcaaggg

SEQ ID NO: 6928838 - DNA, 22 bp, Homo sapiens
tgatgatatgaaagaatcttta

SEQ ID NO: 6928839 - DNA, 22 bp, Homo sapiens
gaatacacgcacgacacggggg

SEQ ID NO: 6928840 - DNA, 20 bp, Homo sapiens
aaaatctcccagaaacttat

SEQ ID NO: 6928841 - DNA, 22 bp, Homo sapiens
cggcacagggtaaacgttaccc

SEQ ID NO: 6928842 - DNA, 22 bp, Homo sapiens
gacatttgtatcttaggggaaa

SEQ ID NO: 6928843 - DNA, 22 bp, Homo sapiens
acactggtgatcaaagggtaga

SEQ ID NO: 6928844 - DNA, 22 bp, Homo sapiens
aggctgtgggaatggctgcttg

SEQ ID NO: 6928845 - DNA, 22 bp, Homo sapiens
tagatggctttctgaggtattt

SEQ ID NO: 6928846 - DNA, 22 bp, Homo sapiens
tgttggtgaacttccacttgct

SEQ ID NO: 6928847 - DNA, 22 bp, Homo sapiens
ttcctgaagtcaaagatctaaa

SEQ ID NO: 6928848 - DNA, 21 bp, Homo sapiens
ctgtgtcgctctcgctgggag

SEQ ID NO: 6928849 - DNA, 22 bp, Homo sapiens
gacctgagattttgaggctcat

SEQ ID NO: 6928850 - DNA, 22 bp, Homo sapiens
ccagctccagcatagccaccat

SEQ ID NO: 6928851 - DNA, 22 bp, Homo sapiens
atgtcatgaaatgctactaact

SEQ ID NO: 6928852 - DNA, 22 bp, Homo sapiens
aacctttgaggggagctctttc

SEQ ID NO: 6928853 - DNA, 22 bp, Homo sapiens
tgtttatgcatcgttaatacca

SEQ ID NO: 6928854 - DNA, 22 bp, Homo sapiens
taaaagttttagttgtacataa

SEQ ID NO: 6928855 - DNA, 22 bp, Homo sapiens
agagcactttcgagagccggag

SEQ ID NO: 6928856 - DNA, 22 bp, Homo sapiens
tacaaagatagtgttagagtaa

SEQ ID NO: 6928857 - DNA, 22 bp, Homo sapiens
tatgtcttgtgtttgctaatct

SEQ ID NO: 6928858 - DNA, 22 bp, Homo sapiens
acatagatgcctctgctgcttc

SEQ ID NO: 6928859 - DNA, 22 bp, Homo sapiens
tttttctgagaatatgagagga

SEQ ID NO: 6928860 - DNA, 22 bp, Homo sapiens
aggttctgtttggctgaggatc

SEQ ID NO: 6928861 - DNA, 22 bp, Homo sapiens
aaccatggatttcagttcacct

SEQ ID NO: 6928862 - DNA, 22 bp, Homo sapiens
aaggtacagttttaagaataag

SEQ ID NO: 6928863 - DNA, 23 bp, Homo sapiens
acagtgtggtggacaaggagcag

SEQ ID NO: 6928864 - DNA, 18 bp, Homo sapiens
gtttggcataactgatgc

SEQ ID NO: 6928865 - DNA, 22 bp, Homo sapiens
attgttaataactattacattg

SEQ ID NO: 6928866 - DNA, 22 bp, Homo sapiens
gcaagattagaatcaactgtga

SEQ ID NO: 6928867 - DNA, 22 bp, Homo sapiens
tgagatgagggctgcactcaaa

SEQ ID NO: 6928868 - DNA, 22 bp, Homo sapiens
gcagtggcagagacagcaccaa

SEQ ID NO: 6928869 - DNA, 22 bp, Homo sapiens
tcaattacagcacagtactcca

SEQ ID NO: 6928870 - DNA, 22 bp, Homo sapiens
ttctgtcagaagctagctcctg

SEQ ID NO: 6928871 - DNA, 22 bp, Homo sapiens
gagcttggtgttatttctgtgg

SEQ ID NO: 6928872 - DNA, 22 bp, Homo sapiens
ggactgctccagtgtgatttgt

SEQ ID NO: 6928873 - DNA, 22 bp, Homo sapiens
gctcactggcctgaagaggacg

SEQ ID NO: 6928874 - DNA, 20 bp, Homo sapiens
tgccttggagcagccaaggt

SEQ ID NO: 6928875 - DNA, 22 bp, Homo sapiens
agtgcttataccaaagactctt

SEQ ID NO: 6928876 - DNA, 22 bp, Homo sapiens
tgctgctttggaactccacagg

SEQ ID NO: 6928877 - DNA, 23 bp, Homo sapiens
cttgtattcactcatttgggaac

SEQ ID NO: 6928878 - DNA, 22 bp, Homo sapiens
tgaaagcacaagttctaacagg

SEQ ID NO: 6928879 - DNA, 18 bp, Homo sapiens
agcctgggctctgcctgg

SEQ ID NO: 6928880 - DNA, 22 bp, Homo sapiens
tctttgatgggagatctgagag

SEQ ID NO: 6928881 - DNA, 21 bp, Homo sapiens
taataattccactacagagta

SEQ ID NO: 6928882 - DNA, 22 bp, Homo sapiens
tagaaagatctgtaggcaagag

SEQ ID NO: 6928883 - DNA, 22 bp, Homo sapiens
cttattatggcatgtaagtggg

SEQ ID NO: 6928884 - DNA, 22 bp, Homo sapiens
tccaaagtaatttcacttctgt

SEQ ID NO: 6928885 - DNA, 22 bp, Homo sapiens
agccagtttccagatattaact

SEQ ID NO: 6928886 - DNA, 22 bp, Homo sapiens
tcctgaggaaagttcatgaatg

SEQ ID NO: 6928887 - DNA, 23 bp, Homo sapiens
tcggtgggcgtggaggccgaggc

SEQ ID NO: 6928888 - DNA, 22 bp, Homo sapiens
acttacccaagttatttgtagt

SEQ ID NO: 6928889 - DNA, 22 bp, Homo sapiens
tggtataaaactttttattgaa

SEQ ID NO: 6928890 - DNA, 22 bp, Homo sapiens
ggacagtgtctgcttcaggccc

SEQ ID NO: 6928891 - DNA, 22 bp, Homo sapiens
cagagccacagcctccagattt

SEQ ID NO: 6928892 - DNA, 22 bp, Homo sapiens
tttatccaagggttttaactgt

SEQ ID NO: 6928893 - DNA, 22 bp, Homo sapiens
acagcctgacttttgttgtcac

SEQ ID NO: 6928894 - DNA, 22 bp, Homo sapiens
aagtgcaggagtggggaaagta

SEQ ID NO: 6928895 - DNA, 22 bp, Homo sapiens
gtaagatagccttgggttattt

SEQ ID NO: 6928896 - DNA, 22 bp, Homo sapiens
tgcatgcacccagccgggtatt

SEQ ID NO: 6928897 - DNA, 22 bp, Homo sapiens
agtagattccagtgatagttaa

SEQ ID NO: 6928898 - DNA, 22 bp, Homo sapiens
atgagaaaattcattccatcca

SEQ ID NO: 6928899 - DNA, 22 bp, Homo sapiens
atgtgttaatgtcaaccagaaa

SEQ ID NO: 6928900 - DNA, 22 bp, Homo sapiens
gttctcagttcaggaaggacat

SEQ ID NO: 6928901 - DNA, 22 bp, Homo sapiens
gcatttggaacttggttgagat

SEQ ID NO: 6928902 - DNA, 22 bp, Homo sapiens
taggaagataaacatttgtatg

SEQ ID NO: 6928903 - DNA, 20 bp, Homo sapiens
atgtagatgaaagcaaaggc

SEQ ID NO: 6928904 - DNA, 22 bp, Homo sapiens
gaccctttgacttgtgacatta

SEQ ID NO: 6928905 - DNA, 22 bp, Homo sapiens
gtgggtggatggctcacctcca

SEQ ID NO: 6928906 - DNA, 22 bp, Homo sapiens
gcagatgcatcttggtttaaac

SEQ ID NO: 6928907 - DNA, 22 bp, Homo sapiens
ggggagctgacaaccacatcct

SEQ ID NO: 6928908 - DNA, 22 bp, Homo sapiens
cctctcagtattgaactttata

SEQ ID NO: 6928909 - DNA, 22 bp, Homo sapiens
acggattttacttccatggtta

SEQ ID NO: 6928910 - DNA, 22 bp, Homo sapiens
tctgataagacagctgatttga

SEQ ID NO: 6928911 - DNA, 22 bp, Homo sapiens
gtgggcaggaggccctgccctg

SEQ ID NO: 6928912 - DNA, 22 bp, Homo sapiens
ccactaccacggcatgcctccc

SEQ ID NO: 6928913 - DNA, 22 bp, Homo sapiens
gaagttctggctcagagaggaa

SEQ ID NO: 6928914 - DNA, 22 bp, Homo sapiens
ttgctatgtgggttgtgcactc

SEQ ID NO: 6928915 - DNA, 22 bp, Homo sapiens
agtggactcttcccagtgcttg

SEQ ID NO: 6928916 - DNA, 22 bp, Homo sapiens
gggcagcaggctccacgttcct

SEQ ID NO: 6928917 - DNA, 19 bp, Homo sapiens
cccacaggaggacatatgg

SEQ ID NO: 6928918 - DNA, 22 bp, Homo sapiens
tggaccctttatgcggaacagg

SEQ ID NO: 6928919 - DNA, 22 bp, Homo sapiens
tgtaacctgactgctttgctct

SEQ ID NO: 6928920 - DNA, 22 bp, Homo sapiens
tttggaaacacggtcatcttcc

SEQ ID NO: 6928921 - DNA, 18 bp, Homo sapiens
cagacctagccccaccat

SEQ ID NO: 6928922 - DNA, 22 bp, Homo sapiens
cagaggcttcaagtcattctcc

SEQ ID NO: 6928923 - DNA, 22 bp, Homo sapiens
ccttagtgtgaggggatacccc

SEQ ID NO: 6928924 - DNA, 22 bp, Homo sapiens
ttcacagtggcttaggctatgg

SEQ ID NO: 6928925 - DNA, 22 bp, Homo sapiens
atgcaaaagtaactgtgatttt

SEQ ID NO: 6928926 - DNA, 22 bp, Homo sapiens
ggtctcctgacctttagtccct

SEQ ID NO: 6928927 - DNA, 22 bp, Homo sapiens
tgaatcattttgctgtttgaac

SEQ ID NO: 6928928 - DNA, 22 bp, Homo sapiens
ttcttcagcctaccttgacctc

SEQ ID NO: 6928929 - DNA, 22 bp, Homo sapiens
acatgactataattacttaaat

SEQ ID NO: 6928930 - DNA, 22 bp, Homo sapiens
cagtggcttcttcctagagcca

SEQ ID NO: 6928931 - DNA, 22 bp, Homo sapiens
tgtccccattctaagaggtggc

SEQ ID NO: 6928932 - DNA, 22 bp, Homo sapiens
aatgaggttttttaaagccaga

SEQ ID NO: 6928933 - DNA, 22 bp, Homo sapiens
tcagctggcatcggctcaccca

SEQ ID NO: 6928934 - DNA, 22 bp, Homo sapiens
attattactcctgattgtactg

SEQ ID NO: 6928935 - DNA, 21 bp, Homo sapiens
tcagtgtatttaagaatgttg

SEQ ID NO: 6928936 - DNA, 22 bp, Homo sapiens
ttgcacagcaacgtgaatgtac

SEQ ID NO: 6928937 - DNA, 22 bp, Homo sapiens
taagtgggtttgtaatgtgcct

SEQ ID NO: 6928938 - DNA, 22 bp, Homo sapiens
ttaccgagaacatgactggaat

SEQ ID NO: 6928939 - DNA, 22 bp, Homo sapiens
cttcaaagggtcactatttatc

SEQ ID NO: 6928940 - DNA, 22 bp, Homo sapiens
acagtcaagaaatggcagagcc

SEQ ID NO: 6928941 - DNA, 22 bp, Homo sapiens
tctgaagaactgtctagagaac

SEQ ID NO: 6928942 - DNA, 22 bp, Homo sapiens
attagtgactctcacatatgcc

SEQ ID NO: 6928943 - DNA, 22 bp, Homo sapiens
cctcagtcattggcctacactt

SEQ ID NO: 6928944 - DNA, 22 bp, Homo sapiens
tggctggctgtcaaggaaagcc

SEQ ID NO: 6928945 - DNA, 22 bp, Homo sapiens
cacaaggccttgtagaccacgg

SEQ ID NO: 6928946 - DNA, 22 bp, Homo sapiens
tatcattctaattctcctcgta

SEQ ID NO: 6928947 - DNA, 22 bp, Homo sapiens
atatgagtttcccacttctgga

SEQ ID NO: 6928948 - DNA, 22 bp, Homo sapiens
gttcaaattgattttggtaaag

SEQ ID NO: 6928949 - DNA, 22 bp, Homo sapiens
atgatgtaaaataagttgtgag

SEQ ID NO: 6928950 - DNA, 22 bp, Homo sapiens
aattgcatgttaatgactaagt

SEQ ID NO: 6928951 - DNA, 22 bp, Homo sapiens
ggtcattgtcagagcctgtact

SEQ ID NO: 6928952 - DNA, 23 bp, Homo sapiens
ctgtgggaagtcggggagcgcgc

SEQ ID NO: 6928953 - DNA, 22 bp, Homo sapiens
ctgtgagtcttcagcaagtgtt

SEQ ID NO: 6928954 - DNA, 22 bp, Homo sapiens
actattcaggctccatctggta

SEQ ID NO: 6928955 - DNA, 22 bp, Homo sapiens
ctaaacatgtagcttttgtggt

SEQ ID NO: 6928956 - DNA, 22 bp, Homo sapiens
tagtacactaccatcaggtttt

SEQ ID NO: 6928957 - DNA, 22 bp, Homo sapiens
gctttctgggctatagaacggg

SEQ ID NO: 6928958 - DNA, 19 bp, Homo sapiens
ccattgtaaagaaaaatgt

SEQ ID NO: 6928959 - DNA, 22 bp, Homo sapiens
tatccaaagtggcatattatag

SEQ ID NO: 6928960 - DNA, 22 bp, Homo sapiens
tctgagaagcgtgtctctgttt

SEQ ID NO: 6928961 - DNA, 22 bp, Homo sapiens
atctgtcaggagcaaggactac

SEQ ID NO: 6928962 - DNA, 20 bp, Homo sapiens
agggtggggacgttctgact

SEQ ID NO: 6928963 - DNA, 23 bp, Homo sapiens
aaccagataaatggctccagggc

SEQ ID NO: 6928964 - DNA, 22 bp, Homo sapiens
ggccttggtactgtaaaccgag

SEQ ID NO: 6928965 - DNA, 22 bp, Homo sapiens
gctccagggaacagaatgtact

SEQ ID NO: 6928966 - DNA, 22 bp, Homo sapiens
ggaaagctctacaaagccacag

SEQ ID NO: 6928967 - DNA, 22 bp, Homo sapiens
cagcctgcatttgtatctgtat

SEQ ID NO: 6928968 - DNA, 22 bp, Homo sapiens
ggagcagagcatttcacagcct

SEQ ID NO: 6928969 - DNA, 22 bp, Homo sapiens
gaatacaaacttaaggctttac

SEQ ID NO: 6928970 - DNA, 22 bp, Homo sapiens
tgtgaatggcagttggatagca

SEQ ID NO: 6928971 - DNA, 20 bp, Homo sapiens
atcagacttttaggaacata

SEQ ID NO: 6928972 - DNA, 23 bp, Homo sapiens
tggaaacttaagggggagatgtc

SEQ ID NO: 6928973 - DNA, 22 bp, Homo sapiens
agcatttatgactaatgtaaaa

SEQ ID NO: 6928974 - DNA, 22 bp, Homo sapiens
tatcaaattgaggcagctgggg

SEQ ID NO: 6928975 - DNA, 22 bp, Homo sapiens
tctatctgaggaggtgacattt

SEQ ID NO: 6928976 - DNA, 22 bp, Homo sapiens
tgattcagacctgtcagacttc

SEQ ID NO: 6928977 - DNA, 22 bp, Homo sapiens
aaagttcattgatgactgaggt

SEQ ID NO: 6928978 - DNA, 18 bp, Homo sapiens
ttcctgatcctctgctga

SEQ ID NO: 6928979 - DNA, 22 bp, Homo sapiens
atggctctaggttgggcagttt

SEQ ID NO: 6928980 - DNA, 22 bp, Homo sapiens
gaacatgcaatgacaggggact

SEQ ID NO: 6928981 - DNA, 22 bp, Homo sapiens
ttaccacagtgcctgtctaatg

SEQ ID NO: 6928982 - DNA, 22 bp, Homo sapiens
ggagaaagctgtagtggaatgt

SEQ ID NO: 6928983 - DNA, 22 bp, Homo sapiens
tattagtagcttgaaattggtg

SEQ ID NO: 6928984 - DNA, 22 bp, Homo sapiens
catgcacagtgatatctgaaga

SEQ ID NO: 6928985 - DNA, 20 bp, Homo sapiens
cgaggccaaggggctgggcc

SEQ ID NO: 6928986 - DNA, 22 bp, Homo sapiens
tcttaacatattattttagcac

SEQ ID NO: 6928987 - DNA, 22 bp, Homo sapiens
cacaatttcagttgcatgcaac

SEQ ID NO: 6928988 - DNA, 22 bp, Homo sapiens
cagcagtgtctccagcatcaca

SEQ ID NO: 6928989 - DNA, 22 bp, Homo sapiens
ccctggagtccggagctcacct

SEQ ID NO: 6928990 - DNA, 22 bp, Homo sapiens
gactttctgctatactttctgt

SEQ ID NO: 6928991 - DNA, 22 bp, Homo sapiens
acagctgctctatatctcagcc

SEQ ID NO: 6928992 - DNA, 22 bp, Homo sapiens
atgtgattcccactgaatcact

SEQ ID NO: 6928993 - DNA, 22 bp, Homo sapiens
cagagcccatttctttgttcct

SEQ ID NO: 6928994 - DNA, 22 bp, Homo sapiens
atgaaattaatcaacacataca

SEQ ID NO: 6928995 - DNA, 22 bp, Homo sapiens
gtcagctctcttatccatgagg

SEQ ID NO: 6928996 - DNA, 22 bp, Homo sapiens
cactgcaagctctgccacctgg

SEQ ID NO: 6928997 - DNA, 22 bp, Homo sapiens
cagtaagtattcgagtctccat

SEQ ID NO: 6928998 - DNA, 22 bp, Homo sapiens
tatgtttacgctggtagaatta

SEQ ID NO: 6928999 - DNA, 22 bp, Homo sapiens
gggctgcacgtattctgctcac

SEQ ID NO: 6929000 - DNA, 18 bp, Homo sapiens
tgttggtgttcactcact

SEQ ID NO: 6929001 - DNA, 22 bp, Homo sapiens
ggctctgccacttcttggctgt

SEQ ID NO: 6929002 - DNA, 20 bp, Homo sapiens
ctgcaaaatgacattaggaa

SEQ ID NO: 6929003 - DNA, 22 bp, Homo sapiens
agccagaggtcatgagcacagg

SEQ ID NO: 6929004 - DNA, 22 bp, Homo sapiens
ggctgctagcaatgctcaggcg

SEQ ID NO: 6929005 - DNA, 22 bp, Homo sapiens
gtgtccattcactgcaacactt

SEQ ID NO: 6929006 - DNA, 22 bp, Homo sapiens
catttgtaggatgcttcttgtt

SEQ ID NO: 6929007 - DNA, 22 bp, Homo sapiens
aggctcagggacggggcccctt

SEQ ID NO: 6929008 - DNA, 22 bp, Homo sapiens
ggtcacttcagataactggtgt

SEQ ID NO: 6929009 - DNA, 22 bp, Homo sapiens
tctttccagaggaatttttaga

SEQ ID NO: 6929010 - DNA, 22 bp, Homo sapiens
gttttcctgttgagtagtattc

SEQ ID NO: 6929011 - DNA, 22 bp, Homo sapiens
agatacaagaggcctgacgtgt

SEQ ID NO: 6929012 - DNA, 18 bp, Homo sapiens
aagaggctgttctgtggg

SEQ ID NO: 6929013 - DNA, 22 bp, Homo sapiens
aaatgctgtgttttaacataga

SEQ ID NO: 6929014 - DNA, 22 bp, Homo sapiens
tagagagagatatatacacaca

SEQ ID NO: 6929015 - DNA, 22 bp, Homo sapiens
aatacagatggcatgtgaagat

SEQ ID NO: 6929016 - DNA, 22 bp, Homo sapiens
agactgaaccctctgctgcact

SEQ ID NO: 6929017 - DNA, 22 bp, Homo sapiens
gcaaggctgttgctgctgcaag

SEQ ID NO: 6929018 - DNA, 22 bp, Homo sapiens
ggcagcagaactggccctgtat

SEQ ID NO: 6929019 - DNA, 22 bp, Homo sapiens
caaggcatttcgcttagagaga

SEQ ID NO: 6929020 - DNA, 22 bp, Homo sapiens
tctcagggcaattctcagcgac

SEQ ID NO: 6929021 - DNA, 22 bp, Homo sapiens
tcaattttatgaaacaaagtga

SEQ ID NO: 6929022 - DNA, 22 bp, Homo sapiens
cagctgggtttagtggggtgtg

SEQ ID NO: 6929023 - DNA, 22 bp, Homo sapiens
tgcgatcctgcattaaatttcc

SEQ ID NO: 6929024 - DNA, 22 bp, Homo sapiens
aggtctgagagccgctttcccc

SEQ ID NO: 6929025 - DNA, 22 bp, Homo sapiens
tgggcttggtttctaggtaggt

SEQ ID NO: 6929026 - DNA, 22 bp, Homo sapiens
ggactcctctagaagttgaggc

SEQ ID NO: 6929027 - DNA, 22 bp, Homo sapiens
ctgatggagagtgtgatttggg

SEQ ID NO: 6929028 - DNA, 22 bp, Homo sapiens
atgcatgtttatagggtgcttc

SEQ ID NO: 6929029 - DNA, 22 bp, Homo sapiens
ttcatttgtggtgaatgaagtg

SEQ ID NO: 6929030 - DNA, 22 bp, Homo sapiens
gtgagatggagttggtgtcttt

SEQ ID NO: 6929031 - DNA, 22 bp, Homo sapiens
ggaattctgtagctcttcctct

SEQ ID NO: 6929032 - DNA, 20 bp, Homo sapiens
ctcagtttcctcatggctca

SEQ ID NO: 6929033 - DNA, 22 bp, Homo sapiens
catgctgatgaacttctacttg

SEQ ID NO: 6929034 - DNA, 22 bp, Homo sapiens
catcttcattttgtccagtact

SEQ ID NO: 6929035 - DNA, 22 bp, Homo sapiens
tggcagattgtaggcagttagg

SEQ ID NO: 6929036 - DNA, 22 bp, Homo sapiens
tgctgttatacttagctggtta

SEQ ID NO: 6929037 - DNA, 22 bp, Homo sapiens
tcagtccactaagacccttgtt

SEQ ID NO: 6929038 - DNA, 22 bp, Homo sapiens
cttcctggatgaacagtagaaa

SEQ ID NO: 6929039 - DNA, 22 bp, Homo sapiens
ggaggacctgctggccctgcaa

SEQ ID NO: 6929040 - DNA, 22 bp, Homo sapiens
cttcttgaagtcctccagaagt

SEQ ID NO: 6929041 - DNA, 22 bp, Homo sapiens
agactaactttttgctctatca

SEQ ID NO: 6929042 - DNA, 22 bp, Homo sapiens
aagcaattggttttagtaaaat

SEQ ID NO: 6929043 - DNA, 17 bp, Homo sapiens
tgctagggggagagtag

SEQ ID NO: 6929044 - DNA, 22 bp, Homo sapiens
tagcaccatacccggcagctcg

SEQ ID NO: 6929045 - DNA, 20 bp, Homo sapiens
tcatctgattaacctcgaag

SEQ ID NO: 6929046 - DNA, 22 bp, Homo sapiens
ttcataggcaccctgtctgagg

SEQ ID NO: 6929047 - DNA, 22 bp, Homo sapiens
tagatgaatgacttatatgtca

SEQ ID NO: 6929048 - DNA, 22 bp, Homo sapiens
gaccattggcacagagcttttt

SEQ ID NO: 6929049 - DNA, 22 bp, Homo sapiens
atgtctttgccatagttcatat

SEQ ID NO: 6929050 - DNA, 22 bp, Homo sapiens
tcatgtattgaaaagcatttta

SEQ ID NO: 6929051 - DNA, 22 bp, Homo sapiens
gatgtgctttgttaaacagatg

SEQ ID NO: 6929052 - DNA, 22 bp, Homo sapiens
ttagggaactctcatcgtgaag

SEQ ID NO: 6929053 - DNA, 22 bp, Homo sapiens
attttgtggcagatgcagaacc

SEQ ID NO: 6929054 - DNA, 22 bp, Homo sapiens
tccttcaatcacccagtgggga

SEQ ID NO: 6929055 - DNA, 22 bp, Homo sapiens
aatttcggttcaaggcccagtt

SEQ ID NO: 6929056 - DNA, 23 bp, Homo sapiens
gcaggtggttcgaacagaagttt

SEQ ID NO: 6929057 - DNA, 22 bp, Homo sapiens
cagttattctagttccacatct

SEQ ID NO: 6929058 - DNA, 18 bp, Homo sapiens
tctgaggtggacgaggag

SEQ ID NO: 6929059 - DNA, 22 bp, Homo sapiens
gggaagagaccgtaccctggcc

SEQ ID NO: 6929060 - DNA, 22 bp, Homo sapiens
ttgccattccagggtattaggg

SEQ ID NO: 6929061 - DNA, 23 bp, Homo sapiens
gcaagtgaggcgtcagcagtcaa

SEQ ID NO: 6929062 - DNA, 22 bp, Homo sapiens
tggataaatagatacacttgca

SEQ ID NO: 6929063 - DNA, 22 bp, Homo sapiens
tctcccaacctctggtgggtgc

SEQ ID NO: 6929064 - DNA, 21 bp, Homo sapiens
ctgtattaacttttgcacctt

SEQ ID NO: 6929065 - DNA, 22 bp, Homo sapiens
tttcacaggagtcctttctata

SEQ ID NO: 6929066 - DNA, 22 bp, Homo sapiens
cgcagctgcaaaggaaacattt

SEQ ID NO: 6929067 - DNA, 22 bp, Homo sapiens
gatgtgtttccaggatttgttt

SEQ ID NO: 6929068 - DNA, 22 bp, Homo sapiens
cctggcattctctccagagaga

SEQ ID NO: 6929069 - DNA, 22 bp, Homo sapiens
tttctacttctcctgaatgtct

SEQ ID NO: 6929070 - DNA, 22 bp, Homo sapiens
tctatgcttgagacagatgggg

SEQ ID NO: 6929071 - DNA, 22 bp, Homo sapiens
tgtggccatggtcagaatattg

SEQ ID NO: 6929072 - DNA, 21 bp, Homo sapiens
gacttatctatattctattta

SEQ ID NO: 6929073 - DNA, 22 bp, Homo sapiens
acagagcagttctggagctggc

SEQ ID NO: 6929074 - DNA, 22 bp, Homo sapiens
ggctgggaggatgacttgctac

SEQ ID NO: 6929075 - DNA, 22 bp, Homo sapiens
aagtgtttaatggttttgatga

SEQ ID NO: 6929076 - DNA, 22 bp, Homo sapiens
ctgcctggccacaacccagggt

SEQ ID NO: 6929077 - DNA, 22 bp, Homo sapiens
tctgacttttctcactgttgtg

SEQ ID NO: 6929078 - DNA, 22 bp, Homo sapiens
tggtaattatggatacttaaat

SEQ ID NO: 6929079 - DNA, 22 bp, Homo sapiens
gcagggctttttgaaacatggt

SEQ ID NO: 6929080 - DNA, 20 bp, Homo sapiens
tcctgagtgcagttggcttg

SEQ ID NO: 6929081 - DNA, 22 bp, Homo sapiens
atgggggaaagtacgagcatgg

SEQ ID NO: 6929082 - DNA, 22 bp, Homo sapiens
tttgtagattcattgaactttt

SEQ ID NO: 6929083 - DNA, 22 bp, Homo sapiens
tgggcactgtgtgtggtaaaat

SEQ ID NO: 6929084 - DNA, 22 bp, Homo sapiens
tgttcacatcgatggattttgc

SEQ ID NO: 6929085 - DNA, 22 bp, Homo sapiens
gttgcattaatctgctcaggct

SEQ ID NO: 6929086 - DNA, 22 bp, Homo sapiens
ggcttctcctggaagtacagag

SEQ ID NO: 6929087 - DNA, 22 bp, Homo sapiens
ggcattaagaatatcattaaaa

SEQ ID NO: 6929088 - DNA, 22 bp, Homo sapiens
ctgtttctaaagggagcagatt

SEQ ID NO: 6929089 - DNA, 22 bp, Homo sapiens
tgctgggcctgcccctgtcagc

SEQ ID NO: 6929090 - DNA, 22 bp, Homo sapiens
ttcacaccaaagacaaacaggg

SEQ ID NO: 6929091 - DNA, 22 bp, Homo sapiens
acaggcacctgccaccacatct

SEQ ID NO: 6929092 - DNA, 22 bp, Homo sapiens
cagcagggtaggttgtatcagt

SEQ ID NO: 6929093 - DNA, 22 bp, Homo sapiens
aagatattttagaacattcact

SEQ ID NO: 6929094 - DNA, 22 bp, Homo sapiens
tactttacagtattagataatt

SEQ ID NO: 6929095 - DNA, 22 bp, Homo sapiens
ttcattgtcttggaaaacccat

SEQ ID NO: 6929096 - DNA, 22 bp, Homo sapiens
agtttgctcagaaatttgaaat

SEQ ID NO: 6929097 - DNA, 22 bp, Homo sapiens
tacattatttcatcagtcatct

SEQ ID NO: 6929098 - DNA, 22 bp, Homo sapiens
atgaaacagtgaattagtcaag

SEQ ID NO: 6929099 - DNA, 22 bp, Homo sapiens
atgcagatgttcctactgtgtt

SEQ ID NO: 6929100 - DNA, 22 bp, Homo sapiens
atcaggatctgggagcctgaaa

SEQ ID NO: 6929101 - DNA, 22 bp, Homo sapiens
ctgcagaggggttgaagggtcc

SEQ ID NO: 6929102 - DNA, 22 bp, Homo sapiens
ggagggaggttagattcaagct

SEQ ID NO: 6929103 - DNA, 22 bp, Homo sapiens
acaatgtgggcatgagaaacca

SEQ ID NO: 6929104 - DNA, 22 bp, Homo sapiens
cgcctggaacctctaggaccag

SEQ ID NO: 6929105 - DNA, 16 bp, Homo sapiens
taacttcttccttcaa

SEQ ID NO: 6929106 - DNA, 22 bp, Homo sapiens
gagttccttctgcctcagcttg

SEQ ID NO: 6929107 - DNA, 22 bp, Homo sapiens
agacaaaccttgttttatgatg

SEQ ID NO: 6929108 - DNA, 22 bp, Homo sapiens
tggaaatgcctggcttcctgaa

SEQ ID NO: 6929109 - DNA, 22 bp, Homo sapiens
ctgcctctggcctcaggcccag

SEQ ID NO: 6929110 - DNA, 22 bp, Homo sapiens
cgggaaagttccacagatggat

SEQ ID NO: 6929111 - DNA, 22 bp, Homo sapiens
gccgtcctacgccatcatagcg

SEQ ID NO: 6929112 - DNA, 18 bp, Homo sapiens
agacagctgaaaggaaaa

SEQ ID NO: 6929113 - DNA, 22 bp, Homo sapiens
acatctgattacatgagaatat

SEQ ID NO: 6929114 - DNA, 22 bp, Homo sapiens
atggttcatattatgcatctga

SEQ ID NO: 6929115 - DNA, 22 bp, Homo sapiens
tccagcattagatgtgaaattg

SEQ ID NO: 6929116 - DNA, 22 bp, Homo sapiens
cataagaatatttagtggcagc

SEQ ID NO: 6929117 - DNA, 22 bp, Homo sapiens
attgattctgtaagtcaacaat

SEQ ID NO: 6929118 - DNA, 22 bp, Homo sapiens
agggaccagcctgcccagggct

SEQ ID NO: 6929119 - DNA, 21 bp, Homo sapiens
agggagctatttatagtaagc

SEQ ID NO: 6929120 - DNA, 22 bp, Homo sapiens
tgaagagtgtgactgcacctag

SEQ ID NO: 6929121 - DNA, 22 bp, Homo sapiens
actgcttttgatctcttctgta

SEQ ID NO: 6929122 - DNA, 22 bp, Homo sapiens
agcagtggtccccaacctttct

SEQ ID NO: 6929123 - DNA, 22 bp, Homo sapiens
aggcccccacaggcttgaggca

SEQ ID NO: 6929124 - DNA, 22 bp, Homo sapiens
tgctttatatctctcttcttag

SEQ ID NO: 6929125 - DNA, 16 bp, Homo sapiens
gggctggagatacagt

SEQ ID NO: 6929126 - DNA, 22 bp, Homo sapiens
ggaagtaatgtcttaagattct

SEQ ID NO: 6929127 - DNA, 22 bp, Homo sapiens
actcagagtcaatgttaatggc

SEQ ID NO: 6929128 - DNA, 22 bp, Homo sapiens
tacacagggagagattggaaac

SEQ ID NO: 6929129 - DNA, 22 bp, Homo sapiens
agcaaagttaaggtttctcttt

SEQ ID NO: 6929130 - DNA, 22 bp, Homo sapiens
taattatttgaagacattagag

SEQ ID NO: 6929131 - DNA, 22 bp, Homo sapiens
gaatcattggaaccacatccaa

SEQ ID NO: 6929132 - DNA, 22 bp, Homo sapiens
gctgtgctgcgggaggattccg

SEQ ID NO: 6929133 - DNA, 19 bp, Homo sapiens
tgtgtcctagcagccagtc

SEQ ID NO: 6929134 - DNA, 19 bp, Homo sapiens
acctggcctcttgagcaag

SEQ ID NO: 6929135 - DNA, 21 bp, Homo sapiens
tttgccttcacgaagcatcct

SEQ ID NO: 6929136 - DNA, 22 bp, Homo sapiens
tcttcacatcatgttttttaat

SEQ ID NO: 6929137 - DNA, 22 bp, Homo sapiens
taatggctgggataaaggaatg

SEQ ID NO: 6929138 - DNA, 22 bp, Homo sapiens
tgtcttcagataggcattcttc

SEQ ID NO: 6929139 - DNA, 22 bp, Homo sapiens
tggccctggtggcacagcctgc

SEQ ID NO: 6929140 - DNA, 22 bp, Homo sapiens
gcctgcagtgagtgcagaaggt

SEQ ID NO: 6929141 - DNA, 22 bp, Homo sapiens
gctgttggcgaggagctcagct

SEQ ID NO: 6929142 - DNA, 22 bp, Homo sapiens
cttcctccgaagaagttgctgg

SEQ ID NO: 6929143 - DNA, 22 bp, Homo sapiens
atagcagggatgtcagcaagta

SEQ ID NO: 6929144 - DNA, 23 bp, Homo sapiens
agcaaagttgttgctaacctcat

SEQ ID NO: 6929145 - DNA, 22 bp, Homo sapiens
tctggcacttgccagtttctat

SEQ ID NO: 6929146 - DNA, 22 bp, Homo sapiens
cactttacccttgttactcatg

SEQ ID NO: 6929147 - DNA, 22 bp, Homo sapiens
acattgagcctcacctagatgc

SEQ ID NO: 6929148 - DNA, 23 bp, Homo sapiens
aaacatttctcttttcctgcctc

SEQ ID NO: 6929149 - DNA, 22 bp, Homo sapiens
tcttgcttgatacatggaggaa

SEQ ID NO: 6929150 - DNA, 22 bp, Homo sapiens
ttggggtggaagtgaggatcat

SEQ ID NO: 6929151 - DNA, 22 bp, Homo sapiens
gcaatagtgcctattctcttga

SEQ ID NO: 6929152 - DNA, 22 bp, Homo sapiens
cagaatgcattgcttctgatgg

SEQ ID NO: 6929153 - DNA, 22 bp, Homo sapiens
atttttgagctgtgaacatagc

SEQ ID NO: 6929154 - DNA, 22 bp, Homo sapiens
agggtcaccagttcataggcac

SEQ ID NO: 6929155 - DNA, 22 bp, Homo sapiens
aagggccagtagaattttagtg

SEQ ID NO: 6929156 - DNA, 22 bp, Homo sapiens
tgaggaagcaaaggcttgtgtg

SEQ ID NO: 6929157 - DNA, 22 bp, Homo sapiens
tctgaagacatatgatatggtg

SEQ ID NO: 6929158 - DNA, 22 bp, Homo sapiens
tgacagctgagccccaggcaag

SEQ ID NO: 6929159 - DNA, 22 bp, Homo sapiens
ctggaagagtcctaaacagata

SEQ ID NO: 6929160 - DNA, 22 bp, Homo sapiens
agtggggacaatgagagcaggt

SEQ ID NO: 6929161 - DNA, 21 bp, Homo sapiens
gctttttgtatggcccaggaa

SEQ ID NO: 6929162 - DNA, 22 bp, Homo sapiens
tcaaatcagcaagcagcttccc

SEQ ID NO: 6929163 - DNA, 22 bp, Homo sapiens
ttcaggcctctaaagggaaagc

SEQ ID NO: 6929164 - DNA, 22 bp, Homo sapiens
aagattactacggaacatgacc

SEQ ID NO: 6929165 - DNA, 22 bp, Homo sapiens
cctgtggctgccccgctgttgg

SEQ ID NO: 6929166 - DNA, 22 bp, Homo sapiens
ttaagagggtgatgctagcatt

SEQ ID NO: 6929167 - DNA, 22 bp, Homo sapiens
atgtgtccttataagaagaaga

SEQ ID NO: 6929168 - DNA, 22 bp, Homo sapiens
aaggtggtgcttctgctcctct

SEQ ID NO: 6929169 - DNA, 23 bp, Homo sapiens
cctgttgggacagctttaccaga

SEQ ID NO: 6929170 - DNA, 22 bp, Homo sapiens
tgtcttgactttagagccagga

SEQ ID NO: 6929171 - DNA, 22 bp, Homo sapiens
atgatgttaccagtacttagag

SEQ ID NO: 6929172 - DNA, 22 bp, Homo sapiens
gtgtcaaatccactcctctttt

SEQ ID NO: 6929173 - DNA, 20 bp, Homo sapiens
gagctgtgctctcaggagcc

SEQ ID NO: 6929174 - DNA, 22 bp, Homo sapiens
tttccaatttttaagtggatga

SEQ ID NO: 6929175 - DNA, 22 bp, Homo sapiens
ttcccatcgtctccttcacctt

SEQ ID NO: 6929176 - DNA, 23 bp, Homo sapiens
tactggaaatttgacagatttga

SEQ ID NO: 6929177 - DNA, 22 bp, Homo sapiens
gattaacaaatttcatatccaa

SEQ ID NO: 6929178 - DNA, 22 bp, Homo sapiens
catcagaagaaagacaaatgat

SEQ ID NO: 6929179 - DNA, 20 bp, Homo sapiens
tgcaggtgttggagaaggta

SEQ ID NO: 6929180 - DNA, 22 bp, Homo sapiens
ccttccaaaggagccacatctg

SEQ ID NO: 6929181 - DNA, 22 bp, Homo sapiens
gaagttattgcctgtgatgaaa

SEQ ID NO: 6929182 - DNA, 22 bp, Homo sapiens
tcttggctggtttcacattacc

SEQ ID NO: 6929183 - DNA, 22 bp, Homo sapiens
tggcagccttctctgagaaggt

SEQ ID NO: 6929184 - DNA, 22 bp, Homo sapiens
tctgcccagccagacccaaggt

SEQ ID NO: 6929185 - DNA, 22 bp, Homo sapiens
aatgtcaaacagagcagagcta

SEQ ID NO: 6929186 - DNA, 21 bp, Homo sapiens
ttctctggataggccagtcct

SEQ ID NO: 6929187 - DNA, 22 bp, Homo sapiens
tggagccaccttcttatttgtc

SEQ ID NO: 6929188 - DNA, 22 bp, Homo sapiens
ggaattcagtggccagacatga

SEQ ID NO: 6929189 - DNA, 22 bp, Homo sapiens
acagtcttgcacttctatcagc

SEQ ID NO: 6929190 - DNA, 21 bp, Homo sapiens
atttggtcaatgtctgcgtga

SEQ ID NO: 6929191 - DNA, 22 bp, Homo sapiens
atccatctttcctgctgaactg

SEQ ID NO: 6929192 - DNA, 22 bp, Homo sapiens
tgtaaaataccattccttgtca

SEQ ID NO: 6929193 - DNA, 22 bp, Homo sapiens
gagttaaaagccctctcagcag

SEQ ID NO: 6929194 - DNA, 22 bp, Homo sapiens
ttacaacaccaggcagtatcct

SEQ ID NO: 6929195 - DNA, 22 bp, Homo sapiens
ttcatttagcatgctaaacctg

SEQ ID NO: 6929196 - DNA, 23 bp, Homo sapiens
agaggcacctaaagtcaagttgt

SEQ ID NO: 6929197 - DNA, 22 bp, Homo sapiens
gtcaggtcttggaagataggct

SEQ ID NO: 6929198 - DNA, 22 bp, Homo sapiens
ttctgcccaccacactttatct

SEQ ID NO: 6929199 - DNA, 22 bp, Homo sapiens
agcacagagctaggagtggagg

SEQ ID NO: 6929200 - DNA, 22 bp, Homo sapiens
acttagataacaaacctgtggt

SEQ ID NO: 6929201 - DNA, 22 bp, Homo sapiens
agaaaagggcaggagggataca

SEQ ID NO: 6929202 - DNA, 22 bp, Homo sapiens
gcccagcgagcagaggtggacg

SEQ ID NO: 6929203 - DNA, 22 bp, Homo sapiens
ctggggtccttgccatgtgtca

SEQ ID NO: 6929204 - DNA, 22 bp, Homo sapiens
tgagataacaaaattatcttca

SEQ ID NO: 6929205 - DNA, 22 bp, Homo sapiens
aaggtggtcttactgatggtat

SEQ ID NO: 6929206 - DNA, 22 bp, Homo sapiens
tcaggagctcaggctgatggaa

SEQ ID NO: 6929207 - DNA, 22 bp, Homo sapiens
atcaagggcgcgtggttcggcg

SEQ ID NO: 6929208 - DNA, 22 bp, Homo sapiens
gcctctgggggctcagacctgt

SEQ ID NO: 6929209 - DNA, 22 bp, Homo sapiens
gaggcactctcgacaagggtgg

SEQ ID NO: 6929210 - DNA, 22 bp, Homo sapiens
aacacacctggttaacctcttt

SEQ ID NO: 6929211 - DNA, 22 bp, Homo sapiens
ttaatggaacagcatgcataga

SEQ ID NO: 6929212 - DNA, 22 bp, Homo sapiens
ggtgccgttgaggaagtaactg

SEQ ID NO: 6929213 - DNA, 22 bp, Homo sapiens
aggactggtgccagacaaggta

SEQ ID NO: 6929214 - DNA, 22 bp, Homo sapiens
tgaaaacactttagtttaggtc

SEQ ID NO: 6929215 - DNA, 22 bp, Homo sapiens
atgcagaattgctaagtatctg

SEQ ID NO: 6929216 - DNA, 22 bp, Homo sapiens
acttgaggaagcagcaagggat

SEQ ID NO: 6929217 - DNA, 22 bp, Homo sapiens
ctgtgtcttctgcttacagtct

SEQ ID NO: 6929218 - DNA, 21 bp, Homo sapiens
gtgtgagtagcatgtgtctca

SEQ ID NO: 6929219 - DNA, 22 bp, Homo sapiens
ggacagctctgccaggagctca

SEQ ID NO: 6929220 - DNA, 21 bp, Homo sapiens
gatttagtggctgttctacct

SEQ ID NO: 6929221 - DNA, 22 bp, Homo sapiens
cgtgtggacatgactagctgcc

SEQ ID NO: 6929222 - DNA, 22 bp, Homo sapiens
tgtacaaggcagaaggggcgag

SEQ ID NO: 6929223 - DNA, 22 bp, Homo sapiens
ttcttgatgaatgctaagaact

SEQ ID NO: 6929224 - DNA, 22 bp, Homo sapiens
ataggcttggcttattcttggg

SEQ ID NO: 6929225 - DNA, 22 bp, Homo sapiens
ctgagccaaccacagcaggagc

SEQ ID NO: 6929226 - DNA, 19 bp, Homo sapiens
gctctccctctcagttgag

SEQ ID NO: 6929227 - DNA, 22 bp, Homo sapiens
tcgcatttgggcaggagatgct

SEQ ID NO: 6929228 - DNA, 22 bp, Homo sapiens
tccaggcatgtggccagtactc

SEQ ID NO: 6929229 - DNA, 22 bp, Homo sapiens
ctgttgctgaggttcaagggtc

SEQ ID NO: 6929230 - DNA, 22 bp, Homo sapiens
gatgttcttcgatgatctgttt

SEQ ID NO: 6929231 - DNA, 22 bp, Homo sapiens
attttcagtgtaaatgttttat

SEQ ID NO: 6929232 - DNA, 20 bp, Homo sapiens
atccttaaagagaatttcta

SEQ ID NO: 6929233 - DNA, 22 bp, Homo sapiens
cagtaacatgaagagacatgga

SEQ ID NO: 6929234 - DNA, 22 bp, Homo sapiens
gaaatgtatgtcttcccccatt

SEQ ID NO: 6929235 - DNA, 22 bp, Homo sapiens
ttgcatttatagactgccattt

SEQ ID NO: 6929236 - DNA, 22 bp, Homo sapiens
actgcccagtgattggtggtta

SEQ ID NO: 6929237 - DNA, 22 bp, Homo sapiens
atgcaatgtgacacactacctt

SEQ ID NO: 6929238 - DNA, 22 bp, Homo sapiens
aggagctgtgaatgggaggggt

SEQ ID NO: 6929239 - DNA, 22 bp, Homo sapiens
gcccccagacctcagtgggctg

SEQ ID NO: 6929240 - DNA, 22 bp, Homo sapiens
tttataaacagtaccacggtgc

SEQ ID NO: 6929241 - DNA, 22 bp, Homo sapiens
ctcttggtgtgttctcctggga

SEQ ID NO: 6929242 - DNA, 22 bp, Homo sapiens
cctgtgccaaaaggctgcttat

SEQ ID NO: 6929243 - DNA, 22 bp, Homo sapiens
ctgtctccgccctcttggtagg

SEQ ID NO: 6929244 - DNA, 22 bp, Homo sapiens
gacaactgagcagaggaaatga

SEQ ID NO: 6929245 - DNA, 22 bp, Homo sapiens
attcagcattcatttccaactt

SEQ ID NO: 6929246 - DNA, 22 bp, Homo sapiens
catcctgtttctgtgcagcatg

SEQ ID NO: 6929247 - DNA, 22 bp, Homo sapiens
agcagcaggcttaaggaaaagt

SEQ ID NO: 6929248 - DNA, 22 bp, Homo sapiens
acacttaagcatgaagtataaa

SEQ ID NO: 6929249 - DNA, 22 bp, Homo sapiens
ggccagctcagactccacttgc

SEQ ID NO: 6929250 - DNA, 22 bp, Homo sapiens
atttaatttgtgtctttagctg

SEQ ID NO: 6929251 - DNA, 22 bp, Homo sapiens
cagaatttagaaaacaacataa

SEQ ID NO: 6929252 - DNA, 22 bp, Homo sapiens
cgcaacagagcaggtttgatga

SEQ ID NO: 6929253 - DNA, 19 bp, Homo sapiens
agggcacagggacagaagg

SEQ ID NO: 6929254 - DNA, 22 bp, Homo sapiens
aaggactgaataattctctttc

SEQ ID NO: 6929255 - DNA, 22 bp, Homo sapiens
gtctcctgcccccggtgcttgg

SEQ ID NO: 6929256 - DNA, 22 bp, Homo sapiens
gtcttattgcgtatgtatacaa

SEQ ID NO: 6929257 - DNA, 22 bp, Homo sapiens
atggagagttcacttctaagtt

SEQ ID NO: 6929258 - DNA, 20 bp, Homo sapiens
ttcagctaccaggtatcttc

SEQ ID NO: 6929259 - DNA, 22 bp, Homo sapiens
gccaggaggcttaactggacag

SEQ ID NO: 6929260 - DNA, 22 bp, Homo sapiens
tcaggcctttcttcagagcttc

SEQ ID NO: 6929261 - DNA, 22 bp, Homo sapiens
cttcttatctgaaagtaatatt

SEQ ID NO: 6929262 - DNA, 22 bp, Homo sapiens
gccaaagcagtcttgcctctgc

SEQ ID NO: 6929263 - DNA, 22 bp, Homo sapiens
aacatgcacatcatagctcgtg

SEQ ID NO: 6929264 - DNA, 22 bp, Homo sapiens
acaaaaattagctgggcatggt

SEQ ID NO: 6929265 - DNA, 22 bp, Homo sapiens
tcatgttatcttggctctggga

SEQ ID NO: 6929266 - DNA, 18 bp, Homo sapiens
ctgactcctttgctgcca

SEQ ID NO: 6929267 - DNA, 22 bp, Homo sapiens
tctcatctccattatagcatca

SEQ ID NO: 6929268 - DNA, 22 bp, Homo sapiens
gatatgtaccacctcttaaaag

SEQ ID NO: 6929269 - DNA, 22 bp, Homo sapiens
ttgtcatcatcctctttggggt

SEQ ID NO: 6929270 - DNA, 22 bp, Homo sapiens
tgatggccctgtacaaggagtg

SEQ ID NO: 6929271 - DNA, 19 bp, Homo sapiens
aatggtttgatgaagtata

SEQ ID NO: 6929272 - DNA, 22 bp, Homo sapiens
cagagacatccattttatatgc

SEQ ID NO: 6929273 - DNA, 22 bp, Homo sapiens
atgacaagagtgttcagggaga

SEQ ID NO: 6929274 - DNA, 22 bp, Homo sapiens
ggccctctggcttccgcatggg

SEQ ID NO: 6929275 - DNA, 22 bp, Homo sapiens
ctctggagaactccttgtgtct

SEQ ID NO: 6929276 - DNA, 22 bp, Homo sapiens
gctttgctatgactcaccagca

SEQ ID NO: 6929277 - DNA, 22 bp, Homo sapiens
ccagcgttactattactgacac

SEQ ID NO: 6929278 - DNA, 22 bp, Homo sapiens
cactgcagatcagaggctgaga

SEQ ID NO: 6929279 - DNA, 22 bp, Homo sapiens
tgttcattccggggagggctaa

SEQ ID NO: 6929280 - DNA, 22 bp, Homo sapiens
ggagatccaggcaaggccgcag

SEQ ID NO: 6929281 - DNA, 22 bp, Homo sapiens
cctggctccagctgcctgtcct

SEQ ID NO: 6929282 - DNA, 22 bp, Homo sapiens
gatttcactggctttaagcaca

SEQ ID NO: 6929283 - DNA, 22 bp, Homo sapiens
caggctgcgtttgtgaaaggta

SEQ ID NO: 6929284 - DNA, 22 bp, Homo sapiens
tgtctccttgcttttccctgta

SEQ ID NO: 6929285 - DNA, 22 bp, Homo sapiens
gagcaggcctggggtgaggcct

SEQ ID NO: 6929286 - DNA, 22 bp, Homo sapiens
tgctcagtatagaaaatgatat

SEQ ID NO: 6929287 - DNA, 22 bp, Homo sapiens
agcctctgtcaagcttttcaaa

SEQ ID NO: 6929288 - DNA, 22 bp, Homo sapiens
agtctgggctgtctgcaggagt

SEQ ID NO: 6929289 - DNA, 22 bp, Homo sapiens
cagctgaggtcttttttatgtg

SEQ ID NO: 6929290 - DNA, 19 bp, Homo sapiens
tcagcccatcagactcaca

SEQ ID NO: 6929291 - DNA, 22 bp, Homo sapiens
tcaggagggctaagactgtagc

SEQ ID NO: 6929292 - DNA, 22 bp, Homo sapiens
gagggcctggcacagggaggct

SEQ ID NO: 6929293 - DNA, 22 bp, Homo sapiens
ttcttagtcatctgagccagcc

SEQ ID NO: 6929294 - DNA, 22 bp, Homo sapiens
ccaagggctatttacagaacag

SEQ ID NO: 6929295 - DNA, 22 bp, Homo sapiens
ttatatctttttacatctctcc

SEQ ID NO: 6929296 - DNA, 22 bp, Homo sapiens
tggatgagattaaagtgaggtt

SEQ ID NO: 6929297 - DNA, 22 bp, Homo sapiens
gacccagtgggggcctgatctg

SEQ ID NO: 6929298 - DNA, 22 bp, Homo sapiens
agtcaggttctcacagctcttc

SEQ ID NO: 6929299 - DNA, 22 bp, Homo sapiens
tcgatttgtattacatctacat

SEQ ID NO: 6929300 - DNA, 22 bp, Homo sapiens
gttgagtacctgctttatgtca

SEQ ID NO: 6929301 - DNA, 22 bp, Homo sapiens
tctggggttttcacgctgtctc

SEQ ID NO: 6929302 - DNA, 22 bp, Homo sapiens
atgcccacagagagggaaattt

SEQ ID NO: 6929303 - DNA, 22 bp, Homo sapiens
aggcaacatgactcacttgcac

SEQ ID NO: 6929304 - DNA, 22 bp, Homo sapiens
gtgttaaatttctaatttgtga

SEQ ID NO: 6929305 - DNA, 22 bp, Homo sapiens
ccttagactggagctatgccgt

SEQ ID NO: 6929306 - DNA, 22 bp, Homo sapiens
atgtgtattaccctttcattcc

SEQ ID NO: 6929307 - DNA, 22 bp, Homo sapiens
ctctgaaagcaaaactagagaa

SEQ ID NO: 6929308 - DNA, 22 bp, Homo sapiens
ctggcagtgtccagctcgtgat

SEQ ID NO: 6929309 - DNA, 22 bp, Homo sapiens
cttctgcactgaccttttgtcc

SEQ ID NO: 6929310 - DNA, 22 bp, Homo sapiens
agggtctatataggtcaggacc

SEQ ID NO: 6929311 - DNA, 22 bp, Homo sapiens
aatgtatcggagcttggggtgg

SEQ ID NO: 6929312 - DNA, 22 bp, Homo sapiens
ctgggctagaaggaccaggatg

SEQ ID NO: 6929313 - DNA, 22 bp, Homo sapiens
agctgggcaaaatgtgaggttg

SEQ ID NO: 6929314 - DNA, 22 bp, Homo sapiens
cttttctctgcaccatgtgtga

SEQ ID NO: 6929315 - DNA, 22 bp, Homo sapiens
ttggaaaggtgcttttgtctgt

SEQ ID NO: 6929316 - DNA, 22 bp, Homo sapiens
gctttacatgtttccctttaag

SEQ ID NO: 6929317 - DNA, 22 bp, Homo sapiens
acatgcaaaaatatatttatga

SEQ ID NO: 6929318 - DNA, 22 bp, Homo sapiens
gggtaaaggaattgggtttcct

SEQ ID NO: 6929319 - DNA, 22 bp, Homo sapiens
tgctggtcccctgcagcctgtg

SEQ ID NO: 6929320 - DNA, 22 bp, Homo sapiens
gcccaaggtatatcagagacag

SEQ ID NO: 6929321 - DNA, 22 bp, Homo sapiens
tcctcaggctgcctggaagact

SEQ ID NO: 6929322 - DNA, 22 bp, Homo sapiens
atctaaaatgtggttagttggt

SEQ ID NO: 6929323 - DNA, 22 bp, Homo sapiens
acttccaaagaagtgattacag

SEQ ID NO: 6929324 - DNA, 22 bp, Homo sapiens
actagacatcgagctacagagt

SEQ ID NO: 6929325 - DNA, 22 bp, Homo sapiens
tcagtggtgagtaacgtcagtt

SEQ ID NO: 6929326 - DNA, 22 bp, Homo sapiens
ttctctgctataggcagggagg

SEQ ID NO: 6929327 - DNA, 22 bp, Homo sapiens
tttgaagacagatcaatataag

SEQ ID NO: 6929328 - DNA, 22 bp, Homo sapiens
cttcacatgggtactgctgatc

SEQ ID NO: 6929329 - DNA, 22 bp, Homo sapiens
taaaggctttattttccagtca

SEQ ID NO: 6929330 - DNA, 22 bp, Homo sapiens
atacagtgtactatttagcagt

SEQ ID NO: 6929331 - DNA, 22 bp, Homo sapiens
tggcatcacctccacgatcatc

SEQ ID NO: 6929332 - DNA, 21 bp, Homo sapiens
acattcacaggatattatcat

SEQ ID NO: 6929333 - DNA, 22 bp, Homo sapiens
ttacatgttctcatacacagag

SEQ ID NO: 6929334 - DNA, 19 bp, Homo sapiens
atacactaatataaaccac

SEQ ID NO: 6929335 - DNA, 22 bp, Homo sapiens
atggtggatttgtgattcagct

SEQ ID NO: 6929336 - DNA, 20 bp, Homo sapiens
aaacatagtggataccacag

SEQ ID NO: 6929337 - DNA, 22 bp, Homo sapiens
tcaggcagaccaccgtgggcag

SEQ ID NO: 6929338 - DNA, 22 bp, Homo sapiens
tggagttctttttcaagataga

SEQ ID NO: 6929339 - DNA, 22 bp, Homo sapiens
atttcacaaagaacagatgcag

SEQ ID NO: 6929340 - DNA, 22 bp, Homo sapiens
tggtggaggtgcatttcggagc

SEQ ID NO: 6929341 - DNA, 22 bp, Homo sapiens
tcccagggactggatgatgcag

SEQ ID NO: 6929342 - DNA, 22 bp, Homo sapiens
caggccaatatcacatgctatg

SEQ ID NO: 6929343 - DNA, 22 bp, Homo sapiens
ggcatctgagctgtgtatggtt

SEQ ID NO: 6929344 - DNA, 23 bp, Homo sapiens
tcctccctgacttctacagcaca

SEQ ID NO: 6929345 - DNA, 22 bp, Homo sapiens
gtgagttaacgccatatatatg

SEQ ID NO: 6929346 - DNA, 22 bp, Homo sapiens
gtgaaaagagagcctgtgtcag

SEQ ID NO: 6929347 - DNA, 22 bp, Homo sapiens
aggtgggtgccgtctgtcctct

SEQ ID NO: 6929348 - DNA, 22 bp, Homo sapiens
gtttcaatttcactttccaggc

SEQ ID NO: 6929349 - DNA, 22 bp, Homo sapiens
aatcttcagtgtctaaaaagca

SEQ ID NO: 6929350 - DNA, 22 bp, Homo sapiens
gatgattgttggctctcttgat

SEQ ID NO: 6929351 - DNA, 22 bp, Homo sapiens
cagaatccagaattgctgaggt

SEQ ID NO: 6929352 - DNA, 22 bp, Homo sapiens
ggccatgccaggctgcctggga

SEQ ID NO: 6929353 - DNA, 22 bp, Homo sapiens
tgcatgtatgtaaatgtgagcg

SEQ ID NO: 6929354 - DNA, 22 bp, Homo sapiens
cctttctggtatttaaccaaag

SEQ ID NO: 6929355 - DNA, 22 bp, Homo sapiens
aggagtttcaaagcttccatgt

SEQ ID NO: 6929356 - DNA, 20 bp, Homo sapiens
ttcattcattccacaacttc

SEQ ID NO: 6929357 - DNA, 22 bp, Homo sapiens
ggtggccattctaccgccttct

SEQ ID NO: 6929358 - DNA, 22 bp, Homo sapiens
tttctctggcattaggtataaa

SEQ ID NO: 6929359 - DNA, 22 bp, Homo sapiens
tagctgttacccataaaagcca

SEQ ID NO: 6929360 - DNA, 22 bp, Homo sapiens
gcatgctgctgaggctggaata

SEQ ID NO: 6929361 - DNA, 22 bp, Homo sapiens
aagtaagtcttacattcacatt

SEQ ID NO: 6929362 - DNA, 22 bp, Homo sapiens
agctgaggttgaagagtgaacg

SEQ ID NO: 6929363 - DNA, 22 bp, Homo sapiens
gtgaaggataaggatctaaatt

SEQ ID NO: 6929364 - DNA, 22 bp, Homo sapiens
tctgccatgctaacttcagtat

SEQ ID NO: 6929365 - DNA, 22 bp, Homo sapiens
agtcacttaataggttcatctg

SEQ ID NO: 6929366 - DNA, 22 bp, Homo sapiens
gccagagttgaggcagtttatt

SEQ ID NO: 6929367 - DNA, 22 bp, Homo sapiens
aaacccagggttttgtcttccc

SEQ ID NO: 6929368 - DNA, 22 bp, Homo sapiens
tttggagatggagagagggcat

SEQ ID NO: 6929369 - DNA, 22 bp, Homo sapiens
aaggtctgagttttgccaggcc

SEQ ID NO: 6929370 - DNA, 22 bp, Homo sapiens
agcaccctggggaagcacaaag

SEQ ID NO: 6929371 - DNA, 22 bp, Homo sapiens
cccaggcttttctcttgcccca

SEQ ID NO: 6929372 - DNA, 22 bp, Homo sapiens
atatttactgctgtggtgaagg

SEQ ID NO: 6929373 - DNA, 22 bp, Homo sapiens
tattgggacttaaaggtaaaga

SEQ ID NO: 6929374 - DNA, 22 bp, Homo sapiens
ttagtacaagagattaattact

SEQ ID NO: 6929375 - DNA, 22 bp, Homo sapiens
caggatattacctaatatttga

SEQ ID NO: 6929376 - DNA, 22 bp, Homo sapiens
gcattgatctttattctgcttt

SEQ ID NO: 6929377 - DNA, 22 bp, Homo sapiens
acatgtaggagagtcacaatgc

SEQ ID NO: 6929378 - DNA, 22 bp, Homo sapiens
aatgtgtagcagaaccaggatt

SEQ ID NO: 6929379 - DNA, 23 bp, Homo sapiens
tccaggagcatgctggctggcga

SEQ ID NO: 6929380 - DNA, 23 bp, Homo sapiens
aggctagtttgtgactttctttg

SEQ ID NO: 6929381 - DNA, 22 bp, Homo sapiens
gtgtgtttagcattagcagggg

SEQ ID NO: 6929382 - DNA, 22 bp, Homo sapiens
tcagcagttattcccctacaga

SEQ ID NO: 6929383 - DNA, 22 bp, Homo sapiens
caagtgcatggtggcaaagaat

SEQ ID NO: 6929384 - DNA, 22 bp, Homo sapiens
cagtttctctcaataagcatcg

SEQ ID NO: 6929385 - DNA, 22 bp, Homo sapiens
gaacatgatggctgttattttg

SEQ ID NO: 6929386 - DNA, 22 bp, Homo sapiens
catgggaataaagttatttcaa

SEQ ID NO: 6929387 - DNA, 20 bp, Homo sapiens
agtaccttttgtatgttacc

SEQ ID NO: 6929388 - DNA, 22 bp, Homo sapiens
aatttcagcaacgggagcctag

SEQ ID NO: 6929389 - DNA, 22 bp, Homo sapiens
ttcataggaatttaaagaggaa

SEQ ID NO: 6929390 - DNA, 22 bp, Homo sapiens
tgatttcaagccagggggcgtt

SEQ ID NO: 6929391 - DNA, 22 bp, Homo sapiens
agagatagtgtattagttgggc

SEQ ID NO: 6929392 - DNA, 22 bp, Homo sapiens
ttatgttgggaaaagtcagatt

SEQ ID NO: 6929393 - DNA, 22 bp, Homo sapiens
aaggtgaagctcccgatgagaa

SEQ ID NO: 6929394 - DNA, 22 bp, Homo sapiens
agagtattgtgaccatttgtca

SEQ ID NO: 6929395 - DNA, 22 bp, Homo sapiens
gttcactgggtttgatttcctt

SEQ ID NO: 6929396 - DNA, 22 bp, Homo sapiens
agaagtttgaaattaggagaaa

SEQ ID NO: 6929397 - DNA, 22 bp, Homo sapiens
agctggattccagtgcagtcac

SEQ ID NO: 6929398 - DNA, 22 bp, Homo sapiens
agtcacagtttccctgagagag

SEQ ID NO: 6929399 - DNA, 22 bp, Homo sapiens
tctgtgtgaccataagccagct

SEQ ID NO: 6929400 - DNA, 22 bp, Homo sapiens
gtacagattaataatatactga

SEQ ID NO: 6929401 - DNA, 22 bp, Homo sapiens
gaatcacactcgtaagtgagtt

SEQ ID NO: 6929402 - DNA, 22 bp, Homo sapiens
ccagactattgtgtgtcttggg

SEQ ID NO: 6929403 - DNA, 22 bp, Homo sapiens
aataaggtgtgggtgctaatat

SEQ ID NO: 6929404 - DNA, 22 bp, Homo sapiens
aaaaacacaactgtctttctct

SEQ ID NO: 6929405 - DNA, 23 bp, Homo sapiens
tttatgctgtgattcacccagcc

SEQ ID NO: 6929406 - DNA, 22 bp, Homo sapiens
ctggaaaatgaagaagcagagg

SEQ ID NO: 6929407 - DNA, 22 bp, Homo sapiens
catatattctggttttcactgg

SEQ ID NO: 6929408 - DNA, 22 bp, Homo sapiens
tttgcagtgttcatcagtattt

SEQ ID NO: 6929409 - DNA, 22 bp, Homo sapiens
atctcaaacatctttgaccata

SEQ ID NO: 6929410 - DNA, 22 bp, Homo sapiens
gtctttttctacgatagcgcct

SEQ ID NO: 6929411 - DNA, 22 bp, Homo sapiens
aaagtgttttctgatgtgttct

SEQ ID NO: 6929412 - DNA, 22 bp, Homo sapiens
cttagaagaatgcctaggacag

SEQ ID NO: 6929413 - DNA, 22 bp, Homo sapiens
ctggattcatgccaggccaccc

SEQ ID NO: 6929414 - DNA, 22 bp, Homo sapiens
acatgcacacgattcagtctgg

SEQ ID NO: 6929415 - DNA, 21 bp, Homo sapiens
tggcctcccacacttccatgg

SEQ ID NO: 6929416 - DNA, 22 bp, Homo sapiens
aagggtgttgatcagagaggat

SEQ ID NO: 6929417 - DNA, 23 bp, Homo sapiens
tggaggttttactgagttgagga

SEQ ID NO: 6929418 - DNA, 22 bp, Homo sapiens
agcagaagtgccttagcaatca

SEQ ID NO: 6929419 - DNA, 22 bp, Homo sapiens
accagctccaggcccctgctgg

SEQ ID NO: 6929420 - DNA, 22 bp, Homo sapiens
tggggcaccttgtatctctaag

SEQ ID NO: 6929421 - DNA, 22 bp, Homo sapiens
aggtttagttctgcttatattg

SEQ ID NO: 6929422 - DNA, 22 bp, Homo sapiens
tggaaagaggaagtgcccagca

SEQ ID NO: 6929423 - DNA, 22 bp, Homo sapiens
atacaatgataatagtacttta

SEQ ID NO: 6929424 - DNA, 19 bp, Homo sapiens
agtgccttgctctctaggt

SEQ ID NO: 6929425 - DNA, 22 bp, Homo sapiens
aagcagaggtagggtgtgcagt

SEQ ID NO: 6929426 - DNA, 22 bp, Homo sapiens
taaatgttggcattggaggccg

SEQ ID NO: 6929427 - DNA, 22 bp, Homo sapiens
cactctgactggccctgcagga

SEQ ID NO: 6929428 - DNA, 22 bp, Homo sapiens
tccagagcaggtggtcagaagg

SEQ ID NO: 6929429 - DNA, 22 bp, Homo sapiens
ggctttctcacagcatggcagc

SEQ ID NO: 6929430 - DNA, 22 bp, Homo sapiens
tgacagaaatagttcttaattt

SEQ ID NO: 6929431 - DNA, 22 bp, Homo sapiens
aaacttgttctcatgttgcaga

SEQ ID NO: 6929432 - DNA, 22 bp, Homo sapiens
acacagttcgtgcttttctatt

SEQ ID NO: 6929433 - DNA, 22 bp, Homo sapiens
gaacatctgggatcattgctgt

SEQ ID NO: 6929434 - DNA, 22 bp, Homo sapiens
cagaggatatactatctggaaa

SEQ ID NO: 6929435 - DNA, 18 bp, Homo sapiens
ccagatggccagtctgct

SEQ ID NO: 6929436 - DNA, 22 bp, Homo sapiens
agcctgtgtcctcatctgcagc

SEQ ID NO: 6929437 - DNA, 22 bp, Homo sapiens
gtgaggcaggcattctcctttc

SEQ ID NO: 6929438 - DNA, 22 bp, Homo sapiens
ctgcaactctagtccagggctg

SEQ ID NO: 6929439 - DNA, 22 bp, Homo sapiens
gtttctcctctgtgtcttgttt

SEQ ID NO: 6929440 - DNA, 18 bp, Homo sapiens
gtgtaaacagccattgag

SEQ ID NO: 6929441 - DNA, 22 bp, Homo sapiens
cacagagctgaacctgggtcat

SEQ ID NO: 6929442 - DNA, 22 bp, Homo sapiens
acaggtttttgtggatatatgt

SEQ ID NO: 6929443 - DNA, 19 bp, Homo sapiens
ctggaatgagaacatgccc

SEQ ID NO: 6929444 - DNA, 22 bp, Homo sapiens
cccagctccaagggacagcgaa

SEQ ID NO: 6929445 - DNA, 22 bp, Homo sapiens
aggagccattttccaagggcga

SEQ ID NO: 6929446 - DNA, 22 bp, Homo sapiens
ctttagtgttgttgtgaggatt

SEQ ID NO: 6929447 - DNA, 22 bp, Homo sapiens
actgatgttaaccctctcttct

SEQ ID NO: 6929448 - DNA, 22 bp, Homo sapiens
ccaggctcacctggagcccctg

SEQ ID NO: 6929449 - DNA, 21 bp, Homo sapiens
ttgcaatgggcattttggagg

SEQ ID NO: 6929450 - DNA, 22 bp, Homo sapiens
atgaagttccagtatatgcagt

SEQ ID NO: 6929451 - DNA, 22 bp, Homo sapiens
ttgagtgtaaggaatgtggggc

SEQ ID NO: 6929452 - DNA, 22 bp, Homo sapiens
gactaaattcctgttcgcgatg

SEQ ID NO: 6929453 - DNA, 21 bp, Homo sapiens
acataactgtcaagtaacgtt

SEQ ID NO: 6929454 - DNA, 22 bp, Homo sapiens
aacccgggaggcagaggttgtg

SEQ ID NO: 6929455 - DNA, 22 bp, Homo sapiens
caggcacaagatcggctagata

SEQ ID NO: 6929456 - DNA, 22 bp, Homo sapiens
cattctgcatttggaaggggca

SEQ ID NO: 6929457 - DNA, 22 bp, Homo sapiens
acaaggcagtacaatgatgaca

SEQ ID NO: 6929458 - DNA, 22 bp, Homo sapiens
ggtccccagcagtggctgcttc

SEQ ID NO: 6929459 - DNA, 22 bp, Homo sapiens
tggaaaaaacccagactctaga

SEQ ID NO: 6929460 - DNA, 23 bp, Homo sapiens
aaaggctatcaaagttttgctga

SEQ ID NO: 6929461 - DNA, 23 bp, Homo sapiens
tcccctcaggcagccagtgccct

SEQ ID NO: 6929462 - DNA, 18 bp, Homo sapiens
gcacatgtgtaaggcgac

SEQ ID NO: 6929463 - DNA, 17 bp, Homo sapiens
tcaatacactgctttta

SEQ ID NO: 6929464 - DNA, 23 bp, Homo sapiens
cccagcagattgtaaagtgtcca

SEQ ID NO: 6929465 - DNA, 17 bp, Homo sapiens
gaggcctcttggcatct

SEQ ID NO: 6929466 - DNA, 22 bp, Homo sapiens
ggctgtgtggccgtgggctcta

SEQ ID NO: 6929467 - DNA, 22 bp, Homo sapiens
gcactgccatcaatgcatgaca

SEQ ID NO: 6929468 - DNA, 22 bp, Homo sapiens
ccactgccctgcaaaagctgga

SEQ ID NO: 6929469 - DNA, 22 bp, Homo sapiens
taatggagttggaattaataag

SEQ ID NO: 6929470 - DNA, 22 bp, Homo sapiens
aatgatggtattgatgagctaa

SEQ ID NO: 6929471 - DNA, 22 bp, Homo sapiens
cttcagcaactttggaatgttt

SEQ ID NO: 6929472 - DNA, 22 bp, Homo sapiens
tcaattcatagagttgacacag

SEQ ID NO: 6929473 - DNA, 22 bp, Homo sapiens
tgcctgagggagtaagagtcct

SEQ ID NO: 6929474 - DNA, 19 bp, Homo sapiens
actggcagtttctgcatgg

SEQ ID NO: 6929475 - DNA, 22 bp, Homo sapiens
tggcaatttcttatggttcaac

SEQ ID NO: 6929476 - DNA, 22 bp, Homo sapiens
ggacacagccacttagggtacc

SEQ ID NO: 6929477 - DNA, 22 bp, Homo sapiens
ttatgtgtataattacaggaag

SEQ ID NO: 6929478 - DNA, 22 bp, Homo sapiens
ggcaggcttggtggcaccggtt

SEQ ID NO: 6929479 - DNA, 22 bp, Homo sapiens
tctcacagccatttctccctct

SEQ ID NO: 6929480 - DNA, 22 bp, Homo sapiens
gtttggttggctgtctttaaca

SEQ ID NO: 6929481 - DNA, 22 bp, Homo sapiens
ggcacctggtaagtgctcagta

SEQ ID NO: 6929482 - DNA, 22 bp, Homo sapiens
ataggcagactctttttggagg

SEQ ID NO: 6929483 - DNA, 22 bp, Homo sapiens
gggatgcagtatgtatattttc

SEQ ID NO: 6929484 - DNA, 22 bp, Homo sapiens
agagtcttccaggcagcctgag

SEQ ID NO: 6929485 - DNA, 22 bp, Homo sapiens
tgttgtgacccagaccaagaag

SEQ ID NO: 6929486 - DNA, 22 bp, Homo sapiens
aaggcagctcagctcatggcag

SEQ ID NO: 6929487 - DNA, 22 bp, Homo sapiens
aagtggggcctggtggtacagt

SEQ ID NO: 6929488 - DNA, 22 bp, Homo sapiens
tgtcagttacctagcacaagaa

SEQ ID NO: 6929489 - DNA, 22 bp, Homo sapiens
ctctgtttctcagcctatttcc

SEQ ID NO: 6929490 - DNA, 22 bp, Homo sapiens
agggcagctagctgtagaaaga

SEQ ID NO: 6929491 - DNA, 22 bp, Homo sapiens
tgtcattagagaaggaccactc

SEQ ID NO: 6929492 - DNA, 22 bp, Homo sapiens
taccagtaatagtatgtgagat

SEQ ID NO: 6929493 - DNA, 22 bp, Homo sapiens
gcccttccttagacagcaggat

SEQ ID NO: 6929494 - DNA, 22 bp, Homo sapiens
aggagggtgggaagcagtttta

SEQ ID NO: 6929495 - DNA, 22 bp, Homo sapiens
ccacagtgattcacttttgaag

SEQ ID NO: 6929496 - DNA, 22 bp, Homo sapiens
ggcactgataatgtcctctctc

SEQ ID NO: 6929497 - DNA, 22 bp, Homo sapiens
ccctgaccccacggctggagaa

SEQ ID NO: 6929498 - DNA, 18 bp, Homo sapiens
ttgtagcaaatggcagtg

SEQ ID NO: 6929499 - DNA, 22 bp, Homo sapiens
agcctgggttagggttcttccc

SEQ ID NO: 6929500 - DNA, 22 bp, Homo sapiens
agaaagcactctgtcttttacc

SEQ ID NO: 6929501 - DNA, 19 bp, Homo sapiens
ggcctttcacctggatgct

SEQ ID NO: 6929502 - DNA, 22 bp, Homo sapiens
tgtgcacattctaggactagta

SEQ ID NO: 6929503 - DNA, 22 bp, Homo sapiens
tttgaagtgttatttctatcac

SEQ ID NO: 6929504 - DNA, 20 bp, Homo sapiens
cctatcagactttttaaata

SEQ ID NO: 6929505 - DNA, 22 bp, Homo sapiens
actgtacaacctctgcccctgt

SEQ ID NO: 6929506 - DNA, 22 bp, Homo sapiens
tttctccatcaccccctcggtg

SEQ ID NO: 6929507 - DNA, 22 bp, Homo sapiens
gacatttctagcccataaaact

SEQ ID NO: 6929508 - DNA, 22 bp, Homo sapiens
taagaaggtagtttccaagtca

SEQ ID NO: 6929509 - DNA, 22 bp, Homo sapiens
gccctctgctggcctcacctcg

SEQ ID NO: 6929510 - DNA, 21 bp, Homo sapiens
ttcagctattcagaaggggag

SEQ ID NO: 6929511 - DNA, 22 bp, Homo sapiens
aaactgttatagcagaaaggac

SEQ ID NO: 6929512 - DNA, 21 bp, Homo sapiens
ggcagtaagccaaatccattt

SEQ ID NO: 6929513 - DNA, 22 bp, Homo sapiens
agctgttgcagggatcagcacc

SEQ ID NO: 6929514 - DNA, 22 bp, Homo sapiens
aactttggtattcgacagctct

SEQ ID NO: 6929515 - DNA, 22 bp, Homo sapiens
ctagaggtgagatggaatcact

SEQ ID NO: 6929516 - DNA, 22 bp, Homo sapiens
atgcaaacaagagctaggtctg

SEQ ID NO: 6929517 - DNA, 22 bp, Homo sapiens
agtgaccgaggcacttggcaac

SEQ ID NO: 6929518 - DNA, 23 bp, Homo sapiens
ctgcaattgcctgatctcattgg

SEQ ID NO: 6929519 - DNA, 22 bp, Homo sapiens
aggtctctcagccctgacattc

SEQ ID NO: 6929520 - DNA, 22 bp, Homo sapiens
tctaaagaaacattgagacctg

SEQ ID NO: 6929521 - DNA, 22 bp, Homo sapiens
gaagagtatatttagtgaaatc

SEQ ID NO: 6929522 - DNA, 22 bp, Homo sapiens
cctaactttaatgggaccagga

SEQ ID NO: 6929523 - DNA, 22 bp, Homo sapiens
gtctggaaattaagaggaggtt

SEQ ID NO: 6929524 - DNA, 22 bp, Homo sapiens
gacaggtaaagatggtggcagg

SEQ ID NO: 6929525 - DNA, 22 bp, Homo sapiens
aaccagttggcaaccagcagtt

SEQ ID NO: 6929526 - DNA, 22 bp, Homo sapiens
aactgcttcttactgctgggca

SEQ ID NO: 6929527 - DNA, 20 bp, Homo sapiens
caacagaggggtctggagta

SEQ ID NO: 6929528 - DNA, 18 bp, Homo sapiens
aagtgaattgtccttttc

SEQ ID NO: 6929529 - DNA, 21 bp, Homo sapiens
gactttcttaccagatttttg

SEQ ID NO: 6929530 - DNA, 22 bp, Homo sapiens
ggtggatggactctcgggggcc

SEQ ID NO: 6929531 - DNA, 22 bp, Homo sapiens
tcccagagtgagccaggggcag

SEQ ID NO: 6929532 - DNA, 22 bp, Homo sapiens
atcggcttcctgaaggcaagga

SEQ ID NO: 6929533 - DNA, 23 bp, Homo sapiens
ggttttcatggcattccttgcct

SEQ ID NO: 6929534 - DNA, 22 bp, Homo sapiens
caaaccattaagcatgttgagt

SEQ ID NO: 6929535 - DNA, 22 bp, Homo sapiens
tactgttatatatagcagcagt

SEQ ID NO: 6929536 - DNA, 22 bp, Homo sapiens
tttgtaccagccacatatgaaa

SEQ ID NO: 6929537 - DNA, 22 bp, Homo sapiens
aagcttttctctgtattacctg

SEQ ID NO: 6929538 - DNA, 22 bp, Homo sapiens
atgttcctggtatatcatgacc

SEQ ID NO: 6929539 - DNA, 22 bp, Homo sapiens
ttacaagtttctggcttcatcc

SEQ ID NO: 6929540 - DNA, 20 bp, Homo sapiens
atactgtacaactataggta

SEQ ID NO: 6929541 - DNA, 22 bp, Homo sapiens
tgtcctgggtcaaccaggtcga

SEQ ID NO: 6929542 - DNA, 22 bp, Homo sapiens
ggctgcaggcttccctccagca

SEQ ID NO: 6929543 - DNA, 20 bp, Homo sapiens
tctagggtggctgtagcagc

SEQ ID NO: 6929544 - DNA, 22 bp, Homo sapiens
atgcaaattgccataaagtggg

SEQ ID NO: 6929545 - DNA, 19 bp, Homo sapiens
gcacgctggcttgataggg

SEQ ID NO: 6929546 - DNA, 22 bp, Homo sapiens
tgtctgcaccctgtgattgttt

SEQ ID NO: 6929547 - DNA, 22 bp, Homo sapiens
aggccaagttacttgggaaagc

SEQ ID NO: 6929548 - DNA, 22 bp, Homo sapiens
gcatcagaatcatccggggaat

SEQ ID NO: 6929549 - DNA, 22 bp, Homo sapiens
agcctgagagccaagctgtgca

SEQ ID NO: 6929550 - DNA, 22 bp, Homo sapiens
gggctccagccagctccttgtg

SEQ ID NO: 6929551 - DNA, 22 bp, Homo sapiens
tagcttccctgctggatcataa

SEQ ID NO: 6929552 - DNA, 22 bp, Homo sapiens
aaggagaagggtaatcaacaca

SEQ ID NO: 6929553 - DNA, 22 bp, Homo sapiens
acaggagtttaagaaatatttc

SEQ ID NO: 6929554 - DNA, 22 bp, Homo sapiens
ggcagccatgcacgctgcctgg

SEQ ID NO: 6929555 - DNA, 22 bp, Homo sapiens
caagtggtttatgggagttcca

SEQ ID NO: 6929556 - DNA, 22 bp, Homo sapiens
ccagctgcccaagaggcatcct

SEQ ID NO: 6929557 - DNA, 22 bp, Homo sapiens
ggaccagagctcgggcttctca

SEQ ID NO: 6929558 - DNA, 22 bp, Homo sapiens
gtagcctagaggtcacgtcttc

SEQ ID NO: 6929559 - DNA, 22 bp, Homo sapiens
aggctgagactgtgcattagtg

SEQ ID NO: 6929560 - DNA, 22 bp, Homo sapiens
agcagtgggtgacagagctgag

SEQ ID NO: 6929561 - DNA, 22 bp, Homo sapiens
tggacagcttgcagagccaccc

SEQ ID NO: 6929562 - DNA, 22 bp, Homo sapiens
tgtgacttttcacaggctggtc

SEQ ID NO: 6929563 - DNA, 22 bp, Homo sapiens
ctgaagctgggcacttcctttt

SEQ ID NO: 6929564 - DNA, 22 bp, Homo sapiens
caagaaatgtttactgagcatc

SEQ ID NO: 6929565 - DNA, 22 bp, Homo sapiens
cctggattctgctggccacttt

SEQ ID NO: 6929566 - DNA, 22 bp, Homo sapiens
atttgtgccaaattatttctaa

SEQ ID NO: 6929567 - DNA, 22 bp, Homo sapiens
ctcagggtgcccggatcccagg

SEQ ID NO: 6929568 - DNA, 22 bp, Homo sapiens
tacattgatggagtacctagct

SEQ ID NO: 6929569 - DNA, 22 bp, Homo sapiens
aactgtaaggcttagaacagca

SEQ ID NO: 6929570 - DNA, 22 bp, Homo sapiens
ctgtctcctccactgcatggga

SEQ ID NO: 6929571 - DNA, 22 bp, Homo sapiens
tgcagaggcgccgtgggtgggg

SEQ ID NO: 6929572 - DNA, 22 bp, Homo sapiens
ctgagctggttctcttgtgaaa

SEQ ID NO: 6929573 - DNA, 22 bp, Homo sapiens
agtcacatttgggggtgtcaaa

SEQ ID NO: 6929574 - DNA, 20 bp, Homo sapiens
tatggcttggcaaagcttca

SEQ ID NO: 6929575 - DNA, 22 bp, Homo sapiens
cgagttaaagaacagattgccc

SEQ ID NO: 6929576 - DNA, 22 bp, Homo sapiens
agctggttgtcattcagaattg

SEQ ID NO: 6929577 - DNA, 22 bp, Homo sapiens
gtagataaggattgatttttat

SEQ ID NO: 6929578 - DNA, 21 bp, Homo sapiens
ttctccccagcgaatcctcgg

SEQ ID NO: 6929579 - DNA, 22 bp, Homo sapiens
agcctctctccagcttggcaga

SEQ ID NO: 6929580 - DNA, 22 bp, Homo sapiens
agaaactgaacacaagagtcgg

SEQ ID NO: 6929581 - DNA, 22 bp, Homo sapiens
gtccttgccatataatgggggg

SEQ ID NO: 6929582 - DNA, 22 bp, Homo sapiens
tgctctgatggggtggacatag

SEQ ID NO: 6929583 - DNA, 22 bp, Homo sapiens
tactgtaagtcaaatgaaacat

SEQ ID NO: 6929584 - DNA, 22 bp, Homo sapiens
cattggcacctcacaggataga

SEQ ID NO: 6929585 - DNA, 22 bp, Homo sapiens
ggcgtgggaagtggggcttctg

SEQ ID NO: 6929586 - DNA, 22 bp, Homo sapiens
tccttcaccttagccctcctag

SEQ ID NO: 6929587 - DNA, 22 bp, Homo sapiens
tgtaactggacaagatattcat

SEQ ID NO: 6929588 - DNA, 22 bp, Homo sapiens
ctcctcagactttccttgtccg

SEQ ID NO: 6929589 - DNA, 22 bp, Homo sapiens
agggatggatcttggccctgga

SEQ ID NO: 6929590 - DNA, 22 bp, Homo sapiens
ttcgcagggagacaggctctct

SEQ ID NO: 6929591 - DNA, 22 bp, Homo sapiens
actcaagtcataggcttctttc

SEQ ID NO: 6929592 - DNA, 23 bp, Homo sapiens
tctgaccaagttttgcatgccac

SEQ ID NO: 6929593 - DNA, 22 bp, Homo sapiens
aagcacagataaaacaggattc

SEQ ID NO: 6929594 - DNA, 22 bp, Homo sapiens
ccactcaggcctcctgctctcc

SEQ ID NO: 6929595 - DNA, 20 bp, Homo sapiens
atgctcgtcccactaagctc

SEQ ID NO: 6929596 - DNA, 22 bp, Homo sapiens
gtagttattctgcctttaagga

SEQ ID NO: 6929597 - DNA, 22 bp, Homo sapiens
tgtgccaggccctggggaccaa

SEQ ID NO: 6929598 - DNA, 22 bp, Homo sapiens
ctctggagttcttcaagctact

SEQ ID NO: 6929599 - DNA, 22 bp, Homo sapiens
cctctctgtaagggtccctccc

SEQ ID NO: 6929600 - DNA, 22 bp, Homo sapiens
tttttgtcatctatttctggtg

SEQ ID NO: 6929601 - DNA, 17 bp, Homo sapiens
accaatgtcagacaaag

SEQ ID NO: 6929602 - DNA, 22 bp, Homo sapiens
cttctagccttgatgactggga

SEQ ID NO: 6929603 - DNA, 23 bp, Homo sapiens
tttcaacaatgcttagagaaaac

SEQ ID NO: 6929604 - DNA, 22 bp, Homo sapiens
atgctggcagccgagtgctcca

SEQ ID NO: 6929605 - DNA, 22 bp, Homo sapiens
actcagtacatctggagttggc

SEQ ID NO: 6929606 - DNA, 22 bp, Homo sapiens
tgcaggctggatttgcttttgt

SEQ ID NO: 6929607 - DNA, 22 bp, Homo sapiens
tggagcaggactgctgccctca

SEQ ID NO: 6929608 - DNA, 22 bp, Homo sapiens
gagcagaaagttatgtcttgca

SEQ ID NO: 6929609 - DNA, 22 bp, Homo sapiens
ttgtattccagccaccacaggc

SEQ ID NO: 6929610 - DNA, 22 bp, Homo sapiens
actgtttaggaggcttatatgc

SEQ ID NO: 6929611 - DNA, 22 bp, Homo sapiens
actctgtaaagcataacgtttg

SEQ ID NO: 6929612 - DNA, 22 bp, Homo sapiens
ggcaccagggcaagggtctttc

SEQ ID NO: 6929613 - DNA, 22 bp, Homo sapiens
gtacactgggtaagggactcct

SEQ ID NO: 6929614 - DNA, 22 bp, Homo sapiens
gatttcagaagcaagaggaggt

SEQ ID NO: 6929615 - DNA, 22 bp, Homo sapiens
caaaagtaatcgtggcttttgc

SEQ ID NO: 6929616 - DNA, 22 bp, Homo sapiens
tcggaaccgacctgggagctgg

SEQ ID NO: 6929617 - DNA, 22 bp, Homo sapiens
tagaaatgtaggcttcctgaca

SEQ ID NO: 6929618 - DNA, 22 bp, Homo sapiens
ccaggagccactcaggcccaca

SEQ ID NO: 6929619 - DNA, 22 bp, Homo sapiens
aggcacaaaagcagggtgacca

SEQ ID NO: 6929620 - DNA, 22 bp, Homo sapiens
ctggcctttcgtgagagctggg

SEQ ID NO: 6929621 - DNA, 22 bp, Homo sapiens
aacttagacttgtttcttggta

SEQ ID NO: 6929622 - DNA, 22 bp, Homo sapiens
taattcagaagtcctggctgga

SEQ ID NO: 6929623 - DNA, 22 bp, Homo sapiens
tttgaaagacagaatatttttg

SEQ ID NO: 6929624 - DNA, 22 bp, Homo sapiens
tggaacacagtgattgatagcg

SEQ ID NO: 6929625 - DNA, 22 bp, Homo sapiens
ttatgtagcagaaagatgtttg

SEQ ID NO: 6929626 - DNA, 22 bp, Homo sapiens
tcaggtgggcgttccggtgcgg

SEQ ID NO: 6929627 - DNA, 22 bp, Homo sapiens
gaaatctacttagtgtctggat

SEQ ID NO: 6929628 - DNA, 22 bp, Homo sapiens
gaatgatagagctgccttcgga

SEQ ID NO: 6929629 - DNA, 22 bp, Homo sapiens
cagctgctgatggcctgacaga

SEQ ID NO: 6929630 - DNA, 22 bp, Homo sapiens
gtctgctgtgggtccccaggag

SEQ ID NO: 6929631 - DNA, 22 bp, Homo sapiens
agcagtgatgaaatgagcatcc

SEQ ID NO: 6929632 - DNA, 22 bp, Homo sapiens
tgagaaagcctttagtcccagg

SEQ ID NO: 6929633 - DNA, 22 bp, Homo sapiens
tgaagtttaattttggacatga

SEQ ID NO: 6929634 - DNA, 22 bp, Homo sapiens
agtgttataaaggccaagtttt

SEQ ID NO: 6929635 - DNA, 22 bp, Homo sapiens
agtaccatctatgtgccaagca

SEQ ID NO: 6929636 - DNA, 22 bp, Homo sapiens
gtgcagcctgtcgccagtggat

SEQ ID NO: 6929637 - DNA, 18 bp, Homo sapiens
tggctctggacttgctcc

SEQ ID NO: 6929638 - DNA, 22 bp, Homo sapiens
gtggcttcttctgccagaagga

SEQ ID NO: 6929639 - DNA, 18 bp, Homo sapiens
tggtcactgtggatagtg

SEQ ID NO: 6929640 - DNA, 22 bp, Homo sapiens
tgtcattccttcaatgtagata

SEQ ID NO: 6929641 - DNA, 19 bp, Homo sapiens
ccagcccacagtgactttc

SEQ ID NO: 6929642 - DNA, 22 bp, Homo sapiens
tggttttatttatgttgagtca

SEQ ID NO: 6929643 - DNA, 22 bp, Homo sapiens
tgttcagaaaacagataactaa

SEQ ID NO: 6929644 - DNA, 22 bp, Homo sapiens
ctgtggcactcaagaagcctcc

SEQ ID NO: 6929645 - DNA, 22 bp, Homo sapiens
ttcaacatttgaaatgaatgaa

SEQ ID NO: 6929646 - DNA, 22 bp, Homo sapiens
cttgcacacgtgtatgtacatg

SEQ ID NO: 6929647 - DNA, 22 bp, Homo sapiens
ctgtctgcaggatagtaccctc

SEQ ID NO: 6929648 - DNA, 22 bp, Homo sapiens
tccttagcttacaagtcttctg

SEQ ID NO: 6929649 - DNA, 22 bp, Homo sapiens
gagtgctagcattagtatataa

SEQ ID NO: 6929650 - DNA, 22 bp, Homo sapiens
ggagctgagttcttcagccggg

SEQ ID NO: 6929651 - DNA, 22 bp, Homo sapiens
cacagtcagcctctagtagcat

SEQ ID NO: 6929652 - DNA, 22 bp, Homo sapiens
gctcacagagggtgcttaatac

SEQ ID NO: 6929653 - DNA, 22 bp, Homo sapiens
ctgaagaagctgcagcctggag

SEQ ID NO: 6929654 - DNA, 21 bp, Homo sapiens
ttcctctgcaactgatgctca

SEQ ID NO: 6929655 - DNA, 22 bp, Homo sapiens
cattcctgagggccccctactt

SEQ ID NO: 6929656 - DNA, 22 bp, Homo sapiens
cttattggtcccaggaggagaa

SEQ ID NO: 6929657 - DNA, 20 bp, Homo sapiens
catgcacagccatagcgcta

SEQ ID NO: 6929658 - DNA, 22 bp, Homo sapiens
gctgaaatgccttgtaaatatt

SEQ ID NO: 6929659 - DNA, 22 bp, Homo sapiens
aggcagtttaggcagcgattta

SEQ ID NO: 6929660 - DNA, 22 bp, Homo sapiens
gctcagggtcccttggtgctgg

SEQ ID NO: 6929661 - DNA, 22 bp, Homo sapiens
acagaccaagtttccagcaggt

SEQ ID NO: 6929662 - DNA, 22 bp, Homo sapiens
cgttgtttgagattttcagaat

SEQ ID NO: 6929663 - DNA, 22 bp, Homo sapiens
ctgggctgcaggagtggggcaa

SEQ ID NO: 6929664 - DNA, 22 bp, Homo sapiens
gattatggatggacagtggagc

SEQ ID NO: 6929665 - DNA, 22 bp, Homo sapiens
gggtaaatctcttttcatggct

SEQ ID NO: 6929666 - DNA, 18 bp, Homo sapiens
agtaaatggtttattttc

SEQ ID NO: 6929667 - DNA, 22 bp, Homo sapiens
ccacatttggagaagatacttt

SEQ ID NO: 6929668 - DNA, 22 bp, Homo sapiens
gactccagcatatacttttagt

SEQ ID NO: 6929669 - DNA, 22 bp, Homo sapiens
gagaaggctgatccttggagtt

SEQ ID NO: 6929670 - DNA, 22 bp, Homo sapiens
tcggtcaccgcgggctgcggcg

SEQ ID NO: 6929671 - DNA, 22 bp, Homo sapiens
tactgccaaattgcagcaatgt

SEQ ID NO: 6929672 - DNA, 22 bp, Homo sapiens
acccaggcctgagagacaggag

SEQ ID NO: 6929673 - DNA, 20 bp, Homo sapiens
tggcaggagccactggaagc

SEQ ID NO: 6929674 - DNA, 22 bp, Homo sapiens
atgtaacaggcacgggtggata

SEQ ID NO: 6929675 - DNA, 22 bp, Homo sapiens
tcaagctttctgtctcttatgg

SEQ ID NO: 6929676 - DNA, 22 bp, Homo sapiens
aggggctctaaagatcatggaa

SEQ ID NO: 6929677 - DNA, 22 bp, Homo sapiens
actcttttatgcattccttcag

SEQ ID NO: 6929678 - DNA, 22 bp, Homo sapiens
gcagaattccttcttccttggg

SEQ ID NO: 6929679 - DNA, 22 bp, Homo sapiens
tagaataatctgaggaaatgct

SEQ ID NO: 6929680 - DNA, 22 bp, Homo sapiens
tggaactgctccaaaacctcca

SEQ ID NO: 6929681 - DNA, 22 bp, Homo sapiens
tcacaggagcccaggggagctg

SEQ ID NO: 6929682 - DNA, 22 bp, Homo sapiens
aagctatagagtgtaagatgat

SEQ ID NO: 6929683 - DNA, 22 bp, Homo sapiens
ccagacatattgacatttgatc

SEQ ID NO: 6929684 - DNA, 22 bp, Homo sapiens
ctctgccagccaaaatttatga

SEQ ID NO: 6929685 - DNA, 22 bp, Homo sapiens
gatgaaatttgggcaggttaaa

SEQ ID NO: 6929686 - DNA, 23 bp, Homo sapiens
agagtgcagagatatgcttgtgt

SEQ ID NO: 6929687 - DNA, 22 bp, Homo sapiens
ttcatgaatgttccatgtgagt

SEQ ID NO: 6929688 - DNA, 22 bp, Homo sapiens
actaaactgcacagatgggtca

SEQ ID NO: 6929689 - DNA, 22 bp, Homo sapiens
ctgatttcatgctatcaatgtt

SEQ ID NO: 6929690 - DNA, 22 bp, Homo sapiens
cagctccccatggttcctgaag

SEQ ID NO: 6929691 - DNA, 22 bp, Homo sapiens
ttgaccatacctccaggcagtt

SEQ ID NO: 6929692 - DNA, 22 bp, Homo sapiens
tatcttgagagacaacacagca

SEQ ID NO: 6929693 - DNA, 22 bp, Homo sapiens
cacctcaggcagcaaagtctca

SEQ ID NO: 6929694 - DNA, 22 bp, Homo sapiens
tttatattgtaaaaatggttct

SEQ ID NO: 6929695 - DNA, 22 bp, Homo sapiens
aggtctaactgatagaattcat

SEQ ID NO: 6929696 - DNA, 22 bp, Homo sapiens
gtacccactatcctgagttttt

SEQ ID NO: 6929697 - DNA, 22 bp, Homo sapiens
caagattttatctccgtttctg

SEQ ID NO: 6929698 - DNA, 22 bp, Homo sapiens
gtcctggctgtgtttggtttct

SEQ ID NO: 6929699 - DNA, 20 bp, Homo sapiens
cggactttcttctcagggca

SEQ ID NO: 6929700 - DNA, 22 bp, Homo sapiens
aatggtttgatggacaaaatga

SEQ ID NO: 6929701 - DNA, 22 bp, Homo sapiens
gaaagaggaaggagatgtatta

SEQ ID NO: 6929702 - DNA, 19 bp, Homo sapiens
ttcacggccaggacaatgc

SEQ ID NO: 6929703 - DNA, 22 bp, Homo sapiens
tctcaggtaaaagggtatctac

SEQ ID NO: 6929704 - DNA, 22 bp, Homo sapiens
gatgttgatttgattaaggctt

SEQ ID NO: 6929705 - DNA, 22 bp, Homo sapiens
ttctgaggcactggctctccca

SEQ ID NO: 6929706 - DNA, 22 bp, Homo sapiens
tgcccctcttgctggccctgtc

SEQ ID NO: 6929707 - DNA, 22 bp, Homo sapiens
gaagtctgactctttgtaagct

SEQ ID NO: 6929708 - DNA, 22 bp, Homo sapiens
gaggctggtttgccttttggca

SEQ ID NO: 6929709 - DNA, 22 bp, Homo sapiens
ctttcttatacctgtcagggcc

SEQ ID NO: 6929710 - DNA, 23 bp, Homo sapiens
aagtaaacattagaagttgaggt

SEQ ID NO: 6929711 - DNA, 22 bp, Homo sapiens
atgctgaagaatcacagggact

SEQ ID NO: 6929712 - DNA, 22 bp, Homo sapiens
gtcgatcacctcgtcctccgtg

SEQ ID NO: 6929713 - DNA, 22 bp, Homo sapiens
gctgctggaacaaatcacccca

SEQ ID NO: 6929714 - DNA, 17 bp, Homo sapiens
tggttgtgggaactgaa

SEQ ID NO: 6929715 - DNA, 22 bp, Homo sapiens
aagagcatattaatagtggaga

SEQ ID NO: 6929716 - DNA, 23 bp, Homo sapiens
ttcaagagccatgctcttcttat

SEQ ID NO: 6929717 - DNA, 22 bp, Homo sapiens
accctcagacatattccatcat

SEQ ID NO: 6929718 - DNA, 22 bp, Homo sapiens
tctgattccagagcattgctca

SEQ ID NO: 6929719 - DNA, 22 bp, Homo sapiens
gcccaggctggagtgcagtagc

SEQ ID NO: 6929720 - DNA, 16 bp, Homo sapiens
ttctagaaaagaaggt

SEQ ID NO: 6929721 - DNA, 22 bp, Homo sapiens
ataaagtctcatgggtaaatgt

SEQ ID NO: 6929722 - DNA, 22 bp, Homo sapiens
ttctcctgggaggggttgccca

SEQ ID NO: 6929723 - DNA, 18 bp, Homo sapiens
gtgtcttattacagtggg

SEQ ID NO: 6929724 - DNA, 22 bp, Homo sapiens
ttctacattcatgtattacctc

SEQ ID NO: 6929725 - DNA, 22 bp, Homo sapiens
gtttttctagactgggagtttg

SEQ ID NO: 6929726 - DNA, 22 bp, Homo sapiens
ggaatgaatttccagctgggtc

SEQ ID NO: 6929727 - DNA, 22 bp, Homo sapiens
ccactgggggctgcaggcactc

SEQ ID NO: 6929728 - DNA, 22 bp, Homo sapiens
ctacattaaattggcttactta

SEQ ID NO: 6929729 - DNA, 22 bp, Homo sapiens
ccccagaaagcctggcactagg

SEQ ID NO: 6929730 - DNA, 22 bp, Homo sapiens
cctggcctcctggccttctcat

SEQ ID NO: 6929731 - DNA, 22 bp, Homo sapiens
ttgcaggtctgggggtcctggt

SEQ ID NO: 6929732 - DNA, 22 bp, Homo sapiens
gtccttagttacttttcatgtc

SEQ ID NO: 6929733 - DNA, 22 bp, Homo sapiens
tcagaatatgctaatgacattt

SEQ ID NO: 6929734 - DNA, 22 bp, Homo sapiens
agacagacaaaattcctgcctg

SEQ ID NO: 6929735 - DNA, 22 bp, Homo sapiens
actgaatatattccattgcatg

SEQ ID NO: 6929736 - DNA, 22 bp, Homo sapiens
tggagccagcaggactcagagg

SEQ ID NO: 6929737 - DNA, 22 bp, Homo sapiens
ctccagagtcacactgcctggg

SEQ ID NO: 6929738 - DNA, 22 bp, Homo sapiens
cccagaggtctgaaaaggttga

SEQ ID NO: 6929739 - DNA, 22 bp, Homo sapiens
aatgcattgattgctggaaata

SEQ ID NO: 6929740 - DNA, 22 bp, Homo sapiens
gagagggagccagccaggaacc

SEQ ID NO: 6929741 - DNA, 21 bp, Homo sapiens
tttctagaaggaggcatgagg

SEQ ID NO: 6929742 - DNA, 22 bp, Homo sapiens
taacagttttgagttttgcttc

SEQ ID NO: 6929743 - DNA, 22 bp, Homo sapiens
agccaattgtccatctttagct

SEQ ID NO: 6929744 - DNA, 22 bp, Homo sapiens
actccacatttgaacacagttc

SEQ ID NO: 6929745 - DNA, 22 bp, Homo sapiens
agcatgttgggatgagaaggaa

SEQ ID NO: 6929746 - DNA, 22 bp, Homo sapiens
ggtagggatgggatttggaagt

SEQ ID NO: 6929747 - DNA, 22 bp, Homo sapiens
tgtttacacttcaaggttaagg

SEQ ID NO: 6929748 - DNA, 21 bp, Homo sapiens
tagcagtgaatccatacgggt

SEQ ID NO: 6929749 - DNA, 22 bp, Homo sapiens
taaaggagtgtgatgaaaggga

SEQ ID NO: 6929750 - DNA, 22 bp, Homo sapiens
tgtcataaaacacaagctgttg

SEQ ID NO: 6929751 - DNA, 22 bp, Homo sapiens
aatgttgacctcctgaatgttt

SEQ ID NO: 6929752 - DNA, 23 bp, Homo sapiens
atttcctaaaagataatcattac

SEQ ID NO: 6929753 - DNA, 22 bp, Homo sapiens
ccacagtgaaatcttgatggag

SEQ ID NO: 6929754 - DNA, 22 bp, Homo sapiens
atctgtctggaggcctggcatg

SEQ ID NO: 6929755 - DNA, 22 bp, Homo sapiens
cagaggctttgccctggaaacc

SEQ ID NO: 6929756 - DNA, 22 bp, Homo sapiens
tttctagatgcttttgaaaatc

SEQ ID NO: 6929757 - DNA, 22 bp, Homo sapiens
cctcaggcagtggtatggatgg

SEQ ID NO: 6929758 - DNA, 21 bp, Homo sapiens
tcttttctctgcaggattcct

SEQ ID NO: 6929759 - DNA, 22 bp, Homo sapiens
taggcccagttccgcctcccgg

SEQ ID NO: 6929760 - DNA, 23 bp, Homo sapiens
tgtcccagagggagggataggct

SEQ ID NO: 6929761 - DNA, 23 bp, Homo sapiens
gcaacagagaagtaggagatggc

SEQ ID NO: 6929762 - DNA, 20 bp, Homo sapiens
tataagcagctccaggcaga

SEQ ID NO: 6929763 - DNA, 23 bp, Homo sapiens
cagcccatggcattttttacagt

SEQ ID NO: 6929764 - DNA, 22 bp, Homo sapiens
tattatgaggactggtgtaagg

SEQ ID NO: 6929765 - DNA, 17 bp, Homo sapiens
catttgttgatcagttg

SEQ ID NO: 6929766 - DNA, 22 bp, Homo sapiens
gcagagtcattatttatgcaat

SEQ ID NO: 6929767 - DNA, 22 bp, Homo sapiens
agctcctgccaacactgatggg

SEQ ID NO: 6929768 - DNA, 22 bp, Homo sapiens
aaatacagatagatttaaccca

SEQ ID NO: 6929769 - DNA, 19 bp, Homo sapiens
tcagctctggggtcagtgg

SEQ ID NO: 6929770 - DNA, 22 bp, Homo sapiens
tttcccagttagtgaagacatg

SEQ ID NO: 6929771 - DNA, 22 bp, Homo sapiens
aaactcttcatatacatatgct

SEQ ID NO: 6929772 - DNA, 22 bp, Homo sapiens
tgcttgctctgctccaccaaga

SEQ ID NO: 6929773 - DNA, 22 bp, Homo sapiens
ttgtcagggactggaaaagaaa

SEQ ID NO: 6929774 - DNA, 22 bp, Homo sapiens
taggttcaagttcaggctctat

SEQ ID NO: 6929775 - DNA, 18 bp, Homo sapiens
ccagcatgccagaggctg

SEQ ID NO: 6929776 - DNA, 22 bp, Homo sapiens
ggctgcctctggaagctggaga

SEQ ID NO: 6929777 - DNA, 22 bp, Homo sapiens
cctgcacagaccaaagaggaca

SEQ ID NO: 6929778 - DNA, 22 bp, Homo sapiens
tcttgagctttatccagtttct

SEQ ID NO: 6929779 - DNA, 22 bp, Homo sapiens
atggcagcggagctggaaatga

SEQ ID NO: 6929780 - DNA, 22 bp, Homo sapiens
cggagcgctgggggactctgca

SEQ ID NO: 6929781 - DNA, 22 bp, Homo sapiens
cctgtcataatgtccgatgtca

SEQ ID NO: 6929782 - DNA, 22 bp, Homo sapiens
cttgtgcatctcttcatgacca

SEQ ID NO: 6929783 - DNA, 22 bp, Homo sapiens
aggcttttatacattgctgacc

SEQ ID NO: 6929784 - DNA, 19 bp, Homo sapiens
gaacaaacttaaacttttc

SEQ ID NO: 6929785 - DNA, 22 bp, Homo sapiens
atggtcctttttgcctggatgc

SEQ ID NO: 6929786 - DNA, 22 bp, Homo sapiens
ttggatacagatgaaaggaagg

SEQ ID NO: 6929787 - DNA, 22 bp, Homo sapiens
ttggctgtatgtacatctgtta

SEQ ID NO: 6929788 - DNA, 22 bp, Homo sapiens
tgctcagccgtgagcagagccg

SEQ ID NO: 6929789 - DNA, 19 bp, Homo sapiens
gaggaggcttcagctttct

SEQ ID NO: 6929790 - DNA, 20 bp, Homo sapiens
ttatttcagttgctagattg

SEQ ID NO: 6929791 - DNA, 22 bp, Homo sapiens
ccaaggatctggttctttttac

SEQ ID NO: 6929792 - DNA, 22 bp, Homo sapiens
tgcggggagagaggtccaggat

SEQ ID NO: 6929793 - DNA, 22 bp, Homo sapiens
gcagtgctagcctcacagggtc

SEQ ID NO: 6929794 - DNA, 22 bp, Homo sapiens
ttcctatggccagagtcaaaga

SEQ ID NO: 6929795 - DNA, 22 bp, Homo sapiens
acagtgtactcctttaccggag

SEQ ID NO: 6929796 - DNA, 18 bp, Homo sapiens
gaggatcagaaatctgta

SEQ ID NO: 6929797 - DNA, 22 bp, Homo sapiens
ggcatccgcctggagggtgcta

SEQ ID NO: 6929798 - DNA, 22 bp, Homo sapiens
tcaatgtaataaaatactctat

SEQ ID NO: 6929799 - DNA, 19 bp, Homo sapiens
tatgaagttgataaaagtt

SEQ ID NO: 6929800 - DNA, 22 bp, Homo sapiens
tttgttcaacatcacttccacc

SEQ ID NO: 6929801 - DNA, 22 bp, Homo sapiens
tactcatgactgatgaatacct

SEQ ID NO: 6929802 - DNA, 22 bp, Homo sapiens
tctgtgcctttaagaagctcat

SEQ ID NO: 6929803 - DNA, 22 bp, Homo sapiens
accagtgagtatttgtaacaga

SEQ ID NO: 6929804 - DNA, 22 bp, Homo sapiens
atccattattgggccaataaag

SEQ ID NO: 6929805 - DNA, 22 bp, Homo sapiens
tttaattttcctcttcctggag

SEQ ID NO: 6929806 - DNA, 22 bp, Homo sapiens
ttccttacattcatatggcttc

SEQ ID NO: 6929807 - DNA, 22 bp, Homo sapiens
cttaggaacacttactggtact

SEQ ID NO: 6929808 - DNA, 22 bp, Homo sapiens
ttcagaagttttcaaaactaag

SEQ ID NO: 6929809 - DNA, 22 bp, Homo sapiens
tggaaacactgcatgttcaccc

SEQ ID NO: 6929810 - DNA, 22 bp, Homo sapiens
aaagcactatagccaaatagcc

SEQ ID NO: 6929811 - DNA, 22 bp, Homo sapiens
catttattcagctcagtcggtt

SEQ ID NO: 6929812 - DNA, 20 bp, Homo sapiens
tttagcaaaagggactgctc

SEQ ID NO: 6929813 - DNA, 22 bp, Homo sapiens
accgggctaatttttgtatctt

SEQ ID NO: 6929814 - DNA, 22 bp, Homo sapiens
agccagaaaggggcattatctg

SEQ ID NO: 6929815 - DNA, 22 bp, Homo sapiens
gcagaggagtgattatgccgtg

SEQ ID NO: 6929816 - DNA, 22 bp, Homo sapiens
gagcctgcaggcctcggcctca

SEQ ID NO: 6929817 - DNA, 22 bp, Homo sapiens
agcctccagtagctgaagagac

SEQ ID NO: 6929818 - DNA, 22 bp, Homo sapiens
aagggctcacccaactcacttc

SEQ ID NO: 6929819 - DNA, 22 bp, Homo sapiens
aaatccttttctatacagcata

SEQ ID NO: 6929820 - DNA, 22 bp, Homo sapiens
agtgttcttcctatctgctgtt

SEQ ID NO: 6929821 - DNA, 22 bp, Homo sapiens
tttgacttctgggcattttggt

SEQ ID NO: 6929822 - DNA, 22 bp, Homo sapiens
acagggctggcgttgggacaga

SEQ ID NO: 6929823 - DNA, 22 bp, Homo sapiens
agctttgtggctttgcaagact

SEQ ID NO: 6929824 - DNA, 22 bp, Homo sapiens
gctgagaagtcccatgatccgc

SEQ ID NO: 6929825 - DNA, 22 bp, Homo sapiens
tgaagctaggttcatgaggtcg

SEQ ID NO: 6929826 - DNA, 22 bp, Homo sapiens
tctgggtccgggggtgaattga

SEQ ID NO: 6929827 - DNA, 22 bp, Homo sapiens
acagtgctgtcaaatatgtttt

SEQ ID NO: 6929828 - DNA, 22 bp, Homo sapiens
tgaggcaggaggttgagaactg

SEQ ID NO: 6929829 - DNA, 22 bp, Homo sapiens
tcatagaaatggaaagtatatt

SEQ ID NO: 6929830 - DNA, 22 bp, Homo sapiens
ttggaagatctaacagaggcat

SEQ ID NO: 6929831 - DNA, 22 bp, Homo sapiens
ctggtgcctcctctcccaggtc

SEQ ID NO: 6929832 - DNA, 22 bp, Homo sapiens
ctatggctcaattctagtggtt

SEQ ID NO: 6929833 - DNA, 22 bp, Homo sapiens
gtctttttgtctggcagaggtc

SEQ ID NO: 6929834 - DNA, 22 bp, Homo sapiens
acgtaatataagaaagtgtggt

SEQ ID NO: 6929835 - DNA, 22 bp, Homo sapiens
tttccaaaggctaaactcagtt

SEQ ID NO: 6929836 - DNA, 22 bp, Homo sapiens
tagtaacacattgaacgatcgc

SEQ ID NO: 6929837 - DNA, 22 bp, Homo sapiens
gcagcttcctgagtgtggacag

SEQ ID NO: 6929838 - DNA, 20 bp, Homo sapiens
tgtctggatgtttaagcaga

SEQ ID NO: 6929839 - DNA, 17 bp, Homo sapiens
cgtggctgagccataga

SEQ ID NO: 6929840 - DNA, 22 bp, Homo sapiens
aggtctctcacactcacagggc

SEQ ID NO: 6929841 - DNA, 22 bp, Homo sapiens
agggtggtatttaacaactgga

SEQ ID NO: 6929842 - DNA, 22 bp, Homo sapiens
agctttgtcttctcacatatcc

SEQ ID NO: 6929843 - DNA, 22 bp, Homo sapiens
caaggcagcttaatagaatttg

SEQ ID NO: 6929844 - DNA, 22 bp, Homo sapiens
tcctggagtaggccttagccat

SEQ ID NO: 6929845 - DNA, 22 bp, Homo sapiens
cagctgagctgccagactactg

SEQ ID NO: 6929846 - DNA, 22 bp, Homo sapiens
acgtcatcgttgtcatcgtcat

SEQ ID NO: 6929847 - DNA, 22 bp, Homo sapiens
aaaagcagaccacgctttgtgg

SEQ ID NO: 6929848 - DNA, 22 bp, Homo sapiens
ttagggaaatattgtaggttag

SEQ ID NO: 6929849 - DNA, 22 bp, Homo sapiens
aggtttgttaaaccagattgct

SEQ ID NO: 6929850 - DNA, 22 bp, Homo sapiens
tcaggctagcccagtgcttggg

SEQ ID NO: 6929851 - DNA, 22 bp, Homo sapiens
aagagattgtcagagatatgcc

SEQ ID NO: 6929852 - DNA, 22 bp, Homo sapiens
gtcgtcctgggccgagccccgg

SEQ ID NO: 6929853 - DNA, 22 bp, Homo sapiens
ggatgacagctcttccatgtgg

SEQ ID NO: 6929854 - DNA, 22 bp, Homo sapiens
cctgcctgcgtcctctgagggc

SEQ ID NO: 6929855 - DNA, 20 bp, Homo sapiens
taacacttgctttttgactt

SEQ ID NO: 6929856 - DNA, 23 bp, Homo sapiens
tggctaaacagtggagaaagctt

SEQ ID NO: 6929857 - DNA, 22 bp, Homo sapiens
gaaacctatttataacttctag

SEQ ID NO: 6929858 - DNA, 22 bp, Homo sapiens
cctggtttaatgctcactgttg

SEQ ID NO: 6929859 - DNA, 22 bp, Homo sapiens
tctttagaaacttttcttcatg

SEQ ID NO: 6929860 - DNA, 18 bp, Homo sapiens
tgtgcctctgcaggacgt

SEQ ID NO: 6929861 - DNA, 22 bp, Homo sapiens
tcaccactaggaattgtgtagt

SEQ ID NO: 6929862 - DNA, 22 bp, Homo sapiens
aggtggtcttggcccacccagg

SEQ ID NO: 6929863 - DNA, 21 bp, Homo sapiens
gcctgggaaatctgggaagcc

SEQ ID NO: 6929864 - DNA, 22 bp, Homo sapiens
tgggaacagaggacttgactgt

SEQ ID NO: 6929865 - DNA, 22 bp, Homo sapiens
caagcccaggattccccagtta

SEQ ID NO: 6929866 - DNA, 22 bp, Homo sapiens
acttcctgtgttggtcttgctg

SEQ ID NO: 6929867 - DNA, 22 bp, Homo sapiens
caatttcaatacaaaatacatt

SEQ ID NO: 6929868 - DNA, 22 bp, Homo sapiens
catcataaaattgagataactg

SEQ ID NO: 6929869 - DNA, 22 bp, Homo sapiens
gggcactggccgcccatccctg

SEQ ID NO: 6929870 - DNA, 22 bp, Homo sapiens
ggtgaacattgatgtggttaca

SEQ ID NO: 6929871 - DNA, 22 bp, Homo sapiens
gcctggagggctctagagaggc

SEQ ID NO: 6929872 - DNA, 22 bp, Homo sapiens
tgtctttagttttactgtctgg

SEQ ID NO: 6929873 - DNA, 22 bp, Homo sapiens
tggcagactttagggtctacat

SEQ ID NO: 6929874 - DNA, 22 bp, Homo sapiens
tcacatcttgtgatgttttcat

SEQ ID NO: 6929875 - DNA, 22 bp, Homo sapiens
tccacattagaatgttttctca

SEQ ID NO: 6929876 - DNA, 22 bp, Homo sapiens
ccctgactcggcgcgctcccgt

SEQ ID NO: 6929877 - DNA, 22 bp, Homo sapiens
gaaaggtttaagtaggatttgt

SEQ ID NO: 6929878 - DNA, 22 bp, Homo sapiens
ttttcattgttcctcgagcatt

SEQ ID NO: 6929879 - DNA, 22 bp, Homo sapiens
caaacattttaaataagggata

SEQ ID NO: 6929880 - DNA, 22 bp, Homo sapiens
gaatcagaatctctaaggtggg

SEQ ID NO: 6929881 - DNA, 22 bp, Homo sapiens
aataggtagccagatatataaa

SEQ ID NO: 6929882 - DNA, 23 bp, Homo sapiens
tttggacttgtgactcttctcct

SEQ ID NO: 6929883 - DNA, 22 bp, Homo sapiens
ttcaacaagtcttttttcactg

SEQ ID NO: 6929884 - DNA, 22 bp, Homo sapiens
gcacactgtgaatttgcatatg

SEQ ID NO: 6929885 - DNA, 22 bp, Homo sapiens
ttcctaacgccagtattttcat

SEQ ID NO: 6929886 - DNA, 23 bp, Homo sapiens
cagaaagtttgagaagatacatc

SEQ ID NO: 6929887 - DNA, 22 bp, Homo sapiens
cctgaaatgactccagctgagt

SEQ ID NO: 6929888 - DNA, 22 bp, Homo sapiens
atggcactaagagggagctgga

SEQ ID NO: 6929889 - DNA, 19 bp, Homo sapiens
taggaccctggtggccccc

SEQ ID NO: 6929890 - DNA, 22 bp, Homo sapiens
tttccagagcatgtctgctcag

SEQ ID NO: 6929891 - DNA, 22 bp, Homo sapiens
aaagaaatagatggcatttaaa

SEQ ID NO: 6929892 - DNA, 22 bp, Homo sapiens
tcatccatgaagagtgacagaa

SEQ ID NO: 6929893 - DNA, 22 bp, Homo sapiens
taaaagatcactggctgcttta

SEQ ID NO: 6929894 - DNA, 22 bp, Homo sapiens
tgcaggtacttgacaacttggg

SEQ ID NO: 6929895 - DNA, 19 bp, Homo sapiens
actggcacacaggggctgc

SEQ ID NO: 6929896 - DNA, 22 bp, Homo sapiens
cgtgtacacgcacacgtgtcct

SEQ ID NO: 6929897 - DNA, 22 bp, Homo sapiens
atccatataggcagatggcaca

SEQ ID NO: 6929898 - DNA, 22 bp, Homo sapiens
ttcacagattgactggattcct

SEQ ID NO: 6929899 - DNA, 22 bp, Homo sapiens
gtgagttcccggatctgttcca

SEQ ID NO: 6929900 - DNA, 22 bp, Homo sapiens
ttgactttacagttttcttagg

SEQ ID NO: 6929901 - DNA, 22 bp, Homo sapiens
atactgaacatgtttgcagtca

SEQ ID NO: 6929902 - DNA, 22 bp, Homo sapiens
gtcacactcagaatgactagag

SEQ ID NO: 6929903 - DNA, 22 bp, Homo sapiens
ccctgagcacacctggcagaca

SEQ ID NO: 6929904 - DNA, 22 bp, Homo sapiens
tccaggagctcatccacgtcaa

SEQ ID NO: 6929905 - DNA, 22 bp, Homo sapiens
tcaccaataataacttgagaat

SEQ ID NO: 6929906 - DNA, 22 bp, Homo sapiens
cagagcagtccttgtcaatcag

SEQ ID NO: 6929907 - DNA, 22 bp, Homo sapiens
tccagttgcctgtctctgatta

SEQ ID NO: 6929908 - DNA, 22 bp, Homo sapiens
tgcagatgcctgggctgcacca

SEQ ID NO: 6929909 - DNA, 18 bp, Homo sapiens
tactgtggatcaggggtt

SEQ ID NO: 6929910 - DNA, 22 bp, Homo sapiens
gctggctctgtggtagttggca

SEQ ID NO: 6929911 - DNA, 22 bp, Homo sapiens
acaactgatgggtcatgtggga

SEQ ID NO: 6929912 - DNA, 22 bp, Homo sapiens
gttacaaatgtaaattctgggg

SEQ ID NO: 6929913 - DNA, 22 bp, Homo sapiens
agtaaccagtagtcattcattc

SEQ ID NO: 6929914 - DNA, 22 bp, Homo sapiens
caggccaagtcccaagtgcggg

SEQ ID NO: 6929915 - DNA, 22 bp, Homo sapiens
ggcccttcctgctctcttagct

SEQ ID NO: 6929916 - DNA, 18 bp, Homo sapiens
cattccccatctctgagc

SEQ ID NO: 6929917 - DNA, 22 bp, Homo sapiens
tcatgcaaggctgaaacatggt

SEQ ID NO: 6929918 - DNA, 22 bp, Homo sapiens
cagtgccaagccacagatcact

SEQ ID NO: 6929919 - DNA, 22 bp, Homo sapiens
cctagtttcttaattttgagaa

SEQ ID NO: 6929920 - DNA, 22 bp, Homo sapiens
gcatggttagacatcaatgtga

SEQ ID NO: 6929921 - DNA, 22 bp, Homo sapiens
ctcttccatttctacttcacag

SEQ ID NO: 6929922 - DNA, 22 bp, Homo sapiens
gcacagtaggctcagctctatc

SEQ ID NO: 6929923 - DNA, 22 bp, Homo sapiens
actggctggagttgccaaggct

SEQ ID NO: 6929924 - DNA, 22 bp, Homo sapiens
ttggcagggccaggctctctct

SEQ ID NO: 6929925 - DNA, 22 bp, Homo sapiens
agtgtctgtgttttctattgct

SEQ ID NO: 6929926 - DNA, 22 bp, Homo sapiens
cccaggaaatatgtttcttaac

SEQ ID NO: 6929927 - DNA, 22 bp, Homo sapiens
tctcttaaaagagtaatagaga

SEQ ID NO: 6929928 - DNA, 22 bp, Homo sapiens
aagttgtatgtcttagaaagta

SEQ ID NO: 6929929 - DNA, 22 bp, Homo sapiens
acatttaagttaaaacctcagt

SEQ ID NO: 6929930 - DNA, 22 bp, Homo sapiens
tttcacatggaagctctcgaga

SEQ ID NO: 6929931 - DNA, 22 bp, Homo sapiens
atgagcatctgacatttaaaac

SEQ ID NO: 6929932 - DNA, 22 bp, Homo sapiens
cactacagaatcaaatacgggc

SEQ ID NO: 6929933 - DNA, 22 bp, Homo sapiens
aaaattggacgtagctactcca

SEQ ID NO: 6929934 - DNA, 22 bp, Homo sapiens
gaatacttgggtctggagtcaa

SEQ ID NO: 6929935 - DNA, 22 bp, Homo sapiens
ctttagatggcttaggaggccc

SEQ ID NO: 6929936 - DNA, 22 bp, Homo sapiens
agtggcagagccaagatatgat

SEQ ID NO: 6929937 - DNA, 22 bp, Homo sapiens
atatagtgaaagtgatgtgtgg

SEQ ID NO: 6929938 - DNA, 22 bp, Homo sapiens
tccagagccccaattcacctct

SEQ ID NO: 6929939 - DNA, 23 bp, Homo sapiens
tgaatcaattatgggattcaatg

SEQ ID NO: 6929940 - DNA, 22 bp, Homo sapiens
gaccatgcttctccctggtgtg

SEQ ID NO: 6929941 - DNA, 22 bp, Homo sapiens
tagctttgaccaacgactggtc

SEQ ID NO: 6929942 - DNA, 19 bp, Homo sapiens
gtataacttacaccagcaa

SEQ ID NO: 6929943 - DNA, 22 bp, Homo sapiens
agacaaatgaacaaatatgtga

SEQ ID NO: 6929944 - DNA, 22 bp, Homo sapiens
acttctgggtcccacccccaga

SEQ ID NO: 6929945 - DNA, 22 bp, Homo sapiens
ttgaggtcttgagtactgggga

SEQ ID NO: 6929946 - DNA, 22 bp, Homo sapiens
agaaaggacatctccctttaag

SEQ ID NO: 6929947 - DNA, 20 bp, Homo sapiens
ggcagagggcctgggagaag

SEQ ID NO: 6929948 - DNA, 22 bp, Homo sapiens
ctaaagatgtacatttttctcc

SEQ ID NO: 6929949 - DNA, 22 bp, Homo sapiens
tctgtttaggcaaaatagctac

SEQ ID NO: 6929950 - DNA, 22 bp, Homo sapiens
acttggaaccgaggacctttat

SEQ ID NO: 6929951 - DNA, 22 bp, Homo sapiens
tgaagccaaggatgcctttctc

SEQ ID NO: 6929952 - DNA, 22 bp, Homo sapiens
tttggctctagtaaatataacc

SEQ ID NO: 6929953 - DNA, 20 bp, Homo sapiens
gcaggccctctctctagtct

SEQ ID NO: 6929954 - DNA, 22 bp, Homo sapiens
tccagctaacacctactggcca

SEQ ID NO: 6929955 - DNA, 22 bp, Homo sapiens
gagagttcttgcctgggtatta

SEQ ID NO: 6929956 - DNA, 22 bp, Homo sapiens
tgctagcactgtgcagtctacg

SEQ ID NO: 6929957 - DNA, 23 bp, Homo sapiens
agcacctactccataccaggcac

SEQ ID NO: 6929958 - DNA, 22 bp, Homo sapiens
atgttctttgtgattctgagct

SEQ ID NO: 6929959 - DNA, 22 bp, Homo sapiens
gagatgatctttcctgtagtcc

SEQ ID NO: 6929960 - DNA, 22 bp, Homo sapiens
aatgtcaatctcagagaacaca

SEQ ID NO: 6929961 - DNA, 19 bp, Homo sapiens
tcctggcacagtggaacca

SEQ ID NO: 6929962 - DNA, 22 bp, Homo sapiens
tgccaccatctggctgtgttga

SEQ ID NO: 6929963 - DNA, 22 bp, Homo sapiens
gctgccagctcactctcctgag

SEQ ID NO: 6929964 - DNA, 22 bp, Homo sapiens
agagactgctttatattgtact

SEQ ID NO: 6929965 - DNA, 22 bp, Homo sapiens
cttcccaagctttagttatttt

SEQ ID NO: 6929966 - DNA, 22 bp, Homo sapiens
tggctctgttttatgagtacca

SEQ ID NO: 6929967 - DNA, 22 bp, Homo sapiens
gcccagaacagtgtcacatgtc

SEQ ID NO: 6929968 - DNA, 22 bp, Homo sapiens
attctgctggtaactctataaa

SEQ ID NO: 6929969 - DNA, 22 bp, Homo sapiens
agtgggtgggtgtctgacagtt

SEQ ID NO: 6929970 - DNA, 22 bp, Homo sapiens
ctcaggatgaaagtcatggtga

SEQ ID NO: 6929971 - DNA, 22 bp, Homo sapiens
ccgtggggggccgtcgtccctg

SEQ ID NO: 6929972 - DNA, 20 bp, Homo sapiens
agtggctgatggaaagaagc

SEQ ID NO: 6929973 - DNA, 22 bp, Homo sapiens
acacatctatctctacacaagg

SEQ ID NO: 6929974 - DNA, 22 bp, Homo sapiens
ctactggccatctgatctacaa

SEQ ID NO: 6929975 - DNA, 19 bp, Homo sapiens
actgtgctcgggaaccact

SEQ ID NO: 6929976 - DNA, 22 bp, Homo sapiens
agctgcctgtcctaggccatca

SEQ ID NO: 6929977 - DNA, 22 bp, Homo sapiens
gatttatagtatgtgctttcag

SEQ ID NO: 6929978 - DNA, 22 bp, Homo sapiens
agacagaaataggagaaaccag

SEQ ID NO: 6929979 - DNA, 22 bp, Homo sapiens
ccaagagtaaattcatgatgcc

SEQ ID NO: 6929980 - DNA, 20 bp, Homo sapiens
ccaggtggtgcctggagagg

SEQ ID NO: 6929981 - DNA, 22 bp, Homo sapiens
tttcttcagccactccaaactg

SEQ ID NO: 6929982 - DNA, 22 bp, Homo sapiens
ctgcctgctgccctccagagcc

SEQ ID NO: 6929983 - DNA, 22 bp, Homo sapiens
cctggctgcttcctctgccatg

SEQ ID NO: 6929984 - DNA, 22 bp, Homo sapiens
tgggagagtgctcaatgtgcaa

SEQ ID NO: 6929985 - DNA, 22 bp, Homo sapiens
ggtgggaaggggccagtgtgcg

SEQ ID NO: 6929986 - DNA, 22 bp, Homo sapiens
ttggcagtccaggattaatata

SEQ ID NO: 6929987 - DNA, 22 bp, Homo sapiens
tgtagcagagtatctctgtttt

SEQ ID NO: 6929988 - DNA, 22 bp, Homo sapiens
agagctgggtgaagtgccatca

SEQ ID NO: 6929989 - DNA, 22 bp, Homo sapiens
aacagagtttcaaataacatct

SEQ ID NO: 6929990 - DNA, 22 bp, Homo sapiens
tgtgtcaggagatagcaaaggg

SEQ ID NO: 6929991 - DNA, 20 bp, Homo sapiens
taacacagaaagcttccttc

SEQ ID NO: 6929992 - DNA, 22 bp, Homo sapiens
tacacagttttgctcccatgat

SEQ ID NO: 6929993 - DNA, 22 bp, Homo sapiens
ttcagagtacacagagatcttc

SEQ ID NO: 6929994 - DNA, 22 bp, Homo sapiens
cctgtctacataactgtgtgaa

SEQ ID NO: 6929995 - DNA, 22 bp, Homo sapiens
ggatggccttcttgctcaggaa

SEQ ID NO: 6929996 - DNA, 22 bp, Homo sapiens
tctgtgctagcacgcagcaagg

SEQ ID NO: 6929997 - DNA, 22 bp, Homo sapiens
tatgtgacaaaagtaaactgca

SEQ ID NO: 6929998 - DNA, 22 bp, Homo sapiens
gtggcagtgaggcaggagcagt

SEQ ID NO: 6929999 - DNA, 22 bp, Homo sapiens
gaggctttataactatttgttc

SEQ ID NO: 6930000 - DNA, 22 bp, Homo sapiens
ggagggaatgtctagcattctt

SEQ ID NO: 6930001 - DNA, 22 bp, Homo sapiens
cccccagccagcagtgctcagc

SEQ ID NO: 6930002 - DNA, 22 bp, Homo sapiens
gttgactcttgaactataccta

SEQ ID NO: 6930003 - DNA, 20 bp, Homo sapiens
caccacagaattggggacag

SEQ ID NO: 6930004 - DNA, 22 bp, Homo sapiens
tgaaggctgggctcagccagct

SEQ ID NO: 6930005 - DNA, 22 bp, Homo sapiens
gacgcctcttccctgctgcact

SEQ ID NO: 6930006 - DNA, 22 bp, Homo sapiens
tgtgctttggttttacaggatg

SEQ ID NO: 6930007 - DNA, 21 bp, Homo sapiens
tgcctggcctttgcttttcct

SEQ ID NO: 6930008 - DNA, 22 bp, Homo sapiens
atgctgggagtgaagcccctgg

SEQ ID NO: 6930009 - DNA, 22 bp, Homo sapiens
ttgcttcaccccaccttgttgc

SEQ ID NO: 6930010 - DNA, 19 bp, Homo sapiens
gagtgattgcagggaccct

SEQ ID NO: 6930011 - DNA, 22 bp, Homo sapiens
tgtgagaattcctgatcacagg

SEQ ID NO: 6930012 - DNA, 22 bp, Homo sapiens
ctgtcaggtttcccatctgcaa

SEQ ID NO: 6930013 - DNA, 22 bp, Homo sapiens
gaaagtttgcctctctcttgag

SEQ ID NO: 6930014 - DNA, 22 bp, Homo sapiens
ctcttgcagataccttgaagga

SEQ ID NO: 6930015 - DNA, 22 bp, Homo sapiens
ctggtggagatgcctggcccct

SEQ ID NO: 6930016 - DNA, 22 bp, Homo sapiens
gaagttctgggagtggcgccct

SEQ ID NO: 6930017 - DNA, 22 bp, Homo sapiens
ataatggattcagaaccgtcaa

SEQ ID NO: 6930018 - DNA, 22 bp, Homo sapiens
tcatctgtctgagagacttctg

SEQ ID NO: 6930019 - DNA, 22 bp, Homo sapiens
cccaggaactccagagctcctc

SEQ ID NO: 6930020 - DNA, 22 bp, Homo sapiens
tgtgttggtagatctgaggtct

SEQ ID NO: 6930021 - DNA, 22 bp, Homo sapiens
tgggtccctcatgagaggcatt

SEQ ID NO: 6930022 - DNA, 22 bp, Homo sapiens
tgtcttaatagtatccaggttc

SEQ ID NO: 6930023 - DNA, 22 bp, Homo sapiens
ttcataaacaaattaaggcctg

SEQ ID NO: 6930024 - DNA, 19 bp, Homo sapiens
ttggtgcacacatgggccc

SEQ ID NO: 6930025 - DNA, 22 bp, Homo sapiens
gacctcagtgaatggtcatgta

SEQ ID NO: 6930026 - DNA, 22 bp, Homo sapiens
atattatagacagagtcttctg

SEQ ID NO: 6930027 - DNA, 22 bp, Homo sapiens
tgatgttctgtatatcatatag

SEQ ID NO: 6930028 - DNA, 22 bp, Homo sapiens
tgtcaaagcaaggattaaatgt

SEQ ID NO: 6930029 - DNA, 22 bp, Homo sapiens
gcgcagagccctcttctgtgga

SEQ ID NO: 6930030 - DNA, 22 bp, Homo sapiens
tgcaggtggtccatttgggaac

SEQ ID NO: 6930031 - DNA, 22 bp, Homo sapiens
tccagacattttatagcagtct

SEQ ID NO: 6930032 - DNA, 22 bp, Homo sapiens
atcacatatttaagaaacatgt

SEQ ID NO: 6930033 - DNA, 22 bp, Homo sapiens
acatttgtatgcgtttttactg

SEQ ID NO: 6930034 - DNA, 22 bp, Homo sapiens
tgaggtaaatagaaaaaccatg

SEQ ID NO: 6930035 - DNA, 22 bp, Homo sapiens
cttgctctgggaagaaaaagtc

SEQ ID NO: 6930036 - DNA, 22 bp, Homo sapiens
gcagtgtttgtgttctcacatg

SEQ ID NO: 6930037 - DNA, 20 bp, Homo sapiens
accccacagagtccattgca

SEQ ID NO: 6930038 - DNA, 22 bp, Homo sapiens
atattgcagtgtgtttatgtga

SEQ ID NO: 6930039 - DNA, 18 bp, Homo sapiens
tatgtgcatatgtgtgta

SEQ ID NO: 6930040 - DNA, 22 bp, Homo sapiens
cccatgaactgtcttgctgtag

SEQ ID NO: 6930041 - DNA, 22 bp, Homo sapiens
agggatgcagtaaaaactgtag

SEQ ID NO: 6930042 - DNA, 20 bp, Homo sapiens
atacttgttttcaggctttt

SEQ ID NO: 6930043 - DNA, 22 bp, Homo sapiens
ttctccttattcatagttgtct

SEQ ID NO: 6930044 - DNA, 22 bp, Homo sapiens
gtttcatttacatctgtaggta

SEQ ID NO: 6930045 - DNA, 22 bp, Homo sapiens
gcattcatgtccttcctgaacg

SEQ ID NO: 6930046 - DNA, 22 bp, Homo sapiens
aagacattcatgaagaagggat

SEQ ID NO: 6930047 - DNA, 22 bp, Homo sapiens
gatatgttgagtagagtttttg

SEQ ID NO: 6930048 - DNA, 22 bp, Homo sapiens
caagtagaacagagctaccttg

SEQ ID NO: 6930049 - DNA, 22 bp, Homo sapiens
ctggagaacagagctgtttaga

SEQ ID NO: 6930050 - DNA, 22 bp, Homo sapiens
caggtctgttttcaaggtcagt

SEQ ID NO: 6930051 - DNA, 16 bp, Homo sapiens
ataattactgctactt

SEQ ID NO: 6930052 - DNA, 16 bp, Homo sapiens
ttgaatgactgtgtgc

SEQ ID NO: 6930053 - DNA, 21 bp, Homo sapiens
tcccttgggaaactttcttga

SEQ ID NO: 6930054 - DNA, 22 bp, Homo sapiens
actgagtggctggggagtggca

SEQ ID NO: 6930055 - DNA, 22 bp, Homo sapiens
cttgtttatctctgtagccctg

SEQ ID NO: 6930056 - DNA, 22 bp, Homo sapiens
taaattagggactttagttaat

SEQ ID NO: 6930057 - DNA, 22 bp, Homo sapiens
ggtgtagaaaagggaagggttt

SEQ ID NO: 6930058 - DNA, 22 bp, Homo sapiens
gctgtggctgaagatgcaggga

SEQ ID NO: 6930059 - DNA, 22 bp, Homo sapiens
tgtctgagttagctcttctcag

SEQ ID NO: 6930060 - DNA, 22 bp, Homo sapiens
atcttgcaatgacctatttagg

SEQ ID NO: 6930061 - DNA, 22 bp, Homo sapiens
tgcatcctagggaaggcactga

SEQ ID NO: 6930062 - DNA, 21 bp, Homo sapiens
ttcctttttatggcttagtgg

SEQ ID NO: 6930063 - DNA, 22 bp, Homo sapiens
tagtgtaatgacatttagacga

SEQ ID NO: 6930064 - DNA, 22 bp, Homo sapiens
agccctcctggggccacgctgg

SEQ ID NO: 6930065 - DNA, 22 bp, Homo sapiens
acaaattgggtatgagctaaga

SEQ ID NO: 6930066 - DNA, 22 bp, Homo sapiens
ttacagagtagtgcagaactca

SEQ ID NO: 6930067 - DNA, 22 bp, Homo sapiens
gaagcttcgaaagagtgatttc

SEQ ID NO: 6930068 - DNA, 22 bp, Homo sapiens
ttcttcatgggttcttttagga

SEQ ID NO: 6930069 - DNA, 22 bp, Homo sapiens
tagctgaatgccttggattttt

SEQ ID NO: 6930070 - DNA, 22 bp, Homo sapiens
ttctaaacactacgggatttgg

SEQ ID NO: 6930071 - DNA, 22 bp, Homo sapiens
acaaggccaagcattctagcaa

SEQ ID NO: 6930072 - DNA, 22 bp, Homo sapiens
tccagggagttggctggatagt

SEQ ID NO: 6930073 - DNA, 22 bp, Homo sapiens
aatgtttcattcttgcccattg

SEQ ID NO: 6930074 - DNA, 22 bp, Homo sapiens
tagagccctctggccacgttgc

SEQ ID NO: 6930075 - DNA, 22 bp, Homo sapiens
ctctgctcaccagccatgtgat

SEQ ID NO: 6930076 - DNA, 22 bp, Homo sapiens
ctacaggagggtgtgttgggcg

SEQ ID NO: 6930077 - DNA, 22 bp, Homo sapiens
tgctagtgtgtgagatgttcaa

SEQ ID NO: 6930078 - DNA, 22 bp, Homo sapiens
tacacagggtatggcttgagga

SEQ ID NO: 6930079 - DNA, 21 bp, Homo sapiens
gggctttttatttagcactgt

SEQ ID NO: 6930080 - DNA, 20 bp, Homo sapiens
tggtcctcacaggtcctccc

SEQ ID NO: 6930081 - DNA, 22 bp, Homo sapiens
agtctggtattggtctttaatc

SEQ ID NO: 6930082 - DNA, 19 bp, Homo sapiens
ccagcagaagccactcctg

SEQ ID NO: 6930083 - DNA, 22 bp, Homo sapiens
gaccttcagtgtgtttctcaca

SEQ ID NO: 6930084 - DNA, 17 bp, Homo sapiens
gctactggttacctcta

SEQ ID NO: 6930085 - DNA, 22 bp, Homo sapiens
gcagggcatccctgagcgggtg

SEQ ID NO: 6930086 - DNA, 22 bp, Homo sapiens
cagtttggggtcggagtcaggg

SEQ ID NO: 6930087 - DNA, 22 bp, Homo sapiens
gctgagtcagattgcagtcttg

SEQ ID NO: 6930088 - DNA, 22 bp, Homo sapiens
taaagcagtatgatggaaggat

SEQ ID NO: 6930089 - DNA, 22 bp, Homo sapiens
tctactgtagtgatgctgcagt

SEQ ID NO: 6930090 - DNA, 22 bp, Homo sapiens
tatagtatacttaaagtctatt

SEQ ID NO: 6930091 - DNA, 22 bp, Homo sapiens
tgctgggccaaagcagggtttt

SEQ ID NO: 6930092 - DNA, 22 bp, Homo sapiens
aatggctttggtctgggtccca

SEQ ID NO: 6930093 - DNA, 22 bp, Homo sapiens
tgtgacgttgttctggattccc

SEQ ID NO: 6930094 - DNA, 22 bp, Homo sapiens
ttaaggaaagattagcatttgt

SEQ ID NO: 6930095 - DNA, 19 bp, Homo sapiens
tacatttgtgtacacttgt

SEQ ID NO: 6930096 - DNA, 22 bp, Homo sapiens
gagcccgagcgcgtacccggcg

SEQ ID NO: 6930097 - DNA, 22 bp, Homo sapiens
ctatttcaaggcccagatatga

SEQ ID NO: 6930098 - DNA, 22 bp, Homo sapiens
gtttatgagttacgtaggggtt

SEQ ID NO: 6930099 - DNA, 20 bp, Homo sapiens
tattaggtagcactgggata

SEQ ID NO: 6930100 - DNA, 22 bp, Homo sapiens
tatgtggccattctgtttgtgt

SEQ ID NO: 6930101 - DNA, 22 bp, Homo sapiens
ggctgcctgcctccaagccggg

SEQ ID NO: 6930102 - DNA, 22 bp, Homo sapiens
cactgcacaggtgagatgtggg

SEQ ID NO: 6930103 - DNA, 22 bp, Homo sapiens
taattcttcaggccttttgtct

SEQ ID NO: 6930104 - DNA, 22 bp, Homo sapiens
caggcccagggttattgggaaa

SEQ ID NO: 6930105 - DNA, 22 bp, Homo sapiens
tgggacttcaatgcaatgaggt

SEQ ID NO: 6930106 - DNA, 22 bp, Homo sapiens
aggtcagctgtgtgtgcatgag

SEQ ID NO: 6930107 - DNA, 22 bp, Homo sapiens
tgacagcatgaccacagggtct

SEQ ID NO: 6930108 - DNA, 22 bp, Homo sapiens
gtcctgtgtaagccaggacaat

SEQ ID NO: 6930109 - DNA, 22 bp, Homo sapiens
gtggcccaggcaccctgatgac

SEQ ID NO: 6930110 - DNA, 22 bp, Homo sapiens
taacagaatttgctaaactccg

SEQ ID NO: 6930111 - DNA, 22 bp, Homo sapiens
acagtgtactaaatagtaagag

SEQ ID NO: 6930112 - DNA, 22 bp, Homo sapiens
tttggcaagcgagtactttctg

SEQ ID NO: 6930113 - DNA, 21 bp, Homo sapiens
cactgaggaggaaaaggagct

SEQ ID NO: 6930114 - DNA, 22 bp, Homo sapiens
tcagaaccagcccagcagatga

SEQ ID NO: 6930115 - DNA, 22 bp, Homo sapiens
gcatgtgtccctcagtctgtgc

SEQ ID NO: 6930116 - DNA, 22 bp, Homo sapiens
tttctgaatttactcaaggtca

SEQ ID NO: 6930117 - DNA, 22 bp, Homo sapiens
ggagcatctgaacagggagaag

SEQ ID NO: 6930118 - DNA, 22 bp, Homo sapiens
agcaacagccctgaggttcatg

SEQ ID NO: 6930119 - DNA, 22 bp, Homo sapiens
gtttcctgtgggaactcggctg

SEQ ID NO: 6930120 - DNA, 23 bp, Homo sapiens
tttgccattacttttaacggcag

SEQ ID NO: 6930121 - DNA, 22 bp, Homo sapiens
gaaatcaaacccttttctgata

SEQ ID NO: 6930122 - DNA, 22 bp, Homo sapiens
tgtacaatgctgaggtttgggg

SEQ ID NO: 6930123 - DNA, 22 bp, Homo sapiens
gttttgttcttgtccagggaaa

SEQ ID NO: 6930124 - DNA, 22 bp, Homo sapiens
gcaggtgtggatttgcatccag

SEQ ID NO: 6930125 - DNA, 22 bp, Homo sapiens
tagtggatgggtaaagtatttt

SEQ ID NO: 6930126 - DNA, 23 bp, Homo sapiens
ccaggcctctcagagggtgtgcc

SEQ ID NO: 6930127 - DNA, 22 bp, Homo sapiens
tacacatatgtgtgtatatgtg

SEQ ID NO: 6930128 - DNA, 18 bp, Homo sapiens
gctcatttggatgggctt

SEQ ID NO: 6930129 - DNA, 21 bp, Homo sapiens
tagaaatcagctggtgcctct

SEQ ID NO: 6930130 - DNA, 22 bp, Homo sapiens
aattccaacagacaaagttaga

SEQ ID NO: 6930131 - DNA, 22 bp, Homo sapiens
aagttctttctggaaggtctgc

SEQ ID NO: 6930132 - DNA, 22 bp, Homo sapiens
tgtacaagcaaatagaccttca

SEQ ID NO: 6930133 - DNA, 22 bp, Homo sapiens
acacagagatgtaaagttaggc

SEQ ID NO: 6930134 - DNA, 22 bp, Homo sapiens
agagccaggctctacctgggtt

SEQ ID NO: 6930135 - DNA, 22 bp, Homo sapiens
ttgtccgtggtgagttcgcatt

SEQ ID NO: 6930136 - DNA, 22 bp, Homo sapiens
taggaacagtcctagaaatctg

SEQ ID NO: 6930137 - DNA, 22 bp, Homo sapiens
tattgcacatgcgctagaacca

SEQ ID NO: 6930138 - DNA, 22 bp, Homo sapiens
gtggctgcagtagtgtagggtc

SEQ ID NO: 6930139 - DNA, 22 bp, Homo sapiens
tgcctgtcctgaggatgagggt

SEQ ID NO: 6930140 - DNA, 22 bp, Homo sapiens
agtgatcagctagatctacttg

SEQ ID NO: 6930141 - DNA, 22 bp, Homo sapiens
caaaagttattgcggtttttgc

SEQ ID NO: 6930142 - DNA, 22 bp, Homo sapiens
ttcatgtttgcctatttgactt

SEQ ID NO: 6930143 - DNA, 19 bp, Homo sapiens
tgtcaaaggaatttattct

SEQ ID NO: 6930144 - DNA, 22 bp, Homo sapiens
aggtggggctgggaaagattcc

SEQ ID NO: 6930145 - DNA, 22 bp, Homo sapiens
gtctggaagtgtcttgttaagt

SEQ ID NO: 6930146 - DNA, 20 bp, Homo sapiens
cagtttacaacataaattgt

SEQ ID NO: 6930147 - DNA, 22 bp, Homo sapiens
ttgggaaattactctgctagga

SEQ ID NO: 6930148 - DNA, 22 bp, Homo sapiens
gaggaggcactagttagtgaca

SEQ ID NO: 6930149 - DNA, 22 bp, Homo sapiens
tgaactcctgacctcatgatcc

SEQ ID NO: 6930150 - DNA, 22 bp, Homo sapiens
ggcattcaaagaatggtaatta

SEQ ID NO: 6930151 - DNA, 22 bp, Homo sapiens
ctgctgctgactcatcccagct

SEQ ID NO: 6930152 - DNA, 22 bp, Homo sapiens
tgctggcatggtcttggtgaca

SEQ ID NO: 6930153 - DNA, 22 bp, Homo sapiens
cgtgtctgggctcccatggcag

SEQ ID NO: 6930154 - DNA, 22 bp, Homo sapiens
atcaggctagtgtgtgtgttca

SEQ ID NO: 6930155 - DNA, 22 bp, Homo sapiens
ggtggctgcaccctggctaact

SEQ ID NO: 6930156 - DNA, 22 bp, Homo sapiens
tgagggacttgctagttctctg

SEQ ID NO: 6930157 - DNA, 22 bp, Homo sapiens
tcgaaggaggcactcagacatg

SEQ ID NO: 6930158 - DNA, 22 bp, Homo sapiens
tccaggaaacactcaagccatg

SEQ ID NO: 6930159 - DNA, 22 bp, Homo sapiens
ttacaagcagctacatatcaca

SEQ ID NO: 6930160 - DNA, 22 bp, Homo sapiens
gtggcactggtagttttaagat

SEQ ID NO: 6930161 - DNA, 22 bp, Homo sapiens
tagttctctattcaaggatcaa

SEQ ID NO: 6930162 - DNA, 22 bp, Homo sapiens
ctctgagaggatcctgcccggg

SEQ ID NO: 6930163 - DNA, 22 bp, Homo sapiens
aggcaccagtaagagtagaact

SEQ ID NO: 6930164 - DNA, 22 bp, Homo sapiens
gtagggactgttctcacctgag

SEQ ID NO: 6930165 - DNA, 22 bp, Homo sapiens
tggctagcactctacctttctc

SEQ ID NO: 6930166 - DNA, 22 bp, Homo sapiens
cccaggcagcctgcagggaagg

SEQ ID NO: 6930167 - DNA, 22 bp, Homo sapiens
ggtcactgtctgaggtactgga

SEQ ID NO: 6930168 - DNA, 22 bp, Homo sapiens
tgagaattttcagtttcacttt

SEQ ID NO: 6930169 - DNA, 22 bp, Homo sapiens
agaaaacttgtcacagctctca

SEQ ID NO: 6930170 - DNA, 22 bp, Homo sapiens
gtgcagtccctcctcccaaggc

SEQ ID NO: 6930171 - DNA, 22 bp, Homo sapiens
aattctgatccagaacctgtca

SEQ ID NO: 6930172 - DNA, 22 bp, Homo sapiens
ggtggctctccctggactcagc

SEQ ID NO: 6930173 - DNA, 22 bp, Homo sapiens
agtctgtcacttcaggggggga

SEQ ID NO: 6930174 - DNA, 22 bp, Homo sapiens
atcagtttgtatatgaaacact

SEQ ID NO: 6930175 - DNA, 22 bp, Homo sapiens
ctgctttaatgtaagatatacc

SEQ ID NO: 6930176 - DNA, 22 bp, Homo sapiens
atggtaggtacaacagcaggca

SEQ ID NO: 6930177 - DNA, 22 bp, Homo sapiens
ctggctggggtccatcctctaa

SEQ ID NO: 6930178 - DNA, 22 bp, Homo sapiens
gtattctgggccgattacaaaa

SEQ ID NO: 6930179 - DNA, 22 bp, Homo sapiens
actctgcttattgctgcaggca

SEQ ID NO: 6930180 - DNA, 22 bp, Homo sapiens
tgtgtccaacccagggacaagt

SEQ ID NO: 6930181 - DNA, 22 bp, Homo sapiens
agagagctctggctgggtgacc

SEQ ID NO: 6930182 - DNA, 22 bp, Homo sapiens
tcagtcttctagcaaatccagg

SEQ ID NO: 6930183 - DNA, 23 bp, Homo sapiens
taattttagccttacaggaccct

SEQ ID NO: 6930184 - DNA, 22 bp, Homo sapiens
attgaatgtctactatgtgcaa

SEQ ID NO: 6930185 - DNA, 22 bp, Homo sapiens
gcctgctttaagtctgttgcct

SEQ ID NO: 6930186 - DNA, 22 bp, Homo sapiens
ttcttcaaatagcagggagtca

SEQ ID NO: 6930187 - DNA, 19 bp, Homo sapiens
ctggtctgctgcttccagg

SEQ ID NO: 6930188 - DNA, 22 bp, Homo sapiens
ctgttagtgatcaaagggagag

SEQ ID NO: 6930189 - DNA, 22 bp, Homo sapiens
gtttacatgtttttctcttaca

SEQ ID NO: 6930190 - DNA, 22 bp, Homo sapiens
tcaggaaaggtttgttgaatgg

SEQ ID NO: 6930191 - DNA, 22 bp, Homo sapiens
agtcagctggatactcttgtag

SEQ ID NO: 6930192 - DNA, 18 bp, Homo sapiens
cctcagggagatccagtg

SEQ ID NO: 6930193 - DNA, 22 bp, Homo sapiens
atactagactgttctgttatca

SEQ ID NO: 6930194 - DNA, 22 bp, Homo sapiens
gtaaacattttcatctgtgccc

SEQ ID NO: 6930195 - DNA, 22 bp, Homo sapiens
caggaggcatcatggagcggac

SEQ ID NO: 6930196 - DNA, 22 bp, Homo sapiens
aggaagctaaccagggagtgag

SEQ ID NO: 6930197 - DNA, 22 bp, Homo sapiens
gagacctgagtcaccctgtctg

SEQ ID NO: 6930198 - DNA, 22 bp, Homo sapiens
atgtcacttttctccctgctgg

SEQ ID NO: 6930199 - DNA, 22 bp, Homo sapiens
agtagattttagattacatagt

SEQ ID NO: 6930200 - DNA, 21 bp, Homo sapiens
aggagttgagtgcacagttgg

SEQ ID NO: 6930201 - DNA, 22 bp, Homo sapiens
tcaagaaactgtgctacagagt

SEQ ID NO: 6930202 - DNA, 22 bp, Homo sapiens
tacaatgttcctagcaggaaag

SEQ ID NO: 6930203 - DNA, 22 bp, Homo sapiens
gtccccagagctggtggtggtt

SEQ ID NO: 6930204 - DNA, 22 bp, Homo sapiens
tggcttgctactgaggtgtcag

SEQ ID NO: 6930205 - DNA, 22 bp, Homo sapiens
tcttccttgtaagggctttaga

SEQ ID NO: 6930206 - DNA, 23 bp, Homo sapiens
tgtctcagactgaggggtttccc

SEQ ID NO: 6930207 - DNA, 22 bp, Homo sapiens
cagagcttctgacagctgctgc

SEQ ID NO: 6930208 - DNA, 22 bp, Homo sapiens
aaagttcactgaccagcactgg

SEQ ID NO: 6930209 - DNA, 22 bp, Homo sapiens
tttgggattttacattgtatgg

SEQ ID NO: 6930210 - DNA, 22 bp, Homo sapiens
tcctttgttgagataaattggg

SEQ ID NO: 6930211 - DNA, 22 bp, Homo sapiens
ttcttcagtgacaaaggcaaaa

SEQ ID NO: 6930212 - DNA, 22 bp, Homo sapiens
gacacattgatgtgagtacata

SEQ ID NO: 6930213 - DNA, 22 bp, Homo sapiens
ggtcattatagtggggaggtgg

SEQ ID NO: 6930214 - DNA, 22 bp, Homo sapiens
tgaccctgcttcttggtgcagg

SEQ ID NO: 6930215 - DNA, 22 bp, Homo sapiens
tgtgagagaagtgtgtgctccc

SEQ ID NO: 6930216 - DNA, 22 bp, Homo sapiens
tctctatagactgtggataaaa

SEQ ID NO: 6930217 - DNA, 22 bp, Homo sapiens
actgggcctgtacagagaaaac

SEQ ID NO: 6930218 - DNA, 22 bp, Homo sapiens
gttaaataacctcatgtccgtt

SEQ ID NO: 6930219 - DNA, 22 bp, Homo sapiens
tctcagactatagtagagattc

SEQ ID NO: 6930220 - DNA, 22 bp, Homo sapiens
tagggctggcgtgctcagggaa

SEQ ID NO: 6930221 - DNA, 22 bp, Homo sapiens
acttcagaaaatgttgaatgtt

SEQ ID NO: 6930222 - DNA, 22 bp, Homo sapiens
tggtcattgatagtgcagggaa

SEQ ID NO: 6930223 - DNA, 22 bp, Homo sapiens
cagctgcccaagccccagatgt

SEQ ID NO: 6930224 - DNA, 22 bp, Homo sapiens
tgccggatgtggttgtaagtca

SEQ ID NO: 6930225 - DNA, 22 bp, Homo sapiens
aagatgatagatctgtcaatgt

SEQ ID NO: 6930226 - DNA, 22 bp, Homo sapiens
ttctccagcctattggcctatc

SEQ ID NO: 6930227 - DNA, 22 bp, Homo sapiens
acagctcttcttcaagcctggc

SEQ ID NO: 6930228 - DNA, 22 bp, Homo sapiens
tctcttggtacacagatgatca

SEQ ID NO: 6930229 - DNA, 22 bp, Homo sapiens
tacagaatctatgcttcacagt

SEQ ID NO: 6930230 - DNA, 22 bp, Homo sapiens
tgtcctcgctgagcatcttata

SEQ ID NO: 6930231 - DNA, 22 bp, Homo sapiens
agctttggatttcttatagccc

SEQ ID NO: 6930232 - DNA, 22 bp, Homo sapiens
agcagctcgggctacagagggg

SEQ ID NO: 6930233 - DNA, 22 bp, Homo sapiens
atcaaagaaggagaggttcctg

SEQ ID NO: 6930234 - DNA, 22 bp, Homo sapiens
agttccaaatggtccttgaaga

SEQ ID NO: 6930235 - DNA, 22 bp, Homo sapiens
tatatgtagtcagtcagagtaa

SEQ ID NO: 6930236 - DNA, 22 bp, Homo sapiens
ggtgtcaaaataccatttcagg

SEQ ID NO: 6930237 - DNA, 22 bp, Homo sapiens
ttcacataatcctccagtggca

SEQ ID NO: 6930238 - DNA, 22 bp, Homo sapiens
gcccatgaggtggaggctgcag

SEQ ID NO: 6930239 - DNA, 19 bp, Homo sapiens
agtgtcctagtcatttgcc

SEQ ID NO: 6930240 - DNA, 19 bp, Homo sapiens
agaatcaggtcaggtgaca

SEQ ID NO: 6930241 - DNA, 22 bp, Homo sapiens
agactctgctaagaatataatt

SEQ ID NO: 6930242 - DNA, 22 bp, Homo sapiens
ccctttctccagaactgtctga

SEQ ID NO: 6930243 - DNA, 22 bp, Homo sapiens
ggtctagagtggggcctggaaa

SEQ ID NO: 6930244 - DNA, 22 bp, Homo sapiens
agatctgaatctcatccgagga

SEQ ID NO: 6930245 - DNA, 22 bp, Homo sapiens
tcctttgtggaaatacttgtgg

SEQ ID NO: 6930246 - DNA, 22 bp, Homo sapiens
catttctgggagacatgctaga

SEQ ID NO: 6930247 - DNA, 22 bp, Homo sapiens
ttgggagaaatagttgatccgc

SEQ ID NO: 6930248 - DNA, 22 bp, Homo sapiens
ttgtcactagtgaagaatcagg

SEQ ID NO: 6930249 - DNA, 22 bp, Homo sapiens
agtcacatggactcaggatgac

SEQ ID NO: 6930250 - DNA, 22 bp, Homo sapiens
aggtccagaggttgaacggtgg

SEQ ID NO: 6930251 - DNA, 22 bp, Homo sapiens
gaccttgtaaattttcactcca

SEQ ID NO: 6930252 - DNA, 22 bp, Homo sapiens
cagcctgtctgggcagagtgga

SEQ ID NO: 6930253 - DNA, 22 bp, Homo sapiens
tacatgcatgtcacagaatgaa

SEQ ID NO: 6930254 - DNA, 22 bp, Homo sapiens
agggatcacggtggacttggat

SEQ ID NO: 6930255 - DNA, 22 bp, Homo sapiens
gtcccataagtagtgcaacttg

SEQ ID NO: 6930256 - DNA, 22 bp, Homo sapiens
gggtgcagggtctccagcagct

SEQ ID NO: 6930257 - DNA, 22 bp, Homo sapiens
agcaggtgcgttacttcactct

SEQ ID NO: 6930258 - DNA, 22 bp, Homo sapiens
gcaggtggttaaggtcccatgt

SEQ ID NO: 6930259 - DNA, 22 bp, Homo sapiens
gttttagataaagctgtccttg

SEQ ID NO: 6930260 - DNA, 22 bp, Homo sapiens
cttggagattcattgcctgaaa

SEQ ID NO: 6930261 - DNA, 22 bp, Homo sapiens
cctttgtgcatctctgctccta

SEQ ID NO: 6930262 - DNA, 22 bp, Homo sapiens
tgaggcagttgagcttcctgag

SEQ ID NO: 6930263 - DNA, 22 bp, Homo sapiens
agccagtttaagcaggaggggt

SEQ ID NO: 6930264 - DNA, 22 bp, Homo sapiens
gtctttctgctgcacggactgc

SEQ ID NO: 6930265 - DNA, 22 bp, Homo sapiens
gagccagggagggtctggtata

SEQ ID NO: 6930266 - DNA, 22 bp, Homo sapiens
taagttatcggagtgtgtttca

SEQ ID NO: 6930267 - DNA, 22 bp, Homo sapiens
agtttggaagaatttggtctgt

SEQ ID NO: 6930268 - DNA, 22 bp, Homo sapiens
aagttcttggaggatgaagagt

SEQ ID NO: 6930269 - DNA, 22 bp, Homo sapiens
aatgctctctgccatagctaac

SEQ ID NO: 6930270 - DNA, 22 bp, Homo sapiens
actctgcttgcccaatggaaac

SEQ ID NO: 6930271 - DNA, 22 bp, Homo sapiens
ttcattgtctctgtttgccttc

SEQ ID NO: 6930272 - DNA, 17 bp, Homo sapiens
aatctgtttacagtcag

SEQ ID NO: 6930273 - DNA, 22 bp, Homo sapiens
ctggaggcaaagcagaggcatg

SEQ ID NO: 6930274 - DNA, 22 bp, Homo sapiens
tcatcagaatcagggctttgaa

SEQ ID NO: 6930275 - DNA, 22 bp, Homo sapiens
ctggcctgaggtcggctgtagg

SEQ ID NO: 6930276 - DNA, 22 bp, Homo sapiens
agattcagttaaggctggtaga

SEQ ID NO: 6930277 - DNA, 22 bp, Homo sapiens
tcttcttccagcaggtgaggag

SEQ ID NO: 6930278 - DNA, 22 bp, Homo sapiens
ttgaccactgaatggttctgaa

SEQ ID NO: 6930279 - DNA, 22 bp, Homo sapiens
agtgttttgctaatcctattaa

SEQ ID NO: 6930280 - DNA, 22 bp, Homo sapiens
agtaatgggttgaaatttagtt

SEQ ID NO: 6930281 - DNA, 22 bp, Homo sapiens
agacaggcttggaaaaaacctc

SEQ ID NO: 6930282 - DNA, 22 bp, Homo sapiens
tgtcataacttagtgacaaatc

SEQ ID NO: 6930283 - DNA, 20 bp, Homo sapiens
agtgagttatcagctacagt

SEQ ID NO: 6930284 - DNA, 21 bp, Homo sapiens
tctggagtcatctttaccata

SEQ ID NO: 6930285 - DNA, 22 bp, Homo sapiens
agacattatgctgagtgaaaga

SEQ ID NO: 6930286 - DNA, 21 bp, Homo sapiens
gagatttagaaggatcaattt

SEQ ID NO: 6930287 - DNA, 18 bp, Homo sapiens
gctgcaggccctccgagg

SEQ ID NO: 6930288 - DNA, 21 bp, Homo sapiens
ctcagggccatcttgccactg

SEQ ID NO: 6930289 - DNA, 21 bp, Homo sapiens
tctttcctgcccagttgccct

SEQ ID NO: 6930290 - DNA, 23 bp, Homo sapiens
acagcttgccaattagccttccg

SEQ ID NO: 6930291 - DNA, 22 bp, Homo sapiens
aaacatctggaggccccgtttg

SEQ ID NO: 6930292 - DNA, 22 bp, Homo sapiens
ctgcctgaactgggtgagcaag

SEQ ID NO: 6930293 - DNA, 22 bp, Homo sapiens
cggagctgcgccgggacacggg

SEQ ID NO: 6930294 - DNA, 22 bp, Homo sapiens
taatgatatttcccatttctct

SEQ ID NO: 6930295 - DNA, 22 bp, Homo sapiens
ctaggagaatattatagtagtg

SEQ ID NO: 6930296 - DNA, 22 bp, Homo sapiens
tatgtgtttgacaccctgcaag

SEQ ID NO: 6930297 - DNA, 22 bp, Homo sapiens
tttcccttgaataaagatatct

SEQ ID NO: 6930298 - DNA, 22 bp, Homo sapiens
attattggacacttcttctgca

SEQ ID NO: 6930299 - DNA, 21 bp, Homo sapiens
cagtgaggccctcctgttccc

SEQ ID NO: 6930300 - DNA, 22 bp, Homo sapiens
agacgtcaaatgcagttatcaa

SEQ ID NO: 6930301 - DNA, 22 bp, Homo sapiens
taccctgctagctagcatctct

SEQ ID NO: 6930302 - DNA, 22 bp, Homo sapiens
aggtgaggataggtggccaagg

SEQ ID NO: 6930303 - DNA, 22 bp, Homo sapiens
tgcttgtagcaatacacaagtt

SEQ ID NO: 6930304 - DNA, 22 bp, Homo sapiens
ctgccccctgctttgtccttga

SEQ ID NO: 6930305 - DNA, 22 bp, Homo sapiens
ttggaacacaatgtttctttca

SEQ ID NO: 6930306 - DNA, 22 bp, Homo sapiens
tgatctttggtaatctggcaca

SEQ ID NO: 6930307 - DNA, 22 bp, Homo sapiens
ttacagctagccaattatttag

SEQ ID NO: 6930308 - DNA, 22 bp, Homo sapiens
ttctttgaccaaacagttttcc

SEQ ID NO: 6930309 - DNA, 22 bp, Homo sapiens
cctgctttgagatgggcagcag

SEQ ID NO: 6930310 - DNA, 22 bp, Homo sapiens
taagtttatagataaatgccta

SEQ ID NO: 6930311 - DNA, 22 bp, Homo sapiens
gacttgaatcccaactcctctc

SEQ ID NO: 6930312 - DNA, 22 bp, Homo sapiens
ctggcatgaaatggcatctcat

SEQ ID NO: 6930313 - DNA, 22 bp, Homo sapiens
cagtgaggctctgctgagcggt

SEQ ID NO: 6930314 - DNA, 22 bp, Homo sapiens
tcccaagaggggttattatgcc

SEQ ID NO: 6930315 - DNA, 22 bp, Homo sapiens
taaattagagccaggtaagttt

SEQ ID NO: 6930316 - DNA, 22 bp, Homo sapiens
gaagaacacttcatgattcatt

SEQ ID NO: 6930317 - DNA, 22 bp, Homo sapiens
gtagtgctttcatctggagtgt

SEQ ID NO: 6930318 - DNA, 18 bp, Homo sapiens
tctgtggcagcagtgcac

SEQ ID NO: 6930319 - DNA, 22 bp, Homo sapiens
agctatggtaatcatccaccaa

SEQ ID NO: 6930320 - DNA, 22 bp, Homo sapiens
ctcctcactttccagactgggc

SEQ ID NO: 6930321 - DNA, 22 bp, Homo sapiens
ggcagcaattcttcagaatcat

SEQ ID NO: 6930322 - DNA, 22 bp, Homo sapiens
actgtggagaaagaaagactgc

SEQ ID NO: 6930323 - DNA, 22 bp, Homo sapiens
tgaggtaggttgaaagatagat

SEQ ID NO: 6930324 - DNA, 22 bp, Homo sapiens
gcagcaggcacttaccgttgct

SEQ ID NO: 6930325 - DNA, 22 bp, Homo sapiens
tgtttaatctataaaatggaga

SEQ ID NO: 6930326 - DNA, 22 bp, Homo sapiens
atgccaagcttcagctgaaact

SEQ ID NO: 6930327 - DNA, 22 bp, Homo sapiens
cactgcagtaactctaggactg

SEQ ID NO: 6930328 - DNA, 22 bp, Homo sapiens
aagactagtgaaacatcaaact

SEQ ID NO: 6930329 - DNA, 22 bp, Homo sapiens
aacatgcccgctgtatgccatt

SEQ ID NO: 6930330 - DNA, 22 bp, Homo sapiens
tttgtcaagtttgcaaatacgt

SEQ ID NO: 6930331 - DNA, 22 bp, Homo sapiens
agaagttatccaccttagatgc

SEQ ID NO: 6930332 - DNA, 22 bp, Homo sapiens
aagattgacggctttgagtgct

SEQ ID NO: 6930333 - DNA, 23 bp, Homo sapiens
cagaagacagtctcaagacaagg

SEQ ID NO: 6930334 - DNA, 22 bp, Homo sapiens
cataatccatttgcactgcaga

SEQ ID NO: 6930335 - DNA, 22 bp, Homo sapiens
ttgtaattgggtggtttgggac

SEQ ID NO: 6930336 - DNA, 22 bp, Homo sapiens
taggacagggacatctttttga

SEQ ID NO: 6930337 - DNA, 22 bp, Homo sapiens
tctggcaggatatcgaagtgaa

SEQ ID NO: 6930338 - DNA, 22 bp, Homo sapiens
ttagaaaaatgttcagtagttt

SEQ ID NO: 6930339 - DNA, 22 bp, Homo sapiens
ccctggccagctcatgtctgag

SEQ ID NO: 6930340 - DNA, 22 bp, Homo sapiens
ccttcctggctgtccgcctgat

SEQ ID NO: 6930341 - DNA, 22 bp, Homo sapiens
atagatacattgttatatttgt

SEQ ID NO: 6930342 - DNA, 18 bp, Homo sapiens
ctgtgggaagagtttggg

SEQ ID NO: 6930343 - DNA, 22 bp, Homo sapiens
atgtgggttgatggaggtgtca

SEQ ID NO: 6930344 - DNA, 22 bp, Homo sapiens
gagataactctaggtcttcgag

SEQ ID NO: 6930345 - DNA, 22 bp, Homo sapiens
tgcctgctatttgcctaaagtg

SEQ ID NO: 6930346 - DNA, 22 bp, Homo sapiens
tgcctgggaaccaatcctggct

SEQ ID NO: 6930347 - DNA, 22 bp, Homo sapiens
aactatactctgtaaatgtgct

SEQ ID NO: 6930348 - DNA, 22 bp, Homo sapiens
gtatacactggtaagatttgtc

SEQ ID NO: 6930349 - DNA, 22 bp, Homo sapiens
gaggacagctctaactaaagtc

SEQ ID NO: 6930350 - DNA, 22 bp, Homo sapiens
caggggctgtgggcggagcctc

SEQ ID NO: 6930351 - DNA, 22 bp, Homo sapiens
ttgtaaggtccttctgctgcag

SEQ ID NO: 6930352 - DNA, 22 bp, Homo sapiens
gtgctttaaaccactgtgctgt

SEQ ID NO: 6930353 - DNA, 22 bp, Homo sapiens
caattagaggaggaagctcata

SEQ ID NO: 6930354 - DNA, 22 bp, Homo sapiens
acaattcattaatgtgaggtag

SEQ ID NO: 6930355 - DNA, 22 bp, Homo sapiens
cagtggaaatattggcagcatc

SEQ ID NO: 6930356 - DNA, 21 bp, Homo sapiens
atcattctggaaaattcaagc

SEQ ID NO: 6930357 - DNA, 22 bp, Homo sapiens
actgtaattatctgaacgtgca

SEQ ID NO: 6930358 - DNA, 22 bp, Homo sapiens
gagttcagtgtttctagtagtg

SEQ ID NO: 6930359 - DNA, 22 bp, Homo sapiens
actgaaatactgctcttggatt

SEQ ID NO: 6930360 - DNA, 22 bp, Homo sapiens
gaagtctggctgacgagagtta

SEQ ID NO: 6930361 - DNA, 22 bp, Homo sapiens
attgaaaaatgactattgctta

SEQ ID NO: 6930362 - DNA, 22 bp, Homo sapiens
tctgccttgccgaattccaggc

SEQ ID NO: 6930363 - DNA, 22 bp, Homo sapiens
ggaaatataagcagtttgtgtg

SEQ ID NO: 6930364 - DNA, 22 bp, Homo sapiens
tgcagaacagggccatgtcacc

SEQ ID NO: 6930365 - DNA, 21 bp, Homo sapiens
agagtggcaaagtgtccaaga

SEQ ID NO: 6930366 - DNA, 23 bp, Homo sapiens
ggcccccggaacgctctgtgacc

SEQ ID NO: 6930367 - DNA, 22 bp, Homo sapiens
tctgagggtgaggcccagaatc

SEQ ID NO: 6930368 - DNA, 22 bp, Homo sapiens
tatttccaccctcagtaaggaa

SEQ ID NO: 6930369 - DNA, 20 bp, Homo sapiens
tcttggcaaatgggagtgtc

SEQ ID NO: 6930370 - DNA, 22 bp, Homo sapiens
catgttcagtgacagttattga

SEQ ID NO: 6930371 - DNA, 22 bp, Homo sapiens
ctggtgggagataattgaatca

SEQ ID NO: 6930372 - DNA, 23 bp, Homo sapiens
aggcaatgccctgctgagaactc

SEQ ID NO: 6930373 - DNA, 22 bp, Homo sapiens
ccacatctgcagtcccttctgt

SEQ ID NO: 6930374 - DNA, 22 bp, Homo sapiens
atttggaagcttgaagattatt

SEQ ID NO: 6930375 - DNA, 23 bp, Homo sapiens
agctcctgtaaggtggtcgtcac

SEQ ID NO: 6930376 - DNA, 22 bp, Homo sapiens
cacacacagttttgtattctgt

SEQ ID NO: 6930377 - DNA, 22 bp, Homo sapiens
tgctggctcagtttgcagactc

SEQ ID NO: 6930378 - DNA, 22 bp, Homo sapiens
ttaatcaccaagtgaccctgtg

SEQ ID NO: 6930379 - DNA, 19 bp, Homo sapiens
gctgaggtggaggaaggag

SEQ ID NO: 6930380 - DNA, 22 bp, Homo sapiens
tggcagttgagttactgggtga

SEQ ID NO: 6930381 - DNA, 22 bp, Homo sapiens
ccctcctgtgcctgaggccagc

SEQ ID NO: 6930382 - DNA, 22 bp, Homo sapiens
aattcttaatcccataaagtga

SEQ ID NO: 6930383 - DNA, 22 bp, Homo sapiens
tttggcacttggcagttgagtt

SEQ ID NO: 6930384 - DNA, 22 bp, Homo sapiens
tagcaagaggaaacaaggggcc

SEQ ID NO: 6930385 - DNA, 22 bp, Homo sapiens
tgggagcaggctgatgataggt

SEQ ID NO: 6930386 - DNA, 22 bp, Homo sapiens
tgtcatttggactttggtatta

SEQ ID NO: 6930387 - DNA, 22 bp, Homo sapiens
caactttctccaagtacaagaa

SEQ ID NO: 6930388 - DNA, 22 bp, Homo sapiens
aagtgcacttatagtaatatgt

SEQ ID NO: 6930389 - DNA, 20 bp, Homo sapiens
cttaacacttctttgccagt

SEQ ID NO: 6930390 - DNA, 22 bp, Homo sapiens
ttgtttcagctgtatgctatgt

SEQ ID NO: 6930391 - DNA, 22 bp, Homo sapiens
tactctgcaagttgaaggtggc

SEQ ID NO: 6930392 - DNA, 22 bp, Homo sapiens
agtccaggaagcatcatggtct

SEQ ID NO: 6930393 - DNA, 22 bp, Homo sapiens
agctgaccatgtttccagtggt

SEQ ID NO: 6930394 - DNA, 22 bp, Homo sapiens
ggtgccaggctcccagctcagg

SEQ ID NO: 6930395 - DNA, 22 bp, Homo sapiens
gtccacaagcaggaagtgagcc

SEQ ID NO: 6930396 - DNA, 22 bp, Homo sapiens
aactctcttgggagtacctgga

SEQ ID NO: 6930397 - DNA, 22 bp, Homo sapiens
gtggtcaggttatcagatcata

SEQ ID NO: 6930398 - DNA, 22 bp, Homo sapiens
aagagatgctttacatcggatg

SEQ ID NO: 6930399 - DNA, 22 bp, Homo sapiens
ttgtctaatgagctccacttca

SEQ ID NO: 6930400 - DNA, 23 bp, Homo sapiens
tgattttaaaaagtaagttatca

SEQ ID NO: 6930401 - DNA, 22 bp, Homo sapiens
aaatgtactgatacttatttta

SEQ ID NO: 6930402 - DNA, 22 bp, Homo sapiens
cagcacagtagagtagttgtaa

SEQ ID NO: 6930403 - DNA, 22 bp, Homo sapiens
agtgccaagtagaaatgaattt

SEQ ID NO: 6930404 - DNA, 22 bp, Homo sapiens
tttaactcatttctggcagttt

SEQ ID NO: 6930405 - DNA, 22 bp, Homo sapiens
gtgtacaaaatgtctccatgga

SEQ ID NO: 6930406 - DNA, 22 bp, Homo sapiens
ctgctcctccccatcaggcagc

SEQ ID NO: 6930407 - DNA, 18 bp, Homo sapiens
gtttcctgaggtgaaggg

SEQ ID NO: 6930408 - DNA, 19 bp, Homo sapiens
tatatttgagtgtgcatgc

SEQ ID NO: 6930409 - DNA, 23 bp, Homo sapiens
gcatccagagctcagtccccttt

SEQ ID NO: 6930410 - DNA, 22 bp, Homo sapiens
gctcacactctgaaatttaagc

SEQ ID NO: 6930411 - DNA, 22 bp, Homo sapiens
tcttaaactttgctgtaattct

SEQ ID NO: 6930412 - DNA, 22 bp, Homo sapiens
tgaaggcttttagctctgaaaa

SEQ ID NO: 6930413 - DNA, 22 bp, Homo sapiens
taataattagttattgatcgtg

SEQ ID NO: 6930414 - DNA, 22 bp, Homo sapiens
agccaaggtatcatgagaggca

SEQ ID NO: 6930415 - DNA, 22 bp, Homo sapiens
tcagtttctttactcatagaat

SEQ ID NO: 6930416 - DNA, 19 bp, Homo sapiens
tgtgcttatgtttagatat

SEQ ID NO: 6930417 - DNA, 22 bp, Homo sapiens
acattggtcaactgtatcttgg

SEQ ID NO: 6930418 - DNA, 22 bp, Homo sapiens
ttcactgttatgaagctctggg

SEQ ID NO: 6930419 - DNA, 22 bp, Homo sapiens
agatcaaatctgggatttctaa

SEQ ID NO: 6930420 - DNA, 22 bp, Homo sapiens
tactcattgattcctttactca

SEQ ID NO: 6930421 - DNA, 22 bp, Homo sapiens
tcaggacacttggcacaaggtc

SEQ ID NO: 6930422 - DNA, 22 bp, Homo sapiens
cccttagctggtgagcccagcg

SEQ ID NO: 6930423 - DNA, 21 bp, Homo sapiens
tgccagggatttacagagcct

SEQ ID NO: 6930424 - DNA, 22 bp, Homo sapiens
agatacaaggcagagatgtgca

SEQ ID NO: 6930425 - DNA, 22 bp, Homo sapiens
tggctcatctatcagaaagtcc

SEQ ID NO: 6930426 - DNA, 22 bp, Homo sapiens
caaatgctggccctgctactta

SEQ ID NO: 6930427 - DNA, 22 bp, Homo sapiens
caaatgcaggtcagcaggtgtc

SEQ ID NO: 6930428 - DNA, 19 bp, Homo sapiens
tttctaatgtgtttttctt

SEQ ID NO: 6930429 - DNA, 22 bp, Homo sapiens
agccaagagctcacctcgtgtg

SEQ ID NO: 6930430 - DNA, 22 bp, Homo sapiens
ttctgcaccaagcatagtgctg

SEQ ID NO: 6930431 - DNA, 22 bp, Homo sapiens
gctctgtgcagttcagggacac

SEQ ID NO: 6930432 - DNA, 22 bp, Homo sapiens
gtgccctgttgcacacttgagg

SEQ ID NO: 6930433 - DNA, 22 bp, Homo sapiens
ttcaaagaccttacttggcaaa

SEQ ID NO: 6930434 - DNA, 22 bp, Homo sapiens
atagacagaaagataatagaat

SEQ ID NO: 6930435 - DNA, 22 bp, Homo sapiens
accagcagagttgaggaggaca

SEQ ID NO: 6930436 - DNA, 22 bp, Homo sapiens
tctgggaactctgtcatttccc

SEQ ID NO: 6930437 - DNA, 22 bp, Homo sapiens
ctggcaggtctcgctgacgtgt

SEQ ID NO: 6930438 - DNA, 22 bp, Homo sapiens
agctgctcattactttctgttg

SEQ ID NO: 6930439 - DNA, 22 bp, Homo sapiens
ccatttgtaaccttagagcaat

SEQ ID NO: 6930440 - DNA, 22 bp, Homo sapiens
tgtggcaggatgcggaagatgc

SEQ ID NO: 6930441 - DNA, 22 bp, Homo sapiens
acttagaatatgttcaagattt

SEQ ID NO: 6930442 - DNA, 22 bp, Homo sapiens
aaaagtcttggggaaggccagg

SEQ ID NO: 6930443 - DNA, 22 bp, Homo sapiens
gggtcagctccctccccagggc

SEQ ID NO: 6930444 - DNA, 22 bp, Homo sapiens
aggcactaatggtagtggactg

SEQ ID NO: 6930445 - DNA, 22 bp, Homo sapiens
aaagttgtggtttgatgcagtt

SEQ ID NO: 6930446 - DNA, 21 bp, Homo sapiens
ggaatagcctccttgaactca

SEQ ID NO: 6930447 - DNA, 22 bp, Homo sapiens
ccctttcatattttataaatgg

SEQ ID NO: 6930448 - DNA, 22 bp, Homo sapiens
cagatcatgaatgactgacaga

SEQ ID NO: 6930449 - DNA, 22 bp, Homo sapiens
tggctgctagccagagcttcag

SEQ ID NO: 6930450 - DNA, 23 bp, Homo sapiens
cttcattgtagtgttggggagat

SEQ ID NO: 6930451 - DNA, 22 bp, Homo sapiens
ctctggtctcctgtagctacag

SEQ ID NO: 6930452 - DNA, 22 bp, Homo sapiens
acttatcacacactaaattagg

SEQ ID NO: 6930453 - DNA, 22 bp, Homo sapiens
tgtcagcaccatgggtagtgat

SEQ ID NO: 6930454 - DNA, 22 bp, Homo sapiens
ttagaggaattattttctgctg

SEQ ID NO: 6930455 - DNA, 20 bp, Homo sapiens
tacttgaatgttgcagcagt

SEQ ID NO: 6930456 - DNA, 22 bp, Homo sapiens
agtctagagattctgaagggaa

SEQ ID NO: 6930457 - DNA, 22 bp, Homo sapiens
tggaggtcgctagcgagcgggc

SEQ ID NO: 6930458 - DNA, 18 bp, Homo sapiens
tctgggcaatctcagtat

SEQ ID NO: 6930459 - DNA, 22 bp, Homo sapiens
cactgcctctgcctcctgggtt

SEQ ID NO: 6930460 - DNA, 22 bp, Homo sapiens
ttgtgtcctgatttgacacaat

SEQ ID NO: 6930461 - DNA, 22 bp, Homo sapiens
tacaatgaccatattatgtaag

SEQ ID NO: 6930462 - DNA, 22 bp, Homo sapiens
aggcccaatggctattgggtga

SEQ ID NO: 6930463 - DNA, 22 bp, Homo sapiens
tctggtttcaatgggtacgatt

SEQ ID NO: 6930464 - DNA, 22 bp, Homo sapiens
gctgtaggaatgacatgtacct

SEQ ID NO: 6930465 - DNA, 22 bp, Homo sapiens
tacagcttgatgtttgtgtgtt

SEQ ID NO: 6930466 - DNA, 22 bp, Homo sapiens
tctgaagagtcttgcaagaaag

SEQ ID NO: 6930467 - DNA, 22 bp, Homo sapiens
ctgggaaatggcttcgagctca

SEQ ID NO: 6930468 - DNA, 22 bp, Homo sapiens
ttataaaggtttgtgcatattt

SEQ ID NO: 6930469 - DNA, 22 bp, Homo sapiens
agtagggtgttgctataacaag

SEQ ID NO: 6930470 - DNA, 23 bp, Homo sapiens
aggatatgacttgtctgccaacc

SEQ ID NO: 6930471 - DNA, 22 bp, Homo sapiens
tgcgggatgacagtggccaaca

SEQ ID NO: 6930472 - DNA, 22 bp, Homo sapiens
ctctgggcacattttccaggac

SEQ ID NO: 6930473 - DNA, 22 bp, Homo sapiens
tgtatgaatgggaaaaggaaac

SEQ ID NO: 6930474 - DNA, 22 bp, Homo sapiens
taactgtatattaaggtggccc

SEQ ID NO: 6930475 - DNA, 22 bp, Homo sapiens
gaagaactgaaagttgatgcac

SEQ ID NO: 6930476 - DNA, 22 bp, Homo sapiens
ccctggcttggcactctccact

SEQ ID NO: 6930477 - DNA, 22 bp, Homo sapiens
agctgagctgcagatgactgta

SEQ ID NO: 6930478 - DNA, 22 bp, Homo sapiens
aagtgccagggacacttcttgt

SEQ ID NO: 6930479 - DNA, 22 bp, Homo sapiens
tagggatgtggtgagaactgag

SEQ ID NO: 6930480 - DNA, 21 bp, Homo sapiens
tatggtaaccagacaagaatg

SEQ ID NO: 6930481 - DNA, 22 bp, Homo sapiens
ttctgggtcacccttctgctca

SEQ ID NO: 6930482 - DNA, 22 bp, Homo sapiens
atttcagtgttggttagcaagc

SEQ ID NO: 6930483 - DNA, 22 bp, Homo sapiens
ggctgctcttcttggcgacctc

SEQ ID NO: 6930484 - DNA, 22 bp, Homo sapiens
tcctcttcagagggacctcggg

SEQ ID NO: 6930485 - DNA, 22 bp, Homo sapiens
aagccaggttccatggaggagc

SEQ ID NO: 6930486 - DNA, 22 bp, Homo sapiens
actgctctctttgcaggggcta

SEQ ID NO: 6930487 - DNA, 15 bp, Homo sapiens
tgctctaagatgagg

SEQ ID NO: 6930488 - DNA, 22 bp, Homo sapiens
tatgttacaaagtttttctaaa

SEQ ID NO: 6930489 - DNA, 22 bp, Homo sapiens
ttctccagacaggcagagggaa

SEQ ID NO: 6930490 - DNA, 22 bp, Homo sapiens
aggcagcgtagcaaggctagta

SEQ ID NO: 6930491 - DNA, 17 bp, Homo sapiens
gcccccagaaatctcag

SEQ ID NO: 6930492 - DNA, 22 bp, Homo sapiens
atgtctgcgttatatcaatatc

SEQ ID NO: 6930493 - DNA, 20 bp, Homo sapiens
gctcccagcctgcagtcccc

SEQ ID NO: 6930494 - DNA, 22 bp, Homo sapiens
ttacagtcagcttacattagtt

SEQ ID NO: 6930495 - DNA, 22 bp, Homo sapiens
agcaatgactaaggcactttgg

SEQ ID NO: 6930496 - DNA, 22 bp, Homo sapiens
tccattaatgattatttctgtg

SEQ ID NO: 6930497 - DNA, 22 bp, Homo sapiens
gatggtggcaagagccaagtct

SEQ ID NO: 6930498 - DNA, 22 bp, Homo sapiens
tctaagtttggtgattaccaat

SEQ ID NO: 6930499 - DNA, 22 bp, Homo sapiens
tttcctggccaaatgctttgtg

SEQ ID NO: 6930500 - DNA, 22 bp, Homo sapiens
gactcagtgatttgacatgcct

SEQ ID NO: 6930501 - DNA, 22 bp, Homo sapiens
aaacacaatgtttctttgttct

SEQ ID NO: 6930502 - DNA, 22 bp, Homo sapiens
ctgcccgctgctagagaggccg

SEQ ID NO: 6930503 - DNA, 22 bp, Homo sapiens
atgtccagccaaccactggatt

SEQ ID NO: 6930504 - DNA, 22 bp, Homo sapiens
tcagccagctgtgtgcttctgc

SEQ ID NO: 6930505 - DNA, 22 bp, Homo sapiens
tacatttccttgactcctcaac

SEQ ID NO: 6930506 - DNA, 22 bp, Homo sapiens
aaagtagcccttctggaattta

SEQ ID NO: 6930507 - DNA, 22 bp, Homo sapiens
ggagttggtggcccggaatctc

SEQ ID NO: 6930508 - DNA, 22 bp, Homo sapiens
acttgttgccctcctgaaaatt

SEQ ID NO: 6930509 - DNA, 22 bp, Homo sapiens
tttaaatggcattttcccagat

SEQ ID NO: 6930510 - DNA, 22 bp, Homo sapiens
ccttccaggttttggctccatt

SEQ ID NO: 6930511 - DNA, 22 bp, Homo sapiens
ctcttttaattgtcataacaac

SEQ ID NO: 6930512 - DNA, 22 bp, Homo sapiens
cagaagtttgcaattgtttatt

SEQ ID NO: 6930513 - DNA, 22 bp, Homo sapiens
ccctctcgcggggcagcggagg

SEQ ID NO: 6930514 - DNA, 22 bp, Homo sapiens
cgtgcggttagacaggtaccgg

SEQ ID NO: 6930515 - DNA, 22 bp, Homo sapiens
ctctggttgagtgagaaccaag

SEQ ID NO: 6930516 - DNA, 22 bp, Homo sapiens
tcaggcaccctctattttcatc

SEQ ID NO: 6930517 - DNA, 22 bp, Homo sapiens
gtcatgagggacccgttattta

SEQ ID NO: 6930518 - DNA, 22 bp, Homo sapiens
ctgagcgacaagtagcttttga

SEQ ID NO: 6930519 - DNA, 22 bp, Homo sapiens
attccttgcacatcagatagtt

SEQ ID NO: 6930520 - DNA, 21 bp, Homo sapiens
tgtgactgttgcatttgtcgt

SEQ ID NO: 6930521 - DNA, 22 bp, Homo sapiens
tcctgaggactaacaggaagga

SEQ ID NO: 6930522 - DNA, 22 bp, Homo sapiens
tgtcagatgtgtctccaagtgc

SEQ ID NO: 6930523 - DNA, 22 bp, Homo sapiens
gcaggctaatggaaatgcactg

SEQ ID NO: 6930524 - DNA, 20 bp, Homo sapiens
cacatgctgtgtgtttctct

SEQ ID NO: 6930525 - DNA, 22 bp, Homo sapiens
aaaaatgtcattatggaactga

SEQ ID NO: 6930526 - DNA, 22 bp, Homo sapiens
taggaaaatatctcttattggg

SEQ ID NO: 6930527 - DNA, 22 bp, Homo sapiens
acagtgtttaaaaatcagatct

SEQ ID NO: 6930528 - DNA, 22 bp, Homo sapiens
gacagcagaatccattcccagt

SEQ ID NO: 6930529 - DNA, 22 bp, Homo sapiens
ttcagagctggtgtctacagct

SEQ ID NO: 6930530 - DNA, 22 bp, Homo sapiens
aggattctgacttaggaggttt

SEQ ID NO: 6930531 - DNA, 22 bp, Homo sapiens
tgtatctgacagtggagcggag

SEQ ID NO: 6930532 - DNA, 22 bp, Homo sapiens
tttctgcagcagactcagtgtg

SEQ ID NO: 6930533 - DNA, 21 bp, Homo sapiens
tggtgacccctgtctgttccc

SEQ ID NO: 6930534 - DNA, 20 bp, Homo sapiens
aggtgcaagcagtaaattgc

SEQ ID NO: 6930535 - DNA, 22 bp, Homo sapiens
ctgttgctccagggaacacaga

SEQ ID NO: 6930536 - DNA, 22 bp, Homo sapiens
gagggagaaggactatcaggct

SEQ ID NO: 6930537 - DNA, 22 bp, Homo sapiens
tccccagggtccctgcttccat

SEQ ID NO: 6930538 - DNA, 22 bp, Homo sapiens
tttccagtctctgcctccaagg

SEQ ID NO: 6930539 - DNA, 22 bp, Homo sapiens
gagctctctggggagatgggat

SEQ ID NO: 6930540 - DNA, 22 bp, Homo sapiens
aatgtattttgggagtttcttt

SEQ ID NO: 6930541 - DNA, 22 bp, Homo sapiens
cctcagactcagtgcgttgtga

SEQ ID NO: 6930542 - DNA, 22 bp, Homo sapiens
ggctggactttttgcaggtcat

SEQ ID NO: 6930543 - DNA, 21 bp, Homo sapiens
tgtcattaatcgctatagaag

SEQ ID NO: 6930544 - DNA, 23 bp, Homo sapiens
tatgccaaaatggaaagtgtata

SEQ ID NO: 6930545 - DNA, 22 bp, Homo sapiens
gcgggcagggcactggtcccct

SEQ ID NO: 6930546 - DNA, 22 bp, Homo sapiens
gactttaagtaagtcaaggagc

SEQ ID NO: 6930547 - DNA, 22 bp, Homo sapiens
ttggcctattccagcagctgtg

SEQ ID NO: 6930548 - DNA, 22 bp, Homo sapiens
tctcatgcatgcataagtctag

SEQ ID NO: 6930549 - DNA, 22 bp, Homo sapiens
gctctgtccagcgtgcacagaa

SEQ ID NO: 6930550 - DNA, 22 bp, Homo sapiens
ttgatgcactatgtaacttaca

SEQ ID NO: 6930551 - DNA, 22 bp, Homo sapiens
cctctcccgggtgccgctgggc

SEQ ID NO: 6930552 - DNA, 22 bp, Homo sapiens
gtgaacatcagattacatgaga

SEQ ID NO: 6930553 - DNA, 22 bp, Homo sapiens
gcaggcaccacggctcaggtct

SEQ ID NO: 6930554 - DNA, 22 bp, Homo sapiens
acttaaagtagttttactgtgg

SEQ ID NO: 6930555 - DNA, 23 bp, Homo sapiens
agaaagtttgtgccttgtgacac

SEQ ID NO: 6930556 - DNA, 22 bp, Homo sapiens
gccccagctctgccacaactag

SEQ ID NO: 6930557 - DNA, 22 bp, Homo sapiens
acactacagggccgggatggaa

SEQ ID NO: 6930558 - DNA, 22 bp, Homo sapiens
actgaacacttttgaaagatta

SEQ ID NO: 6930559 - DNA, 23 bp, Homo sapiens
atgcaggacttataaggtaaggt

SEQ ID NO: 6930560 - DNA, 22 bp, Homo sapiens
ggagctgaggctgaggcctcac

SEQ ID NO: 6930561 - DNA, 22 bp, Homo sapiens
atctactgtgctttaaatagac

SEQ ID NO: 6930562 - DNA, 22 bp, Homo sapiens
cacccagacatgtggtcccaga

SEQ ID NO: 6930563 - DNA, 22 bp, Homo sapiens
tatgtctctgaaccttagcaag

SEQ ID NO: 6930564 - DNA, 22 bp, Homo sapiens
aagctgtgaaatctctagtgca

SEQ ID NO: 6930565 - DNA, 22 bp, Homo sapiens
tcctcacagctggttcattcag

SEQ ID NO: 6930566 - DNA, 22 bp, Homo sapiens
agttttatctgtaagctgttca

SEQ ID NO: 6930567 - DNA, 22 bp, Homo sapiens
ttacatgtattttggaaaaagt

SEQ ID NO: 6930568 - DNA, 22 bp, Homo sapiens
gtctggagccccagtcaatgag

SEQ ID NO: 6930569 - DNA, 22 bp, Homo sapiens
gtgaagataaggatgctgcagt

SEQ ID NO: 6930570 - DNA, 22 bp, Homo sapiens
cgcagctgcacggggctgagcc

SEQ ID NO: 6930571 - DNA, 22 bp, Homo sapiens
agcttgctgtattttctggagg

SEQ ID NO: 6930572 - DNA, 22 bp, Homo sapiens
gttgggaagtatccccaaagtt

SEQ ID NO: 6930573 - DNA, 21 bp, Homo sapiens
ccagtgattcaatgaaaacag

SEQ ID NO: 6930574 - DNA, 22 bp, Homo sapiens
gctcttatagtcccagcatgtt

SEQ ID NO: 6930575 - DNA, 22 bp, Homo sapiens
tttgctgtgggatatccatgtg

SEQ ID NO: 6930576 - DNA, 22 bp, Homo sapiens
gggcacaaaatttcagaaagct

SEQ ID NO: 6930577 - DNA, 20 bp, Homo sapiens
gggatcaggaaaggaggcta

SEQ ID NO: 6930578 - DNA, 22 bp, Homo sapiens
cactgcccaccaagtggctggt

SEQ ID NO: 6930579 - DNA, 22 bp, Homo sapiens
tgtatacatgtgttcatgcatg

SEQ ID NO: 6930580 - DNA, 23 bp, Homo sapiens
ggacaatcaagtttcacttatgc

SEQ ID NO: 6930581 - DNA, 17 bp, Homo sapiens
tgtagcttctccttctc

SEQ ID NO: 6930582 - DNA, 22 bp, Homo sapiens
tggctgcctagtccctcagcct

SEQ ID NO: 6930583 - DNA, 22 bp, Homo sapiens
cagtgggtatttactgattcct

SEQ ID NO: 6930584 - DNA, 22 bp, Homo sapiens
agatatgcttgaagacaggaca

SEQ ID NO: 6930585 - DNA, 22 bp, Homo sapiens
ctctgaaattggccctcagcag

SEQ ID NO: 6930586 - DNA, 22 bp, Homo sapiens
agcagtttgaatcaatggccag

SEQ ID NO: 6930587 - DNA, 22 bp, Homo sapiens
tggtccattcttgttcagcatt

SEQ ID NO: 6930588 - DNA, 22 bp, Homo sapiens
atgaccagtgttgctggccccg

SEQ ID NO: 6930589 - DNA, 22 bp, Homo sapiens
aatagttagcttagttctgtat

SEQ ID NO: 6930590 - DNA, 22 bp, Homo sapiens
tcctctgaaatctagattgtga

SEQ ID NO: 6930591 - DNA, 22 bp, Homo sapiens
acagtatgctttaaactttgtt

SEQ ID NO: 6930592 - DNA, 22 bp, Homo sapiens
tttagccaactatatgactagt

SEQ ID NO: 6930593 - DNA, 22 bp, Homo sapiens
ttacatgccattttgaaatcag

SEQ ID NO: 6930594 - DNA, 19 bp, Homo sapiens
tgagacagaagatgagcct

SEQ ID NO: 6930595 - DNA, 22 bp, Homo sapiens
aagactgagttcaaatcacagc

SEQ ID NO: 6930596 - DNA, 22 bp, Homo sapiens
gtggcagagaacaaggagaggt

SEQ ID NO: 6930597 - DNA, 22 bp, Homo sapiens
cctttgccatgacatggcacaa

SEQ ID NO: 6930598 - DNA, 22 bp, Homo sapiens
gcaaaggtagccaaggagctca

SEQ ID NO: 6930599 - DNA, 22 bp, Homo sapiens
gtctctctgactggtccacacc

SEQ ID NO: 6930600 - DNA, 22 bp, Homo sapiens
tcagacaagttgatgtacctgg

SEQ ID NO: 6930601 - DNA, 22 bp, Homo sapiens
caatttcactgacaccctggaa

SEQ ID NO: 6930602 - DNA, 22 bp, Homo sapiens
gttttcatgtctattgggcata

SEQ ID NO: 6930603 - DNA, 22 bp, Homo sapiens
aactgagctggtgctcaaggga

SEQ ID NO: 6930604 - DNA, 22 bp, Homo sapiens
ggagagggtaggggtcctgccc

SEQ ID NO: 6930605 - DNA, 22 bp, Homo sapiens
tgaactcgggaggaggctgcag

SEQ ID NO: 6930606 - DNA, 22 bp, Homo sapiens
aacttatacccagggcagaaat

SEQ ID NO: 6930607 - DNA, 22 bp, Homo sapiens
ctaactttagcttagattatca

SEQ ID NO: 6930608 - DNA, 22 bp, Homo sapiens
acattaaagagtaaggttagtt

SEQ ID NO: 6930609 - DNA, 22 bp, Homo sapiens
tggtggcaaagtacaaagtgac

SEQ ID NO: 6930610 - DNA, 22 bp, Homo sapiens
ttccacaaacacatcctgagca

SEQ ID NO: 6930611 - DNA, 22 bp, Homo sapiens
ttgtgggccattcagctgctct

SEQ ID NO: 6930612 - DNA, 22 bp, Homo sapiens
tttcaagttaaatggggtcttt

SEQ ID NO: 6930613 - DNA, 22 bp, Homo sapiens
ccagaggtggtgggtgctacag

SEQ ID NO: 6930614 - DNA, 22 bp, Homo sapiens
tttagaggggaaagtggctggt

SEQ ID NO: 6930615 - DNA, 22 bp, Homo sapiens
ttacccagccctgcccagatgt

SEQ ID NO: 6930616 - DNA, 22 bp, Homo sapiens
atgaagataagaccaggctgga

SEQ ID NO: 6930617 - DNA, 22 bp, Homo sapiens
agatgggtctcccttagcacct

SEQ ID NO: 6930618 - DNA, 22 bp, Homo sapiens
tcagtataattgctggcactga

SEQ ID NO: 6930619 - DNA, 22 bp, Homo sapiens
atgctctggccctttgaacgct

SEQ ID NO: 6930620 - DNA, 22 bp, Homo sapiens
gtgggccaggccggagtgcaga

SEQ ID NO: 6930621 - DNA, 22 bp, Homo sapiens
ttcagctataacattgagactt

SEQ ID NO: 6930622 - DNA, 21 bp, Homo sapiens
gtctgatgcttgatgcagttg

SEQ ID NO: 6930623 - DNA, 22 bp, Homo sapiens
atggccctcagtccttccttgg

SEQ ID NO: 6930624 - DNA, 21 bp, Homo sapiens
ttggccacgtctctccttccc

SEQ ID NO: 6930625 - DNA, 22 bp, Homo sapiens
tcctctggcccagctgcctctg

SEQ ID NO: 6930626 - DNA, 22 bp, Homo sapiens
ttaagtgtcataatttccaaga

SEQ ID NO: 6930627 - DNA, 22 bp, Homo sapiens
agctagggcaaatatgagatac

SEQ ID NO: 6930628 - DNA, 22 bp, Homo sapiens
gggttccctgcctggccactct

SEQ ID NO: 6930629 - DNA, 22 bp, Homo sapiens
acaagctccttattcagctggg

SEQ ID NO: 6930630 - DNA, 22 bp, Homo sapiens
tcagaaatttaggctggacttg

SEQ ID NO: 6930631 - DNA, 20 bp, Homo sapiens
tacagagagctagctctctg

SEQ ID NO: 6930632 - DNA, 22 bp, Homo sapiens
tcctggctctctacaaaccaga

SEQ ID NO: 6930633 - DNA, 22 bp, Homo sapiens
caggagtcccaggggtgggcca

SEQ ID NO: 6930634 - DNA, 22 bp, Homo sapiens
acagactgtgagtctcattttc

SEQ ID NO: 6930635 - DNA, 22 bp, Homo sapiens
acaataagtattgggcttttga

SEQ ID NO: 6930636 - DNA, 22 bp, Homo sapiens
ggtggcagcgtctatctgacat

SEQ ID NO: 6930637 - DNA, 22 bp, Homo sapiens
acctcaagtgatccactcacct

SEQ ID NO: 6930638 - DNA, 23 bp, Homo sapiens
acagccaggatgggagcagaagc

SEQ ID NO: 6930639 - DNA, 22 bp, Homo sapiens
gaagttctcagctaggtgatgt

SEQ ID NO: 6930640 - DNA, 22 bp, Homo sapiens
taagctggggctatgctaaata

SEQ ID NO: 6930641 - DNA, 22 bp, Homo sapiens
tagaagattccagaggcaaagc

SEQ ID NO: 6930642 - DNA, 22 bp, Homo sapiens
tttctactgttatgacactggg

SEQ ID NO: 6930643 - DNA, 22 bp, Homo sapiens
cagcagtagtctctgtggcttt

SEQ ID NO: 6930644 - DNA, 22 bp, Homo sapiens
tagcatagcacctgacacagag

SEQ ID NO: 6930645 - DNA, 22 bp, Homo sapiens
tgttttgtagctaatagctatt

SEQ ID NO: 6930646 - DNA, 21 bp, Homo sapiens
tcagcagcttttgcagtccct

SEQ ID NO: 6930647 - DNA, 22 bp, Homo sapiens
tccagttttgaatcctgcttct

SEQ ID NO: 6930648 - DNA, 22 bp, Homo sapiens
aaggaactaaatagttctggaa

SEQ ID NO: 6930649 - DNA, 18 bp, Homo sapiens
caatgttttagatctcta

SEQ ID NO: 6930650 - DNA, 22 bp, Homo sapiens
tctctaggtgcagtcactgctc

SEQ ID NO: 6930651 - DNA, 22 bp, Homo sapiens
gttctctcagcgatagtgatgg

SEQ ID NO: 6930652 - DNA, 22 bp, Homo sapiens
tggcctgactgtccagccaggg

SEQ ID NO: 6930653 - DNA, 21 bp, Homo sapiens
tgaggcctgccagtctcagaa

SEQ ID NO: 6930654 - DNA, 22 bp, Homo sapiens
taaattgtgtgttgctagggga

SEQ ID NO: 6930655 - DNA, 22 bp, Homo sapiens
tcataatgtagttcatggctgg

SEQ ID NO: 6930656 - DNA, 22 bp, Homo sapiens
tgagcatcttcgtgaaagcttc

SEQ ID NO: 6930657 - DNA, 22 bp, Homo sapiens
gggagctgcacacgccccggaa

SEQ ID NO: 6930658 - DNA, 22 bp, Homo sapiens
tcccagggtgaaatgcagtagg

SEQ ID NO: 6930659 - DNA, 23 bp, Homo sapiens
acctacattatagggatatgggt

SEQ ID NO: 6930660 - DNA, 22 bp, Homo sapiens
ctgctttaatggaaagtgtttt

SEQ ID NO: 6930661 - DNA, 22 bp, Homo sapiens
ttagcaaacctggactacagat

SEQ ID NO: 6930662 - DNA, 22 bp, Homo sapiens
aattgttgtacagaataaatga

SEQ ID NO: 6930663 - DNA, 20 bp, Homo sapiens
cctcaagcagactgacagct

SEQ ID NO: 6930664 - DNA, 22 bp, Homo sapiens
ccaggcctgtgcaaggagggag

SEQ ID NO: 6930665 - DNA, 22 bp, Homo sapiens
tctcaaactacagtatggctgt

SEQ ID NO: 6930666 - DNA, 22 bp, Homo sapiens
acaactttctgggttatctgat

SEQ ID NO: 6930667 - DNA, 22 bp, Homo sapiens
ttcttcttgaaactttaggttg

SEQ ID NO: 6930668 - DNA, 22 bp, Homo sapiens
agagttgcttatgtcaggtgag

SEQ ID NO: 6930669 - DNA, 22 bp, Homo sapiens
tgtcaataactggagtcattat

SEQ ID NO: 6930670 - DNA, 22 bp, Homo sapiens
tggctgaggttatgctggttgt

SEQ ID NO: 6930671 - DNA, 22 bp, Homo sapiens
gctctgtttctccatgctgtgg

SEQ ID NO: 6930672 - DNA, 22 bp, Homo sapiens
atttctcaagtaaatgagtcat

SEQ ID NO: 6930673 - DNA, 22 bp, Homo sapiens
gaagataattcctacttataac

SEQ ID NO: 6930674 - DNA, 22 bp, Homo sapiens
agggaccctgatgactgaggag

SEQ ID NO: 6930675 - DNA, 22 bp, Homo sapiens
taggccagttggtggccctgga

SEQ ID NO: 6930676 - DNA, 22 bp, Homo sapiens
tgacagactttacttctcctat

SEQ ID NO: 6930677 - DNA, 22 bp, Homo sapiens
tagcttggaataaaatgagaat

SEQ ID NO: 6930678 - DNA, 22 bp, Homo sapiens
agacaggacacaagctgcataa

SEQ ID NO: 6930679 - DNA, 22 bp, Homo sapiens
tttgggcatgttgtggccagct

SEQ ID NO: 6930680 - DNA, 23 bp, Homo sapiens
acctaaatagctgtgttgaagta

SEQ ID NO: 6930681 - DNA, 21 bp, Homo sapiens
tttcattgaatgagataaggt

SEQ ID NO: 6930682 - DNA, 23 bp, Homo sapiens
gctgtcagttgtttttgtctcta

SEQ ID NO: 6930683 - DNA, 22 bp, Homo sapiens
aggaagctcaaagccatgatgt

SEQ ID NO: 6930684 - DNA, 22 bp, Homo sapiens
tgagcatagccttcagtagcag

SEQ ID NO: 6930685 - DNA, 22 bp, Homo sapiens
aggtacatgttccagatacgta

SEQ ID NO: 6930686 - DNA, 22 bp, Homo sapiens
tggagcagagatggtggccttc

SEQ ID NO: 6930687 - DNA, 22 bp, Homo sapiens
aggtgctgggcagcagtcattg

SEQ ID NO: 6930688 - DNA, 22 bp, Homo sapiens
agctggtgtgccactgttgggg

SEQ ID NO: 6930689 - DNA, 22 bp, Homo sapiens
ttggcactcaaaatagatggtt

SEQ ID NO: 6930690 - DNA, 22 bp, Homo sapiens
atgacaaaatgaatgcagctag

SEQ ID NO: 6930691 - DNA, 22 bp, Homo sapiens
gacgtgggtcgccatcgatatg

SEQ ID NO: 6930692 - DNA, 22 bp, Homo sapiens
tgtttcagtccctgtgttcaat

SEQ ID NO: 6930693 - DNA, 22 bp, Homo sapiens
ctgtgggatgggacctcagctg

SEQ ID NO: 6930694 - DNA, 22 bp, Homo sapiens
ttctcaagtgagtggtaaatga

SEQ ID NO: 6930695 - DNA, 22 bp, Homo sapiens
gtgcggtcaacatcagcagttg

SEQ ID NO: 6930696 - DNA, 22 bp, Homo sapiens
aatgtcctaggcatgattttgt

SEQ ID NO: 6930697 - DNA, 22 bp, Homo sapiens
gctggcaggtccaagatagagc

SEQ ID NO: 6930698 - DNA, 22 bp, Homo sapiens
ttagaaatgcacccaagaccta

SEQ ID NO: 6930699 - DNA, 22 bp, Homo sapiens
ttgaacataaatcactggtcag

SEQ ID NO: 6930700 - DNA, 22 bp, Homo sapiens
tctggaataaccctgcttccaa

SEQ ID NO: 6930701 - DNA, 22 bp, Homo sapiens
gagcttggatgtcttttgttca

SEQ ID NO: 6930702 - DNA, 22 bp, Homo sapiens
ccccaggtggatggctcgcata

SEQ ID NO: 6930703 - DNA, 21 bp, Homo sapiens
gctcaggctcttgacagagca

SEQ ID NO: 6930704 - DNA, 22 bp, Homo sapiens
ctggtctgggatgagggatgta

SEQ ID NO: 6930705 - DNA, 22 bp, Homo sapiens
gaggaaacattgtagaagcagt

SEQ ID NO: 6930706 - DNA, 22 bp, Homo sapiens
cactttgcctcttacctgtggt

SEQ ID NO: 6930707 - DNA, 22 bp, Homo sapiens
tatttatgtggaccataagcct

SEQ ID NO: 6930708 - DNA, 22 bp, Homo sapiens
ttccaccaattctcctccaagg

SEQ ID NO: 6930709 - DNA, 21 bp, Homo sapiens
tttagcaagagtatagtgcat

SEQ ID NO: 6930710 - DNA, 22 bp, Homo sapiens
taaggggcccagaccgggcgcc

SEQ ID NO: 6930711 - DNA, 22 bp, Homo sapiens
ctgtccctcatcacctctgggt

SEQ ID NO: 6930712 - DNA, 22 bp, Homo sapiens
tgagatgctaaagggctgctca

SEQ ID NO: 6930713 - DNA, 21 bp, Homo sapiens
atcaccagcagaagctgcaga

SEQ ID NO: 6930714 - DNA, 22 bp, Homo sapiens
gccagctgcatctcctgggctg

SEQ ID NO: 6930715 - DNA, 22 bp, Homo sapiens
tgcagggtgcacagtggggtgc

SEQ ID NO: 6930716 - DNA, 22 bp, Homo sapiens
aaaggcttctcagaaaggcctt

SEQ ID NO: 6930717 - DNA, 22 bp, Homo sapiens
ggtcggggatggccaggctccc

SEQ ID NO: 6930718 - DNA, 22 bp, Homo sapiens
aggcaggtgcttatgacttgct

SEQ ID NO: 6930719 - DNA, 22 bp, Homo sapiens
gtgtcttttgaggctgaccagt

SEQ ID NO: 6930720 - DNA, 22 bp, Homo sapiens
aaagaggctcaaggtgggccag

SEQ ID NO: 6930721 - DNA, 22 bp, Homo sapiens
caagaataaccagacaatagca

SEQ ID NO: 6930722 - DNA, 22 bp, Homo sapiens
ggcggccgccttcggccacggc

SEQ ID NO: 6930723 - DNA, 22 bp, Homo sapiens
atgctcctcgagtgtctcacag

SEQ ID NO: 6930724 - DNA, 22 bp, Homo sapiens
gaagaccccagagcgaggtaag

SEQ ID NO: 6930725 - DNA, 22 bp, Homo sapiens
tcagagaagcttaagctgtaat

SEQ ID NO: 6930726 - DNA, 22 bp, Homo sapiens
aagtaagtgccttttattctta

SEQ ID NO: 6930727 - DNA, 22 bp, Homo sapiens
tttgaaagaatttatgtacttt

SEQ ID NO: 6930728 - DNA, 22 bp, Homo sapiens
cagatgagggctggaggtgagc

SEQ ID NO: 6930729 - DNA, 22 bp, Homo sapiens
aggctccagcagccagaggaag

SEQ ID NO: 6930730 - DNA, 22 bp, Homo sapiens
ccagggaagaccacttcctgga

SEQ ID NO: 6930731 - DNA, 22 bp, Homo sapiens
tgcttgctctccggactctaat

SEQ ID NO: 6930732 - DNA, 22 bp, Homo sapiens
gaagttataaacttttcctccc

SEQ ID NO: 6930733 - DNA, 22 bp, Homo sapiens
tctcagagaacagttggtgctt

SEQ ID NO: 6930734 - DNA, 20 bp, Homo sapiens
agtgccctccgacattgttt

SEQ ID NO: 6930735 - DNA, 22 bp, Homo sapiens
gtcccagggcaaggctgtttct

SEQ ID NO: 6930736 - DNA, 22 bp, Homo sapiens
ttacagtagctttatttggagt

SEQ ID NO: 6930737 - DNA, 22 bp, Homo sapiens
tgtggggaagagtatgacttgg

SEQ ID NO: 6930738 - DNA, 22 bp, Homo sapiens
tccaaatataggatgtgatata

SEQ ID NO: 6930739 - DNA, 22 bp, Homo sapiens
tcaaagtaaaagtatagagttt

SEQ ID NO: 6930740 - DNA, 22 bp, Homo sapiens
tttggtgtgcaccttgcggtgc

SEQ ID NO: 6930741 - DNA, 22 bp, Homo sapiens
attttcagttgaaaaagttggt

SEQ ID NO: 6930742 - DNA, 22 bp, Homo sapiens
tggagggctctttcacctggta

SEQ ID NO: 6930743 - DNA, 22 bp, Homo sapiens
caaatgaaaatggcgtcttgga

SEQ ID NO: 6930744 - DNA, 22 bp, Homo sapiens
agcagggctcctgaaagccgcg

SEQ ID NO: 6930745 - DNA, 22 bp, Homo sapiens
aatggtttcaaacacactaagt

SEQ ID NO: 6930746 - DNA, 17 bp, Homo sapiens
agcttcagttgcaaaac

SEQ ID NO: 6930747 - DNA, 20 bp, Homo sapiens
gcagcagtgcaagtcctctt

SEQ ID NO: 6930748 - DNA, 22 bp, Homo sapiens
atcagtgttgttgattggatag

SEQ ID NO: 6930749 - DNA, 20 bp, Homo sapiens
tccatctggtataagctgat

SEQ ID NO: 6930750 - DNA, 22 bp, Homo sapiens
tgagtatcaattacatagttgt

SEQ ID NO: 6930751 - DNA, 22 bp, Homo sapiens
gactctgggcctttggtgactc

SEQ ID NO: 6930752 - DNA, 22 bp, Homo sapiens
tttggccttgtgttctctccat

SEQ ID NO: 6930753 - DNA, 22 bp, Homo sapiens
ctccccattgtgacctcatcca

SEQ ID NO: 6930754 - DNA, 22 bp, Homo sapiens
taaagggctaatgtgtgactgg

SEQ ID NO: 6930755 - DNA, 22 bp, Homo sapiens
gtcccaaactcctgacctcagg

SEQ ID NO: 6930756 - DNA, 22 bp, Homo sapiens
agttctcatttcacaggcagtg

SEQ ID NO: 6930757 - DNA, 22 bp, Homo sapiens
gacagtttaggttcaaatctca

SEQ ID NO: 6930758 - DNA, 22 bp, Homo sapiens
gacagctgtggagaggcatgtg

SEQ ID NO: 6930759 - DNA, 22 bp, Homo sapiens
ctcctaggtaacagggtggttt

SEQ ID NO: 6930760 - DNA, 22 bp, Homo sapiens
tgatgaggcatatgctacacat

SEQ ID NO: 6930761 - DNA, 22 bp, Homo sapiens
aactggattattcagttgctgc

SEQ ID NO: 6930762 - DNA, 22 bp, Homo sapiens
tttggtcactggatttggctgt

SEQ ID NO: 6930763 - DNA, 22 bp, Homo sapiens
ttcagctctagtaagcagacac

SEQ ID NO: 6930764 - DNA, 20 bp, Homo sapiens
ttggatctaaaatgtgggga

SEQ ID NO: 6930765 - DNA, 22 bp, Homo sapiens
cccaggctgggaacgattctag

SEQ ID NO: 6930766 - DNA, 22 bp, Homo sapiens
acatggctggcaccttaaattt

SEQ ID NO: 6930767 - DNA, 22 bp, Homo sapiens
atctagatggaattgtatatag

SEQ ID NO: 6930768 - DNA, 19 bp, Homo sapiens
ccatgcagcctgggggcag

SEQ ID NO: 6930769 - DNA, 22 bp, Homo sapiens
tcaggaaactacagttgaacta

SEQ ID NO: 6930770 - DNA, 22 bp, Homo sapiens
gcaggagtatgcagctatggtt

SEQ ID NO: 6930771 - DNA, 22 bp, Homo sapiens
agtcaccatctgtggcagcctg

SEQ ID NO: 6930772 - DNA, 22 bp, Homo sapiens
ttcaagaagcccaaagactagc

SEQ ID NO: 6930773 - DNA, 19 bp, Homo sapiens
tctcagagccctagaggcc

SEQ ID NO: 6930774 - DNA, 22 bp, Homo sapiens
atgaggaggtcaggccttacaa

SEQ ID NO: 6930775 - DNA, 22 bp, Homo sapiens
gactggcttatttcacttagca

SEQ ID NO: 6930776 - DNA, 22 bp, Homo sapiens
tggccaggcctcttggtgccca

SEQ ID NO: 6930777 - DNA, 22 bp, Homo sapiens
caatctgtacttgaaaaattat

SEQ ID NO: 6930778 - DNA, 22 bp, Homo sapiens
aggtgctgccccgagaaggatg

SEQ ID NO: 6930779 - DNA, 22 bp, Homo sapiens
ggcaggtgctctgtgggcctgg

SEQ ID NO: 6930780 - DNA, 22 bp, Homo sapiens
ttggctcacaaggacggttgct

SEQ ID NO: 6930781 - DNA, 22 bp, Homo sapiens
agcaataaatgtaaaggttaag

SEQ ID NO: 6930782 - DNA, 22 bp, Homo sapiens
catcattgcctgtttcccttgg

SEQ ID NO: 6930783 - DNA, 22 bp, Homo sapiens
ccccaccctcgctccatttcgg

SEQ ID NO: 6930784 - DNA, 22 bp, Homo sapiens
gtgctgacaggagcctggcggt

SEQ ID NO: 6930785 - DNA, 22 bp, Homo sapiens
agtctgggagggatgccagtgt

SEQ ID NO: 6930786 - DNA, 22 bp, Homo sapiens
tgctcaggtcgttctgcccctt

SEQ ID NO: 6930787 - DNA, 20 bp, Homo sapiens
tgagcctgctgtaggaggcc

SEQ ID NO: 6930788 - DNA, 22 bp, Homo sapiens
tgggtcctctgagagggcagcg

SEQ ID NO: 6930789 - DNA, 22 bp, Homo sapiens
tggcttctcagtttcataatga

SEQ ID NO: 6930790 - DNA, 21 bp, Homo sapiens
tgcagaaagcggcttgaagca

SEQ ID NO: 6930791 - DNA, 22 bp, Homo sapiens
ttgtttttagagaagccctgaa

SEQ ID NO: 6930792 - DNA, 22 bp, Homo sapiens
agatggggctcagtgtggaggc

SEQ ID NO: 6930793 - DNA, 22 bp, Homo sapiens
agagcctggaggttctgctgaa

SEQ ID NO: 6930794 - DNA, 22 bp, Homo sapiens
tgcagttttccttcaacattgt

SEQ ID NO: 6930795 - DNA, 22 bp, Homo sapiens
tccttttgctgggatcatcagg

SEQ ID NO: 6930796 - DNA, 22 bp, Homo sapiens
caaagcttggagaagcagctgg

SEQ ID NO: 6930797 - DNA, 22 bp, Homo sapiens
aatgaggcttgcattgtgaact

SEQ ID NO: 6930798 - DNA, 22 bp, Homo sapiens
tcactgaaggaagacactgtca

SEQ ID NO: 6930799 - DNA, 16 bp, Homo sapiens
gatctgaaggtgctgg

SEQ ID NO: 6930800 - DNA, 22 bp, Homo sapiens
tgtctgcttcagtgttaagccc

SEQ ID NO: 6930801 - DNA, 22 bp, Homo sapiens
tcaaggaaaagataacttgatg

SEQ ID NO: 6930802 - DNA, 22 bp, Homo sapiens
gagtcaggagtcctgtgtgaga

SEQ ID NO: 6930803 - DNA, 19 bp, Homo sapiens
tgaaggtgtatgtgctggg

SEQ ID NO: 6930804 - DNA, 22 bp, Homo sapiens
gtttcttaatagcaggggccaa

SEQ ID NO: 6930805 - DNA, 22 bp, Homo sapiens
ttgcagggttgacactgcctgc

SEQ ID NO: 6930806 - DNA, 22 bp, Homo sapiens
gtggctttgtttccaaatgaaa

SEQ ID NO: 6930807 - DNA, 22 bp, Homo sapiens
gggagcagttaaaatgattcct

SEQ ID NO: 6930808 - DNA, 22 bp, Homo sapiens
acagggtcaagggtgctacaag

SEQ ID NO: 6930809 - DNA, 22 bp, Homo sapiens
tcagaggagcaaaagaggggat

SEQ ID NO: 6930810 - DNA, 22 bp, Homo sapiens
tggctacagtggcatatcaaat

SEQ ID NO: 6930811 - DNA, 22 bp, Homo sapiens
tgcaggagtccaatcaggagac

SEQ ID NO: 6930812 - DNA, 22 bp, Homo sapiens
gtcagcacttttccgaggcaga

SEQ ID NO: 6930813 - DNA, 22 bp, Homo sapiens
tcagtcaccaatgggaggagga

SEQ ID NO: 6930814 - DNA, 21 bp, Homo sapiens
atggatttaaacaggccacaa

SEQ ID NO: 6930815 - DNA, 22 bp, Homo sapiens
gtgaaggctacaagagatcaag

SEQ ID NO: 6930816 - DNA, 22 bp, Homo sapiens
aaggtgccagcccctccactga

SEQ ID NO: 6930817 - DNA, 22 bp, Homo sapiens
tcttccagatgcagatgcttct

SEQ ID NO: 6930818 - DNA, 22 bp, Homo sapiens
gacctggaatgaagggtccctc

SEQ ID NO: 6930819 - DNA, 22 bp, Homo sapiens
acaggtggtctttgctcctttt

SEQ ID NO: 6930820 - DNA, 22 bp, Homo sapiens
tctccagtctcaagacattgag

SEQ ID NO: 6930821 - DNA, 22 bp, Homo sapiens
tcaatttcttggtttgataata

SEQ ID NO: 6930822 - DNA, 22 bp, Homo sapiens
atacaagtgttgtgcctcatca

SEQ ID NO: 6930823 - DNA, 22 bp, Homo sapiens
gcaacatcggtattggaggagt

SEQ ID NO: 6930824 - DNA, 22 bp, Homo sapiens
ctgttgtatcatttgttcacat

SEQ ID NO: 6930825 - DNA, 22 bp, Homo sapiens
taggtgggtgacttccatgggg

SEQ ID NO: 6930826 - DNA, 22 bp, Homo sapiens
tactttggttgaatatgtaatg

SEQ ID NO: 6930827 - DNA, 22 bp, Homo sapiens
ctgaagaggttgttgaggaata

SEQ ID NO: 6930828 - DNA, 22 bp, Homo sapiens
tggtaggaatgattacgacttt

SEQ ID NO: 6930829 - DNA, 22 bp, Homo sapiens
ttactttcaaaaactacgtggg

SEQ ID NO: 6930830 - DNA, 22 bp, Homo sapiens
agagatctgtctactatttaag

SEQ ID NO: 6930831 - DNA, 22 bp, Homo sapiens
tcttaactgacagtttaatggg

SEQ ID NO: 6930832 - DNA, 22 bp, Homo sapiens
ttctctgagtacgtttcagtgt

SEQ ID NO: 6930833 - DNA, 22 bp, Homo sapiens
tctctcaacctcggcactattg

SEQ ID NO: 6930834 - DNA, 22 bp, Homo sapiens
gcctgtttttgcttcgtttaag

SEQ ID NO: 6930835 - DNA, 21 bp, Homo sapiens
tcctggctttatgctacctct

SEQ ID NO: 6930836 - DNA, 23 bp, Homo sapiens
aaagacctaggatgagggagacg

SEQ ID NO: 6930837 - DNA, 22 bp, Homo sapiens
cccaagaggtggaggttgcagt

SEQ ID NO: 6930838 - DNA, 22 bp, Homo sapiens
gcagctggctctgggaaaaact

SEQ ID NO: 6930839 - DNA, 22 bp, Homo sapiens
ccaggcagggagctgtttggcc

SEQ ID NO: 6930840 - DNA, 22 bp, Homo sapiens
tgggccttgctgagctatggag

SEQ ID NO: 6930841 - DNA, 22 bp, Homo sapiens
gctctccactgaccacggggca

SEQ ID NO: 6930842 - DNA, 22 bp, Homo sapiens
ttttcctagtaggcctattaga

SEQ ID NO: 6930843 - DNA, 22 bp, Homo sapiens
agcctggccctgctgaactctg

SEQ ID NO: 6930844 - DNA, 22 bp, Homo sapiens
tgctggctttagtgattggggt

SEQ ID NO: 6930845 - DNA, 22 bp, Homo sapiens
aaccagaaggaatctgagctga

SEQ ID NO: 6930846 - DNA, 22 bp, Homo sapiens
taggtgcctgcacgacccaaac

SEQ ID NO: 6930847 - DNA, 22 bp, Homo sapiens
tctctcataagatgagtactta

SEQ ID NO: 6930848 - DNA, 22 bp, Homo sapiens
agaccaagactataatgagagg

SEQ ID NO: 6930849 - DNA, 22 bp, Homo sapiens
cagtgcagaacacatggaaaat

SEQ ID NO: 6930850 - DNA, 22 bp, Homo sapiens
aaagcttaccttttcagtcttt

SEQ ID NO: 6930851 - DNA, 22 bp, Homo sapiens
gagcttttcccgtctttctcgt

SEQ ID NO: 6930852 - DNA, 22 bp, Homo sapiens
caaggtttgaaaacgccatggc

SEQ ID NO: 6930853 - DNA, 22 bp, Homo sapiens
tgttagtcagacacacctaaat

SEQ ID NO: 6930854 - DNA, 22 bp, Homo sapiens
ccaaagtaaggcaattcctaaa

SEQ ID NO: 6930855 - DNA, 22 bp, Homo sapiens
ctatggctgatttcatttgttt

SEQ ID NO: 6930856 - DNA, 22 bp, Homo sapiens
caaagtatagtgtaggatggca

SEQ ID NO: 6930857 - DNA, 22 bp, Homo sapiens
aggtatatgaagatgaaataac

SEQ ID NO: 6930858 - DNA, 22 bp, Homo sapiens
ttacattcagaaagatttgagt

SEQ ID NO: 6930859 - DNA, 22 bp, Homo sapiens
aaatactgggctcaaaagggtt

SEQ ID NO: 6930860 - DNA, 22 bp, Homo sapiens
cataccgcttgtcaccagcatt

SEQ ID NO: 6930861 - DNA, 22 bp, Homo sapiens
tatgagttcagttatcttaagt

SEQ ID NO: 6930862 - DNA, 22 bp, Homo sapiens
ctgggaaatataataaagtggt

SEQ ID NO: 6930863 - DNA, 22 bp, Homo sapiens
ctggccctcgtcagtttcactg

SEQ ID NO: 6930864 - DNA, 20 bp, Homo sapiens
ctgcccagccactgagggat

SEQ ID NO: 6930865 - DNA, 22 bp, Homo sapiens
acatccacatttattcagtcat

SEQ ID NO: 6930866 - DNA, 22 bp, Homo sapiens
tggtcacctatagaggagatgt

SEQ ID NO: 6930867 - DNA, 22 bp, Homo sapiens
actgtccagaagatagaaatat

SEQ ID NO: 6930868 - DNA, 22 bp, Homo sapiens
cttgtgcaagaaacctggaatg

SEQ ID NO: 6930869 - DNA, 22 bp, Homo sapiens
tactttgcggcgcggaggagca

SEQ ID NO: 6930870 - DNA, 22 bp, Homo sapiens
ttccctggaaagccatgcagtc

SEQ ID NO: 6930871 - DNA, 22 bp, Homo sapiens
gcagggaccttgcccaccctcc

SEQ ID NO: 6930872 - DNA, 22 bp, Homo sapiens
acttgaattcaaagcgaaagca

SEQ ID NO: 6930873 - DNA, 22 bp, Homo sapiens
acatggtatgtattttaagaga

SEQ ID NO: 6930874 - DNA, 22 bp, Homo sapiens
aaggcctcaggtgaggctgccc

SEQ ID NO: 6930875 - DNA, 22 bp, Homo sapiens
tgaaacagagtggatacagtga

SEQ ID NO: 6930876 - DNA, 22 bp, Homo sapiens
tcctgccacctgcacagctccc

SEQ ID NO: 6930877 - DNA, 22 bp, Homo sapiens
ttctaactccacttcccactcc

SEQ ID NO: 6930878 - DNA, 22 bp, Homo sapiens
cactgctttgcccaagagggca

SEQ ID NO: 6930879 - DNA, 22 bp, Homo sapiens
gaagcactgtgctgctaagttg

SEQ ID NO: 6930880 - DNA, 22 bp, Homo sapiens
aaagagcttcatttccatttat

SEQ ID NO: 6930881 - DNA, 21 bp, Homo sapiens
agaagctagtcactaaatcca

SEQ ID NO: 6930882 - DNA, 22 bp, Homo sapiens
caagttgttgggagggttggtt

SEQ ID NO: 6930883 - DNA, 22 bp, Homo sapiens
ggcctctgccccgcggggctcg

SEQ ID NO: 6930884 - DNA, 22 bp, Homo sapiens
tgtttactgcattctatttgct

SEQ ID NO: 6930885 - DNA, 22 bp, Homo sapiens
cacccagcacagagggaggcga

SEQ ID NO: 6930886 - DNA, 22 bp, Homo sapiens
gtctgctttctgggaactcttt

SEQ ID NO: 6930887 - DNA, 22 bp, Homo sapiens
gattccttccctacccaggcct

SEQ ID NO: 6930888 - DNA, 18 bp, Homo sapiens
tctgtgggatcagtgagg

SEQ ID NO: 6930889 - DNA, 22 bp, Homo sapiens
acctctggacactgcatccttc

SEQ ID NO: 6930890 - DNA, 22 bp, Homo sapiens
aaggtacagaaattaacaagga

SEQ ID NO: 6930891 - DNA, 22 bp, Homo sapiens
tgtaactgcttagaaggtttta

SEQ ID NO: 6930892 - DNA, 22 bp, Homo sapiens
ttagaacaccattctatattac

SEQ ID NO: 6930893 - DNA, 18 bp, Homo sapiens
ctgatgtttgctattgct

SEQ ID NO: 6930894 - DNA, 22 bp, Homo sapiens
acatccttggttgattaatcaa

SEQ ID NO: 6930895 - DNA, 22 bp, Homo sapiens
ggcgccagcggtaagtaagaca

SEQ ID NO: 6930896 - DNA, 22 bp, Homo sapiens
tggcgcgacgtgccccctgctt

SEQ ID NO: 6930897 - DNA, 22 bp, Homo sapiens
agtctggatttagaggtgggcc

SEQ ID NO: 6930898 - DNA, 22 bp, Homo sapiens
tgctgtgatggagaattctgga

SEQ ID NO: 6930899 - DNA, 20 bp, Homo sapiens
aggctcctgtacctgaggaa

SEQ ID NO: 6930900 - DNA, 22 bp, Homo sapiens
gaggctggtcagccctaagatc

SEQ ID NO: 6930901 - DNA, 22 bp, Homo sapiens
gtaattctgtgtgaatctatta

SEQ ID NO: 6930902 - DNA, 22 bp, Homo sapiens
agggcctgctctatcactctca

SEQ ID NO: 6930903 - DNA, 22 bp, Homo sapiens
aatcatgtactgctgtggcttt

SEQ ID NO: 6930904 - DNA, 22 bp, Homo sapiens
agaggttcagagaaggcgatct

SEQ ID NO: 6930905 - DNA, 22 bp, Homo sapiens
atgctgttaagaatctcttcct

SEQ ID NO: 6930906 - DNA, 22 bp, Homo sapiens
cttggctggaactcctgagaaa

SEQ ID NO: 6930907 - DNA, 19 bp, Homo sapiens
tacacttgtaatgagcaga

SEQ ID NO: 6930908 - DNA, 22 bp, Homo sapiens
cagaacagggcccaaggggtcg

SEQ ID NO: 6930909 - DNA, 22 bp, Homo sapiens
ctctgctgctttgccagtggaa

SEQ ID NO: 6930910 - DNA, 22 bp, Homo sapiens
gtttctcaagcttgaatgcaca

SEQ ID NO: 6930911 - DNA, 21 bp, Homo sapiens
gcatggcaggtcactggggca

SEQ ID NO: 6930912 - DNA, 22 bp, Homo sapiens
ccagtcagtcagttgctggcat

SEQ ID NO: 6930913 - DNA, 22 bp, Homo sapiens
gagctcagcctgaggcctggct

SEQ ID NO: 6930914 - DNA, 22 bp, Homo sapiens
agccatcctcccacctcagcct

SEQ ID NO: 6930915 - DNA, 22 bp, Homo sapiens
aaagccttcttcggtctgtgat

SEQ ID NO: 6930916 - DNA, 22 bp, Homo sapiens
tgcatttcagaagaaaattcgg

SEQ ID NO: 6930917 - DNA, 22 bp, Homo sapiens
ctctgagaatatgagctctttg

SEQ ID NO: 6930918 - DNA, 22 bp, Homo sapiens
ttcagttggccatacccctaga

SEQ ID NO: 6930919 - DNA, 22 bp, Homo sapiens
agtctttaacatttggagattg

SEQ ID NO: 6930920 - DNA, 22 bp, Homo sapiens
aggcccaaaagaaaccactggg

SEQ ID NO: 6930921 - DNA, 22 bp, Homo sapiens
caggctagattggggccagtag

SEQ ID NO: 6930922 - DNA, 22 bp, Homo sapiens
ggatcaaagggaacctgttagg

SEQ ID NO: 6930923 - DNA, 22 bp, Homo sapiens
tgaggcagcaattgtattgtat

SEQ ID NO: 6930924 - DNA, 22 bp, Homo sapiens
gctaaatttaagcctttctcct

SEQ ID NO: 6930925 - DNA, 22 bp, Homo sapiens
tgatggctgtgctgatgttagg

SEQ ID NO: 6930926 - DNA, 22 bp, Homo sapiens
cagagaaactcagatagctgat

SEQ ID NO: 6930927 - DNA, 22 bp, Homo sapiens
cacatgcatacctatgtgtata

SEQ ID NO: 6930928 - DNA, 22 bp, Homo sapiens
ttaaggattactttgtgtaccc

SEQ ID NO: 6930929 - DNA, 22 bp, Homo sapiens
tagtgccatcttgagctgcttt

SEQ ID NO: 6930930 - DNA, 22 bp, Homo sapiens
cagaatctctgggagtggatca

SEQ ID NO: 6930931 - DNA, 22 bp, Homo sapiens
tacttacattagcaaacaaggt

SEQ ID NO: 6930932 - DNA, 22 bp, Homo sapiens
tcctcagcttttatttcacttg

SEQ ID NO: 6930933 - DNA, 22 bp, Homo sapiens
gggaaaggatcagtgggaggct

SEQ ID NO: 6930934 - DNA, 22 bp, Homo sapiens
ctgggaggtggaggttgcattg

SEQ ID NO: 6930935 - DNA, 21 bp, Homo sapiens
gcagcagtgttctagaatact

SEQ ID NO: 6930936 - DNA, 22 bp, Homo sapiens
cagcattttccatagaaagaag

SEQ ID NO: 6930937 - DNA, 19 bp, Homo sapiens
gaggttcacgcgctggatg

SEQ ID NO: 6930938 - DNA, 22 bp, Homo sapiens
agcaagttgaatgataatactc

SEQ ID NO: 6930939 - DNA, 20 bp, Homo sapiens
cagcagccattctagtagta

SEQ ID NO: 6930940 - DNA, 22 bp, Homo sapiens
acacaagttctaaagattgcgc

SEQ ID NO: 6930941 - DNA, 22 bp, Homo sapiens
gttacacagctaagcttctcct

SEQ ID NO: 6930942 - DNA, 22 bp, Homo sapiens
aacaaatgtgttttgtaattaa

SEQ ID NO: 6930943 - DNA, 22 bp, Homo sapiens
tcactggatcctagctgagcct

SEQ ID NO: 6930944 - DNA, 22 bp, Homo sapiens
agcagggactgagccagtggga

SEQ ID NO: 6930945 - DNA, 22 bp, Homo sapiens
tggttcagatatggagctggga

SEQ ID NO: 6930946 - DNA, 22 bp, Homo sapiens
tacaacactgttcagcctcttc

SEQ ID NO: 6930947 - DNA, 22 bp, Homo sapiens
gctggagttggcaaggcatgta

SEQ ID NO: 6930948 - DNA, 22 bp, Homo sapiens
acctggagtcatttgaggagta

SEQ ID NO: 6930949 - DNA, 22 bp, Homo sapiens
gcagttatggtttttattgcag

SEQ ID NO: 6930950 - DNA, 22 bp, Homo sapiens
agggaccaatcaccgacaggct

SEQ ID NO: 6930951 - DNA, 22 bp, Homo sapiens
actgagaacttgccaaggactg

SEQ ID NO: 6930952 - DNA, 22 bp, Homo sapiens
ccccaaagtgttggataattga

SEQ ID NO: 6930953 - DNA, 21 bp, Homo sapiens
ctcttgaatgcttgataagat

SEQ ID NO: 6930954 - DNA, 22 bp, Homo sapiens
gcagtgttgttaaaagattaga

SEQ ID NO: 6930955 - DNA, 22 bp, Homo sapiens
aatactgctgctgctgaaatca

SEQ ID NO: 6930956 - DNA, 22 bp, Homo sapiens
ttgttgaccgtggactgcagat

SEQ ID NO: 6930957 - DNA, 22 bp, Homo sapiens
ccataaagcactgaatcaccga

SEQ ID NO: 6930958 - DNA, 22 bp, Homo sapiens
agctccagagccacatccatca

SEQ ID NO: 6930959 - DNA, 22 bp, Homo sapiens
tgaatgatggtgtgttcttgcc

SEQ ID NO: 6930960 - DNA, 22 bp, Homo sapiens
atattccattggtttcccttct

SEQ ID NO: 6930961 - DNA, 22 bp, Homo sapiens
tgagtccaaatcccttctctga

SEQ ID NO: 6930962 - DNA, 22 bp, Homo sapiens
tgatgagggggaacagagattt

SEQ ID NO: 6930963 - DNA, 22 bp, Homo sapiens
gttcaattatacagtcagaggg

SEQ ID NO: 6930964 - DNA, 22 bp, Homo sapiens
tgcttcagcagggatcgggggg

SEQ ID NO: 6930965 - DNA, 22 bp, Homo sapiens
tctgggatgagatcagagacac

SEQ ID NO: 6930966 - DNA, 22 bp, Homo sapiens
atttcttacataacaaattgtt

SEQ ID NO: 6930967 - DNA, 22 bp, Homo sapiens
tatttaaaaagaggccagctgg

SEQ ID NO: 6930968 - DNA, 22 bp, Homo sapiens
ggctgctgtttcagagactgtt

SEQ ID NO: 6930969 - DNA, 18 bp, Homo sapiens
gtttgctacattcacttg

SEQ ID NO: 6930970 - DNA, 22 bp, Homo sapiens
cactgaggctgggggagaaggt

SEQ ID NO: 6930971 - DNA, 22 bp, Homo sapiens
atgttacagagaaagtggaagc

SEQ ID NO: 6930972 - DNA, 22 bp, Homo sapiens
tcagacaactctggaggctggc

SEQ ID NO: 6930973 - DNA, 22 bp, Homo sapiens
atagtcatccagaaagattaca

SEQ ID NO: 6930974 - DNA, 19 bp, Homo sapiens
gggtcccactgcccgtctg

SEQ ID NO: 6930975 - DNA, 22 bp, Homo sapiens
cgcaggtgaaagaggctgggca

SEQ ID NO: 6930976 - DNA, 22 bp, Homo sapiens
ctgctctagagagcattagtca

SEQ ID NO: 6930977 - DNA, 19 bp, Homo sapiens
aggctgcaaggtggtgggc

SEQ ID NO: 6930978 - DNA, 22 bp, Homo sapiens
tttgtacagtgaaagcgaggtt

SEQ ID NO: 6930979 - DNA, 22 bp, Homo sapiens
gcctttcctgctctggcattca

SEQ ID NO: 6930980 - DNA, 22 bp, Homo sapiens
agtggccaacttatatgaaaaa

SEQ ID NO: 6930981 - DNA, 22 bp, Homo sapiens
tgctcagattacagccccacat

SEQ ID NO: 6930982 - DNA, 22 bp, Homo sapiens
attttctctcaaaccttaaaat

SEQ ID NO: 6930983 - DNA, 22 bp, Homo sapiens
caggatgggatgtagtgggccc

SEQ ID NO: 6930984 - DNA, 22 bp, Homo sapiens
tctgtgctgtctcagataagca

SEQ ID NO: 6930985 - DNA, 22 bp, Homo sapiens
cccagtgccaggcacaggcagc

SEQ ID NO: 6930986 - DNA, 22 bp, Homo sapiens
ctgttctggagacactgatgaa

SEQ ID NO: 6930987 - DNA, 22 bp, Homo sapiens
actaggaggcatataaaacatt

SEQ ID NO: 6930988 - DNA, 23 bp, Homo sapiens
tctttagaagaacatcagaaatg

SEQ ID NO: 6930989 - DNA, 22 bp, Homo sapiens
ccagtcctgggagcttgcactg

SEQ ID NO: 6930990 - DNA, 22 bp, Homo sapiens
ggtgaaattccttgtggaaagt

SEQ ID NO: 6930991 - DNA, 22 bp, Homo sapiens
ggcaaggccttgcccagcattc

SEQ ID NO: 6930992 - DNA, 22 bp, Homo sapiens
cactggtgagtccagaagtcat

SEQ ID NO: 6930993 - DNA, 22 bp, Homo sapiens
tcatcagaggcatctggcaagg

SEQ ID NO: 6930994 - DNA, 22 bp, Homo sapiens
aaaaccttctagactttatatt

SEQ ID NO: 6930995 - DNA, 22 bp, Homo sapiens
ggccagctggagttccgggtgg

SEQ ID NO: 6930996 - DNA, 22 bp, Homo sapiens
tgcaggtgtagagttgggctcc

SEQ ID NO: 6930997 - DNA, 22 bp, Homo sapiens
ttatacgctcaatcctatcatc

SEQ ID NO: 6930998 - DNA, 15 bp, Homo sapiens
ggaacatttctgttt

SEQ ID NO: 6930999 - DNA, 22 bp, Homo sapiens
attttctgtaaaaaggcactaa

SEQ ID NO: 6931000 - DNA, 22 bp, Homo sapiens
cctgcccctcaaggcctggtgc

SEQ ID NO: 6931001 - DNA, 22 bp, Homo sapiens
gatgagaaggctcagatccaaa

SEQ ID NO: 6931002 - DNA, 22 bp, Homo sapiens
agagcagctggctgcatctaga

SEQ ID NO: 6931003 - DNA, 22 bp, Homo sapiens
agaatgcagtttgaaataaggt

SEQ ID NO: 6931004 - DNA, 22 bp, Homo sapiens
tgtcattttagtgcatcactca

SEQ ID NO: 6931005 - DNA, 22 bp, Homo sapiens
ggagtcagactttgattagtag

SEQ ID NO: 6931006 - DNA, 23 bp, Homo sapiens
tgctggaaggtccaatttgctca

SEQ ID NO: 6931007 - DNA, 19 bp, Homo sapiens
tggacctgtgcccatggct

SEQ ID NO: 6931008 - DNA, 22 bp, Homo sapiens
cagaacatccccactgctacct

SEQ ID NO: 6931009 - DNA, 22 bp, Homo sapiens
tctttcctctgagctcctgtag

SEQ ID NO: 6931010 - DNA, 22 bp, Homo sapiens
ttcaacccaagttctccatttt

SEQ ID NO: 6931011 - DNA, 22 bp, Homo sapiens
aagaatctctctactttattac

SEQ ID NO: 6931012 - DNA, 22 bp, Homo sapiens
agctttctagactctgtggtca

SEQ ID NO: 6931013 - DNA, 22 bp, Homo sapiens
acaggagccaaacacatgccag

SEQ ID NO: 6931014 - DNA, 22 bp, Homo sapiens
tagttctgtaacatttcaaggg

SEQ ID NO: 6931015 - DNA, 22 bp, Homo sapiens
agctcaaagctgttacattgta

SEQ ID NO: 6931016 - DNA, 22 bp, Homo sapiens
cttaggcagactgctgatgcag

SEQ ID NO: 6931017 - DNA, 23 bp, Homo sapiens
agcattgatgcaaggtgcccctg

SEQ ID NO: 6931018 - DNA, 22 bp, Homo sapiens
gggtcctatccacttttctatt

SEQ ID NO: 6931019 - DNA, 22 bp, Homo sapiens
agttttcaggaaagagttggtg

SEQ ID NO: 6931020 - DNA, 22 bp, Homo sapiens
catgtatatttctgtatgtgca

SEQ ID NO: 6931021 - DNA, 22 bp, Homo sapiens
tgcttgtcttcaggattatggt

SEQ ID NO: 6931022 - DNA, 22 bp, Homo sapiens
tcccacagggcttctctgtaca

SEQ ID NO: 6931023 - DNA, 22 bp, Homo sapiens
atcagcagctaaggaactaaca

SEQ ID NO: 6931024 - DNA, 22 bp, Homo sapiens
gctgcagcagaagttctcagag

SEQ ID NO: 6931025 - DNA, 22 bp, Homo sapiens
ttttatgttgctataataggta

SEQ ID NO: 6931026 - DNA, 22 bp, Homo sapiens
tgtagcacctagcagaaactct

SEQ ID NO: 6931027 - DNA, 22 bp, Homo sapiens
ctgatattcattatggagctcc

SEQ ID NO: 6931028 - DNA, 22 bp, Homo sapiens
gtgagaatgagattggaatgta

SEQ ID NO: 6931029 - DNA, 22 bp, Homo sapiens
gctcaagccttctgcccacctc

SEQ ID NO: 6931030 - DNA, 22 bp, Homo sapiens
gtgtgcatgtatatacttttat

SEQ ID NO: 6931031 - DNA, 22 bp, Homo sapiens
ttggaccaaattaaaagttggc

SEQ ID NO: 6931032 - DNA, 22 bp, Homo sapiens
agctgtttttgtctgctgatcc

SEQ ID NO: 6931033 - DNA, 22 bp, Homo sapiens
ttagccatatagtgctcttgta

SEQ ID NO: 6931034 - DNA, 22 bp, Homo sapiens
ctgtgccatctgcactctcgtc

SEQ ID NO: 6931035 - DNA, 22 bp, Homo sapiens
ttcagtctcaagtgctgctcac

SEQ ID NO: 6931036 - DNA, 22 bp, Homo sapiens
caaaggcaggtcatggccactt

SEQ ID NO: 6931037 - DNA, 22 bp, Homo sapiens
gggcaagaagctggaagcattc

SEQ ID NO: 6931038 - DNA, 22 bp, Homo sapiens
acaggtgataagaaaactcgct

SEQ ID NO: 6931039 - DNA, 19 bp, Homo sapiens
agattattgcacattcatg

SEQ ID NO: 6931040 - DNA, 22 bp, Homo sapiens
ccttctccctctgagaggaacc

SEQ ID NO: 6931041 - DNA, 22 bp, Homo sapiens
agccagctgtactgcctgctca

SEQ ID NO: 6931042 - DNA, 22 bp, Homo sapiens
atgagttttgggggatgttaga

SEQ ID NO: 6931043 - DNA, 22 bp, Homo sapiens
cagcagcagattcagcgtctgg

SEQ ID NO: 6931044 - DNA, 22 bp, Homo sapiens
agagtataggcaggatgccagt

SEQ ID NO: 6931045 - DNA, 22 bp, Homo sapiens
ctgctttatattgagcttgaaa

SEQ ID NO: 6931046 - DNA, 22 bp, Homo sapiens
atagcagttgtcaaactccatc

SEQ ID NO: 6931047 - DNA, 22 bp, Homo sapiens
atcagtccaccatactcatctt

SEQ ID NO: 6931048 - DNA, 22 bp, Homo sapiens
gagcccaggagtttgatgctgc

SEQ ID NO: 6931049 - DNA, 22 bp, Homo sapiens
gagttaaagtacctttgtatgt

SEQ ID NO: 6931050 - DNA, 22 bp, Homo sapiens
gggcctctgtgcagaggggcct

SEQ ID NO: 6931051 - DNA, 22 bp, Homo sapiens
gagtcagaaactcactctatag

SEQ ID NO: 6931052 - DNA, 22 bp, Homo sapiens
caggttagtatttttagttcat

SEQ ID NO: 6931053 - DNA, 22 bp, Homo sapiens
ctcctggctctctgtttagtgt

SEQ ID NO: 6931054 - DNA, 22 bp, Homo sapiens
aagcctgagcaacctgctggcg

SEQ ID NO: 6931055 - DNA, 22 bp, Homo sapiens
gtggatgcttaggcagcctggg

SEQ ID NO: 6931056 - DNA, 22 bp, Homo sapiens
tctgctgtgtccctggtctcct

SEQ ID NO: 6931057 - DNA, 22 bp, Homo sapiens
ctgtaggtttgctctgacctgg

SEQ ID NO: 6931058 - DNA, 22 bp, Homo sapiens
gaaaagtaaacactaggggtca

SEQ ID NO: 6931059 - DNA, 22 bp, Homo sapiens
tttgaaactctgaacatgtttc

SEQ ID NO: 6931060 - DNA, 22 bp, Homo sapiens
acaaagtgaaaagcatcgaatt

SEQ ID NO: 6931061 - DNA, 22 bp, Homo sapiens
tggctcagtctgggttgactga

SEQ ID NO: 6931062 - DNA, 22 bp, Homo sapiens
taagtgcaatgttttacttaaa

SEQ ID NO: 6931063 - DNA, 22 bp, Homo sapiens
ggattcagtgtctgttaatagt

SEQ ID NO: 6931064 - DNA, 22 bp, Homo sapiens
aggtaaaatgagtctccattat

SEQ ID NO: 6931065 - DNA, 22 bp, Homo sapiens
ggatgggcagacaggacggcac

SEQ ID NO: 6931066 - DNA, 22 bp, Homo sapiens
gttcaaatctcaggacttcaga

SEQ ID NO: 6931067 - DNA, 22 bp, Homo sapiens
aggagacccaatgccagaaaga

SEQ ID NO: 6931068 - DNA, 22 bp, Homo sapiens
tttgcatttataagttggtgga

SEQ ID NO: 6931069 - DNA, 22 bp, Homo sapiens
ggcgtgggcgaggtgctctatc

SEQ ID NO: 6931070 - DNA, 22 bp, Homo sapiens
tcccagaggcagttggtaactt

SEQ ID NO: 6931071 - DNA, 22 bp, Homo sapiens
gagtggctaaagtatgtcatgg

SEQ ID NO: 6931072 - DNA, 22 bp, Homo sapiens
ctgtatcagttcagaggtgcag

SEQ ID NO: 6931073 - DNA, 22 bp, Homo sapiens
gagtgactattggatcagaatt

SEQ ID NO: 6931074 - DNA, 22 bp, Homo sapiens
cattatgatggtaattttctct

SEQ ID NO: 6931075 - DNA, 22 bp, Homo sapiens
ttgaggtccaggtgtgggcagg

SEQ ID NO: 6931076 - DNA, 22 bp, Homo sapiens
atgcacaggacagcctctactc

SEQ ID NO: 6931077 - DNA, 22 bp, Homo sapiens
cccactttggttgcactctgcc

SEQ ID NO: 6931078 - DNA, 22 bp, Homo sapiens
gaaacttacttactcacatttc

SEQ ID NO: 6931079 - DNA, 22 bp, Homo sapiens
tttcacattggcttctatttct

SEQ ID NO: 6931080 - DNA, 22 bp, Homo sapiens
taattctagattgacattttga

SEQ ID NO: 6931081 - DNA, 22 bp, Homo sapiens
ctgtggctgcagaccttaaaca

SEQ ID NO: 6931082 - DNA, 22 bp, Homo sapiens
actggctgagttgcttcagcaa

SEQ ID NO: 6931083 - DNA, 22 bp, Homo sapiens
ctgcgttttgacatttcggggc

SEQ ID NO: 6931084 - DNA, 18 bp, Homo sapiens
gtctggaggtcaggagct

SEQ ID NO: 6931085 - DNA, 21 bp, Homo sapiens
agtctgttaggatgactctga

SEQ ID NO: 6931086 - DNA, 22 bp, Homo sapiens
gtctcctgagccttgactgcaa

SEQ ID NO: 6931087 - DNA, 22 bp, Homo sapiens
gggctcaggcctggcctctcac

SEQ ID NO: 6931088 - DNA, 22 bp, Homo sapiens
aggaaactcaaagtgtcaggta

SEQ ID NO: 6931089 - DNA, 22 bp, Homo sapiens
tgtctcagaggcaggaagagcc

SEQ ID NO: 6931090 - DNA, 22 bp, Homo sapiens
ttaggtctgtttataaaacagt

SEQ ID NO: 6931091 - DNA, 21 bp, Homo sapiens
aggattttgttgaagtttctg

SEQ ID NO: 6931092 - DNA, 22 bp, Homo sapiens
tgctttcaatgaattgtatact

SEQ ID NO: 6931093 - DNA, 22 bp, Homo sapiens
cagcacctgttagcattaaata

SEQ ID NO: 6931094 - DNA, 22 bp, Homo sapiens
ccagctctgtaagctgtgaaat

SEQ ID NO: 6931095 - DNA, 22 bp, Homo sapiens
ttatttattcattctgtctgtc

SEQ ID NO: 6931096 - DNA, 22 bp, Homo sapiens
gcaagtaggaagtgtcctcctt

SEQ ID NO: 6931097 - DNA, 22 bp, Homo sapiens
tcctgaagatgaaaagagaggt

SEQ ID NO: 6931098 - DNA, 17 bp, Homo sapiens
ctcctctctgggttact

SEQ ID NO: 6931099 - DNA, 22 bp, Homo sapiens
tgagtcagccttggcagcccct

SEQ ID NO: 6931100 - DNA, 22 bp, Homo sapiens
tgtgtgtgtaaaagcatttata

SEQ ID NO: 6931101 - DNA, 22 bp, Homo sapiens
catatattatggactgcagaat

SEQ ID NO: 6931102 - DNA, 22 bp, Homo sapiens
actgagagaagggattttaagt

SEQ ID NO: 6931103 - DNA, 22 bp, Homo sapiens
tagccatcttcccaccccatct

SEQ ID NO: 6931104 - DNA, 22 bp, Homo sapiens
tgtgggaatgacgaggaagagg

SEQ ID NO: 6931105 - DNA, 22 bp, Homo sapiens
ccaggctggagtgcaatggtgc

SEQ ID NO: 6931106 - DNA, 22 bp, Homo sapiens
agcagactccattgagtgagtc

SEQ ID NO: 6931107 - DNA, 22 bp, Homo sapiens
tcttgtgtggtggaagatatgg

SEQ ID NO: 6931108 - DNA, 22 bp, Homo sapiens
ttggagagcagtaaaccacact

SEQ ID NO: 6931109 - DNA, 22 bp, Homo sapiens
cttgcctgaggaacagagggta

SEQ ID NO: 6931110 - DNA, 21 bp, Homo sapiens
acagattttatatctctgctg

SEQ ID NO: 6931111 - DNA, 22 bp, Homo sapiens
ttatatcagaaggtgagattga

SEQ ID NO: 6931112 - DNA, 22 bp, Homo sapiens
accctggaggtctacagtgcag

SEQ ID NO: 6931113 - DNA, 22 bp, Homo sapiens
gaggggcaatgagggaaagagt

SEQ ID NO: 6931114 - DNA, 22 bp, Homo sapiens
caaggctgtgttagctgccctc

SEQ ID NO: 6931115 - DNA, 22 bp, Homo sapiens
aaactgcacaagggtgcatagc

SEQ ID NO: 6931116 - DNA, 22 bp, Homo sapiens
ggctctataaaggggcgcgcgc

SEQ ID NO: 6931117 - DNA, 21 bp, Homo sapiens
tagggcaggcattggaagaga

SEQ ID NO: 6931118 - DNA, 22 bp, Homo sapiens
tatacatcagtatgtttagata

SEQ ID NO: 6931119 - DNA, 22 bp, Homo sapiens
tcagcagtgagaattaatgttg

SEQ ID NO: 6931120 - DNA, 22 bp, Homo sapiens
tttctcctctccagagtgcagt

SEQ ID NO: 6931121 - DNA, 22 bp, Homo sapiens
gtgccaatgcactctagcctgg

SEQ ID NO: 6931122 - DNA, 19 bp, Homo sapiens
gcccaggggcccgatgctg

SEQ ID NO: 6931123 - DNA, 22 bp, Homo sapiens
ttctgccctgccagtgggctca

SEQ ID NO: 6931124 - DNA, 22 bp, Homo sapiens
ttttgctttaagatggagagga

SEQ ID NO: 6931125 - DNA, 22 bp, Homo sapiens
aattcttgttgttagtatattt

SEQ ID NO: 6931126 - DNA, 22 bp, Homo sapiens
tggctggagtgggagaagttta

SEQ ID NO: 6931127 - DNA, 22 bp, Homo sapiens
aaagtatcttactgcagccgag

SEQ ID NO: 6931128 - DNA, 22 bp, Homo sapiens
tgagctgatggcatccctgttt

SEQ ID NO: 6931129 - DNA, 22 bp, Homo sapiens
caaggcatgtaacaatggcttt

SEQ ID NO: 6931130 - DNA, 22 bp, Homo sapiens
tgctcctgacagttttaggctc

SEQ ID NO: 6931131 - DNA, 22 bp, Homo sapiens
cagtgtttgttgagaaaggcaa

SEQ ID NO: 6931132 - DNA, 22 bp, Homo sapiens
cacctcatgtcatcagtaaaat

SEQ ID NO: 6931133 - DNA, 22 bp, Homo sapiens
cctcagatgtcttaaggcactg

SEQ ID NO: 6931134 - DNA, 22 bp, Homo sapiens
tcaggcttgaggtctgtatgtg

SEQ ID NO: 6931135 - DNA, 22 bp, Homo sapiens
tatttcagagttgttttctgtc

SEQ ID NO: 6931136 - DNA, 22 bp, Homo sapiens
cttgtattcagcatcttaacta

SEQ ID NO: 6931137 - DNA, 22 bp, Homo sapiens
tcctgggcagcctctctggaag

SEQ ID NO: 6931138 - DNA, 22 bp, Homo sapiens
gtcctcaggcttgagtgtttat

SEQ ID NO: 6931139 - DNA, 22 bp, Homo sapiens
cggggacacactggcagctcct

SEQ ID NO: 6931140 - DNA, 22 bp, Homo sapiens
tcagactggtgaccctgaatct

SEQ ID NO: 6931141 - DNA, 22 bp, Homo sapiens
ccgtcccctctgaccttgctga

SEQ ID NO: 6931142 - DNA, 22 bp, Homo sapiens
tttccagtccctggatttaacc

SEQ ID NO: 6931143 - DNA, 22 bp, Homo sapiens
aaccccagtaccccaggatatg

SEQ ID NO: 6931144 - DNA, 22 bp, Homo sapiens
agcagggcactggaaggcactg

SEQ ID NO: 6931145 - DNA, 22 bp, Homo sapiens
tgacatcctgagtacataagag

SEQ ID NO: 6931146 - DNA, 22 bp, Homo sapiens
atcaaaaccttgacttttaatg

SEQ ID NO: 6931147 - DNA, 22 bp, Homo sapiens
gttatgtaatctaacactcagt

SEQ ID NO: 6931148 - DNA, 16 bp, Homo sapiens
gagctggtgccggagc

SEQ ID NO: 6931149 - DNA, 23 bp, Homo sapiens
tcctcgcaggagggagatgatgc

SEQ ID NO: 6931150 - DNA, 20 bp, Homo sapiens
gctccaggtcagagaggacg

SEQ ID NO: 6931151 - DNA, 22 bp, Homo sapiens
gcctcagccggcggacgccagg

SEQ ID NO: 6931152 - DNA, 22 bp, Homo sapiens
tctcatgttgcttaactctatg

SEQ ID NO: 6931153 - DNA, 22 bp, Homo sapiens
caatatataggaacaacttagg

SEQ ID NO: 6931154 - DNA, 22 bp, Homo sapiens
taacagagatagaaatgtaaag

SEQ ID NO: 6931155 - DNA, 23 bp, Homo sapiens
tctctctggcaaatttcacatat

SEQ ID NO: 6931156 - DNA, 22 bp, Homo sapiens
atacatggaagatgcttagcac

SEQ ID NO: 6931157 - DNA, 22 bp, Homo sapiens
gaaaatgtttgtccggagctga

SEQ ID NO: 6931158 - DNA, 23 bp, Homo sapiens
gaggtacagcaccagtgaatagg

SEQ ID NO: 6931159 - DNA, 22 bp, Homo sapiens
gacaaaagtgttttgaacaagg

SEQ ID NO: 6931160 - DNA, 22 bp, Homo sapiens
cttacccaaattagagttacca

SEQ ID NO: 6931161 - DNA, 22 bp, Homo sapiens
ctttccagacctccttgtagct

SEQ ID NO: 6931162 - DNA, 22 bp, Homo sapiens
ttcttatgttcacataattcca

SEQ ID NO: 6931163 - DNA, 22 bp, Homo sapiens
agtcactgggctgcttcctata

SEQ ID NO: 6931164 - DNA, 22 bp, Homo sapiens
ccaagagcctcagctgccgtgc

SEQ ID NO: 6931165 - DNA, 22 bp, Homo sapiens
ctcagtgtcttattgtacacat

SEQ ID NO: 6931166 - DNA, 22 bp, Homo sapiens
tggctcacaatctcccatgaag

SEQ ID NO: 6931167 - DNA, 22 bp, Homo sapiens
gacttgtagaatcttctctgca

SEQ ID NO: 6931168 - DNA, 22 bp, Homo sapiens
gtttcctgtctgctttactata

SEQ ID NO: 6931169 - DNA, 22 bp, Homo sapiens
tacaacactggttcgacatgtg

SEQ ID NO: 6931170 - DNA, 22 bp, Homo sapiens
tgacccttagaagctgcagcga

SEQ ID NO: 6931171 - DNA, 22 bp, Homo sapiens
agatagacatacaatgtatgaa

SEQ ID NO: 6931172 - DNA, 22 bp, Homo sapiens
tacagtgaccctatttccaaat

SEQ ID NO: 6931173 - DNA, 22 bp, Homo sapiens
tgttgtactcaacagatgaatt

SEQ ID NO: 6931174 - DNA, 22 bp, Homo sapiens
tagattcatgcagtatgctagt

SEQ ID NO: 6931175 - DNA, 22 bp, Homo sapiens
tacagaaatactggggggttct

SEQ ID NO: 6931176 - DNA, 22 bp, Homo sapiens
attgtgtatgttaattctgtaa

SEQ ID NO: 6931177 - DNA, 22 bp, Homo sapiens
caggtggcagtgcctgcattct

SEQ ID NO: 6931178 - DNA, 22 bp, Homo sapiens
gatgagtaatagctaatggttc

SEQ ID NO: 6931179 - DNA, 19 bp, Homo sapiens
aggagaagtagcagaaatt

SEQ ID NO: 6931180 - DNA, 17 bp, Homo sapiens
aggcaggcagagcggga

SEQ ID NO: 6931181 - DNA, 22 bp, Homo sapiens
cgagcagaagcctggtggtctg

SEQ ID NO: 6931182 - DNA, 22 bp, Homo sapiens
tgggagaagacgtactttagac

SEQ ID NO: 6931183 - DNA, 19 bp, Homo sapiens
acatttaaattcagatctc

SEQ ID NO: 6931184 - DNA, 22 bp, Homo sapiens
agcaaggcagctttcactgctt

SEQ ID NO: 6931185 - DNA, 22 bp, Homo sapiens
gggcaggtatttatcttctatt

SEQ ID NO: 6931186 - DNA, 22 bp, Homo sapiens
gtcctgtgtaagtacttgctca

SEQ ID NO: 6931187 - DNA, 22 bp, Homo sapiens
ttcagtatattactcttgtcaa

SEQ ID NO: 6931188 - DNA, 22 bp, Homo sapiens
atacatctggatgtatgcattt

SEQ ID NO: 6931189 - DNA, 22 bp, Homo sapiens
ttctacaggtactgaagtacat

SEQ ID NO: 6931190 - DNA, 22 bp, Homo sapiens
ttctggacacgtgactctcatt

SEQ ID NO: 6931191 - DNA, 22 bp, Homo sapiens
tcccagaaccttttagcttcac

SEQ ID NO: 6931192 - DNA, 22 bp, Homo sapiens
ccaggccagcaggcacacctgc

SEQ ID NO: 6931193 - DNA, 22 bp, Homo sapiens
atgggagtgtgcttgaggagtt

SEQ ID NO: 6931194 - DNA, 22 bp, Homo sapiens
cagccttcgacagttggagtag

SEQ ID NO: 6931195 - DNA, 22 bp, Homo sapiens
tattatgaggcttagggatgac

SEQ ID NO: 6931196 - DNA, 22 bp, Homo sapiens
gaccaggctgttccagtctaac

SEQ ID NO: 6931197 - DNA, 22 bp, Homo sapiens
tgtgtagaggtaagtaacactt

SEQ ID NO: 6931198 - DNA, 22 bp, Homo sapiens
aagggctgagcacagtgagcca

SEQ ID NO: 6931199 - DNA, 22 bp, Homo sapiens
ttatttcctgacacagctgatt

SEQ ID NO: 6931200 - DNA, 23 bp, Homo sapiens
attgccagacggcccctgctcgc

SEQ ID NO: 6931201 - DNA, 22 bp, Homo sapiens
gaatgctggcttacaggcagtt

SEQ ID NO: 6931202 - DNA, 22 bp, Homo sapiens
ctcgggcaccctggttctggtg

SEQ ID NO: 6931203 - DNA, 22 bp, Homo sapiens
ccaatgagaggtatcagatcct

SEQ ID NO: 6931204 - DNA, 22 bp, Homo sapiens
ccagccctacagtatcacctgt

SEQ ID NO: 6931205 - DNA, 22 bp, Homo sapiens
tctgaacatggcttcctcttca

SEQ ID NO: 6931206 - DNA, 22 bp, Homo sapiens
gcgcaggtgctgctggagcagc

SEQ ID NO: 6931207 - DNA, 22 bp, Homo sapiens
acttgattttgaacctttctac

SEQ ID NO: 6931208 - DNA, 22 bp, Homo sapiens
agctgtcctgtgggagggagtg

SEQ ID NO: 6931209 - DNA, 22 bp, Homo sapiens
ccagtgggagggagctaggcca

SEQ ID NO: 6931210 - DNA, 23 bp, Homo sapiens
ttcacagattaaatatttcttct

SEQ ID NO: 6931211 - DNA, 22 bp, Homo sapiens
tctggaattctcaagtcctgga

SEQ ID NO: 6931212 - DNA, 22 bp, Homo sapiens
ccaatgaatatatttcatatga

SEQ ID NO: 6931213 - DNA, 22 bp, Homo sapiens
atttcatgagttattatagtgg

SEQ ID NO: 6931214 - DNA, 22 bp, Homo sapiens
agagatgagaacatgcttggat

SEQ ID NO: 6931215 - DNA, 21 bp, Homo sapiens
gtttttcagccctgaggtgag

SEQ ID NO: 6931216 - DNA, 22 bp, Homo sapiens
ttttgtgagatgcgtatgaatg

SEQ ID NO: 6931217 - DNA, 22 bp, Homo sapiens
tattcttaattgctgagctgaa

SEQ ID NO: 6931218 - DNA, 22 bp, Homo sapiens
tcagggaaacctaaggaagcca

SEQ ID NO: 6931219 - DNA, 22 bp, Homo sapiens
aaagtgtaaaagcatgttaggg

SEQ ID NO: 6931220 - DNA, 23 bp, Homo sapiens
ttcataggcacattgcgcacaga

SEQ ID NO: 6931221 - DNA, 22 bp, Homo sapiens
tgcatttatttgaattgatcta

SEQ ID NO: 6931222 - DNA, 19 bp, Homo sapiens
agggaatccggctgaggga

SEQ ID NO: 6931223 - DNA, 22 bp, Homo sapiens
gtcatcttaaggactgctatag

SEQ ID NO: 6931224 - DNA, 22 bp, Homo sapiens
tgccttgcgggcgtttctgttg

SEQ ID NO: 6931225 - DNA, 17 bp, Homo sapiens
atggctttgtcacacag

SEQ ID NO: 6931226 - DNA, 22 bp, Homo sapiens
gactgggccaaggtcagcagct

SEQ ID NO: 6931227 - DNA, 22 bp, Homo sapiens
aatagctgagggtgaggcccaa

SEQ ID NO: 6931228 - DNA, 22 bp, Homo sapiens
tggagagctgttgaaatgcaga

SEQ ID NO: 6931229 - DNA, 22 bp, Homo sapiens
tacctgggcccaccagtgcctg

SEQ ID NO: 6931230 - DNA, 22 bp, Homo sapiens
cagtgattcacgcccttgggcc

SEQ ID NO: 6931231 - DNA, 22 bp, Homo sapiens
agcttcccaggagaatcaggga

SEQ ID NO: 6931232 - DNA, 20 bp, Homo sapiens
gagcctgggaagtctaaggt

SEQ ID NO: 6931233 - DNA, 23 bp, Homo sapiens
tggcatcttggcatcttgctgct

SEQ ID NO: 6931234 - DNA, 22 bp, Homo sapiens
tctccacactttctctcccagg

SEQ ID NO: 6931235 - DNA, 22 bp, Homo sapiens
ctttgactttgtcctcaggaaa

SEQ ID NO: 6931236 - DNA, 22 bp, Homo sapiens
aaagagctggcatttatagtct

SEQ ID NO: 6931237 - DNA, 22 bp, Homo sapiens
aaagagctaacattgccgagat

SEQ ID NO: 6931238 - DNA, 22 bp, Homo sapiens
aagtagacaataataagacatg

SEQ ID NO: 6931239 - DNA, 22 bp, Homo sapiens
ggaccagatgaagagttggagg

SEQ ID NO: 6931240 - DNA, 22 bp, Homo sapiens
tgagagtctcagacctcctggt

SEQ ID NO: 6931241 - DNA, 22 bp, Homo sapiens
aattcacaattatgttgggaga

SEQ ID NO: 6931242 - DNA, 22 bp, Homo sapiens
tctagagctttttcctcttgta

SEQ ID NO: 6931243 - DNA, 22 bp, Homo sapiens
tggctttataaaaggaaagagg

SEQ ID NO: 6931244 - DNA, 22 bp, Homo sapiens
cctctgtagtaagagaacatat

SEQ ID NO: 6931245 - DNA, 22 bp, Homo sapiens
gaagttacttgataaagaccga

SEQ ID NO: 6931246 - DNA, 22 bp, Homo sapiens
cacccacattccatcactctgc

SEQ ID NO: 6931247 - DNA, 23 bp, Homo sapiens
ccagctgtgcctggcccaggagc

SEQ ID NO: 6931248 - DNA, 22 bp, Homo sapiens
cagcagttatgagtagaatagt

SEQ ID NO: 6931249 - DNA, 22 bp, Homo sapiens
gggcatggggcggacctggttc

SEQ ID NO: 6931250 - DNA, 22 bp, Homo sapiens
cctggctctggggcggacagct

SEQ ID NO: 6931251 - DNA, 22 bp, Homo sapiens
aatgaagccaggtagaagagaa

SEQ ID NO: 6931252 - DNA, 22 bp, Homo sapiens
cctggaagctgatgtttaggac

SEQ ID NO: 6931253 - DNA, 22 bp, Homo sapiens
gtggctggagtatgaggaaagg

SEQ ID NO: 6931254 - DNA, 22 bp, Homo sapiens
acagattgggaactgtctcctt

SEQ ID NO: 6931255 - DNA, 21 bp, Homo sapiens
catgcatacatatacaagctt

SEQ ID NO: 6931256 - DNA, 23 bp, Homo sapiens
atatcacacccagtacagtctcc

SEQ ID NO: 6931257 - DNA, 23 bp, Homo sapiens
acacatttttcccgttctgaggt

SEQ ID NO: 6931258 - DNA, 22 bp, Homo sapiens
tacaatatgtggccttttgtga

SEQ ID NO: 6931259 - DNA, 22 bp, Homo sapiens
tagtttaggtcgtacaagcaaa

SEQ ID NO: 6931260 - DNA, 22 bp, Homo sapiens
ggccagcctggggctcccagac

SEQ ID NO: 6931261 - DNA, 22 bp, Homo sapiens
atgaattgtaaattccttgaaa

SEQ ID NO: 6931262 - DNA, 18 bp, Homo sapiens
gggctaggcaaggaccac

SEQ ID NO: 6931263 - DNA, 19 bp, Homo sapiens
agaatgcatttctgctgtc

SEQ ID NO: 6931264 - DNA, 22 bp, Homo sapiens
atcaggaaatacttatttataa

SEQ ID NO: 6931265 - DNA, 22 bp, Homo sapiens
tgctacagagcgggggctcagt

SEQ ID NO: 6931266 - DNA, 22 bp, Homo sapiens
acctttgctaggtaggtattgg

SEQ ID NO: 6931267 - DNA, 22 bp, Homo sapiens
ttgctggtaaagtctttatcgg

SEQ ID NO: 6931268 - DNA, 22 bp, Homo sapiens
cacagtaactcctgacccctcg

SEQ ID NO: 6931269 - DNA, 22 bp, Homo sapiens
tcatctgtctgttcaacagcct

SEQ ID NO: 6931270 - DNA, 20 bp, Homo sapiens
atcagaagtgatattaacca

SEQ ID NO: 6931271 - DNA, 19 bp, Homo sapiens
ggagaagcccaggaatcct

SEQ ID NO: 6931272 - DNA, 22 bp, Homo sapiens
tcttcatgttgcttattctggg

SEQ ID NO: 6931273 - DNA, 22 bp, Homo sapiens
accaaatgctgacagcatgact

SEQ ID NO: 6931274 - DNA, 22 bp, Homo sapiens
tttgcaagatgaaaaagttcta

SEQ ID NO: 6931275 - DNA, 22 bp, Homo sapiens
tgtctataagagttgtttattt

SEQ ID NO: 6931276 - DNA, 22 bp, Homo sapiens
atggaggtgatgttaatgatgc

SEQ ID NO: 6931277 - DNA, 21 bp, Homo sapiens
gataaggcaggaggataagta

SEQ ID NO: 6931278 - DNA, 22 bp, Homo sapiens
gctgcccagcaggccccagggg

SEQ ID NO: 6931279 - DNA, 20 bp, Homo sapiens
acaggctttggagtctgaat

SEQ ID NO: 6931280 - DNA, 22 bp, Homo sapiens
aggcctctgggcctgcgggttt

SEQ ID NO: 6931281 - DNA, 22 bp, Homo sapiens
ttgttattattactaagtcttc

SEQ ID NO: 6931282 - DNA, 22 bp, Homo sapiens
gacctgaaatgggggcctgtcc

SEQ ID NO: 6931283 - DNA, 22 bp, Homo sapiens
tagcctctctcctccacaacct

SEQ ID NO: 6931284 - DNA, 22 bp, Homo sapiens
aagcccagtttcacactgagac

SEQ ID NO: 6931285 - DNA, 22 bp, Homo sapiens
gtgggggagatgcttaggtccg

SEQ ID NO: 6931286 - DNA, 22 bp, Homo sapiens
aaggctggtcagatgtggtgaa

SEQ ID NO: 6931287 - DNA, 22 bp, Homo sapiens
tttacacaaaatgttagtagat

SEQ ID NO: 6931288 - DNA, 22 bp, Homo sapiens
caaaagcagcaagtttatatgt

SEQ ID NO: 6931289 - DNA, 22 bp, Homo sapiens
taggcttccgagtcttggtatc

SEQ ID NO: 6931290 - DNA, 22 bp, Homo sapiens
gtcccagggaggttcagggctt

SEQ ID NO: 6931291 - DNA, 22 bp, Homo sapiens
caaatgaagtccaaagggctta

SEQ ID NO: 6931292 - DNA, 22 bp, Homo sapiens
agagacaggagttctgtttcca

SEQ ID NO: 6931293 - DNA, 22 bp, Homo sapiens
atggataacccagttcatttct

SEQ ID NO: 6931294 - DNA, 22 bp, Homo sapiens
taaatctttaggaagctcaaac

SEQ ID NO: 6931295 - DNA, 22 bp, Homo sapiens
attgctttagaaagaaaaatat

SEQ ID NO: 6931296 - DNA, 20 bp, Homo sapiens
ggatggctccacatcatttt

SEQ ID NO: 6931297 - DNA, 22 bp, Homo sapiens
caagccagcttgatgacctgtc

SEQ ID NO: 6931298 - DNA, 22 bp, Homo sapiens
cctcagtctgtctgatctgcca

SEQ ID NO: 6931299 - DNA, 22 bp, Homo sapiens
tattccgtggtgccaggtagta

SEQ ID NO: 6931300 - DNA, 22 bp, Homo sapiens
aggtagatcaactggggaggga

SEQ ID NO: 6931301 - DNA, 22 bp, Homo sapiens
gggcaagtgtcaagcatgtcat

SEQ ID NO: 6931302 - DNA, 20 bp, Homo sapiens
aagattcattgtaattaggg

SEQ ID NO: 6931303 - DNA, 22 bp, Homo sapiens
aagcaggagatgggtgcttttc

SEQ ID NO: 6931304 - DNA, 22 bp, Homo sapiens
tgtacagtcatgctttctgttc

SEQ ID NO: 6931305 - DNA, 22 bp, Homo sapiens
gactgaacagtaagaggcttta

SEQ ID NO: 6931306 - DNA, 22 bp, Homo sapiens
cggcttcttcgaggtgtctgcg

SEQ ID NO: 6931307 - DNA, 19 bp, Homo sapiens
cgctctgggtttcgtgtca

SEQ ID NO: 6931308 - DNA, 22 bp, Homo sapiens
tggactcttggaccttctctaa

SEQ ID NO: 6931309 - DNA, 22 bp, Homo sapiens
ctctctttttcgtgtgccgaag

SEQ ID NO: 6931310 - DNA, 19 bp, Homo sapiens
gaggcccatgagggtgctc

SEQ ID NO: 6931311 - DNA, 20 bp, Homo sapiens
catctgagcccacagaagtc

SEQ ID NO: 6931312 - DNA, 22 bp, Homo sapiens
ctaacttcccctctggcagaaa

SEQ ID NO: 6931313 - DNA, 22 bp, Homo sapiens
ttgaaacatatacaaagtggtg

SEQ ID NO: 6931314 - DNA, 22 bp, Homo sapiens
ccagctccactgtcagatgaga

SEQ ID NO: 6931315 - DNA, 22 bp, Homo sapiens
gttaggatatggtgaaatggag

SEQ ID NO: 6931316 - DNA, 22 bp, Homo sapiens
aacatgctcttcctggctagtc

SEQ ID NO: 6931317 - DNA, 22 bp, Homo sapiens
tggcactttacacccatttggc

SEQ ID NO: 6931318 - DNA, 22 bp, Homo sapiens
aggcaacacttgcattttttag

SEQ ID NO: 6931319 - DNA, 22 bp, Homo sapiens
caggctccactgtaggcagctc

SEQ ID NO: 6931320 - DNA, 23 bp, Homo sapiens
cagtataatgtatggatggggca

SEQ ID NO: 6931321 - DNA, 22 bp, Homo sapiens
gcttcagcccatcccagtacat

SEQ ID NO: 6931322 - DNA, 23 bp, Homo sapiens
taaatttcttgattcttatgtga

SEQ ID NO: 6931323 - DNA, 22 bp, Homo sapiens
ttcatagttcagcaaaagagaa

SEQ ID NO: 6931324 - DNA, 22 bp, Homo sapiens
ttatgagctaagttgtggcccc

SEQ ID NO: 6931325 - DNA, 22 bp, Homo sapiens
tcacatttctgattataccaaa

SEQ ID NO: 6931326 - DNA, 22 bp, Homo sapiens
tagttaaagattctgttaagag

SEQ ID NO: 6931327 - DNA, 22 bp, Homo sapiens
tcagacttgactttgtaagttt

SEQ ID NO: 6931328 - DNA, 19 bp, Homo sapiens
ctgctgggtgctgagggag

SEQ ID NO: 6931329 - DNA, 22 bp, Homo sapiens
gcaactttagggccagcaagta

SEQ ID NO: 6931330 - DNA, 22 bp, Homo sapiens
tgggaacacctgctgcccagtg

SEQ ID NO: 6931331 - DNA, 22 bp, Homo sapiens
tgagcttcctccctgcatccat

SEQ ID NO: 6931332 - DNA, 22 bp, Homo sapiens
tccagcctaggggaacagctgc

SEQ ID NO: 6931333 - DNA, 22 bp, Homo sapiens
gtgggccagcattttgaagagt

SEQ ID NO: 6931334 - DNA, 22 bp, Homo sapiens
aggctccttgctcacaggctca

SEQ ID NO: 6931335 - DNA, 22 bp, Homo sapiens
ctcctggatgcaggctgtctgc

SEQ ID NO: 6931336 - DNA, 22 bp, Homo sapiens
agtgatgtcttttaaattacat

SEQ ID NO: 6931337 - DNA, 22 bp, Homo sapiens
attatgctcttcatctctgtag

SEQ ID NO: 6931338 - DNA, 22 bp, Homo sapiens
catcaggaaaaaactggagcca

SEQ ID NO: 6931339 - DNA, 22 bp, Homo sapiens
gggagctggagctggaagactc

SEQ ID NO: 6931340 - DNA, 22 bp, Homo sapiens
gacagagtgcagggctagaaga

SEQ ID NO: 6931341 - DNA, 22 bp, Homo sapiens
aaatcgttataatgttaagcct

SEQ ID NO: 6931342 - DNA, 21 bp, Homo sapiens
aaactgaagagacaggaactt

SEQ ID NO: 6931343 - DNA, 22 bp, Homo sapiens
cacattaaatagtagggatgct

SEQ ID NO: 6931344 - DNA, 22 bp, Homo sapiens
atgggctgtccattgctggctg

SEQ ID NO: 6931345 - DNA, 22 bp, Homo sapiens
ggcgcagttgagcgtgctgttc

SEQ ID NO: 6931346 - DNA, 19 bp, Homo sapiens
ggcatccacgaatgcagag

SEQ ID NO: 6931347 - DNA, 22 bp, Homo sapiens
catgtataagcgctaggagtgc

SEQ ID NO: 6931348 - DNA, 22 bp, Homo sapiens
ggtttcctgcattgggaaattt

SEQ ID NO: 6931349 - DNA, 22 bp, Homo sapiens
cgtgtgcgtgcatatgcacaag

SEQ ID NO: 6931350 - DNA, 22 bp, Homo sapiens
tgctgcctttcaatgttgtcat

SEQ ID NO: 6931351 - DNA, 22 bp, Homo sapiens
tagacactagggatttagtact

SEQ ID NO: 6931352 - DNA, 22 bp, Homo sapiens
gctgctgcttgaaggctcggag

SEQ ID NO: 6931353 - DNA, 22 bp, Homo sapiens
tttcatgcctggaattgccctt

SEQ ID NO: 6931354 - DNA, 22 bp, Homo sapiens
ttctatatgacttctaggcagg

SEQ ID NO: 6931355 - DNA, 22 bp, Homo sapiens
accagctggtcagttgaagatt

SEQ ID NO: 6931356 - DNA, 22 bp, Homo sapiens
ttacagtttatccaggaagagc

SEQ ID NO: 6931357 - DNA, 22 bp, Homo sapiens
tgctccaggtgtgcctctcatg

SEQ ID NO: 6931358 - DNA, 22 bp, Homo sapiens
atcaggaagatctagcgaatgt

SEQ ID NO: 6931359 - DNA, 22 bp, Homo sapiens
ttgcttcatatttgtggcttgc

SEQ ID NO: 6931360 - DNA, 22 bp, Homo sapiens
aaacttcaactggaatgggcta

SEQ ID NO: 6931361 - DNA, 22 bp, Homo sapiens
gcttctgacagcacctgaactt

SEQ ID NO: 6931362 - DNA, 22 bp, Homo sapiens
ctcagtgcagctaggcatgaga

SEQ ID NO: 6931363 - DNA, 19 bp, Homo sapiens
tccagtttggcaggaagac

SEQ ID NO: 6931364 - DNA, 22 bp, Homo sapiens
ttctgtggtctcccatgtctgt

SEQ ID NO: 6931365 - DNA, 22 bp, Homo sapiens
tataggaataaagtggggtata

SEQ ID NO: 6931366 - DNA, 22 bp, Homo sapiens
aatgagttattaggtgtaagtg

SEQ ID NO: 6931367 - DNA, 20 bp, Homo sapiens
catgcctgctggtatctggc

SEQ ID NO: 6931368 - DNA, 22 bp, Homo sapiens
tgagcttccctcctgcactaca

SEQ ID NO: 6931369 - DNA, 18 bp, Homo sapiens
agagcagcggcatcacac

SEQ ID NO: 6931370 - DNA, 22 bp, Homo sapiens
agtgctttgagcgtttgaaaag

SEQ ID NO: 6931371 - DNA, 20 bp, Homo sapiens
agctgctctcatccagacct

SEQ ID NO: 6931372 - DNA, 22 bp, Homo sapiens
ctcagtgctagaagtagattgc

SEQ ID NO: 6931373 - DNA, 22 bp, Homo sapiens
gcctgggtctcctccgcttccc

SEQ ID NO: 6931374 - DNA, 22 bp, Homo sapiens
tttgctttcccttgtagaaagt

SEQ ID NO: 6931375 - DNA, 22 bp, Homo sapiens
cactatctactattgtggttat

SEQ ID NO: 6931376 - DNA, 22 bp, Homo sapiens
gggctctgcagagaactggctc

SEQ ID NO: 6931377 - DNA, 22 bp, Homo sapiens
gaaccttatggtaaatctagag

SEQ ID NO: 6931378 - DNA, 22 bp, Homo sapiens
gcagggacacctttgtgaagct

SEQ ID NO: 6931379 - DNA, 22 bp, Homo sapiens
caacatataatatttgagttct

SEQ ID NO: 6931380 - DNA, 18 bp, Homo sapiens
tgctgggtaactgtatgg

SEQ ID NO: 6931381 - DNA, 22 bp, Homo sapiens
gtctgctgttcagagatgttgc

SEQ ID NO: 6931382 - DNA, 22 bp, Homo sapiens
cttcaaaagccagaagcctgcg

SEQ ID NO: 6931383 - DNA, 22 bp, Homo sapiens
cctctggatctttctccacact

SEQ ID NO: 6931384 - DNA, 22 bp, Homo sapiens
cctggaaagctgccctgtgaca

SEQ ID NO: 6931385 - DNA, 20 bp, Homo sapiens
gcacatctgctttggatttc

SEQ ID NO: 6931386 - DNA, 22 bp, Homo sapiens
aagagtggagctggaaagtggg

SEQ ID NO: 6931387 - DNA, 20 bp, Homo sapiens
ggaccagctgtctgaggggc

SEQ ID NO: 6931388 - DNA, 22 bp, Homo sapiens
gagaccctcttcctccctacag

SEQ ID NO: 6931389 - DNA, 22 bp, Homo sapiens
tctggctcataggaaggccatt

SEQ ID NO: 6931390 - DNA, 22 bp, Homo sapiens
aggaagggatacataggatagt

SEQ ID NO: 6931391 - DNA, 22 bp, Homo sapiens
ggcttcctaatactccctacac

SEQ ID NO: 6931392 - DNA, 22 bp, Homo sapiens
cttagctttaaaagtgagatct

SEQ ID NO: 6931393 - DNA, 22 bp, Homo sapiens
gtcagtctgcctgagcttgttt

SEQ ID NO: 6931394 - DNA, 22 bp, Homo sapiens
taagggctatgtgactgattaa

SEQ ID NO: 6931395 - DNA, 22 bp, Homo sapiens
aagggaaatcctcagcccagga

SEQ ID NO: 6931396 - DNA, 22 bp, Homo sapiens
tcactgctgctgccatgatgga

SEQ ID NO: 6931397 - DNA, 22 bp, Homo sapiens
tctgaggttttcatgttttctg

SEQ ID NO: 6931398 - DNA, 22 bp, Homo sapiens
cagaaggctggcagattgagat

SEQ ID NO: 6931399 - DNA, 22 bp, Homo sapiens
atgttaaatagccatttgtttg

SEQ ID NO: 6931400 - DNA, 22 bp, Homo sapiens
ttgtcaaatccttgtcatctgc

SEQ ID NO: 6931401 - DNA, 22 bp, Homo sapiens
gtgcttgacgtgtagccgcccc

SEQ ID NO: 6931402 - DNA, 22 bp, Homo sapiens
tcctttcttcttctgcccatgg

SEQ ID NO: 6931403 - DNA, 22 bp, Homo sapiens
acttgggatttcagatgctgtg

SEQ ID NO: 6931404 - DNA, 22 bp, Homo sapiens
ctgtgcttgacagtgggaagca

SEQ ID NO: 6931405 - DNA, 22 bp, Homo sapiens
ttcaaagataattaccaaacat

SEQ ID NO: 6931406 - DNA, 22 bp, Homo sapiens
atggcttggttggttaaagcac

SEQ ID NO: 6931407 - DNA, 22 bp, Homo sapiens
atctcaccaagttattacgaga

SEQ ID NO: 6931408 - DNA, 22 bp, Homo sapiens
aagggctctgttgccatttcag

SEQ ID NO: 6931409 - DNA, 22 bp, Homo sapiens
aaggggaaaaagtgttaggagt

SEQ ID NO: 6931410 - DNA, 22 bp, Homo sapiens
gcccaaagccagtgtgctctcc

SEQ ID NO: 6931411 - DNA, 22 bp, Homo sapiens
cacagtggcaggtgtgggttgt

SEQ ID NO: 6931412 - DNA, 20 bp, Homo sapiens
gcctgttcacaggcttcttg

SEQ ID NO: 6931413 - DNA, 22 bp, Homo sapiens
tttctaaacaaagggagtttgg

SEQ ID NO: 6931414 - DNA, 22 bp, Homo sapiens
agttctgggaaaaacatggcca

SEQ ID NO: 6931415 - DNA, 22 bp, Homo sapiens
aaggcagccgtgtgactgcatg

SEQ ID NO: 6931416 - DNA, 22 bp, Homo sapiens
aacttagtctttcaatttgata

SEQ ID NO: 6931417 - DNA, 23 bp, Homo sapiens
tttcacaatgagcattacagaat

SEQ ID NO: 6931418 - DNA, 22 bp, Homo sapiens
tttgactcttgtctcttgttag

SEQ ID NO: 6931419 - DNA, 22 bp, Homo sapiens
gcactagtctaggtgctaagat

SEQ ID NO: 6931420 - DNA, 22 bp, Homo sapiens
gccacctccttattccacctgt

SEQ ID NO: 6931421 - DNA, 22 bp, Homo sapiens
gagacacacattctggagagaa

SEQ ID NO: 6931422 - DNA, 22 bp, Homo sapiens
tctgccagaaccagtcaccgat

SEQ ID NO: 6931423 - DNA, 22 bp, Homo sapiens
agaatgtgggcacgtatgttct

SEQ ID NO: 6931424 - DNA, 22 bp, Homo sapiens
gggcgagggcgaaagcgagagc

SEQ ID NO: 6931425 - DNA, 22 bp, Homo sapiens
gtctggactgtggcagcttgcc

SEQ ID NO: 6931426 - DNA, 22 bp, Homo sapiens
agcagcaggctagggaactgct

SEQ ID NO: 6931427 - DNA, 22 bp, Homo sapiens
gctggcctttgaggaagctgcg

SEQ ID NO: 6931428 - DNA, 22 bp, Homo sapiens
gtggcaggggtattccagctga

SEQ ID NO: 6931429 - DNA, 22 bp, Homo sapiens
gtattaggttggtgcaaaagta

SEQ ID NO: 6931430 - DNA, 22 bp, Homo sapiens
ttccttccgggcaccaggcact

SEQ ID NO: 6931431 - DNA, 22 bp, Homo sapiens
cagctagctaagaaggccagag

SEQ ID NO: 6931432 - DNA, 22 bp, Homo sapiens
tcttcacatattccttgagcta

SEQ ID NO: 6931433 - DNA, 22 bp, Homo sapiens
cactgctgatttcataggcagg

SEQ ID NO: 6931434 - DNA, 22 bp, Homo sapiens
gatcacatgagttatctaactt

SEQ ID NO: 6931435 - DNA, 22 bp, Homo sapiens
tatgacaaagagaggcccatgc

SEQ ID NO: 6931436 - DNA, 22 bp, Homo sapiens
ttagtattaggatcatatttga

SEQ ID NO: 6931437 - DNA, 22 bp, Homo sapiens
gaagtgtttaagtcttctttgt

SEQ ID NO: 6931438 - DNA, 22 bp, Homo sapiens
tttgctgctgtatatggagccc

SEQ ID NO: 6931439 - DNA, 22 bp, Homo sapiens
ggacatggaaatcggcttgctc

SEQ ID NO: 6931440 - DNA, 22 bp, Homo sapiens
catgaacatttgtttacatctg

SEQ ID NO: 6931441 - DNA, 22 bp, Homo sapiens
acagccttgatattaattgtct

SEQ ID NO: 6931442 - DNA, 22 bp, Homo sapiens
cagtgccgagctgggggctcct

SEQ ID NO: 6931443 - DNA, 22 bp, Homo sapiens
aaggctatatctcaatactatt

SEQ ID NO: 6931444 - DNA, 19 bp, Homo sapiens
tgaggccagctggcatttt

SEQ ID NO: 6931445 - DNA, 22 bp, Homo sapiens
tctgagccagccacctccttca

SEQ ID NO: 6931446 - DNA, 22 bp, Homo sapiens
taaggctgtccaaaattttgac

SEQ ID NO: 6931447 - DNA, 22 bp, Homo sapiens
caccaggaagtggtggcctggg

SEQ ID NO: 6931448 - DNA, 22 bp, Homo sapiens
cttgtgtggtctggtcttgcta

SEQ ID NO: 6931449 - DNA, 22 bp, Homo sapiens
ctcacagctgcttcaggatcca

SEQ ID NO: 6931450 - DNA, 22 bp, Homo sapiens
aggtccagaggctccttattac

SEQ ID NO: 6931451 - DNA, 22 bp, Homo sapiens
aggctatgacagactcagcctg

SEQ ID NO: 6931452 - DNA, 22 bp, Homo sapiens
tgcctctgctgcatattcacct

SEQ ID NO: 6931453 - DNA, 22 bp, Homo sapiens
cctgttcatttgtatttgtctt

SEQ ID NO: 6931454 - DNA, 22 bp, Homo sapiens
gtgcaaaagtaattgcagtact

SEQ ID NO: 6931455 - DNA, 22 bp, Homo sapiens
gcactggaaatacctagatgaa

SEQ ID NO: 6931456 - DNA, 22 bp, Homo sapiens
actccagggcttctatgatggt

SEQ ID NO: 6931457 - DNA, 22 bp, Homo sapiens
caaactgccaatggtttttata

SEQ ID NO: 6931458 - DNA, 22 bp, Homo sapiens
tctgcacatgtagtaaatatta

SEQ ID NO: 6931459 - DNA, 22 bp, Homo sapiens
gacacagagataggcctgtgtt

SEQ ID NO: 6931460 - DNA, 22 bp, Homo sapiens
aggttcatccagctcattaaaa

SEQ ID NO: 6931461 - DNA, 22 bp, Homo sapiens
agattcattgctttaggcattg

SEQ ID NO: 6931462 - DNA, 22 bp, Homo sapiens
aatgctttgccaacagctattg

SEQ ID NO: 6931463 - DNA, 22 bp, Homo sapiens
caaactctgtaggacagttcaa

SEQ ID NO: 6931464 - DNA, 22 bp, Homo sapiens
ctggcacacagtaggcaccaat

SEQ ID NO: 6931465 - DNA, 22 bp, Homo sapiens
gtgatcctataaagtgagcaca

SEQ ID NO: 6931466 - DNA, 22 bp, Homo sapiens
aaggcacatgacctaggcctgg

SEQ ID NO: 6931467 - DNA, 22 bp, Homo sapiens
gtctggagtaccataaaaagga

SEQ ID NO: 6931468 - DNA, 22 bp, Homo sapiens
ccaaggacccgagcctgcggga

SEQ ID NO: 6931469 - DNA, 22 bp, Homo sapiens
tgaccaaagagttgcttgtatt

SEQ ID NO: 6931470 - DNA, 20 bp, Homo sapiens
ctggggagctgctcccacga

SEQ ID NO: 6931471 - DNA, 22 bp, Homo sapiens
cctccaagcttcatctcaacca

SEQ ID NO: 6931472 - DNA, 18 bp, Homo sapiens
aggggcagcttgtgtgga

SEQ ID NO: 6931473 - DNA, 22 bp, Homo sapiens
gagcatctatgtgctgggtact

SEQ ID NO: 6931474 - DNA, 22 bp, Homo sapiens
gagctggtcgaaatgggctgac

SEQ ID NO: 6931475 - DNA, 22 bp, Homo sapiens
tccagctcctgagttcactgct

SEQ ID NO: 6931476 - DNA, 22 bp, Homo sapiens
gtacccagaggcatgatcccag

SEQ ID NO: 6931477 - DNA, 22 bp, Homo sapiens
atttttcctgctggatctgctc

SEQ ID NO: 6931478 - DNA, 22 bp, Homo sapiens
gctatgttagacattctcattt

SEQ ID NO: 6931479 - DNA, 22 bp, Homo sapiens
ggagcctattattagcatggca

SEQ ID NO: 6931480 - DNA, 22 bp, Homo sapiens
gagccctgcttccaagggggca

SEQ ID NO: 6931481 - DNA, 22 bp, Homo sapiens
tggtctgattcttgctccccaa

SEQ ID NO: 6931482 - DNA, 22 bp, Homo sapiens
cctctacagggcatagcccaaa

SEQ ID NO: 6931483 - DNA, 22 bp, Homo sapiens
ggcatcagtatggccatagggt

SEQ ID NO: 6931484 - DNA, 22 bp, Homo sapiens
agattcctaaagtaagatatca

SEQ ID NO: 6931485 - DNA, 22 bp, Homo sapiens
gatggtcaggctttaacatctg

SEQ ID NO: 6931486 - DNA, 22 bp, Homo sapiens
gtgcttgatctcacctgatctc

SEQ ID NO: 6931487 - DNA, 22 bp, Homo sapiens
gacctgaaatttgtggtagaac

SEQ ID NO: 6931488 - DNA, 22 bp, Homo sapiens
gagatatgttggcagctggtat

SEQ ID NO: 6931489 - DNA, 22 bp, Homo sapiens
aaaggcactagaagttaccttt

SEQ ID NO: 6931490 - DNA, 22 bp, Homo sapiens
tggtgcaggccaagctgcgagc

SEQ ID NO: 6931491 - DNA, 21 bp, Homo sapiens
ggctgcctgggaagaagaaga

SEQ ID NO: 6931492 - DNA, 22 bp, Homo sapiens
agccaatgcgtaaaaagatcta

SEQ ID NO: 6931493 - DNA, 23 bp, Homo sapiens
tcatgcagagaaggactgcttac

SEQ ID NO: 6931494 - DNA, 22 bp, Homo sapiens
ttctggtgggactcaggctttc

SEQ ID NO: 6931495 - DNA, 22 bp, Homo sapiens
aaagactcttaactccctagcg

SEQ ID NO: 6931496 - DNA, 22 bp, Homo sapiens
gagtctgagtctaatggcccca

SEQ ID NO: 6931497 - DNA, 22 bp, Homo sapiens
tctggccacttgcttcacactg

SEQ ID NO: 6931498 - DNA, 22 bp, Homo sapiens
tcattttcccactgaagctgtc

SEQ ID NO: 6931499 - DNA, 22 bp, Homo sapiens
ctccaaattcagtcacagtctg

SEQ ID NO: 6931500 - DNA, 22 bp, Homo sapiens
atgctttctcttagttcattga

SEQ ID NO: 6931501 - DNA, 22 bp, Homo sapiens
tcattagctgtggatggagtgg

SEQ ID NO: 6931502 - DNA, 22 bp, Homo sapiens
agtctgagtgcactcaataaag

SEQ ID NO: 6931503 - DNA, 22 bp, Homo sapiens
caaactattgttcacaagacaa

SEQ ID NO: 6931504 - DNA, 22 bp, Homo sapiens
ctgcatctcaggagacgggtct

SEQ ID NO: 6931505 - DNA, 22 bp, Homo sapiens
attccaaggtctttctagattg

SEQ ID NO: 6931506 - DNA, 22 bp, Homo sapiens
aggctatgtggaataatttgct

SEQ ID NO: 6931507 - DNA, 22 bp, Homo sapiens
caaggcttagtcagagggtgct

SEQ ID NO: 6931508 - DNA, 22 bp, Homo sapiens
ctctgatgtcgagtaaggtgtg

SEQ ID NO: 6931509 - DNA, 22 bp, Homo sapiens
gcatgcaaggaccaagggagca

SEQ ID NO: 6931510 - DNA, 22 bp, Homo sapiens
tggcacatggtaagtgcttaac

SEQ ID NO: 6931511 - DNA, 22 bp, Homo sapiens
tagggaagctcctgattcccct

SEQ ID NO: 6931512 - DNA, 22 bp, Homo sapiens
cttcatgctgatatcctcgatg

SEQ ID NO: 6931513 - DNA, 22 bp, Homo sapiens
ttttccagatggatactagaat

SEQ ID NO: 6931514 - DNA, 22 bp, Homo sapiens
gagccacagaaggaaattgggg

SEQ ID NO: 6931515 - DNA, 22 bp, Homo sapiens
tttccactgtagagatgttgaa

SEQ ID NO: 6931516 - DNA, 22 bp, Homo sapiens
accattctttacacttatttct

SEQ ID NO: 6931517 - DNA, 22 bp, Homo sapiens
tggccctgctgggtcagagctg

SEQ ID NO: 6931518 - DNA, 22 bp, Homo sapiens
aagtttctgtatgctcttctgt

SEQ ID NO: 6931519 - DNA, 22 bp, Homo sapiens
gcacaacaccaagggaggtatc

SEQ ID NO: 6931520 - DNA, 22 bp, Homo sapiens
gttgcattttaaatgcatgttg

SEQ ID NO: 6931521 - DNA, 22 bp, Homo sapiens
agactttaacaatgggtatgaa

SEQ ID NO: 6931522 - DNA, 22 bp, Homo sapiens
ctgccactagctttcacatctt

SEQ ID NO: 6931523 - DNA, 22 bp, Homo sapiens
agcatagagcaggaagttaaga

SEQ ID NO: 6931524 - DNA, 22 bp, Homo sapiens
ttcagtggtttgatgatgtata

SEQ ID NO: 6931525 - DNA, 22 bp, Homo sapiens
gagccctgacactgagggagtt

SEQ ID NO: 6931526 - DNA, 22 bp, Homo sapiens
gacacccttcctcctgaggcta

SEQ ID NO: 6931527 - DNA, 18 bp, Homo sapiens
agcaggtgtgcagaatgt

SEQ ID NO: 6931528 - DNA, 22 bp, Homo sapiens
ttataattctggcataggctgt

SEQ ID NO: 6931529 - DNA, 17 bp, Homo sapiens
ctaaatacttgcgtttc

SEQ ID NO: 6931530 - DNA, 22 bp, Homo sapiens
tatttagttatctttcataaaa

SEQ ID NO: 6931531 - DNA, 22 bp, Homo sapiens
attcacactgtatacacaggat

SEQ ID NO: 6931532 - DNA, 22 bp, Homo sapiens
gtccagctctgagaagaaacat

SEQ ID NO: 6931533 - DNA, 22 bp, Homo sapiens
actgaataatggtctgtgatct

SEQ ID NO: 6931534 - DNA, 22 bp, Homo sapiens
cccagctctgcagacctgccct

SEQ ID NO: 6931535 - DNA, 22 bp, Homo sapiens
tacaaactgtccagcccagagg

SEQ ID NO: 6931536 - DNA, 22 bp, Homo sapiens
tatgcaaacagttcaggtgaca

SEQ ID NO: 6931537 - DNA, 22 bp, Homo sapiens
ctcagagagacaatgtgggaca

SEQ ID NO: 6931538 - DNA, 19 bp, Homo sapiens
tgtagctagtgtctatcca

SEQ ID NO: 6931539 - DNA, 22 bp, Homo sapiens
gaacagagctgactacaaggca

SEQ ID NO: 6931540 - DNA, 22 bp, Homo sapiens
cctccagtactccagtccagcg

SEQ ID NO: 6931541 - DNA, 21 bp, Homo sapiens
agtgtctctggaagcacgtgt

SEQ ID NO: 6931542 - DNA, 22 bp, Homo sapiens
ctgagcctccatttcatcaggt

SEQ ID NO: 6931543 - DNA, 22 bp, Homo sapiens
tctggccaaccctcaagttgta

SEQ ID NO: 6931544 - DNA, 22 bp, Homo sapiens
atggcttgtccaagcggcagac

SEQ ID NO: 6931545 - DNA, 22 bp, Homo sapiens
ctctgggaattctgagcaagca

SEQ ID NO: 6931546 - DNA, 22 bp, Homo sapiens
atgaaatgttggtcccaatcgc

SEQ ID NO: 6931547 - DNA, 22 bp, Homo sapiens
attgatttagctcaagacacat

SEQ ID NO: 6931548 - DNA, 22 bp, Homo sapiens
ctggcctgcctgccggttgtcg

SEQ ID NO: 6931549 - DNA, 22 bp, Homo sapiens
agaacagctgatttacggggct

SEQ ID NO: 6931550 - DNA, 22 bp, Homo sapiens
gcagaacatggaaagagaacta

SEQ ID NO: 6931551 - DNA, 22 bp, Homo sapiens
tacaaatcagatcatgagttta

SEQ ID NO: 6931552 - DNA, 22 bp, Homo sapiens
gtcagagagggcacgtgcacac

SEQ ID NO: 6931553 - DNA, 22 bp, Homo sapiens
ttggtatattgtgctactttat

SEQ ID NO: 6931554 - DNA, 22 bp, Homo sapiens
aggcaggccgtgtccctcctca

SEQ ID NO: 6931555 - DNA, 16 bp, Homo sapiens
ctggccctggctctgg

SEQ ID NO: 6931556 - DNA, 22 bp, Homo sapiens
tctgagaagctagaggacaaag

SEQ ID NO: 6931557 - DNA, 22 bp, Homo sapiens
cctcagggtctgaggagaccgt

SEQ ID NO: 6931558 - DNA, 22 bp, Homo sapiens
tggaattcccaagtaactttta

SEQ ID NO: 6931559 - DNA, 22 bp, Homo sapiens
gccttctctgtgagctcctagg

SEQ ID NO: 6931560 - DNA, 22 bp, Homo sapiens
tctctttctattgcaccatgct

SEQ ID NO: 6931561 - DNA, 22 bp, Homo sapiens
taacattcttaacttagaaaca

SEQ ID NO: 6931562 - DNA, 22 bp, Homo sapiens
acactggatgaagcaagctaaa

SEQ ID NO: 6931563 - DNA, 22 bp, Homo sapiens
atctggaattaagagaaagtga

SEQ ID NO: 6931564 - DNA, 22 bp, Homo sapiens
tttagacagcggctctgaacca

SEQ ID NO: 6931565 - DNA, 22 bp, Homo sapiens
agagagttgaggaagcaacact

SEQ ID NO: 6931566 - DNA, 22 bp, Homo sapiens
attacacagcggttactactag

SEQ ID NO: 6931567 - DNA, 22 bp, Homo sapiens
cgagcatgatgacggctgtggc

SEQ ID NO: 6931568 - DNA, 22 bp, Homo sapiens
ctgcccgtccctttgctctcgc

SEQ ID NO: 6931569 - DNA, 22 bp, Homo sapiens
tagcacgtgtacacacagcatg

SEQ ID NO: 6931570 - DNA, 22 bp, Homo sapiens
attgtactcacaaaacatgagt

SEQ ID NO: 6931571 - DNA, 22 bp, Homo sapiens
ccagctgttggagtttcactgc

SEQ ID NO: 6931572 - DNA, 22 bp, Homo sapiens
tcagactgatcatctatcagat

SEQ ID NO: 6931573 - DNA, 22 bp, Homo sapiens
agatgccagcttacactgggaa

SEQ ID NO: 6931574 - DNA, 22 bp, Homo sapiens
cccgtcattttatgagtaggtt

SEQ ID NO: 6931575 - DNA, 22 bp, Homo sapiens
acatgctctcctaaggccctgt

SEQ ID NO: 6931576 - DNA, 22 bp, Homo sapiens
cagcattgtaagaatgaagacc

SEQ ID NO: 6931577 - DNA, 22 bp, Homo sapiens
ttcatcatcagaactgttcact

SEQ ID NO: 6931578 - DNA, 22 bp, Homo sapiens
tgccatttgtaactatcattct

SEQ ID NO: 6931579 - DNA, 22 bp, Homo sapiens
aggaggaatacaatccagcagc

SEQ ID NO: 6931580 - DNA, 22 bp, Homo sapiens
gcttaaatcccaatgctagacc

SEQ ID NO: 6931581 - DNA, 22 bp, Homo sapiens
gtggcagtgggatgctatcagg

SEQ ID NO: 6931582 - DNA, 22 bp, Homo sapiens
agcctggctaaattctcccatg

SEQ ID NO: 6931583 - DNA, 22 bp, Homo sapiens
tgcaatatgttgcattgtatgg

SEQ ID NO: 6931584 - DNA, 22 bp, Homo sapiens
tcagagcaccacacagttccct

SEQ ID NO: 6931585 - DNA, 21 bp, Homo sapiens
gtgcatgagggaggatagcaa

SEQ ID NO: 6931586 - DNA, 22 bp, Homo sapiens
ccatttgcccaaggattgtctt

SEQ ID NO: 6931587 - DNA, 22 bp, Homo sapiens
gttctgggaaggtggacctgtt

SEQ ID NO: 6931588 - DNA, 22 bp, Homo sapiens
taaggaggtgcccactctcagg

SEQ ID NO: 6931589 - DNA, 22 bp, Homo sapiens
tgtcaccttgcagggctggggc

SEQ ID NO: 6931590 - DNA, 22 bp, Homo sapiens
tggcctcttaggacatcctcta

SEQ ID NO: 6931591 - DNA, 22 bp, Homo sapiens
acacagggatatttcaggtggt

SEQ ID NO: 6931592 - DNA, 17 bp, Homo sapiens
atgtggctaagctgctg

SEQ ID NO: 6931593 - DNA, 22 bp, Homo sapiens
tcaggagcaggttgtttggttt

SEQ ID NO: 6931594 - DNA, 22 bp, Homo sapiens
cctcaggggtgcccacagctgc

SEQ ID NO: 6931595 - DNA, 20 bp, Homo sapiens
aattcagctgccttcatgct

SEQ ID NO: 6931596 - DNA, 22 bp, Homo sapiens
ttattgtaggcctattgtagaa

SEQ ID NO: 6931597 - DNA, 22 bp, Homo sapiens
tgagagtattttggcattatca

SEQ ID NO: 6931598 - DNA, 22 bp, Homo sapiens
gtcactgacaagagagaagaac

SEQ ID NO: 6931599 - DNA, 22 bp, Homo sapiens
agagaagggcctgtatgtaatc

SEQ ID NO: 6931600 - DNA, 21 bp, Homo sapiens
gcagatgggaagagacgaggc

SEQ ID NO: 6931601 - DNA, 22 bp, Homo sapiens
tgctacctgccgcttccaaggg

SEQ ID NO: 6931602 - DNA, 23 bp, Homo sapiens
tgggttcattcttgaagtcagtg

SEQ ID NO: 6931603 - DNA, 22 bp, Homo sapiens
ctggtgttggagcaaatgcagg

SEQ ID NO: 6931604 - DNA, 22 bp, Homo sapiens
cattgaaaatgttgcaggctgt

SEQ ID NO: 6931605 - DNA, 17 bp, Homo sapiens
cagtcctctgctctaag

SEQ ID NO: 6931606 - DNA, 22 bp, Homo sapiens
gagatttattgacttaacagta

SEQ ID NO: 6931607 - DNA, 18 bp, Homo sapiens
atccatttaatgcctgga

SEQ ID NO: 6931608 - DNA, 22 bp, Homo sapiens
ggtgaattaccaaaggggcaga

SEQ ID NO: 6931609 - DNA, 22 bp, Homo sapiens
gacagttaggacaactgacttc

SEQ ID NO: 6931610 - DNA, 18 bp, Homo sapiens
gagcactggtgttgaggt

SEQ ID NO: 6931611 - DNA, 22 bp, Homo sapiens
tggatgggttgaaatgtgagcc

SEQ ID NO: 6931612 - DNA, 22 bp, Homo sapiens
tcaggcaggctcagaggaaaac

SEQ ID NO: 6931613 - DNA, 22 bp, Homo sapiens
ctgcacaactagggcgtttgat

SEQ ID NO: 6931614 - DNA, 22 bp, Homo sapiens
ttctaagagtcattaatggcct

SEQ ID NO: 6931615 - DNA, 22 bp, Homo sapiens
ctggcctttagccccagtgtct

SEQ ID NO: 6931616 - DNA, 20 bp, Homo sapiens
agtgggtgtaagttattgcc

SEQ ID NO: 6931617 - DNA, 19 bp, Homo sapiens
ctcacctggaggtgctgat

SEQ ID NO: 6931618 - DNA, 22 bp, Homo sapiens
agtccatggttgtagttctctc

SEQ ID NO: 6931619 - DNA, 22 bp, Homo sapiens
caaatgtaattgcggtttttgc

SEQ ID NO: 6931620 - DNA, 22 bp, Homo sapiens
tgagtatagcatgatgggccat

SEQ ID NO: 6931621 - DNA, 22 bp, Homo sapiens
ctcctgggctcaagtgatcctc

SEQ ID NO: 6931622 - DNA, 22 bp, Homo sapiens
agcagcatcttctaagtaaggc

SEQ ID NO: 6931623 - DNA, 22 bp, Homo sapiens
ggtttccacttgctgaagaaag

SEQ ID NO: 6931624 - DNA, 23 bp, Homo sapiens
ggaaaaacactgtgtcttggcag

SEQ ID NO: 6931625 - DNA, 22 bp, Homo sapiens
ttagccaaacaggtgaaattga

SEQ ID NO: 6931626 - DNA, 23 bp, Homo sapiens
tccatgagatgtgggcttctagt

SEQ ID NO: 6931627 - DNA, 22 bp, Homo sapiens
agccaggtactcttgtgaccat

SEQ ID NO: 6931628 - DNA, 22 bp, Homo sapiens
ttgggctaataactgattttag

SEQ ID NO: 6931629 - DNA, 22 bp, Homo sapiens
tccttctcctccttgagtgaca

SEQ ID NO: 6931630 - DNA, 22 bp, Homo sapiens
tgggctgcttcctcagctgaga

SEQ ID NO: 6931631 - DNA, 22 bp, Homo sapiens
tgggcacttatcgaaattgagg

SEQ ID NO: 6931632 - DNA, 22 bp, Homo sapiens
attattataaagtgcatgacct

SEQ ID NO: 6931633 - DNA, 21 bp, Homo sapiens
tgagaatttactctggagagt

SEQ ID NO: 6931634 - DNA, 22 bp, Homo sapiens
tgtatattcactgagcaagggg

SEQ ID NO: 6931635 - DNA, 22 bp, Homo sapiens
gccgtgtcatctgcgggtggca

SEQ ID NO: 6931636 - DNA, 22 bp, Homo sapiens
atactgttggcagcagaccaga

SEQ ID NO: 6931637 - DNA, 22 bp, Homo sapiens
cccatctcagtcgtgctaaggg

SEQ ID NO: 6931638 - DNA, 22 bp, Homo sapiens
tgaaatgctgtagagactgtat

SEQ ID NO: 6931639 - DNA, 22 bp, Homo sapiens
atagggaggaactgagtcagga

SEQ ID NO: 6931640 - DNA, 22 bp, Homo sapiens
cttgtacattgatttctgcatt

SEQ ID NO: 6931641 - DNA, 18 bp, Homo sapiens
tgaactggcatcagaatc

SEQ ID NO: 6931642 - DNA, 22 bp, Homo sapiens
tggagtgcaatagtaataaggt

SEQ ID NO: 6931643 - DNA, 22 bp, Homo sapiens
agaaattatgcagtagttttat

SEQ ID NO: 6931644 - DNA, 22 bp, Homo sapiens
gtctcaatagcaactctatcct

SEQ ID NO: 6931645 - DNA, 22 bp, Homo sapiens
tggagggcatctgtggtcaggc

SEQ ID NO: 6931646 - DNA, 22 bp, Homo sapiens
cagactcttgagctgattgtat

SEQ ID NO: 6931647 - DNA, 22 bp, Homo sapiens
tgcagcaggtgacaacgagtgg

SEQ ID NO: 6931648 - DNA, 22 bp, Homo sapiens
ggagcggagggagggccactgt

SEQ ID NO: 6931649 - DNA, 18 bp, Homo sapiens
ggaggctctgtggtttcc

SEQ ID NO: 6931650 - DNA, 22 bp, Homo sapiens
taacacagagtaagtggtcaat

SEQ ID NO: 6931651 - DNA, 23 bp, Homo sapiens
ctgttatattctagggagctgca

SEQ ID NO: 6931652 - DNA, 22 bp, Homo sapiens
tgggtaatggagaaataaatct

SEQ ID NO: 6931653 - DNA, 22 bp, Homo sapiens
aagcagatgcagctaataaagc

SEQ ID NO: 6931654 - DNA, 22 bp, Homo sapiens
ggaatggtccaagaaagcacgt

SEQ ID NO: 6931655 - DNA, 22 bp, Homo sapiens
cgtcctttgaattgaggtcttt

SEQ ID NO: 6931656 - DNA, 22 bp, Homo sapiens
ctatttgaagttgcagagatga

SEQ ID NO: 6931657 - DNA, 22 bp, Homo sapiens
cccagagatgtcctgagtgata

SEQ ID NO: 6931658 - DNA, 22 bp, Homo sapiens
aaatatcttaggagtatatgag

SEQ ID NO: 6931659 - DNA, 22 bp, Homo sapiens
tcctggggtgtgttttgctgct

SEQ ID NO: 6931660 - DNA, 22 bp, Homo sapiens
caccatgtattcagtttggcac

SEQ ID NO: 6931661 - DNA, 22 bp, Homo sapiens
tgggagaatatatttaaaactt

SEQ ID NO: 6931662 - DNA, 22 bp, Homo sapiens
agtcaggatttaaactcagaca

SEQ ID NO: 6931663 - DNA, 22 bp, Homo sapiens
tctcattgcacaatgcagagtg

SEQ ID NO: 6931664 - DNA, 22 bp, Homo sapiens
agtgttcaggatctgaggccag

SEQ ID NO: 6931665 - DNA, 22 bp, Homo sapiens
gccttcatagagtgtaggcctt

SEQ ID NO: 6931666 - DNA, 22 bp, Homo sapiens
ttacaagatgggaaagggaagt

SEQ ID NO: 6931667 - DNA, 22 bp, Homo sapiens
atagctgactccagacatagct

SEQ ID NO: 6931668 - DNA, 22 bp, Homo sapiens
gggagtggggcttaccttgaag

SEQ ID NO: 6931669 - DNA, 22 bp, Homo sapiens
agggtcttgaggatctgaactg

SEQ ID NO: 6931670 - DNA, 22 bp, Homo sapiens
aactttctaaagtcaaattggt

SEQ ID NO: 6931671 - DNA, 22 bp, Homo sapiens
caagatggacataaggagagaa

SEQ ID NO: 6931672 - DNA, 23 bp, Homo sapiens
ggtagagccgcgccctgggggaa

SEQ ID NO: 6931673 - DNA, 22 bp, Homo sapiens
gggacgacaggctctgtggtag

SEQ ID NO: 6931674 - DNA, 22 bp, Homo sapiens
cacatatatgaaatgaggaatt

SEQ ID NO: 6931675 - DNA, 22 bp, Homo sapiens
gcacccagaggtcagcagtgct

SEQ ID NO: 6931676 - DNA, 22 bp, Homo sapiens
cctggaaacacatgatgatgaa

SEQ ID NO: 6931677 - DNA, 22 bp, Homo sapiens
gattccagaaaccagtgaagat

SEQ ID NO: 6931678 - DNA, 21 bp, Homo sapiens
cttggctgcagtgacaggcat

SEQ ID NO: 6931679 - DNA, 22 bp, Homo sapiens
acctctgacctctgagagagaa

SEQ ID NO: 6931680 - DNA, 22 bp, Homo sapiens
cacagctaatggaagtggaatc

SEQ ID NO: 6931681 - DNA, 22 bp, Homo sapiens
ggttcagcagcagccacaattc

SEQ ID NO: 6931682 - DNA, 22 bp, Homo sapiens
tatgcccttcttggtggctcag

SEQ ID NO: 6931683 - DNA, 19 bp, Homo sapiens
cccagagagatctcttgcc

SEQ ID NO: 6931684 - DNA, 22 bp, Homo sapiens
ctcaaatagaactgatctataa

SEQ ID NO: 6931685 - DNA, 22 bp, Homo sapiens
acatgggcatctatgaggctct

SEQ ID NO: 6931686 - DNA, 22 bp, Homo sapiens
tcaccaaggcattttcacagca

SEQ ID NO: 6931687 - DNA, 22 bp, Homo sapiens
cacacaattatgtgtgcacaat

SEQ ID NO: 6931688 - DNA, 22 bp, Homo sapiens
aggtagcgcaatttcctgggac

SEQ ID NO: 6931689 - DNA, 20 bp, Homo sapiens
tgagttcatttgcatgtggt

SEQ ID NO: 6931690 - DNA, 22 bp, Homo sapiens
tctgttggacattcatctgcag

SEQ ID NO: 6931691 - DNA, 22 bp, Homo sapiens
tccaaaaaacgtttgaatagtt

SEQ ID NO: 6931692 - DNA, 15 bp, Homo sapiens
gtgattaagtgcgtt

SEQ ID NO: 6931693 - DNA, 22 bp, Homo sapiens
acctaataaaggtaaattctgt

SEQ ID NO: 6931694 - DNA, 22 bp, Homo sapiens
cagagctttctgtcacattagt

SEQ ID NO: 6931695 - DNA, 22 bp, Homo sapiens
tatgggtactttgatttagaaa

SEQ ID NO: 6931696 - DNA, 22 bp, Homo sapiens
gcagcaagaggtttctgttgac

SEQ ID NO: 6931697 - DNA, 22 bp, Homo sapiens
tagaagcagtaatagaaatagg

SEQ ID NO: 6931698 - DNA, 22 bp, Homo sapiens
tagtggaggggatgcaaagctt

SEQ ID NO: 6931699 - DNA, 22 bp, Homo sapiens
gggccagtctgactctgctggt

SEQ ID NO: 6931700 - DNA, 22 bp, Homo sapiens
ctgagcatcatggcagaatctt

SEQ ID NO: 6931701 - DNA, 22 bp, Homo sapiens
agcttgttgttactgatgcatt

SEQ ID NO: 6931702 - DNA, 22 bp, Homo sapiens
cctgggagagtctgtggtctcc

SEQ ID NO: 6931703 - DNA, 22 bp, Homo sapiens
gaggtgcctggcgatgtctctg

SEQ ID NO: 6931704 - DNA, 22 bp, Homo sapiens
agaaagtttgtttttatccata

SEQ ID NO: 6931705 - DNA, 22 bp, Homo sapiens
tctgaggaactggcaaagatgg

SEQ ID NO: 6931706 - DNA, 22 bp, Homo sapiens
acatcccacagaaacatacata

SEQ ID NO: 6931707 - DNA, 22 bp, Homo sapiens
ggcatcagggtaggaaggtatc

SEQ ID NO: 6931708 - DNA, 22 bp, Homo sapiens
ttctggatatgggagagggagc

SEQ ID NO: 6931709 - DNA, 22 bp, Homo sapiens
gatgttaacttgttctgcctct

SEQ ID NO: 6931710 - DNA, 22 bp, Homo sapiens
gtcattattctgggattctata

SEQ ID NO: 6931711 - DNA, 22 bp, Homo sapiens
cagttataggagccattgtata

SEQ ID NO: 6931712 - DNA, 17 bp, Homo sapiens
agaaaggcagttcctct

SEQ ID NO: 6931713 - DNA, 22 bp, Homo sapiens
gatatcatatcagacaacctct

SEQ ID NO: 6931714 - DNA, 22 bp, Homo sapiens
ttccatattgtactctttggag

SEQ ID NO: 6931715 - DNA, 22 bp, Homo sapiens
tatcacaggtgtgatttacatt

SEQ ID NO: 6931716 - DNA, 20 bp, Homo sapiens
aaagagcccttggagcaggc

SEQ ID NO: 6931717 - DNA, 22 bp, Homo sapiens
gtcctctggtgaaagcattccc

SEQ ID NO: 6931718 - DNA, 16 bp, Homo sapiens
ggacagtatgtcagga

SEQ ID NO: 6931719 - DNA, 22 bp, Homo sapiens
tagaagtggattgaagtttgga

SEQ ID NO: 6931720 - DNA, 22 bp, Homo sapiens
aggaatgtattattccttctgg

SEQ ID NO: 6931721 - DNA, 22 bp, Homo sapiens
ctcagctgcagcctggctggca

SEQ ID NO: 6931722 - DNA, 19 bp, Homo sapiens
taaaatgtctgtggtcagt

SEQ ID NO: 6931723 - DNA, 22 bp, Homo sapiens
caagtcctcaaagggctctgct

SEQ ID NO: 6931724 - DNA, 22 bp, Homo sapiens
aagaacctatatgctgatgaat

SEQ ID NO: 6931725 - DNA, 22 bp, Homo sapiens
tttgtcagtcatgtctgctttt

SEQ ID NO: 6931726 - DNA, 22 bp, Homo sapiens
ttcctgagcttttaacctagtc

SEQ ID NO: 6931727 - DNA, 22 bp, Homo sapiens
tgtatctgtaatcccagatcaa

SEQ ID NO: 6931728 - DNA, 20 bp, Homo sapiens
gacacaggcagtcctcagag

SEQ ID NO: 6931729 - DNA, 22 bp, Homo sapiens
ttgtccttggctctagaggtga

SEQ ID NO: 6931730 - DNA, 22 bp, Homo sapiens
tacaaaggagactctgtattta

SEQ ID NO: 6931731 - DNA, 22 bp, Homo sapiens
gaaatattgggactcagagctt

SEQ ID NO: 6931732 - DNA, 22 bp, Homo sapiens
tcagctgcttcatgttctgaat

SEQ ID NO: 6931733 - DNA, 22 bp, Homo sapiens
cttgatgagtcagaactgaagg

SEQ ID NO: 6931734 - DNA, 22 bp, Homo sapiens
tgtgtattcagcaagcgaaaca

SEQ ID NO: 6931735 - DNA, 22 bp, Homo sapiens
ctcatggaagacactccttcac

SEQ ID NO: 6931736 - DNA, 22 bp, Homo sapiens
aagctaattgtacttctcacag

SEQ ID NO: 6931737 - DNA, 22 bp, Homo sapiens
tatgcatagtggaattagcaaa

SEQ ID NO: 6931738 - DNA, 22 bp, Homo sapiens
gaggctccctttaggtccagat

SEQ ID NO: 6931739 - DNA, 22 bp, Homo sapiens
gtgccctgggccttcagggcca

SEQ ID NO: 6931740 - DNA, 22 bp, Homo sapiens
ggccatggcgggagccggcgtc

SEQ ID NO: 6931741 - DNA, 22 bp, Homo sapiens
aggcacaagaaactgctcccca

SEQ ID NO: 6931742 - DNA, 22 bp, Homo sapiens
agtctttccttttggaagaaaa

SEQ ID NO: 6931743 - DNA, 21 bp, Homo sapiens
gcccagcaaggtgagaaggcc

SEQ ID NO: 6931744 - DNA, 22 bp, Homo sapiens
ctgtacaaatggcagttgagtt

SEQ ID NO: 6931745 - DNA, 22 bp, Homo sapiens
catgtcaacaggcccagaaaat

SEQ ID NO: 6931746 - DNA, 22 bp, Homo sapiens
tgattccctgcctgtgctgtga

SEQ ID NO: 6931747 - DNA, 22 bp, Homo sapiens
aaatgggtttgattctcagcca

SEQ ID NO: 6931748 - DNA, 23 bp, Homo sapiens
gcccatgctgttgggcccgagca

SEQ ID NO: 6931749 - DNA, 22 bp, Homo sapiens
gtttataaggtaaaggagagag

SEQ ID NO: 6931750 - DNA, 18 bp, Homo sapiens
ggaaggtgattcagtttt

SEQ ID NO: 6931751 - DNA, 22 bp, Homo sapiens
tgaggcagagtaagatacatga

SEQ ID NO: 6931752 - DNA, 22 bp, Homo sapiens
tataagtagttgttgaagactt

SEQ ID NO: 6931753 - DNA, 18 bp, Homo sapiens
agcccaggcatcgtctgc

SEQ ID NO: 6931754 - DNA, 22 bp, Homo sapiens
gatggtgcaattatcgtgcatg

SEQ ID NO: 6931755 - DNA, 22 bp, Homo sapiens
cagtagcacctatgattttgta

SEQ ID NO: 6931756 - DNA, 22 bp, Homo sapiens
cccagcttgctcaccattccca

SEQ ID NO: 6931757 - DNA, 22 bp, Homo sapiens
agagtcctgagtggaaaaatgg

SEQ ID NO: 6931758 - DNA, 19 bp, Homo sapiens
cctgtgttgggagtgtgag

SEQ ID NO: 6931759 - DNA, 22 bp, Homo sapiens
tggcagagcaaaaagatagaat

SEQ ID NO: 6931760 - DNA, 22 bp, Homo sapiens
tcagctggtgaatggactcatc

SEQ ID NO: 6931761 - DNA, 22 bp, Homo sapiens
gaaaccagataagggaggctga

SEQ ID NO: 6931762 - DNA, 18 bp, Homo sapiens
taggagagaatttattta

SEQ ID NO: 6931763 - DNA, 22 bp, Homo sapiens
gatgtcatcaggctaagacact

SEQ ID NO: 6931764 - DNA, 22 bp, Homo sapiens
gactggctctatcaggataaat

SEQ ID NO: 6931765 - DNA, 22 bp, Homo sapiens
tttctctccccaagtggaattg

SEQ ID NO: 6931766 - DNA, 22 bp, Homo sapiens
agccagttccagcacaccactg

SEQ ID NO: 6931767 - DNA, 20 bp, Homo sapiens
ggcctcggacttcatcgtag

SEQ ID NO: 6931768 - DNA, 18 bp, Homo sapiens
cagcaactttagatcctg

SEQ ID NO: 6931769 - DNA, 18 bp, Homo sapiens
gagagggatccctcagga

SEQ ID NO: 6931770 - DNA, 22 bp, Homo sapiens
tttcaccatcttggccaggctg

SEQ ID NO: 6931771 - DNA, 22 bp, Homo sapiens
ttacccatgattactgctgaaa

SEQ ID NO: 6931772 - DNA, 22 bp, Homo sapiens
attacaataatacatgctcatt

SEQ ID NO: 6931773 - DNA, 22 bp, Homo sapiens
cacagatgagctgaatagcttt

SEQ ID NO: 6931774 - DNA, 22 bp, Homo sapiens
tgctatgtccagcacagagtgg

SEQ ID NO: 6931775 - DNA, 22 bp, Homo sapiens
tctgtgctgccatcctgtggcc

SEQ ID NO: 6931776 - DNA, 22 bp, Homo sapiens
acttccttttgggaaactgttt

SEQ ID NO: 6931777 - DNA, 22 bp, Homo sapiens
ttcctgagtcgccgagtctatg

SEQ ID NO: 6931778 - DNA, 22 bp, Homo sapiens
attttctgagcacgtgacagca

SEQ ID NO: 6931779 - DNA, 22 bp, Homo sapiens
atggtgtccccagcctttgaag

SEQ ID NO: 6931780 - DNA, 22 bp, Homo sapiens
attgcattcattgacatatgag

SEQ ID NO: 6931781 - DNA, 22 bp, Homo sapiens
tcaggaagctgaattacaaaaa

SEQ ID NO: 6931782 - DNA, 22 bp, Homo sapiens
gggagggtctgagagctgcacc

SEQ ID NO: 6931783 - DNA, 22 bp, Homo sapiens
tgcaaacaactgtttaatgctg

SEQ ID NO: 6931784 - DNA, 22 bp, Homo sapiens
atatcttggccccaggatttta

SEQ ID NO: 6931785 - DNA, 22 bp, Homo sapiens
tcttgttaaagtgaagatactg

SEQ ID NO: 6931786 - DNA, 22 bp, Homo sapiens
tcaatagcaatcaagccttcca

SEQ ID NO: 6931787 - DNA, 22 bp, Homo sapiens
tgtatagtttcttagttactga

SEQ ID NO: 6931788 - DNA, 22 bp, Homo sapiens
aggttttcagctgtatcctgag

SEQ ID NO: 6931789 - DNA, 22 bp, Homo sapiens
agcacctgtcacaagcagaagg

SEQ ID NO: 6931790 - DNA, 22 bp, Homo sapiens
ttttgcagccacatctgacctg

SEQ ID NO: 6931791 - DNA, 22 bp, Homo sapiens
cacatgaggtgacttccaagct

SEQ ID NO: 6931792 - DNA, 22 bp, Homo sapiens
agtcagagaccctagatctaat

SEQ ID NO: 6931793 - DNA, 22 bp, Homo sapiens
gctgcctgatgtccagcaggac

SEQ ID NO: 6931794 - DNA, 22 bp, Homo sapiens
ggacaaagggctagccacaact

SEQ ID NO: 6931795 - DNA, 22 bp, Homo sapiens
agccaggaagaaggtcacacca

SEQ ID NO: 6931796 - DNA, 22 bp, Homo sapiens
cagtttcagctcaagcactcag

SEQ ID NO: 6931797 - DNA, 22 bp, Homo sapiens
aactttattgttaggggctaaa

SEQ ID NO: 6931798 - DNA, 22 bp, Homo sapiens
acatttatatttagtggggaat

SEQ ID NO: 6931799 - DNA, 22 bp, Homo sapiens
tttaaaggccttgctgagccac

SEQ ID NO: 6931800 - DNA, 22 bp, Homo sapiens
tctttatgtttactccagctga

SEQ ID NO: 6931801 - DNA, 22 bp, Homo sapiens
tcacagtgcaggatcagttaat

SEQ ID NO: 6931802 - DNA, 22 bp, Homo sapiens
caggcagaaattttgtttcatt

SEQ ID NO: 6931803 - DNA, 22 bp, Homo sapiens
acagccactcaaagggccgaag

SEQ ID NO: 6931804 - DNA, 19 bp, Homo sapiens
cagcatctgagccgtgtcc

SEQ ID NO: 6931805 - DNA, 22 bp, Homo sapiens
aagttcatcttacctagatttt

SEQ ID NO: 6931806 - DNA, 22 bp, Homo sapiens
tgatttgtttagtgccaagttt

SEQ ID NO: 6931807 - DNA, 22 bp, Homo sapiens
tttagtgtagcctaagcagaat

SEQ ID NO: 6931808 - DNA, 22 bp, Homo sapiens
cagtcctgttcctggagtagtt

SEQ ID NO: 6931809 - DNA, 22 bp, Homo sapiens
gacagtgtccctctggggtgga

SEQ ID NO: 6931810 - DNA, 22 bp, Homo sapiens
tcctgtttttgtaatcgactct

SEQ ID NO: 6931811 - DNA, 20 bp, Homo sapiens
gttggtcactttgagcagga

SEQ ID NO: 6931812 - DNA, 22 bp, Homo sapiens
ctctgcagattcatcccttcac

SEQ ID NO: 6931813 - DNA, 19 bp, Homo sapiens
gcctgtacctgctttttac

SEQ ID NO: 6931814 - DNA, 22 bp, Homo sapiens
aaatggaggcaaaattggtttc

SEQ ID NO: 6931815 - DNA, 22 bp, Homo sapiens
tcaggctgaatcatcctagctt

SEQ ID NO: 6931816 - DNA, 22 bp, Homo sapiens
acgtgcatctttccatatgtgg

SEQ ID NO: 6931817 - DNA, 22 bp, Homo sapiens
tctgtatctcacttctttgtgg

SEQ ID NO: 6931818 - DNA, 22 bp, Homo sapiens
taaacagttaacatgccagaat

SEQ ID NO: 6931819 - DNA, 22 bp, Homo sapiens
ggcatctcgcattcttgtttct

SEQ ID NO: 6931820 - DNA, 22 bp, Homo sapiens
ttcctgaggtgattctaatgtg

SEQ ID NO: 6931821 - DNA, 22 bp, Homo sapiens
gattgggggtcaggctcaggtc

SEQ ID NO: 6931822 - DNA, 22 bp, Homo sapiens
ttcatgattgactatcaagagc

SEQ ID NO: 6931823 - DNA, 22 bp, Homo sapiens
tttcacaagacagctactgttg

SEQ ID NO: 6931824 - DNA, 22 bp, Homo sapiens
gcaatgatattgaagtgatgaa

SEQ ID NO: 6931825 - DNA, 22 bp, Homo sapiens
actgtggcaaaagaacattgga

SEQ ID NO: 6931826 - DNA, 22 bp, Homo sapiens
tgtggcagaaagcatgtggaca

SEQ ID NO: 6931827 - DNA, 22 bp, Homo sapiens
agaagaatttctctcatgattt

SEQ ID NO: 6931828 - DNA, 22 bp, Homo sapiens
ggaaagaggatagtgggtaggt

SEQ ID NO: 6931829 - DNA, 22 bp, Homo sapiens
tttgacagaaagttattatttt

SEQ ID NO: 6931830 - DNA, 18 bp, Homo sapiens
ccttcagctctggttttc

SEQ ID NO: 6931831 - DNA, 23 bp, Homo sapiens
tgagaagccgccgggcagcctgg

SEQ ID NO: 6931832 - DNA, 22 bp, Homo sapiens
tgtggtagtctcagggcagtat

SEQ ID NO: 6931833 - DNA, 22 bp, Homo sapiens
aaactctagttatgaagtttgt

SEQ ID NO: 6931834 - DNA, 22 bp, Homo sapiens
gagctggctaatactgacttat

SEQ ID NO: 6931835 - DNA, 22 bp, Homo sapiens
ggaactgggttagggtctcttc

SEQ ID NO: 6931836 - DNA, 19 bp, Homo sapiens
cctctgctccagtttcctt

SEQ ID NO: 6931837 - DNA, 22 bp, Homo sapiens
cagaaggcaaacaaaaggattt

SEQ ID NO: 6931838 - DNA, 22 bp, Homo sapiens
acagccaggaattctggagaag

SEQ ID NO: 6931839 - DNA, 22 bp, Homo sapiens
ggacacgtggctgaaggcggcc

SEQ ID NO: 6931840 - DNA, 22 bp, Homo sapiens
taaagccacgctggaaatcagg

SEQ ID NO: 6931841 - DNA, 19 bp, Homo sapiens
tccagaactgccctggcct

SEQ ID NO: 6931842 - DNA, 18 bp, Homo sapiens
gcaggtgccactgctgtt

SEQ ID NO: 6931843 - DNA, 22 bp, Homo sapiens
acaggtggtaaaatggactgtc

SEQ ID NO: 6931844 - DNA, 22 bp, Homo sapiens
agtgttgtatgggatgactgct

SEQ ID NO: 6931845 - DNA, 22 bp, Homo sapiens
acatagatgaggggctgatggg

SEQ ID NO: 6931846 - DNA, 22 bp, Homo sapiens
agtgcattctggcagaacaggt

SEQ ID NO: 6931847 - DNA, 22 bp, Homo sapiens
ttcaaaggagacagagggaagg

SEQ ID NO: 6931848 - DNA, 22 bp, Homo sapiens
tcaagaactggaaattgatatg

SEQ ID NO: 6931849 - DNA, 15 bp, Homo sapiens
agttggtgatttcta

SEQ ID NO: 6931850 - DNA, 22 bp, Homo sapiens
agacaaataactttttatgtcc

SEQ ID NO: 6931851 - DNA, 22 bp, Homo sapiens
ttgcagattcggctgctcagga

SEQ ID NO: 6931852 - DNA, 22 bp, Homo sapiens
actcatcagcctctaggaaaga

SEQ ID NO: 6931853 - DNA, 18 bp, Homo sapiens
ttcttttcatgtgatctc

SEQ ID NO: 6931854 - DNA, 22 bp, Homo sapiens
cttcagaagagttaagtgtgag

SEQ ID NO: 6931855 - DNA, 22 bp, Homo sapiens
atgaggctctcaacaccttgag

SEQ ID NO: 6931856 - DNA, 22 bp, Homo sapiens
gaggccaggaggatctctctaa

SEQ ID NO: 6931857 - DNA, 22 bp, Homo sapiens
ggtcaacttcttatggtagctt

SEQ ID NO: 6931858 - DNA, 22 bp, Homo sapiens
agtgtgcatttgcagaagaccc

SEQ ID NO: 6931859 - DNA, 22 bp, Homo sapiens
gtgctgttaaatggggaggagc

SEQ ID NO: 6931860 - DNA, 22 bp, Homo sapiens
gcagggcttagaaatggtggct

SEQ ID NO: 6931861 - DNA, 22 bp, Homo sapiens
aatgtgattagcctctactgga

SEQ ID NO: 6931862 - DNA, 22 bp, Homo sapiens
tgaagctggcttgacatggcct

SEQ ID NO: 6931863 - DNA, 22 bp, Homo sapiens
tgttgtcagtattaatttcaca

SEQ ID NO: 6931864 - DNA, 22 bp, Homo sapiens
tacacccttctcctgagtgtgt

SEQ ID NO: 6931865 - DNA, 22 bp, Homo sapiens
cagaggggtgtagagatcactg

SEQ ID NO: 6931866 - DNA, 22 bp, Homo sapiens
tttatacatggagaatttttgc

SEQ ID NO: 6931867 - DNA, 20 bp, Homo sapiens
actgacagggaactaaggct

SEQ ID NO: 6931868 - DNA, 19 bp, Homo sapiens
aaagatgtccttttgggct

SEQ ID NO: 6931869 - DNA, 22 bp, Homo sapiens
tttcatagctgaaaatgttgaa

SEQ ID NO: 6931870 - DNA, 22 bp, Homo sapiens
gccattaatgagatcaagaatc

SEQ ID NO: 6931871 - DNA, 22 bp, Homo sapiens
tgaactgagcagtttcctggga

SEQ ID NO: 6931872 - DNA, 22 bp, Homo sapiens
tctggagaacttgcaagaggat

SEQ ID NO: 6931873 - DNA, 22 bp, Homo sapiens
ttccaggatggcaataatgaat

SEQ ID NO: 6931874 - DNA, 19 bp, Homo sapiens
tgcagcactaaaaactttc

SEQ ID NO: 6931875 - DNA, 22 bp, Homo sapiens
ttaaatgtgcctaaacctgtaa

SEQ ID NO: 6931876 - DNA, 22 bp, Homo sapiens
tgtcagtgacctagcacggtgc

SEQ ID NO: 6931877 - DNA, 22 bp, Homo sapiens
caatgacatggataatcatatt

SEQ ID NO: 6931878 - DNA, 22 bp, Homo sapiens
gctcagggagagagggcagccg

SEQ ID NO: 6931879 - DNA, 22 bp, Homo sapiens
taacattgtcagttcaactgct

SEQ ID NO: 6931880 - DNA, 22 bp, Homo sapiens
ttacaatgagaaatggttggca

SEQ ID NO: 6931881 - DNA, 22 bp, Homo sapiens
ctgcacgtataatcagtctgtt

SEQ ID NO: 6931882 - DNA, 22 bp, Homo sapiens
catgccatgtgtgaggagagga

SEQ ID NO: 6931883 - DNA, 22 bp, Homo sapiens
ttgaatgagaagttattgccat

SEQ ID NO: 6931884 - DNA, 22 bp, Homo sapiens
ctcacagtctctccctaatttt

SEQ ID NO: 6931885 - DNA, 22 bp, Homo sapiens
atgtacaacctgcatgacagtc

SEQ ID NO: 6931886 - DNA, 22 bp, Homo sapiens
tggcttcagtctcatcttggaa

SEQ ID NO: 6931887 - DNA, 22 bp, Homo sapiens
aggtccagtgaaactttatttg

SEQ ID NO: 6931888 - DNA, 22 bp, Homo sapiens
tgaacattagttgagtaaagtc

SEQ ID NO: 6931889 - DNA, 22 bp, Homo sapiens
tgtgtaaaagattagtttacta

SEQ ID NO: 6931890 - DNA, 22 bp, Homo sapiens
ttggcagaggtctcgttgtggc

SEQ ID NO: 6931891 - DNA, 20 bp, Homo sapiens
gctaggaaggggaaaaagtg

SEQ ID NO: 6931892 - DNA, 22 bp, Homo sapiens
acatgtatgctttatgaagtag

SEQ ID NO: 6931893 - DNA, 22 bp, Homo sapiens
ccagagaaaaatgtgtccctgt

SEQ ID NO: 6931894 - DNA, 22 bp, Homo sapiens
tctgggaagatgtttcaaaggt

SEQ ID NO: 6931895 - DNA, 22 bp, Homo sapiens
ttggaaagtgacgttcaactgt

SEQ ID NO: 6931896 - DNA, 22 bp, Homo sapiens
gtttctcatcagtttctgatat

SEQ ID NO: 6931897 - DNA, 22 bp, Homo sapiens
atacttggtggtgttccatagg

SEQ ID NO: 6931898 - DNA, 22 bp, Homo sapiens
gacaatctagataatctgtctc

SEQ ID NO: 6931899 - DNA, 22 bp, Homo sapiens
tcactggagaaaagtaatgtat

SEQ ID NO: 6931900 - DNA, 22 bp, Homo sapiens
tcacttgctaacagatattgag

SEQ ID NO: 6931901 - DNA, 18 bp, Homo sapiens
agaccctctaagggcagt

SEQ ID NO: 6931902 - DNA, 22 bp, Homo sapiens
tagaacagagggttgcccagat

SEQ ID NO: 6931903 - DNA, 22 bp, Homo sapiens
cttggagaaaggaaagggcttg

SEQ ID NO: 6931904 - DNA, 22 bp, Homo sapiens
tctgcccagtttgtgctcaggt

SEQ ID NO: 6931905 - DNA, 22 bp, Homo sapiens
ccttagcaaattggcatcttct

SEQ ID NO: 6931906 - DNA, 22 bp, Homo sapiens
actgaggcagaagggtaagtgg

SEQ ID NO: 6931907 - DNA, 22 bp, Homo sapiens
ggagatatttgcaggtcttatg

SEQ ID NO: 6931908 - DNA, 22 bp, Homo sapiens
tagtcacctttggcacctgcaa

SEQ ID NO: 6931909 - DNA, 22 bp, Homo sapiens
tggagaattaggccaaatctcc

SEQ ID NO: 6931910 - DNA, 22 bp, Homo sapiens
ttcagagaacttcatggaagag

SEQ ID NO: 6931911 - DNA, 22 bp, Homo sapiens
ttctgtttattcctaggagctc

SEQ ID NO: 6931912 - DNA, 22 bp, Homo sapiens
taatgaacatcttaatctgaaa

SEQ ID NO: 6931913 - DNA, 16 bp, Homo sapiens
gtcaccatcatgtagt

SEQ ID NO: 6931914 - DNA, 22 bp, Homo sapiens
ccacactgaacctcagtgtctt

SEQ ID NO: 6931915 - DNA, 22 bp, Homo sapiens
tagttacacatgggtagggaat

SEQ ID NO: 6931916 - DNA, 22 bp, Homo sapiens
tgcaagggtgacaggttgctct

SEQ ID NO: 6931917 - DNA, 22 bp, Homo sapiens
accccagaggcggaggctgcag

SEQ ID NO: 6931918 - DNA, 22 bp, Homo sapiens
agaagtatcttgggaaggcact

SEQ ID NO: 6931919 - DNA, 22 bp, Homo sapiens
agtagtgtgacaattaatattt

SEQ ID NO: 6931920 - DNA, 22 bp, Homo sapiens
tttgggcaagctcactgattca

SEQ ID NO: 6931921 - DNA, 22 bp, Homo sapiens
gggcttatggagggctttgtac

SEQ ID NO: 6931922 - DNA, 22 bp, Homo sapiens
gagttctcagtaaagttctttg

SEQ ID NO: 6931923 - DNA, 22 bp, Homo sapiens
tatggagattcaaaagcatctt

SEQ ID NO: 6931924 - DNA, 22 bp, Homo sapiens
gtctggctttatatttgctatt

SEQ ID NO: 6931925 - DNA, 22 bp, Homo sapiens
taattgggcaatttaggactag

SEQ ID NO: 6931926 - DNA, 22 bp, Homo sapiens
cgcccctcagcgacccaccagc

SEQ ID NO: 6931927 - DNA, 22 bp, Homo sapiens
tggctccttcattctcctgcca

SEQ ID NO: 6931928 - DNA, 22 bp, Homo sapiens
aatgacaatggcagaggtagaa

SEQ ID NO: 6931929 - DNA, 22 bp, Homo sapiens
gtactaaaaaatgatcagtttg

SEQ ID NO: 6931930 - DNA, 22 bp, Homo sapiens
atgcacttgcgtgtttgcaaat

SEQ ID NO: 6931931 - DNA, 22 bp, Homo sapiens
cacattccccagagctggggct

SEQ ID NO: 6931932 - DNA, 22 bp, Homo sapiens
gaaagaatgagcatcatgactt

SEQ ID NO: 6931933 - DNA, 22 bp, Homo sapiens
aatctttttcacaagaaagcac

SEQ ID NO: 6931934 - DNA, 22 bp, Homo sapiens
atgcctttcttagccctgaagg

SEQ ID NO: 6931935 - DNA, 22 bp, Homo sapiens
cagaacagagcctgaatctctc

SEQ ID NO: 6931936 - DNA, 22 bp, Homo sapiens
ttggctgctggtctttggatat

SEQ ID NO: 6931937 - DNA, 22 bp, Homo sapiens
cactgtgctcctaactagctgt

SEQ ID NO: 6931938 - DNA, 22 bp, Homo sapiens
tcctggagccatgattcccctc

SEQ ID NO: 6931939 - DNA, 22 bp, Homo sapiens
tttgtgaaatgaagtcacaact

SEQ ID NO: 6931940 - DNA, 22 bp, Homo sapiens
ctaaaatgtttggggcagaacc

SEQ ID NO: 6931941 - DNA, 22 bp, Homo sapiens
tgcagagcagcaactgcgtgcg

SEQ ID NO: 6931942 - DNA, 22 bp, Homo sapiens
agggaagtgatggagttcgatc

SEQ ID NO: 6931943 - DNA, 22 bp, Homo sapiens
aaacaaggtccttctgtgacat

SEQ ID NO: 6931944 - DNA, 22 bp, Homo sapiens
attttgacattgcggcattgct

SEQ ID NO: 6931945 - DNA, 22 bp, Homo sapiens
aggtctgatcatgggcccactt

SEQ ID NO: 6931946 - DNA, 22 bp, Homo sapiens
gatgtacaggagtttttcaagg

SEQ ID NO: 6931947 - DNA, 18 bp, Homo sapiens
tcagctgggtttctgggt

SEQ ID NO: 6931948 - DNA, 22 bp, Homo sapiens
aggctgtgaaggttaaagacga

SEQ ID NO: 6931949 - DNA, 19 bp, Homo sapiens
cttctagaccttataccac

SEQ ID NO: 6931950 - DNA, 22 bp, Homo sapiens
aggctgtgcattttggagggcc

SEQ ID NO: 6931951 - DNA, 22 bp, Homo sapiens
tttgacagtgatgatatataca

SEQ ID NO: 6931952 - DNA, 22 bp, Homo sapiens
tacaagttgcagaaagttgttt

SEQ ID NO: 6931953 - DNA, 22 bp, Homo sapiens
attgctgggaatatttagccca

SEQ ID NO: 6931954 - DNA, 22 bp, Homo sapiens
ctccccagcattctgacttcct

SEQ ID NO: 6931955 - DNA, 20 bp, Homo sapiens
tttcaccatcttggccaggc

SEQ ID NO: 6931956 - DNA, 22 bp, Homo sapiens
cgggcagattgggaaggttcat

SEQ ID NO: 6931957 - DNA, 22 bp, Homo sapiens
aatagcacacttgtgagcatta

SEQ ID NO: 6931958 - DNA, 22 bp, Homo sapiens
aaattcctgtcatttgcacttt

SEQ ID NO: 6931959 - DNA, 22 bp, Homo sapiens
gcctggctcgggcactcgccag

SEQ ID NO: 6931960 - DNA, 22 bp, Homo sapiens
gggcctgccattgctgccccag

SEQ ID NO: 6931961 - DNA, 22 bp, Homo sapiens
actgaggcttacaaaggtaaag

SEQ ID NO: 6931962 - DNA, 22 bp, Homo sapiens
agcaggcagctgggggagttga

SEQ ID NO: 6931963 - DNA, 22 bp, Homo sapiens
tcagaaaaggtagctgtgacaa

SEQ ID NO: 6931964 - DNA, 22 bp, Homo sapiens
accaggaactcacccgcagagg

SEQ ID NO: 6931965 - DNA, 22 bp, Homo sapiens
ttcaatgatttttagggatcat

SEQ ID NO: 6931966 - DNA, 22 bp, Homo sapiens
gcagggctgaaggtcccaggcc

SEQ ID NO: 6931967 - DNA, 22 bp, Homo sapiens
tatccatattcagactgtgaat

SEQ ID NO: 6931968 - DNA, 22 bp, Homo sapiens
aggcatgtgctgtttgtctcca

SEQ ID NO: 6931969 - DNA, 22 bp, Homo sapiens
tgtgaagtccagagaagtcagg

SEQ ID NO: 6931970 - DNA, 21 bp, Homo sapiens
agtgcaatggctcgatctcgg

SEQ ID NO: 6931971 - DNA, 22 bp, Homo sapiens
tctctgaaggggagctgtttaa

SEQ ID NO: 6931972 - DNA, 22 bp, Homo sapiens
ttcctctgtatgctttgctgct

SEQ ID NO: 6931973 - DNA, 22 bp, Homo sapiens
tctcacattttaaaaggacata

SEQ ID NO: 6931974 - DNA, 18 bp, Homo sapiens
gatgtgggccctggatat

SEQ ID NO: 6931975 - DNA, 22 bp, Homo sapiens
ttctaaaataagtttatctggt

SEQ ID NO: 6931976 - DNA, 22 bp, Homo sapiens
gtacagaattatgccatgaggg

SEQ ID NO: 6931977 - DNA, 22 bp, Homo sapiens
gcttccatctatgtcttcatca

SEQ ID NO: 6931978 - DNA, 22 bp, Homo sapiens
tcactaagtgccgagtttagtt

SEQ ID NO: 6931979 - DNA, 21 bp, Homo sapiens
ggagtccaaaaattagccatg

SEQ ID NO: 6931980 - DNA, 22 bp, Homo sapiens
tgtacactgcaggatgcattgc

SEQ ID NO: 6931981 - DNA, 22 bp, Homo sapiens
gtgggctggatttgcttgcaga

SEQ ID NO: 6931982 - DNA, 22 bp, Homo sapiens
ggaggacactggctctgccttc

SEQ ID NO: 6931983 - DNA, 22 bp, Homo sapiens
tcacatagtggggcattggaat

SEQ ID NO: 6931984 - DNA, 22 bp, Homo sapiens
acactggagatggacctcacaa

SEQ ID NO: 6931985 - DNA, 22 bp, Homo sapiens
tcagtggggtcgatgtgaggga

SEQ ID NO: 6931986 - DNA, 22 bp, Homo sapiens
atgcacattgtagccacacaat

SEQ ID NO: 6931987 - DNA, 22 bp, Homo sapiens
ccctgctcttctgactcaagct

SEQ ID NO: 6931988 - DNA, 22 bp, Homo sapiens
atgagcatccagaacagtgcct

SEQ ID NO: 6931989 - DNA, 22 bp, Homo sapiens
tgggaccagataaagggaggtc

SEQ ID NO: 6931990 - DNA, 22 bp, Homo sapiens
aacactttggaatagagatagg

SEQ ID NO: 6931991 - DNA, 19 bp, Homo sapiens
ggttaatgttaggatactt

SEQ ID NO: 6931992 - DNA, 22 bp, Homo sapiens
ctgggcagctgtatcagggagt

SEQ ID NO: 6931993 - DNA, 22 bp, Homo sapiens
aggcttctgggattcccttggt

SEQ ID NO: 6931994 - DNA, 22 bp, Homo sapiens
ttgcaggtccggaacctcgccg

SEQ ID NO: 6931995 - DNA, 22 bp, Homo sapiens
tatgtgacttgacaaagcttcc

SEQ ID NO: 6931996 - DNA, 22 bp, Homo sapiens
taagaaacatgatacttttcct

SEQ ID NO: 6931997 - DNA, 22 bp, Homo sapiens
cagtctctttatccaccaagcc

SEQ ID NO: 6931998 - DNA, 22 bp, Homo sapiens
tctagaaacatgacattgatct

SEQ ID NO: 6931999 - DNA, 22 bp, Homo sapiens
gggctctggatggagcctgcag

SEQ ID NO: 6932000 - DNA, 22 bp, Homo sapiens
ggaggaagccctcggtgcccca

SEQ ID NO: 6932001 - DNA, 22 bp, Homo sapiens
gcagagaaagttttgtcctcag

SEQ ID NO: 6932002 - DNA, 22 bp, Homo sapiens
ggtaaaatgcagattcttagcc

SEQ ID NO: 6932003 - DNA, 22 bp, Homo sapiens
caaatagtgaaacagatggggg

SEQ ID NO: 6932004 - DNA, 22 bp, Homo sapiens
aaggcacagccacttgatcatc

SEQ ID NO: 6932005 - DNA, 22 bp, Homo sapiens
gggaagaagacatggtgaaggc

SEQ ID NO: 6932006 - DNA, 21 bp, Homo sapiens
agtgactatgacattattacc

SEQ ID NO: 6932007 - DNA, 22 bp, Homo sapiens
aactttggggtggtttgttagt

SEQ ID NO: 6932008 - DNA, 22 bp, Homo sapiens
cttctctggcatagcaagcagg

SEQ ID NO: 6932009 - DNA, 23 bp, Homo sapiens
ttgaaggagaaagctttcttggt

SEQ ID NO: 6932010 - DNA, 22 bp, Homo sapiens
aacagctattagaacttcatgg

SEQ ID NO: 6932011 - DNA, 23 bp, Homo sapiens
ctggtcagaggctgctggaaggg

SEQ ID NO: 6932012 - DNA, 22 bp, Homo sapiens
tggctctactcaaatatctggc

SEQ ID NO: 6932013 - DNA, 22 bp, Homo sapiens
actgtggctaattcatttggtc

SEQ ID NO: 6932014 - DNA, 23 bp, Homo sapiens
ccctttaagatttgaatagtcag

SEQ ID NO: 6932015 - DNA, 22 bp, Homo sapiens
ctgtaaagtaagaggtaagtta

SEQ ID NO: 6932016 - DNA, 22 bp, Homo sapiens
gagcagttctccttggtagggg

SEQ ID NO: 6932017 - DNA, 20 bp, Homo sapiens
ttttatatgtagggtatatg

SEQ ID NO: 6932018 - DNA, 22 bp, Homo sapiens
tagctgcttgaccaggcagtgg

SEQ ID NO: 6932019 - DNA, 22 bp, Homo sapiens
ttatcattgtcgcagtctaatt

SEQ ID NO: 6932020 - DNA, 22 bp, Homo sapiens
atttgattagctgtgtaatttt

SEQ ID NO: 6932021 - DNA, 22 bp, Homo sapiens
agagcctggacttttctgagcc

SEQ ID NO: 6932022 - DNA, 22 bp, Homo sapiens
atacaagtggccacttgaattc

SEQ ID NO: 6932023 - DNA, 22 bp, Homo sapiens
tttgggcagaaacatgcgcccc

SEQ ID NO: 6932024 - DNA, 22 bp, Homo sapiens
cagaaatatcacctggactcta

SEQ ID NO: 6932025 - DNA, 22 bp, Homo sapiens
cttgtggccaatgtttgttata

SEQ ID NO: 6932026 - DNA, 22 bp, Homo sapiens
gatttacaaagctctctagtgt

SEQ ID NO: 6932027 - DNA, 22 bp, Homo sapiens
tggtgcagtagaaggccgactt

SEQ ID NO: 6932028 - DNA, 22 bp, Homo sapiens
tcttttccttgatggttaaata

SEQ ID NO: 6932029 - DNA, 22 bp, Homo sapiens
tgggttcacgccattctcctgc

SEQ ID NO: 6932030 - DNA, 22 bp, Homo sapiens
gcagccaggctacagcgggctt

SEQ ID NO: 6932031 - DNA, 22 bp, Homo sapiens
acccaaaagtcactcaggagca

SEQ ID NO: 6932032 - DNA, 23 bp, Homo sapiens
tctctgagccatagcagtcccaa

SEQ ID NO: 6932033 - DNA, 22 bp, Homo sapiens
tattctcagtgctataagtaga

SEQ ID NO: 6932034 - DNA, 22 bp, Homo sapiens
acatgcaggtgatctggtcaat

SEQ ID NO: 6932035 - DNA, 22 bp, Homo sapiens
ttattcccactgtgaaatgagg

SEQ ID NO: 6932036 - DNA, 22 bp, Homo sapiens
caattcatgttaaacagaagca

SEQ ID NO: 6932037 - DNA, 22 bp, Homo sapiens
tcctggagataattgcagtgaa

SEQ ID NO: 6932038 - DNA, 22 bp, Homo sapiens
tgcctttactgattagctgtgt

SEQ ID NO: 6932039 - DNA, 22 bp, Homo sapiens
aagtattctacaaagaaattga

SEQ ID NO: 6932040 - DNA, 17 bp, Homo sapiens
gggttttgggagcagct

SEQ ID NO: 6932041 - DNA, 22 bp, Homo sapiens
agagccaggtgtagtctcggag

SEQ ID NO: 6932042 - DNA, 22 bp, Homo sapiens
gctctgttcatcagtttgttgg

SEQ ID NO: 6932043 - DNA, 22 bp, Homo sapiens
attagcttggtatgccataaag

SEQ ID NO: 6932044 - DNA, 22 bp, Homo sapiens
agggatgttagttgtgagctca

SEQ ID NO: 6932045 - DNA, 17 bp, Homo sapiens
ggccacagagcttgggg

SEQ ID NO: 6932046 - DNA, 22 bp, Homo sapiens
tggaggcagtttaagtctgaga

SEQ ID NO: 6932047 - DNA, 22 bp, Homo sapiens
actcagagaacattcccagtct

SEQ ID NO: 6932048 - DNA, 22 bp, Homo sapiens
cttgttcatctcattgggactg

SEQ ID NO: 6932049 - DNA, 22 bp, Homo sapiens
gaacaggcataagcatttgcat

SEQ ID NO: 6932050 - DNA, 22 bp, Homo sapiens
tcttggtctgtggcaggtgccg

SEQ ID NO: 6932051 - DNA, 22 bp, Homo sapiens
tgtacattgtcactcatcaagt

SEQ ID NO: 6932052 - DNA, 22 bp, Homo sapiens
ctgtccagaataggcaaatcca

SEQ ID NO: 6932053 - DNA, 22 bp, Homo sapiens
gattcaggcctgcatctcagca

SEQ ID NO: 6932054 - DNA, 22 bp, Homo sapiens
ttaagatcaagataagcaataa

SEQ ID NO: 6932055 - DNA, 22 bp, Homo sapiens
gctgggagtcgcgtctgtggcc

SEQ ID NO: 6932056 - DNA, 22 bp, Homo sapiens
aaactggtaatcggcaagtgag

SEQ ID NO: 6932057 - DNA, 22 bp, Homo sapiens
ggagaacaaatatctggcttct

SEQ ID NO: 6932058 - DNA, 22 bp, Homo sapiens
cttgcattggctttcttggcag

SEQ ID NO: 6932059 - DNA, 22 bp, Homo sapiens
cttgtggagatatccatgtctg

SEQ ID NO: 6932060 - DNA, 22 bp, Homo sapiens
gaggacagagccgcctggcaag

SEQ ID NO: 6932061 - DNA, 22 bp, Homo sapiens
ctcagaggtggatgccttgtgg

SEQ ID NO: 6932062 - DNA, 22 bp, Homo sapiens
cagctgtcttttctaaatatta

SEQ ID NO: 6932063 - DNA, 22 bp, Homo sapiens
ctgtccccattgtttgagggtt

SEQ ID NO: 6932064 - DNA, 22 bp, Homo sapiens
tggccagtgtgtgctgccggct

SEQ ID NO: 6932065 - DNA, 22 bp, Homo sapiens
cagtcacaggtggagaaccgag

SEQ ID NO: 6932066 - DNA, 22 bp, Homo sapiens
gagtcggaggcaggagacctgg

SEQ ID NO: 6932067 - DNA, 22 bp, Homo sapiens
gctacaagtcttgtcattcatt

SEQ ID NO: 6932068 - DNA, 23 bp, Homo sapiens
tcaacagagcagagggaggcttt

SEQ ID NO: 6932069 - DNA, 22 bp, Homo sapiens
ggccaccagtcctctggcaggg

SEQ ID NO: 6932070 - DNA, 22 bp, Homo sapiens
gccagtgtgtcctctcagtttc

SEQ ID NO: 6932071 - DNA, 22 bp, Homo sapiens
aggtggggccaaatgctacagt

SEQ ID NO: 6932072 - DNA, 22 bp, Homo sapiens
taatacatcattcatctaagga

SEQ ID NO: 6932073 - DNA, 22 bp, Homo sapiens
ctttacagcttagtggtatgga

SEQ ID NO: 6932074 - DNA, 22 bp, Homo sapiens
agttggtcctaggagttgagtt

SEQ ID NO: 6932075 - DNA, 22 bp, Homo sapiens
ctgaccactgttctcctggggt

SEQ ID NO: 6932076 - DNA, 22 bp, Homo sapiens
ctggatgataacagcaatattt

SEQ ID NO: 6932077 - DNA, 22 bp, Homo sapiens
gtgtagagtgacaaggtgggaa

SEQ ID NO: 6932078 - DNA, 22 bp, Homo sapiens
tattcacaaaatgaggtcctca

SEQ ID NO: 6932079 - DNA, 22 bp, Homo sapiens
tacagtgtgacatttctacaaa

SEQ ID NO: 6932080 - DNA, 22 bp, Homo sapiens
agtgactggttttgacaggaat

SEQ ID NO: 6932081 - DNA, 22 bp, Homo sapiens
ccacagtacaggaaatcttgtt

SEQ ID NO: 6932082 - DNA, 22 bp, Homo sapiens
gagacagtgctccgtgggtcca

SEQ ID NO: 6932083 - DNA, 22 bp, Homo sapiens
attaggatttggtatggtcata

SEQ ID NO: 6932084 - DNA, 22 bp, Homo sapiens
ttccacggggctccccgctctt

SEQ ID NO: 6932085 - DNA, 22 bp, Homo sapiens
taggagggggaacaaggcatac

SEQ ID NO: 6932086 - DNA, 22 bp, Homo sapiens
aactgcttccttggcaggcatg

SEQ ID NO: 6932087 - DNA, 22 bp, Homo sapiens
ctggctcccctacttcttattg

SEQ ID NO: 6932088 - DNA, 22 bp, Homo sapiens
tacaaagtgtgcccatgctgag

SEQ ID NO: 6932089 - DNA, 20 bp, Homo sapiens
gaggagccaccttgagctgg

SEQ ID NO: 6932090 - DNA, 23 bp, Homo sapiens
tcagaacaatgccttaggggcat

SEQ ID NO: 6932091 - DNA, 22 bp, Homo sapiens
aggtactgtgagttagcctgtt

SEQ ID NO: 6932092 - DNA, 22 bp, Homo sapiens
aagattcttgactagaatgatt

SEQ ID NO: 6932093 - DNA, 22 bp, Homo sapiens
taaaaatcttatgaatggcaag

SEQ ID NO: 6932094 - DNA, 22 bp, Homo sapiens
tgctgccactggtagtctcatt

SEQ ID NO: 6932095 - DNA, 22 bp, Homo sapiens
agttcctatactgggtcagtcc

SEQ ID NO: 6932096 - DNA, 19 bp, Homo sapiens
aggactctggaggcatgag

SEQ ID NO: 6932097 - DNA, 22 bp, Homo sapiens
tcctttccagcctcacctcagc

SEQ ID NO: 6932098 - DNA, 21 bp, Homo sapiens
agactgtggattttgacatgt

SEQ ID NO: 6932099 - DNA, 22 bp, Homo sapiens
tagaggtgagatattttatttt

SEQ ID NO: 6932100 - DNA, 22 bp, Homo sapiens
agcagtccttctttagagagcc

SEQ ID NO: 6932101 - DNA, 18 bp, Homo sapiens
ttgattcatattaaccat

SEQ ID NO: 6932102 - DNA, 22 bp, Homo sapiens
gtgaaggcagccatcgacagtt

SEQ ID NO: 6932103 - DNA, 22 bp, Homo sapiens
cttaatcatggcttgtgggagg

SEQ ID NO: 6932104 - DNA, 22 bp, Homo sapiens
tacaccagaatctctgtgggga

SEQ ID NO: 6932105 - DNA, 22 bp, Homo sapiens
ctgccatgctcttttatgaaga

SEQ ID NO: 6932106 - DNA, 22 bp, Homo sapiens
tgggtggcggcctggttctgag

SEQ ID NO: 6932107 - DNA, 22 bp, Homo sapiens
gtgacaggccactgcggctctg

SEQ ID NO: 6932108 - DNA, 23 bp, Homo sapiens
acagcttcctggcatggagaacc

SEQ ID NO: 6932109 - DNA, 22 bp, Homo sapiens
taagttggaaaggctatgaggc

SEQ ID NO: 6932110 - DNA, 23 bp, Homo sapiens
cctggggcacttgagtcctcatc

SEQ ID NO: 6932111 - DNA, 22 bp, Homo sapiens
acctcctggcctcaagcaatcc

SEQ ID NO: 6932112 - DNA, 22 bp, Homo sapiens
ataagtgactgcagggaattca

SEQ ID NO: 6932113 - DNA, 22 bp, Homo sapiens
gtatagtttgcgatttgtggtt

SEQ ID NO: 6932114 - DNA, 22 bp, Homo sapiens
cactttgatttgtgatgtgaga

SEQ ID NO: 6932115 - DNA, 22 bp, Homo sapiens
ggaatgtagaatctctggtctc

SEQ ID NO: 6932116 - DNA, 22 bp, Homo sapiens
ttagcattgtacatttgtgctt

SEQ ID NO: 6932117 - DNA, 22 bp, Homo sapiens
atagacattttgcattcaagca

SEQ ID NO: 6932118 - DNA, 19 bp, Homo sapiens
taatatacagacccatctg

SEQ ID NO: 6932119 - DNA, 22 bp, Homo sapiens
atattgttagtaatatttcgaa

SEQ ID NO: 6932120 - DNA, 23 bp, Homo sapiens
agggccactgggaaggattactg

SEQ ID NO: 6932121 - DNA, 22 bp, Homo sapiens
ttttgggtatagaggtgttcat

SEQ ID NO: 6932122 - DNA, 22 bp, Homo sapiens
actgtgttgtctcaacctgacc

SEQ ID NO: 6932123 - DNA, 22 bp, Homo sapiens
ggcctggaatgctttcctacca

SEQ ID NO: 6932124 - DNA, 22 bp, Homo sapiens
ttatcttgggtaactttgtgca

SEQ ID NO: 6932125 - DNA, 22 bp, Homo sapiens
ggtgttaacttgtttatgacaa

SEQ ID NO: 6932126 - DNA, 22 bp, Homo sapiens
aatttgtgaatctgtctcttga

SEQ ID NO: 6932127 - DNA, 22 bp, Homo sapiens
tggccaggggagttcccctcca

SEQ ID NO: 6932128 - DNA, 22 bp, Homo sapiens
ctatttatgtgctattttgtat

SEQ ID NO: 6932129 - DNA, 22 bp, Homo sapiens
acgcaaaacaggtggacgccaa

SEQ ID NO: 6932130 - DNA, 22 bp, Homo sapiens
aacaggaactatttgtattcca

SEQ ID NO: 6932131 - DNA, 16 bp, Homo sapiens
cagagaggacagaggc

SEQ ID NO: 6932132 - DNA, 22 bp, Homo sapiens
ggaccctgggctctgggcctat

SEQ ID NO: 6932133 - DNA, 22 bp, Homo sapiens
gggcaaaggcagaaagcggtgt

SEQ ID NO: 6932134 - DNA, 22 bp, Homo sapiens
tctctgggataaactgggccag

SEQ ID NO: 6932135 - DNA, 22 bp, Homo sapiens
acagcttctcctcgatgtcatg

SEQ ID NO: 6932136 - DNA, 22 bp, Homo sapiens
tcccttagggctgggtgggtgt

SEQ ID NO: 6932137 - DNA, 23 bp, Homo sapiens
ccctggccttggggcacaggctg

SEQ ID NO: 6932138 - DNA, 22 bp, Homo sapiens
tttaaacatcttgttgccttaa

SEQ ID NO: 6932139 - DNA, 22 bp, Homo sapiens
ggctggaacttcttctggcatt

SEQ ID NO: 6932140 - DNA, 22 bp, Homo sapiens
agtagccaacatttatgatcca

SEQ ID NO: 6932141 - DNA, 22 bp, Homo sapiens
agaaagcccacccagaagatgt

SEQ ID NO: 6932142 - DNA, 22 bp, Homo sapiens
tggaatgtcaaaagtctgctat

SEQ ID NO: 6932143 - DNA, 22 bp, Homo sapiens
cagaaagacctgattggcagtt

SEQ ID NO: 6932144 - DNA, 22 bp, Homo sapiens
agagtagcctcatagacactca

SEQ ID NO: 6932145 - DNA, 22 bp, Homo sapiens
gcaagtcccttgttcacttgga

SEQ ID NO: 6932146 - DNA, 23 bp, Homo sapiens
aggtgcagccctggacctgcccc

SEQ ID NO: 6932147 - DNA, 22 bp, Homo sapiens
gagcacagaactaaatgctggt

SEQ ID NO: 6932148 - DNA, 22 bp, Homo sapiens
ttgcaattagttacaaaagtgg

SEQ ID NO: 6932149 - DNA, 22 bp, Homo sapiens
aggaagcccttgtcatttctgt

SEQ ID NO: 6932150 - DNA, 22 bp, Homo sapiens
gccaggagccctgggcaagttc

SEQ ID NO: 6932151 - DNA, 19 bp, Homo sapiens
aagctacagcccaggtctg

SEQ ID NO: 6932152 - DNA, 22 bp, Homo sapiens
gtctttcactgcggtttacatg

SEQ ID NO: 6932153 - DNA, 23 bp, Homo sapiens
ctgtggacttccttcattctact

SEQ ID NO: 6932154 - DNA, 20 bp, Homo sapiens
aaggaatatttgtatctggg

SEQ ID NO: 6932155 - DNA, 22 bp, Homo sapiens
aggccagaaatgtcagggagtg

SEQ ID NO: 6932156 - DNA, 22 bp, Homo sapiens
gaactacagtgcattttcttaa

SEQ ID NO: 6932157 - DNA, 18 bp, Homo sapiens
actttgcaggctcccatt

SEQ ID NO: 6932158 - DNA, 22 bp, Homo sapiens
aaagcatggcatgaagaacatg

SEQ ID NO: 6932159 - DNA, 22 bp, Homo sapiens
ttgcaggtgagggaaatgactg

SEQ ID NO: 6932160 - DNA, 22 bp, Homo sapiens
gaccctccactcactgctgtgt

SEQ ID NO: 6932161 - DNA, 22 bp, Homo sapiens
tatttaaaatagtgctccagca

SEQ ID NO: 6932162 - DNA, 22 bp, Homo sapiens
tttatatccatctttgaagtaa

SEQ ID NO: 6932163 - DNA, 22 bp, Homo sapiens
tattagtgaaagaattagtttg

SEQ ID NO: 6932164 - DNA, 22 bp, Homo sapiens
agttcaattgttttgtaaaagt

SEQ ID NO: 6932165 - DNA, 22 bp, Homo sapiens
gaggtcatgcaaaattgaatca

SEQ ID NO: 6932166 - DNA, 22 bp, Homo sapiens
atgaatatgtacacatctgtca

SEQ ID NO: 6932167 - DNA, 22 bp, Homo sapiens
ccagaaagactttttaggtacg

SEQ ID NO: 6932168 - DNA, 22 bp, Homo sapiens
taggctcagggtctcagaggct

SEQ ID NO: 6932169 - DNA, 22 bp, Homo sapiens
gtgggcagggttgctttctccg

SEQ ID NO: 6932170 - DNA, 22 bp, Homo sapiens
tctgaggtcctactataagtgg

SEQ ID NO: 6932171 - DNA, 22 bp, Homo sapiens
caggcagggagccactgtataa

SEQ ID NO: 6932172 - DNA, 22 bp, Homo sapiens
acttggttgatgtcataaggtt

SEQ ID NO: 6932173 - DNA, 21 bp, Homo sapiens
agtgggatactggaaggtaga

SEQ ID NO: 6932174 - DNA, 22 bp, Homo sapiens
tgcagctgggtctgccctggct

SEQ ID NO: 6932175 - DNA, 22 bp, Homo sapiens
gtttcagaacaccccatttggg

SEQ ID NO: 6932176 - DNA, 22 bp, Homo sapiens
taaactgtagctctcgtaattc

SEQ ID NO: 6932177 - DNA, 22 bp, Homo sapiens
acaggtcctcaagtcagctggg

SEQ ID NO: 6932178 - DNA, 22 bp, Homo sapiens
acaggacatgtaccaggtggtc

SEQ ID NO: 6932179 - DNA, 22 bp, Homo sapiens
gattgggcagaaatttccttaa

SEQ ID NO: 6932180 - DNA, 22 bp, Homo sapiens
tgatgagggagatttgagccca

SEQ ID NO: 6932181 - DNA, 22 bp, Homo sapiens
actgtatattggacaaggaaaa

SEQ ID NO: 6932182 - DNA, 22 bp, Homo sapiens
cagttttatcatctgtgaaatg

SEQ ID NO: 6932183 - DNA, 22 bp, Homo sapiens
gaggggagaggcttatggatca

SEQ ID NO: 6932184 - DNA, 22 bp, Homo sapiens
ctgtcctggtactttgaggttc

SEQ ID NO: 6932185 - DNA, 22 bp, Homo sapiens
ttcacagctcatactgttctca

SEQ ID NO: 6932186 - DNA, 22 bp, Homo sapiens
tgctgaggaataattgttcctg

SEQ ID NO: 6932187 - DNA, 22 bp, Homo sapiens
tcgcttcatccgtgaagccaaa

SEQ ID NO: 6932188 - DNA, 22 bp, Homo sapiens
gttgtgtttttctgctggaagc

SEQ ID NO: 6932189 - DNA, 23 bp, Homo sapiens
cactgtgttacatgttgaagatg

SEQ ID NO: 6932190 - DNA, 22 bp, Homo sapiens
gttctctctgcttccaagatgg

SEQ ID NO: 6932191 - DNA, 22 bp, Homo sapiens
gtcataattccataacagatat

SEQ ID NO: 6932192 - DNA, 22 bp, Homo sapiens
cagctgcctgtattgtcctcat

SEQ ID NO: 6932193 - DNA, 19 bp, Homo sapiens
tgttgacattctgagttga

SEQ ID NO: 6932194 - DNA, 22 bp, Homo sapiens
acctcagattgtggctccgctg

SEQ ID NO: 6932195 - DNA, 19 bp, Homo sapiens
ccagtagtatagcacagtc

SEQ ID NO: 6932196 - DNA, 22 bp, Homo sapiens
aacagcttgaggaatatcatca

SEQ ID NO: 6932197 - DNA, 19 bp, Homo sapiens
agaggcagtctccaacagg

SEQ ID NO: 6932198 - DNA, 22 bp, Homo sapiens
tactttgtcattctaaccttcc

SEQ ID NO: 6932199 - DNA, 22 bp, Homo sapiens
ctagattcatatatttttggag

SEQ ID NO: 6932200 - DNA, 22 bp, Homo sapiens
aggagtcacctgcccaaagtca

SEQ ID NO: 6932201 - DNA, 22 bp, Homo sapiens
cagcatctgtaggactcctctt

SEQ ID NO: 6932202 - DNA, 22 bp, Homo sapiens
tgtgccctgcctacatcacctt

SEQ ID NO: 6932203 - DNA, 20 bp, Homo sapiens
atgtgtctgcctctgtgttc

SEQ ID NO: 6932204 - DNA, 22 bp, Homo sapiens
tctctgaccactgagggattta

SEQ ID NO: 6932205 - DNA, 22 bp, Homo sapiens
tggaagcggacgttgtggggtg

SEQ ID NO: 6932206 - DNA, 22 bp, Homo sapiens
gtggtaatagagctccaaacta

SEQ ID NO: 6932207 - DNA, 22 bp, Homo sapiens
ggagagctggtagctggctcca

SEQ ID NO: 6932208 - DNA, 22 bp, Homo sapiens
tggtctgatggtcccaccaccg

SEQ ID NO: 6932209 - DNA, 22 bp, Homo sapiens
gggcctgaggcttccctaatgc

SEQ ID NO: 6932210 - DNA, 22 bp, Homo sapiens
gatgacactaagcatgttgtgg

SEQ ID NO: 6932211 - DNA, 22 bp, Homo sapiens
ggtgtccattggcctaacctag

SEQ ID NO: 6932212 - DNA, 22 bp, Homo sapiens
acactgagttttaccaggcaca

SEQ ID NO: 6932213 - DNA, 21 bp, Homo sapiens
cagagggcttttctctgttct

SEQ ID NO: 6932214 - DNA, 22 bp, Homo sapiens
tcaccagatgatttttcttcag

SEQ ID NO: 6932215 - DNA, 22 bp, Homo sapiens
ggccttgccaaggagcccttaa

SEQ ID NO: 6932216 - DNA, 22 bp, Homo sapiens
gtctgtgtgcacagagctttgg

SEQ ID NO: 6932217 - DNA, 22 bp, Homo sapiens
aatgaagcaagctgctgtgttt

SEQ ID NO: 6932218 - DNA, 22 bp, Homo sapiens
taagcaatgagataatcatggg

SEQ ID NO: 6932219 - DNA, 23 bp, Homo sapiens
gccaggtattctgataggcactg

SEQ ID NO: 6932220 - DNA, 22 bp, Homo sapiens
tgtggaacacctagaatgggta

SEQ ID NO: 6932221 - DNA, 22 bp, Homo sapiens
gacatagacaaagtcattgtca

SEQ ID NO: 6932222 - DNA, 22 bp, Homo sapiens
agcccagcccgggctgcgcttt

SEQ ID NO: 6932223 - DNA, 22 bp, Homo sapiens
cctggggaatagagtcaagggg

SEQ ID NO: 6932224 - DNA, 22 bp, Homo sapiens
tgctcccagctcctgcagcaac

SEQ ID NO: 6932225 - DNA, 22 bp, Homo sapiens
ttagaaatcacctctgaagatc

SEQ ID NO: 6932226 - DNA, 22 bp, Homo sapiens
agctgctgtttggtgagtcttg

SEQ ID NO: 6932227 - DNA, 17 bp, Homo sapiens
ggagcagatccaccatt

SEQ ID NO: 6932228 - DNA, 22 bp, Homo sapiens
cagtatgtttgggagacatgac

SEQ ID NO: 6932229 - DNA, 22 bp, Homo sapiens
aattcagttatatgtccacttc

SEQ ID NO: 6932230 - DNA, 22 bp, Homo sapiens
gccaggaaagggaattccctga

SEQ ID NO: 6932231 - DNA, 22 bp, Homo sapiens
tcttacagaaaatagataacat

SEQ ID NO: 6932232 - DNA, 22 bp, Homo sapiens
cagtggttttatatctaagctt

SEQ ID NO: 6932233 - DNA, 22 bp, Homo sapiens
tctgtgactgatggaggctttt

SEQ ID NO: 6932234 - DNA, 22 bp, Homo sapiens
tcccaccccctccaaggaggaa

SEQ ID NO: 6932235 - DNA, 22 bp, Homo sapiens
tgcttctggcagattgagtgag

SEQ ID NO: 6932236 - DNA, 20 bp, Homo sapiens
tatggcttgcagccaccctt

SEQ ID NO: 6932237 - DNA, 22 bp, Homo sapiens
acatgtaatacatccagcaata

SEQ ID NO: 6932238 - DNA, 22 bp, Homo sapiens
ccatgcatataatagtgcctgg

SEQ ID NO: 6932239 - DNA, 22 bp, Homo sapiens
ccaggaatgcacactctgagaa

SEQ ID NO: 6932240 - DNA, 22 bp, Homo sapiens
agtcagagaataaagaatgcat

SEQ ID NO: 6932241 - DNA, 22 bp, Homo sapiens
gtcccctggcccccagcgtcgg

SEQ ID NO: 6932242 - DNA, 22 bp, Homo sapiens
taggctgggggtaggaattgag

SEQ ID NO: 6932243 - DNA, 22 bp, Homo sapiens
tctgcgccgcatgtgttctttc

SEQ ID NO: 6932244 - DNA, 22 bp, Homo sapiens
tgtcactttggggagagttttg

SEQ ID NO: 6932245 - DNA, 19 bp, Homo sapiens
agagtattgaatttgccct

SEQ ID NO: 6932246 - DNA, 20 bp, Homo sapiens
agctacaatgcgaagctggc

SEQ ID NO: 6932247 - DNA, 22 bp, Homo sapiens
caaaagtaattgcggtttttgc

SEQ ID NO: 6932248 - DNA, 22 bp, Homo sapiens
tttcagttgcagtggttgtcta

SEQ ID NO: 6932249 - DNA, 22 bp, Homo sapiens
tccctaaactctgaactgattc

SEQ ID NO: 6932250 - DNA, 22 bp, Homo sapiens
ggctggtcccgggtcctccggc

SEQ ID NO: 6932251 - DNA, 22 bp, Homo sapiens
ttgaagattattctattaaaag

SEQ ID NO: 6932252 - DNA, 22 bp, Homo sapiens
ttgtagcaagcttgtaagttca

SEQ ID NO: 6932253 - DNA, 22 bp, Homo sapiens
gagaggttgaacaacatactct

SEQ ID NO: 6932254 - DNA, 22 bp, Homo sapiens
agggtcacctgcttgccagggc

SEQ ID NO: 6932255 - DNA, 22 bp, Homo sapiens
atgattacatgtgttaatatac

SEQ ID NO: 6932256 - DNA, 22 bp, Homo sapiens
tcatttctcccggccaaaaact

SEQ ID NO: 6932257 - DNA, 22 bp, Homo sapiens
ttacagggaaccaatccagtgt

SEQ ID NO: 6932258 - DNA, 22 bp, Homo sapiens
tcccagaatggcccagctgccc

SEQ ID NO: 6932259 - DNA, 22 bp, Homo sapiens
agagactgcaatgagtggtagg

SEQ ID NO: 6932260 - DNA, 22 bp, Homo sapiens
ggcatagaaaatgtgccctctg

SEQ ID NO: 6932261 - DNA, 22 bp, Homo sapiens
gctggccagtgtcccagggatc

SEQ ID NO: 6932262 - DNA, 22 bp, Homo sapiens
gaggaacagagggcaaggccag

SEQ ID NO: 6932263 - DNA, 22 bp, Homo sapiens
aaggtggcgctggagctggtcc

SEQ ID NO: 6932264 - DNA, 22 bp, Homo sapiens
accttgatgcctttccaagatg

SEQ ID NO: 6932265 - DNA, 22 bp, Homo sapiens
gatgaattctggcttggacaga

SEQ ID NO: 6932266 - DNA, 22 bp, Homo sapiens
aacactaaaggtcagttagaag

SEQ ID NO: 6932267 - DNA, 22 bp, Homo sapiens
tttggggaaccactgaggtagg

SEQ ID NO: 6932268 - DNA, 22 bp, Homo sapiens
gaagatgtgcaatacaaagaaa

SEQ ID NO: 6932269 - DNA, 22 bp, Homo sapiens
aaaggttaaggtgttcaagaaa

SEQ ID NO: 6932270 - DNA, 22 bp, Homo sapiens
tctattactacatcagccaggt

SEQ ID NO: 6932271 - DNA, 22 bp, Homo sapiens
gcagtgttcagtgaagcaggag

SEQ ID NO: 6932272 - DNA, 22 bp, Homo sapiens
tctcataaactcagttttctca

SEQ ID NO: 6932273 - DNA, 18 bp, Homo sapiens
tccaaagctgctggtttt

SEQ ID NO: 6932274 - DNA, 22 bp, Homo sapiens
catgaatatttagtatttactt

SEQ ID NO: 6932275 - DNA, 22 bp, Homo sapiens
tgagctggtcactccttctgaa

SEQ ID NO: 6932276 - DNA, 22 bp, Homo sapiens
ttactttgtttgcacttcacct

SEQ ID NO: 6932277 - DNA, 22 bp, Homo sapiens
cagtcccagtttgagactctgg

SEQ ID NO: 6932278 - DNA, 22 bp, Homo sapiens
tgatctgaaggacatgggaccc

SEQ ID NO: 6932279 - DNA, 22 bp, Homo sapiens
tcactcagcattcactgggcct

SEQ ID NO: 6932280 - DNA, 22 bp, Homo sapiens
tcctgagccctggggtcagtgt

SEQ ID NO: 6932281 - DNA, 22 bp, Homo sapiens
cagggctcttcatcacacagta

SEQ ID NO: 6932282 - DNA, 16 bp, Homo sapiens
aagcattggaattagg

SEQ ID NO: 6932283 - DNA, 22 bp, Homo sapiens
ttacagtattgttaaactcttt

SEQ ID NO: 6932284 - DNA, 22 bp, Homo sapiens
atcttatgttgtattcaaaatc

SEQ ID NO: 6932285 - DNA, 22 bp, Homo sapiens
ccctcagcttctccctgcagct

SEQ ID NO: 6932286 - DNA, 22 bp, Homo sapiens
ccagtgcgcaggcgccacctgt

SEQ ID NO: 6932287 - DNA, 23 bp, Homo sapiens
aatttggtatatctgaaccactg

SEQ ID NO: 6932288 - DNA, 21 bp, Homo sapiens
tggaactggtgaaaacctcct

SEQ ID NO: 6932289 - DNA, 22 bp, Homo sapiens
tcacagtgttaaacctttcttt

SEQ ID NO: 6932290 - DNA, 22 bp, Homo sapiens
ggtgtccatcaggctgtgcttc

SEQ ID NO: 6932291 - DNA, 20 bp, Homo sapiens
ttggtcagtggttcagtttg

SEQ ID NO: 6932292 - DNA, 22 bp, Homo sapiens
gcccacagtgtagcaggtactc

SEQ ID NO: 6932293 - DNA, 20 bp, Homo sapiens
gtgccctgtgggctattttc

SEQ ID NO: 6932294 - DNA, 22 bp, Homo sapiens
aatattcaagttattctttctt

SEQ ID NO: 6932295 - DNA, 22 bp, Homo sapiens
tggatgagggctgagcactggg

SEQ ID NO: 6932296 - DNA, 22 bp, Homo sapiens
ctttacaaatagggagggagtg

SEQ ID NO: 6932297 - DNA, 22 bp, Homo sapiens
atctgtcttgccttgcatattt

SEQ ID NO: 6932298 - DNA, 22 bp, Homo sapiens
atggttttagaatcaggaaaaa

SEQ ID NO: 6932299 - DNA, 22 bp, Homo sapiens
gctctctttccatgtggaggat

SEQ ID NO: 6932300 - DNA, 22 bp, Homo sapiens
cttgttttgaaagcagtggcca

SEQ ID NO: 6932301 - DNA, 22 bp, Homo sapiens
ccagggctgcctggccgtgtgt

SEQ ID NO: 6932302 - DNA, 22 bp, Homo sapiens
gcacactcctggatcctagaga

SEQ ID NO: 6932303 - DNA, 22 bp, Homo sapiens
ctgggcctcatccagccacaac

SEQ ID NO: 6932304 - DNA, 22 bp, Homo sapiens
ttgcattccagtccccactgtg

SEQ ID NO: 6932305 - DNA, 22 bp, Homo sapiens
tagccgggtgtggtggaactcc

SEQ ID NO: 6932306 - DNA, 22 bp, Homo sapiens
tgacagacacaccttaggaaag

SEQ ID NO: 6932307 - DNA, 19 bp, Homo sapiens
gccagcacatgtcttctag

SEQ ID NO: 6932308 - DNA, 22 bp, Homo sapiens
cctgtcacatatttgctgttca

SEQ ID NO: 6932309 - DNA, 22 bp, Homo sapiens
atgtaaagtatctgaaatgctg

SEQ ID NO: 6932310 - DNA, 22 bp, Homo sapiens
gctgaagtgcttttgaatttgg

SEQ ID NO: 6932311 - DNA, 22 bp, Homo sapiens
tcaatacagaaaggatattttg

SEQ ID NO: 6932312 - DNA, 22 bp, Homo sapiens
gcctcctgttatgccatgtgcc

SEQ ID NO: 6932313 - DNA, 22 bp, Homo sapiens
gctcagggcgcgagggacgtgg

SEQ ID NO: 6932314 - DNA, 23 bp, Homo sapiens
tggggctctggcaggcctgaggt

SEQ ID NO: 6932315 - DNA, 22 bp, Homo sapiens
gacccagcttaagtcacatgtt

SEQ ID NO: 6932316 - DNA, 22 bp, Homo sapiens
tatcttggtgggcttaatataa

SEQ ID NO: 6932317 - DNA, 18 bp, Homo sapiens
aatactggtttattatga

SEQ ID NO: 6932318 - DNA, 22 bp, Homo sapiens
tggtctaaatatggctctaaat

SEQ ID NO: 6932319 - DNA, 22 bp, Homo sapiens
cagttacataaatgataaaatg

SEQ ID NO: 6932320 - DNA, 22 bp, Homo sapiens
aactgtttcagaaatattgttg

SEQ ID NO: 6932321 - DNA, 22 bp, Homo sapiens
aatctagattcggatcaaaggg

SEQ ID NO: 6932322 - DNA, 22 bp, Homo sapiens
aagatttactttctttgtaata

SEQ ID NO: 6932323 - DNA, 22 bp, Homo sapiens
caacagttcctccatcctctct

SEQ ID NO: 6932324 - DNA, 22 bp, Homo sapiens
agacccagagggctgctgggag

SEQ ID NO: 6932325 - DNA, 22 bp, Homo sapiens
tgtaaagtatctgtgagctctc

SEQ ID NO: 6932326 - DNA, 22 bp, Homo sapiens
attcagaaactctgggcagaac

SEQ ID NO: 6932327 - DNA, 22 bp, Homo sapiens
atgacttaatcatacttgcatt

SEQ ID NO: 6932328 - DNA, 22 bp, Homo sapiens
tcctgggtcccgcacatctgtc

SEQ ID NO: 6932329 - DNA, 22 bp, Homo sapiens
gtgattcataaaacactagatg

SEQ ID NO: 6932330 - DNA, 22 bp, Homo sapiens
ctctttggggtgccccactggt

SEQ ID NO: 6932331 - DNA, 22 bp, Homo sapiens
aggctcagaggtgagcatctgc

SEQ ID NO: 6932332 - DNA, 22 bp, Homo sapiens
atgggaaggttttgagagcggg

SEQ ID NO: 6932333 - DNA, 22 bp, Homo sapiens
ggggtggatttcaggcggtgtc

SEQ ID NO: 6932334 - DNA, 22 bp, Homo sapiens
ggcactgcccaccctcacaggg

SEQ ID NO: 6932335 - DNA, 22 bp, Homo sapiens
ctggttttctagtccactggct

SEQ ID NO: 6932336 - DNA, 22 bp, Homo sapiens
taaggcccgtgagtttcatatc

SEQ ID NO: 6932337 - DNA, 22 bp, Homo sapiens
tctaggagaaccatcagggagg

SEQ ID NO: 6932338 - DNA, 22 bp, Homo sapiens
gcagtcatttaacctctctgtg

SEQ ID NO: 6932339 - DNA, 22 bp, Homo sapiens
aacagtaaagacagaatttatc

SEQ ID NO: 6932340 - DNA, 22 bp, Homo sapiens
tgagcccgtaggggccaaggct

SEQ ID NO: 6932341 - DNA, 22 bp, Homo sapiens
catggggagacacctagggaaa

SEQ ID NO: 6932342 - DNA, 22 bp, Homo sapiens
gcagtgctaaggattctgcctt

SEQ ID NO: 6932343 - DNA, 22 bp, Homo sapiens
aactttttctgggatggagggt

SEQ ID NO: 6932344 - DNA, 22 bp, Homo sapiens
tttcacattcttctgaatctac

SEQ ID NO: 6932345 - DNA, 22 bp, Homo sapiens
tttctaaggtgaggtagaaaat

SEQ ID NO: 6932346 - DNA, 22 bp, Homo sapiens
tggcaagtcttgcaggcagagg

SEQ ID NO: 6932347 - DNA, 19 bp, Homo sapiens
ctgcactgagaaaaggagg

SEQ ID NO: 6932348 - DNA, 22 bp, Homo sapiens
ctttgcagttagcctaggattg

SEQ ID NO: 6932349 - DNA, 22 bp, Homo sapiens
acggtgctgggtattggggttc

SEQ ID NO: 6932350 - DNA, 22 bp, Homo sapiens
acagcacaatctgagtcccaga

SEQ ID NO: 6932351 - DNA, 22 bp, Homo sapiens
tatagatagtcacttgttgcta

SEQ ID NO: 6932352 - DNA, 22 bp, Homo sapiens
tctttagagttaacaataatga

SEQ ID NO: 6932353 - DNA, 22 bp, Homo sapiens
tgggaggccaaggcaggcggat

SEQ ID NO: 6932354 - DNA, 18 bp, Homo sapiens
gggaagaggatctggccc

SEQ ID NO: 6932355 - DNA, 22 bp, Homo sapiens
tgcatctttgcttggctccttc

SEQ ID NO: 6932356 - DNA, 22 bp, Homo sapiens
attgtggtgtcagttataggca

SEQ ID NO: 6932357 - DNA, 22 bp, Homo sapiens
aaaccacctccccagctgctgt

SEQ ID NO: 6932358 - DNA, 22 bp, Homo sapiens
agcatgtaaagctcttagcacc

SEQ ID NO: 6932359 - DNA, 22 bp, Homo sapiens
acatccaccacatgccaggctc

SEQ ID NO: 6932360 - DNA, 22 bp, Homo sapiens
tgcagctgcctagggctggctt

SEQ ID NO: 6932361 - DNA, 22 bp, Homo sapiens
acatttcagattcatgaagtga

SEQ ID NO: 6932362 - DNA, 22 bp, Homo sapiens
catttattggttaggccagcag

SEQ ID NO: 6932363 - DNA, 22 bp, Homo sapiens
taaggctactgtcagcttcagg

SEQ ID NO: 6932364 - DNA, 22 bp, Homo sapiens
gtagcaccagtgctcttctcaa

SEQ ID NO: 6932365 - DNA, 22 bp, Homo sapiens
tctgaggttactgctttgtaga

SEQ ID NO: 6932366 - DNA, 22 bp, Homo sapiens
atatagaaggtgctatttacat

SEQ ID NO: 6932367 - DNA, 18 bp, Homo sapiens
caggcctttgagacagaa

SEQ ID NO: 6932368 - DNA, 20 bp, Homo sapiens
tctagcttagtgcctgcctc

SEQ ID NO: 6932369 - DNA, 22 bp, Homo sapiens
ctgaggtagtcattttctactc

SEQ ID NO: 6932370 - DNA, 22 bp, Homo sapiens
gctctctgggcgggagctaaga

SEQ ID NO: 6932371 - DNA, 22 bp, Homo sapiens
cagtttggtacttttctagcaa

SEQ ID NO: 6932372 - DNA, 22 bp, Homo sapiens
cttgcctgggactgaggcattt

SEQ ID NO: 6932373 - DNA, 22 bp, Homo sapiens
tgactaaaataggacattaact

SEQ ID NO: 6932374 - DNA, 22 bp, Homo sapiens
tcaattcagactgagaaatgat

SEQ ID NO: 6932375 - DNA, 22 bp, Homo sapiens
tttacagacaacttaatagggg

SEQ ID NO: 6932376 - DNA, 22 bp, Homo sapiens
gaagaaacaggggcttggggag

SEQ ID NO: 6932377 - DNA, 23 bp, Homo sapiens
ttctcaggagcccccaggtcagg

SEQ ID NO: 6932378 - DNA, 22 bp, Homo sapiens
gaggtcagtcagaccagggttt

SEQ ID NO: 6932379 - DNA, 22 bp, Homo sapiens
ttacagtagatacaatgagtaa

SEQ ID NO: 6932380 - DNA, 22 bp, Homo sapiens
ttgattctgatgaaagtccatt

SEQ ID NO: 6932381 - DNA, 22 bp, Homo sapiens
tattatgaggggcagagggcat

SEQ ID NO: 6932382 - DNA, 22 bp, Homo sapiens
ttctcccactccgtgcttcagt

SEQ ID NO: 6932383 - DNA, 22 bp, Homo sapiens
gggacagagcaacttgggatgg

SEQ ID NO: 6932384 - DNA, 22 bp, Homo sapiens
ccaaatcaccagcacgatcatt

SEQ ID NO: 6932385 - DNA, 22 bp, Homo sapiens
agacacagaagttgctgttggg

SEQ ID NO: 6932386 - DNA, 22 bp, Homo sapiens
cttatggctgtagtctggaagt

SEQ ID NO: 6932387 - DNA, 22 bp, Homo sapiens
gcaaggtatgtagtattaactc

SEQ ID NO: 6932388 - DNA, 22 bp, Homo sapiens
tacacatctggagaagccctgt

SEQ ID NO: 6932389 - DNA, 22 bp, Homo sapiens
tgagtttagtgtgagacttatc

SEQ ID NO: 6932390 - DNA, 22 bp, Homo sapiens
actagcaagttttgtgtctgga

SEQ ID NO: 6932391 - DNA, 22 bp, Homo sapiens
tgtctgggggttctgaaagctg

SEQ ID NO: 6932392 - DNA, 22 bp, Homo sapiens
tttcccagcctcctttgcagct

SEQ ID NO: 6932393 - DNA, 22 bp, Homo sapiens
atgggatcttgccctgagggct

SEQ ID NO: 6932394 - DNA, 22 bp, Homo sapiens
ggcaacctgagcttgtggagaa

SEQ ID NO: 6932395 - DNA, 22 bp, Homo sapiens
aaggagagtacaggagttggta

SEQ ID NO: 6932396 - DNA, 22 bp, Homo sapiens
cagagggctcttggctgcctgc

SEQ ID NO: 6932397 - DNA, 22 bp, Homo sapiens
gagttttaatgagctgctgtgg

SEQ ID NO: 6932398 - DNA, 22 bp, Homo sapiens
cctgagctgcggggcagtgctc

SEQ ID NO: 6932399 - DNA, 22 bp, Homo sapiens
gagaatctcaggcacccagaag

SEQ ID NO: 6932400 - DNA, 22 bp, Homo sapiens
aagttctactgtgggtaaaatg

SEQ ID NO: 6932401 - DNA, 20 bp, Homo sapiens
gtatccccgcgtggggaagg

SEQ ID NO: 6932402 - DNA, 22 bp, Homo sapiens
tggctgcagatcaagggcaggc

SEQ ID NO: 6932403 - DNA, 17 bp, Homo sapiens
ttacatccttctgaatt

SEQ ID NO: 6932404 - DNA, 22 bp, Homo sapiens
agtgcaatagcaaagaacaaca

SEQ ID NO: 6932405 - DNA, 22 bp, Homo sapiens
aggacaggattccttgccttgc

SEQ ID NO: 6932406 - DNA, 22 bp, Homo sapiens
ggacagattgagctaggcgttt

SEQ ID NO: 6932407 - DNA, 22 bp, Homo sapiens
tagttattgcctaggagcagct

SEQ ID NO: 6932408 - DNA, 22 bp, Homo sapiens
ttgtgtttcccttgcatattcc

SEQ ID NO: 6932409 - DNA, 22 bp, Homo sapiens
agtgtcttactccctcaggcac

SEQ ID NO: 6932410 - DNA, 22 bp, Homo sapiens
gaggccaatcaatagggcaata

SEQ ID NO: 6932411 - DNA, 22 bp, Homo sapiens
agcatggcattattggaaggac

SEQ ID NO: 6932412 - DNA, 22 bp, Homo sapiens
tcattgcaagctcatttatctg

SEQ ID NO: 6932413 - DNA, 22 bp, Homo sapiens
acagtggagaaggcatgaggct

SEQ ID NO: 6932414 - DNA, 21 bp, Homo sapiens
ttgatggtgggtgatgctctg

SEQ ID NO: 6932415 - DNA, 22 bp, Homo sapiens
ggctctggtgggaaggttagat

SEQ ID NO: 6932416 - DNA, 22 bp, Homo sapiens
tgtcacagtgcacagctaagaa

SEQ ID NO: 6932417 - DNA, 22 bp, Homo sapiens
agcttctgcccgtgtttgctct

SEQ ID NO: 6932418 - DNA, 22 bp, Homo sapiens
actgagttatgggtatgccttg

SEQ ID NO: 6932419 - DNA, 22 bp, Homo sapiens
aaagtcagttggccagatcact

SEQ ID NO: 6932420 - DNA, 22 bp, Homo sapiens
agtccataggcagttcataaca

SEQ ID NO: 6932421 - DNA, 22 bp, Homo sapiens
gaatctgggtgactggttcttt

SEQ ID NO: 6932422 - DNA, 22 bp, Homo sapiens
atgaacaagagagggaagattc

SEQ ID NO: 6932423 - DNA, 22 bp, Homo sapiens
cggggttcatccatgctgtggc

SEQ ID NO: 6932424 - DNA, 22 bp, Homo sapiens
gctggcccagcgcccagggcag

SEQ ID NO: 6932425 - DNA, 22 bp, Homo sapiens
tcctggttcctaccttcagctg

SEQ ID NO: 6932426 - DNA, 22 bp, Homo sapiens
atgtaacaggtgaagctctgag

SEQ ID NO: 6932427 - DNA, 22 bp, Homo sapiens
ccaggtggtgcctctgttcgca

SEQ ID NO: 6932428 - DNA, 22 bp, Homo sapiens
aggatacagcgtttttcccaca

SEQ ID NO: 6932429 - DNA, 22 bp, Homo sapiens
tagatacttataatcttccaag

SEQ ID NO: 6932430 - DNA, 22 bp, Homo sapiens
aaggactggcattatcttatgt

SEQ ID NO: 6932431 - DNA, 22 bp, Homo sapiens
tgaggcagggagagtggatatg

SEQ ID NO: 6932432 - DNA, 22 bp, Homo sapiens
caggaagattagaccaagagct

SEQ ID NO: 6932433 - DNA, 22 bp, Homo sapiens
tcttatttagagaggactagag

SEQ ID NO: 6932434 - DNA, 22 bp, Homo sapiens
gtggctctaggtgagcatggag

SEQ ID NO: 6932435 - DNA, 22 bp, Homo sapiens
gctacagatttatcatgttata

SEQ ID NO: 6932436 - DNA, 22 bp, Homo sapiens
tgtgggaagtttggagggaaag

SEQ ID NO: 6932437 - DNA, 22 bp, Homo sapiens
gtattcagggctagtcagagga

SEQ ID NO: 6932438 - DNA, 22 bp, Homo sapiens
ccattgtgcacctccagggctg

SEQ ID NO: 6932439 - DNA, 22 bp, Homo sapiens
agcctgagctgcctgccgcctc

SEQ ID NO: 6932440 - DNA, 22 bp, Homo sapiens
tgctgccttagcagccaggcaa

SEQ ID NO: 6932441 - DNA, 22 bp, Homo sapiens
tggagcagaggctgaggttggg

SEQ ID NO: 6932442 - DNA, 22 bp, Homo sapiens
atctcacagaggcccaccagga

SEQ ID NO: 6932443 - DNA, 22 bp, Homo sapiens
tgtgggagaaggaagcaagctg

SEQ ID NO: 6932444 - DNA, 22 bp, Homo sapiens
gctgatggaaggacaggcgccg

SEQ ID NO: 6932445 - DNA, 22 bp, Homo sapiens
tgagagccagaagggcctgagg

SEQ ID NO: 6932446 - DNA, 22 bp, Homo sapiens
caggctgaggcagtagggtttg

SEQ ID NO: 6932447 - DNA, 22 bp, Homo sapiens
tgggacaccctcacgcctgcac

SEQ ID NO: 6932448 - DNA, 22 bp, Homo sapiens
gctgccatcagagttcaggaat

SEQ ID NO: 6932449 - DNA, 22 bp, Homo sapiens
catcaatgtgcagagatgaacg

SEQ ID NO: 6932450 - DNA, 22 bp, Homo sapiens
acttgtttcaactgtactctca

SEQ ID NO: 6932451 - DNA, 18 bp, Homo sapiens
agtgccagctctgctttc

SEQ ID NO: 6932452 - DNA, 23 bp, Homo sapiens
gcctcagagaaacagctgcacac

SEQ ID NO: 6932453 - DNA, 18 bp, Homo sapiens
ccaggacaggcaaaaggt

SEQ ID NO: 6932454 - DNA, 22 bp, Homo sapiens
gttcattttactgtaaatagca

SEQ ID NO: 6932455 - DNA, 22 bp, Homo sapiens
agcagcttggttttaggcatgg

SEQ ID NO: 6932456 - DNA, 22 bp, Homo sapiens
actctgacatttaaaaagcaat

SEQ ID NO: 6932457 - DNA, 22 bp, Homo sapiens
ttaaggaagaattgcaatggca

SEQ ID NO: 6932458 - DNA, 17 bp, Homo sapiens
tctgggtttaaatccca

SEQ ID NO: 6932459 - DNA, 22 bp, Homo sapiens
attccacagctacatcaatcta

SEQ ID NO: 6932460 - DNA, 22 bp, Homo sapiens
cttcacagagtccctgattgtt

SEQ ID NO: 6932461 - DNA, 22 bp, Homo sapiens
atcaatgacagttgaattctac

SEQ ID NO: 6932462 - DNA, 22 bp, Homo sapiens
ataaattctctgatgtatagta

SEQ ID NO: 6932463 - DNA, 22 bp, Homo sapiens
tcacccagggactgtgatggaa

SEQ ID NO: 6932464 - DNA, 22 bp, Homo sapiens
ctgtcagcactctactacagat

SEQ ID NO: 6932465 - DNA, 22 bp, Homo sapiens
agaggttgttagaatagtggag

SEQ ID NO: 6932466 - DNA, 22 bp, Homo sapiens
aactctttctgaggattgggag

SEQ ID NO: 6932467 - DNA, 21 bp, Homo sapiens
tttagttcaagtacagaacca

SEQ ID NO: 6932468 - DNA, 22 bp, Homo sapiens
ttgggtgctgtcatggggcacg

SEQ ID NO: 6932469 - DNA, 22 bp, Homo sapiens
tgtggctccactccacattaat

SEQ ID NO: 6932470 - DNA, 22 bp, Homo sapiens
ctgttgattagaatttcacatc

SEQ ID NO: 6932471 - DNA, 22 bp, Homo sapiens
gctgggacaacaggtgagcacc

SEQ ID NO: 6932472 - DNA, 22 bp, Homo sapiens
agtcctgttggttccagaggtg

SEQ ID NO: 6932473 - DNA, 22 bp, Homo sapiens
gaaaccagcatttaaaccagga

SEQ ID NO: 6932474 - DNA, 22 bp, Homo sapiens
agctttctagatttggaattgt

SEQ ID NO: 6932475 - DNA, 22 bp, Homo sapiens
acacatgataagaaagtttaaa

SEQ ID NO: 6932476 - DNA, 21 bp, Homo sapiens
ttctgccttcgaggtctcagg

SEQ ID NO: 6932477 - DNA, 21 bp, Homo sapiens
cacacagtggagtgcccttgc

SEQ ID NO: 6932478 - DNA, 22 bp, Homo sapiens
tctgtttatgtgtctaaataaa

SEQ ID NO: 6932479 - DNA, 22 bp, Homo sapiens
agggcccagcagcatttcagtg

SEQ ID NO: 6932480 - DNA, 20 bp, Homo sapiens
tttctgtaaggcattaatct

SEQ ID NO: 6932481 - DNA, 22 bp, Homo sapiens
atgggctgcttggcttccaccc

SEQ ID NO: 6932482 - DNA, 22 bp, Homo sapiens
tgattaaattaattaagatgag

SEQ ID NO: 6932483 - DNA, 22 bp, Homo sapiens
tttctaagaatattgctcttaa

SEQ ID NO: 6932484 - DNA, 22 bp, Homo sapiens
ggagatggccaaaaacacaaat

SEQ ID NO: 6932485 - DNA, 22 bp, Homo sapiens
ctggattaagtaaaatagagga

SEQ ID NO: 6932486 - DNA, 22 bp, Homo sapiens
cccagagccggtggtgctcaca

SEQ ID NO: 6932487 - DNA, 22 bp, Homo sapiens
cagagccctagtcctgatggcc

SEQ ID NO: 6932488 - DNA, 22 bp, Homo sapiens
cacacctgcctgccgtgtgctg

SEQ ID NO: 6932489 - DNA, 20 bp, Homo sapiens
gcctgtggaggaggacggac

SEQ ID NO: 6932490 - DNA, 22 bp, Homo sapiens
tggacagtattgtgaagcaggc

SEQ ID NO: 6932491 - DNA, 23 bp, Homo sapiens
ctgtgctcagagggagggagagc

SEQ ID NO: 6932492 - DNA, 18 bp, Homo sapiens
gaaagatgaacttttttc

SEQ ID NO: 6932493 - DNA, 22 bp, Homo sapiens
tccagtggcaggcggtgaggtc

SEQ ID NO: 6932494 - DNA, 22 bp, Homo sapiens
aagctgtgcctttgcctagaat

SEQ ID NO: 6932495 - DNA, 22 bp, Homo sapiens
tggctatgacttcgtactgtct

SEQ ID NO: 6932496 - DNA, 21 bp, Homo sapiens
ttcaaagacttgatgctgacc

SEQ ID NO: 6932497 - DNA, 21 bp, Homo sapiens
ttagccattgggacattcagc

SEQ ID NO: 6932498 - DNA, 22 bp, Homo sapiens
taagaatgactaccaaactgga

SEQ ID NO: 6932499 - DNA, 22 bp, Homo sapiens
gtttgcatgtgtacttaattgg

SEQ ID NO: 6932500 - DNA, 22 bp, Homo sapiens
caggcccaaatgcaaccttctt

SEQ ID NO: 6932501 - DNA, 22 bp, Homo sapiens
ccgtgtgtatggtggaactgct

SEQ ID NO: 6932502 - DNA, 22 bp, Homo sapiens
ggaacccagagctcataaaatt

SEQ ID NO: 6932503 - DNA, 22 bp, Homo sapiens
aggtttggtttgacaagactga

SEQ ID NO: 6932504 - DNA, 22 bp, Homo sapiens
gacccaggggtccatttctcct

SEQ ID NO: 6932505 - DNA, 22 bp, Homo sapiens
gcagcaggcacggtctcgacat

SEQ ID NO: 6932506 - DNA, 22 bp, Homo sapiens
agtttccatcccacacttgctt

SEQ ID NO: 6932507 - DNA, 22 bp, Homo sapiens
cctacatatctaagacaagcca

SEQ ID NO: 6932508 - DNA, 22 bp, Homo sapiens
gtgctacatggtagtgtagtta

SEQ ID NO: 6932509 - DNA, 22 bp, Homo sapiens
tgcacttgtgttttcagaatct

SEQ ID NO: 6932510 - DNA, 22 bp, Homo sapiens
gtggtagcatgtctggcttttt

SEQ ID NO: 6932511 - DNA, 22 bp, Homo sapiens
ttctccaggccgcgcagggggc

SEQ ID NO: 6932512 - DNA, 22 bp, Homo sapiens
gcttccagtaagttgctgccat

SEQ ID NO: 6932513 - DNA, 22 bp, Homo sapiens
tagatcatttgaattgaggtag

SEQ ID NO: 6932514 - DNA, 22 bp, Homo sapiens
attaaatgttggacgtatacat

SEQ ID NO: 6932515 - DNA, 22 bp, Homo sapiens
atgtttctcactgtttctctat

SEQ ID NO: 6932516 - DNA, 22 bp, Homo sapiens
tctttggctttgccacacccaa

SEQ ID NO: 6932517 - DNA, 21 bp, Homo sapiens
cacaccaaacaggaacaggga

SEQ ID NO: 6932518 - DNA, 22 bp, Homo sapiens
ttggcttggagagttgaaatgt

SEQ ID NO: 6932519 - DNA, 23 bp, Homo sapiens
ttcttctaaggagggccaccatt

SEQ ID NO: 6932520 - DNA, 17 bp, Homo sapiens
gtgaagagtcattgaat

SEQ ID NO: 6932521 - DNA, 22 bp, Homo sapiens
aaagcttttgttttcgtaactg

SEQ ID NO: 6932522 - DNA, 22 bp, Homo sapiens
aggatttattggtgggaagtta

SEQ ID NO: 6932523 - DNA, 22 bp, Homo sapiens
agagtccaggtgggctggaggc

SEQ ID NO: 6932524 - DNA, 22 bp, Homo sapiens
catcagtcccacggagcagccc

SEQ ID NO: 6932525 - DNA, 22 bp, Homo sapiens
ggaaacagctctttggggctgt

SEQ ID NO: 6932526 - DNA, 17 bp, Homo sapiens
tagtcaagtttacatgt

SEQ ID NO: 6932527 - DNA, 22 bp, Homo sapiens
tgctcacattaggcatccatgg

SEQ ID NO: 6932528 - DNA, 22 bp, Homo sapiens
cccagggtgctaattaaatatg

SEQ ID NO: 6932529 - DNA, 22 bp, Homo sapiens
tttggaattggtggaggaaggg

SEQ ID NO: 6932530 - DNA, 22 bp, Homo sapiens
tttagacacactttgtatattt

SEQ ID NO: 6932531 - DNA, 22 bp, Homo sapiens
gagtcttctacgctcacacaaa

SEQ ID NO: 6932532 - DNA, 22 bp, Homo sapiens
tttttgttcccagagaatttgt

SEQ ID NO: 6932533 - DNA, 22 bp, Homo sapiens
catccatagcctcaataaatag

SEQ ID NO: 6932534 - DNA, 22 bp, Homo sapiens
tctgggccctgagatgttcttc

SEQ ID NO: 6932535 - DNA, 22 bp, Homo sapiens
agccctgcacaggtctgtggct

SEQ ID NO: 6932536 - DNA, 23 bp, Homo sapiens
tggatatttcagagatacttcag

SEQ ID NO: 6932537 - DNA, 22 bp, Homo sapiens
gtgaccatcctggtaatgaatc

SEQ ID NO: 6932538 - DNA, 22 bp, Homo sapiens
atggtaaaagatatactgtgca

SEQ ID NO: 6932539 - DNA, 22 bp, Homo sapiens
aatattgtttcaagatcacaga

SEQ ID NO: 6932540 - DNA, 22 bp, Homo sapiens
ttggcataaaactcttcaaaat

SEQ ID NO: 6932541 - DNA, 19 bp, Homo sapiens
agtcctggcctgggggacc

SEQ ID NO: 6932542 - DNA, 20 bp, Homo sapiens
agcatagagcaccagaaggc

SEQ ID NO: 6932543 - DNA, 22 bp, Homo sapiens
tgcagaggagtcagcctgggca

SEQ ID NO: 6932544 - DNA, 19 bp, Homo sapiens
tatcactgggcactgagga

SEQ ID NO: 6932545 - DNA, 14 bp, Homo sapiens
acactgtgtttaga

SEQ ID NO: 6932546 - DNA, 22 bp, Homo sapiens
tcttcacattttaagaagttct

SEQ ID NO: 6932547 - DNA, 22 bp, Homo sapiens
ttctcttagctgtaaagtcaat

SEQ ID NO: 6932548 - DNA, 22 bp, Homo sapiens
atgaaacagagtacttaatata

SEQ ID NO: 6932549 - DNA, 22 bp, Homo sapiens
gcccacaggtcctacctctttc

SEQ ID NO: 6932550 - DNA, 19 bp, Homo sapiens
taccaatcccttggtttac

SEQ ID NO: 6932551 - DNA, 22 bp, Homo sapiens
gaatgcagatggctggtgtatg

SEQ ID NO: 6932552 - DNA, 22 bp, Homo sapiens
cttgaggctgcactccagggcc

SEQ ID NO: 6932553 - DNA, 18 bp, Homo sapiens
tcagtcagtcctgtgaag

SEQ ID NO: 6932554 - DNA, 22 bp, Homo sapiens
atcacctggaggtgatcacttg

SEQ ID NO: 6932555 - DNA, 22 bp, Homo sapiens
ctccagtctctttcggagacac

SEQ ID NO: 6932556 - DNA, 22 bp, Homo sapiens
ctaccagaattttggatcaact

SEQ ID NO: 6932557 - DNA, 22 bp, Homo sapiens
ctgtgtttctgagaagtgggga

SEQ ID NO: 6932558 - DNA, 22 bp, Homo sapiens
aagatgcttgcaaatttctgaa

SEQ ID NO: 6932559 - DNA, 22 bp, Homo sapiens
tctcacagcatcattgctcatg

SEQ ID NO: 6932560 - DNA, 22 bp, Homo sapiens
tagtctctgttcccacaatgcc

SEQ ID NO: 6932561 - DNA, 22 bp, Homo sapiens
atgtttccaggttcttcctatg

SEQ ID NO: 6932562 - DNA, 22 bp, Homo sapiens
gctgagggtctgttcatgttgc

SEQ ID NO: 6932563 - DNA, 22 bp, Homo sapiens
ttgttttggagatgagctaaaa

SEQ ID NO: 6932564 - DNA, 22 bp, Homo sapiens
ggaagccataccctgatttctg

SEQ ID NO: 6932565 - DNA, 22 bp, Homo sapiens
gaattgaattcatttactcaaa

SEQ ID NO: 6932566 - DNA, 22 bp, Homo sapiens
ggtagggaaggtctcccacatt

SEQ ID NO: 6932567 - DNA, 22 bp, Homo sapiens
cagtctctgccacttctaagct

SEQ ID NO: 6932568 - DNA, 22 bp, Homo sapiens
catgtgttgtctcatttaatcc

SEQ ID NO: 6932569 - DNA, 22 bp, Homo sapiens
ccttccaggctggaggcttggg

SEQ ID NO: 6932570 - DNA, 22 bp, Homo sapiens
aggagcctgtgcctggcactcc

SEQ ID NO: 6932571 - DNA, 22 bp, Homo sapiens
acacaaacagtctatagcacca

SEQ ID NO: 6932572 - DNA, 22 bp, Homo sapiens
gctcagctgggaccaatgtgtt

SEQ ID NO: 6932573 - DNA, 22 bp, Homo sapiens
ttgttttaatgagggaggttga

SEQ ID NO: 6932574 - DNA, 22 bp, Homo sapiens
tcccagagctgataagccttta

SEQ ID NO: 6932575 - DNA, 22 bp, Homo sapiens
aactgaaaccaaacactttagg

SEQ ID NO: 6932576 - DNA, 22 bp, Homo sapiens
gggcgctgggtgtcgagactca

SEQ ID NO: 6932577 - DNA, 22 bp, Homo sapiens
tggacagagaggaaggccattt

SEQ ID NO: 6932578 - DNA, 22 bp, Homo sapiens
atccttgagccttatcttttgt

SEQ ID NO: 6932579 - DNA, 22 bp, Homo sapiens
tcacagtacatgattcagtggt

SEQ ID NO: 6932580 - DNA, 21 bp, Homo sapiens
agccatcctgaatggtgccat

SEQ ID NO: 6932581 - DNA, 22 bp, Homo sapiens
ttgtgaatagtgccgcaatgaa

SEQ ID NO: 6932582 - DNA, 22 bp, Homo sapiens
ggccaaatttggccatgagcat

SEQ ID NO: 6932583 - DNA, 22 bp, Homo sapiens
ctgtgccaggcccagctgactt

SEQ ID NO: 6932584 - DNA, 22 bp, Homo sapiens
gtaatgctacaggagtctacat

SEQ ID NO: 6932585 - DNA, 22 bp, Homo sapiens
tgtgttgttagtaccagcagtc

SEQ ID NO: 6932586 - DNA, 22 bp, Homo sapiens
ttggattcgtgcaaaagtaata

SEQ ID NO: 6932587 - DNA, 22 bp, Homo sapiens
ggcagcaagtaggattcttatt

SEQ ID NO: 6932588 - DNA, 22 bp, Homo sapiens
ctatttcatgttcctatggccg

SEQ ID NO: 6932589 - DNA, 22 bp, Homo sapiens
ggcttcatggaggaggtgagtc

SEQ ID NO: 6932590 - DNA, 22 bp, Homo sapiens
tttcattgtgatgcttttatca

SEQ ID NO: 6932591 - DNA, 22 bp, Homo sapiens
ctgctctaggtcatgggtactt

SEQ ID NO: 6932592 - DNA, 22 bp, Homo sapiens
atattgggagctgagatctatt

SEQ ID NO: 6932593 - DNA, 22 bp, Homo sapiens
taagtgtccctattgtgatttt

SEQ ID NO: 6932594 - DNA, 22 bp, Homo sapiens
cctccaagctggtcctctgtgt

SEQ ID NO: 6932595 - DNA, 22 bp, Homo sapiens
tgaaagcagtgatttctccttc

SEQ ID NO: 6932596 - DNA, 21 bp, Homo sapiens
tgcacctgttcactgcagttc

SEQ ID NO: 6932597 - DNA, 19 bp, Homo sapiens
ctgaggcccatgtaccatg

SEQ ID NO: 6932598 - DNA, 22 bp, Homo sapiens
aaagtcatgcagttgaactttt

SEQ ID NO: 6932599 - DNA, 22 bp, Homo sapiens
agcccaggaagttgaggcttgc

SEQ ID NO: 6932600 - DNA, 22 bp, Homo sapiens
tcagctatctgagaataaccct

SEQ ID NO: 6932601 - DNA, 22 bp, Homo sapiens
catcagaagatggctctggaaa

SEQ ID NO: 6932602 - DNA, 22 bp, Homo sapiens
cttagaattttgcctactacaa

SEQ ID NO: 6932603 - DNA, 22 bp, Homo sapiens
tctgagagtacgggctgcgcgc

SEQ ID NO: 6932604 - DNA, 22 bp, Homo sapiens
taacaaggtggtcttggtattt

SEQ ID NO: 6932605 - DNA, 22 bp, Homo sapiens
tttggatatgtttctgtcttct

SEQ ID NO: 6932606 - DNA, 22 bp, Homo sapiens
tacctgattttattaccagttt

SEQ ID NO: 6932607 - DNA, 22 bp, Homo sapiens
ttccttcttgtaatgatctgcc

SEQ ID NO: 6932608 - DNA, 18 bp, Homo sapiens
atgcagcaatcagaaata

SEQ ID NO: 6932609 - DNA, 22 bp, Homo sapiens
cctctcttggccgcagtcttct

SEQ ID NO: 6932610 - DNA, 22 bp, Homo sapiens
ttgagaaaagctgtgtaaggat

SEQ ID NO: 6932611 - DNA, 22 bp, Homo sapiens
ggggtgtcagcaccagcccctg

SEQ ID NO: 6932612 - DNA, 22 bp, Homo sapiens
cttgcttgccatgggcttgggc

SEQ ID NO: 6932613 - DNA, 22 bp, Homo sapiens
cttggaaggacgggctgtatct

SEQ ID NO: 6932614 - DNA, 22 bp, Homo sapiens
taggaatgagaaagaattagat

SEQ ID NO: 6932615 - DNA, 22 bp, Homo sapiens
ctacttcttgatctgtcgacct

SEQ ID NO: 6932616 - DNA, 22 bp, Homo sapiens
tcaaattcagtgtgacaacatt

SEQ ID NO: 6932617 - DNA, 22 bp, Homo sapiens
tgccagctccgaggagctgcag

SEQ ID NO: 6932618 - DNA, 22 bp, Homo sapiens
acaaagtctgaaacctgaggca

SEQ ID NO: 6932619 - DNA, 22 bp, Homo sapiens
caggtggtcaggcaaggacacg

SEQ ID NO: 6932620 - DNA, 22 bp, Homo sapiens
tcatgccacttacaaaataatg

SEQ ID NO: 6932621 - DNA, 23 bp, Homo sapiens
ttcaaaactggaaaatcagatgc

SEQ ID NO: 6932622 - DNA, 22 bp, Homo sapiens
attccctttgacgatccctagg

SEQ ID NO: 6932623 - DNA, 23 bp, Homo sapiens
agtttccacccagggtagaaggg

SEQ ID NO: 6932624 - DNA, 22 bp, Homo sapiens
tcctggaggaataagttttcca

SEQ ID NO: 6932625 - DNA, 22 bp, Homo sapiens
ctgcaggtctctgtgtgcattc

SEQ ID NO: 6932626 - DNA, 22 bp, Homo sapiens
ccagggctgctgtgggactcca

SEQ ID NO: 6932627 - DNA, 22 bp, Homo sapiens
aaaggcataggatgtggaatcg

SEQ ID NO: 6932628 - DNA, 22 bp, Homo sapiens
cagggcacagttatggaggtgg

SEQ ID NO: 6932629 - DNA, 22 bp, Homo sapiens
ttctgggtaacaaggcaagaat

SEQ ID NO: 6932630 - DNA, 22 bp, Homo sapiens
ctctgccaccatgcttcctgac

SEQ ID NO: 6932631 - DNA, 22 bp, Homo sapiens
aatgcagaccagtatgaaaaac

SEQ ID NO: 6932632 - DNA, 23 bp, Homo sapiens
tcccatgggctcactgccctgca

SEQ ID NO: 6932633 - DNA, 22 bp, Homo sapiens
tcatctctccccagtgtcttta

SEQ ID NO: 6932634 - DNA, 22 bp, Homo sapiens
aagcagccagccatcatgcccg

SEQ ID NO: 6932635 - DNA, 22 bp, Homo sapiens
gaggcccagtggagggccatgg

SEQ ID NO: 6932636 - DNA, 22 bp, Homo sapiens
ttgaggcagcccttaattggga

SEQ ID NO: 6932637 - DNA, 22 bp, Homo sapiens
tggtccctgaagagagaccttg

SEQ ID NO: 6932638 - DNA, 22 bp, Homo sapiens
cagtcacctgaagacttgacca

SEQ ID NO: 6932639 - DNA, 22 bp, Homo sapiens
gctgggctcaccaggccactag

SEQ ID NO: 6932640 - DNA, 22 bp, Homo sapiens
gggctgagtgtcccaggccgaa

SEQ ID NO: 6932641 - DNA, 22 bp, Homo sapiens
tgggccacctgcttttttgcat

SEQ ID NO: 6932642 - DNA, 22 bp, Homo sapiens
aggaatgtggcaatcttcaagt

SEQ ID NO: 6932643 - DNA, 22 bp, Homo sapiens
gcagcctccgcactgcgagtcc

SEQ ID NO: 6932644 - DNA, 22 bp, Homo sapiens
taattggcagagacattggcaa

SEQ ID NO: 6932645 - DNA, 22 bp, Homo sapiens
gagaggctgtgtgccattgttg

SEQ ID NO: 6932646 - DNA, 18 bp, Homo sapiens
gtgcatgcatgctctgcc

SEQ ID NO: 6932647 - DNA, 22 bp, Homo sapiens
ccatccctgagtcacaggaggg

SEQ ID NO: 6932648 - DNA, 22 bp, Homo sapiens
tcttcatactcatcacataggt

SEQ ID NO: 6932649 - DNA, 22 bp, Homo sapiens
ctcatggcagagtcacctgtcc

SEQ ID NO: 6932650 - DNA, 22 bp, Homo sapiens
acctttatcgccatcattgtgc

SEQ ID NO: 6932651 - DNA, 22 bp, Homo sapiens
tgcagccaccacctctgctgaa

SEQ ID NO: 6932652 - DNA, 22 bp, Homo sapiens
ctcagtgcttctagcttgatga

SEQ ID NO: 6932653 - DNA, 22 bp, Homo sapiens
tgtccttcttgtcttgcccaaa

SEQ ID NO: 6932654 - DNA, 21 bp, Homo sapiens
tgcagcagaagtctctgtgtc

SEQ ID NO: 6932655 - DNA, 22 bp, Homo sapiens
tgctgaggttgtggagtgcatt

SEQ ID NO: 6932656 - DNA, 22 bp, Homo sapiens
ttttatgttcctctttatgcga

SEQ ID NO: 6932657 - DNA, 22 bp, Homo sapiens
gcagggctgatggcttccctca

SEQ ID NO: 6932658 - DNA, 22 bp, Homo sapiens
gggaggtcctaaaggggaccag

SEQ ID NO: 6932659 - DNA, 22 bp, Homo sapiens
acagaaattcaaactggaattt

SEQ ID NO: 6932660 - DNA, 18 bp, Homo sapiens
tgtcatctgtttaaaacc

SEQ ID NO: 6932661 - DNA, 22 bp, Homo sapiens
ttcacattgtggttcatgtgaa

SEQ ID NO: 6932662 - DNA, 22 bp, Homo sapiens
tacaatgtaattctgattatgt

SEQ ID NO: 6932663 - DNA, 22 bp, Homo sapiens
tttctaatctgattctcctacc

SEQ ID NO: 6932664 - DNA, 22 bp, Homo sapiens
ctatagaaaattgtatcacacg

SEQ ID NO: 6932665 - DNA, 22 bp, Homo sapiens
ttgcccatctcagtgcctcgct

SEQ ID NO: 6932666 - DNA, 22 bp, Homo sapiens
cctgtaagtagtttgcctgagc

SEQ ID NO: 6932667 - DNA, 22 bp, Homo sapiens
gtggagacgggacagaagctaa

SEQ ID NO: 6932668 - DNA, 22 bp, Homo sapiens
actgttcatattcttagaaatt

SEQ ID NO: 6932669 - DNA, 22 bp, Homo sapiens
ttgcagtttgcttttaatggga

SEQ ID NO: 6932670 - DNA, 22 bp, Homo sapiens
ccagatatcactgccgtgttgt

SEQ ID NO: 6932671 - DNA, 22 bp, Homo sapiens
gccacagggattgttttgtgag

SEQ ID NO: 6932672 - DNA, 22 bp, Homo sapiens
gaagcctcattgacctccactg

SEQ ID NO: 6932673 - DNA, 22 bp, Homo sapiens
tactgtgcagctgtgctttggg

SEQ ID NO: 6932674 - DNA, 22 bp, Homo sapiens
cactgcttttcagacagttatt

SEQ ID NO: 6932675 - DNA, 22 bp, Homo sapiens
taggctgagctaagagagctta

SEQ ID NO: 6932676 - DNA, 22 bp, Homo sapiens
agatcagagatgctaaaagagc

SEQ ID NO: 6932677 - DNA, 22 bp, Homo sapiens
agtcagtgggcttggcacagaa

SEQ ID NO: 6932678 - DNA, 19 bp, Homo sapiens
cacagctggcgctgaccgc

SEQ ID NO: 6932679 - DNA, 22 bp, Homo sapiens
caagatgcccctggtagggatc

SEQ ID NO: 6932680 - DNA, 22 bp, Homo sapiens
gggagtcctcagaagttcccgg

SEQ ID NO: 6932681 - DNA, 21 bp, Homo sapiens
aggaagtggccagattgggaa

SEQ ID NO: 6932682 - DNA, 22 bp, Homo sapiens
ttcttacatctataaagttggg

SEQ ID NO: 6932683 - DNA, 23 bp, Homo sapiens
aaataggagtatctggatcatga

SEQ ID NO: 6932684 - DNA, 22 bp, Homo sapiens
tgaaggccaaaagacgggcttc

SEQ ID NO: 6932685 - DNA, 21 bp, Homo sapiens
acagcagacaggcttaggacc

SEQ ID NO: 6932686 - DNA, 22 bp, Homo sapiens
ggttattttggttgtctaaggc

SEQ ID NO: 6932687 - DNA, 22 bp, Homo sapiens
aaactttggattgtgattgtgc

SEQ ID NO: 6932688 - DNA, 22 bp, Homo sapiens
aactcagaatagggtgcagggc

SEQ ID NO: 6932689 - DNA, 22 bp, Homo sapiens
attctgctccacactgattcat

SEQ ID NO: 6932690 - DNA, 22 bp, Homo sapiens
gtaatgcatttattttatgaaa

SEQ ID NO: 6932691 - DNA, 22 bp, Homo sapiens
aaaagtaattgtggttttggcc

SEQ ID NO: 6932692 - DNA, 21 bp, Homo sapiens
cagtggcacgatttcggctca

SEQ ID NO: 6932693 - DNA, 22 bp, Homo sapiens
tttctcaaggtgtcatgtattt

SEQ ID NO: 6932694 - DNA, 22 bp, Homo sapiens
tgctgctccccagcacacagca

SEQ ID NO: 6932695 - DNA, 20 bp, Homo sapiens
ggcaggtgctcgcttggtct

SEQ ID NO: 6932696 - DNA, 22 bp, Homo sapiens
ggtcagcatctggttgagggca

SEQ ID NO: 6932697 - DNA, 18 bp, Homo sapiens
tcacagtgctcttgccta

SEQ ID NO: 6932698 - DNA, 22 bp, Homo sapiens
gccaggtggaggttgcagtgag

SEQ ID NO: 6932699 - DNA, 22 bp, Homo sapiens
attggcagaaacagcagggcca

SEQ ID NO: 6932700 - DNA, 22 bp, Homo sapiens
aagccatgcaagccacaaggtg

SEQ ID NO: 6932701 - DNA, 22 bp, Homo sapiens
ggctttatagggtagaggatca

SEQ ID NO: 6932702 - DNA, 22 bp, Homo sapiens
gcccagtgtctaggaggtgaac

SEQ ID NO: 6932703 - DNA, 22 bp, Homo sapiens
tcctctgactcacagcctgggg

SEQ ID NO: 6932704 - DNA, 22 bp, Homo sapiens
agagaaatggggtaatctttca

SEQ ID NO: 6932705 - DNA, 22 bp, Homo sapiens
ttgtgtaagatgcaatatggta

SEQ ID NO: 6932706 - DNA, 22 bp, Homo sapiens
gacacgttcctgcctcagagac

SEQ ID NO: 6932707 - DNA, 22 bp, Homo sapiens
agcaggtatgacatagatatgt

SEQ ID NO: 6932708 - DNA, 22 bp, Homo sapiens
ggactcagcagccaggagtggc

SEQ ID NO: 6932709 - DNA, 17 bp, Homo sapiens
tgcttctgtattgctgg

SEQ ID NO: 6932710 - DNA, 23 bp, Homo sapiens
actgaggtactgaggttgtgaca

SEQ ID NO: 6932711 - DNA, 22 bp, Homo sapiens
ctacacagagcctacttctgca

SEQ ID NO: 6932712 - DNA, 22 bp, Homo sapiens
gtccctgggcgcctccgtgctc

SEQ ID NO: 6932713 - DNA, 22 bp, Homo sapiens
attctctagtctcttccataaa

SEQ ID NO: 6932714 - DNA, 23 bp, Homo sapiens
ggacactgctataaaggatctgc

SEQ ID NO: 6932715 - DNA, 22 bp, Homo sapiens
cttggctttctgacccttgtca

SEQ ID NO: 6932716 - DNA, 23 bp, Homo sapiens
agatgaggcttctccatgttggt

SEQ ID NO: 6932717 - DNA, 22 bp, Homo sapiens
ctgagctggtggaagcatgcag

SEQ ID NO: 6932718 - DNA, 22 bp, Homo sapiens
accagtgggaagtggaaaatga

SEQ ID NO: 6932719 - DNA, 23 bp, Homo sapiens
tagcaaagttgtttgggaaattt

SEQ ID NO: 6932720 - DNA, 22 bp, Homo sapiens
aattcctttggatcttctggag

SEQ ID NO: 6932721 - DNA, 22 bp, Homo sapiens
ttcctatggtgaacatgaatga

SEQ ID NO: 6932722 - DNA, 21 bp, Homo sapiens
agtcacattgggggtttaggg

SEQ ID NO: 6932723 - DNA, 22 bp, Homo sapiens
gggcctcaggccttgctctgtg

SEQ ID NO: 6932724 - DNA, 23 bp, Homo sapiens
tacttgaaatcaggcttacttcc

SEQ ID NO: 6932725 - DNA, 22 bp, Homo sapiens
caagacaagatctaagcatgct

SEQ ID NO: 6932726 - DNA, 22 bp, Homo sapiens
tcccagtctagagccggattgg

SEQ ID NO: 6932727 - DNA, 22 bp, Homo sapiens
cagcttcaccagggccatggtt

SEQ ID NO: 6932728 - DNA, 22 bp, Homo sapiens
tggcaggaaggagactcagccc

SEQ ID NO: 6932729 - DNA, 22 bp, Homo sapiens
ctcttcaggaatatgtcagtca

SEQ ID NO: 6932730 - DNA, 22 bp, Homo sapiens
cagggcaggatgctgtgattat

SEQ ID NO: 6932731 - DNA, 22 bp, Homo sapiens
tcagatattctctaagaacaat

SEQ ID NO: 6932732 - DNA, 22 bp, Homo sapiens
tggcatgtggcagctggttcag

SEQ ID NO: 6932733 - DNA, 22 bp, Homo sapiens
cacagcagagggagccattgaa

SEQ ID NO: 6932734 - DNA, 22 bp, Homo sapiens
tcatgacagccagagctctgac

SEQ ID NO: 6932735 - DNA, 22 bp, Homo sapiens
aggcttctaggaaactttctgg

SEQ ID NO: 6932736 - DNA, 22 bp, Homo sapiens
gcctgaagaacagctgtgagga

SEQ ID NO: 6932737 - DNA, 21 bp, Homo sapiens
atgacctgggaagatgctcaa

SEQ ID NO: 6932738 - DNA, 22 bp, Homo sapiens
aaggcttcctggaggaggtgtc

SEQ ID NO: 6932739 - DNA, 22 bp, Homo sapiens
ttcagagacatgttctagatca

SEQ ID NO: 6932740 - DNA, 22 bp, Homo sapiens
gaacacagaagaatttctaaga

SEQ ID NO: 6932741 - DNA, 22 bp, Homo sapiens
gccaggcagccaccctctgcga

SEQ ID NO: 6932742 - DNA, 22 bp, Homo sapiens
atgtccaatttctgaggctgct

SEQ ID NO: 6932743 - DNA, 22 bp, Homo sapiens
cagaagctggtacaaggcctag

SEQ ID NO: 6932744 - DNA, 22 bp, Homo sapiens
tcatgcacagctcttagcacca

SEQ ID NO: 6932745 - DNA, 22 bp, Homo sapiens
aatgcttatgggttccataata

SEQ ID NO: 6932746 - DNA, 22 bp, Homo sapiens
ccagtgcctatccttctcctgt

SEQ ID NO: 6932747 - DNA, 22 bp, Homo sapiens
cacaggctgcccgcagctggga

SEQ ID NO: 6932748 - DNA, 22 bp, Homo sapiens
ctggctcatccaggtgttgctc

SEQ ID NO: 6932749 - DNA, 22 bp, Homo sapiens
attgtcttggaaccaaggtctt

SEQ ID NO: 6932750 - DNA, 22 bp, Homo sapiens
tgccctggaaatgagaggtgtg

SEQ ID NO: 6932751 - DNA, 22 bp, Homo sapiens
tgatgcgtctcctctttcaggt

SEQ ID NO: 6932752 - DNA, 22 bp, Homo sapiens
tttcagttctgtacaagtccag

SEQ ID NO: 6932753 - DNA, 22 bp, Homo sapiens
ttaagtacagggttagtgacgg

SEQ ID NO: 6932754 - DNA, 22 bp, Homo sapiens
attttgactgcattacagaaca

SEQ ID NO: 6932755 - DNA, 22 bp, Homo sapiens
aacaaaccttccctatacgtct

SEQ ID NO: 6932756 - DNA, 22 bp, Homo sapiens
caccagggctctgagctctgaa

SEQ ID NO: 6932757 - DNA, 22 bp, Homo sapiens
tgctgttagtaaggaacatgac

SEQ ID NO: 6932758 - DNA, 22 bp, Homo sapiens
ccaggccttccagtacgcagaa

SEQ ID NO: 6932759 - DNA, 22 bp, Homo sapiens
agactggcttgctttacaagga

SEQ ID NO: 6932760 - DNA, 17 bp, Homo sapiens
tgagcttcaatcaggtg

SEQ ID NO: 6932761 - DNA, 22 bp, Homo sapiens
gagattttcagcttgactggga

SEQ ID NO: 6932762 - DNA, 22 bp, Homo sapiens
ctgatggatgctacgtaagagg

SEQ ID NO: 6932763 - DNA, 22 bp, Homo sapiens
gttagcatttgtttaatatcag

SEQ ID NO: 6932764 - DNA, 22 bp, Homo sapiens
ctgctccaagccagccctgcag

SEQ ID NO: 6932765 - DNA, 22 bp, Homo sapiens
atttcaacagagtttgaaggca

SEQ ID NO: 6932766 - DNA, 23 bp, Homo sapiens
actttagataaattatgtgcaca

SEQ ID NO: 6932767 - DNA, 22 bp, Homo sapiens
acacaggaactctgagaggtgg

SEQ ID NO: 6932768 - DNA, 22 bp, Homo sapiens
ctctcctccaacagccctgccg

SEQ ID NO: 6932769 - DNA, 22 bp, Homo sapiens
tcagtctttcgaattcagccag

SEQ ID NO: 6932770 - DNA, 22 bp, Homo sapiens
ggctagggaaatcctgatccaa

SEQ ID NO: 6932771 - DNA, 21 bp, Homo sapiens
accattaacacccaggtttct

SEQ ID NO: 6932772 - DNA, 22 bp, Homo sapiens
gacagggaacttcattagctgt

SEQ ID NO: 6932773 - DNA, 22 bp, Homo sapiens
catttcaattatttgctcttct

SEQ ID NO: 6932774 - DNA, 22 bp, Homo sapiens
tattccaggtattcttcaagag

SEQ ID NO: 6932775 - DNA, 22 bp, Homo sapiens
tctgatgtaggcttttctggga

SEQ ID NO: 6932776 - DNA, 22 bp, Homo sapiens
cccaggaggtggagttcacagt

SEQ ID NO: 6932777 - DNA, 22 bp, Homo sapiens
ggcttcatggagttctacacca

SEQ ID NO: 6932778 - DNA, 22 bp, Homo sapiens
atggatggcctgagcacagctg

SEQ ID NO: 6932779 - DNA, 22 bp, Homo sapiens
ataaagtagctttcagtgccaa

SEQ ID NO: 6932780 - DNA, 22 bp, Homo sapiens
tccctcctggtgagcaggggct

SEQ ID NO: 6932781 - DNA, 22 bp, Homo sapiens
acagaggtcacctttgtatctt

SEQ ID NO: 6932782 - DNA, 18 bp, Homo sapiens
agcagggcattttgccat

SEQ ID NO: 6932783 - DNA, 22 bp, Homo sapiens
tcctacagcacagatgtttact

SEQ ID NO: 6932784 - DNA, 22 bp, Homo sapiens
ttactgatgatctggaggggct

SEQ ID NO: 6932785 - DNA, 22 bp, Homo sapiens
agtatgtcaatcttttgttgtt

SEQ ID NO: 6932786 - DNA, 23 bp, Homo sapiens
tggagggcagaataacagactac

SEQ ID NO: 6932787 - DNA, 22 bp, Homo sapiens
gaggggaaagttctgcacaagg

SEQ ID NO: 6932788 - DNA, 22 bp, Homo sapiens
gttcatttttagaatgctagta

SEQ ID NO: 6932789 - DNA, 22 bp, Homo sapiens
tggggccttggcctcattagat

SEQ ID NO: 6932790 - DNA, 22 bp, Homo sapiens
tctgacttccttttctgatcca

SEQ ID NO: 6932791 - DNA, 22 bp, Homo sapiens
aatatgttccacttaaagctgg

SEQ ID NO: 6932792 - DNA, 22 bp, Homo sapiens
aagtttcatgatgtaattattg

SEQ ID NO: 6932793 - DNA, 22 bp, Homo sapiens
cttcttaaagttgtcacagctg

SEQ ID NO: 6932794 - DNA, 22 bp, Homo sapiens
cccattcttcatggtttcctgt

SEQ ID NO: 6932795 - DNA, 22 bp, Homo sapiens
ttagctttcttggagaattaca

SEQ ID NO: 6932796 - DNA, 22 bp, Homo sapiens
cccgggaggtggaggttgcagt

SEQ ID NO: 6932797 - DNA, 22 bp, Homo sapiens
gtcctttgtctctgatccagga

SEQ ID NO: 6932798 - DNA, 22 bp, Homo sapiens
cccaggaggtggaggttgcggt

SEQ ID NO: 6932799 - DNA, 18 bp, Homo sapiens
agggccagctgtgagtag

SEQ ID NO: 6932800 - DNA, 20 bp, Homo sapiens
tggagctccagcgtccatgt

SEQ ID NO: 6932801 - DNA, 22 bp, Homo sapiens
tagtgatttccatttcagggtt

SEQ ID NO: 6932802 - DNA, 22 bp, Homo sapiens
tgactcctggtatggatgacag

SEQ ID NO: 6932803 - DNA, 22 bp, Homo sapiens
ctgtcactgatgggctcaccag

SEQ ID NO: 6932804 - DNA, 22 bp, Homo sapiens
atctctttgatggctcctgtga

SEQ ID NO: 6932805 - DNA, 23 bp, Homo sapiens
tctccagtgtctcttcattgagt

SEQ ID NO: 6932806 - DNA, 22 bp, Homo sapiens
gctgtgttttatgttaggttaa

SEQ ID NO: 6932807 - DNA, 22 bp, Homo sapiens
gtaagaagatgaatccaggctg

SEQ ID NO: 6932808 - DNA, 22 bp, Homo sapiens
tctgggagagggaaagaagact

SEQ ID NO: 6932809 - DNA, 21 bp, Homo sapiens
acatgtctctaatctcagtga

SEQ ID NO: 6932810 - DNA, 22 bp, Homo sapiens
tcacaattgtttttaggatcaa

SEQ ID NO: 6932811 - DNA, 22 bp, Homo sapiens
tagccaggcctttgatcccggc

SEQ ID NO: 6932812 - DNA, 22 bp, Homo sapiens
tcagaaaccagctctctcaatt

SEQ ID NO: 6932813 - DNA, 22 bp, Homo sapiens
ggcacactcaccacgtggaggg

SEQ ID NO: 6932814 - DNA, 22 bp, Homo sapiens
gagaggtgaatgtggatgccac

SEQ ID NO: 6932815 - DNA, 22 bp, Homo sapiens
aggaggcaaaggtctctgataa

SEQ ID NO: 6932816 - DNA, 22 bp, Homo sapiens
tgctggaaaaagattgtgtttt

SEQ ID NO: 6932817 - DNA, 23 bp, Homo sapiens
gcatcttaaaacctacatatgtg

SEQ ID NO: 6932818 - DNA, 23 bp, Homo sapiens
agccaggggatcttgggccctgg

SEQ ID NO: 6932819 - DNA, 20 bp, Homo sapiens
aaaattgctctgcagtcccc

SEQ ID NO: 6932820 - DNA, 22 bp, Homo sapiens
cctgcccactgcccggtcagcc

SEQ ID NO: 6932821 - DNA, 18 bp, Homo sapiens
tctgaaagcaccggtgaa

SEQ ID NO: 6932822 - DNA, 22 bp, Homo sapiens
caagatatcaatgacatagtat

SEQ ID NO: 6932823 - DNA, 22 bp, Homo sapiens
acttaccagagaggatccgccc

SEQ ID NO: 6932824 - DNA, 22 bp, Homo sapiens
cattctaaagtgttttatacct

SEQ ID NO: 6932825 - DNA, 22 bp, Homo sapiens
ggcattatttaaaagcctcact

SEQ ID NO: 6932826 - DNA, 22 bp, Homo sapiens
tggtaatttccgaagtgagtaa

SEQ ID NO: 6932827 - DNA, 22 bp, Homo sapiens
cacttcaattaacttcagcatt

SEQ ID NO: 6932828 - DNA, 22 bp, Homo sapiens
gaaagttattgaaccttattta

SEQ ID NO: 6932829 - DNA, 22 bp, Homo sapiens
gccgggaccaaggccacggagc

SEQ ID NO: 6932830 - DNA, 22 bp, Homo sapiens
tcaggagagtgttcagtggagg

SEQ ID NO: 6932831 - DNA, 22 bp, Homo sapiens
ccagtgtcagaaagattatcct

SEQ ID NO: 6932832 - DNA, 22 bp, Homo sapiens
acacttctcatttgatactaac

SEQ ID NO: 6932833 - DNA, 22 bp, Homo sapiens
gcgagggcacgcggttgaaggc

SEQ ID NO: 6932834 - DNA, 22 bp, Homo sapiens
cagggagaggcatcatagggaa

SEQ ID NO: 6932835 - DNA, 20 bp, Homo sapiens
agatttacctttgagccttc

SEQ ID NO: 6932836 - DNA, 23 bp, Homo sapiens
ttgaatttctcttgcaatattta

SEQ ID NO: 6932837 - DNA, 22 bp, Homo sapiens
gacagtgaacaggttcccactg

SEQ ID NO: 6932838 - DNA, 22 bp, Homo sapiens
tagtgcaaaggccctgagatgg

SEQ ID NO: 6932839 - DNA, 22 bp, Homo sapiens
cacatacaagccatggggggat

SEQ ID NO: 6932840 - DNA, 22 bp, Homo sapiens
tgctttaagacactaagtttga

SEQ ID NO: 6932841 - DNA, 22 bp, Homo sapiens
tcagaacaattgggaaccatta

SEQ ID NO: 6932842 - DNA, 22 bp, Homo sapiens
caaagtccatagtttacaatag

SEQ ID NO: 6932843 - DNA, 22 bp, Homo sapiens
actgtgcaaatgacaggcacac

SEQ ID NO: 6932844 - DNA, 22 bp, Homo sapiens
gtcatgagaaatctttgaaggt

SEQ ID NO: 6932845 - DNA, 22 bp, Homo sapiens
tagagatggggtcttgctatga

SEQ ID NO: 6932846 - DNA, 22 bp, Homo sapiens
agggcagcccttctgggagggc

SEQ ID NO: 6932847 - DNA, 22 bp, Homo sapiens
attagagaatgtgctgacattg

SEQ ID NO: 6932848 - DNA, 22 bp, Homo sapiens
cccctcgcctgcagagcacagc

SEQ ID NO: 6932849 - DNA, 21 bp, Homo sapiens
caaaaggataggaaattaggg

SEQ ID NO: 6932850 - DNA, 22 bp, Homo sapiens
gcaggcctaagagaaggcattg

SEQ ID NO: 6932851 - DNA, 22 bp, Homo sapiens
gaggtgcccttgtgtattgctg

SEQ ID NO: 6932852 - DNA, 22 bp, Homo sapiens
atagcaaatattttaatgagca

SEQ ID NO: 6932853 - DNA, 22 bp, Homo sapiens
aaacatctattatgtgctgagc

SEQ ID NO: 6932854 - DNA, 22 bp, Homo sapiens
taagcctggttcataatttgct

SEQ ID NO: 6932855 - DNA, 22 bp, Homo sapiens
agccttgatcttggtaacagga

SEQ ID NO: 6932856 - DNA, 22 bp, Homo sapiens
gccccactttcctaggcagtat

SEQ ID NO: 6932857 - DNA, 22 bp, Homo sapiens
atactgtatatttcacatcttg

SEQ ID NO: 6932858 - DNA, 22 bp, Homo sapiens
tggagagccttcccggcatcgc

SEQ ID NO: 6932859 - DNA, 22 bp, Homo sapiens
caaagctggactgctcagttca

SEQ ID NO: 6932860 - DNA, 22 bp, Homo sapiens
catggcttttagccctacatga

SEQ ID NO: 6932861 - DNA, 22 bp, Homo sapiens
gaggaggctaagtgggctctgg

SEQ ID NO: 6932862 - DNA, 22 bp, Homo sapiens
taagggctctatcctactgttt

SEQ ID NO: 6932863 - DNA, 22 bp, Homo sapiens
acatgattcttgataggcattg

SEQ ID NO: 6932864 - DNA, 22 bp, Homo sapiens
ttgtgcatggagaaggcagggc

SEQ ID NO: 6932865 - DNA, 22 bp, Homo sapiens
tttgcactctaagtagtttgga

SEQ ID NO: 6932866 - DNA, 22 bp, Homo sapiens
ctttagcaacgatgatgatatt

SEQ ID NO: 6932867 - DNA, 22 bp, Homo sapiens
gtgcttaaaacagaaaacattg

SEQ ID NO: 6932868 - DNA, 22 bp, Homo sapiens
gcgtgcatggccgtgtgtatgc

SEQ ID NO: 6932869 - DNA, 22 bp, Homo sapiens
taccagccttttaacatgggcc

SEQ ID NO: 6932870 - DNA, 22 bp, Homo sapiens
cactgcttatgtctccttttca

SEQ ID NO: 6932871 - DNA, 20 bp, Homo sapiens
gtctgcccaggccaccacgg

SEQ ID NO: 6932872 - DNA, 22 bp, Homo sapiens
cacttcaacagttatttcttag

SEQ ID NO: 6932873 - DNA, 22 bp, Homo sapiens
tctacactgggggctttgagca

SEQ ID NO: 6932874 - DNA, 22 bp, Homo sapiens
agtaacagagcatgggttcaga

SEQ ID NO: 6932875 - DNA, 22 bp, Homo sapiens
tattgaggaaacagagcaggca

SEQ ID NO: 6932876 - DNA, 22 bp, Homo sapiens
tatttggaaggtataaacacaa

SEQ ID NO: 6932877 - DNA, 22 bp, Homo sapiens
tgggctgcaggggttgagagct

SEQ ID NO: 6932878 - DNA, 20 bp, Homo sapiens
atgcatctggtatctttcct

SEQ ID NO: 6932879 - DNA, 22 bp, Homo sapiens
ttcttattgggagaccttttct

SEQ ID NO: 6932880 - DNA, 22 bp, Homo sapiens
tgtttcaagtttgctcaaagga

SEQ ID NO: 6932881 - DNA, 22 bp, Homo sapiens
gagtgctgagcccacttccttg

SEQ ID NO: 6932882 - DNA, 22 bp, Homo sapiens
caatctgtgaaatgggaataat

SEQ ID NO: 6932883 - DNA, 22 bp, Homo sapiens
tgaggtagtgattgtagaagtg

SEQ ID NO: 6932884 - DNA, 22 bp, Homo sapiens
actgtctgccctgagatgccag

SEQ ID NO: 6932885 - DNA, 22 bp, Homo sapiens
acagtaaaattaagggcagtta

SEQ ID NO: 6932886 - DNA, 20 bp, Homo sapiens
ccattctgggtgcagtctgg

SEQ ID NO: 6932887 - DNA, 22 bp, Homo sapiens
gagcacctcaaatgaacataaa

SEQ ID NO: 6932888 - DNA, 22 bp, Homo sapiens
ctggctgacaccttgatagcag

SEQ ID NO: 6932889 - DNA, 22 bp, Homo sapiens
catttattagttagttcgatgt

SEQ ID NO: 6932890 - DNA, 22 bp, Homo sapiens
gactttggtataccttgcttta

SEQ ID NO: 6932891 - DNA, 22 bp, Homo sapiens
tgtgtctcctttccctgtctaa

SEQ ID NO: 6932892 - DNA, 22 bp, Homo sapiens
agtcattaagacaactggagta

SEQ ID NO: 6932893 - DNA, 22 bp, Homo sapiens
tagaactgtccaagtctgagct

SEQ ID NO: 6932894 - DNA, 22 bp, Homo sapiens
atgcagccccctggtgcccggg

SEQ ID NO: 6932895 - DNA, 20 bp, Homo sapiens
agccagaagaaggctggaga

SEQ ID NO: 6932896 - DNA, 22 bp, Homo sapiens
ttagaactgaagaagattaagg

SEQ ID NO: 6932897 - DNA, 22 bp, Homo sapiens
ttgcatgggcaacaggaggtgg

SEQ ID NO: 6932898 - DNA, 22 bp, Homo sapiens
catgtgtattattcttgtggaa

SEQ ID NO: 6932899 - DNA, 22 bp, Homo sapiens
tctctgcaagatgagaaatatt

SEQ ID NO: 6932900 - DNA, 22 bp, Homo sapiens
gttttctaggatcccctccaag

SEQ ID NO: 6932901 - DNA, 22 bp, Homo sapiens
taacacatgtctgggatgtgaa

SEQ ID NO: 6932902 - DNA, 22 bp, Homo sapiens
ttcaagtacattgtgttttcct

SEQ ID NO: 6932903 - DNA, 22 bp, Homo sapiens
tccataggatctgcttcatact

SEQ ID NO: 6932904 - DNA, 22 bp, Homo sapiens
agagctggctgctgcggtgctt

SEQ ID NO: 6932905 - DNA, 22 bp, Homo sapiens
gtgatttctaatcatctgaatg

SEQ ID NO: 6932906 - DNA, 22 bp, Homo sapiens
ttgctttttaattaggaggcag

SEQ ID NO: 6932907 - DNA, 22 bp, Homo sapiens
agttttattgtcccagaggtga

SEQ ID NO: 6932908 - DNA, 22 bp, Homo sapiens
agcagcagatcaaacaggcttg

SEQ ID NO: 6932909 - DNA, 22 bp, Homo sapiens
acttcaaatctcttgaaagcaa

SEQ ID NO: 6932910 - DNA, 22 bp, Homo sapiens
caggagactatggcccaaggcc

SEQ ID NO: 6932911 - DNA, 22 bp, Homo sapiens
ctgtgagctgggtggccaggac

SEQ ID NO: 6932912 - DNA, 22 bp, Homo sapiens
gtctagaaataggtttcagaaa

SEQ ID NO: 6932913 - DNA, 22 bp, Homo sapiens
agatgcgtgcagcctgacaatt

SEQ ID NO: 6932914 - DNA, 22 bp, Homo sapiens
tgccatatgcaaatactttctt

SEQ ID NO: 6932915 - DNA, 22 bp, Homo sapiens
ccaggtggacttgatttgaata

SEQ ID NO: 6932916 - DNA, 22 bp, Homo sapiens
gactgctttgacaaatgatacc

SEQ ID NO: 6932917 - DNA, 21 bp, Homo sapiens
cctgtgccaaagtgtgttagg

SEQ ID NO: 6932918 - DNA, 22 bp, Homo sapiens
gaggtgcctttttgtaattagt

SEQ ID NO: 6932919 - DNA, 22 bp, Homo sapiens
gcatgtgtgtcactttcctgcc

SEQ ID NO: 6932920 - DNA, 22 bp, Homo sapiens
ctagctccatataaagcaggat

SEQ ID NO: 6932921 - DNA, 22 bp, Homo sapiens
tagcatctgcatttgtaactag

SEQ ID NO: 6932922 - DNA, 22 bp, Homo sapiens
ttgctgttttacatctggtggg

SEQ ID NO: 6932923 - DNA, 22 bp, Homo sapiens
ctggtgcatgtggccttgctct

SEQ ID NO: 6932924 - DNA, 22 bp, Homo sapiens
ctgaaccatctctgttctgtat

SEQ ID NO: 6932925 - DNA, 22 bp, Homo sapiens
taagagcttaatctggatcgta

SEQ ID NO: 6932926 - DNA, 22 bp, Homo sapiens
acattagatgtgtggccacagt

SEQ ID NO: 6932927 - DNA, 21 bp, Homo sapiens
tcagagagtcacagtgaactg

SEQ ID NO: 6932928 - DNA, 22 bp, Homo sapiens
tataagtagcattggaacttca

SEQ ID NO: 6932929 - DNA, 22 bp, Homo sapiens
agatatatttcctgcccaaggc

SEQ ID NO: 6932930 - DNA, 22 bp, Homo sapiens
agtttctctagagtctttgaaa

SEQ ID NO: 6932931 - DNA, 22 bp, Homo sapiens
tgaggtctgctcaagtccctgg

SEQ ID NO: 6932932 - DNA, 22 bp, Homo sapiens
tgacaacattgagttatgtgca

SEQ ID NO: 6932933 - DNA, 22 bp, Homo sapiens
agagtcaaaatttaccagaatg

SEQ ID NO: 6932934 - DNA, 22 bp, Homo sapiens
atggaatatttgacacataggg

SEQ ID NO: 6932935 - DNA, 22 bp, Homo sapiens
gggctcagacatccctcctgga

SEQ ID NO: 6932936 - DNA, 22 bp, Homo sapiens
gctcagagataaaactgatcag

SEQ ID NO: 6932937 - DNA, 22 bp, Homo sapiens
ctggcctcagagggtcatggtg

SEQ ID NO: 6932938 - DNA, 22 bp, Homo sapiens
cgtccatattcctgagggctca

SEQ ID NO: 6932939 - DNA, 22 bp, Homo sapiens
aagactcaaggaacaacacagt

SEQ ID NO: 6932940 - DNA, 22 bp, Homo sapiens
ctctgaggtctaggaccatggc

SEQ ID NO: 6932941 - DNA, 22 bp, Homo sapiens
ggaaaacaagagaatgatgttt

SEQ ID NO: 6932942 - DNA, 22 bp, Homo sapiens
tatggcttatgctgaacacctg

SEQ ID NO: 6932943 - DNA, 22 bp, Homo sapiens
agttctttgtgagtaatacaga

SEQ ID NO: 6932944 - DNA, 22 bp, Homo sapiens
ctgctctccccaggccagtctg

SEQ ID NO: 6932945 - DNA, 22 bp, Homo sapiens
ccagtagaaagcaacgtggcat

SEQ ID NO: 6932946 - DNA, 22 bp, Homo sapiens
acaaaggttgggtcaattgtcc

SEQ ID NO: 6932947 - DNA, 22 bp, Homo sapiens
aggcacagagaatgccctccat

SEQ ID NO: 6932948 - DNA, 22 bp, Homo sapiens
cttgtacaggatattataggct

SEQ ID NO: 6932949 - DNA, 22 bp, Homo sapiens
cagacccaggatccaaatgttg

SEQ ID NO: 6932950 - DNA, 23 bp, Homo sapiens
gaatcagtggctaacaaggaaac

SEQ ID NO: 6932951 - DNA, 22 bp, Homo sapiens
tcaggagtaaagacagagttcc

SEQ ID NO: 6932952 - DNA, 22 bp, Homo sapiens
tcatgagtctgcaaattatgga

SEQ ID NO: 6932953 - DNA, 22 bp, Homo sapiens
tagcccagctaactcggtgagc

SEQ ID NO: 6932954 - DNA, 22 bp, Homo sapiens
agctcagcactgtcagcactcc

SEQ ID NO: 6932955 - DNA, 22 bp, Homo sapiens
tttacaagtctgttgatcccaa

SEQ ID NO: 6932956 - DNA, 22 bp, Homo sapiens
actctgtcttcatatttgcatt

SEQ ID NO: 6932957 - DNA, 22 bp, Homo sapiens
gcccagaaatgaacttgctgtg

SEQ ID NO: 6932958 - DNA, 22 bp, Homo sapiens
agttttctctgtgttctgctta

SEQ ID NO: 6932959 - DNA, 22 bp, Homo sapiens
ctttcacagtcatatgatgaat

SEQ ID NO: 6932960 - DNA, 22 bp, Homo sapiens
aaagcacaggagagttcagtaa

SEQ ID NO: 6932961 - DNA, 22 bp, Homo sapiens
tgtgaaatgctattgtgacaaa

SEQ ID NO: 6932962 - DNA, 22 bp, Homo sapiens
gcaagcaatggacggtgacttt

SEQ ID NO: 6932963 - DNA, 22 bp, Homo sapiens
agttgtatacacttaggcagat

SEQ ID NO: 6932964 - DNA, 22 bp, Homo sapiens
aatttctcatggattcagttat

SEQ ID NO: 6932965 - DNA, 22 bp, Homo sapiens
gggcaatgctatgaagagctaa

SEQ ID NO: 6932966 - DNA, 22 bp, Homo sapiens
ccagagagctacaaggcataaa

SEQ ID NO: 6932967 - DNA, 22 bp, Homo sapiens
tgggcctcccatgtcttaggga

SEQ ID NO: 6932968 - DNA, 22 bp, Homo sapiens
tgcagtttcctggtctctactt

SEQ ID NO: 6932969 - DNA, 22 bp, Homo sapiens
gcttttatgcacataagggtca

SEQ ID NO: 6932970 - DNA, 22 bp, Homo sapiens
gagacacaagacgcaactctgt

SEQ ID NO: 6932971 - DNA, 22 bp, Homo sapiens
gagctccctggaggttcagata

SEQ ID NO: 6932972 - DNA, 23 bp, Homo sapiens
ccctggagctagtctgagcgggg

SEQ ID NO: 6932973 - DNA, 19 bp, Homo sapiens
aattgcctgtctctgccag

SEQ ID NO: 6932974 - DNA, 22 bp, Homo sapiens
tttcatcttcccagagaccttg

SEQ ID NO: 6932975 - DNA, 22 bp, Homo sapiens
tcaaggctattaattctgtgag

SEQ ID NO: 6932976 - DNA, 22 bp, Homo sapiens
tctgaccctgagtctattttct

SEQ ID NO: 6932977 - DNA, 22 bp, Homo sapiens
gcccagcaggacagagtggttt

SEQ ID NO: 6932978 - DNA, 22 bp, Homo sapiens
tggagcagctaagcctctgaga

SEQ ID NO: 6932979 - DNA, 22 bp, Homo sapiens
tctgaggctaagagacagaggc

SEQ ID NO: 6932980 - DNA, 22 bp, Homo sapiens
acaggcaagaggaaagcaagta

SEQ ID NO: 6932981 - DNA, 22 bp, Homo sapiens
gttcagatggagaaggaaaact

SEQ ID NO: 6932982 - DNA, 22 bp, Homo sapiens
aatgcacataaatatggtctta

SEQ ID NO: 6932983 - DNA, 22 bp, Homo sapiens
atacagagaaggggtagaggat

SEQ ID NO: 6932984 - DNA, 22 bp, Homo sapiens
gattcttatgagtgaactttac

SEQ ID NO: 6932985 - DNA, 22 bp, Homo sapiens
ttagggttacaccagcctcctg

SEQ ID NO: 6932986 - DNA, 22 bp, Homo sapiens
tccagaggcaaaaaggtatgga

SEQ ID NO: 6932987 - DNA, 22 bp, Homo sapiens
ccaggaaaaacacattgaagag

SEQ ID NO: 6932988 - DNA, 22 bp, Homo sapiens
actgatttttcaggagggcctt

SEQ ID NO: 6932989 - DNA, 22 bp, Homo sapiens
gaggcagctcttctgaatgggg

SEQ ID NO: 6932990 - DNA, 22 bp, Homo sapiens
gaagacactaaggcccagggag

SEQ ID NO: 6932991 - DNA, 22 bp, Homo sapiens
acaggtgacttgcattttcaca

SEQ ID NO: 6932992 - DNA, 22 bp, Homo sapiens
aatcctcagaagaaatagcaga

SEQ ID NO: 6932993 - DNA, 22 bp, Homo sapiens
ttcagaatgctatttctgaaat

SEQ ID NO: 6932994 - DNA, 22 bp, Homo sapiens
tctgtccacaagcacaggctct

SEQ ID NO: 6932995 - DNA, 22 bp, Homo sapiens
tttcctctttgtgacacagctg

SEQ ID NO: 6932996 - DNA, 22 bp, Homo sapiens
ctggcatcatttagcacagtgt

SEQ ID NO: 6932997 - DNA, 22 bp, Homo sapiens
ttctgaggaggagcaaaaactc

SEQ ID NO: 6932998 - DNA, 22 bp, Homo sapiens
cccattttagcaaggggtggcg

SEQ ID NO: 6932999 - DNA, 22 bp, Homo sapiens
actgtgactgagcattcacatg

SEQ ID NO: 6933000 - DNA, 22 bp, Homo sapiens
tgccccttcaccttcagtcttg

SEQ ID NO: 6933001 - DNA, 22 bp, Homo sapiens
actccagggctccaccccagat

SEQ ID NO: 6933002 - DNA, 22 bp, Homo sapiens
tcctgggtggtggtaggagcag

SEQ ID NO: 6933003 - DNA, 22 bp, Homo sapiens
ttctttgaaatactgttttgcc

SEQ ID NO: 6933004 - DNA, 22 bp, Homo sapiens
tgttagcagagcagctgacaga

SEQ ID NO: 6933005 - DNA, 22 bp, Homo sapiens
cagcacataagccgaagactgt

SEQ ID NO: 6933006 - DNA, 22 bp, Homo sapiens
aagagcttggactttcaagtca

SEQ ID NO: 6933007 - DNA, 22 bp, Homo sapiens
tgggcccgcagctgctgctcca

SEQ ID NO: 6933008 - DNA, 22 bp, Homo sapiens
atgctgaatgaaagaaattagt

SEQ ID NO: 6933009 - DNA, 22 bp, Homo sapiens
gaacattattgtacaaatgtct

SEQ ID NO: 6933010 - DNA, 22 bp, Homo sapiens
tgtgtacagcatggtccagcag

SEQ ID NO: 6933011 - DNA, 22 bp, Homo sapiens
gagtgctgtaggactgagccct

SEQ ID NO: 6933012 - DNA, 22 bp, Homo sapiens
ctcccggcacttggcatgtcat

SEQ ID NO: 6933013 - DNA, 20 bp, Homo sapiens
tctgagagtctgagtgatga

SEQ ID NO: 6933014 - DNA, 22 bp, Homo sapiens
tcagtgttcagcggtgtgtgca

SEQ ID NO: 6933015 - DNA, 22 bp, Homo sapiens
aggtggcatgcctgagacataa

SEQ ID NO: 6933016 - DNA, 22 bp, Homo sapiens
agtaggtatgatggtgacttga

SEQ ID NO: 6933017 - DNA, 22 bp, Homo sapiens
gcagggcagagggagaatctct

SEQ ID NO: 6933018 - DNA, 22 bp, Homo sapiens
tatgtgcagcacttgccattac

SEQ ID NO: 6933019 - DNA, 22 bp, Homo sapiens
tacttttcataatgaagcagca

SEQ ID NO: 6933020 - DNA, 20 bp, Homo sapiens
atgcttccagggtgtgtctg

SEQ ID NO: 6933021 - DNA, 22 bp, Homo sapiens
gattccaaatggagatgtccac

SEQ ID NO: 6933022 - DNA, 22 bp, Homo sapiens
agacatggatttcttacataaa

SEQ ID NO: 6933023 - DNA, 22 bp, Homo sapiens
ttaaatattatgttgtctgcaa

SEQ ID NO: 6933024 - DNA, 22 bp, Homo sapiens
atgatgaaaactgaaggttagg

SEQ ID NO: 6933025 - DNA, 22 bp, Homo sapiens
tcctgagataaatctcatgtga

SEQ ID NO: 6933026 - DNA, 22 bp, Homo sapiens
gtgatgggtaactgtttaggga

SEQ ID NO: 6933027 - DNA, 22 bp, Homo sapiens
cactgctcgctgcagcatggcc

SEQ ID NO: 6933028 - DNA, 19 bp, Homo sapiens
ccatccatggggccagagg

SEQ ID NO: 6933029 - DNA, 22 bp, Homo sapiens
taagtccacctcattcttcagc

SEQ ID NO: 6933030 - DNA, 22 bp, Homo sapiens
tatacagaaagaattcaagtct

SEQ ID NO: 6933031 - DNA, 22 bp, Homo sapiens
tgccaggatgttgtttgagaat

SEQ ID NO: 6933032 - DNA, 22 bp, Homo sapiens
tcaagagcctgtcccctgtgct

SEQ ID NO: 6933033 - DNA, 22 bp, Homo sapiens
ttgttgaatggataaataaatt

SEQ ID NO: 6933034 - DNA, 22 bp, Homo sapiens
gtttatggactgtgtatgttat

SEQ ID NO: 6933035 - DNA, 22 bp, Homo sapiens
ttttctgtaagaggactttaat

SEQ ID NO: 6933036 - DNA, 22 bp, Homo sapiens
gcaagcagatctccggagggaa

SEQ ID NO: 6933037 - DNA, 22 bp, Homo sapiens
cagagccaggtctaggagtctc

SEQ ID NO: 6933038 - DNA, 22 bp, Homo sapiens
tctgacagggccaaacatgaca

SEQ ID NO: 6933039 - DNA, 22 bp, Homo sapiens
aattcaatctaagaaatgatca

SEQ ID NO: 6933040 - DNA, 22 bp, Homo sapiens
tgctttataacttagtttatgg

SEQ ID NO: 6933041 - DNA, 22 bp, Homo sapiens
tcattctcacactcgtcaatgt

SEQ ID NO: 6933042 - DNA, 22 bp, Homo sapiens
cacagagaattcccatatgtga

SEQ ID NO: 6933043 - DNA, 22 bp, Homo sapiens
ctgctttaatccctgcctggaa

SEQ ID NO: 6933044 - DNA, 22 bp, Homo sapiens
tcacatgaaatgctgtaaagaa

SEQ ID NO: 6933045 - DNA, 22 bp, Homo sapiens
tatttggagtgatggaaatgtt

SEQ ID NO: 6933046 - DNA, 22 bp, Homo sapiens
cacagctggtgcactagctctg

SEQ ID NO: 6933047 - DNA, 22 bp, Homo sapiens
ttcttctgttggcagagcatac

SEQ ID NO: 6933048 - DNA, 22 bp, Homo sapiens
caaacctgagaacatgtgctgt

SEQ ID NO: 6933049 - DNA, 22 bp, Homo sapiens
atttgccttttaaactcacaat

SEQ ID NO: 6933050 - DNA, 22 bp, Homo sapiens
tacacatgctcagattcctgtg

SEQ ID NO: 6933051 - DNA, 22 bp, Homo sapiens
ggtggctggttttataagaggt

SEQ ID NO: 6933052 - DNA, 22 bp, Homo sapiens
gctgggtttccagcaggcagga

SEQ ID NO: 6933053 - DNA, 22 bp, Homo sapiens
ttaatgacctagagcagtaatt

SEQ ID NO: 6933054 - DNA, 22 bp, Homo sapiens
gagagagaaccccgtgcccttc

SEQ ID NO: 6933055 - DNA, 22 bp, Homo sapiens
gccctgttatccagatgaggat

SEQ ID NO: 6933056 - DNA, 22 bp, Homo sapiens
gcaggggctactctgagcttcc

SEQ ID NO: 6933057 - DNA, 22 bp, Homo sapiens
gaaagccagagagaaagggctc

SEQ ID NO: 6933058 - DNA, 22 bp, Homo sapiens
acattgtaaatacctttatcac

SEQ ID NO: 6933059 - DNA, 22 bp, Homo sapiens
ggtctcatctttcagcgtcgag

SEQ ID NO: 6933060 - DNA, 22 bp, Homo sapiens
acagcctgtgtaccagctggga

SEQ ID NO: 6933061 - DNA, 22 bp, Homo sapiens
aggactgaggtccttttaggtt

SEQ ID NO: 6933062 - DNA, 22 bp, Homo sapiens
cctggactttcatttccccttg

SEQ ID NO: 6933063 - DNA, 22 bp, Homo sapiens
ggacccagctctgagaccctgc

SEQ ID NO: 6933064 - DNA, 22 bp, Homo sapiens
agtctctttaatcacagtgtct

SEQ ID NO: 6933065 - DNA, 22 bp, Homo sapiens
agctgcctccatggtcaaagat

SEQ ID NO: 6933066 - DNA, 22 bp, Homo sapiens
tcccattctgccaaggacattg

SEQ ID NO: 6933067 - DNA, 22 bp, Homo sapiens
ggcgggtggcgaggcttctcgg

SEQ ID NO: 6933068 - DNA, 22 bp, Homo sapiens
aatgtctgcctgaactttatat

SEQ ID NO: 6933069 - DNA, 22 bp, Homo sapiens
ctggttcatccccttccaggaa

SEQ ID NO: 6933070 - DNA, 22 bp, Homo sapiens
gcctcttgtttccttacatgga

SEQ ID NO: 6933071 - DNA, 22 bp, Homo sapiens
gtgcaccccggggccctgctcc

SEQ ID NO: 6933072 - DNA, 22 bp, Homo sapiens
tttctaagtgtattgagcttgg

SEQ ID NO: 6933073 - DNA, 22 bp, Homo sapiens
tggagcctgttctgagaagccg

SEQ ID NO: 6933074 - DNA, 22 bp, Homo sapiens
attcattggcttgaactccacc

SEQ ID NO: 6933075 - DNA, 22 bp, Homo sapiens
aaatctgtttctcatagggtag

SEQ ID NO: 6933076 - DNA, 22 bp, Homo sapiens
aggcaagcgcagaagcggagga

SEQ ID NO: 6933077 - DNA, 22 bp, Homo sapiens
tatctttctgtcctagattctg

SEQ ID NO: 6933078 - DNA, 22 bp, Homo sapiens
cttggttatactccaggaacca

SEQ ID NO: 6933079 - DNA, 22 bp, Homo sapiens
tgcacacctctccaccactctc

SEQ ID NO: 6933080 - DNA, 22 bp, Homo sapiens
ttacagttaggtgtgtagtggt

SEQ ID NO: 6933081 - DNA, 22 bp, Homo sapiens
agatgtgggcaaaaggcttagc

SEQ ID NO: 6933082 - DNA, 22 bp, Homo sapiens
cagtttgtcttgattcagaaca

SEQ ID NO: 6933083 - DNA, 22 bp, Homo sapiens
gcctgctctgagtgtggggggt

SEQ ID NO: 6933084 - DNA, 22 bp, Homo sapiens
aaagggttgttgtaaggattat

SEQ ID NO: 6933085 - DNA, 22 bp, Homo sapiens
tctgcctgtaatatttggagaa

SEQ ID NO: 6933086 - DNA, 22 bp, Homo sapiens
tacatgcatgatacaaagttgc

SEQ ID NO: 6933087 - DNA, 22 bp, Homo sapiens
tcccagcagagccagcaagccg

SEQ ID NO: 6933088 - DNA, 22 bp, Homo sapiens
gacagcttcgaggaggtgagct

SEQ ID NO: 6933089 - DNA, 21 bp, Homo sapiens
agacacaggggttgctggggt

SEQ ID NO: 6933090 - DNA, 22 bp, Homo sapiens
tttcctgagtcagagacaccag

SEQ ID NO: 6933091 - DNA, 22 bp, Homo sapiens
gccactgagcccggccattgtt

SEQ ID NO: 6933092 - DNA, 22 bp, Homo sapiens
atgccatctgaaatctgtcata

SEQ ID NO: 6933093 - DNA, 22 bp, Homo sapiens
tttcttctttcccagtgatggg

SEQ ID NO: 6933094 - DNA, 22 bp, Homo sapiens
ttagagaaatgggtactgcata

SEQ ID NO: 6933095 - DNA, 22 bp, Homo sapiens
cccacccagctgagccgctcac

SEQ ID NO: 6933096 - DNA, 22 bp, Homo sapiens
gcagctgcagaccctcagtgct

SEQ ID NO: 6933097 - DNA, 22 bp, Homo sapiens
gtgaagtccaggagtaaagaaa

SEQ ID NO: 6933098 - DNA, 19 bp, Homo sapiens
atggaagctgggatcaatg

SEQ ID NO: 6933099 - DNA, 22 bp, Homo sapiens
taaagcaggcatctctctcctc

SEQ ID NO: 6933100 - DNA, 22 bp, Homo sapiens
ttaaggaaggagtcttaaatgg

SEQ ID NO: 6933101 - DNA, 22 bp, Homo sapiens
tcaaatgctgtattgtagtaat

SEQ ID NO: 6933102 - DNA, 22 bp, Homo sapiens
aatactttcctatataaggtgc

SEQ ID NO: 6933103 - DNA, 22 bp, Homo sapiens
aggagtcctcatgtctgtgcga

SEQ ID NO: 6933104 - DNA, 22 bp, Homo sapiens
cctctgggccagcctggaccct

SEQ ID NO: 6933105 - DNA, 22 bp, Homo sapiens
cagccatactgacatcaacaaa

SEQ ID NO: 6933106 - DNA, 22 bp, Homo sapiens
tttaatgtgacatcttttagag

SEQ ID NO: 6933107 - DNA, 22 bp, Homo sapiens
cctctgtgacttctaccttcac

SEQ ID NO: 6933108 - DNA, 22 bp, Homo sapiens
agtcttggctatgcatagagct

SEQ ID NO: 6933109 - DNA, 20 bp, Homo sapiens
aatgtcttgagacatttcag

SEQ ID NO: 6933110 - DNA, 18 bp, Homo sapiens
cccactgtccccacaggc

SEQ ID NO: 6933111 - DNA, 22 bp, Homo sapiens
tgccagtcacgtataagaaaat

SEQ ID NO: 6933112 - DNA, 22 bp, Homo sapiens
cagtggtggaatgaggaattgt

SEQ ID NO: 6933113 - DNA, 22 bp, Homo sapiens
gtgattatagaatgctacaaag

SEQ ID NO: 6933114 - DNA, 22 bp, Homo sapiens
aatttacacttcatttggaggg

SEQ ID NO: 6933115 - DNA, 22 bp, Homo sapiens
cctgagggaacatgcacccaat

SEQ ID NO: 6933116 - DNA, 22 bp, Homo sapiens
tcagaaggtggaggttgcagtg

SEQ ID NO: 6933117 - DNA, 22 bp, Homo sapiens
aagtattctggcagtcattcag

SEQ ID NO: 6933118 - DNA, 22 bp, Homo sapiens
tcccagccacaggtgtagccct

SEQ ID NO: 6933119 - DNA, 22 bp, Homo sapiens
ttggttcattattgaatgtgct

SEQ ID NO: 6933120 - DNA, 22 bp, Homo sapiens
agtccggtcagggggctgctgt

SEQ ID NO: 6933121 - DNA, 22 bp, Homo sapiens
cccaggagagaggccagttggc

SEQ ID NO: 6933122 - DNA, 22 bp, Homo sapiens
catggcaacaactctttattcc

SEQ ID NO: 6933123 - DNA, 22 bp, Homo sapiens
tcctaagatagaagatagtgaa

SEQ ID NO: 6933124 - DNA, 22 bp, Homo sapiens
tccagtgttgtcagatcatctg

SEQ ID NO: 6933125 - DNA, 22 bp, Homo sapiens
acttcctgttatgtgtgcctct

SEQ ID NO: 6933126 - DNA, 22 bp, Homo sapiens
tgacacttccagttaaaaatat

SEQ ID NO: 6933127 - DNA, 22 bp, Homo sapiens
tgggacctgccctggccccatc

SEQ ID NO: 6933128 - DNA, 22 bp, Homo sapiens
tggtataagctgtgtcagagcc

SEQ ID NO: 6933129 - DNA, 22 bp, Homo sapiens
aaatggatggaattgacattta

SEQ ID NO: 6933130 - DNA, 22 bp, Homo sapiens
gtgtgtcctgttttaaaatagt

SEQ ID NO: 6933131 - DNA, 22 bp, Homo sapiens
tcaccagggctccagccagcct

SEQ ID NO: 6933132 - DNA, 22 bp, Homo sapiens
tctgtcacaatttgcttactct

SEQ ID NO: 6933133 - DNA, 21 bp, Homo sapiens
ttctgcagccatgttggtttt

SEQ ID NO: 6933134 - DNA, 22 bp, Homo sapiens
ctttcactttaatctgacacct

SEQ ID NO: 6933135 - DNA, 21 bp, Homo sapiens
ctggaggcaggtggtgccagg

SEQ ID NO: 6933136 - DNA, 19 bp, Homo sapiens
ttgtgccaagggtcagaag

SEQ ID NO: 6933137 - DNA, 22 bp, Homo sapiens
gctgccctgcatctgtgccttc

SEQ ID NO: 6933138 - DNA, 22 bp, Homo sapiens
gcttccagagactgagctcttc

SEQ ID NO: 6933139 - DNA, 22 bp, Homo sapiens
gaagtccagaatactgctctga

SEQ ID NO: 6933140 - DNA, 23 bp, Homo sapiens
cagtgggaggactgagataaaac

SEQ ID NO: 6933141 - DNA, 21 bp, Homo sapiens
actagctttctggagaagtgt

SEQ ID NO: 6933142 - DNA, 22 bp, Homo sapiens
gcacttcacatgccttttcctg

SEQ ID NO: 6933143 - DNA, 22 bp, Homo sapiens
aggctttcctgtcactcatgct

SEQ ID NO: 6933144 - DNA, 22 bp, Homo sapiens
tcatttacatgtctttctctga

SEQ ID NO: 6933145 - DNA, 22 bp, Homo sapiens
gacagcttaggaagtttctatt

SEQ ID NO: 6933146 - DNA, 22 bp, Homo sapiens
aagaaggttgaatgactacttt

SEQ ID NO: 6933147 - DNA, 21 bp, Homo sapiens
ggacaattgttcattttcttt

SEQ ID NO: 6933148 - DNA, 22 bp, Homo sapiens
cagcccaggactgcaggtgttt

SEQ ID NO: 6933149 - DNA, 22 bp, Homo sapiens
ctgtctggaatgcagtacatag

SEQ ID NO: 6933150 - DNA, 22 bp, Homo sapiens
gacaacaataatgtggagctga

SEQ ID NO: 6933151 - DNA, 22 bp, Homo sapiens
tatttgagcgaagcagtgtttt

SEQ ID NO: 6933152 - DNA, 20 bp, Homo sapiens
agcttcagccctaggattgc

SEQ ID NO: 6933153 - DNA, 22 bp, Homo sapiens
atggctgcagagacctgaagaa

SEQ ID NO: 6933154 - DNA, 22 bp, Homo sapiens
cccaggagagaggggataaagc

SEQ ID NO: 6933155 - DNA, 22 bp, Homo sapiens
taggaaacaaagcttagcagga

SEQ ID NO: 6933156 - DNA, 22 bp, Homo sapiens
ttagcaaacatcttcgtgtgag

SEQ ID NO: 6933157 - DNA, 22 bp, Homo sapiens
cagccaagaaagcagtgctcca

SEQ ID NO: 6933158 - DNA, 22 bp, Homo sapiens
ctgggagtccctggaatagctc

SEQ ID NO: 6933159 - DNA, 23 bp, Homo sapiens
tatgttaggtttgcaagccagat

SEQ ID NO: 6933160 - DNA, 22 bp, Homo sapiens
gggcttggtggagagaatgctg

SEQ ID NO: 6933161 - DNA, 22 bp, Homo sapiens
catatcccattggccaggacat

SEQ ID NO: 6933162 - DNA, 22 bp, Homo sapiens
cagaggaagggtgctgcgaaag

SEQ ID NO: 6933163 - DNA, 22 bp, Homo sapiens
atgtgcacagtgctttttccca

SEQ ID NO: 6933164 - DNA, 22 bp, Homo sapiens
tttacttctgcatttcccctag

SEQ ID NO: 6933165 - DNA, 22 bp, Homo sapiens
gaactcttgcagtgaaagctta

SEQ ID NO: 6933166 - DNA, 18 bp, Homo sapiens
gggtcctgttcttggaag

SEQ ID NO: 6933167 - DNA, 22 bp, Homo sapiens
cacagctgccccctctctaact

SEQ ID NO: 6933168 - DNA, 22 bp, Homo sapiens
tctgggcagccgccccatagga

SEQ ID NO: 6933169 - DNA, 22 bp, Homo sapiens
cctttaggagtgaggaccgagc

SEQ ID NO: 6933170 - DNA, 22 bp, Homo sapiens
gaggggatgcagagaggcttat

SEQ ID NO: 6933171 - DNA, 22 bp, Homo sapiens
agatttatgtggtcacactcag

SEQ ID NO: 6933172 - DNA, 22 bp, Homo sapiens
ttatttggaaatatggcttctg

SEQ ID NO: 6933173 - DNA, 22 bp, Homo sapiens
ttaacaaatatttcccatgccc

SEQ ID NO: 6933174 - DNA, 22 bp, Homo sapiens
tagttgaagagatgaatgacca

SEQ ID NO: 6933175 - DNA, 22 bp, Homo sapiens
tcatgccaaaatccagtggctt

SEQ ID NO: 6933176 - DNA, 22 bp, Homo sapiens
tccaatgttcctgctttcagct

SEQ ID NO: 6933177 - DNA, 22 bp, Homo sapiens
caggctgctgacaggcttggag

SEQ ID NO: 6933178 - DNA, 19 bp, Homo sapiens
gggcacagcctccccccag

SEQ ID NO: 6933179 - DNA, 22 bp, Homo sapiens
taatccagcgggtgattgcaca

SEQ ID NO: 6933180 - DNA, 19 bp, Homo sapiens
tggtctaaatgtgtgcccc

SEQ ID NO: 6933181 - DNA, 22 bp, Homo sapiens
aggagttggtgctctccaaata

SEQ ID NO: 6933182 - DNA, 22 bp, Homo sapiens
gagcaggatggcacttctgtga

SEQ ID NO: 6933183 - DNA, 19 bp, Homo sapiens
tgaggagcagctggttgat

SEQ ID NO: 6933184 - DNA, 22 bp, Homo sapiens
aggtaaatataaatcttactct

SEQ ID NO: 6933185 - DNA, 22 bp, Homo sapiens
aatgtgtatatgaacatacagg

SEQ ID NO: 6933186 - DNA, 22 bp, Homo sapiens
ctgaatgaaatcaaggactgag

SEQ ID NO: 6933187 - DNA, 22 bp, Homo sapiens
gcggtggggaaaggaggtgctg

SEQ ID NO: 6933188 - DNA, 22 bp, Homo sapiens
tcccagagttcaatgggaaggt

SEQ ID NO: 6933189 - DNA, 22 bp, Homo sapiens
tacatgcaatgaggattctagt

SEQ ID NO: 6933190 - DNA, 22 bp, Homo sapiens
catttgctgtattttcagattc

SEQ ID NO: 6933191 - DNA, 22 bp, Homo sapiens
ttcttgcaggtcactcactgag

SEQ ID NO: 6933192 - DNA, 22 bp, Homo sapiens
gcctggctctgagtttctctcc

SEQ ID NO: 6933193 - DNA, 22 bp, Homo sapiens
agggaaggtagaggtcaccggc

SEQ ID NO: 6933194 - DNA, 22 bp, Homo sapiens
atatcagacagaaagcattgac

SEQ ID NO: 6933195 - DNA, 22 bp, Homo sapiens
cttgtttaataataccttagca

SEQ ID NO: 6933196 - DNA, 22 bp, Homo sapiens
ctcaaagaagggaggtatttgg

SEQ ID NO: 6933197 - DNA, 22 bp, Homo sapiens
ttgcaggttagagacctgtgga

SEQ ID NO: 6933198 - DNA, 22 bp, Homo sapiens
tgcatgtcaaggcactcaggat

SEQ ID NO: 6933199 - DNA, 22 bp, Homo sapiens
atgaggtattcgtaatatttcc

SEQ ID NO: 6933200 - DNA, 22 bp, Homo sapiens
tttgtcctgtagttacagtgga

SEQ ID NO: 6933201 - DNA, 22 bp, Homo sapiens
actttcaagccctctagagaca

SEQ ID NO: 6933202 - DNA, 22 bp, Homo sapiens
ggctggctgtgccctgtactct

SEQ ID NO: 6933203 - DNA, 22 bp, Homo sapiens
agagcacctttagtatgttacc

SEQ ID NO: 6933204 - DNA, 22 bp, Homo sapiens
gaagtacacgtgtaagcttttc

SEQ ID NO: 6933205 - DNA, 22 bp, Homo sapiens
tggagatgaggacatggacgtc

SEQ ID NO: 6933206 - DNA, 22 bp, Homo sapiens
aattggaaaaagacttaattgc

SEQ ID NO: 6933207 - DNA, 22 bp, Homo sapiens
cagactctcttccatgcatcac

SEQ ID NO: 6933208 - DNA, 22 bp, Homo sapiens
aaacacagcatgtccttgggga

SEQ ID NO: 6933209 - DNA, 22 bp, Homo sapiens
acaaggttcttagagctgggat

SEQ ID NO: 6933210 - DNA, 22 bp, Homo sapiens
agctaatggaacagagatgtca

SEQ ID NO: 6933211 - DNA, 22 bp, Homo sapiens
tttcattgcctttggaaggtct

SEQ ID NO: 6933212 - DNA, 22 bp, Homo sapiens
gcctctgcatcatcactccagc

SEQ ID NO: 6933213 - DNA, 22 bp, Homo sapiens
agcaggtggacagaggaagaaa

SEQ ID NO: 6933214 - DNA, 22 bp, Homo sapiens
gactggggtaaggtgaggaggt

SEQ ID NO: 6933215 - DNA, 22 bp, Homo sapiens
cagcataaaataaatctacatg

SEQ ID NO: 6933216 - DNA, 22 bp, Homo sapiens
aagaggaggattgatgtgggag

SEQ ID NO: 6933217 - DNA, 22 bp, Homo sapiens
aacctctagtatctgtcgtact

SEQ ID NO: 6933218 - DNA, 22 bp, Homo sapiens
ttcagaaaaaacttcaataagt

SEQ ID NO: 6933219 - DNA, 19 bp, Homo sapiens
agaaatctcgagatttgtt

SEQ ID NO: 6933220 - DNA, 18 bp, Homo sapiens
tcagtactgcagagagaa

SEQ ID NO: 6933221 - DNA, 22 bp, Homo sapiens
ttcttttcaagaggggcaagga

SEQ ID NO: 6933222 - DNA, 22 bp, Homo sapiens
ggcctgagaatgtaccagatct

SEQ ID NO: 6933223 - DNA, 22 bp, Homo sapiens
cagtgtctacagtggctggagg

SEQ ID NO: 6933224 - DNA, 22 bp, Homo sapiens
ttcggcttcttagaggcgctcc

SEQ ID NO: 6933225 - DNA, 23 bp, Homo sapiens
tggcacagcaggtgtgctttgtt

SEQ ID NO: 6933226 - DNA, 22 bp, Homo sapiens
gtagggcatagagatgttggca

SEQ ID NO: 6933227 - DNA, 22 bp, Homo sapiens
agtgaccattttcagctagagg

SEQ ID NO: 6933228 - DNA, 22 bp, Homo sapiens
ttgtcctgatttataaaatgaa

SEQ ID NO: 6933229 - DNA, 22 bp, Homo sapiens
ggacagactttacagccccggg

SEQ ID NO: 6933230 - DNA, 22 bp, Homo sapiens
agggccagttcagaggacatgg

SEQ ID NO: 6933231 - DNA, 22 bp, Homo sapiens
tttgattgcaatagttttatga

SEQ ID NO: 6933232 - DNA, 18 bp, Homo sapiens
cagtcccaaaccttagga

SEQ ID NO: 6933233 - DNA, 22 bp, Homo sapiens
atttctcttcctcctagggttg

SEQ ID NO: 6933234 - DNA, 22 bp, Homo sapiens
gcacaccttagaggggagctgc

SEQ ID NO: 6933235 - DNA, 21 bp, Homo sapiens
acacaaacctcctcagcctgg

SEQ ID NO: 6933236 - DNA, 19 bp, Homo sapiens
aaatgtgatggtacaattc

SEQ ID NO: 6933237 - DNA, 22 bp, Homo sapiens
agtagccaccaaccatgtgtgg

SEQ ID NO: 6933238 - DNA, 22 bp, Homo sapiens
atgctttattgttaggtcatgt

SEQ ID NO: 6933239 - DNA, 22 bp, Homo sapiens
gtgggtggatcacctgaggtca

SEQ ID NO: 6933240 - DNA, 22 bp, Homo sapiens
aatgacctgggtgtcatttcat

SEQ ID NO: 6933241 - DNA, 22 bp, Homo sapiens
ctggttggaggagaagtttgga

SEQ ID NO: 6933242 - DNA, 22 bp, Homo sapiens
ctggctgggattttaaagagca

SEQ ID NO: 6933243 - DNA, 22 bp, Homo sapiens
attgtgcagcagtggtacctgg

SEQ ID NO: 6933244 - DNA, 22 bp, Homo sapiens
gcctgcaggctgtagtttgtga

SEQ ID NO: 6933245 - DNA, 22 bp, Homo sapiens
tccaatctagtatgataaatga

SEQ ID NO: 6933246 - DNA, 22 bp, Homo sapiens
cgctgggcaggtccacttgtta

SEQ ID NO: 6933247 - DNA, 22 bp, Homo sapiens
agctgctcgaagccggtggccc

SEQ ID NO: 6933248 - DNA, 22 bp, Homo sapiens
aggtgccagctctcaggcagga

SEQ ID NO: 6933249 - DNA, 22 bp, Homo sapiens
gattccagactatttatactgc

SEQ ID NO: 6933250 - DNA, 22 bp, Homo sapiens
cagcctctttccacatcaggca

SEQ ID NO: 6933251 - DNA, 22 bp, Homo sapiens
catggcaggcttcttcagcctt

SEQ ID NO: 6933252 - DNA, 22 bp, Homo sapiens
ttcttaggagcattagtaattt

SEQ ID NO: 6933253 - DNA, 17 bp, Homo sapiens
agccctgtgctcttttt

SEQ ID NO: 6933254 - DNA, 22 bp, Homo sapiens
cctcgagcagcgacccctccac

SEQ ID NO: 6933255 - DNA, 22 bp, Homo sapiens
gaggcctagtctgcctgctcac

SEQ ID NO: 6933256 - DNA, 22 bp, Homo sapiens
gtaaagtcctacatatgtcagg

SEQ ID NO: 6933257 - DNA, 22 bp, Homo sapiens
tggctgctgtgggtagagggat

SEQ ID NO: 6933258 - DNA, 22 bp, Homo sapiens
ggagaagccaggtgataagcaa

SEQ ID NO: 6933259 - DNA, 22 bp, Homo sapiens
cctttcagatgggcatggaccg

SEQ ID NO: 6933260 - DNA, 22 bp, Homo sapiens
gcatgcatgtgtgcagacagtc

SEQ ID NO: 6933261 - DNA, 22 bp, Homo sapiens
gaagctgtgtgaagctctgaag

SEQ ID NO: 6933262 - DNA, 19 bp, Homo sapiens
aggtgggtaagcagttctc

SEQ ID NO: 6933263 - DNA, 22 bp, Homo sapiens
gtctctatcatagctgaaccct

SEQ ID NO: 6933264 - DNA, 22 bp, Homo sapiens
tgagcctgggctttctctggag

SEQ ID NO: 6933265 - DNA, 22 bp, Homo sapiens
aggaggctgggcacagtggcct

SEQ ID NO: 6933266 - DNA, 22 bp, Homo sapiens
gtccatccggccacctccagcc

SEQ ID NO: 6933267 - DNA, 22 bp, Homo sapiens
ttatttgtgaatcatttatcta

SEQ ID NO: 6933268 - DNA, 22 bp, Homo sapiens
tagctgaataatgcgtctgcag

SEQ ID NO: 6933269 - DNA, 22 bp, Homo sapiens
gtttaataatgttgaattacta

SEQ ID NO: 6933270 - DNA, 22 bp, Homo sapiens
aatctagtttaatatgtttaaa

SEQ ID NO: 6933271 - DNA, 22 bp, Homo sapiens
tccggtccgggtactcctctct

SEQ ID NO: 6933272 - DNA, 22 bp, Homo sapiens
taacagtaccattaactttgat

SEQ ID NO: 6933273 - DNA, 22 bp, Homo sapiens
cttcttgtcagtgatttcttcc

SEQ ID NO: 6933274 - DNA, 22 bp, Homo sapiens
gcaaaattaaacttagcatcat

SEQ ID NO: 6933275 - DNA, 22 bp, Homo sapiens
ggagcctgcgggagctcccatt

SEQ ID NO: 6933276 - DNA, 17 bp, Homo sapiens
cgttggtttgcctcatt

SEQ ID NO: 6933277 - DNA, 22 bp, Homo sapiens
gctccacttgattgttacagca

SEQ ID NO: 6933278 - DNA, 22 bp, Homo sapiens
gactgaacctcaaatttggctc

SEQ ID NO: 6933279 - DNA, 22 bp, Homo sapiens
ggacctgccctggctcagatgc

SEQ ID NO: 6933280 - DNA, 22 bp, Homo sapiens
cagagagggcggccctggcttc

SEQ ID NO: 6933281 - DNA, 22 bp, Homo sapiens
agccagggaggattacacccca

SEQ ID NO: 6933282 - DNA, 22 bp, Homo sapiens
aggggtggcctgccttactccc

SEQ ID NO: 6933283 - DNA, 21 bp, Homo sapiens
gagtcctggctagggtggcag

SEQ ID NO: 6933284 - DNA, 22 bp, Homo sapiens
acaaacagctaacatatgttaa

SEQ ID NO: 6933285 - DNA, 22 bp, Homo sapiens
ttcctggggtgaagatattttt

SEQ ID NO: 6933286 - DNA, 22 bp, Homo sapiens
ctgctgctgagaatgcctcagg

SEQ ID NO: 6933287 - DNA, 22 bp, Homo sapiens
ttgcacagatgcacatggttgc

SEQ ID NO: 6933288 - DNA, 22 bp, Homo sapiens
taatctctctaagtttccattt

SEQ ID NO: 6933289 - DNA, 22 bp, Homo sapiens
tggagacagagatagccaattg

SEQ ID NO: 6933290 - DNA, 22 bp, Homo sapiens
tgactatgtggccttgaccaag

SEQ ID NO: 6933291 - DNA, 22 bp, Homo sapiens
aggcagtccccaggggtgttgc

SEQ ID NO: 6933292 - DNA, 22 bp, Homo sapiens
atctctgcgtccccagcatcga

SEQ ID NO: 6933293 - DNA, 22 bp, Homo sapiens
aagtactacagagctaaatgaa

SEQ ID NO: 6933294 - DNA, 22 bp, Homo sapiens
caactgctgggatggggtagag

SEQ ID NO: 6933295 - DNA, 22 bp, Homo sapiens
agatgtttgtgttatctccatt

SEQ ID NO: 6933296 - DNA, 22 bp, Homo sapiens
ggctgctctgagagtgggtttt

SEQ ID NO: 6933297 - DNA, 22 bp, Homo sapiens
cagcttctgtcctagaaactgg

SEQ ID NO: 6933298 - DNA, 22 bp, Homo sapiens
gtggctcacgcctgtaatccca

SEQ ID NO: 6933299 - DNA, 22 bp, Homo sapiens
tgctatctaggcaaggtggtcc

SEQ ID NO: 6933300 - DNA, 22 bp, Homo sapiens
gttccaggaccctggcctctga

SEQ ID NO: 6933301 - DNA, 22 bp, Homo sapiens
gggccggagctgggtcccgcgc

SEQ ID NO: 6933302 - DNA, 22 bp, Homo sapiens
gtagctcatgccagggactttg

SEQ ID NO: 6933303 - DNA, 22 bp, Homo sapiens
taatcagggatgaaaaatgtca

SEQ ID NO: 6933304 - DNA, 22 bp, Homo sapiens
ttagcagttgtgagaccctaga

SEQ ID NO: 6933305 - DNA, 22 bp, Homo sapiens
gagagcccttaggtttagagtt

SEQ ID NO: 6933306 - DNA, 22 bp, Homo sapiens
tttgggttcagacatgattaca

SEQ ID NO: 6933307 - DNA, 22 bp, Homo sapiens
tccagcagccacacctctggac

SEQ ID NO: 6933308 - DNA, 22 bp, Homo sapiens
acaggacatggcttctgtgacg

SEQ ID NO: 6933309 - DNA, 20 bp, Homo sapiens
aaatgcttttgacacatatt

SEQ ID NO: 6933310 - DNA, 22 bp, Homo sapiens
agaaacagaagggaaagctttt

SEQ ID NO: 6933311 - DNA, 22 bp, Homo sapiens
atattatgctaagggaaataag

SEQ ID NO: 6933312 - DNA, 22 bp, Homo sapiens
agaaaaagaaagtggatttgtc

SEQ ID NO: 6933313 - DNA, 22 bp, Homo sapiens
tacttttctttgtcatgcatct

SEQ ID NO: 6933314 - DNA, 22 bp, Homo sapiens
caagtccaggtcaatttaaagc

SEQ ID NO: 6933315 - DNA, 22 bp, Homo sapiens
aaggaaattaggttattttgct

SEQ ID NO: 6933316 - DNA, 20 bp, Homo sapiens
gtatgacatgcgaaatgcat

SEQ ID NO: 6933317 - DNA, 22 bp, Homo sapiens
ccccttctctgcaagcctgctc

SEQ ID NO: 6933318 - DNA, 22 bp, Homo sapiens
gtgtgtgtactctgtatataaa

SEQ ID NO: 6933319 - DNA, 22 bp, Homo sapiens
aaactagtatgtatattaccaa

SEQ ID NO: 6933320 - DNA, 22 bp, Homo sapiens
tggcagcacattgacccgggct

SEQ ID NO: 6933321 - DNA, 22 bp, Homo sapiens
tggtaatttgagtggacttagt

SEQ ID NO: 6933322 - DNA, 18 bp, Homo sapiens
agtcctggctctaccacc

SEQ ID NO: 6933323 - DNA, 18 bp, Homo sapiens
tctagaaacttctctcct

SEQ ID NO: 6933324 - DNA, 22 bp, Homo sapiens
agagcagctgacagcctgccat

SEQ ID NO: 6933325 - DNA, 22 bp, Homo sapiens
agcatcagagagaagttaacta

SEQ ID NO: 6933326 - DNA, 22 bp, Homo sapiens
cttcttgtatctgccgccgagc

SEQ ID NO: 6933327 - DNA, 22 bp, Homo sapiens
gagcaacacgcagtagtatacg

SEQ ID NO: 6933328 - DNA, 22 bp, Homo sapiens
tacacctgctgagcctgtcctc

SEQ ID NO: 6933329 - DNA, 22 bp, Homo sapiens
cacctgggctttctctggaact

SEQ ID NO: 6933330 - DNA, 22 bp, Homo sapiens
aagaatgtctctggtgaggcgc

SEQ ID NO: 6933331 - DNA, 22 bp, Homo sapiens
taggtgtcaggtatagaattta

SEQ ID NO: 6933332 - DNA, 21 bp, Homo sapiens
agcttcctgcagtgggaggtc

SEQ ID NO: 6933333 - DNA, 22 bp, Homo sapiens
taagctattcctgaagaaggtt

SEQ ID NO: 6933334 - DNA, 21 bp, Homo sapiens
ggtagtattatgtctctctgt

SEQ ID NO: 6933335 - DNA, 22 bp, Homo sapiens
tctggagctggagggcaaggca

SEQ ID NO: 6933336 - DNA, 22 bp, Homo sapiens
gcagtttgaaagtatgagtcca

SEQ ID NO: 6933337 - DNA, 22 bp, Homo sapiens
cctgggtgtcatgggcagctgg

SEQ ID NO: 6933338 - DNA, 17 bp, Homo sapiens
cagtgatcattacatta

SEQ ID NO: 6933339 - DNA, 22 bp, Homo sapiens
ttatgaacaatttctaggaatg

SEQ ID NO: 6933340 - DNA, 22 bp, Homo sapiens
gtggcctttgtccaggcgaaac

SEQ ID NO: 6933341 - DNA, 22 bp, Homo sapiens
agcagaaaattggaaatgacaa

SEQ ID NO: 6933342 - DNA, 22 bp, Homo sapiens
gagcagctggaggccttgttgg

SEQ ID NO: 6933343 - DNA, 22 bp, Homo sapiens
aagaatgttcttgtagtcatga

SEQ ID NO: 6933344 - DNA, 22 bp, Homo sapiens
atagttacatacagaaatattt

SEQ ID NO: 6933345 - DNA, 22 bp, Homo sapiens
aacaggatgtcatttctcatgt

SEQ ID NO: 6933346 - DNA, 22 bp, Homo sapiens
aggaggggcatagaaatgtaat

SEQ ID NO: 6933347 - DNA, 21 bp, Homo sapiens
agcctgcctgaactctgtggc

SEQ ID NO: 6933348 - DNA, 22 bp, Homo sapiens
cctgaggggctgcaggccagct

SEQ ID NO: 6933349 - DNA, 22 bp, Homo sapiens
cagctgaagctcttgtcaaagg

SEQ ID NO: 6933350 - DNA, 22 bp, Homo sapiens
ttcacaactgccatagccagtg

SEQ ID NO: 6933351 - DNA, 22 bp, Homo sapiens
cctggctcccccatcatagctg

SEQ ID NO: 6933352 - DNA, 22 bp, Homo sapiens
gcatgtgtggaggagatgtgct

SEQ ID NO: 6933353 - DNA, 22 bp, Homo sapiens
cttggtcatgcaagatatcgat

SEQ ID NO: 6933354 - DNA, 21 bp, Homo sapiens
tcatgcaggcagagtttggta

SEQ ID NO: 6933355 - DNA, 22 bp, Homo sapiens
aatactgtatgagctatggtag

SEQ ID NO: 6933356 - DNA, 22 bp, Homo sapiens
tgagtaccgctacgttgtccat

SEQ ID NO: 6933357 - DNA, 22 bp, Homo sapiens
agctgaaacttcccattaattg

SEQ ID NO: 6933358 - DNA, 22 bp, Homo sapiens
aacaggctatttctttacaaac

SEQ ID NO: 6933359 - DNA, 22 bp, Homo sapiens
agaggtccccagatgattccag

SEQ ID NO: 6933360 - DNA, 22 bp, Homo sapiens
aaccagctcctcaccccattgt

SEQ ID NO: 6933361 - DNA, 22 bp, Homo sapiens
ccatagagtacctctgtgtgag

SEQ ID NO: 6933362 - DNA, 22 bp, Homo sapiens
acttctctgctacctgcaaaga

SEQ ID NO: 6933363 - DNA, 22 bp, Homo sapiens
ctccagggggcatccacacagc

SEQ ID NO: 6933364 - DNA, 22 bp, Homo sapiens
agaagatgttgcagttgatgcg

SEQ ID NO: 6933365 - DNA, 22 bp, Homo sapiens
cggccgcagcagtgtcggccca

SEQ ID NO: 6933366 - DNA, 22 bp, Homo sapiens
tgtcatcatttgagagaagaaa

SEQ ID NO: 6933367 - DNA, 22 bp, Homo sapiens
ctccctgggcctcagtttctct

SEQ ID NO: 6933368 - DNA, 22 bp, Homo sapiens
gatctgtttgcctagagattta

SEQ ID NO: 6933369 - DNA, 22 bp, Homo sapiens
tggctctccagctctaaggcct

SEQ ID NO: 6933370 - DNA, 22 bp, Homo sapiens
accaaggaagaatctatttgag

SEQ ID NO: 6933371 - DNA, 22 bp, Homo sapiens
cttccatacagacaatgcaatg

SEQ ID NO: 6933372 - DNA, 22 bp, Homo sapiens
agggctgcttacctggaatggc

SEQ ID NO: 6933373 - DNA, 22 bp, Homo sapiens
gaggagctgcagggggagtcta

SEQ ID NO: 6933374 - DNA, 22 bp, Homo sapiens
agaagtctggttgcaaagcgct

SEQ ID NO: 6933375 - DNA, 22 bp, Homo sapiens
aatgttgttggctcttcatgat

SEQ ID NO: 6933376 - DNA, 22 bp, Homo sapiens
tgtggcagtctcactggagggc

SEQ ID NO: 6933377 - DNA, 20 bp, Homo sapiens
tgggctgaggatcaggtgcc

SEQ ID NO: 6933378 - DNA, 22 bp, Homo sapiens
taaatcagtttctcttattggt

SEQ ID NO: 6933379 - DNA, 22 bp, Homo sapiens
gaagctttgagagcagaagccc

SEQ ID NO: 6933380 - DNA, 22 bp, Homo sapiens
gggagaaatgtctggcctgctg

SEQ ID NO: 6933381 - DNA, 20 bp, Homo sapiens
tggcacagaacccttgccta

SEQ ID NO: 6933382 - DNA, 22 bp, Homo sapiens
ccaggtggacaaggctttcaca

SEQ ID NO: 6933383 - DNA, 22 bp, Homo sapiens
tctctgggtcctggcaagctca

SEQ ID NO: 6933384 - DNA, 22 bp, Homo sapiens
gtgagcaattcaaaggcaggaa

SEQ ID NO: 6933385 - DNA, 22 bp, Homo sapiens
taattgtagctttgtaatcagc

SEQ ID NO: 6933386 - DNA, 22 bp, Homo sapiens
gagcctgaatttgacctgctta

SEQ ID NO: 6933387 - DNA, 22 bp, Homo sapiens
atgtgagaataactcaaaacaa

SEQ ID NO: 6933388 - DNA, 22 bp, Homo sapiens
gccaggtctaagcatcagccac

SEQ ID NO: 6933389 - DNA, 22 bp, Homo sapiens
ttaattttgatgaggttcagtt

SEQ ID NO: 6933390 - DNA, 22 bp, Homo sapiens
tgggagaacactgctctggatg

SEQ ID NO: 6933391 - DNA, 22 bp, Homo sapiens
ctgcagctatattttcccacag

SEQ ID NO: 6933392 - DNA, 22 bp, Homo sapiens
atgctgcagtcaggccagattg

SEQ ID NO: 6933393 - DNA, 22 bp, Homo sapiens
ctagagaatcttttaagaagtg

SEQ ID NO: 6933394 - DNA, 22 bp, Homo sapiens
ttgagcacttattggtgttagg

SEQ ID NO: 6933395 - DNA, 22 bp, Homo sapiens
gctatttagtgagtcacatcct

SEQ ID NO: 6933396 - DNA, 19 bp, Homo sapiens
gcataaatacactattgtc

SEQ ID NO: 6933397 - DNA, 22 bp, Homo sapiens
ctggacttggggaggctagatt

SEQ ID NO: 6933398 - DNA, 22 bp, Homo sapiens
ttacacttagggtttgtcagag

SEQ ID NO: 6933399 - DNA, 22 bp, Homo sapiens
gggacacagccatctgtgtttt

SEQ ID NO: 6933400 - DNA, 22 bp, Homo sapiens
cacagaatcatattgtcagttt

SEQ ID NO: 6933401 - DNA, 22 bp, Homo sapiens
cttcagaaactagtaacagcta

SEQ ID NO: 6933402 - DNA, 22 bp, Homo sapiens
cgaaacaggatcttagcccttg

SEQ ID NO: 6933403 - DNA, 22 bp, Homo sapiens
ctgtacttttgcaggtcacagc

SEQ ID NO: 6933404 - DNA, 22 bp, Homo sapiens
gttctaggtatagtaagaaatt

SEQ ID NO: 6933405 - DNA, 22 bp, Homo sapiens
aaataagttaaactagaatgat

SEQ ID NO: 6933406 - DNA, 22 bp, Homo sapiens
tattgctttcagttgctttgag

SEQ ID NO: 6933407 - DNA, 22 bp, Homo sapiens
agtgcagtgatgaataatggtt

SEQ ID NO: 6933408 - DNA, 22 bp, Homo sapiens
tcttcagagtgaaagtctgtga

SEQ ID NO: 6933409 - DNA, 22 bp, Homo sapiens
gtaacctgggatgtagcacaga

SEQ ID NO: 6933410 - DNA, 22 bp, Homo sapiens
cagcagactggagtaggcagtg

SEQ ID NO: 6933411 - DNA, 22 bp, Homo sapiens
aggcaaatccagatttttccac

SEQ ID NO: 6933412 - DNA, 20 bp, Homo sapiens
cattgcatatttcattgagg

SEQ ID NO: 6933413 - DNA, 22 bp, Homo sapiens
gctgtctcatgggtgctagtcc

SEQ ID NO: 6933414 - DNA, 22 bp, Homo sapiens
ccagccctttgtggttcactga

SEQ ID NO: 6933415 - DNA, 22 bp, Homo sapiens
tagcttgtcagtgaatagctgt

SEQ ID NO: 6933416 - DNA, 22 bp, Homo sapiens
gcatccaggtagagcttgcggg

SEQ ID NO: 6933417 - DNA, 22 bp, Homo sapiens
atggccaagagtcgatttgggg

SEQ ID NO: 6933418 - DNA, 23 bp, Homo sapiens
cagaaaacccagagctcagtccc

SEQ ID NO: 6933419 - DNA, 22 bp, Homo sapiens
tgaggggaactgatgcccattg

SEQ ID NO: 6933420 - DNA, 22 bp, Homo sapiens
aactgcatttgcataagtccat

SEQ ID NO: 6933421 - DNA, 22 bp, Homo sapiens
tacttcatgagttaatatgcag

SEQ ID NO: 6933422 - DNA, 22 bp, Homo sapiens
ttcagtttcaaatcctgtgaag

SEQ ID NO: 6933423 - DNA, 22 bp, Homo sapiens
gagccaagatcgcaccactgca

SEQ ID NO: 6933424 - DNA, 22 bp, Homo sapiens
gagtcagaccgactgggctcat

SEQ ID NO: 6933425 - DNA, 22 bp, Homo sapiens
gctgactgtccgctgctcccgg

SEQ ID NO: 6933426 - DNA, 20 bp, Homo sapiens
tgaggtgaatgtcttttaga

SEQ ID NO: 6933427 - DNA, 23 bp, Homo sapiens
tgagatcgcccagctggtaggca

SEQ ID NO: 6933428 - DNA, 22 bp, Homo sapiens
gttcccacgcctcctctccagc

SEQ ID NO: 6933429 - DNA, 22 bp, Homo sapiens
tggcatttcctcagtgctcaga

SEQ ID NO: 6933430 - DNA, 22 bp, Homo sapiens
tttctgtacctcctcttgcccc

SEQ ID NO: 6933431 - DNA, 22 bp, Homo sapiens
agtttgtaaaatgtggcctgga

SEQ ID NO: 6933432 - DNA, 22 bp, Homo sapiens
gggactgtccggcagaaggtac

SEQ ID NO: 6933433 - DNA, 18 bp, Homo sapiens
tgccagccgactggcctg

SEQ ID NO: 6933434 - DNA, 22 bp, Homo sapiens
actccaggttttttcactgaag

SEQ ID NO: 6933435 - DNA, 22 bp, Homo sapiens
ataatggaaaagatcatttcct

SEQ ID NO: 6933436 - DNA, 18 bp, Homo sapiens
agggtcagtgtcactggc

SEQ ID NO: 6933437 - DNA, 22 bp, Homo sapiens
ggctgttcctctgagagctgat

SEQ ID NO: 6933438 - DNA, 22 bp, Homo sapiens
atgtcccagacactttatctta

SEQ ID NO: 6933439 - DNA, 22 bp, Homo sapiens
ccactgtaagtttgaaaataac

SEQ ID NO: 6933440 - DNA, 22 bp, Homo sapiens
tttaaagtgctgctcctatcct

SEQ ID NO: 6933441 - DNA, 22 bp, Homo sapiens
cactggtgtacaggaggtaaaa

SEQ ID NO: 6933442 - DNA, 22 bp, Homo sapiens
ctctaacaccacagtgtggttt

SEQ ID NO: 6933443 - DNA, 22 bp, Homo sapiens
actgtactcggggaaatggggt

SEQ ID NO: 6933444 - DNA, 22 bp, Homo sapiens
cactggctgagcttctctaggg

SEQ ID NO: 6933445 - DNA, 22 bp, Homo sapiens
ttgtaactctgaatacatccta

SEQ ID NO: 6933446 - DNA, 22 bp, Homo sapiens
tgctggccgtgagctctcggga

SEQ ID NO: 6933447 - DNA, 22 bp, Homo sapiens
ttgtccaaggtcccacagttag

SEQ ID NO: 6933448 - DNA, 22 bp, Homo sapiens
gttgagctctccagcttcattt

SEQ ID NO: 6933449 - DNA, 22 bp, Homo sapiens
cacagctgccctactccatgtg

SEQ ID NO: 6933450 - DNA, 22 bp, Homo sapiens
gtcatgtgacccaacctgagcc

SEQ ID NO: 6933451 - DNA, 22 bp, Homo sapiens
tttagtaccatcatttgcctct

SEQ ID NO: 6933452 - DNA, 22 bp, Homo sapiens
tgaaattagtgaagttacagtt

SEQ ID NO: 6933453 - DNA, 21 bp, Homo sapiens
agagagggagatgaaacatcc

SEQ ID NO: 6933454 - DNA, 22 bp, Homo sapiens
ttcatgcttgttcctccacctg

SEQ ID NO: 6933455 - DNA, 22 bp, Homo sapiens
catggcagggctgtgggcaggt

SEQ ID NO: 6933456 - DNA, 22 bp, Homo sapiens
caggaggattgcttgaggccag

SEQ ID NO: 6933457 - DNA, 22 bp, Homo sapiens
cacagcattcacagaaagacat

SEQ ID NO: 6933458 - DNA, 22 bp, Homo sapiens
gggcttcagttctgaccatctt

SEQ ID NO: 6933459 - DNA, 22 bp, Homo sapiens
tgcacacattctatggggctga

SEQ ID NO: 6933460 - DNA, 18 bp, Homo sapiens
taacaatcctgagtgtct

SEQ ID NO: 6933461 - DNA, 22 bp, Homo sapiens
acaaatgccatatataaattct

SEQ ID NO: 6933462 - DNA, 22 bp, Homo sapiens
tcccaaagctactcttctgact

SEQ ID NO: 6933463 - DNA, 22 bp, Homo sapiens
ctgcatcattttcagacaatgg

SEQ ID NO: 6933464 - DNA, 18 bp, Homo sapiens
tctgaaagcccttttcca

SEQ ID NO: 6933465 - DNA, 21 bp, Homo sapiens
tgcactttgggggacaggctg

SEQ ID NO: 6933466 - DNA, 22 bp, Homo sapiens
catatgtactgtttgctttcaa

SEQ ID NO: 6933467 - DNA, 22 bp, Homo sapiens
ggacacacaagttatctaatga

SEQ ID NO: 6933468 - DNA, 22 bp, Homo sapiens
aagtgtttacttaaagtcatgg

SEQ ID NO: 6933469 - DNA, 22 bp, Homo sapiens
gaagtagaaaactcagtttcaa

SEQ ID NO: 6933470 - DNA, 22 bp, Homo sapiens
ctcagagaggcagtggaagtca

SEQ ID NO: 6933471 - DNA, 22 bp, Homo sapiens
tgacaccttgctcttggacttc

SEQ ID NO: 6933472 - DNA, 22 bp, Homo sapiens
acagctcttaggcagaaccaac

SEQ ID NO: 6933473 - DNA, 21 bp, Homo sapiens
tttcagacctatctttgaagg

SEQ ID NO: 6933474 - DNA, 22 bp, Homo sapiens
tcatctatttatgtagaacaag

SEQ ID NO: 6933475 - DNA, 22 bp, Homo sapiens
taaatcagtagatatggtatag

SEQ ID NO: 6933476 - DNA, 22 bp, Homo sapiens
aaagcacatagtagaaggattt

SEQ ID NO: 6933477 - DNA, 22 bp, Homo sapiens
cctgaggttgaagtataaattg

SEQ ID NO: 6933478 - DNA, 22 bp, Homo sapiens
cagtggaagactcagctctccc

SEQ ID NO: 6933479 - DNA, 22 bp, Homo sapiens
tcatccagtaccatggaaggca

SEQ ID NO: 6933480 - DNA, 22 bp, Homo sapiens
cttctgtgcgcctctattccct

SEQ ID NO: 6933481 - DNA, 22 bp, Homo sapiens
aaaaaatcagatctttggttaa

SEQ ID NO: 6933482 - DNA, 22 bp, Homo sapiens
agtggaccagaagactgaagct

SEQ ID NO: 6933483 - DNA, 22 bp, Homo sapiens
gaaataatacagtgctcttctc

SEQ ID NO: 6933484 - DNA, 22 bp, Homo sapiens
tccccacctacacactgctcct

SEQ ID NO: 6933485 - DNA, 22 bp, Homo sapiens
atgtccagagggttttattttg

SEQ ID NO: 6933486 - DNA, 22 bp, Homo sapiens
tcctaggctccagaactgtgaa

SEQ ID NO: 6933487 - DNA, 22 bp, Homo sapiens
tcacatgcacatacttcctgtg

SEQ ID NO: 6933488 - DNA, 22 bp, Homo sapiens
actctgtgaagatgcaggcttg

SEQ ID NO: 6933489 - DNA, 22 bp, Homo sapiens
ttcctaaaggataggtcagttt

SEQ ID NO: 6933490 - DNA, 22 bp, Homo sapiens
ctttgttagcagccaatttgtt

SEQ ID NO: 6933491 - DNA, 22 bp, Homo sapiens
agatgcagatttggattcagga

SEQ ID NO: 6933492 - DNA, 22 bp, Homo sapiens
ataaactaattggggtatagtt

SEQ ID NO: 6933493 - DNA, 22 bp, Homo sapiens
aacccgtgatcctgactcccct

SEQ ID NO: 6933494 - DNA, 20 bp, Homo sapiens
cctgctgagccagtgtgagg

SEQ ID NO: 6933495 - DNA, 22 bp, Homo sapiens
cctcttggagtctatcattctg

SEQ ID NO: 6933496 - DNA, 22 bp, Homo sapiens
gccagtggccctctggagaagg

SEQ ID NO: 6933497 - DNA, 22 bp, Homo sapiens
gcccacaggggacctggtggct

SEQ ID NO: 6933498 - DNA, 22 bp, Homo sapiens
ggcctcagggtcactctgtaga

SEQ ID NO: 6933499 - DNA, 21 bp, Homo sapiens
acttggtccacattagtcatt

SEQ ID NO: 6933500 - DNA, 22 bp, Homo sapiens
tcctcaggcggtgaggaggggc

SEQ ID NO: 6933501 - DNA, 22 bp, Homo sapiens
ctgtgctgaggatgcagtttct

SEQ ID NO: 6933502 - DNA, 22 bp, Homo sapiens
ggggcgctcggagggatcccct

SEQ ID NO: 6933503 - DNA, 22 bp, Homo sapiens
cttgtgtagtgctccacagtga

SEQ ID NO: 6933504 - DNA, 22 bp, Homo sapiens
catttattgagtggccacagtg

SEQ ID NO: 6933505 - DNA, 22 bp, Homo sapiens
ctttcctagatggccatctttc

SEQ ID NO: 6933506 - DNA, 22 bp, Homo sapiens
attccacttccactagtttctc

SEQ ID NO: 6933507 - DNA, 22 bp, Homo sapiens
actggctggccacaccctggta

SEQ ID NO: 6933508 - DNA, 22 bp, Homo sapiens
cagaaagcttaggcaagttgga

SEQ ID NO: 6933509 - DNA, 22 bp, Homo sapiens
tcacaggttccagggatgagaa

SEQ ID NO: 6933510 - DNA, 22 bp, Homo sapiens
ccattgcactccatcctgggca

SEQ ID NO: 6933511 - DNA, 22 bp, Homo sapiens
tcactatgttcggagaactctg

SEQ ID NO: 6933512 - DNA, 22 bp, Homo sapiens
gtgcttgcagtgagatgagatg

SEQ ID NO: 6933513 - DNA, 23 bp, Homo sapiens
gttattgctggtgctggccagcc

SEQ ID NO: 6933514 - DNA, 22 bp, Homo sapiens
gaagcctgtcacttcccttgct

SEQ ID NO: 6933515 - DNA, 22 bp, Homo sapiens
ccagagggagccaccagggtgt

SEQ ID NO: 6933516 - DNA, 22 bp, Homo sapiens
atacaaagtattgatcctgagt

SEQ ID NO: 6933517 - DNA, 22 bp, Homo sapiens
aaacaatgtagattaccattta

SEQ ID NO: 6933518 - DNA, 22 bp, Homo sapiens
ctcaggcagttgtttgcatagt

SEQ ID NO: 6933519 - DNA, 22 bp, Homo sapiens
tgtattatcaagtaaatacatg

SEQ ID NO: 6933520 - DNA, 22 bp, Homo sapiens
catgggctcaaccttgaccaca

SEQ ID NO: 6933521 - DNA, 22 bp, Homo sapiens
actgcaggtggatggcacttta

SEQ ID NO: 6933522 - DNA, 22 bp, Homo sapiens
aatcagccatttttccaaggag

SEQ ID NO: 6933523 - DNA, 21 bp, Homo sapiens
cactttaatggatatttgttt

SEQ ID NO: 6933524 - DNA, 22 bp, Homo sapiens
ttaactggggaagcatttcatg

SEQ ID NO: 6933525 - DNA, 22 bp, Homo sapiens
ccacgtccagctaattttcgta

SEQ ID NO: 6933526 - DNA, 22 bp, Homo sapiens
aatgttctgatgtagggtttag

SEQ ID NO: 6933527 - DNA, 22 bp, Homo sapiens
aaatgcaagttcatattttgtt

SEQ ID NO: 6933528 - DNA, 22 bp, Homo sapiens
tctctctcctagtttttagtgg

SEQ ID NO: 6933529 - DNA, 22 bp, Homo sapiens
ctgggctccactcccacagtgt

SEQ ID NO: 6933530 - DNA, 23 bp, Homo sapiens
attttacaggtcagttccttgaa

SEQ ID NO: 6933531 - DNA, 22 bp, Homo sapiens
taggaagatgagtatcaacttg

SEQ ID NO: 6933532 - DNA, 22 bp, Homo sapiens
atgtctggaggtcatctggtta

SEQ ID NO: 6933533 - DNA, 22 bp, Homo sapiens
gttctaggctaggggagtaaga

SEQ ID NO: 6933534 - DNA, 22 bp, Homo sapiens
cagtttagtgttgcatttggag

SEQ ID NO: 6933535 - DNA, 22 bp, Homo sapiens
tgctcagagggtgatgtcattt

SEQ ID NO: 6933536 - DNA, 21 bp, Homo sapiens
tctggtctgctgtggacctgg

SEQ ID NO: 6933537 - DNA, 22 bp, Homo sapiens
gaggttagcagtatcttctagt

SEQ ID NO: 6933538 - DNA, 22 bp, Homo sapiens
acctttcattaaagtctgtagt

SEQ ID NO: 6933539 - DNA, 22 bp, Homo sapiens
ggaagtttgtatactggcctct

SEQ ID NO: 6933540 - DNA, 22 bp, Homo sapiens
tgggctgcttctattggtggtc

SEQ ID NO: 6933541 - DNA, 22 bp, Homo sapiens
tcggaggatatcacagagcttt

SEQ ID NO: 6933542 - DNA, 22 bp, Homo sapiens
ggtctgtgatcttatggattct

SEQ ID NO: 6933543 - DNA, 22 bp, Homo sapiens
ttggccctttatgggatgggca

SEQ ID NO: 6933544 - DNA, 22 bp, Homo sapiens
gcacggcaagacggggcctcct

SEQ ID NO: 6933545 - DNA, 22 bp, Homo sapiens
ctggcacaaaagaaaactgcca

SEQ ID NO: 6933546 - DNA, 22 bp, Homo sapiens
ctcataggtttggaaccaggta

SEQ ID NO: 6933547 - DNA, 22 bp, Homo sapiens
aacaagtgatgctcatgattca

SEQ ID NO: 6933548 - DNA, 22 bp, Homo sapiens
gcaggagctgctctcctgacga

SEQ ID NO: 6933549 - DNA, 17 bp, Homo sapiens
gagcagggatgcggttc

SEQ ID NO: 6933550 - DNA, 22 bp, Homo sapiens
aacactgtgcccaccctagtcc

SEQ ID NO: 6933551 - DNA, 22 bp, Homo sapiens
catcagaaagagtcctggactt

SEQ ID NO: 6933552 - DNA, 22 bp, Homo sapiens
acagtaatttattgaacacctt

SEQ ID NO: 6933553 - DNA, 22 bp, Homo sapiens
gaccttgtgatctgcctgcctt

SEQ ID NO: 6933554 - DNA, 22 bp, Homo sapiens
gatgctggaagtgctgatcttg

SEQ ID NO: 6933555 - DNA, 22 bp, Homo sapiens
aaatgatgctacagttttccca

SEQ ID NO: 6933556 - DNA, 20 bp, Homo sapiens
tcctgcagttcctaggaggg

SEQ ID NO: 6933557 - DNA, 22 bp, Homo sapiens
aatgtacagctgtctttcctcc

SEQ ID NO: 6933558 - DNA, 22 bp, Homo sapiens
cagttctgagctttcccagaag

SEQ ID NO: 6933559 - DNA, 22 bp, Homo sapiens
ctgggagctcagccctggggtg

SEQ ID NO: 6933560 - DNA, 22 bp, Homo sapiens
gccagagcatgcactgcctgca

SEQ ID NO: 6933561 - DNA, 22 bp, Homo sapiens
cctgcacctaacacaacgctct

SEQ ID NO: 6933562 - DNA, 22 bp, Homo sapiens
ctttacttcagcaagctttcct

SEQ ID NO: 6933563 - DNA, 22 bp, Homo sapiens
tggttgaaaaacattggctttt

SEQ ID NO: 6933564 - DNA, 23 bp, Homo sapiens
tagatagcacactgacatctgac

SEQ ID NO: 6933565 - DNA, 22 bp, Homo sapiens
gagctgcagaaggggttttcct

SEQ ID NO: 6933566 - DNA, 22 bp, Homo sapiens
atttggatatcactgaatacat

SEQ ID NO: 6933567 - DNA, 22 bp, Homo sapiens
tctgggctgggagcgtgtggac

SEQ ID NO: 6933568 - DNA, 22 bp, Homo sapiens
gctgtgggtttccaatcctgga

SEQ ID NO: 6933569 - DNA, 22 bp, Homo sapiens
tccagccccgggatgttcttca

SEQ ID NO: 6933570 - DNA, 19 bp, Homo sapiens
ctctgaggattagctgtgg

SEQ ID NO: 6933571 - DNA, 22 bp, Homo sapiens
atgaagctgaggttctctttga

SEQ ID NO: 6933572 - DNA, 22 bp, Homo sapiens
cattccagatgaggccaggccc

SEQ ID NO: 6933573 - DNA, 22 bp, Homo sapiens
tctcctgatgatggtactggca

SEQ ID NO: 6933574 - DNA, 22 bp, Homo sapiens
tcctgggactcaacttagaagg

SEQ ID NO: 6933575 - DNA, 20 bp, Homo sapiens
aaagtcccttagtgggagca

SEQ ID NO: 6933576 - DNA, 22 bp, Homo sapiens
ctttcttcaagctggtctcaat

SEQ ID NO: 6933577 - DNA, 22 bp, Homo sapiens
tccttgttgctgcagtcacctg

SEQ ID NO: 6933578 - DNA, 22 bp, Homo sapiens
atgatgaaattttctatcatgt

SEQ ID NO: 6933579 - DNA, 22 bp, Homo sapiens
gatatttttaggtgatgcaggc

SEQ ID NO: 6933580 - DNA, 22 bp, Homo sapiens
agcagctcagaggcaccagggc

SEQ ID NO: 6933581 - DNA, 22 bp, Homo sapiens
gctaagggaggcatgccgtggt

SEQ ID NO: 6933582 - DNA, 22 bp, Homo sapiens
ttgcgcctccctgtgccaggca

SEQ ID NO: 6933583 - DNA, 20 bp, Homo sapiens
aggggcctggaacaggcctt

SEQ ID NO: 6933584 - DNA, 22 bp, Homo sapiens
tgcagtgtcttgtggacttgag

SEQ ID NO: 6933585 - DNA, 22 bp, Homo sapiens
tgtaaatgtgaatttccttttc

SEQ ID NO: 6933586 - DNA, 22 bp, Homo sapiens
aagtggcagaatagtggcagga

SEQ ID NO: 6933587 - DNA, 22 bp, Homo sapiens
gaggtaattactatgttcagat

SEQ ID NO: 6933588 - DNA, 22 bp, Homo sapiens
agctcttcctgcacctgtggct

SEQ ID NO: 6933589 - DNA, 22 bp, Homo sapiens
ggctttatattgtttgagcaga

SEQ ID NO: 6933590 - DNA, 22 bp, Homo sapiens
agctgggtttctggcaggctta

SEQ ID NO: 6933591 - DNA, 20 bp, Homo sapiens
tgtggcctctagagacagcc

SEQ ID NO: 6933592 - DNA, 22 bp, Homo sapiens
gctttggaacttaaatccttgg

SEQ ID NO: 6933593 - DNA, 22 bp, Homo sapiens
gtctcctccagtaggaagtggc

SEQ ID NO: 6933594 - DNA, 22 bp, Homo sapiens
ttccaagtctaagttataaatc

SEQ ID NO: 6933595 - DNA, 22 bp, Homo sapiens
catctcactgaggggtttacaa

SEQ ID NO: 6933596 - DNA, 22 bp, Homo sapiens
tgtccccacccaaatctcatct

SEQ ID NO: 6933597 - DNA, 21 bp, Homo sapiens
aggagggcacaaggccaggaa

SEQ ID NO: 6933598 - DNA, 19 bp, Homo sapiens
gcagtgtcatggtaggagc

SEQ ID NO: 6933599 - DNA, 22 bp, Homo sapiens
atgatgtaccactttctcagtt

SEQ ID NO: 6933600 - DNA, 22 bp, Homo sapiens
tggcagctggctctgcgcaggc

SEQ ID NO: 6933601 - DNA, 22 bp, Homo sapiens
gaaaacttggatctctagaatg

SEQ ID NO: 6933602 - DNA, 22 bp, Homo sapiens
agtcactaggctgaaagtggag

SEQ ID NO: 6933603 - DNA, 19 bp, Homo sapiens
aacatctgtaactattttc

SEQ ID NO: 6933604 - DNA, 17 bp, Homo sapiens
caggcagacatgtaagc

SEQ ID NO: 6933605 - DNA, 22 bp, Homo sapiens
tttgccatgtaggttaatcatt

SEQ ID NO: 6933606 - DNA, 22 bp, Homo sapiens
atttggtagaggctcggtgtta

SEQ ID NO: 6933607 - DNA, 22 bp, Homo sapiens
agcagtgttttagccatttctg

SEQ ID NO: 6933608 - DNA, 22 bp, Homo sapiens
tcagtttaatacccagatgcct

SEQ ID NO: 6933609 - DNA, 22 bp, Homo sapiens
tggaggccgcaatgcagtttcc

SEQ ID NO: 6933610 - DNA, 22 bp, Homo sapiens
gaaggtagctgctgagatgaca

SEQ ID NO: 6933611 - DNA, 22 bp, Homo sapiens
tagaacttattagaaaggctca

SEQ ID NO: 6933612 - DNA, 19 bp, Homo sapiens
tcaggagcagcttctgaac

SEQ ID NO: 6933613 - DNA, 22 bp, Homo sapiens
ttttcccatctacaaagcaggg

SEQ ID NO: 6933614 - DNA, 22 bp, Homo sapiens
ttgcatgtgtaatttttctaaa

SEQ ID NO: 6933615 - DNA, 16 bp, Homo sapiens
gatctgttctatttca

SEQ ID NO: 6933616 - DNA, 19 bp, Homo sapiens
ccttcctccccagggccat

SEQ ID NO: 6933617 - DNA, 22 bp, Homo sapiens
cagcttgttaccaagggtggct

SEQ ID NO: 6933618 - DNA, 22 bp, Homo sapiens
cagtatgtttattagaactgca

SEQ ID NO: 6933619 - DNA, 22 bp, Homo sapiens
tggaggccaactttcctcatct

SEQ ID NO: 6933620 - DNA, 22 bp, Homo sapiens
taagaattgtgttgaatagagt

SEQ ID NO: 6933621 - DNA, 22 bp, Homo sapiens
aagaataaattaagatacttag

SEQ ID NO: 6933622 - DNA, 22 bp, Homo sapiens
aggagcctccatggtcacattc

SEQ ID NO: 6933623 - DNA, 22 bp, Homo sapiens
ttctggagatagtcaggcatta

SEQ ID NO: 6933624 - DNA, 22 bp, Homo sapiens
ggaaacacagaggctgagctca

SEQ ID NO: 6933625 - DNA, 22 bp, Homo sapiens
gaggggtcacatgggctggctt

SEQ ID NO: 6933626 - DNA, 22 bp, Homo sapiens
aagctgaaacattagcctaaac

SEQ ID NO: 6933627 - DNA, 23 bp, Homo sapiens
atctgaaaaggcattttcttccc

SEQ ID NO: 6933628 - DNA, 22 bp, Homo sapiens
actgttacagagcaggaaattg

SEQ ID NO: 6933629 - DNA, 22 bp, Homo sapiens
tcaagatgattgcttcaggccc

SEQ ID NO: 6933630 - DNA, 22 bp, Homo sapiens
gctcagagatggggaatgaaaa

SEQ ID NO: 6933631 - DNA, 22 bp, Homo sapiens
ggcaggtgccttctgtgctagc

SEQ ID NO: 6933632 - DNA, 22 bp, Homo sapiens
acagtctttaatttctttgtgg

SEQ ID NO: 6933633 - DNA, 22 bp, Homo sapiens
agtgttagtggctgcagctggt

SEQ ID NO: 6933634 - DNA, 22 bp, Homo sapiens
aggtcctgacgccctttgaaat

SEQ ID NO: 6933635 - DNA, 22 bp, Homo sapiens
aggcagaggagaatgatcttcc

SEQ ID NO: 6933636 - DNA, 22 bp, Homo sapiens
tggtcctgtagctctctaagtt

SEQ ID NO: 6933637 - DNA, 22 bp, Homo sapiens
tcttcgtagcatcgtgctggct

SEQ ID NO: 6933638 - DNA, 22 bp, Homo sapiens
aaggtttctccgaggctatttt

SEQ ID NO: 6933639 - DNA, 22 bp, Homo sapiens
tacattcaacatgtcactatgt

SEQ ID NO: 6933640 - DNA, 22 bp, Homo sapiens
tcctgagtgagagctgggaggt

SEQ ID NO: 6933641 - DNA, 20 bp, Homo sapiens
tcttaaatccccagggccat

SEQ ID NO: 6933642 - DNA, 22 bp, Homo sapiens
tagtgggtttatacaatttaaa

SEQ ID NO: 6933643 - DNA, 22 bp, Homo sapiens
gtgcaggtttaggaagcagctc

SEQ ID NO: 6933644 - DNA, 20 bp, Homo sapiens
acctcctggaagcaggtgcc

SEQ ID NO: 6933645 - DNA, 22 bp, Homo sapiens
agtaatgaatacggtatttgaa

SEQ ID NO: 6933646 - DNA, 21 bp, Homo sapiens
tagggctctctgtgtcaggtg

SEQ ID NO: 6933647 - DNA, 19 bp, Homo sapiens
atatagcattattcaattt

SEQ ID NO: 6933648 - DNA, 22 bp, Homo sapiens
tgccccaggtgctgaggttgga

SEQ ID NO: 6933649 - DNA, 22 bp, Homo sapiens
tggactatcatatctctgtgca

SEQ ID NO: 6933650 - DNA, 22 bp, Homo sapiens
ctcagagaaaaggagcaagggt

SEQ ID NO: 6933651 - DNA, 22 bp, Homo sapiens
atacagatgttgaatgttatat

SEQ ID NO: 6933652 - DNA, 22 bp, Homo sapiens
agccaagagacagatgcccacc

SEQ ID NO: 6933653 - DNA, 22 bp, Homo sapiens
gagcttcctgatgccgaccagt

SEQ ID NO: 6933654 - DNA, 22 bp, Homo sapiens
aacattgaatttaaaatacagt

SEQ ID NO: 6933655 - DNA, 17 bp, Homo sapiens
ccactgactctgacttc

SEQ ID NO: 6933656 - DNA, 22 bp, Homo sapiens
gcaaaagtacagccggatttct

SEQ ID NO: 6933657 - DNA, 22 bp, Homo sapiens
taaagtgcttcctaacccagag

SEQ ID NO: 6933658 - DNA, 22 bp, Homo sapiens
cttagcagagcagagtggatca

SEQ ID NO: 6933659 - DNA, 22 bp, Homo sapiens
agcacagccagctttattggcc

SEQ ID NO: 6933660 - DNA, 22 bp, Homo sapiens
cagtggatggtttgtcttgcct

SEQ ID NO: 6933661 - DNA, 22 bp, Homo sapiens
cctgtgagagggcgagtgtaga

SEQ ID NO: 6933662 - DNA, 22 bp, Homo sapiens
tgccacccagccaggagtggga

SEQ ID NO: 6933663 - DNA, 22 bp, Homo sapiens
ctggcttttagtgtgaagactt

SEQ ID NO: 6933664 - DNA, 22 bp, Homo sapiens
atacttctttagcatattgaac

SEQ ID NO: 6933665 - DNA, 22 bp, Homo sapiens
ttagtaggagagcttgttcatt

SEQ ID NO: 6933666 - DNA, 22 bp, Homo sapiens
tgtgccatttctattctgcagc

SEQ ID NO: 6933667 - DNA, 21 bp, Homo sapiens
tctctgtatccatgggttcca

SEQ ID NO: 6933668 - DNA, 22 bp, Homo sapiens
gaggggcagttgattgtgctat

SEQ ID NO: 6933669 - DNA, 22 bp, Homo sapiens
tgcaaaggaggatgggaaagaa

SEQ ID NO: 6933670 - DNA, 22 bp, Homo sapiens
tctttcccagtagctctcccag

SEQ ID NO: 6933671 - DNA, 22 bp, Homo sapiens
aacagtttttaaagctggcttc

SEQ ID NO: 6933672 - DNA, 22 bp, Homo sapiens
tctaagccccgtggaaagggaa

SEQ ID NO: 6933673 - DNA, 22 bp, Homo sapiens
aagagacaagaattccaacgct

SEQ ID NO: 6933674 - DNA, 22 bp, Homo sapiens
tacagtattactgtgttgtttt

SEQ ID NO: 6933675 - DNA, 22 bp, Homo sapiens
gcacctggacagtgaccctagc

SEQ ID NO: 6933676 - DNA, 22 bp, Homo sapiens
tgaagccaatctgccaggcaga

SEQ ID NO: 6933677 - DNA, 22 bp, Homo sapiens
taactgaacatctcaaatcaag

SEQ ID NO: 6933678 - DNA, 22 bp, Homo sapiens
tcttcagtgcatgttacctata

SEQ ID NO: 6933679 - DNA, 22 bp, Homo sapiens
tgtaatactccattgtatggat

SEQ ID NO: 6933680 - DNA, 22 bp, Homo sapiens
caatttgccctgttaaattttc

SEQ ID NO: 6933681 - DNA, 21 bp, Homo sapiens
catttcagtaaggaagcctgt

SEQ ID NO: 6933682 - DNA, 22 bp, Homo sapiens
agcagccacagtctgggacagg

SEQ ID NO: 6933683 - DNA, 22 bp, Homo sapiens
agtgcatagggggatgcacagc

SEQ ID NO: 6933684 - DNA, 22 bp, Homo sapiens
ctttaatcaagataagtatact

SEQ ID NO: 6933685 - DNA, 22 bp, Homo sapiens
tgggacacctcagatagtgtct

SEQ ID NO: 6933686 - DNA, 22 bp, Homo sapiens
agcagacatatctcatgtcaca

SEQ ID NO: 6933687 - DNA, 22 bp, Homo sapiens
cagctgttgatctcttaagcct

SEQ ID NO: 6933688 - DNA, 22 bp, Homo sapiens
agcatcttcaacaggcatttta

SEQ ID NO: 6933689 - DNA, 22 bp, Homo sapiens
tcccaggcgcctggtggggagc

SEQ ID NO: 6933690 - DNA, 19 bp, Homo sapiens
gtgaggtctttccttttgt

SEQ ID NO: 6933691 - DNA, 22 bp, Homo sapiens
tacacttgttcaaacagcaaaa

SEQ ID NO: 6933692 - DNA, 23 bp, Homo sapiens
acctgtctgcctcccaccatcaa

SEQ ID NO: 6933693 - DNA, 22 bp, Homo sapiens
aggctaggctgatgcctcttcc

SEQ ID NO: 6933694 - DNA, 22 bp, Homo sapiens
cagttgctggatgtgcagctct

SEQ ID NO: 6933695 - DNA, 22 bp, Homo sapiens
ctaaagatctacagaggctttt

SEQ ID NO: 6933696 - DNA, 22 bp, Homo sapiens
tttctcgcgtttgagctctcag

SEQ ID NO: 6933697 - DNA, 22 bp, Homo sapiens
gatggctttgaggaatttgaat

SEQ ID NO: 6933698 - DNA, 22 bp, Homo sapiens
cagcagtggccatctgtgtggt

SEQ ID NO: 6933699 - DNA, 22 bp, Homo sapiens
aggctctggacagtgaggagtt

SEQ ID NO: 6933700 - DNA, 22 bp, Homo sapiens
gttggccaggctggtctcaaac

SEQ ID NO: 6933701 - DNA, 22 bp, Homo sapiens
tgtgtgtgcacatgcatataca

SEQ ID NO: 6933702 - DNA, 23 bp, Homo sapiens
tgtgttcagtcaaggatcagagt

SEQ ID NO: 6933703 - DNA, 22 bp, Homo sapiens
aggacacacaaagagtgagaac

SEQ ID NO: 6933704 - DNA, 22 bp, Homo sapiens
aagtaagtaagtctcttttctg

SEQ ID NO: 6933705 - DNA, 22 bp, Homo sapiens
tagcaggtgctcatttaactcc

SEQ ID NO: 6933706 - DNA, 23 bp, Homo sapiens
tagaatcctctgagatggaatag

SEQ ID NO: 6933707 - DNA, 22 bp, Homo sapiens
aagggaatgttgtggctggttt

SEQ ID NO: 6933708 - DNA, 22 bp, Homo sapiens
gcattcatcttcctccatgcag

SEQ ID NO: 6933709 - DNA, 22 bp, Homo sapiens
ggtgcagctgcagcctgggagc

SEQ ID NO: 6933710 - DNA, 22 bp, Homo sapiens
ggaatgcactagactgtgaaac

SEQ ID NO: 6933711 - DNA, 20 bp, Homo sapiens
cctctgccccggggctgcta

SEQ ID NO: 6933712 - DNA, 22 bp, Homo sapiens
agcccctgggagtagctgctgc

SEQ ID NO: 6933713 - DNA, 22 bp, Homo sapiens
ctgctggtaccagtggccgtca

SEQ ID NO: 6933714 - DNA, 22 bp, Homo sapiens
tagtacactctgtaagtttaaa

SEQ ID NO: 6933715 - DNA, 22 bp, Homo sapiens
agtagcttatagccaaagagag

SEQ ID NO: 6933716 - DNA, 22 bp, Homo sapiens
atgccatcaatgacagagttag

SEQ ID NO: 6933717 - DNA, 22 bp, Homo sapiens
ttcttcctcacactctcaccca

SEQ ID NO: 6933718 - DNA, 22 bp, Homo sapiens
atatttcttgagcacctggtat

SEQ ID NO: 6933719 - DNA, 22 bp, Homo sapiens
ggggcccgggcactggccgtca

SEQ ID NO: 6933720 - DNA, 22 bp, Homo sapiens
tactgcctggagcattggtgct

SEQ ID NO: 6933721 - DNA, 22 bp, Homo sapiens
tggctttataaatccactggtt

SEQ ID NO: 6933722 - DNA, 23 bp, Homo sapiens
tgtaacagagcactgattgacaa

SEQ ID NO: 6933723 - DNA, 22 bp, Homo sapiens
gaagtctgggaggggcccaata

SEQ ID NO: 6933724 - DNA, 22 bp, Homo sapiens
ctctgagactcaagtgagtggg

SEQ ID NO: 6933725 - DNA, 22 bp, Homo sapiens
tgaatgagtggattctgagtag

SEQ ID NO: 6933726 - DNA, 22 bp, Homo sapiens
ttgctctgtccagccagcaggt

SEQ ID NO: 6933727 - DNA, 22 bp, Homo sapiens
tataggctcttgttaacctttt

SEQ ID NO: 6933728 - DNA, 22 bp, Homo sapiens
gagacagagtttcactcttgtt

SEQ ID NO: 6933729 - DNA, 22 bp, Homo sapiens
ggcaggacaggggaatgtttgg

SEQ ID NO: 6933730 - DNA, 22 bp, Homo sapiens
cagcaaattttaatactgcttt

SEQ ID NO: 6933731 - DNA, 22 bp, Homo sapiens
tcccttgggagtggtgaccaca

SEQ ID NO: 6933732 - DNA, 20 bp, Homo sapiens
tttttctgggcttccatagc

SEQ ID NO: 6933733 - DNA, 22 bp, Homo sapiens
gtgattctgatatagctaaagt

SEQ ID NO: 6933734 - DNA, 22 bp, Homo sapiens
catatgaagttcaacagagatg

SEQ ID NO: 6933735 - DNA, 22 bp, Homo sapiens
ttttcattagaatgactgagaa

SEQ ID NO: 6933736 - DNA, 22 bp, Homo sapiens
agttctgtctgacaccgaagtt

SEQ ID NO: 6933737 - DNA, 22 bp, Homo sapiens
tatattcaacaggctaatgtca

SEQ ID NO: 6933738 - DNA, 22 bp, Homo sapiens
cacagtgaagcatgcagacatc

SEQ ID NO: 6933739 - DNA, 22 bp, Homo sapiens
cactggttccccaggtgcctag

SEQ ID NO: 6933740 - DNA, 23 bp, Homo sapiens
ggctcctggattcaaatcctgcc

SEQ ID NO: 6933741 - DNA, 22 bp, Homo sapiens
cggccaaattgcagagagaagc

SEQ ID NO: 6933742 - DNA, 22 bp, Homo sapiens
agctttccactatcttaggggt

SEQ ID NO: 6933743 - DNA, 22 bp, Homo sapiens
accagcacctgataggcagtaa

SEQ ID NO: 6933744 - DNA, 22 bp, Homo sapiens
aaaagttagctattagtaggtg

SEQ ID NO: 6933745 - DNA, 22 bp, Homo sapiens
tttcaagacgttaagtcagctt

SEQ ID NO: 6933746 - DNA, 22 bp, Homo sapiens
tggctacagaattggccctgtt

SEQ ID NO: 6933747 - DNA, 22 bp, Homo sapiens
ctccaaggaagccccaagggat

SEQ ID NO: 6933748 - DNA, 22 bp, Homo sapiens
gcagctggctcagagaggtggg

SEQ ID NO: 6933749 - DNA, 22 bp, Homo sapiens
tttctttccatacatattgcta

SEQ ID NO: 6933750 - DNA, 22 bp, Homo sapiens
attggtgcaattatgagggtgt

SEQ ID NO: 6933751 - DNA, 22 bp, Homo sapiens
aggtggcagagtgacaggctga

SEQ ID NO: 6933752 - DNA, 23 bp, Homo sapiens
ttcatcagttgctgttgcagaac

SEQ ID NO: 6933753 - DNA, 22 bp, Homo sapiens
attgctgactttaatattatat

SEQ ID NO: 6933754 - DNA, 22 bp, Homo sapiens
atggacagtgctgcttcagagg

SEQ ID NO: 6933755 - DNA, 20 bp, Homo sapiens
atacagatggttccagctgg

SEQ ID NO: 6933756 - DNA, 22 bp, Homo sapiens
gattcaatgttgcagatggaat

SEQ ID NO: 6933757 - DNA, 22 bp, Homo sapiens
atttcatgtttcatctacctaa

SEQ ID NO: 6933758 - DNA, 22 bp, Homo sapiens
atcatttgaacagaatttgttt

SEQ ID NO: 6933759 - DNA, 18 bp, Homo sapiens
agttgcttattctgtgca

SEQ ID NO: 6933760 - DNA, 22 bp, Homo sapiens
tgcttaataggagttgaacatt

SEQ ID NO: 6933761 - DNA, 22 bp, Homo sapiens
attacacaggatttgccttact

SEQ ID NO: 6933762 - DNA, 22 bp, Homo sapiens
agacccaggattggggctgccg

SEQ ID NO: 6933763 - DNA, 18 bp, Homo sapiens
aatgctattgttataggg

SEQ ID NO: 6933764 - DNA, 22 bp, Homo sapiens
agcagcatagaagctgggagga

SEQ ID NO: 6933765 - DNA, 22 bp, Homo sapiens
gagtcagatgaagataaaaggg

SEQ ID NO: 6933766 - DNA, 22 bp, Homo sapiens
ctaatctgtgaaataggtatga

SEQ ID NO: 6933767 - DNA, 22 bp, Homo sapiens
taaatctctcagtggccagaga

SEQ ID NO: 6933768 - DNA, 22 bp, Homo sapiens
gtccttaaatgctgctgcagga

SEQ ID NO: 6933769 - DNA, 22 bp, Homo sapiens
acccaggagctctggggtcctc

SEQ ID NO: 6933770 - DNA, 23 bp, Homo sapiens
aaatgcagggtcgcaggttacag

SEQ ID NO: 6933771 - DNA, 22 bp, Homo sapiens
aggaacacaacttcctgagagc

SEQ ID NO: 6933772 - DNA, 22 bp, Homo sapiens
ggtgtttagacagggcccctct

SEQ ID NO: 6933773 - DNA, 22 bp, Homo sapiens
cctgtctgtcctttgcattctt

SEQ ID NO: 6933774 - DNA, 22 bp, Homo sapiens
aggaagggttctttgtgaaaga

SEQ ID NO: 6933775 - DNA, 22 bp, Homo sapiens
ggctagaaactcaggcaagaaa

SEQ ID NO: 6933776 - DNA, 22 bp, Homo sapiens
atttccagtcctaatgatctgg

SEQ ID NO: 6933777 - DNA, 22 bp, Homo sapiens
gaatgcagtggtgagatcttgg

SEQ ID NO: 6933778 - DNA, 22 bp, Homo sapiens
gctcctctcccagagctgcagg

SEQ ID NO: 6933779 - DNA, 22 bp, Homo sapiens
cagcacagtcctttgcttactg

SEQ ID NO: 6933780 - DNA, 22 bp, Homo sapiens
aaacagtcctctttatttagtc

SEQ ID NO: 6933781 - DNA, 22 bp, Homo sapiens
aacttctaatctgtacagtttt

SEQ ID NO: 6933782 - DNA, 23 bp, Homo sapiens
ggctccttgcccatccagcagcc

SEQ ID NO: 6933783 - DNA, 22 bp, Homo sapiens
tgtgtgcagctgaaaagcgctg

SEQ ID NO: 6933784 - DNA, 16 bp, Homo sapiens
ggcactggcaggtcct

SEQ ID NO: 6933785 - DNA, 22 bp, Homo sapiens
cctcagggtggcatcagatctt

SEQ ID NO: 6933786 - DNA, 16 bp, Homo sapiens
aacaatgccaatccag

SEQ ID NO: 6933787 - DNA, 22 bp, Homo sapiens
gcaggaccaggcacgagggcca

SEQ ID NO: 6933788 - DNA, 22 bp, Homo sapiens
agatggctgattaactccatgg

SEQ ID NO: 6933789 - DNA, 23 bp, Homo sapiens
tacagcaaggacaacataggtgg

SEQ ID NO: 6933790 - DNA, 22 bp, Homo sapiens
tatcacatttggagatttatga

SEQ ID NO: 6933791 - DNA, 22 bp, Homo sapiens
tgatggtctagtcaaattgcca

SEQ ID NO: 6933792 - DNA, 20 bp, Homo sapiens
ccaagagcatgcatgaggaa

SEQ ID NO: 6933793 - DNA, 22 bp, Homo sapiens
caggtaaggtcacattctgaag

SEQ ID NO: 6933794 - DNA, 22 bp, Homo sapiens
ttcctgaacatttctaagttga

SEQ ID NO: 6933795 - DNA, 22 bp, Homo sapiens
cgtctctggcccggcccctggg

SEQ ID NO: 6933796 - DNA, 22 bp, Homo sapiens
tgccccttctacccgtctctgt

SEQ ID NO: 6933797 - DNA, 22 bp, Homo sapiens
agtgacagtttcaggcattttt

SEQ ID NO: 6933798 - DNA, 22 bp, Homo sapiens
acacggaatcccttttgtgaca

SEQ ID NO: 6933799 - DNA, 22 bp, Homo sapiens
caatggttgattaaaatttagc

SEQ ID NO: 6933800 - DNA, 22 bp, Homo sapiens
agagtactgctgctgggtactg

SEQ ID NO: 6933801 - DNA, 22 bp, Homo sapiens
atctttaggcaagttacttaac

SEQ ID NO: 6933802 - DNA, 22 bp, Homo sapiens
cagacgggtggtctgcgaggcc

SEQ ID NO: 6933803 - DNA, 19 bp, Homo sapiens
ctggccacacctgctggtt

SEQ ID NO: 6933804 - DNA, 18 bp, Homo sapiens
aacagtttccagattctc

SEQ ID NO: 6933805 - DNA, 22 bp, Homo sapiens
ccagcccaaagtcaccccggga

SEQ ID NO: 6933806 - DNA, 22 bp, Homo sapiens
cacagtgtgggcatggtgcctg

SEQ ID NO: 6933807 - DNA, 22 bp, Homo sapiens
acatttgagcatctactaagtg

SEQ ID NO: 6933808 - DNA, 22 bp, Homo sapiens
caggcgtcactgccacgggtat

SEQ ID NO: 6933809 - DNA, 22 bp, Homo sapiens
gaagttagttggggcccaagaa

SEQ ID NO: 6933810 - DNA, 22 bp, Homo sapiens
acttatgaatgtcattataatg

SEQ ID NO: 6933811 - DNA, 22 bp, Homo sapiens
gattgtctgtgatcatgagcaa

SEQ ID NO: 6933812 - DNA, 22 bp, Homo sapiens
tggtggctgtaagggagagaag

SEQ ID NO: 6933813 - DNA, 22 bp, Homo sapiens
agaggcttcctgccacctgaga

SEQ ID NO: 6933814 - DNA, 22 bp, Homo sapiens
agatttcccaaatacttgttat

SEQ ID NO: 6933815 - DNA, 21 bp, Homo sapiens
gctgccctggctcagcattca

SEQ ID NO: 6933816 - DNA, 23 bp, Homo sapiens
tccaaactcaagacattaataag

SEQ ID NO: 6933817 - DNA, 22 bp, Homo sapiens
gagccagattttatgcaagaca

SEQ ID NO: 6933818 - DNA, 22 bp, Homo sapiens
tcaagagcatgtatctccctaa

SEQ ID NO: 6933819 - DNA, 22 bp, Homo sapiens
ggagcagcttgcatgctcaggg

SEQ ID NO: 6933820 - DNA, 22 bp, Homo sapiens
gaagctgggtcgctgggatcct

SEQ ID NO: 6933821 - DNA, 22 bp, Homo sapiens
tagtgccatagataggaccatt

SEQ ID NO: 6933822 - DNA, 22 bp, Homo sapiens
ggggttggtttaaatgcttgag

SEQ ID NO: 6933823 - DNA, 22 bp, Homo sapiens
attcacattttatttcactgga

SEQ ID NO: 6933824 - DNA, 22 bp, Homo sapiens
ctgaaatgacggtttggggcaa

SEQ ID NO: 6933825 - DNA, 22 bp, Homo sapiens
tgatttttaaaattctccttgc

SEQ ID NO: 6933826 - DNA, 22 bp, Homo sapiens
tgtctgtcccctgccttgaggg

SEQ ID NO: 6933827 - DNA, 22 bp, Homo sapiens
gtgatgtcagacatctggtatt

SEQ ID NO: 6933828 - DNA, 22 bp, Homo sapiens
ctgggaaggagggttgcgaagg

SEQ ID NO: 6933829 - DNA, 22 bp, Homo sapiens
atgcttctgttgcttaggaggt

SEQ ID NO: 6933830 - DNA, 22 bp, Homo sapiens
tgtaccaagacaaatcagaaac

SEQ ID NO: 6933831 - DNA, 22 bp, Homo sapiens
acctgtttggaggaggtgttag

SEQ ID NO: 6933832 - DNA, 22 bp, Homo sapiens
gcatttgtacaaaatgcagtag

SEQ ID NO: 6933833 - DNA, 22 bp, Homo sapiens
caggggctccctgggtgccagt

SEQ ID NO: 6933834 - DNA, 22 bp, Homo sapiens
ataatttaattttcacagtggt

SEQ ID NO: 6933835 - DNA, 22 bp, Homo sapiens
cctgggaatcggtgcgttgagg

SEQ ID NO: 6933836 - DNA, 22 bp, Homo sapiens
tctcctcccaggctcttccagg

SEQ ID NO: 6933837 - DNA, 22 bp, Homo sapiens
ttggtgagtatggacacagaga

SEQ ID NO: 6933838 - DNA, 22 bp, Homo sapiens
gtcaagtttatccgctcattca

SEQ ID NO: 6933839 - DNA, 22 bp, Homo sapiens
tcatgcaggaccaccccagcat

SEQ ID NO: 6933840 - DNA, 22 bp, Homo sapiens
atccttaaaggaattctgattt

SEQ ID NO: 6933841 - DNA, 22 bp, Homo sapiens
agcacttctcatgggatcaggt

SEQ ID NO: 6933842 - DNA, 19 bp, Homo sapiens
aggaaggcggcggctgccc

SEQ ID NO: 6933843 - DNA, 22 bp, Homo sapiens
gcacagtacctgtcacagaggc

SEQ ID NO: 6933844 - DNA, 22 bp, Homo sapiens
ccaaggtttattttgatacatt

SEQ ID NO: 6933845 - DNA, 19 bp, Homo sapiens
gccctgagagcttgggttc

SEQ ID NO: 6933846 - DNA, 22 bp, Homo sapiens
tccttgaagcaacgtgcagaca

SEQ ID NO: 6933847 - DNA, 22 bp, Homo sapiens
tcagggcatctcttaagtggtg

SEQ ID NO: 6933848 - DNA, 23 bp, Homo sapiens
tagatcttcatctaattctgtag

SEQ ID NO: 6933849 - DNA, 23 bp, Homo sapiens
ttcttctcaattagttgattcag

SEQ ID NO: 6933850 - DNA, 22 bp, Homo sapiens
catgctgcaggagctcttctca

SEQ ID NO: 6933851 - DNA, 22 bp, Homo sapiens
gtaatttttagttcattctatc

SEQ ID NO: 6933852 - DNA, 22 bp, Homo sapiens
ttgctgataccatgaatgttaa

SEQ ID NO: 6933853 - DNA, 22 bp, Homo sapiens
actgtaaagcttttctcatgcg

SEQ ID NO: 6933854 - DNA, 19 bp, Homo sapiens
agcaggtgggtaagaaaat

SEQ ID NO: 6933855 - DNA, 22 bp, Homo sapiens
tgacactgacctaaagacctgg

SEQ ID NO: 6933856 - DNA, 21 bp, Homo sapiens
gccatcaccaagctcttcccc

SEQ ID NO: 6933857 - DNA, 22 bp, Homo sapiens
cacagtgtctgtgcttcagtgt

SEQ ID NO: 6933858 - DNA, 22 bp, Homo sapiens
accttttttcagaactctaaag

SEQ ID NO: 6933859 - DNA, 22 bp, Homo sapiens
gaggtccagggtggggcctgag

SEQ ID NO: 6933860 - DNA, 22 bp, Homo sapiens
attctcaactactgcgagagct

SEQ ID NO: 6933861 - DNA, 22 bp, Homo sapiens
ctggttcaatggggctgagccc

SEQ ID NO: 6933862 - DNA, 22 bp, Homo sapiens
tttgatccagggcttacacata

SEQ ID NO: 6933863 - DNA, 22 bp, Homo sapiens
gtccaattctccttccctgggt

SEQ ID NO: 6933864 - DNA, 22 bp, Homo sapiens
aatatgatccttaaccttcatg

SEQ ID NO: 6933865 - DNA, 22 bp, Homo sapiens
tttgggctcttgctgacctggg

SEQ ID NO: 6933866 - DNA, 23 bp, Homo sapiens
ttaggcacttagtagggccagag

SEQ ID NO: 6933867 - DNA, 22 bp, Homo sapiens
caggggtattcaaggtagttta

SEQ ID NO: 6933868 - DNA, 22 bp, Homo sapiens
ggacaggtgactgcccagagtg

SEQ ID NO: 6933869 - DNA, 22 bp, Homo sapiens
ctcagttttaagactactcttt

SEQ ID NO: 6933870 - DNA, 21 bp, Homo sapiens
agccagctatcacacagcatt

SEQ ID NO: 6933871 - DNA, 22 bp, Homo sapiens
gtggcctggctggcaccacctc

SEQ ID NO: 6933872 - DNA, 22 bp, Homo sapiens
aagccactcacaataactgtcc

SEQ ID NO: 6933873 - DNA, 22 bp, Homo sapiens
tccttggcaagacacagcacag

SEQ ID NO: 6933874 - DNA, 22 bp, Homo sapiens
ctcccagtgttgttttctgatg

SEQ ID NO: 6933875 - DNA, 22 bp, Homo sapiens
ttccggggatagtgtttcccat

SEQ ID NO: 6933876 - DNA, 22 bp, Homo sapiens
ccatgagaagttagactagcca

SEQ ID NO: 6933877 - DNA, 22 bp, Homo sapiens
ataatgagcttttgaatactga

SEQ ID NO: 6933878 - DNA, 22 bp, Homo sapiens
ggctgtgggtgtgacaggcctc

SEQ ID NO: 6933879 - DNA, 22 bp, Homo sapiens
ggcttggaattggtaggatgta

SEQ ID NO: 6933880 - DNA, 20 bp, Homo sapiens
tctctattcccacgaggaaa

SEQ ID NO: 6933881 - DNA, 22 bp, Homo sapiens
tgcattaaatataatctgttga

SEQ ID NO: 6933882 - DNA, 22 bp, Homo sapiens
tactcactattctatcagatag

SEQ ID NO: 6933883 - DNA, 22 bp, Homo sapiens
aggaactctgtctccagagttg

SEQ ID NO: 6933884 - DNA, 22 bp, Homo sapiens
ttgacacaggaaagttgtaact

SEQ ID NO: 6933885 - DNA, 22 bp, Homo sapiens
gaactaaatgaaattactggtg

SEQ ID NO: 6933886 - DNA, 22 bp, Homo sapiens
ctgagccttgatgtcccttgtc

SEQ ID NO: 6933887 - DNA, 22 bp, Homo sapiens
cagagggctgtgtaaggatgtt

SEQ ID NO: 6933888 - DNA, 22 bp, Homo sapiens
tattgtccatgtgtctgttagc

SEQ ID NO: 6933889 - DNA, 22 bp, Homo sapiens
ccacatggtcctcatttactct

SEQ ID NO: 6933890 - DNA, 22 bp, Homo sapiens
gccaggctgtttttattactgt

SEQ ID NO: 6933891 - DNA, 22 bp, Homo sapiens
ccagggcagggaccacgtgtct

SEQ ID NO: 6933892 - DNA, 21 bp, Homo sapiens
tatttattaatttgtaaggct

SEQ ID NO: 6933893 - DNA, 22 bp, Homo sapiens
agtctgagtatctctgagccag

SEQ ID NO: 6933894 - DNA, 22 bp, Homo sapiens
gtgctcactgtgagacgtcctg

SEQ ID NO: 6933895 - DNA, 22 bp, Homo sapiens
aaaggttttcatcacagcaaga

SEQ ID NO: 6933896 - DNA, 22 bp, Homo sapiens
tcagagctaaggggagagcaaa

SEQ ID NO: 6933897 - DNA, 22 bp, Homo sapiens
agccctgctgcttcttgtattt

SEQ ID NO: 6933898 - DNA, 22 bp, Homo sapiens
aagttgctttccggcgggcagg

SEQ ID NO: 6933899 - DNA, 22 bp, Homo sapiens
ttttcctctgtatttgaaatgc

SEQ ID NO: 6933900 - DNA, 22 bp, Homo sapiens
atcagaaaatacccagtgttta

SEQ ID NO: 6933901 - DNA, 22 bp, Homo sapiens
catggctgaacactcagtgact

SEQ ID NO: 6933902 - DNA, 20 bp, Homo sapiens
ttctgcttttgcttagggac

SEQ ID NO: 6933903 - DNA, 22 bp, Homo sapiens
tcagactgcttagctcccagta

SEQ ID NO: 6933904 - DNA, 22 bp, Homo sapiens
tggtttatgctgttgcagctct

SEQ ID NO: 6933905 - DNA, 22 bp, Homo sapiens
cccaggaggtagaggttgcagt

SEQ ID NO: 6933906 - DNA, 22 bp, Homo sapiens
aggctgtcctctcttgctcagt

SEQ ID NO: 6933907 - DNA, 22 bp, Homo sapiens
aggtctgctatgtgagcaatac

SEQ ID NO: 6933908 - DNA, 22 bp, Homo sapiens
aactgtggccagggactggagt

SEQ ID NO: 6933909 - DNA, 22 bp, Homo sapiens
cttagtttttgccctggagttt

SEQ ID NO: 6933910 - DNA, 22 bp, Homo sapiens
gaggcctgggttggaggtgcat

SEQ ID NO: 6933911 - DNA, 22 bp, Homo sapiens
ttagaggactgtaggtgggaat

SEQ ID NO: 6933912 - DNA, 22 bp, Homo sapiens
aattacacagggatcacttttt

SEQ ID NO: 6933913 - DNA, 22 bp, Homo sapiens
ctttacacaatgattttcttta

SEQ ID NO: 6933914 - DNA, 21 bp, Homo sapiens
tttggcagtttcccaggaaat

SEQ ID NO: 6933915 - DNA, 22 bp, Homo sapiens
gacttcttcatgtcttttccac

SEQ ID NO: 6933916 - DNA, 22 bp, Homo sapiens
aaatgcctagaaatcacgcaga

SEQ ID NO: 6933917 - DNA, 22 bp, Homo sapiens
agcagctcctctaggaacggat

SEQ ID NO: 6933918 - DNA, 22 bp, Homo sapiens
tattcctagtaaaaatgcgcac

SEQ ID NO: 6933919 - DNA, 22 bp, Homo sapiens
ctcagagtcccttccctcgtgg

SEQ ID NO: 6933920 - DNA, 22 bp, Homo sapiens
atagccaggtcacagagctagc

SEQ ID NO: 6933921 - DNA, 22 bp, Homo sapiens
tccatcaccatttctgcgagct

SEQ ID NO: 6933922 - DNA, 22 bp, Homo sapiens
agctgtgtcctgaagacactgc

SEQ ID NO: 6933923 - DNA, 22 bp, Homo sapiens
ttctgagggaggttctctggga

SEQ ID NO: 6933924 - DNA, 22 bp, Homo sapiens
ttgtacaaagatttcacagctc

SEQ ID NO: 6933925 - DNA, 19 bp, Homo sapiens
tgtgtggttggtgaaactc

SEQ ID NO: 6933926 - DNA, 22 bp, Homo sapiens
cagggccaccctctgctgggtg

SEQ ID NO: 6933927 - DNA, 22 bp, Homo sapiens
tgtggactagtgtttggatttt

SEQ ID NO: 6933928 - DNA, 22 bp, Homo sapiens
aggacttcaaatggaaacaaaa

SEQ ID NO: 6933929 - DNA, 23 bp, Homo sapiens
gtgcacagtcaagcccagcttag

SEQ ID NO: 6933930 - DNA, 22 bp, Homo sapiens
atctgtcctctgtctggaggct

SEQ ID NO: 6933931 - DNA, 21 bp, Homo sapiens
ctgataattgttaaattattt

SEQ ID NO: 6933932 - DNA, 22 bp, Homo sapiens
cccagcacaggcaattccatac

SEQ ID NO: 6933933 - DNA, 22 bp, Homo sapiens
cagcccagagaaggggcccgtg

SEQ ID NO: 6933934 - DNA, 22 bp, Homo sapiens
gcattgaaggcattttatctac

SEQ ID NO: 6933935 - DNA, 22 bp, Homo sapiens
ttggcaatgtctaaacacattt

SEQ ID NO: 6933936 - DNA, 21 bp, Homo sapiens
gctgcaaattctaacaattat

SEQ ID NO: 6933937 - DNA, 22 bp, Homo sapiens
aagctttttggatttgcttcag

SEQ ID NO: 6933938 - DNA, 22 bp, Homo sapiens
ggcttgatcacataggtctccc

SEQ ID NO: 6933939 - DNA, 22 bp, Homo sapiens
ctccagtggcacaaatgggtgc

SEQ ID NO: 6933940 - DNA, 22 bp, Homo sapiens
ttcagagcttagaatggactac

SEQ ID NO: 6933941 - DNA, 22 bp, Homo sapiens
ttagagttaggatttgtcttta

SEQ ID NO: 6933942 - DNA, 22 bp, Homo sapiens
cttacaaatacacttaggagag

SEQ ID NO: 6933943 - DNA, 22 bp, Homo sapiens
tacaatagggaggtttagggga

SEQ ID NO: 6933944 - DNA, 22 bp, Homo sapiens
gcgttggggaccccgaagctgg

SEQ ID NO: 6933945 - DNA, 22 bp, Homo sapiens
gagcctgagcaatgtgatgttt

SEQ ID NO: 6933946 - DNA, 22 bp, Homo sapiens
aactatggtattctgatgtttc

SEQ ID NO: 6933947 - DNA, 22 bp, Homo sapiens
cagtgctaccccggaagttggt

SEQ ID NO: 6933948 - DNA, 21 bp, Homo sapiens
atggcttctcaggtgcactga

SEQ ID NO: 6933949 - DNA, 22 bp, Homo sapiens
agaagggagagaaagttggtta

SEQ ID NO: 6933950 - DNA, 22 bp, Homo sapiens
aaaggactagtctttctaccat

SEQ ID NO: 6933951 - DNA, 22 bp, Homo sapiens
tggcagaggctctgtgatgttg

SEQ ID NO: 6933952 - DNA, 22 bp, Homo sapiens
tattggtgatgacttgaggcca

SEQ ID NO: 6933953 - DNA, 22 bp, Homo sapiens
tgaacaggtgccttcagggagt

SEQ ID NO: 6933954 - DNA, 22 bp, Homo sapiens
aatgaagacacatctttctcat

SEQ ID NO: 6933955 - DNA, 22 bp, Homo sapiens
tggggctcctcctggcaggagg

SEQ ID NO: 6933956 - DNA, 22 bp, Homo sapiens
gctaaataatcttcttctgaca

SEQ ID NO: 6933957 - DNA, 22 bp, Homo sapiens
aggcaccaggatcagttagaga

SEQ ID NO: 6933958 - DNA, 22 bp, Homo sapiens
catgtaatgctgggagctgggc

SEQ ID NO: 6933959 - DNA, 22 bp, Homo sapiens
aaacatgagcatctcttcaagc

SEQ ID NO: 6933960 - DNA, 22 bp, Homo sapiens
acagtacagctgaaactttagt

SEQ ID NO: 6933961 - DNA, 22 bp, Homo sapiens
gtgtgtaaacctccaatctggg

SEQ ID NO: 6933962 - DNA, 17 bp, Homo sapiens
agtgtttccttatcatt

SEQ ID NO: 6933963 - DNA, 22 bp, Homo sapiens
aatgtatgctgtggtatcttct

SEQ ID NO: 6933964 - DNA, 22 bp, Homo sapiens
ccagtcaaaaggaagtcaatgt

SEQ ID NO: 6933965 - DNA, 22 bp, Homo sapiens
tggtgtcaagcagaactgtgaa

SEQ ID NO: 6933966 - DNA, 22 bp, Homo sapiens
tatgcactgaaaattaacagtt

SEQ ID NO: 6933967 - DNA, 22 bp, Homo sapiens
agtgaatttaaaacactgagga

SEQ ID NO: 6933968 - DNA, 22 bp, Homo sapiens
aataagctgctaggaacttagt

SEQ ID NO: 6933969 - DNA, 22 bp, Homo sapiens
tgttttccggcctcagcacgcc

SEQ ID NO: 6933970 - DNA, 22 bp, Homo sapiens
caggcccagaggcctcttccca

SEQ ID NO: 6933971 - DNA, 22 bp, Homo sapiens
gcaaactgcattctatagcttg

SEQ ID NO: 6933972 - DNA, 22 bp, Homo sapiens
atgcaggagccctcttgagggc

SEQ ID NO: 6933973 - DNA, 22 bp, Homo sapiens
ttttcctttgattcccagatgt

SEQ ID NO: 6933974 - DNA, 22 bp, Homo sapiens
ccaagctgagcaccatctgatc

SEQ ID NO: 6933975 - DNA, 22 bp, Homo sapiens
cccagccagcctcttcccatat

SEQ ID NO: 6933976 - DNA, 22 bp, Homo sapiens
ctggagcaggcttgtcccagct

SEQ ID NO: 6933977 - DNA, 22 bp, Homo sapiens
agtaaatttctgcatgtgtact

SEQ ID NO: 6933978 - DNA, 22 bp, Homo sapiens
aaagcaatggcacatgatggta

SEQ ID NO: 6933979 - DNA, 18 bp, Homo sapiens
caatttcatccttaagcc

SEQ ID NO: 6933980 - DNA, 22 bp, Homo sapiens
gggtgcctacatgtcctccatg

SEQ ID NO: 6933981 - DNA, 22 bp, Homo sapiens
tggcactgaagctggaaagcct

SEQ ID NO: 6933982 - DNA, 22 bp, Homo sapiens
acctccctggccttctgattcc

SEQ ID NO: 6933983 - DNA, 22 bp, Homo sapiens
tgtgaatatacttaatgccact

SEQ ID NO: 6933984 - DNA, 22 bp, Homo sapiens
cttcctcccccacacactcact

SEQ ID NO: 6933985 - DNA, 22 bp, Homo sapiens
ccagtgggtaggccatggtgag

SEQ ID NO: 6933986 - DNA, 22 bp, Homo sapiens
gtcaatatcttggttgtactat

SEQ ID NO: 6933987 - DNA, 22 bp, Homo sapiens
gagctgtgcttataccaattca

SEQ ID NO: 6933988 - DNA, 23 bp, Homo sapiens
cccagagtcatctgtagctgtgg

SEQ ID NO: 6933989 - DNA, 22 bp, Homo sapiens
gtgctgagctgcagatgcgctc

SEQ ID NO: 6933990 - DNA, 22 bp, Homo sapiens
tgagatcaaaattggtattaga

SEQ ID NO: 6933991 - DNA, 22 bp, Homo sapiens
tgcagtgatgcttctggctcag

SEQ ID NO: 6933992 - DNA, 22 bp, Homo sapiens
tgtgtcccttggaacctcagct

SEQ ID NO: 6933993 - DNA, 22 bp, Homo sapiens
aagtttttgattctaagagaga

SEQ ID NO: 6933994 - DNA, 23 bp, Homo sapiens
tgcaaagatttaatgcaggggca

SEQ ID NO: 6933995 - DNA, 22 bp, Homo sapiens
agaaggccctgtgtggtctgag

SEQ ID NO: 6933996 - DNA, 22 bp, Homo sapiens
aaacagactgaagagttgaagc

SEQ ID NO: 6933997 - DNA, 22 bp, Homo sapiens
tctggagtgtgtgtattcagct

SEQ ID NO: 6933998 - DNA, 22 bp, Homo sapiens
cccaggtggcagaagctgcagt

SEQ ID NO: 6933999 - DNA, 23 bp, Homo sapiens
ttttgacaggaggaaggtgttga

SEQ ID NO: 6934000 - DNA, 22 bp, Homo sapiens
aacgtagaggaagtagttttca

SEQ ID NO: 6934001 - DNA, 22 bp, Homo sapiens
tttagctttgaaggatatggtt

SEQ ID NO: 6934002 - DNA, 22 bp, Homo sapiens
atatattgtatctttcatgggg

SEQ ID NO: 6934003 - DNA, 22 bp, Homo sapiens
tattttgtgccatgcactgcct

SEQ ID NO: 6934004 - DNA, 22 bp, Homo sapiens
agccagcttctttacggtggca

SEQ ID NO: 6934005 - DNA, 22 bp, Homo sapiens
aacagtctaaattatacccttt

SEQ ID NO: 6934006 - DNA, 22 bp, Homo sapiens
tggtccaggcacccttctagag

SEQ ID NO: 6934007 - DNA, 22 bp, Homo sapiens
cctgggctcaagtgatggtccc

SEQ ID NO: 6934008 - DNA, 22 bp, Homo sapiens
cacactttcaggtcctctttgc

SEQ ID NO: 6934009 - DNA, 22 bp, Homo sapiens
atgtgttaattggagcagcagg

SEQ ID NO: 6934010 - DNA, 22 bp, Homo sapiens
gcagaggtgtgggaggggccac

SEQ ID NO: 6934011 - DNA, 22 bp, Homo sapiens
actctggctattcactataata

SEQ ID NO: 6934012 - DNA, 22 bp, Homo sapiens
aatgagtgtcacatgtggagtc

SEQ ID NO: 6934013 - DNA, 22 bp, Homo sapiens
ccagggaatctctgagtgtgtt

SEQ ID NO: 6934014 - DNA, 22 bp, Homo sapiens
cacttcaccactaggctatact

SEQ ID NO: 6934015 - DNA, 22 bp, Homo sapiens
tgtctgagtcatgcagagatat

SEQ ID NO: 6934016 - DNA, 22 bp, Homo sapiens
tgaagtcagttccggttggtgt

SEQ ID NO: 6934017 - DNA, 22 bp, Homo sapiens
cttgccagtgttgcagaagctc

SEQ ID NO: 6934018 - DNA, 22 bp, Homo sapiens
gtcactttgaagctgtttttag

SEQ ID NO: 6934019 - DNA, 22 bp, Homo sapiens
gatggcccagtcttgggacagt

SEQ ID NO: 6934020 - DNA, 22 bp, Homo sapiens
ggagatcttgcttgaaggcatg

SEQ ID NO: 6934021 - DNA, 22 bp, Homo sapiens
tggaaacctgtcattggatcca

SEQ ID NO: 6934022 - DNA, 22 bp, Homo sapiens
cccaggaggcggaggttgcagt

SEQ ID NO: 6934023 - DNA, 22 bp, Homo sapiens
gggttttatggttcacttgcaa

SEQ ID NO: 6934024 - DNA, 22 bp, Homo sapiens
tatactgagagcaaatacattc

SEQ ID NO: 6934025 - DNA, 22 bp, Homo sapiens
taaggaggcgaggtggtgagca

SEQ ID NO: 6934026 - DNA, 21 bp, Homo sapiens
accagtccctagtcttatcct

SEQ ID NO: 6934027 - DNA, 22 bp, Homo sapiens
gcagtgctaagtagctggccca

SEQ ID NO: 6934028 - DNA, 22 bp, Homo sapiens
tgtcgagttactgagctccagc

SEQ ID NO: 6934029 - DNA, 22 bp, Homo sapiens
agggtggctgtgaagtgcttgg

SEQ ID NO: 6934030 - DNA, 22 bp, Homo sapiens
ccaatcttgttttctacatcca

SEQ ID NO: 6934031 - DNA, 22 bp, Homo sapiens
gtagtataaatgggaaatacat

SEQ ID NO: 6934032 - DNA, 22 bp, Homo sapiens
aaaatattttagggccaggaga

SEQ ID NO: 6934033 - DNA, 22 bp, Homo sapiens
gagtggggaaagccaggacaga

SEQ ID NO: 6934034 - DNA, 22 bp, Homo sapiens
gtctaattcctgctcttactca

SEQ ID NO: 6934035 - DNA, 22 bp, Homo sapiens
gagccagagatccaggatggct

SEQ ID NO: 6934036 - DNA, 22 bp, Homo sapiens
gtacagaaggagctttggattc

SEQ ID NO: 6934037 - DNA, 19 bp, Homo sapiens
acatgcaaggcacctgcag

SEQ ID NO: 6934038 - DNA, 22 bp, Homo sapiens
atgaggcattcacagaaggcac

SEQ ID NO: 6934039 - DNA, 22 bp, Homo sapiens
tagtaaagtgtcttaacacata

SEQ ID NO: 6934040 - DNA, 22 bp, Homo sapiens
gggaggagcttggagattcact

SEQ ID NO: 6934041 - DNA, 22 bp, Homo sapiens
gattttgtcaaattccaaatgt

SEQ ID NO: 6934042 - DNA, 22 bp, Homo sapiens
aatttgttttcaagtcactgga

SEQ ID NO: 6934043 - DNA, 22 bp, Homo sapiens
tatcagaacacagccacagcca

SEQ ID NO: 6934044 - DNA, 22 bp, Homo sapiens
agctggagattctggggacagt

SEQ ID NO: 6934045 - DNA, 22 bp, Homo sapiens
ggtttccacatccatggaatgg

SEQ ID NO: 6934046 - DNA, 22 bp, Homo sapiens
tggaggcagtaactgagcaaca

SEQ ID NO: 6934047 - DNA, 22 bp, Homo sapiens
acttccagaaatgatttaattt

SEQ ID NO: 6934048 - DNA, 22 bp, Homo sapiens
acacagatattttgaatacata

SEQ ID NO: 6934049 - DNA, 22 bp, Homo sapiens
caggaccaggcgttctgggctg

SEQ ID NO: 6934050 - DNA, 22 bp, Homo sapiens
acagaactgggaaatgcacata

SEQ ID NO: 6934051 - DNA, 22 bp, Homo sapiens
tccctgggaaatgtcagtttca

SEQ ID NO: 6934052 - DNA, 22 bp, Homo sapiens
cttattataaaatcctgtttga

SEQ ID NO: 6934053 - DNA, 22 bp, Homo sapiens
acaggtggcataggcagtttga

SEQ ID NO: 6934054 - DNA, 22 bp, Homo sapiens
gtggcctctgtgctcctgccta

SEQ ID NO: 6934055 - DNA, 22 bp, Homo sapiens
gagcagcttgcgctgtcttcac

SEQ ID NO: 6934056 - DNA, 22 bp, Homo sapiens
cacatgttcttaacttctgttt

SEQ ID NO: 6934057 - DNA, 21 bp, Homo sapiens
ttgacaggaaagaggggagat

SEQ ID NO: 6934058 - DNA, 22 bp, Homo sapiens
ggcaggcatggggtctgccatt

SEQ ID NO: 6934059 - DNA, 22 bp, Homo sapiens
tgtgtgaatggattattctatt

SEQ ID NO: 6934060 - DNA, 22 bp, Homo sapiens
ctcaggacttggttagtgtttt

SEQ ID NO: 6934061 - DNA, 22 bp, Homo sapiens
gttccttagagttgatatggta

SEQ ID NO: 6934062 - DNA, 22 bp, Homo sapiens
aaagtccaattttgttcaggct

SEQ ID NO: 6934063 - DNA, 22 bp, Homo sapiens
tgctttaaatatgaattagcat

SEQ ID NO: 6934064 - DNA, 22 bp, Homo sapiens
tccgggcaactgaagggaggtt

SEQ ID NO: 6934065 - DNA, 22 bp, Homo sapiens
ctttgcagtgaatccataaata

SEQ ID NO: 6934066 - DNA, 22 bp, Homo sapiens
acgctttggctgtgtctcttct

SEQ ID NO: 6934067 - DNA, 22 bp, Homo sapiens
gcatagctgttaatttggtttc

SEQ ID NO: 6934068 - DNA, 22 bp, Homo sapiens
tctgcctgcttcttcatagtct

SEQ ID NO: 6934069 - DNA, 22 bp, Homo sapiens
tacttattggttcagaagttta

SEQ ID NO: 6934070 - DNA, 20 bp, Homo sapiens
gcccaaggtccagaaggggg

SEQ ID NO: 6934071 - DNA, 22 bp, Homo sapiens
tttcttcctaaatatgatttcc

SEQ ID NO: 6934072 - DNA, 22 bp, Homo sapiens
ggaggcaacacagggtgtgttt

SEQ ID NO: 6934073 - DNA, 22 bp, Homo sapiens
actgcattgaggtttcatactt

SEQ ID NO: 6934074 - DNA, 22 bp, Homo sapiens
aagacatgttttaagaatattt

SEQ ID NO: 6934075 - DNA, 22 bp, Homo sapiens
actgtacaaatattgcaaaata

SEQ ID NO: 6934076 - DNA, 22 bp, Homo sapiens
atacaaaatatatactggagac

SEQ ID NO: 6934077 - DNA, 22 bp, Homo sapiens
tggctccagatttcctgctgca

SEQ ID NO: 6934078 - DNA, 22 bp, Homo sapiens
agtgaccacaccctgcagacct

SEQ ID NO: 6934079 - DNA, 20 bp, Homo sapiens
ttggagtctaaagactgggg

SEQ ID NO: 6934080 - DNA, 22 bp, Homo sapiens
ctaactttttgattcttgggga

SEQ ID NO: 6934081 - DNA, 22 bp, Homo sapiens
ctggtggagggacaggcttagc

SEQ ID NO: 6934082 - DNA, 22 bp, Homo sapiens
gtgaagaccagggaacgctggc

SEQ ID NO: 6934083 - DNA, 22 bp, Homo sapiens
gcactgctttctgagtcattgt

SEQ ID NO: 6934084 - DNA, 22 bp, Homo sapiens
tacaatgcattcatttttgagg

SEQ ID NO: 6934085 - DNA, 22 bp, Homo sapiens
agcaatgaaaacaataaggtga

SEQ ID NO: 6934086 - DNA, 22 bp, Homo sapiens
cttggagtatgagcttcctgga

SEQ ID NO: 6934087 - DNA, 22 bp, Homo sapiens
tcactgcactccagcctggtga

SEQ ID NO: 6934088 - DNA, 22 bp, Homo sapiens
cccagcagtagagctcatatgg

SEQ ID NO: 6934089 - DNA, 21 bp, Homo sapiens
ggtggctagaaagcagtgaga

SEQ ID NO: 6934090 - DNA, 22 bp, Homo sapiens
tggctctcaatggctgtactat

SEQ ID NO: 6934091 - DNA, 19 bp, Homo sapiens
cttggcatctgtgaagtga

SEQ ID NO: 6934092 - DNA, 22 bp, Homo sapiens
tgtttgcaaccccttgtgagaa

SEQ ID NO: 6934093 - DNA, 22 bp, Homo sapiens
ttacaggggacattggggacat

SEQ ID NO: 6934094 - DNA, 19 bp, Homo sapiens
aagtgtgttgagccaggat

SEQ ID NO: 6934095 - DNA, 16 bp, Homo sapiens
tctcggtgtgtagagt

SEQ ID NO: 6934096 - DNA, 22 bp, Homo sapiens
tttctactaagaaagttgatta

SEQ ID NO: 6934097 - DNA, 22 bp, Homo sapiens
tcaccaggactgagaccttggg

SEQ ID NO: 6934098 - DNA, 22 bp, Homo sapiens
tcctcacaagcatcctgtctca

SEQ ID NO: 6934099 - DNA, 22 bp, Homo sapiens
ggtggggctaggacctcaggat

SEQ ID NO: 6934100 - DNA, 20 bp, Homo sapiens
gagcagtggagtttccaggg

SEQ ID NO: 6934101 - DNA, 22 bp, Homo sapiens
tgggtccacaaacatcagatat

SEQ ID NO: 6934102 - DNA, 22 bp, Homo sapiens
aataaaggcaccataaggcaaa

SEQ ID NO: 6934103 - DNA, 22 bp, Homo sapiens
tttcagtttaagtaactgctat

SEQ ID NO: 6934104 - DNA, 22 bp, Homo sapiens
tgagcaccttctctcatttccc

SEQ ID NO: 6934105 - DNA, 22 bp, Homo sapiens
gctaatgactgagtttttagca

SEQ ID NO: 6934106 - DNA, 22 bp, Homo sapiens
ggtcagtggagccggaaagacc

SEQ ID NO: 6934107 - DNA, 21 bp, Homo sapiens
ttagaagtaattttctccagc

SEQ ID NO: 6934108 - DNA, 22 bp, Homo sapiens
tatttgtcagctgttgagttca

SEQ ID NO: 6934109 - DNA, 22 bp, Homo sapiens
aacttctgggctgtccaaaact

SEQ ID NO: 6934110 - DNA, 22 bp, Homo sapiens
ccctccatgagtgtgctgctgg

SEQ ID NO: 6934111 - DNA, 22 bp, Homo sapiens
atgcatgtgcatacatgcacag

SEQ ID NO: 6934112 - DNA, 22 bp, Homo sapiens
tgaagtcccattcttaggttga

SEQ ID NO: 6934113 - DNA, 23 bp, Homo sapiens
acccagttagagccctttaggaa

SEQ ID NO: 6934114 - DNA, 22 bp, Homo sapiens
attgctacttcctcaggaaaac

SEQ ID NO: 6934115 - DNA, 22 bp, Homo sapiens
gctctgctgaagccccttgcat

SEQ ID NO: 6934116 - DNA, 22 bp, Homo sapiens
gtcacattcatgcagaatcaaa

SEQ ID NO: 6934117 - DNA, 22 bp, Homo sapiens
actgtgtgaaacatcaatgtgt

SEQ ID NO: 6934118 - DNA, 22 bp, Homo sapiens
tcctggctccagcagctcttcc

SEQ ID NO: 6934119 - DNA, 20 bp, Homo sapiens
agccaggcctcaagttaagt

SEQ ID NO: 6934120 - DNA, 22 bp, Homo sapiens
tagcagggaaggtgtgctgagc

SEQ ID NO: 6934121 - DNA, 16 bp, Homo sapiens
gagctggtagcagctg

SEQ ID NO: 6934122 - DNA, 22 bp, Homo sapiens
gtttgctgccctctcctgtccg

SEQ ID NO: 6934123 - DNA, 22 bp, Homo sapiens
tgccatgcccacctcccttctg

SEQ ID NO: 6934124 - DNA, 22 bp, Homo sapiens
ttttcaaagactggaggctgat

SEQ ID NO: 6934125 - DNA, 22 bp, Homo sapiens
ggctggaccatgctgccccttc

SEQ ID NO: 6934126 - DNA, 22 bp, Homo sapiens
atgttttaaatatgtgtgtaaa

SEQ ID NO: 6934127 - DNA, 22 bp, Homo sapiens
gcagtaagatggggtaatcgta

SEQ ID NO: 6934128 - DNA, 22 bp, Homo sapiens
attgtgaattgagagtacttct

SEQ ID NO: 6934129 - DNA, 22 bp, Homo sapiens
agctagctttaactcttagaca

SEQ ID NO: 6934130 - DNA, 22 bp, Homo sapiens
cgcatcgggtagaggagctgga

SEQ ID NO: 6934131 - DNA, 22 bp, Homo sapiens
tttggaatgacagatatcaata

SEQ ID NO: 6934132 - DNA, 22 bp, Homo sapiens
gcaaatgagttgtaacataaaa

SEQ ID NO: 6934133 - DNA, 22 bp, Homo sapiens
atgtggctcacatagctggaaa

SEQ ID NO: 6934134 - DNA, 16 bp, Homo sapiens
ttttcaagagcggaga

SEQ ID NO: 6934135 - DNA, 22 bp, Homo sapiens
ggccagctgtgggattttctgc

SEQ ID NO: 6934136 - DNA, 22 bp, Homo sapiens
acaaagtaggtcatcaaagctc

SEQ ID NO: 6934137 - DNA, 22 bp, Homo sapiens
caaatgtaaattcttttgaagc

SEQ ID NO: 6934138 - DNA, 22 bp, Homo sapiens
gtcccattgttctgggcttggc

SEQ ID NO: 6934139 - DNA, 22 bp, Homo sapiens
tctctgacagtgaaagagttca

SEQ ID NO: 6934140 - DNA, 22 bp, Homo sapiens
ccttagcattagaagctgtggg

SEQ ID NO: 6934141 - DNA, 22 bp, Homo sapiens
aaatgcctgaatggtatttggt

SEQ ID NO: 6934142 - DNA, 22 bp, Homo sapiens
aatgtatgggtgagaaagttga

SEQ ID NO: 6934143 - DNA, 22 bp, Homo sapiens
ttaaattattgagggattgtca

SEQ ID NO: 6934144 - DNA, 22 bp, Homo sapiens
ctggatttactgagttttatca

SEQ ID NO: 6934145 - DNA, 22 bp, Homo sapiens
cacaagatggtttccagatgct

SEQ ID NO: 6934146 - DNA, 22 bp, Homo sapiens
tgtgaaaagcgtgtgttctagg

SEQ ID NO: 6934147 - DNA, 22 bp, Homo sapiens
ttactacaagattctgttttat

SEQ ID NO: 6934148 - DNA, 20 bp, Homo sapiens
aggcacctgtcacaggtgag

SEQ ID NO: 6934149 - DNA, 22 bp, Homo sapiens
aagcgcaatcttttctgtcttt

SEQ ID NO: 6934150 - DNA, 22 bp, Homo sapiens
gccatgaactcgggcatggaga

SEQ ID NO: 6934151 - DNA, 22 bp, Homo sapiens
cagcacatttactcagccctca

SEQ ID NO: 6934152 - DNA, 22 bp, Homo sapiens
aatatgcagcatgatgaagtaa

SEQ ID NO: 6934153 - DNA, 22 bp, Homo sapiens
cagctcttcctaccctagttgg

SEQ ID NO: 6934154 - DNA, 22 bp, Homo sapiens
gctgccatggctgggggccgtg

SEQ ID NO: 6934155 - DNA, 21 bp, Homo sapiens
tcactctgattaggtgtctct

SEQ ID NO: 6934156 - DNA, 22 bp, Homo sapiens
acctggttcctcctcactgctg

SEQ ID NO: 6934157 - DNA, 22 bp, Homo sapiens
cagtactcttatttgaaatatg

SEQ ID NO: 6934158 - DNA, 22 bp, Homo sapiens
taagtgtttctccagtgtcttt

SEQ ID NO: 6934159 - DNA, 23 bp, Homo sapiens
ctccccagtgtcctcatgcatct

SEQ ID NO: 6934160 - DNA, 22 bp, Homo sapiens
ttgtctaaggaggtagaggact

SEQ ID NO: 6934161 - DNA, 22 bp, Homo sapiens
ttcagcttgcttagtctccttc

SEQ ID NO: 6934162 - DNA, 21 bp, Homo sapiens
ctcttgtgtcagagccagagg

SEQ ID NO: 6934163 - DNA, 22 bp, Homo sapiens
agtgttctttgcatgaggatag

SEQ ID NO: 6934164 - DNA, 22 bp, Homo sapiens
cctgagagcattccacactgaa

SEQ ID NO: 6934165 - DNA, 22 bp, Homo sapiens
tggacaaatagcatgacacttg

SEQ ID NO: 6934166 - DNA, 22 bp, Homo sapiens
atacagcttatgcatatatctc

SEQ ID NO: 6934167 - DNA, 22 bp, Homo sapiens
gcagggcagcttagtccctgtc

SEQ ID NO: 6934168 - DNA, 22 bp, Homo sapiens
tcttcagagtgagcagtgtcat

SEQ ID NO: 6934169 - DNA, 22 bp, Homo sapiens
ctggggcatcatccattctttc

SEQ ID NO: 6934170 - DNA, 22 bp, Homo sapiens
ccaggcaagctctgctgtgccc

SEQ ID NO: 6934171 - DNA, 22 bp, Homo sapiens
aagcccattcggctgccctgca

SEQ ID NO: 6934172 - DNA, 17 bp, Homo sapiens
agcagctgggttgatct

SEQ ID NO: 6934173 - DNA, 22 bp, Homo sapiens
tcagtcccaaggtcctgaggtg

SEQ ID NO: 6934174 - DNA, 23 bp, Homo sapiens
caggaggagaaggcttggttggc

SEQ ID NO: 6934175 - DNA, 22 bp, Homo sapiens
actctggcactgggtacctcag

SEQ ID NO: 6934176 - DNA, 22 bp, Homo sapiens
catgaagcttgaagcagtccac

SEQ ID NO: 6934177 - DNA, 22 bp, Homo sapiens
atcgtaaagccctatggcttca

SEQ ID NO: 6934178 - DNA, 22 bp, Homo sapiens
ggctttctgagtcaaacactga

SEQ ID NO: 6934179 - DNA, 22 bp, Homo sapiens
atgtgtatgtcttattcaaaga

SEQ ID NO: 6934180 - DNA, 22 bp, Homo sapiens
tggagatgggaaaaaggaggta

SEQ ID NO: 6934181 - DNA, 22 bp, Homo sapiens
tctggaattaaactcaggagac

SEQ ID NO: 6934182 - DNA, 23 bp, Homo sapiens
agacaaaagcctcagtcttaggc

SEQ ID NO: 6934183 - DNA, 20 bp, Homo sapiens
ctcaggatactgcaaagttg

SEQ ID NO: 6934184 - DNA, 22 bp, Homo sapiens
tattgttcttcactggtcttat

SEQ ID NO: 6934185 - DNA, 22 bp, Homo sapiens
tggcgtgaagctggaaggcgga

SEQ ID NO: 6934186 - DNA, 22 bp, Homo sapiens
ccagttagttaaaggcgcagta

SEQ ID NO: 6934187 - DNA, 22 bp, Homo sapiens
gagaagctggactttccaaact

SEQ ID NO: 6934188 - DNA, 22 bp, Homo sapiens
tggatctggcagaatatatgta

SEQ ID NO: 6934189 - DNA, 22 bp, Homo sapiens
gcaggggctgagcaccagcggg

SEQ ID NO: 6934190 - DNA, 22 bp, Homo sapiens
atttagtgaaacccataaagca

SEQ ID NO: 6934191 - DNA, 22 bp, Homo sapiens
cattctgcgatcctcaagcaca

SEQ ID NO: 6934192 - DNA, 22 bp, Homo sapiens
aagaaagagatcactcctccat

SEQ ID NO: 6934193 - DNA, 22 bp, Homo sapiens
acccatgagctgcttgggatgc

SEQ ID NO: 6934194 - DNA, 22 bp, Homo sapiens
aggagcccctcttcagtcctgg

SEQ ID NO: 6934195 - DNA, 22 bp, Homo sapiens
aggaaagccaatctctcttgac

SEQ ID NO: 6934196 - DNA, 22 bp, Homo sapiens
tgcatttagttatgagaaaaac

SEQ ID NO: 6934197 - DNA, 18 bp, Homo sapiens
tcatctactggtccaggt

SEQ ID NO: 6934198 - DNA, 22 bp, Homo sapiens
ttcaggtagtttaactgttcca

SEQ ID NO: 6934199 - DNA, 22 bp, Homo sapiens
caggaaatcagaactcaagtgg

SEQ ID NO: 6934200 - DNA, 22 bp, Homo sapiens
tctggtccctgctcacttcttg

SEQ ID NO: 6934201 - DNA, 22 bp, Homo sapiens
ttcatcaatgtgtttaataatg

SEQ ID NO: 6934202 - DNA, 22 bp, Homo sapiens
tattccctgatgtacactggca

SEQ ID NO: 6934203 - DNA, 22 bp, Homo sapiens
gaatgcagctgacagtcgtttt

SEQ ID NO: 6934204 - DNA, 22 bp, Homo sapiens
ttaggacaagataaaacacaag

SEQ ID NO: 6934205 - DNA, 22 bp, Homo sapiens
ctgacagattagatgtgcatat

SEQ ID NO: 6934206 - DNA, 20 bp, Homo sapiens
aaatgctgagaagtccttaa

SEQ ID NO: 6934207 - DNA, 22 bp, Homo sapiens
ctgtctccagggcaggtgcagg

SEQ ID NO: 6934208 - DNA, 22 bp, Homo sapiens
ttacaagggtttctggggccca

SEQ ID NO: 6934209 - DNA, 22 bp, Homo sapiens
ggccaggatctgtttgtccacc

SEQ ID NO: 6934210 - DNA, 22 bp, Homo sapiens
taggaatgcagatgcataataa

SEQ ID NO: 6934211 - DNA, 22 bp, Homo sapiens
taccagcctcagttgtgagccc

SEQ ID NO: 6934212 - DNA, 22 bp, Homo sapiens
aataagaatttacttgtcaaga

SEQ ID NO: 6934213 - DNA, 20 bp, Homo sapiens
tgatggttctttccgggttg

SEQ ID NO: 6934214 - DNA, 22 bp, Homo sapiens
attcatcaactgatagccatag

SEQ ID NO: 6934215 - DNA, 22 bp, Homo sapiens
gaagatattctctaaatacttt

SEQ ID NO: 6934216 - DNA, 22 bp, Homo sapiens
cacatgggcgtaatgtccatgg

SEQ ID NO: 6934217 - DNA, 20 bp, Homo sapiens
accataatgttaattacaaa

SEQ ID NO: 6934218 - DNA, 22 bp, Homo sapiens
agtagccaacttttcttagact

SEQ ID NO: 6934219 - DNA, 22 bp, Homo sapiens
tacagccacggtctatggaggc

SEQ ID NO: 6934220 - DNA, 22 bp, Homo sapiens
tctgtttcttggctagcctctt

SEQ ID NO: 6934221 - DNA, 22 bp, Homo sapiens
ggacacagataatcacacagat

SEQ ID NO: 6934222 - DNA, 22 bp, Homo sapiens
tgtgaagcatagattctgtaga

SEQ ID NO: 6934223 - DNA, 22 bp, Homo sapiens
tttgataagagctgctgaaact

SEQ ID NO: 6934224 - DNA, 22 bp, Homo sapiens
ctgaggcaggggcagctggaga

SEQ ID NO: 6934225 - DNA, 21 bp, Homo sapiens
acatccagggtcctcactgcc

SEQ ID NO: 6934226 - DNA, 22 bp, Homo sapiens
aatagtgcttttgtacatagga

SEQ ID NO: 6934227 - DNA, 22 bp, Homo sapiens
aatagttgtagtatctatctcg

SEQ ID NO: 6934228 - DNA, 23 bp, Homo sapiens
aagaagttacctaaagttgtact

SEQ ID NO: 6934229 - DNA, 19 bp, Homo sapiens
tgtggaaaaaggagacatt

SEQ ID NO: 6934230 - DNA, 21 bp, Homo sapiens
gagctgcaccttgacctgttt

SEQ ID NO: 6934231 - DNA, 22 bp, Homo sapiens
catcagtggatatagattagcg

SEQ ID NO: 6934232 - DNA, 22 bp, Homo sapiens
gccatttaagtctctattatgt

SEQ ID NO: 6934233 - DNA, 22 bp, Homo sapiens
aaataggagcttaagcacttct

SEQ ID NO: 6934234 - DNA, 18 bp, Homo sapiens
ctgaggctggcaggagcc

SEQ ID NO: 6934235 - DNA, 19 bp, Homo sapiens
tgttggtgcggatgtggag

SEQ ID NO: 6934236 - DNA, 22 bp, Homo sapiens
gggcactggaggccaaggagct

SEQ ID NO: 6934237 - DNA, 22 bp, Homo sapiens
tggaaccctcctactccagggc

SEQ ID NO: 6934238 - DNA, 22 bp, Homo sapiens
ctgcagcatcgccacctgcctc

SEQ ID NO: 6934239 - DNA, 22 bp, Homo sapiens
aggcagggaccagttgttttct

SEQ ID NO: 6934240 - DNA, 22 bp, Homo sapiens
atcatgttgtatgtaatctttt

SEQ ID NO: 6934241 - DNA, 20 bp, Homo sapiens
gcatccagacacccagctgc

SEQ ID NO: 6934242 - DNA, 22 bp, Homo sapiens
tcagctgctgtggtatgtacat

SEQ ID NO: 6934243 - DNA, 22 bp, Homo sapiens
tggtgctcttatgttttcatca

SEQ ID NO: 6934244 - DNA, 22 bp, Homo sapiens
taacagtatatttaccaaacct

SEQ ID NO: 6934245 - DNA, 20 bp, Homo sapiens
ccaggctggcaaatgggggc

SEQ ID NO: 6934246 - DNA, 22 bp, Homo sapiens
tggcccctgaggagcgtcagcc

SEQ ID NO: 6934247 - DNA, 22 bp, Homo sapiens
taagtttaccactttcagaatt

SEQ ID NO: 6934248 - DNA, 22 bp, Homo sapiens
gttcaggaagtctcagctggga

SEQ ID NO: 6934249 - DNA, 22 bp, Homo sapiens
gcctgtcctatacaggcggctg

SEQ ID NO: 6934250 - DNA, 23 bp, Homo sapiens
gcaagcaaggcagggtaaagaga

SEQ ID NO: 6934251 - DNA, 22 bp, Homo sapiens
gtcagtctcctgccttttggac

SEQ ID NO: 6934252 - DNA, 22 bp, Homo sapiens
gtcctgtgcccagaccctctgt

SEQ ID NO: 6934253 - DNA, 21 bp, Homo sapiens
tcagtgtgactggcaaattga

SEQ ID NO: 6934254 - DNA, 22 bp, Homo sapiens
ggctcctgtcccctcagctgct

SEQ ID NO: 6934255 - DNA, 20 bp, Homo sapiens
tcatgtgtgtcctacagaga

SEQ ID NO: 6934256 - DNA, 22 bp, Homo sapiens
ggcatgcatacgtagtgatttt

SEQ ID NO: 6934257 - DNA, 22 bp, Homo sapiens
tgaggtaatgtgtacgttaatt

SEQ ID NO: 6934258 - DNA, 22 bp, Homo sapiens
aatgctgaatttagtatttatg

SEQ ID NO: 6934259 - DNA, 22 bp, Homo sapiens
gtctcctgctagcaagcaccac

SEQ ID NO: 6934260 - DNA, 19 bp, Homo sapiens
ttaatcctttcatcagctg

SEQ ID NO: 6934261 - DNA, 22 bp, Homo sapiens
taagaatagtgtttgcctttgg

SEQ ID NO: 6934262 - DNA, 22 bp, Homo sapiens
atctgtcatcagcaccacaggt

SEQ ID NO: 6934263 - DNA, 22 bp, Homo sapiens
cgccccggacgtctgaccaaac

SEQ ID NO: 6934264 - DNA, 22 bp, Homo sapiens
gagaagttgtaggagaattttg

SEQ ID NO: 6934265 - DNA, 22 bp, Homo sapiens
tggcagtccctctggtagcacc

SEQ ID NO: 6934266 - DNA, 22 bp, Homo sapiens
ttggtcagctcaatggagaggg

SEQ ID NO: 6934267 - DNA, 22 bp, Homo sapiens
gcatggcagccagtacatggtg

SEQ ID NO: 6934268 - DNA, 22 bp, Homo sapiens
agaacatagatacctaagacag

SEQ ID NO: 6934269 - DNA, 22 bp, Homo sapiens
tgcaggagacataatagggact

SEQ ID NO: 6934270 - DNA, 22 bp, Homo sapiens
cttgcagtgtggccttgaagag

SEQ ID NO: 6934271 - DNA, 22 bp, Homo sapiens
cactttgcagggtggtgggagg

SEQ ID NO: 6934272 - DNA, 22 bp, Homo sapiens
ggagtgcaatggcacgatctca

SEQ ID NO: 6934273 - DNA, 23 bp, Homo sapiens
acagggctgtccagggctaggtc

SEQ ID NO: 6934274 - DNA, 22 bp, Homo sapiens
aagtcagtgaaaaggcatcatc

SEQ ID NO: 6934275 - DNA, 22 bp, Homo sapiens
gctggctggagtgagctaccct

SEQ ID NO: 6934276 - DNA, 22 bp, Homo sapiens
ctgtcaggaagctgggcatcca

SEQ ID NO: 6934277 - DNA, 22 bp, Homo sapiens
gatccttgcaactctgtgaggt

SEQ ID NO: 6934278 - DNA, 22 bp, Homo sapiens
aacaccttgcagggattatgac

SEQ ID NO: 6934279 - DNA, 22 bp, Homo sapiens
agatggttcagaattataaaga

SEQ ID NO: 6934280 - DNA, 22 bp, Homo sapiens
tttctaagatgtggtttcaagg

SEQ ID NO: 6934281 - DNA, 22 bp, Homo sapiens
ctttggctacaagcgctgcaat

SEQ ID NO: 6934282 - DNA, 22 bp, Homo sapiens
tggaacctggtgatgtacaagt

SEQ ID NO: 6934283 - DNA, 22 bp, Homo sapiens
ttggcaggaggcttcagttcct

SEQ ID NO: 6934284 - DNA, 22 bp, Homo sapiens
tctgcctgggtgtggagcagag

SEQ ID NO: 6934285 - DNA, 22 bp, Homo sapiens
gaggaagtttacaaagcatctg

SEQ ID NO: 6934286 - DNA, 22 bp, Homo sapiens
tcatttacttggttttaatctt

SEQ ID NO: 6934287 - DNA, 22 bp, Homo sapiens
tattggatttctgaaagatgag

SEQ ID NO: 6934288 - DNA, 22 bp, Homo sapiens
agaaaactgggaggagagcttc

SEQ ID NO: 6934289 - DNA, 19 bp, Homo sapiens
gactcacaccttccgctgt

SEQ ID NO: 6934290 - DNA, 22 bp, Homo sapiens
tcaaagtccttgctttttctgt

SEQ ID NO: 6934291 - DNA, 22 bp, Homo sapiens
tctgcaagagcttcaaggtaga

SEQ ID NO: 6934292 - DNA, 21 bp, Homo sapiens
tctttctgaaatctcagtctg

SEQ ID NO: 6934293 - DNA, 22 bp, Homo sapiens
gaagcctggtccagagctccca

SEQ ID NO: 6934294 - DNA, 22 bp, Homo sapiens
ccagctcccgcaggctgcacag

SEQ ID NO: 6934295 - DNA, 22 bp, Homo sapiens
cccaggatgtcgaggctgcagt

SEQ ID NO: 6934296 - DNA, 22 bp, Homo sapiens
agcaaggccgagaggatgctat

SEQ ID NO: 6934297 - DNA, 22 bp, Homo sapiens
agtatttctgctcatgaaagag

SEQ ID NO: 6934298 - DNA, 22 bp, Homo sapiens
agcagctcccctcatgctccac

SEQ ID NO: 6934299 - DNA, 22 bp, Homo sapiens
tctgagatccttgtgttgtttt

SEQ ID NO: 6934300 - DNA, 22 bp, Homo sapiens
tgtaaactgcttctcaccaagg

SEQ ID NO: 6934301 - DNA, 22 bp, Homo sapiens
acccagagcagagcttggcttc

SEQ ID NO: 6934302 - DNA, 22 bp, Homo sapiens
cagcaaggcattctgtggatta

SEQ ID NO: 6934303 - DNA, 22 bp, Homo sapiens
tctaaagacactttttacaggg

SEQ ID NO: 6934304 - DNA, 22 bp, Homo sapiens
aatgtctttgcaggagggattg

SEQ ID NO: 6934305 - DNA, 22 bp, Homo sapiens
tgcaatgaatatggtacattaa

SEQ ID NO: 6934306 - DNA, 22 bp, Homo sapiens
agtccagaccccggcagctggt

SEQ ID NO: 6934307 - DNA, 22 bp, Homo sapiens
aaggctcactgtagagtaattg

SEQ ID NO: 6934308 - DNA, 21 bp, Homo sapiens
aaggatgtcagtggcacagga

SEQ ID NO: 6934309 - DNA, 22 bp, Homo sapiens
gtagctagtagttcagagaaca

SEQ ID NO: 6934310 - DNA, 22 bp, Homo sapiens
tggcaaaggaaatgatttaaga

SEQ ID NO: 6934311 - DNA, 22 bp, Homo sapiens
aatggcttaatgataccttatc

SEQ ID NO: 6934312 - DNA, 22 bp, Homo sapiens
gcccttagggccactgtcactg

SEQ ID NO: 6934313 - DNA, 22 bp, Homo sapiens
attgaggcagcatagttcaggg

SEQ ID NO: 6934314 - DNA, 22 bp, Homo sapiens
cagttattatcttagagagaca

SEQ ID NO: 6934315 - DNA, 22 bp, Homo sapiens
gtaggaagctctgaggctagtt

SEQ ID NO: 6934316 - DNA, 22 bp, Homo sapiens
agcagagcatgctaagtgactc

SEQ ID NO: 6934317 - DNA, 22 bp, Homo sapiens
agcagctcaaagcctgcaagga

SEQ ID NO: 6934318 - DNA, 22 bp, Homo sapiens
tcaggacaacaagacttgttta

SEQ ID NO: 6934319 - DNA, 22 bp, Homo sapiens
ttgcaaatgggcaaagcagatc

SEQ ID NO: 6934320 - DNA, 22 bp, Homo sapiens
agtgaatgtccccgcgggtcag

SEQ ID NO: 6934321 - DNA, 22 bp, Homo sapiens
cagggccctaagatacacatca

SEQ ID NO: 6934322 - DNA, 22 bp, Homo sapiens
tgacagagcaagatcttatctc

SEQ ID NO: 6934323 - DNA, 22 bp, Homo sapiens
tgtttagaggaactggaatcag

SEQ ID NO: 6934324 - DNA, 22 bp, Homo sapiens
tcgtcctgtgcacctgcctgca

SEQ ID NO: 6934325 - DNA, 22 bp, Homo sapiens
agagattataacagtttggacc

SEQ ID NO: 6934326 - DNA, 18 bp, Homo sapiens
gccctggtggagctggtg

SEQ ID NO: 6934327 - DNA, 22 bp, Homo sapiens
tgtcatttcacaatatcactca

SEQ ID NO: 6934328 - DNA, 22 bp, Homo sapiens
ctccagggaggtctgcaggact

SEQ ID NO: 6934329 - DNA, 20 bp, Homo sapiens
tgatatttctggaagtggag

SEQ ID NO: 6934330 - DNA, 22 bp, Homo sapiens
acattttttagagtcccacatt

SEQ ID NO: 6934331 - DNA, 22 bp, Homo sapiens
cagtaaggatgcacataactag

SEQ ID NO: 6934332 - DNA, 22 bp, Homo sapiens
tgtcctggacaacagcccctag

SEQ ID NO: 6934333 - DNA, 22 bp, Homo sapiens
agagatctccatgcccttataa

SEQ ID NO: 6934334 - DNA, 22 bp, Homo sapiens
tgtgcctgagttggctgagtac

SEQ ID NO: 6934335 - DNA, 22 bp, Homo sapiens
cttgttaaaatgccgattctga

SEQ ID NO: 6934336 - DNA, 22 bp, Homo sapiens
ctgctggcctagcccatcctct

SEQ ID NO: 6934337 - DNA, 22 bp, Homo sapiens
cttatgtaaactacagataata

SEQ ID NO: 6934338 - DNA, 22 bp, Homo sapiens
gtgagagtaccacctcaacatc

SEQ ID NO: 6934339 - DNA, 21 bp, Homo sapiens
aaattttcttggctgtagtgt

SEQ ID NO: 6934340 - DNA, 22 bp, Homo sapiens
gacagaattttccatcatgtgg

SEQ ID NO: 6934341 - DNA, 22 bp, Homo sapiens
tgcctgagtgatgtggcagcca

SEQ ID NO: 6934342 - DNA, 22 bp, Homo sapiens
tagaaatcacagatagggtcat

SEQ ID NO: 6934343 - DNA, 22 bp, Homo sapiens
actttctatggcttattatgag

SEQ ID NO: 6934344 - DNA, 22 bp, Homo sapiens
caagctgggtcccaacaattac

SEQ ID NO: 6934345 - DNA, 17 bp, Homo sapiens
agccagcagtagctggt

SEQ ID NO: 6934346 - DNA, 22 bp, Homo sapiens
ggagaaagctatgtgggggagt

SEQ ID NO: 6934347 - DNA, 22 bp, Homo sapiens
tgctgcttttgtatatcagaga

SEQ ID NO: 6934348 - DNA, 22 bp, Homo sapiens
gagctacactgattcatttgtt

SEQ ID NO: 6934349 - DNA, 22 bp, Homo sapiens
gtctggagagctgagcagagtt

SEQ ID NO: 6934350 - DNA, 22 bp, Homo sapiens
aaagatgttatgaaataactat

SEQ ID NO: 6934351 - DNA, 22 bp, Homo sapiens
taacatgtggagagaatggtga

SEQ ID NO: 6934352 - DNA, 22 bp, Homo sapiens
ttccaactttaaaattcattct

SEQ ID NO: 6934353 - DNA, 22 bp, Homo sapiens
taagacacaaatatcttttaca

SEQ ID NO: 6934354 - DNA, 20 bp, Homo sapiens
ccctgcaatgggaagctggt

SEQ ID NO: 6934355 - DNA, 22 bp, Homo sapiens
tggcacttgggagtcgtggcga

SEQ ID NO: 6934356 - DNA, 22 bp, Homo sapiens
tgttttttccttatgcaatctg

SEQ ID NO: 6934357 - DNA, 22 bp, Homo sapiens
tagctttaagatgagatgtgga

SEQ ID NO: 6934358 - DNA, 22 bp, Homo sapiens
taagtttgtgtctctgttactt

SEQ ID NO: 6934359 - DNA, 22 bp, Homo sapiens
ataagtgcccaaaatgaaagga

SEQ ID NO: 6934360 - DNA, 22 bp, Homo sapiens
gtaaggcttctggcccttaact

SEQ ID NO: 6934361 - DNA, 22 bp, Homo sapiens
gcctctgctcggactttgcctc

SEQ ID NO: 6934362 - DNA, 22 bp, Homo sapiens
tgcttggagaatcagtcccagc

SEQ ID NO: 6934363 - DNA, 17 bp, Homo sapiens
aactgctttttttagcc

SEQ ID NO: 6934364 - DNA, 22 bp, Homo sapiens
gctcatctgtaaaacaggatta

SEQ ID NO: 6934365 - DNA, 22 bp, Homo sapiens
ccctcgaggttttctgaggtac

SEQ ID NO: 6934366 - DNA, 22 bp, Homo sapiens
tagatgtgagcccaggctgctt

SEQ ID NO: 6934367 - DNA, 22 bp, Homo sapiens
atccccaagccaaggcctgagg

SEQ ID NO: 6934368 - DNA, 22 bp, Homo sapiens
gctgcccagtgtgctcatgcag

SEQ ID NO: 6934369 - DNA, 22 bp, Homo sapiens
tggaccgcagggatgcccggca

SEQ ID NO: 6934370 - DNA, 22 bp, Homo sapiens
agtgcgtgggcaggcatggaag

SEQ ID NO: 6934371 - DNA, 22 bp, Homo sapiens
acatggcagctgatgattggaa

SEQ ID NO: 6934372 - DNA, 22 bp, Homo sapiens
acagatttaggactgtagcgat

SEQ ID NO: 6934373 - DNA, 22 bp, Homo sapiens
agtcagttgcagtttatggatg

SEQ ID NO: 6934374 - DNA, 22 bp, Homo sapiens
tcactttacagctaaggttgtt

SEQ ID NO: 6934375 - DNA, 22 bp, Homo sapiens
ctccagtatctgtaggaaaagg

SEQ ID NO: 6934376 - DNA, 22 bp, Homo sapiens
tacagtatgttcttgaatttgg

SEQ ID NO: 6934377 - DNA, 22 bp, Homo sapiens
acctctgggcagcacctttgta

SEQ ID NO: 6934378 - DNA, 22 bp, Homo sapiens
agccacagcatgtgtgtatgta

SEQ ID NO: 6934379 - DNA, 17 bp, Homo sapiens
acacagagattaacaca

SEQ ID NO: 6934380 - DNA, 22 bp, Homo sapiens
tggtccctgcgttaagagcact

SEQ ID NO: 6934381 - DNA, 19 bp, Homo sapiens
ttactatgtgacaagcact

SEQ ID NO: 6934382 - DNA, 22 bp, Homo sapiens
tgaaacaagggccatgggaaac

SEQ ID NO: 6934383 - DNA, 22 bp, Homo sapiens
gcacagaggaagcacagactct

SEQ ID NO: 6934384 - DNA, 22 bp, Homo sapiens
actggcagtgtcgtttacatga

SEQ ID NO: 6934385 - DNA, 22 bp, Homo sapiens
agaaactaagtcataactcttt

SEQ ID NO: 6934386 - DNA, 18 bp, Homo sapiens
tctgtggagagggcagtt

SEQ ID NO: 6934387 - DNA, 22 bp, Homo sapiens
catcaaaattagacattgttga

SEQ ID NO: 6934388 - DNA, 22 bp, Homo sapiens
aatgtcctgttaaattttccca

SEQ ID NO: 6934389 - DNA, 19 bp, Homo sapiens
tctagcaacccactgcatg

SEQ ID NO: 6934390 - DNA, 22 bp, Homo sapiens
agcagctccctcctcagccacc

SEQ ID NO: 6934391 - DNA, 22 bp, Homo sapiens
ccttgcatatattatatctttg

SEQ ID NO: 6934392 - DNA, 22 bp, Homo sapiens
gcacctggctgcccaggtggag

SEQ ID NO: 6934393 - DNA, 22 bp, Homo sapiens
ctggtctgagggctcttgaggc

SEQ ID NO: 6934394 - DNA, 22 bp, Homo sapiens
gggtacagccgttggttgccgg

SEQ ID NO: 6934395 - DNA, 22 bp, Homo sapiens
ttccggaatggcagggtagctc

SEQ ID NO: 6934396 - DNA, 22 bp, Homo sapiens
ctcaggatttaaaggggcactc

SEQ ID NO: 6934397 - DNA, 22 bp, Homo sapiens
ggcatttacgatactgcatagg

SEQ ID NO: 6934398 - DNA, 21 bp, Homo sapiens
tggctgcctggctctgtggtt

SEQ ID NO: 6934399 - DNA, 22 bp, Homo sapiens
gagacccaggggtctgctgccc

SEQ ID NO: 6934400 - DNA, 22 bp, Homo sapiens
tttactgtctcagagagacaaa

SEQ ID NO: 6934401 - DNA, 22 bp, Homo sapiens
tacctcgaacttggtctttgat

SEQ ID NO: 6934402 - DNA, 20 bp, Homo sapiens
accaggcccggtgtctcctc

SEQ ID NO: 6934403 - DNA, 22 bp, Homo sapiens
gatgtcttcagatggcaagaga

SEQ ID NO: 6934404 - DNA, 22 bp, Homo sapiens
gattcaagacctagctcagcca

SEQ ID NO: 6934405 - DNA, 22 bp, Homo sapiens
tgcaggctccacgttgttgtcc

SEQ ID NO: 6934406 - DNA, 22 bp, Homo sapiens
gctgttcagatgcgattcagga

SEQ ID NO: 6934407 - DNA, 22 bp, Homo sapiens
tctgagggtgggagaaggagct

SEQ ID NO: 6934408 - DNA, 22 bp, Homo sapiens
tccttcagggctgaccacaggc

SEQ ID NO: 6934409 - DNA, 22 bp, Homo sapiens
tctgcaacagtgccctgtaaat

SEQ ID NO: 6934410 - DNA, 22 bp, Homo sapiens
aagaaactgaaagtggcttcat

SEQ ID NO: 6934411 - DNA, 22 bp, Homo sapiens
atatagtcaaacatatatgtgt

SEQ ID NO: 6934412 - DNA, 22 bp, Homo sapiens
gtggggatcactggggacaatc

SEQ ID NO: 6934413 - DNA, 22 bp, Homo sapiens
agcagctttcacctccccgcct

SEQ ID NO: 6934414 - DNA, 22 bp, Homo sapiens
agccaggtgcagtggcacacac

SEQ ID NO: 6934415 - DNA, 22 bp, Homo sapiens
actgttctcctttggctatatc

SEQ ID NO: 6934416 - DNA, 22 bp, Homo sapiens
tttgggcaattcagtgggacct

SEQ ID NO: 6934417 - DNA, 22 bp, Homo sapiens
ggcttcctttcactaccctcag

SEQ ID NO: 6934418 - DNA, 22 bp, Homo sapiens
accctcggatttggcctaggac

SEQ ID NO: 6934419 - DNA, 22 bp, Homo sapiens
gtaaatgtgctaaaatgtgtcg

SEQ ID NO: 6934420 - DNA, 22 bp, Homo sapiens
tcatcactcattggacaacaga

SEQ ID NO: 6934421 - DNA, 22 bp, Homo sapiens
agtcacagaatgatggctccag

SEQ ID NO: 6934422 - DNA, 21 bp, Homo sapiens
ataaattctgagaggctctgc

SEQ ID NO: 6934423 - DNA, 22 bp, Homo sapiens
cttggtaaaactgtcttaaatt

SEQ ID NO: 6934424 - DNA, 20 bp, Homo sapiens
agcagtaggacctctgggcc

SEQ ID NO: 6934425 - DNA, 22 bp, Homo sapiens
tagaggtataccaaaaaggcat

SEQ ID NO: 6934426 - DNA, 22 bp, Homo sapiens
tggctgtgaatggcaaataatc

SEQ ID NO: 6934427 - DNA, 22 bp, Homo sapiens
aattcacttgtgcacgctatgg

SEQ ID NO: 6934428 - DNA, 22 bp, Homo sapiens
ccagggccaagagacctcgagg

SEQ ID NO: 6934429 - DNA, 18 bp, Homo sapiens
ccatggctccctcctgcc

SEQ ID NO: 6934430 - DNA, 22 bp, Homo sapiens
attcaagctgaatggtgacaga

SEQ ID NO: 6934431 - DNA, 22 bp, Homo sapiens
gtgcaaatgtaattgtggtttt

SEQ ID NO: 6934432 - DNA, 22 bp, Homo sapiens
gtgcaaaagtaattgaggtttt

SEQ ID NO: 6934433 - DNA, 22 bp, Homo sapiens
tcagtagtatggctttgttgat

SEQ ID NO: 6934434 - DNA, 23 bp, Homo sapiens
tttaacatttgaacatgtggcca

SEQ ID NO: 6934435 - DNA, 22 bp, Homo sapiens
acagcaatctgagagacatagt

SEQ ID NO: 6934436 - DNA, 22 bp, Homo sapiens
ccagcatcctcagctcacttct

SEQ ID NO: 6934437 - DNA, 22 bp, Homo sapiens
actgcagagcttttcagttgag

SEQ ID NO: 6934438 - DNA, 20 bp, Homo sapiens
gaaaccagaacgcagccctg

SEQ ID NO: 6934439 - DNA, 22 bp, Homo sapiens
cagtctctcttgtagtgcagct

SEQ ID NO: 6934440 - DNA, 21 bp, Homo sapiens
agaagtccccactctgtcgca

SEQ ID NO: 6934441 - DNA, 22 bp, Homo sapiens
catgtgtcaaatgatgtagctg

SEQ ID NO: 6934442 - DNA, 22 bp, Homo sapiens
aaggctagagaggtattcaagt

SEQ ID NO: 6934443 - DNA, 22 bp, Homo sapiens
gaagtcatctggcactcttcta

SEQ ID NO: 6934444 - DNA, 20 bp, Homo sapiens
cagtgcttcctcctttcttt

SEQ ID NO: 6934445 - DNA, 22 bp, Homo sapiens
atgaagctggttttggcttggg

SEQ ID NO: 6934446 - DNA, 22 bp, Homo sapiens
taagaattatctcatggataat

SEQ ID NO: 6934447 - DNA, 22 bp, Homo sapiens
gttctgggtgatgaggttggct

SEQ ID NO: 6934448 - DNA, 22 bp, Homo sapiens
ggccgccctttccacggtttct

SEQ ID NO: 6934449 - DNA, 22 bp, Homo sapiens
agaagtatttggctaaaagaca

SEQ ID NO: 6934450 - DNA, 22 bp, Homo sapiens
ctccttaagtatgggctgtgca

SEQ ID NO: 6934451 - DNA, 22 bp, Homo sapiens
ttgattctgatcctgtctggag

SEQ ID NO: 6934452 - DNA, 22 bp, Homo sapiens
ttccttgtggaaactatggacg

SEQ ID NO: 6934453 - DNA, 22 bp, Homo sapiens
gtattagtttcctgttgctgct

SEQ ID NO: 6934454 - DNA, 21 bp, Homo sapiens
accgtgcttatctcctgctca

SEQ ID NO: 6934455 - DNA, 22 bp, Homo sapiens
ctggctgtaagcgtgtttccta

SEQ ID NO: 6934456 - DNA, 22 bp, Homo sapiens
attttctcacaatcctatgggg

SEQ ID NO: 6934457 - DNA, 18 bp, Homo sapiens
ctgcttacaaaaataccc

SEQ ID NO: 6934458 - DNA, 22 bp, Homo sapiens
tcgcctgctgtttaacctagga

SEQ ID NO: 6934459 - DNA, 22 bp, Homo sapiens
accatgcatcagttaaaaggag

SEQ ID NO: 6934460 - DNA, 22 bp, Homo sapiens
aggtttctgcagcatagtggca

SEQ ID NO: 6934461 - DNA, 22 bp, Homo sapiens
gctgccctctgtgacccggccc

SEQ ID NO: 6934462 - DNA, 22 bp, Homo sapiens
acgtatattgaaatatcatgag

SEQ ID NO: 6934463 - DNA, 22 bp, Homo sapiens
aaggttctaagggaagccatgc

SEQ ID NO: 6934464 - DNA, 22 bp, Homo sapiens
aatgtattctgggaaaatgtta

SEQ ID NO: 6934465 - DNA, 22 bp, Homo sapiens
acaatgaagggagacacttgct

SEQ ID NO: 6934466 - DNA, 22 bp, Homo sapiens
tgaaaaacactaattggaaagc

SEQ ID NO: 6934467 - DNA, 18 bp, Homo sapiens
caaatactgttgtcttat

SEQ ID NO: 6934468 - DNA, 22 bp, Homo sapiens
acacatatgcagatcccccaca

SEQ ID NO: 6934469 - DNA, 22 bp, Homo sapiens
accatgtgatcaaaacaaatcc

SEQ ID NO: 6934470 - DNA, 22 bp, Homo sapiens
cactggtgatgaggcagttagg

SEQ ID NO: 6934471 - DNA, 22 bp, Homo sapiens
acatatgtatatgtacacagtc

SEQ ID NO: 6934472 - DNA, 22 bp, Homo sapiens
catcacatgcctatcatgagct

SEQ ID NO: 6934473 - DNA, 22 bp, Homo sapiens
acttagcagagtgagttgacta

SEQ ID NO: 6934474 - DNA, 22 bp, Homo sapiens
taacaatgggaaggactgatga

SEQ ID NO: 6934475 - DNA, 22 bp, Homo sapiens
aagcaggttatgaaatatagaa

SEQ ID NO: 6934476 - DNA, 22 bp, Homo sapiens
aaggccaggtccctgcagtgca

SEQ ID NO: 6934477 - DNA, 22 bp, Homo sapiens
tcagaagttaatatataaattt

SEQ ID NO: 6934478 - DNA, 22 bp, Homo sapiens
gtccttcatatcatggattata

SEQ ID NO: 6934479 - DNA, 22 bp, Homo sapiens
acacatgctcataaataaatag

SEQ ID NO: 6934480 - DNA, 22 bp, Homo sapiens
tcgtggaggcaccgtgagcttt

SEQ ID NO: 6934481 - DNA, 22 bp, Homo sapiens
aagctcagagtagctcagcgtc

SEQ ID NO: 6934482 - DNA, 22 bp, Homo sapiens
tatcacatcaatgttttaaaat

SEQ ID NO: 6934483 - DNA, 22 bp, Homo sapiens
ctgggcacacagtgactctgca

SEQ ID NO: 6934484 - DNA, 22 bp, Homo sapiens
cattgaaacctaacataggctg

SEQ ID NO: 6934485 - DNA, 23 bp, Homo sapiens
aggtacatatacttggaggtcag

SEQ ID NO: 6934486 - DNA, 18 bp, Homo sapiens
atggctccagtgtcttcc

SEQ ID NO: 6934487 - DNA, 22 bp, Homo sapiens
gctctggggttggaaagtgatc

SEQ ID NO: 6934488 - DNA, 22 bp, Homo sapiens
tccagactgccctgcacatgtg

SEQ ID NO: 6934489 - DNA, 22 bp, Homo sapiens
tgctttcattgtgataggaagc

SEQ ID NO: 6934490 - DNA, 23 bp, Homo sapiens
gccatcacgttcaaccaaagcct

SEQ ID NO: 6934491 - DNA, 22 bp, Homo sapiens
ttaatggcatgttgcaaaattt

SEQ ID NO: 6934492 - DNA, 22 bp, Homo sapiens
tgcatttttgataactgtgtac

SEQ ID NO: 6934493 - DNA, 22 bp, Homo sapiens
tgcacacagccagtgagtggca

SEQ ID NO: 6934494 - DNA, 23 bp, Homo sapiens
gggagatgggaaatgaaggctct

SEQ ID NO: 6934495 - DNA, 22 bp, Homo sapiens
aatctttcgtttctcctgtctg

SEQ ID NO: 6934496 - DNA, 22 bp, Homo sapiens
tctcctccttttttcaacatag

SEQ ID NO: 6934497 - DNA, 22 bp, Homo sapiens
cctgtctgtattggtttgctat

SEQ ID NO: 6934498 - DNA, 22 bp, Homo sapiens
catttgacagtgagtcacagca

SEQ ID NO: 6934499 - DNA, 22 bp, Homo sapiens
accctgcagggcagaggctggt

SEQ ID NO: 6934500 - DNA, 22 bp, Homo sapiens
aggaaacagaggtgccacaata

SEQ ID NO: 6934501 - DNA, 22 bp, Homo sapiens
atgtcccagctgagagacaact

SEQ ID NO: 6934502 - DNA, 20 bp, Homo sapiens
tgacaaatgatctgattttc

SEQ ID NO: 6934503 - DNA, 22 bp, Homo sapiens
agagctgcgtctattcacaatc

SEQ ID NO: 6934504 - DNA, 22 bp, Homo sapiens
tttgtgcaggtgtgtcagatcg

SEQ ID NO: 6934505 - DNA, 22 bp, Homo sapiens
gcacagccttgccctgtgccct

SEQ ID NO: 6934506 - DNA, 22 bp, Homo sapiens
gctatggctcaccatgtcctgg

SEQ ID NO: 6934507 - DNA, 22 bp, Homo sapiens
agtcttatggccatctctgatt

SEQ ID NO: 6934508 - DNA, 22 bp, Homo sapiens
agcagctgtttgttgaattggt

SEQ ID NO: 6934509 - DNA, 22 bp, Homo sapiens
ataagagctacagccagttctg

SEQ ID NO: 6934510 - DNA, 21 bp, Homo sapiens
acaaactgaaatgagtttcct

SEQ ID NO: 6934511 - DNA, 22 bp, Homo sapiens
tcctgagaggggtgggtttccc

SEQ ID NO: 6934512 - DNA, 22 bp, Homo sapiens
accatcttttcctctgcctcct

SEQ ID NO: 6934513 - DNA, 22 bp, Homo sapiens
agtgtcaaattaaataatctgg

SEQ ID NO: 6934514 - DNA, 22 bp, Homo sapiens
gtcctggtgaggtagtgggagg

SEQ ID NO: 6934515 - DNA, 22 bp, Homo sapiens
ttatttattgtgtacctactgt

SEQ ID NO: 6934516 - DNA, 22 bp, Homo sapiens
atgttctttgaaatattttaga

SEQ ID NO: 6934517 - DNA, 22 bp, Homo sapiens
taggtaggtggaaaagtaattg

SEQ ID NO: 6934518 - DNA, 22 bp, Homo sapiens
tgggcagagtcatacaggagac

SEQ ID NO: 6934519 - DNA, 22 bp, Homo sapiens
tgctttgggtttgactctcatg

SEQ ID NO: 6934520 - DNA, 22 bp, Homo sapiens
tgtgtagctcatattagtgtta

SEQ ID NO: 6934521 - DNA, 22 bp, Homo sapiens
ttggtgcaaaattagagaacca

SEQ ID NO: 6934522 - DNA, 22 bp, Homo sapiens
tcatttctccgacctgctgtcc

SEQ ID NO: 6934523 - DNA, 22 bp, Homo sapiens
aggattctgatctgagctgttt

SEQ ID NO: 6934524 - DNA, 22 bp, Homo sapiens
accaaatatatcttttgacctg

SEQ ID NO: 6934525 - DNA, 22 bp, Homo sapiens
tctgggaatgaataagacctgt

SEQ ID NO: 6934526 - DNA, 22 bp, Homo sapiens
gcctgctgcatccaggctattg

SEQ ID NO: 6934527 - DNA, 22 bp, Homo sapiens
gcttcctgatattcatactgtt

SEQ ID NO: 6934528 - DNA, 22 bp, Homo sapiens
ccacatgaaattgcttatattt

SEQ ID NO: 6934529 - DNA, 22 bp, Homo sapiens
aaacctctttccattagaggaa

SEQ ID NO: 6934530 - DNA, 22 bp, Homo sapiens
tacaacagaagtgtttatttag

SEQ ID NO: 6934531 - DNA, 22 bp, Homo sapiens
gtgacagagctgggatttgaag

SEQ ID NO: 6934532 - DNA, 19 bp, Homo sapiens
tggtgctggcctcccatgg

SEQ ID NO: 6934533 - DNA, 22 bp, Homo sapiens
tgtcatggcgttgtggggacta

SEQ ID NO: 6934534 - DNA, 22 bp, Homo sapiens
gcaatagtatttattaaagtag

SEQ ID NO: 6934535 - DNA, 22 bp, Homo sapiens
tgcattctatgatatcaaaaca

SEQ ID NO: 6934536 - DNA, 22 bp, Homo sapiens
aatcaggaactcaagtgcattg

SEQ ID NO: 6934537 - DNA, 22 bp, Homo sapiens
tgacagtgcgggtacatcatag

SEQ ID NO: 6934538 - DNA, 22 bp, Homo sapiens
agtacaattatatttagatggt

SEQ ID NO: 6934539 - DNA, 22 bp, Homo sapiens
ggactttaggtgagaaggcatt

SEQ ID NO: 6934540 - DNA, 22 bp, Homo sapiens
aagcaggagagcctgggcgagc

SEQ ID NO: 6934541 - DNA, 22 bp, Homo sapiens
cccactgttgcctcaaatatca

SEQ ID NO: 6934542 - DNA, 22 bp, Homo sapiens
tatcaacaatagccagtgttta

SEQ ID NO: 6934543 - DNA, 22 bp, Homo sapiens
atggtacaatgtgtttgttagg

SEQ ID NO: 6934544 - DNA, 22 bp, Homo sapiens
tcattgaggaaaggtagtggct

SEQ ID NO: 6934545 - DNA, 22 bp, Homo sapiens
tttagcatgttcctttcataga

SEQ ID NO: 6934546 - DNA, 22 bp, Homo sapiens
tcaatcataatgaagtgaagaa

SEQ ID NO: 6934547 - DNA, 22 bp, Homo sapiens
tgtctcttggctctatcactta

SEQ ID NO: 6934548 - DNA, 22 bp, Homo sapiens
gctgggcactgtcccataggct

SEQ ID NO: 6934549 - DNA, 22 bp, Homo sapiens
agtgaatacatgtcactcagca

SEQ ID NO: 6934550 - DNA, 22 bp, Homo sapiens
atatgtgtgatgcatggactaa

SEQ ID NO: 6934551 - DNA, 22 bp, Homo sapiens
ctgtaaatggaactatgtagta

SEQ ID NO: 6934552 - DNA, 22 bp, Homo sapiens
ttctgtatctttcttcaagatt

SEQ ID NO: 6934553 - DNA, 22 bp, Homo sapiens
gtgctcagaaacttgctcattt

SEQ ID NO: 6934554 - DNA, 22 bp, Homo sapiens
acacagtgccaaattgcagtta

SEQ ID NO: 6934555 - DNA, 22 bp, Homo sapiens
ggtgtctcagctgctggcaggg

SEQ ID NO: 6934556 - DNA, 22 bp, Homo sapiens
agcaacacgcagtagtatacga

SEQ ID NO: 6934557 - DNA, 17 bp, Homo sapiens
tggcatgagggtgtggg

SEQ ID NO: 6934558 - DNA, 22 bp, Homo sapiens
gtggcagttgctgtggcaataa

SEQ ID NO: 6934559 - DNA, 22 bp, Homo sapiens
cctggcatggggtctccagcca

SEQ ID NO: 6934560 - DNA, 22 bp, Homo sapiens
ttaaaggcgataaggcagtgtt

SEQ ID NO: 6934561 - DNA, 23 bp, Homo sapiens
agagcatcatgatgctaagtctg

SEQ ID NO: 6934562 - DNA, 22 bp, Homo sapiens
cagggggtggtccaggctgcgc

SEQ ID NO: 6934563 - DNA, 22 bp, Homo sapiens
agggctgctgaggaagccttgc

SEQ ID NO: 6934564 - DNA, 18 bp, Homo sapiens
ccccaaaagtcaccctgg

SEQ ID NO: 6934565 - DNA, 22 bp, Homo sapiens
tcccctcctgcctttgcggtgg

SEQ ID NO: 6934566 - DNA, 22 bp, Homo sapiens
tgggcctaggggagggacctca

SEQ ID NO: 6934567 - DNA, 22 bp, Homo sapiens
tgcacagagagatgagacacgt

SEQ ID NO: 6934568 - DNA, 22 bp, Homo sapiens
aagcgccacgagaagctggacc

SEQ ID NO: 6934569 - DNA, 22 bp, Homo sapiens
caaagccctggaaagatgaaga

SEQ ID NO: 6934570 - DNA, 22 bp, Homo sapiens
ttttatgtgtgaaatgctgtct

SEQ ID NO: 6934571 - DNA, 22 bp, Homo sapiens
gctgtgagaaacagggagtgtc

SEQ ID NO: 6934572 - DNA, 17 bp, Homo sapiens
tggcttcagatgtacat

SEQ ID NO: 6934573 - DNA, 22 bp, Homo sapiens
agtctcttgcacattgtattaa

SEQ ID NO: 6934574 - DNA, 22 bp, Homo sapiens
gccctggcacctcgttgcccag

SEQ ID NO: 6934575 - DNA, 22 bp, Homo sapiens
tggctgagaatgggatgatgcc

SEQ ID NO: 6934576 - DNA, 22 bp, Homo sapiens
tgtgcatgtgtttcatggatct

SEQ ID NO: 6934577 - DNA, 22 bp, Homo sapiens
cagagcacccaaggagcatttg

SEQ ID NO: 6934578 - DNA, 22 bp, Homo sapiens
agctggcacagaccaggagatc

SEQ ID NO: 6934579 - DNA, 22 bp, Homo sapiens
cccttagataatttccttttct

SEQ ID NO: 6934580 - DNA, 22 bp, Homo sapiens
gcactgatgcaaaaatcactca

SEQ ID NO: 6934581 - DNA, 22 bp, Homo sapiens
gtgccacagaccaccgtgctgg

SEQ ID NO: 6934582 - DNA, 22 bp, Homo sapiens
taatgtgatattcctgtccttt

SEQ ID NO: 6934583 - DNA, 22 bp, Homo sapiens
acaggctgccacttgcatccaa

SEQ ID NO: 6934584 - DNA, 22 bp, Homo sapiens
gtgtagatgcttgtgtacaact

SEQ ID NO: 6934585 - DNA, 22 bp, Homo sapiens
tttggaaatttcatcaatagcc

SEQ ID NO: 6934586 - DNA, 22 bp, Homo sapiens
tcacatttggagaaagcctgcc

SEQ ID NO: 6934587 - DNA, 22 bp, Homo sapiens
ttctatgctcaatggagccttt

SEQ ID NO: 6934588 - DNA, 22 bp, Homo sapiens
gcctggtgtgcgccgcgcagct

SEQ ID NO: 6934589 - DNA, 22 bp, Homo sapiens
aggtggagttaagtgtgaactg

SEQ ID NO: 6934590 - DNA, 22 bp, Homo sapiens
ctcacagcagccagtctgcctt

SEQ ID NO: 6934591 - DNA, 22 bp, Homo sapiens
gggcttctaagtgaaagtgtaa

SEQ ID NO: 6934592 - DNA, 18 bp, Homo sapiens
ttagcacctatgtgggta

SEQ ID NO: 6934593 - DNA, 22 bp, Homo sapiens
ctgccctgggccaggaagcggc

SEQ ID NO: 6934594 - DNA, 22 bp, Homo sapiens
ttcattagttctgaagatgtct

SEQ ID NO: 6934595 - DNA, 22 bp, Homo sapiens
acaattccacatggcatgcagg

SEQ ID NO: 6934596 - DNA, 22 bp, Homo sapiens
gcctgggagtgcacagtgaggt

SEQ ID NO: 6934597 - DNA, 22 bp, Homo sapiens
tcctggaggggacagcatgggc

SEQ ID NO: 6934598 - DNA, 22 bp, Homo sapiens
tgttattctctgcctacaagtc

SEQ ID NO: 6934599 - DNA, 22 bp, Homo sapiens
caactttaaatggctatgtctg

SEQ ID NO: 6934600 - DNA, 22 bp, Homo sapiens
gaaggccactttgtgttgagaa

SEQ ID NO: 6934601 - DNA, 20 bp, Homo sapiens
agtgtatgaatctggatggg

SEQ ID NO: 6934602 - DNA, 22 bp, Homo sapiens
aaacagttctcatttgtttaga

SEQ ID NO: 6934603 - DNA, 22 bp, Homo sapiens
cagccagagaaagggcactgcc

SEQ ID NO: 6934604 - DNA, 22 bp, Homo sapiens
gtccactcccagtgcctgaggc

SEQ ID NO: 6934605 - DNA, 18 bp, Homo sapiens
ggctccagtcttcagtgg

SEQ ID NO: 6934606 - DNA, 15 bp, Homo sapiens
gcttctccagatgac

SEQ ID NO: 6934607 - DNA, 22 bp, Homo sapiens
gggacagaggcaaactagcaga

SEQ ID NO: 6934608 - DNA, 22 bp, Homo sapiens
ttccccaggtgattctcatggc

SEQ ID NO: 6934609 - DNA, 22 bp, Homo sapiens
aggtaagcgctattatgatctt

SEQ ID NO: 6934610 - DNA, 22 bp, Homo sapiens
tcttggcttctgtatttcctgt

SEQ ID NO: 6934611 - DNA, 22 bp, Homo sapiens
gaatttcctctaaacccctgag

SEQ ID NO: 6934612 - DNA, 22 bp, Homo sapiens
gcaaagcaaatgcctgaaggcg

SEQ ID NO: 6934613 - DNA, 21 bp, Homo sapiens
tgctaggccatattggttgct

SEQ ID NO: 6934614 - DNA, 22 bp, Homo sapiens
tctgctttcttgcgcagatgtg

SEQ ID NO: 6934615 - DNA, 22 bp, Homo sapiens
acttcctgcaatcgtccactcc

SEQ ID NO: 6934616 - DNA, 22 bp, Homo sapiens
gcatggcatttgaaggtagaag

SEQ ID NO: 6934617 - DNA, 22 bp, Homo sapiens
caacagctgatctttgatgaag

SEQ ID NO: 6934618 - DNA, 22 bp, Homo sapiens
gaaggttatgggggttggatta

SEQ ID NO: 6934619 - DNA, 22 bp, Homo sapiens
atggttgagaaggtaaggtacc

SEQ ID NO: 6934620 - DNA, 22 bp, Homo sapiens
gggatccatccgtgcagcagag

SEQ ID NO: 6934621 - DNA, 22 bp, Homo sapiens
aagggctggccacattctgggt

SEQ ID NO: 6934622 - DNA, 17 bp, Homo sapiens
tgaagttaggctgcaga

SEQ ID NO: 6934623 - DNA, 22 bp, Homo sapiens
tgtcctgtgtagaatgtttata

SEQ ID NO: 6934624 - DNA, 22 bp, Homo sapiens
ggtgagcagctgtctgtatgga

SEQ ID NO: 6934625 - DNA, 22 bp, Homo sapiens
ccacatgctctctctccaggtt

SEQ ID NO: 6934626 - DNA, 22 bp, Homo sapiens
agataagctgtttttcaagaat

SEQ ID NO: 6934627 - DNA, 22 bp, Homo sapiens
atgatctgataatcatccacta

SEQ ID NO: 6934628 - DNA, 22 bp, Homo sapiens
ttctagaaggcaggctgggcca

SEQ ID NO: 6934629 - DNA, 22 bp, Homo sapiens
atctacatgttgatttaaagaa

SEQ ID NO: 6934630 - DNA, 22 bp, Homo sapiens
ccaggtgcactcaagacctgct

SEQ ID NO: 6934631 - DNA, 22 bp, Homo sapiens
atagatcacaatggttcacttt

SEQ ID NO: 6934632 - DNA, 22 bp, Homo sapiens
acagaaattgctaatagctcat

SEQ ID NO: 6934633 - DNA, 22 bp, Homo sapiens
tgtcaggtagagataatggggg

SEQ ID NO: 6934634 - DNA, 22 bp, Homo sapiens
gagaatatttttagctttcctc

SEQ ID NO: 6934635 - DNA, 22 bp, Homo sapiens
attcacattctagggccctact

SEQ ID NO: 6934636 - DNA, 22 bp, Homo sapiens
aacaggcaacagttgactctga

SEQ ID NO: 6934637 - DNA, 22 bp, Homo sapiens
gtttgtcaatgacttaggcgtt

SEQ ID NO: 6934638 - DNA, 22 bp, Homo sapiens
cagaaaggactttggttggctt

SEQ ID NO: 6934639 - DNA, 22 bp, Homo sapiens
tttgtgttaaatgttaaattca

SEQ ID NO: 6934640 - DNA, 22 bp, Homo sapiens
ttacagtttacataagaattgt

SEQ ID NO: 6934641 - DNA, 20 bp, Homo sapiens
ctaactaaccactttctgat

SEQ ID NO: 6934642 - DNA, 22 bp, Homo sapiens
cccagctacctctgctaggaga

SEQ ID NO: 6934643 - DNA, 22 bp, Homo sapiens
aaagcagccactctctctgcct

SEQ ID NO: 6934644 - DNA, 22 bp, Homo sapiens
cctcagaggttttcattctgta

SEQ ID NO: 6934645 - DNA, 22 bp, Homo sapiens
actagctccaggctgaattgca

SEQ ID NO: 6934646 - DNA, 22 bp, Homo sapiens
tagctagctgtggcttaaaata

SEQ ID NO: 6934647 - DNA, 21 bp, Homo sapiens
gtagataaagcattttcatta

SEQ ID NO: 6934648 - DNA, 22 bp, Homo sapiens
tcagacagagaagtacaatgag

SEQ ID NO: 6934649 - DNA, 22 bp, Homo sapiens
attggctccctgtgatctggtg

SEQ ID NO: 6934650 - DNA, 22 bp, Homo sapiens
tggagccagcggcctgctgagg

SEQ ID NO: 6934651 - DNA, 20 bp, Homo sapiens
ggctgcctccttcctttcct

SEQ ID NO: 6934652 - DNA, 22 bp, Homo sapiens
catgttgggcatgcatatgtgt

SEQ ID NO: 6934653 - DNA, 22 bp, Homo sapiens
tgcagtttgccctttgctcact

SEQ ID NO: 6934654 - DNA, 19 bp, Homo sapiens
ccttgtttggtctttgagc

SEQ ID NO: 6934655 - DNA, 22 bp, Homo sapiens
cctgcagagggagggccttatt

SEQ ID NO: 6934656 - DNA, 22 bp, Homo sapiens
gcatgtgggagggtcttcccac

SEQ ID NO: 6934657 - DNA, 22 bp, Homo sapiens
gactattttgcacaaaacaatt

SEQ ID NO: 6934658 - DNA, 22 bp, Homo sapiens
tctgaggtcataaagcaacttt

SEQ ID NO: 6934659 - DNA, 22 bp, Homo sapiens
taggggctcagaacatgtcctt

SEQ ID NO: 6934660 - DNA, 22 bp, Homo sapiens
aggcaagaccagaaagggctga

SEQ ID NO: 6934661 - DNA, 19 bp, Homo sapiens
tccttccccccagcacaga

SEQ ID NO: 6934662 - DNA, 22 bp, Homo sapiens
gcccaagctggactgcagtggc

SEQ ID NO: 6934663 - DNA, 22 bp, Homo sapiens
ttggaggcaatgggaaggaggc

SEQ ID NO: 6934664 - DNA, 22 bp, Homo sapiens
tagaatctgaatgtagagctga

SEQ ID NO: 6934665 - DNA, 22 bp, Homo sapiens
aggcagggctgggattagactc

SEQ ID NO: 6934666 - DNA, 22 bp, Homo sapiens
gaaggcccagcttgaatgctgc

SEQ ID NO: 6934667 - DNA, 22 bp, Homo sapiens
tctaagcctcagaccacgctgc

SEQ ID NO: 6934668 - DNA, 19 bp, Homo sapiens
catctatcctcattctctg

SEQ ID NO: 6934669 - DNA, 18 bp, Homo sapiens
tgcatcatttatgggtca

SEQ ID NO: 6934670 - DNA, 22 bp, Homo sapiens
tctcataaggtcagatttcaca

SEQ ID NO: 6934671 - DNA, 19 bp, Homo sapiens
tttatttgagacatgcctt

SEQ ID NO: 6934672 - DNA, 22 bp, Homo sapiens
ttgcatttaagtagatgttaca

SEQ ID NO: 6934673 - DNA, 22 bp, Homo sapiens
atcacctgcacaaatgtgttcc

SEQ ID NO: 6934674 - DNA, 22 bp, Homo sapiens
atccccttcacaccctctgcat

SEQ ID NO: 6934675 - DNA, 22 bp, Homo sapiens
gtgcatttgacgaatactcact

SEQ ID NO: 6934676 - DNA, 22 bp, Homo sapiens
ttataacaacagtttactttaa

SEQ ID NO: 6934677 - DNA, 22 bp, Homo sapiens
agctgcaactgtccttgccttg

SEQ ID NO: 6934678 - DNA, 22 bp, Homo sapiens
gctgtgtgttcaataatgtgat

SEQ ID NO: 6934679 - DNA, 22 bp, Homo sapiens
cagggctccccgcaccgcagcc

SEQ ID NO: 6934680 - DNA, 23 bp, Homo sapiens
agtgccattgaccctatgtctat

SEQ ID NO: 6934681 - DNA, 22 bp, Homo sapiens
atcagtgtattcatagggaata

SEQ ID NO: 6934682 - DNA, 22 bp, Homo sapiens
atcctatggctagcagatgctg

SEQ ID NO: 6934683 - DNA, 22 bp, Homo sapiens
aggacttctgaggtcaagtcgc

SEQ ID NO: 6934684 - DNA, 22 bp, Homo sapiens
agcattagattaaaaatttaga

SEQ ID NO: 6934685 - DNA, 22 bp, Homo sapiens
acttgttaactctcaaagaaca

SEQ ID NO: 6934686 - DNA, 22 bp, Homo sapiens
tatttgatgaaggtaaagtctt

SEQ ID NO: 6934687 - DNA, 22 bp, Homo sapiens
tgccttagagcactcaagagtg

SEQ ID NO: 6934688 - DNA, 18 bp, Homo sapiens
tgaattagtttgtggttt

SEQ ID NO: 6934689 - DNA, 21 bp, Homo sapiens
actgtggggttcaactggcag

SEQ ID NO: 6934690 - DNA, 22 bp, Homo sapiens
tctttaattgtggaagagcagc

SEQ ID NO: 6934691 - DNA, 22 bp, Homo sapiens
cactcaggctgtgtcaggagga

SEQ ID NO: 6934692 - DNA, 22 bp, Homo sapiens
cccaggagatctggatctcgtc

SEQ ID NO: 6934693 - DNA, 22 bp, Homo sapiens
gctattcatcaattgttctagc

SEQ ID NO: 6934694 - DNA, 22 bp, Homo sapiens
agttcagaggttaatttatttg

SEQ ID NO: 6934695 - DNA, 22 bp, Homo sapiens
acaggactgtggaaggatctct

SEQ ID NO: 6934696 - DNA, 22 bp, Homo sapiens
ttggctgctcagtgatatgaga

SEQ ID NO: 6934697 - DNA, 22 bp, Homo sapiens
tcagtgtcatcacttaatataa

SEQ ID NO: 6934698 - DNA, 22 bp, Homo sapiens
tggcatgctatgggcaaaaggg

SEQ ID NO: 6934699 - DNA, 22 bp, Homo sapiens
caacacattgaagctatgatga

SEQ ID NO: 6934700 - DNA, 22 bp, Homo sapiens
atttccattttcagccattact

SEQ ID NO: 6934701 - DNA, 22 bp, Homo sapiens
aggtagcatattccagacttgt

SEQ ID NO: 6934702 - DNA, 22 bp, Homo sapiens
gttaaacaataactggcacaca

SEQ ID NO: 6934703 - DNA, 22 bp, Homo sapiens
acatctagaagatctgggagat

SEQ ID NO: 6934704 - DNA, 22 bp, Homo sapiens
atgcaaataaagcaactataca

SEQ ID NO: 6934705 - DNA, 22 bp, Homo sapiens
tatgttcagaagaagaatgggg

SEQ ID NO: 6934706 - DNA, 22 bp, Homo sapiens
tggccttggctgagagatttaa

SEQ ID NO: 6934707 - DNA, 22 bp, Homo sapiens
tttagcttggagtcctctggga

SEQ ID NO: 6934708 - DNA, 22 bp, Homo sapiens
ggaggggtgctcagctgtcacg

SEQ ID NO: 6934709 - DNA, 22 bp, Homo sapiens
ctaatttttgttctgcattgaa

SEQ ID NO: 6934710 - DNA, 22 bp, Homo sapiens
catgttatttatccattaaaca

SEQ ID NO: 6934711 - DNA, 22 bp, Homo sapiens
ttttataagcaagaaagggaaa

SEQ ID NO: 6934712 - DNA, 22 bp, Homo sapiens
tagcacacaaataaaggagaaa

SEQ ID NO: 6934713 - DNA, 20 bp, Homo sapiens
attcatgtctttataaaagc

SEQ ID NO: 6934714 - DNA, 22 bp, Homo sapiens
acacagagtatttagaaggggt

SEQ ID NO: 6934715 - DNA, 22 bp, Homo sapiens
tattactcttagtggaaggtga

SEQ ID NO: 6934716 - DNA, 22 bp, Homo sapiens
cctggatctttgttgtaaatat

SEQ ID NO: 6934717 - DNA, 22 bp, Homo sapiens
agcttggtggccctcctggctg

SEQ ID NO: 6934718 - DNA, 22 bp, Homo sapiens
gggttgtgggatagagaaggag

SEQ ID NO: 6934719 - DNA, 19 bp, Homo sapiens
tggcacagatttcctccct

SEQ ID NO: 6934720 - DNA, 22 bp, Homo sapiens
ttattggagctggaggctgttt

SEQ ID NO: 6934721 - DNA, 22 bp, Homo sapiens
atctgggcatggaggaaagaga

SEQ ID NO: 6934722 - DNA, 22 bp, Homo sapiens
tctgagtcctaaacccccaggg

SEQ ID NO: 6934723 - DNA, 19 bp, Homo sapiens
gctgtgaatatcatgaggg

SEQ ID NO: 6934724 - DNA, 22 bp, Homo sapiens
agggtggcactggtggctctat

SEQ ID NO: 6934725 - DNA, 22 bp, Homo sapiens
tgctggagctccgggctgtagg

SEQ ID NO: 6934726 - DNA, 22 bp, Homo sapiens
cacaaagtgttagatgccactc

SEQ ID NO: 6934727 - DNA, 22 bp, Homo sapiens
ttcaaactcttgctctgctagt

SEQ ID NO: 6934728 - DNA, 22 bp, Homo sapiens
ttgtgggatggctcttcccaaa

SEQ ID NO: 6934729 - DNA, 22 bp, Homo sapiens
acaggtggcttccattttctaa

SEQ ID NO: 6934730 - DNA, 22 bp, Homo sapiens
gaatctaaaaacgggcttggtt

SEQ ID NO: 6934731 - DNA, 22 bp, Homo sapiens
gttgcacagttcctcaagcagg

SEQ ID NO: 6934732 - DNA, 22 bp, Homo sapiens
aggctggcccacctcttgtctt

SEQ ID NO: 6934733 - DNA, 22 bp, Homo sapiens
gcctcctagagctccagggact

SEQ ID NO: 6934734 - DNA, 22 bp, Homo sapiens
ttcctagggcagagccgctggg

SEQ ID NO: 6934735 - DNA, 22 bp, Homo sapiens
ggtgtggggaggttctgcttct

SEQ ID NO: 6934736 - DNA, 20 bp, Homo sapiens
tgcaggacagagcctgtgtg

SEQ ID NO: 6934737 - DNA, 22 bp, Homo sapiens
acctggatgctggccttgcctt

SEQ ID NO: 6934738 - DNA, 21 bp, Homo sapiens
tgagtgccacctgctggccaa

SEQ ID NO: 6934739 - DNA, 22 bp, Homo sapiens
taggtgcaggtcacaagggatg

SEQ ID NO: 6934740 - DNA, 22 bp, Homo sapiens
agttgtcacctctattcaaatc

SEQ ID NO: 6934741 - DNA, 22 bp, Homo sapiens
ttgtacagattttcctcggtct

SEQ ID NO: 6934742 - DNA, 22 bp, Homo sapiens
aaggctgagacagcacaggtcc

SEQ ID NO: 6934743 - DNA, 22 bp, Homo sapiens
gatccttatttggtcaagcttc

SEQ ID NO: 6934744 - DNA, 22 bp, Homo sapiens
gtggcagaaatgggactttgag

SEQ ID NO: 6934745 - DNA, 22 bp, Homo sapiens
ctgggtagaagattcctcagga

SEQ ID NO: 6934746 - DNA, 18 bp, Homo sapiens
gagcttgaaatggctttt

SEQ ID NO: 6934747 - DNA, 22 bp, Homo sapiens
aatgtcttgagaagagaaatct

SEQ ID NO: 6934748 - DNA, 22 bp, Homo sapiens
ttacattaagccaatggattct

SEQ ID NO: 6934749 - DNA, 22 bp, Homo sapiens
actgctgtgatctgatgtaatt

SEQ ID NO: 6934750 - DNA, 22 bp, Homo sapiens
caagagacgggcaaggcaagag

SEQ ID NO: 6934751 - DNA, 22 bp, Homo sapiens
gggctgtcacgcccctgcacct

SEQ ID NO: 6934752 - DNA, 22 bp, Homo sapiens
tggtgagctggaaggggctttg

SEQ ID NO: 6934753 - DNA, 22 bp, Homo sapiens
cataggaatgaggacaattagc

SEQ ID NO: 6934754 - DNA, 22 bp, Homo sapiens
gagaacactaatggtttcttaa

SEQ ID NO: 6934755 - DNA, 22 bp, Homo sapiens
aatcactttgcactcttatttg

SEQ ID NO: 6934756 - DNA, 22 bp, Homo sapiens
gtcatcttctctcagcccaggc

SEQ ID NO: 6934757 - DNA, 22 bp, Homo sapiens
tgaggtggttactgtggtgctc

SEQ ID NO: 6934758 - DNA, 22 bp, Homo sapiens
aggaaattgtctttttccttgt

SEQ ID NO: 6934759 - DNA, 22 bp, Homo sapiens
tttctaacagcaaatgtttatc

SEQ ID NO: 6934760 - DNA, 22 bp, Homo sapiens
tacttgttgatcagttgttaaa

SEQ ID NO: 6934761 - DNA, 22 bp, Homo sapiens
ccagaggctggcaagggctcct

SEQ ID NO: 6934762 - DNA, 22 bp, Homo sapiens
tcccttcaataattcaacatta

SEQ ID NO: 6934763 - DNA, 17 bp, Homo sapiens
atacagtttattttaca

SEQ ID NO: 6934764 - DNA, 22 bp, Homo sapiens
ctttcattcttagatattagtg

SEQ ID NO: 6934765 - DNA, 22 bp, Homo sapiens
agaccctggggaaagtcacttc

SEQ ID NO: 6934766 - DNA, 22 bp, Homo sapiens
ctgccctggaaaacgtatctta

SEQ ID NO: 6934767 - DNA, 22 bp, Homo sapiens
ttctagggaggagaacttgtga

SEQ ID NO: 6934768 - DNA, 22 bp, Homo sapiens
catcagtctgaaagccagggag

SEQ ID NO: 6934769 - DNA, 22 bp, Homo sapiens
acagcaggttacagtggcacag

SEQ ID NO: 6934770 - DNA, 22 bp, Homo sapiens
ccctcattgcctcctgcgtgca

SEQ ID NO: 6934771 - DNA, 22 bp, Homo sapiens
cattcacaaaaccacatgccat

SEQ ID NO: 6934772 - DNA, 22 bp, Homo sapiens
agccaggtcaggaaaggtccca

SEQ ID NO: 6934773 - DNA, 22 bp, Homo sapiens
tgttacagaaagtttatgaatg

SEQ ID NO: 6934774 - DNA, 22 bp, Homo sapiens
ctgggaagccatgtttctagga

SEQ ID NO: 6934775 - DNA, 20 bp, Homo sapiens
ctagcctggccttgctctgg

SEQ ID NO: 6934776 - DNA, 22 bp, Homo sapiens
atgtagatgttggtttaaattt

SEQ ID NO: 6934777 - DNA, 21 bp, Homo sapiens
tgtgttaaaggctgaggtccc

SEQ ID NO: 6934778 - DNA, 22 bp, Homo sapiens
aacagtgttttgctctttgccc

SEQ ID NO: 6934779 - DNA, 22 bp, Homo sapiens
tcaaattatttaggatagtgct

SEQ ID NO: 6934780 - DNA, 22 bp, Homo sapiens
tagcaaataaaacagtattgaa

SEQ ID NO: 6934781 - DNA, 22 bp, Homo sapiens
ttcatagtgtttccttccagtg

SEQ ID NO: 6934782 - DNA, 22 bp, Homo sapiens
tcagagacagtattggctattg

SEQ ID NO: 6934783 - DNA, 22 bp, Homo sapiens
ggaaattgatctgagctcacct

SEQ ID NO: 6934784 - DNA, 22 bp, Homo sapiens
ttggaaaggagattctattgtg

SEQ ID NO: 6934785 - DNA, 22 bp, Homo sapiens
ttcagtgacttacctggagcca

SEQ ID NO: 6934786 - DNA, 22 bp, Homo sapiens
agttcatttaaatcaggtactt

SEQ ID NO: 6934787 - DNA, 22 bp, Homo sapiens
gggcctgtctcactccctggtt

SEQ ID NO: 6934788 - DNA, 22 bp, Homo sapiens
ctcgtttgcacacaaggctttt

SEQ ID NO: 6934789 - DNA, 23 bp, Homo sapiens
gcccagagaggctcaccaggaat

SEQ ID NO: 6934790 - DNA, 22 bp, Homo sapiens
tgtgacagatctttaaataatg

SEQ ID NO: 6934791 - DNA, 22 bp, Homo sapiens
tggagtcagtggctattgggca

SEQ ID NO: 6934792 - DNA, 22 bp, Homo sapiens
tggccgctatgagtcacctgca

SEQ ID NO: 6934793 - DNA, 22 bp, Homo sapiens
caggcagctgcgacaagagagc

SEQ ID NO: 6934794 - DNA, 23 bp, Homo sapiens
agggaagggggcttattccacag

SEQ ID NO: 6934795 - DNA, 23 bp, Homo sapiens
gctctatcaggaacaagccaggt

SEQ ID NO: 6934796 - DNA, 22 bp, Homo sapiens
ctatgaccccagcatgaataag

SEQ ID NO: 6934797 - DNA, 22 bp, Homo sapiens
aaatgttcaccagatccatgac

SEQ ID NO: 6934798 - DNA, 22 bp, Homo sapiens
actgcaccttgcggtcctgtgg

SEQ ID NO: 6934799 - DNA, 20 bp, Homo sapiens
ataaaactctaatctggcct

SEQ ID NO: 6934800 - DNA, 22 bp, Homo sapiens
acagtgttgtggctcttaatag

SEQ ID NO: 6934801 - DNA, 22 bp, Homo sapiens
actcccttttcccgtaatctat

SEQ ID NO: 6934802 - DNA, 22 bp, Homo sapiens
ctctggagcatttcacctacat

SEQ ID NO: 6934803 - DNA, 22 bp, Homo sapiens
agggggtgggaagtctagaatc

SEQ ID NO: 6934804 - DNA, 22 bp, Homo sapiens
tgtctccaactcactgtatact

SEQ ID NO: 6934805 - DNA, 22 bp, Homo sapiens
tgatttgaactctgggacttgt

SEQ ID NO: 6934806 - DNA, 23 bp, Homo sapiens
gacaggtaagggttgggagaatc

SEQ ID NO: 6934807 - DNA, 22 bp, Homo sapiens
gccctgaacgaggggtctggag

SEQ ID NO: 6934808 - DNA, 16 bp, Homo sapiens
tgtttgcaaagcaatc

SEQ ID NO: 6934809 - DNA, 22 bp, Homo sapiens
acaaagcttagacctaagagat

SEQ ID NO: 6934810 - DNA, 22 bp, Homo sapiens
gctgaaggtgtgtggagagagg

SEQ ID NO: 6934811 - DNA, 22 bp, Homo sapiens
cagctgtcagccggtgcaggct

SEQ ID NO: 6934812 - DNA, 22 bp, Homo sapiens
ctggcccagttctgcgttttgc

SEQ ID NO: 6934813 - DNA, 22 bp, Homo sapiens
agtgaaattgctgtaagaggaa

SEQ ID NO: 6934814 - DNA, 22 bp, Homo sapiens
aaggagggttcccaggtcctgg

SEQ ID NO: 6934815 - DNA, 19 bp, Homo sapiens
gcaccctggccactcccac

SEQ ID NO: 6934816 - DNA, 22 bp, Homo sapiens
tcaggctgttcctgtccaaaat

SEQ ID NO: 6934817 - DNA, 22 bp, Homo sapiens
atataattctcaggtttgacta

SEQ ID NO: 6934818 - DNA, 16 bp, Homo sapiens
aggcagagatttaccc

SEQ ID NO: 6934819 - DNA, 22 bp, Homo sapiens
aagaacatgaacctcttctaac

SEQ ID NO: 6934820 - DNA, 22 bp, Homo sapiens
ctgcaggagggctggggaagcc

SEQ ID NO: 6934821 - DNA, 20 bp, Homo sapiens
tgaattctagatgactggag

SEQ ID NO: 6934822 - DNA, 22 bp, Homo sapiens
aagtccgctttcattctcttca

SEQ ID NO: 6934823 - DNA, 22 bp, Homo sapiens
gggaccctgggaggctggcgca

SEQ ID NO: 6934824 - DNA, 22 bp, Homo sapiens
tgccagccaggttctgaggcta

SEQ ID NO: 6934825 - DNA, 22 bp, Homo sapiens
gcttctaatttcctttgagatt

SEQ ID NO: 6934826 - DNA, 22 bp, Homo sapiens
tctgtttcctcttgtgtaaagt

SEQ ID NO: 6934827 - DNA, 23 bp, Homo sapiens
ataaattactatctccctagagc

SEQ ID NO: 6934828 - DNA, 22 bp, Homo sapiens
ataatcattcacataaggtgct

SEQ ID NO: 6934829 - DNA, 22 bp, Homo sapiens
gccattgtgaaatgttaatgta

SEQ ID NO: 6934830 - DNA, 22 bp, Homo sapiens
gaagctaatgatttattttctg

SEQ ID NO: 6934831 - DNA, 22 bp, Homo sapiens
tcccagcctttcttttctgctg

SEQ ID NO: 6934832 - DNA, 22 bp, Homo sapiens
cagaataaaagtcccaaggcat

SEQ ID NO: 6934833 - DNA, 22 bp, Homo sapiens
gagtgtgcttagagagctgcat

SEQ ID NO: 6934834 - DNA, 19 bp, Homo sapiens
tgtgataagcagaattcca

SEQ ID NO: 6934835 - DNA, 22 bp, Homo sapiens
ctgggctggataattctttgct

SEQ ID NO: 6934836 - DNA, 22 bp, Homo sapiens
gtagtttaattcctggcctttc

SEQ ID NO: 6934837 - DNA, 22 bp, Homo sapiens
aggacagtggtgttctggagtg

SEQ ID NO: 6934838 - DNA, 22 bp, Homo sapiens
ggcaagctcaggcctcaggtgt

SEQ ID NO: 6934839 - DNA, 22 bp, Homo sapiens
gcctggcttcccttggagcatt

SEQ ID NO: 6934840 - DNA, 19 bp, Homo sapiens
gaggtgggtccccgcagcc

SEQ ID NO: 6934841 - DNA, 22 bp, Homo sapiens
agtaagttagtacctgctcaga

SEQ ID NO: 6934842 - DNA, 23 bp, Homo sapiens
cttcatcaaaagttaacactagt

SEQ ID NO: 6934843 - DNA, 22 bp, Homo sapiens
tccaatcaactctggactcctg

SEQ ID NO: 6934844 - DNA, 22 bp, Homo sapiens
ttaatacaagcatatgcacaca

SEQ ID NO: 6934845 - DNA, 22 bp, Homo sapiens
acagttctaaatcttggataat

SEQ ID NO: 6934846 - DNA, 22 bp, Homo sapiens
ctaggccatattttgagaactg

SEQ ID NO: 6934847 - DNA, 22 bp, Homo sapiens
tattcacaggctggagtgatgt

SEQ ID NO: 6934848 - DNA, 22 bp, Homo sapiens
gcaagcaagcaggtagagctga

SEQ ID NO: 6934849 - DNA, 19 bp, Homo sapiens
ggaccaggtcctgggcagc

SEQ ID NO: 6934850 - DNA, 22 bp, Homo sapiens
gtctcagtgggagggtgatggg

SEQ ID NO: 6934851 - DNA, 22 bp, Homo sapiens
tatgctactagaaataaaatgg

SEQ ID NO: 6934852 - DNA, 22 bp, Homo sapiens
gcttagtgaaacaacctttggc

SEQ ID NO: 6934853 - DNA, 22 bp, Homo sapiens
ggtcttgaaggacatccagtcc

SEQ ID NO: 6934854 - DNA, 22 bp, Homo sapiens
tagcaggagtgtgttctatttt

SEQ ID NO: 6934855 - DNA, 19 bp, Homo sapiens
tccaggccattcccagagc

SEQ ID NO: 6934856 - DNA, 22 bp, Homo sapiens
aggggcatcagttgcacatttt

SEQ ID NO: 6934857 - DNA, 23 bp, Homo sapiens
tgcagccgattctattgaattca

SEQ ID NO: 6934858 - DNA, 22 bp, Homo sapiens
tccatctgtctttcccatccac

SEQ ID NO: 6934859 - DNA, 18 bp, Homo sapiens
agtgagttgttgaaagaa

SEQ ID NO: 6934860 - DNA, 19 bp, Homo sapiens
aatgcctcagagacttaag

SEQ ID NO: 6934861 - DNA, 22 bp, Homo sapiens
agtggcaaaagcaggcttaggc

SEQ ID NO: 6934862 - DNA, 22 bp, Homo sapiens
ttttaagttaatataattgagg

SEQ ID NO: 6934863 - DNA, 22 bp, Homo sapiens
tgcaggaatagctacagagctg

SEQ ID NO: 6934864 - DNA, 22 bp, Homo sapiens
tgtcttcatctccatgcacaga

SEQ ID NO: 6934865 - DNA, 22 bp, Homo sapiens
agatgcatgtttatgtctttcc

SEQ ID NO: 6934866 - DNA, 22 bp, Homo sapiens
acactgtaaacatctcaagcac

SEQ ID NO: 6934867 - DNA, 22 bp, Homo sapiens
gcccatccatggggtcatggcc

SEQ ID NO: 6934868 - DNA, 18 bp, Homo sapiens
tcctgcctgtgccccagg

SEQ ID NO: 6934869 - DNA, 22 bp, Homo sapiens
tggaagcacaggatcagtggaa

SEQ ID NO: 6934870 - DNA, 22 bp, Homo sapiens
gagttaatactgagtttattaa

SEQ ID NO: 6934871 - DNA, 22 bp, Homo sapiens
ttgatttcactctctgtccaat

SEQ ID NO: 6934872 - DNA, 22 bp, Homo sapiens
tccatctacggctataccaccc

SEQ ID NO: 6934873 - DNA, 22 bp, Homo sapiens
tgaagaatcccagggaatttgg

SEQ ID NO: 6934874 - DNA, 22 bp, Homo sapiens
gacagccagtgcgatggattca

SEQ ID NO: 6934875 - DNA, 22 bp, Homo sapiens
ggaggggtctctagcgaggaga

SEQ ID NO: 6934876 - DNA, 22 bp, Homo sapiens
aagccttccctttttgagctca

SEQ ID NO: 6934877 - DNA, 20 bp, Homo sapiens
taccataaaatgctgatgga

SEQ ID NO: 6934878 - DNA, 22 bp, Homo sapiens
ctgcttcacttcggttgcatag

SEQ ID NO: 6934879 - DNA, 22 bp, Homo sapiens
ttgacaaagtttagtaataatc

SEQ ID NO: 6934880 - DNA, 22 bp, Homo sapiens
gtctggcattcttcctggagaa

SEQ ID NO: 6934881 - DNA, 22 bp, Homo sapiens
agtgactgacacctgtaatccc

SEQ ID NO: 6934882 - DNA, 22 bp, Homo sapiens
taatgcttctgttaggatcttc

SEQ ID NO: 6934883 - DNA, 22 bp, Homo sapiens
ttccatgcctagaacaggattc

SEQ ID NO: 6934884 - DNA, 22 bp, Homo sapiens
cttttcattgtttgtacatgca

SEQ ID NO: 6934885 - DNA, 21 bp, Homo sapiens
ttctgttttttgtaccagggc

SEQ ID NO: 6934886 - DNA, 22 bp, Homo sapiens
aaggtctgtggccacctctggg

SEQ ID NO: 6934887 - DNA, 22 bp, Homo sapiens
tacctggacatcagagagacac

SEQ ID NO: 6934888 - DNA, 22 bp, Homo sapiens
gtctttgttctgcactattgtc

SEQ ID NO: 6934889 - DNA, 22 bp, Homo sapiens
tccagccatgcatgacaatcac

SEQ ID NO: 6934890 - DNA, 22 bp, Homo sapiens
cttttctggaatcatctctaac

SEQ ID NO: 6934891 - DNA, 22 bp, Homo sapiens
cctgaccatttgccacatgggt

SEQ ID NO: 6934892 - DNA, 22 bp, Homo sapiens
aaggtgcctggctttgccttct

SEQ ID NO: 6934893 - DNA, 22 bp, Homo sapiens
gcacttaactggaaaagaattt

SEQ ID NO: 6934894 - DNA, 22 bp, Homo sapiens
gtctgcctgggacgctgggagt

SEQ ID NO: 6934895 - DNA, 22 bp, Homo sapiens
tgtgtacttccccctgacctgt

SEQ ID NO: 6934896 - DNA, 22 bp, Homo sapiens
cacaaacctgccagccctgccc

SEQ ID NO: 6934897 - DNA, 22 bp, Homo sapiens
acatatctgtgaggttttgttg

SEQ ID NO: 6934898 - DNA, 22 bp, Homo sapiens
tctgcagacttgcctaagtgtg

SEQ ID NO: 6934899 - DNA, 22 bp, Homo sapiens
aaaggccacactgctctttctc

SEQ ID NO: 6934900 - DNA, 22 bp, Homo sapiens
aggtgctgaactggtgaggtct

SEQ ID NO: 6934901 - DNA, 22 bp, Homo sapiens
atctgtccctggtccaagattt

SEQ ID NO: 6934902 - DNA, 22 bp, Homo sapiens
tcagaaaccccaacaatggaga

SEQ ID NO: 6934903 - DNA, 22 bp, Homo sapiens
gcctgagaaggataggaagcga

SEQ ID NO: 6934904 - DNA, 22 bp, Homo sapiens
cagtcacctagacagaacttac

SEQ ID NO: 6934905 - DNA, 22 bp, Homo sapiens
tgcaagagcccaccacacactt

SEQ ID NO: 6934906 - DNA, 22 bp, Homo sapiens
ctaaatgtctcagagggagaca

SEQ ID NO: 6934907 - DNA, 22 bp, Homo sapiens
actgggcccagtggtgtggctg

SEQ ID NO: 6934908 - DNA, 22 bp, Homo sapiens
aaaggccaagcatgaggtggac

SEQ ID NO: 6934909 - DNA, 22 bp, Homo sapiens
gagcagtagagtacatggctcc

SEQ ID NO: 6934910 - DNA, 22 bp, Homo sapiens
ttgttcctgccaagccaagcct

SEQ ID NO: 6934911 - DNA, 22 bp, Homo sapiens
cctgagatttcattgtctggcc

SEQ ID NO: 6934912 - DNA, 22 bp, Homo sapiens
agtgaccaatcatggttagatt

SEQ ID NO: 6934913 - DNA, 18 bp, Homo sapiens
ggaaaccttggactcgcc

SEQ ID NO: 6934914 - DNA, 22 bp, Homo sapiens
agctggggctgtggttgtgatt

SEQ ID NO: 6934915 - DNA, 22 bp, Homo sapiens
cagacaaggccatctttcattt

SEQ ID NO: 6934916 - DNA, 22 bp, Homo sapiens
ctctgacaccatctcatgacag

SEQ ID NO: 6934917 - DNA, 22 bp, Homo sapiens
tgcattggaaactcagcagcac

SEQ ID NO: 6934918 - DNA, 22 bp, Homo sapiens
aatacagagaatgttatttgga

SEQ ID NO: 6934919 - DNA, 22 bp, Homo sapiens
ttaggaagcaggcctaaaattt

SEQ ID NO: 6934920 - DNA, 22 bp, Homo sapiens
cttatctgagaaagatgctaca

SEQ ID NO: 6934921 - DNA, 22 bp, Homo sapiens
tccttttgagctcctatgtggg

SEQ ID NO: 6934922 - DNA, 22 bp, Homo sapiens
aaggtctcaagttttccaaagt

SEQ ID NO: 6934923 - DNA, 22 bp, Homo sapiens
tcttttaaaagccctgctgtct

SEQ ID NO: 6934924 - DNA, 22 bp, Homo sapiens
ttgcatgtgtaaggttgtttat

SEQ ID NO: 6934925 - DNA, 22 bp, Homo sapiens
ggcctagagcagggctaaggtc

SEQ ID NO: 6934926 - DNA, 22 bp, Homo sapiens
tttaaggcttcactggagtggg

SEQ ID NO: 6934927 - DNA, 22 bp, Homo sapiens
ctcctggctctgccacttacta

SEQ ID NO: 6934928 - DNA, 22 bp, Homo sapiens
ctgaggcccctcttgtgagcat

SEQ ID NO: 6934929 - DNA, 22 bp, Homo sapiens
ttcacattagtggttctatata

SEQ ID NO: 6934930 - DNA, 22 bp, Homo sapiens
ggcttcttctttctcaaacccc

SEQ ID NO: 6934931 - DNA, 22 bp, Homo sapiens
cacagagcaactcaaatcagct

SEQ ID NO: 6934932 - DNA, 22 bp, Homo sapiens
ttagagccccagaaaacagtgg

SEQ ID NO: 6934933 - DNA, 18 bp, Homo sapiens
aggcttacagcagcaggc

SEQ ID NO: 6934934 - DNA, 22 bp, Homo sapiens
ctctggtcaagcaaagaggttt

SEQ ID NO: 6934935 - DNA, 22 bp, Homo sapiens
ttctcagggtttgtgcaggctt

SEQ ID NO: 6934936 - DNA, 22 bp, Homo sapiens
gtaaactgattgttggagttac

SEQ ID NO: 6934937 - DNA, 22 bp, Homo sapiens
ggctgtggtctcatctagcctt

SEQ ID NO: 6934938 - DNA, 22 bp, Homo sapiens
ttggcagtgtctgcaaaatgga

SEQ ID NO: 6934939 - DNA, 22 bp, Homo sapiens
ccactattactgtgtggcagtc

SEQ ID NO: 6934940 - DNA, 22 bp, Homo sapiens
gggctgactctgcactgagcca

SEQ ID NO: 6934941 - DNA, 22 bp, Homo sapiens
gctgtttctggttctgttccta

SEQ ID NO: 6934942 - DNA, 22 bp, Homo sapiens
atatattacaaaagaggaagga

SEQ ID NO: 6934943 - DNA, 22 bp, Homo sapiens
atgtctttaaacttgagttgtt

SEQ ID NO: 6934944 - DNA, 22 bp, Homo sapiens
tcacagaaaagtggagagccta

SEQ ID NO: 6934945 - DNA, 22 bp, Homo sapiens
actgcttcctgagaaatcaaca

SEQ ID NO: 6934946 - DNA, 22 bp, Homo sapiens
tttcctggaccaactgagattg

SEQ ID NO: 6934947 - DNA, 22 bp, Homo sapiens
ggctcagaaactaaaggcgctg

SEQ ID NO: 6934948 - DNA, 22 bp, Homo sapiens
gtctccagggacacactagccg

SEQ ID NO: 6934949 - DNA, 22 bp, Homo sapiens
gttgctcaatgggaataagaat

SEQ ID NO: 6934950 - DNA, 22 bp, Homo sapiens
cctaagtctctgccttacgcca

SEQ ID NO: 6934951 - DNA, 22 bp, Homo sapiens
agagcagtcaggctaggacact

SEQ ID NO: 6934952 - DNA, 22 bp, Homo sapiens
cagagccaaacctcagggcccg

SEQ ID NO: 6934953 - DNA, 22 bp, Homo sapiens
ctcagagccagttagcaggtgc

SEQ ID NO: 6934954 - DNA, 22 bp, Homo sapiens
atgaggcaggattaagctatca

SEQ ID NO: 6934955 - DNA, 22 bp, Homo sapiens
tccagtgcattcagacacttgg

SEQ ID NO: 6934956 - DNA, 22 bp, Homo sapiens
gaaatctttatggaaataacaa

SEQ ID NO: 6934957 - DNA, 22 bp, Homo sapiens
tttgctcttgctgcttggggca

SEQ ID NO: 6934958 - DNA, 22 bp, Homo sapiens
gcatggccttgtgctccttctc

SEQ ID NO: 6934959 - DNA, 22 bp, Homo sapiens
agctcttatctctaagcacagc

SEQ ID NO: 6934960 - DNA, 22 bp, Homo sapiens
atcagtggggacgagaagttta

SEQ ID NO: 6934961 - DNA, 22 bp, Homo sapiens
ggtcacaccccaagtacattcg

SEQ ID NO: 6934962 - DNA, 20 bp, Homo sapiens
tatctgctctagtagcagtt

SEQ ID NO: 6934963 - DNA, 22 bp, Homo sapiens
cagtagccactagacacatgta

SEQ ID NO: 6934964 - DNA, 19 bp, Homo sapiens
atacagtaaggtgtttgcc

SEQ ID NO: 6934965 - DNA, 22 bp, Homo sapiens
gtggctcacgtctgtcatctca

SEQ ID NO: 6934966 - DNA, 22 bp, Homo sapiens
aatcagttctacatcttatcca

SEQ ID NO: 6934967 - DNA, 22 bp, Homo sapiens
acatggttgaatgctttatttg

SEQ ID NO: 6934968 - DNA, 22 bp, Homo sapiens
ctttcctgccttattcattcat

SEQ ID NO: 6934969 - DNA, 22 bp, Homo sapiens
ggcagttccagaatttcagtac

SEQ ID NO: 6934970 - DNA, 20 bp, Homo sapiens
cactctaaccatatttcctc

SEQ ID NO: 6934971 - DNA, 22 bp, Homo sapiens
atcaaaatgctccagtgatggt

SEQ ID NO: 6934972 - DNA, 22 bp, Homo sapiens
ttcatcatctacaaccaggacc

SEQ ID NO: 6934973 - DNA, 19 bp, Homo sapiens
tctgtggagctcagagtag

SEQ ID NO: 6934974 - DNA, 22 bp, Homo sapiens
gccagggggtcagcaggcactt

SEQ ID NO: 6934975 - DNA, 22 bp, Homo sapiens
agagactgtgccagccccatgc

SEQ ID NO: 6934976 - DNA, 22 bp, Homo sapiens
atgtcaatttgttctctcgaag

SEQ ID NO: 6934977 - DNA, 22 bp, Homo sapiens
gagatacacaggcagaaaaaga

SEQ ID NO: 6934978 - DNA, 22 bp, Homo sapiens
taaatcactgttcattccacac

SEQ ID NO: 6934979 - DNA, 22 bp, Homo sapiens
tctgtgaaaatgcgaggatctg

SEQ ID NO: 6934980 - DNA, 22 bp, Homo sapiens
taatatggacggctccaaggga

SEQ ID NO: 6934981 - DNA, 19 bp, Homo sapiens
gaggtttctgaagtgggct

SEQ ID NO: 6934982 - DNA, 22 bp, Homo sapiens
tttctctttgacaggaatcaga

SEQ ID NO: 6934983 - DNA, 22 bp, Homo sapiens
tttctaggtgttcacagagcat

SEQ ID NO: 6934984 - DNA, 22 bp, Homo sapiens
attggacttagaaataaagtta

SEQ ID NO: 6934985 - DNA, 22 bp, Homo sapiens
tttcagaggaggaaggcagtta

SEQ ID NO: 6934986 - DNA, 22 bp, Homo sapiens
gctgcctcactccagcccaata

SEQ ID NO: 6934987 - DNA, 22 bp, Homo sapiens
attaaggaggtaaactatggtt

SEQ ID NO: 6934988 - DNA, 22 bp, Homo sapiens
ggacatttgcacctacctcagc

SEQ ID NO: 6934989 - DNA, 22 bp, Homo sapiens
gggcttctctttagtgagctga

SEQ ID NO: 6934990 - DNA, 22 bp, Homo sapiens
gtaccctggggacttcctttta

SEQ ID NO: 6934991 - DNA, 22 bp, Homo sapiens
tggactgagcttgagagggttg

SEQ ID NO: 6934992 - DNA, 22 bp, Homo sapiens
gctgcccagacattgaatcagg

SEQ ID NO: 6934993 - DNA, 22 bp, Homo sapiens
gggctggaagtgcattgatgct

SEQ ID NO: 6934994 - DNA, 22 bp, Homo sapiens
tttgacagatccttaactcagc

SEQ ID NO: 6934995 - DNA, 22 bp, Homo sapiens
tgaaatcagtatgtctttctca

SEQ ID NO: 6934996 - DNA, 22 bp, Homo sapiens
gtgacagagttttagatctcat

SEQ ID NO: 6934997 - DNA, 22 bp, Homo sapiens
cagcagctcactcaggtggctc

SEQ ID NO: 6934998 - DNA, 22 bp, Homo sapiens
ttaacatttgtgaagcatttag

SEQ ID NO: 6934999 - DNA, 22 bp, Homo sapiens
acggcttcttgactgtgggttg

SEQ ID NO: 6935000 - DNA, 21 bp, Homo sapiens
tgttcacatggagcagaatgt

SEQ ID NO: 6935001 - DNA, 22 bp, Homo sapiens
agctatttcaggaaatttgtga

SEQ ID NO: 6935002 - DNA, 22 bp, Homo sapiens
gccaggacctcagatgcagggc

SEQ ID NO: 6935003 - DNA, 19 bp, Homo sapiens
attgagcattacaaataga

SEQ ID NO: 6935004 - DNA, 22 bp, Homo sapiens
tagaactgacgttagggaagaa

SEQ ID NO: 6935005 - DNA, 22 bp, Homo sapiens
acataacactcttctctagtga

SEQ ID NO: 6935006 - DNA, 22 bp, Homo sapiens
tcttctgtgatctatgtgtttt

SEQ ID NO: 6935007 - DNA, 22 bp, Homo sapiens
aaatgttctactttgataatta

SEQ ID NO: 6935008 - DNA, 20 bp, Homo sapiens
tttggagagaaagaagtagt

SEQ ID NO: 6935009 - DNA, 23 bp, Homo sapiens
attgtgagattactatcacactg

SEQ ID NO: 6935010 - DNA, 22 bp, Homo sapiens
cctagcaataaagatatcattt

SEQ ID NO: 6935011 - DNA, 22 bp, Homo sapiens
tccctggcagctgtcctttcag

SEQ ID NO: 6935012 - DNA, 22 bp, Homo sapiens
aagttcctgagctcatatagca

SEQ ID NO: 6935013 - DNA, 22 bp, Homo sapiens
tagtgccaccactgtctttggc

SEQ ID NO: 6935014 - DNA, 22 bp, Homo sapiens
taaatgtgaccttcattttata

SEQ ID NO: 6935015 - DNA, 22 bp, Homo sapiens
gaagcttcgtggctcttcaaat

SEQ ID NO: 6935016 - DNA, 22 bp, Homo sapiens
aataagaaagagtcagcttcag

SEQ ID NO: 6935017 - DNA, 22 bp, Homo sapiens
cctccatcaccatctgccctca

SEQ ID NO: 6935018 - DNA, 22 bp, Homo sapiens
agatagatggtgacaggtatac

SEQ ID NO: 6935019 - DNA, 21 bp, Homo sapiens
cagtggtttataaacaacaga

SEQ ID NO: 6935020 - DNA, 20 bp, Homo sapiens
ccctgagaccagagagcagc

SEQ ID NO: 6935021 - DNA, 22 bp, Homo sapiens
ttgaggtagtacttattattgg

SEQ ID NO: 6935022 - DNA, 22 bp, Homo sapiens
ctggagtcacacacaccaaggt

SEQ ID NO: 6935023 - DNA, 22 bp, Homo sapiens
tcaaacatgaaagcttgatttt

SEQ ID NO: 6935024 - DNA, 22 bp, Homo sapiens
ctacctggtacatagaaatgtt

SEQ ID NO: 6935025 - DNA, 22 bp, Homo sapiens
agctctttgagcaaggcagctc

SEQ ID NO: 6935026 - DNA, 22 bp, Homo sapiens
gctcccaactcaggcctcctcc

SEQ ID NO: 6935027 - DNA, 21 bp, Homo sapiens
ataaacagcatgtgatccatg

SEQ ID NO: 6935028 - DNA, 23 bp, Homo sapiens
ctgtggccctgcttcatgcagcc

SEQ ID NO: 6935029 - DNA, 22 bp, Homo sapiens
cttccctttctggtgacttctc

SEQ ID NO: 6935030 - DNA, 22 bp, Homo sapiens
atgagtaaaaccactatttaca

SEQ ID NO: 6935031 - DNA, 22 bp, Homo sapiens
caagttagttattcttgtgagc

SEQ ID NO: 6935032 - DNA, 22 bp, Homo sapiens
aggacacatgcacaccctgcgt

SEQ ID NO: 6935033 - DNA, 22 bp, Homo sapiens
tcagtgtatggagtgctggatt

SEQ ID NO: 6935034 - DNA, 22 bp, Homo sapiens
cagccaagaaccacagacccag

SEQ ID NO: 6935035 - DNA, 20 bp, Homo sapiens
aaatgctgtgctgttgccat

SEQ ID NO: 6935036 - DNA, 22 bp, Homo sapiens
tgtatatgtgcacatgtgcttc

SEQ ID NO: 6935037 - DNA, 22 bp, Homo sapiens
gagcttggtgcacagtggttaa

SEQ ID NO: 6935038 - DNA, 22 bp, Homo sapiens
tatcagcaccgcggacagcatc

SEQ ID NO: 6935039 - DNA, 22 bp, Homo sapiens
tggaaagtctcttttgactgta

SEQ ID NO: 6935040 - DNA, 22 bp, Homo sapiens
cagctcctgcagctgctgccgt

SEQ ID NO: 6935041 - DNA, 22 bp, Homo sapiens
gagtcaggtccgtggacagtta

SEQ ID NO: 6935042 - DNA, 22 bp, Homo sapiens
gcagtctttgagtatcttcaaa

SEQ ID NO: 6935043 - DNA, 22 bp, Homo sapiens
tagaacagtataggctaaacat

SEQ ID NO: 6935044 - DNA, 22 bp, Homo sapiens
ttctcagatatttactgagcat

SEQ ID NO: 6935045 - DNA, 22 bp, Homo sapiens
ttactttgaatgtcacaagcaa

SEQ ID NO: 6935046 - DNA, 22 bp, Homo sapiens
atccagagttatatccaagcag

SEQ ID NO: 6935047 - DNA, 23 bp, Homo sapiens
ctgaggtggagagtgaggtaagt

SEQ ID NO: 6935048 - DNA, 22 bp, Homo sapiens
aagcagttactatttactatta

SEQ ID NO: 6935049 - DNA, 22 bp, Homo sapiens
gaggagctgtcaccgtgactca

SEQ ID NO: 6935050 - DNA, 22 bp, Homo sapiens
tattggatgattcacttggcag

SEQ ID NO: 6935051 - DNA, 19 bp, Homo sapiens
tcaaagcaagcatgttctg

SEQ ID NO: 6935052 - DNA, 22 bp, Homo sapiens
taataacaattgtaggacatga

SEQ ID NO: 6935053 - DNA, 22 bp, Homo sapiens
cgtctctccgcaggggccttca

SEQ ID NO: 6935054 - DNA, 22 bp, Homo sapiens
ttaggctactgtgactttcctg

SEQ ID NO: 6935055 - DNA, 22 bp, Homo sapiens
aaaggtttttatttatcctgga

SEQ ID NO: 6935056 - DNA, 22 bp, Homo sapiens
aagcttgaatcaatggatatcc

SEQ ID NO: 6935057 - DNA, 22 bp, Homo sapiens
tgtcctggcctccagaaagtcg

SEQ ID NO: 6935058 - DNA, 22 bp, Homo sapiens
gttctggaagcttttgagcaac

SEQ ID NO: 6935059 - DNA, 22 bp, Homo sapiens
ttcagtgcagacgccgaagccc

SEQ ID NO: 6935060 - DNA, 22 bp, Homo sapiens
gatgcaaagaggaccttcagta

SEQ ID NO: 6935061 - DNA, 22 bp, Homo sapiens
cactggaatggattggccgtgg

SEQ ID NO: 6935062 - DNA, 22 bp, Homo sapiens
ttctggtcaatggcctgtaagt

SEQ ID NO: 6935063 - DNA, 22 bp, Homo sapiens
tacagagtaatttgcatgggga

SEQ ID NO: 6935064 - DNA, 22 bp, Homo sapiens
tgaaatatccagcccagcagga

SEQ ID NO: 6935065 - DNA, 21 bp, Homo sapiens
acagtttattagagtaagtgc

SEQ ID NO: 6935066 - DNA, 22 bp, Homo sapiens
aatgggagagaacacaaagtcc

SEQ ID NO: 6935067 - DNA, 22 bp, Homo sapiens
atggtattctctaactcagctt

SEQ ID NO: 6935068 - DNA, 22 bp, Homo sapiens
cagctggttttagcacagttag

SEQ ID NO: 6935069 - DNA, 22 bp, Homo sapiens
tgctataagagtcacttttcct

SEQ ID NO: 6935070 - DNA, 22 bp, Homo sapiens
tacatgtacattgggcattaat

SEQ ID NO: 6935071 - DNA, 22 bp, Homo sapiens
aacagtttatgtaaatgtccag

SEQ ID NO: 6935072 - DNA, 22 bp, Homo sapiens
ggagggtccactgtgaggcaga

SEQ ID NO: 6935073 - DNA, 22 bp, Homo sapiens
aggtggtattgacaaggtggag

SEQ ID NO: 6935074 - DNA, 22 bp, Homo sapiens
attcaacatattctgagtaaaa

SEQ ID NO: 6935075 - DNA, 17 bp, Homo sapiens
gaaaggtcctagaaatc

SEQ ID NO: 6935076 - DNA, 17 bp, Homo sapiens
cctcttcctctcagctg

SEQ ID NO: 6935077 - DNA, 22 bp, Homo sapiens
aagtaacagcatcaagtctcaa

SEQ ID NO: 6935078 - DNA, 22 bp, Homo sapiens
gcaatcattttgtatctccagc

SEQ ID NO: 6935079 - DNA, 15 bp, Homo sapiens
agacagacagtggga

SEQ ID NO: 6935080 - DNA, 17 bp, Homo sapiens
aggtgtggtcaagggag

SEQ ID NO: 6935081 - DNA, 22 bp, Homo sapiens
aggggagctaacaccagagccc

SEQ ID NO: 6935082 - DNA, 22 bp, Homo sapiens
ggtgggcaggtcactctgcctc

SEQ ID NO: 6935083 - DNA, 22 bp, Homo sapiens
agaacagcaggaaggccaggta

SEQ ID NO: 6935084 - DNA, 22 bp, Homo sapiens
cacatttagaggttagcatggt

SEQ ID NO: 6935085 - DNA, 22 bp, Homo sapiens
gccttttaaggcagagggagat

SEQ ID NO: 6935086 - DNA, 22 bp, Homo sapiens
atgggtgtgaaaatggtcatct

SEQ ID NO: 6935087 - DNA, 22 bp, Homo sapiens
atttcacaggccagtggtgggg

SEQ ID NO: 6935088 - DNA, 22 bp, Homo sapiens
ataatggtagatgtccacgcag

SEQ ID NO: 6935089 - DNA, 21 bp, Homo sapiens
ttctgctccagctcctctggg

SEQ ID NO: 6935090 - DNA, 17 bp, Homo sapiens
gcagacacttctattga

SEQ ID NO: 6935091 - DNA, 21 bp, Homo sapiens
agagctgggacttgcctgaga

SEQ ID NO: 6935092 - DNA, 22 bp, Homo sapiens
cggcttcagtaattccatgtcc

SEQ ID NO: 6935093 - DNA, 22 bp, Homo sapiens
ttccagaattttgttctgcttg

SEQ ID NO: 6935094 - DNA, 22 bp, Homo sapiens
tctttcttggtataaagcaggg

SEQ ID NO: 6935095 - DNA, 22 bp, Homo sapiens
tgctgcctccttcctgccagga

SEQ ID NO: 6935096 - DNA, 22 bp, Homo sapiens
ctctgaagccccaaatagtccg

SEQ ID NO: 6935097 - DNA, 22 bp, Homo sapiens
aagtgggaatagaaatgaaggt

SEQ ID NO: 6935098 - DNA, 22 bp, Homo sapiens
tggctgcctcagtgtccctgca

SEQ ID NO: 6935099 - DNA, 22 bp, Homo sapiens
gcacagggagcaggtctctggt

SEQ ID NO: 6935100 - DNA, 22 bp, Homo sapiens
tacatcatgaaagcatacatca

SEQ ID NO: 6935101 - DNA, 19 bp, Homo sapiens
acccattttcagtattggc

SEQ ID NO: 6935102 - DNA, 22 bp, Homo sapiens
gcagccaggaaagctggaccct

SEQ ID NO: 6935103 - DNA, 22 bp, Homo sapiens
ctgagcccttgtcttcctggtc

SEQ ID NO: 6935104 - DNA, 22 bp, Homo sapiens
tcatctgaacatgcagcctgtg

SEQ ID NO: 6935105 - DNA, 22 bp, Homo sapiens
ctcaatgagggaaggacagagg

SEQ ID NO: 6935106 - DNA, 22 bp, Homo sapiens
cctggactcagaggtgctggtg

SEQ ID NO: 6935107 - DNA, 22 bp, Homo sapiens
gctgagagatcaaggcaggatt

SEQ ID NO: 6935108 - DNA, 22 bp, Homo sapiens
acagggctccttgggctgacac

SEQ ID NO: 6935109 - DNA, 22 bp, Homo sapiens
acccaggaggtggaggctgcag

SEQ ID NO: 6935110 - DNA, 18 bp, Homo sapiens
attgtcagaagtcatgtg

SEQ ID NO: 6935111 - DNA, 22 bp, Homo sapiens
agttagcaaataccacaatctg

SEQ ID NO: 6935112 - DNA, 22 bp, Homo sapiens
actgttcccagattctcacatt

SEQ ID NO: 6935113 - DNA, 22 bp, Homo sapiens
acagataaatttataggagtgt

SEQ ID NO: 6935114 - DNA, 22 bp, Homo sapiens
gcagctgtactggcagcattgt

SEQ ID NO: 6935115 - DNA, 19 bp, Homo sapiens
tgccagagatactcccaga

SEQ ID NO: 6935116 - DNA, 22 bp, Homo sapiens
aggcagggtcttgctatgttgc

SEQ ID NO: 6935117 - DNA, 22 bp, Homo sapiens
catggctgcgagaagagtgggt

SEQ ID NO: 6935118 - DNA, 22 bp, Homo sapiens
gttagcaaaatgtttttgaggc

SEQ ID NO: 6935119 - DNA, 22 bp, Homo sapiens
agaggtattaggtaattcagta

SEQ ID NO: 6935120 - DNA, 22 bp, Homo sapiens
gcagcttggggacatgaaaaga

SEQ ID NO: 6935121 - DNA, 22 bp, Homo sapiens
ggaagaaaagcttccagcgcct

SEQ ID NO: 6935122 - DNA, 22 bp, Homo sapiens
aggcttcagtattcaccgcatg

SEQ ID NO: 6935123 - DNA, 22 bp, Homo sapiens
tcactgcaacctccacctcccg

SEQ ID NO: 6935124 - DNA, 22 bp, Homo sapiens
gctttatagccctattacatga

SEQ ID NO: 6935125 - DNA, 20 bp, Homo sapiens
ctgaagagactggaggggca

SEQ ID NO: 6935126 - DNA, 22 bp, Homo sapiens
tttggcacctccaaggactcgc

SEQ ID NO: 6935127 - DNA, 22 bp, Homo sapiens
ttccctctgcgcattgaatttc

SEQ ID NO: 6935128 - DNA, 22 bp, Homo sapiens
gaatgtgtactgagtgcccctt

SEQ ID NO: 6935129 - DNA, 22 bp, Homo sapiens
agttcacagcaaagtggggacc

SEQ ID NO: 6935130 - DNA, 22 bp, Homo sapiens
agtcccatcagatgatatgaga

SEQ ID NO: 6935131 - DNA, 22 bp, Homo sapiens
agcataacacccgacactcagg

SEQ ID NO: 6935132 - DNA, 22 bp, Homo sapiens
gcacagctcagtactccctctg

SEQ ID NO: 6935133 - DNA, 22 bp, Homo sapiens
tggactttttaactgataggag

SEQ ID NO: 6935134 - DNA, 22 bp, Homo sapiens
ctgtcttcccgaggccctggag

SEQ ID NO: 6935135 - DNA, 23 bp, Homo sapiens
ctagtaaatcctgaatagcaggc

SEQ ID NO: 6935136 - DNA, 22 bp, Homo sapiens
taagagtataaagtaatgcgga

SEQ ID NO: 6935137 - DNA, 22 bp, Homo sapiens
tacctgcacagccagccatgtg

SEQ ID NO: 6935138 - DNA, 22 bp, Homo sapiens
aaacagcttgtttcaggaaagt

SEQ ID NO: 6935139 - DNA, 22 bp, Homo sapiens
ctgctgagaaatgcatccagtt

SEQ ID NO: 6935140 - DNA, 22 bp, Homo sapiens
aatatccacttcaatacaggca

SEQ ID NO: 6935141 - DNA, 22 bp, Homo sapiens
ttagatgtggacttatgttatt

SEQ ID NO: 6935142 - DNA, 22 bp, Homo sapiens
tgagtattctgaatttcaaact

SEQ ID NO: 6935143 - DNA, 22 bp, Homo sapiens
atcatttgcctcaagtgaaagt

SEQ ID NO: 6935144 - DNA, 22 bp, Homo sapiens
gccccagatggaggaagctggg

SEQ ID NO: 6935145 - DNA, 19 bp, Homo sapiens
cttatacagattttctcat

SEQ ID NO: 6935146 - DNA, 19 bp, Homo sapiens
gggcctcacccacacctcc

SEQ ID NO: 6935147 - DNA, 22 bp, Homo sapiens
agagcctgtcaattgtaaagag

SEQ ID NO: 6935148 - DNA, 22 bp, Homo sapiens
gtgctcactccccacagtgccc

SEQ ID NO: 6935149 - DNA, 22 bp, Homo sapiens
tcttggcatgcatgggcaatca

SEQ ID NO: 6935150 - DNA, 22 bp, Homo sapiens
ttgatccctggaaattgaaatg

SEQ ID NO: 6935151 - DNA, 22 bp, Homo sapiens
ttgtccttccagactcttccac

SEQ ID NO: 6935152 - DNA, 22 bp, Homo sapiens
tttgtcatgttttgtaatgtct

SEQ ID NO: 6935153 - DNA, 22 bp, Homo sapiens
cctgaaaatatcctctcctttg

SEQ ID NO: 6935154 - DNA, 22 bp, Homo sapiens
aggcaaattgtgagaaaatgaa

SEQ ID NO: 6935155 - DNA, 22 bp, Homo sapiens
atttcaagtccaagtcttgggt

SEQ ID NO: 6935156 - DNA, 22 bp, Homo sapiens
tgacagacagcttctcatttta

SEQ ID NO: 6935157 - DNA, 18 bp, Homo sapiens
gagctgagaagaggatgc

SEQ ID NO: 6935158 - DNA, 22 bp, Homo sapiens
tgtggggcagctagccggcctg

SEQ ID NO: 6935159 - DNA, 22 bp, Homo sapiens
aatgatgagaactggagtaatt

SEQ ID NO: 6935160 - DNA, 22 bp, Homo sapiens
aaagtagtctctttcatctttt

SEQ ID NO: 6935161 - DNA, 22 bp, Homo sapiens
cagcatcctttgctggtttccc

SEQ ID NO: 6935162 - DNA, 22 bp, Homo sapiens
tatgcaaatcattagatttcct

SEQ ID NO: 6935163 - DNA, 22 bp, Homo sapiens
taaatgcaagtgctcctgggag

SEQ ID NO: 6935164 - DNA, 22 bp, Homo sapiens
tctgggtgtagggcctggcaac

SEQ ID NO: 6935165 - DNA, 22 bp, Homo sapiens
tggcttgcttccccattctcat

SEQ ID NO: 6935166 - DNA, 22 bp, Homo sapiens
ggctggcagaagtgtgctggct

SEQ ID NO: 6935167 - DNA, 20 bp, Homo sapiens
gaaggcaatggtttggcaca

SEQ ID NO: 6935168 - DNA, 22 bp, Homo sapiens
gccagctgtaagcagtgattct

SEQ ID NO: 6935169 - DNA, 22 bp, Homo sapiens
agacctcaataccaggcaccac

SEQ ID NO: 6935170 - DNA, 22 bp, Homo sapiens
ggctgcctggacctcctctttc

SEQ ID NO: 6935171 - DNA, 22 bp, Homo sapiens
tgagagtagagtcttcatctgt

SEQ ID NO: 6935172 - DNA, 22 bp, Homo sapiens
tctcaccatggtgcttgcttat

SEQ ID NO: 6935173 - DNA, 22 bp, Homo sapiens
gagtgtcagcagggcagagcac

SEQ ID NO: 6935174 - DNA, 22 bp, Homo sapiens
tctttaattcagcatgatgcgg

SEQ ID NO: 6935175 - DNA, 22 bp, Homo sapiens
ttaaagctgctgaatcctattt

SEQ ID NO: 6935176 - DNA, 22 bp, Homo sapiens
ttgattcaaccacttaataatc

SEQ ID NO: 6935177 - DNA, 22 bp, Homo sapiens
tacatacagccaagtatgaagt

SEQ ID NO: 6935178 - DNA, 22 bp, Homo sapiens
agcctcctggagtttctgggat

SEQ ID NO: 6935179 - DNA, 22 bp, Homo sapiens
tggaaggcatgggaactgttct

SEQ ID NO: 6935180 - DNA, 22 bp, Homo sapiens
cccctcctggccacactgtcag

SEQ ID NO: 6935181 - DNA, 22 bp, Homo sapiens
gcttcagattcctcttctgtaa

SEQ ID NO: 6935182 - DNA, 22 bp, Homo sapiens
tgagaggtcaaagggcatggag

SEQ ID NO: 6935183 - DNA, 22 bp, Homo sapiens
tgtttgcaacaactagatggag

SEQ ID NO: 6935184 - DNA, 22 bp, Homo sapiens
caatagctatgtaacctgaaga

SEQ ID NO: 6935185 - DNA, 22 bp, Homo sapiens
tcagtgtttaccgtatgttgtt

SEQ ID NO: 6935186 - DNA, 22 bp, Homo sapiens
aaaggcaaaattcttagcagga

SEQ ID NO: 6935187 - DNA, 22 bp, Homo sapiens
tcatatatctgcaaagcagtat

SEQ ID NO: 6935188 - DNA, 22 bp, Homo sapiens
tggaccacatagtgaggccccc

SEQ ID NO: 6935189 - DNA, 22 bp, Homo sapiens
atacagggacatccagtttttc

SEQ ID NO: 6935190 - DNA, 22 bp, Homo sapiens
tgacccttgccaagttcctttt

SEQ ID NO: 6935191 - DNA, 22 bp, Homo sapiens
ttcacaggttctttttaaggct

SEQ ID NO: 6935192 - DNA, 22 bp, Homo sapiens
tttgccgtcaagtataggattg

SEQ ID NO: 6935193 - DNA, 22 bp, Homo sapiens
atgtgtgtgtttaatcctcaaa

SEQ ID NO: 6935194 - DNA, 22 bp, Homo sapiens
ggcgcaagcgggggttgtgagc

SEQ ID NO: 6935195 - DNA, 22 bp, Homo sapiens
aagccatcgaactgtacactta

SEQ ID NO: 6935196 - DNA, 22 bp, Homo sapiens
tgatgagagaggtcattgaaat

SEQ ID NO: 6935197 - DNA, 22 bp, Homo sapiens
tccagcatgtttgtgctgctga

SEQ ID NO: 6935198 - DNA, 22 bp, Homo sapiens
gcatgtgtgagaccttttagca

SEQ ID NO: 6935199 - DNA, 22 bp, Homo sapiens
ctgcagctttcgctccatcagc

SEQ ID NO: 6935200 - DNA, 22 bp, Homo sapiens
cagagaggaggctatatgcaaa

SEQ ID NO: 6935201 - DNA, 20 bp, Homo sapiens
agtcccagatcaaatttctg

SEQ ID NO: 6935202 - DNA, 22 bp, Homo sapiens
gcaccactacactccagcctgg

SEQ ID NO: 6935203 - DNA, 22 bp, Homo sapiens
tggaggatgcctggggaggcct

SEQ ID NO: 6935204 - DNA, 22 bp, Homo sapiens
cttgttctgtgcttcttacatt

SEQ ID NO: 6935205 - DNA, 22 bp, Homo sapiens
tttgggaatctttgtgcatgac

SEQ ID NO: 6935206 - DNA, 22 bp, Homo sapiens
aaagcactctatcctttgtaga

SEQ ID NO: 6935207 - DNA, 23 bp, Homo sapiens
tgtctgtcatggaatttcaaggt

SEQ ID NO: 6935208 - DNA, 22 bp, Homo sapiens
atcatgtgactaggtttggcca

SEQ ID NO: 6935209 - DNA, 22 bp, Homo sapiens
atcctaagcctctaaggagtgc

SEQ ID NO: 6935210 - DNA, 22 bp, Homo sapiens
tgttgttttctcatggagaata

SEQ ID NO: 6935211 - DNA, 22 bp, Homo sapiens
ttttaggattcacatggattca

SEQ ID NO: 6935212 - DNA, 22 bp, Homo sapiens
agggccagtgggttgaaaggca

SEQ ID NO: 6935213 - DNA, 22 bp, Homo sapiens
gacagcagacagaactacctgc

SEQ ID NO: 6935214 - DNA, 22 bp, Homo sapiens
atgtttgaaattgtaagtatat

SEQ ID NO: 6935215 - DNA, 22 bp, Homo sapiens
tggaagacaggagatgtgtgta

SEQ ID NO: 6935216 - DNA, 22 bp, Homo sapiens
ccagagcctggcatctgcataa

SEQ ID NO: 6935217 - DNA, 22 bp, Homo sapiens
taggatgatcttgtagagagat

SEQ ID NO: 6935218 - DNA, 22 bp, Homo sapiens
ctgcagggcccgcctgagccct

SEQ ID NO: 6935219 - DNA, 22 bp, Homo sapiens
ctgtgcgttgtgaaatgtttag

SEQ ID NO: 6935220 - DNA, 22 bp, Homo sapiens
gtcagatgtttgcgtagggtat

SEQ ID NO: 6935221 - DNA, 22 bp, Homo sapiens
gttatagccatgcttatttgtt

SEQ ID NO: 6935222 - DNA, 22 bp, Homo sapiens
aggggtctttaggaacgtcggg

SEQ ID NO: 6935223 - DNA, 22 bp, Homo sapiens
gagaggaatgaggttaaggact

SEQ ID NO: 6935224 - DNA, 22 bp, Homo sapiens
tgagacaacattgggcaagtcc

SEQ ID NO: 6935225 - DNA, 22 bp, Homo sapiens
aaagttactttgctgtgcttca

SEQ ID NO: 6935226 - DNA, 22 bp, Homo sapiens
tctcatggtttgtgattcaaat

SEQ ID NO: 6935227 - DNA, 22 bp, Homo sapiens
catgccacatggacttcaaacc

SEQ ID NO: 6935228 - DNA, 22 bp, Homo sapiens
ccagggctgctgggggagttga

SEQ ID NO: 6935229 - DNA, 22 bp, Homo sapiens
tccaggaggtgaggggaccaaa

SEQ ID NO: 6935230 - DNA, 17 bp, Homo sapiens
gtgtaactatgagccat

SEQ ID NO: 6935231 - DNA, 22 bp, Homo sapiens
gtgactatttcacatagtcttt

SEQ ID NO: 6935232 - DNA, 22 bp, Homo sapiens
tttgctcacttgtgtattttca

SEQ ID NO: 6935233 - DNA, 18 bp, Homo sapiens
ccatcaccctaactagtg

SEQ ID NO: 6935234 - DNA, 22 bp, Homo sapiens
tgtcttggatgaggattaacag

SEQ ID NO: 6935235 - DNA, 22 bp, Homo sapiens
gcagagcagagcctgcattggc

SEQ ID NO: 6935236 - DNA, 22 bp, Homo sapiens
gtaaggctttgtgcttattcca

SEQ ID NO: 6935237 - DNA, 22 bp, Homo sapiens
tgtaccataatgtgtattttaa

SEQ ID NO: 6935238 - DNA, 22 bp, Homo sapiens
ttgaggtcatatatatttggca

SEQ ID NO: 6935239 - DNA, 22 bp, Homo sapiens
tcctgggactctgcctcaggct

SEQ ID NO: 6935240 - DNA, 22 bp, Homo sapiens
aattctgaggagggaagaggaa

SEQ ID NO: 6935241 - DNA, 22 bp, Homo sapiens
cgtgtacagtctatcttttttc

SEQ ID NO: 6935242 - DNA, 22 bp, Homo sapiens
cctggcacatagtaagtactag

SEQ ID NO: 6935243 - DNA, 22 bp, Homo sapiens
tttaagtgaaatgtaatacagt

SEQ ID NO: 6935244 - DNA, 22 bp, Homo sapiens
acattgtgatccgactgattaa

SEQ ID NO: 6935245 - DNA, 23 bp, Homo sapiens
tctcagaaaggagaagtaatttg

SEQ ID NO: 6935246 - DNA, 22 bp, Homo sapiens
aagtcctgtgctagagacacct

SEQ ID NO: 6935247 - DNA, 23 bp, Homo sapiens
tctgggaccactcaacaagtcag

SEQ ID NO: 6935248 - DNA, 22 bp, Homo sapiens
gctccctgcactctgcagccct

SEQ ID NO: 6935249 - DNA, 22 bp, Homo sapiens
tggcagaattttaaagacagat

SEQ ID NO: 6935250 - DNA, 22 bp, Homo sapiens
atccctcccagagcaagccatt

SEQ ID NO: 6935251 - DNA, 22 bp, Homo sapiens
gtctatgcaacttttagtggga

SEQ ID NO: 6935252 - DNA, 20 bp, Homo sapiens
tctcaggccccctccttgct

SEQ ID NO: 6935253 - DNA, 22 bp, Homo sapiens
gtgctctggccaagcgcgtgcg

SEQ ID NO: 6935254 - DNA, 22 bp, Homo sapiens
ttccagagcctagaatcttgat

SEQ ID NO: 6935255 - DNA, 22 bp, Homo sapiens
tgcctgtgctgggattgcatgt

SEQ ID NO: 6935256 - DNA, 20 bp, Homo sapiens
gagcagctgtttgcattgca

SEQ ID NO: 6935257 - DNA, 20 bp, Homo sapiens
ggcttggctgcctggggagg

SEQ ID NO: 6935258 - DNA, 22 bp, Homo sapiens
ggctctgcagagggcccagctt

SEQ ID NO: 6935259 - DNA, 22 bp, Homo sapiens
cttcctcacggtgcaacaggaa

SEQ ID NO: 6935260 - DNA, 20 bp, Homo sapiens
ccctccagcaaccaggactt

SEQ ID NO: 6935261 - DNA, 22 bp, Homo sapiens
ggcaggtgatctagagtcaata

SEQ ID NO: 6935262 - DNA, 22 bp, Homo sapiens
agaaaagaggctttctaagcat

SEQ ID NO: 6935263 - DNA, 22 bp, Homo sapiens
tttggtccaagttttactcttt

SEQ ID NO: 6935264 - DNA, 21 bp, Homo sapiens
ctacagaggagagggaaaggc

SEQ ID NO: 6935265 - DNA, 22 bp, Homo sapiens
ttcagcatctacatatttagaa

SEQ ID NO: 6935266 - DNA, 22 bp, Homo sapiens
tctggagtgaatgaagtagtgt

SEQ ID NO: 6935267 - DNA, 22 bp, Homo sapiens
aaagttcttagattaatcactg

SEQ ID NO: 6935268 - DNA, 22 bp, Homo sapiens
cagtctctcagctttcagctgt

SEQ ID NO: 6935269 - DNA, 22 bp, Homo sapiens
aatgacagagcactgaacttgg

SEQ ID NO: 6935270 - DNA, 22 bp, Homo sapiens
tccaggctttggggcaggagcg

SEQ ID NO: 6935271 - DNA, 22 bp, Homo sapiens
ttcagaaaggttaatctggatt

SEQ ID NO: 6935272 - DNA, 22 bp, Homo sapiens
gagaattttctagtagtttcat

SEQ ID NO: 6935273 - DNA, 22 bp, Homo sapiens
ggctgcctgggagccctcctct

SEQ ID NO: 6935274 - DNA, 22 bp, Homo sapiens
atgtttatggagcaggtattag

SEQ ID NO: 6935275 - DNA, 23 bp, Homo sapiens
tgaaatgtagaggaattccacct

SEQ ID NO: 6935276 - DNA, 19 bp, Homo sapiens
gttttctgatcttgccccc

SEQ ID NO: 6935277 - DNA, 22 bp, Homo sapiens
ttgaggtagttctattgtgagt

SEQ ID NO: 6935278 - DNA, 22 bp, Homo sapiens
tctaggagtaatgagctagcac

SEQ ID NO: 6935279 - DNA, 22 bp, Homo sapiens
ttattgactcccagcttttcca

SEQ ID NO: 6935280 - DNA, 22 bp, Homo sapiens
agttttctgatgtgtagtgaga

SEQ ID NO: 6935281 - DNA, 22 bp, Homo sapiens
cactgtggtgtgagggctgatg

SEQ ID NO: 6935282 - DNA, 22 bp, Homo sapiens
ggctgggccgcggctacccaga

SEQ ID NO: 6935283 - DNA, 22 bp, Homo sapiens
caggccttgcagtctgttgtaa

SEQ ID NO: 6935284 - DNA, 22 bp, Homo sapiens
gcacagctccgcttcctcacac

SEQ ID NO: 6935285 - DNA, 22 bp, Homo sapiens
tatgtttaaatgtatgtgtatg

SEQ ID NO: 6935286 - DNA, 22 bp, Homo sapiens
tcagttcctctgcccaaggcag

SEQ ID NO: 6935287 - DNA, 22 bp, Homo sapiens
gtgctggggagataggaagaga

SEQ ID NO: 6935288 - DNA, 22 bp, Homo sapiens
cctggggctttctttgtatcat

SEQ ID NO: 6935289 - DNA, 22 bp, Homo sapiens
gtgtgcaggtgtcagtgcagct

SEQ ID NO: 6935290 - DNA, 22 bp, Homo sapiens
gtatgaagtaagatattgttca

SEQ ID NO: 6935291 - DNA, 18 bp, Homo sapiens
cagcctctgattggttgc

SEQ ID NO: 6935292 - DNA, 22 bp, Homo sapiens
aggtacagcaatataagaggtc

SEQ ID NO: 6935293 - DNA, 22 bp, Homo sapiens
atttccatgaagtttagttata

SEQ ID NO: 6935294 - DNA, 22 bp, Homo sapiens
taacatctttagcagctcgaac

SEQ ID NO: 6935295 - DNA, 22 bp, Homo sapiens
agcttgttaaggatgcatatta

SEQ ID NO: 6935296 - DNA, 19 bp, Homo sapiens
cttttcatcaacagccaat

SEQ ID NO: 6935297 - DNA, 22 bp, Homo sapiens
aaggaccagattatccttaata

SEQ ID NO: 6935298 - DNA, 21 bp, Homo sapiens
gctatgaatgtagaaaattat

SEQ ID NO: 6935299 - DNA, 22 bp, Homo sapiens
tttacagcattgctgaaagttc

SEQ ID NO: 6935300 - DNA, 22 bp, Homo sapiens
taaatatcacctggaattgtta

SEQ ID NO: 6935301 - DNA, 22 bp, Homo sapiens
aacagcaccgaagtcgtctaag

SEQ ID NO: 6935302 - DNA, 22 bp, Homo sapiens
ctgtgacagagcttgagtgaga

SEQ ID NO: 6935303 - DNA, 22 bp, Homo sapiens
ggtgtcctacagggccgcaggc

SEQ ID NO: 6935304 - DNA, 22 bp, Homo sapiens
aaaggcattttaattctaaaga

SEQ ID NO: 6935305 - DNA, 22 bp, Homo sapiens
ttatgcctccgaaacctggagt

SEQ ID NO: 6935306 - DNA, 22 bp, Homo sapiens
atagtcagtgtctatatcgttg

SEQ ID NO: 6935307 - DNA, 22 bp, Homo sapiens
ctggagattaagttctcagcca

SEQ ID NO: 6935308 - DNA, 22 bp, Homo sapiens
cactggtcagtcggtcagtctc

SEQ ID NO: 6935309 - DNA, 22 bp, Homo sapiens
tcagagattgaaaacatatcca

SEQ ID NO: 6935310 - DNA, 22 bp, Homo sapiens
ttggacagtactttaaagcaga

SEQ ID NO: 6935311 - DNA, 22 bp, Homo sapiens
ggataaagtctttaggtggaca

SEQ ID NO: 6935312 - DNA, 22 bp, Homo sapiens
caggaggcagaggttgcagcga

SEQ ID NO: 6935313 - DNA, 22 bp, Homo sapiens
cttgtacagatcttgcaaggac

SEQ ID NO: 6935314 - DNA, 22 bp, Homo sapiens
tagcaagtggcaccacatttct

SEQ ID NO: 6935315 - DNA, 20 bp, Homo sapiens
taaggtgatctcagagaagc

SEQ ID NO: 6935316 - DNA, 20 bp, Homo sapiens
ttttggtcttcagacaaggc

SEQ ID NO: 6935317 - DNA, 22 bp, Homo sapiens
gcagatgcctgaaggagctggg

SEQ ID NO: 6935318 - DNA, 17 bp, Homo sapiens
tcaggatgtagcagtag

SEQ ID NO: 6935319 - DNA, 22 bp, Homo sapiens
agcttattaccactccttgggg

SEQ ID NO: 6935320 - DNA, 19 bp, Homo sapiens
ggttaccagtgtgtctggc

SEQ ID NO: 6935321 - DNA, 22 bp, Homo sapiens
ttctaggggtttacattatcca

SEQ ID NO: 6935322 - DNA, 22 bp, Homo sapiens
catgcatatatgctacatgcaa

SEQ ID NO: 6935323 - DNA, 20 bp, Homo sapiens
atgaggccagcagggctcag

SEQ ID NO: 6935324 - DNA, 22 bp, Homo sapiens
cgctgcagctggctgcagggaa

SEQ ID NO: 6935325 - DNA, 22 bp, Homo sapiens
gtgtgcatgcatagacaccaca

SEQ ID NO: 6935326 - DNA, 22 bp, Homo sapiens
attgtacatgcagtgagtcatc

SEQ ID NO: 6935327 - DNA, 20 bp, Homo sapiens
aggtcaacacctagtaagtg

SEQ ID NO: 6935328 - DNA, 22 bp, Homo sapiens
tctcacacttctgtgttgcaca

SEQ ID NO: 6935329 - DNA, 22 bp, Homo sapiens
tctctgtgagatgccttcctga

SEQ ID NO: 6935330 - DNA, 22 bp, Homo sapiens
ctgaattacttattagtgggga

SEQ ID NO: 6935331 - DNA, 22 bp, Homo sapiens
agctcagagaatagggcttgag

SEQ ID NO: 6935332 - DNA, 22 bp, Homo sapiens
tacaaccgtcttgattctttcg

SEQ ID NO: 6935333 - DNA, 22 bp, Homo sapiens
ctgagggaacttgggcaagtct

SEQ ID NO: 6935334 - DNA, 21 bp, Homo sapiens
ctggagtctgggggtggcagt

SEQ ID NO: 6935335 - DNA, 22 bp, Homo sapiens
aggagattgtggtgcaaggaat

SEQ ID NO: 6935336 - DNA, 17 bp, Homo sapiens
gtggagacagatgcctc

SEQ ID NO: 6935337 - DNA, 22 bp, Homo sapiens
tagagcccaatacatttggttg

SEQ ID NO: 6935338 - DNA, 22 bp, Homo sapiens
cttggtctaatggtaataagca

SEQ ID NO: 6935339 - DNA, 22 bp, Homo sapiens
tcccagagcagtactccaggag

SEQ ID NO: 6935340 - DNA, 22 bp, Homo sapiens
agcagggtttggggattggcac

SEQ ID NO: 6935341 - DNA, 22 bp, Homo sapiens
atccaggccccaagaccccgac

SEQ ID NO: 6935342 - DNA, 22 bp, Homo sapiens
gtgtccactccatgcccatcct

SEQ ID NO: 6935343 - DNA, 22 bp, Homo sapiens
tcagaagataaagctttttgtt

SEQ ID NO: 6935344 - DNA, 22 bp, Homo sapiens
taaagtgagtacaaaatgaggg

SEQ ID NO: 6935345 - DNA, 22 bp, Homo sapiens
gtatgtgtgcaaatgtaaatat

SEQ ID NO: 6935346 - DNA, 22 bp, Homo sapiens
gtttcacagtctgcagaatttt

SEQ ID NO: 6935347 - DNA, 22 bp, Homo sapiens
tggctaggacctctgcggagca

SEQ ID NO: 6935348 - DNA, 22 bp, Homo sapiens
cccagggaatgactctggcctt

SEQ ID NO: 6935349 - DNA, 22 bp, Homo sapiens
tttttataggtcagggcaagtc

SEQ ID NO: 6935350 - DNA, 22 bp, Homo sapiens
tgtcatggtatttgtgagctgc

SEQ ID NO: 6935351 - DNA, 22 bp, Homo sapiens
ctctcagaagcttccagtatgg

SEQ ID NO: 6935352 - DNA, 22 bp, Homo sapiens
gctgagggcagcctcctaggtc

SEQ ID NO: 6935353 - DNA, 22 bp, Homo sapiens
ggtttcaacttcaacctctcca

SEQ ID NO: 6935354 - DNA, 22 bp, Homo sapiens
gcagccagagggggtgtgatca

SEQ ID NO: 6935355 - DNA, 22 bp, Homo sapiens
aaaggcatgtgcaactacaaat

SEQ ID NO: 6935356 - DNA, 22 bp, Homo sapiens
gcagtgttgagccagctggggg

SEQ ID NO: 6935357 - DNA, 22 bp, Homo sapiens
caactacaggaaaagtcattca

SEQ ID NO: 6935358 - DNA, 22 bp, Homo sapiens
gaggaaatcttaggccccaacc

SEQ ID NO: 6935359 - DNA, 22 bp, Homo sapiens
aagctgttttggccttagttga

SEQ ID NO: 6935360 - DNA, 22 bp, Homo sapiens
cacttgttggtggtgaaatcac

SEQ ID NO: 6935361 - DNA, 19 bp, Homo sapiens
aggcttctaccctgtccag

SEQ ID NO: 6935362 - DNA, 22 bp, Homo sapiens
tggggtggggttactcattctg

SEQ ID NO: 6935363 - DNA, 22 bp, Homo sapiens
atctcataaacacacatatatg

SEQ ID NO: 6935364 - DNA, 22 bp, Homo sapiens
tcagtttcttcatctccctaac

SEQ ID NO: 6935365 - DNA, 22 bp, Homo sapiens
aaaattatggagtatcccaaag

SEQ ID NO: 6935366 - DNA, 22 bp, Homo sapiens
gtggaaggtgctagaacaagga

SEQ ID NO: 6935367 - DNA, 22 bp, Homo sapiens
agcagcaactgctagagtggca

SEQ ID NO: 6935368 - DNA, 22 bp, Homo sapiens
agtgaaattcctggtctttgtt

SEQ ID NO: 6935369 - DNA, 22 bp, Homo sapiens
gcagagggcaggggtgtttgtt

SEQ ID NO: 6935370 - DNA, 22 bp, Homo sapiens
acagtgcataaaaacaactttt

SEQ ID NO: 6935371 - DNA, 22 bp, Homo sapiens
aagagggaagtcacctggaggt

SEQ ID NO: 6935372 - DNA, 22 bp, Homo sapiens
cttgctgcttgtaagtaaaaca

SEQ ID NO: 6935373 - DNA, 22 bp, Homo sapiens
atcatacatgtaactaagtaaa

SEQ ID NO: 6935374 - DNA, 22 bp, Homo sapiens
cagggtggccaggtagataata

SEQ ID NO: 6935375 - DNA, 22 bp, Homo sapiens
gggctctgggatgctcttagag

SEQ ID NO: 6935376 - DNA, 22 bp, Homo sapiens
ccccatgggtgtagggaggtgg

SEQ ID NO: 6935377 - DNA, 22 bp, Homo sapiens
gcatgtgtctccccagtggagg

SEQ ID NO: 6935378 - DNA, 21 bp, Homo sapiens
gcctggcttcacaggcactga

SEQ ID NO: 6935379 - DNA, 22 bp, Homo sapiens
tgggccctgcccttgtctgtcc

SEQ ID NO: 6935380 - DNA, 21 bp, Homo sapiens
tggcagcacccacaccctctg

SEQ ID NO: 6935381 - DNA, 22 bp, Homo sapiens
gtggcctttcctgaagaaatga

SEQ ID NO: 6935382 - DNA, 22 bp, Homo sapiens
ctttaattaggaagtataatga

SEQ ID NO: 6935383 - DNA, 22 bp, Homo sapiens
caggaagaggtggggctaaagt

SEQ ID NO: 6935384 - DNA, 18 bp, Homo sapiens
ttctggctcactcatgct

SEQ ID NO: 6935385 - DNA, 22 bp, Homo sapiens
ggaggtagtctgagtcataggc

SEQ ID NO: 6935386 - DNA, 22 bp, Homo sapiens
catttcaccttagagaattatt

SEQ ID NO: 6935387 - DNA, 18 bp, Homo sapiens
ttatgcaaaactgttttc

SEQ ID NO: 6935388 - DNA, 22 bp, Homo sapiens
cagttacagctgcaccagagcc

SEQ ID NO: 6935389 - DNA, 22 bp, Homo sapiens
tgatagtatctgattatttcac

SEQ ID NO: 6935390 - DNA, 22 bp, Homo sapiens
taatgcctttctgtactatatg

SEQ ID NO: 6935391 - DNA, 22 bp, Homo sapiens
taaggcaggtatggtaccaggc

SEQ ID NO: 6935392 - DNA, 22 bp, Homo sapiens
tagttatgtctgcatgcatatt

SEQ ID NO: 6935393 - DNA, 22 bp, Homo sapiens
tgaagcaggtgaatggatgtcg

SEQ ID NO: 6935394 - DNA, 22 bp, Homo sapiens
ccaggctgtgcttttcataaat

SEQ ID NO: 6935395 - DNA, 22 bp, Homo sapiens
aggagaccttcaccacttccac

SEQ ID NO: 6935396 - DNA, 22 bp, Homo sapiens
tcagctccacagctcctctgcc

SEQ ID NO: 6935397 - DNA, 22 bp, Homo sapiens
cctgaaatgagttctgctcact

SEQ ID NO: 6935398 - DNA, 22 bp, Homo sapiens
aacttgcttcaacttatttcac

SEQ ID NO: 6935399 - DNA, 18 bp, Homo sapiens
tttactcataggcctgac

SEQ ID NO: 6935400 - DNA, 22 bp, Homo sapiens
acattcaagtttctgctcatgg

SEQ ID NO: 6935401 - DNA, 22 bp, Homo sapiens
aaagcagtgcaccttaattgat

SEQ ID NO: 6935402 - DNA, 22 bp, Homo sapiens
gatattcaactaaagtgaatta

SEQ ID NO: 6935403 - DNA, 22 bp, Homo sapiens
atctaaagtgtttcatgaaaga

SEQ ID NO: 6935404 - DNA, 22 bp, Homo sapiens
atgcactaaatcttttgtgcac

SEQ ID NO: 6935405 - DNA, 22 bp, Homo sapiens
ggctgggcctctccctcagctg

SEQ ID NO: 6935406 - DNA, 22 bp, Homo sapiens
tggaggccggactgagaggcat

SEQ ID NO: 6935407 - DNA, 22 bp, Homo sapiens
ccctgcctgtgggcatcaacat

SEQ ID NO: 6935408 - DNA, 22 bp, Homo sapiens
gaatacatggcagggagtcatc

SEQ ID NO: 6935409 - DNA, 22 bp, Homo sapiens
accgactgagaatacttggctt

SEQ ID NO: 6935410 - DNA, 22 bp, Homo sapiens
acagaggcagtgtgagatactg

SEQ ID NO: 6935411 - DNA, 22 bp, Homo sapiens
attggtcaggactggcatgtgg

SEQ ID NO: 6935412 - DNA, 22 bp, Homo sapiens
aacaggttgaggtcaaatgcaa

SEQ ID NO: 6935413 - DNA, 22 bp, Homo sapiens
tcctgtctgctcacagagctgg

SEQ ID NO: 6935414 - DNA, 22 bp, Homo sapiens
taagttagtcctttttaaaagt

SEQ ID NO: 6935415 - DNA, 22 bp, Homo sapiens
cttaaagtattggtttaaccaa

SEQ ID NO: 6935416 - DNA, 22 bp, Homo sapiens
atttccggtctcagtctctcaa

SEQ ID NO: 6935417 - DNA, 22 bp, Homo sapiens
aggctgtggtgggctttgagcc

SEQ ID NO: 6935418 - DNA, 22 bp, Homo sapiens
acttttaaggggccttgattta

SEQ ID NO: 6935419 - DNA, 22 bp, Homo sapiens
ggcctgctcaaacagattcctg

SEQ ID NO: 6935420 - DNA, 22 bp, Homo sapiens
ggagcccaagtctgcactcggc

SEQ ID NO: 6935421 - DNA, 22 bp, Homo sapiens
tggcattgtcagaataagtgac

SEQ ID NO: 6935422 - DNA, 22 bp, Homo sapiens
attgttccttagaaccatgcct

SEQ ID NO: 6935423 - DNA, 22 bp, Homo sapiens
tcatgcagttttgccacctaag

SEQ ID NO: 6935424 - DNA, 22 bp, Homo sapiens
agattgggctccagttaaaacg

SEQ ID NO: 6935425 - DNA, 22 bp, Homo sapiens
ggagtccataggttcttatggg

SEQ ID NO: 6935426 - DNA, 22 bp, Homo sapiens
tgctgaggaggtggctgtgctt

SEQ ID NO: 6935427 - DNA, 22 bp, Homo sapiens
gccactggacccagggttatca

SEQ ID NO: 6935428 - DNA, 22 bp, Homo sapiens
agatggtaatcacatttatctg

SEQ ID NO: 6935429 - DNA, 22 bp, Homo sapiens
ccagaggtcccctgccaggagg

SEQ ID NO: 6935430 - DNA, 22 bp, Homo sapiens
actgtgcttgccaaaccattga

SEQ ID NO: 6935431 - DNA, 22 bp, Homo sapiens
tggaggaggaacttcttatctc

SEQ ID NO: 6935432 - DNA, 22 bp, Homo sapiens
gacctggggtaagcttggcaac

SEQ ID NO: 6935433 - DNA, 22 bp, Homo sapiens
ttgaaaggaatacagaggccta

SEQ ID NO: 6935434 - DNA, 22 bp, Homo sapiens
ttcaagatggccccagtgagcc

SEQ ID NO: 6935435 - DNA, 21 bp, Homo sapiens
tcagaattacccctggatctg

SEQ ID NO: 6935436 - DNA, 22 bp, Homo sapiens
ctccactctggggtgggtgaga

SEQ ID NO: 6935437 - DNA, 22 bp, Homo sapiens
gaagaaattgaattcatgagct

SEQ ID NO: 6935438 - DNA, 22 bp, Homo sapiens
gcccttggaacagcctcctgct

SEQ ID NO: 6935439 - DNA, 22 bp, Homo sapiens
ttttctcttccctctggacctg

SEQ ID NO: 6935440 - DNA, 22 bp, Homo sapiens
cagtgcaagggtgctgggggca

SEQ ID NO: 6935441 - DNA, 22 bp, Homo sapiens
tatcagtagaacaatggacatt

SEQ ID NO: 6935442 - DNA, 22 bp, Homo sapiens
ggaggctcgctggtcgcacagc

SEQ ID NO: 6935443 - DNA, 22 bp, Homo sapiens
ctgggcacttgctcacagctct

SEQ ID NO: 6935444 - DNA, 19 bp, Homo sapiens
tgggcttccccagggcaga

SEQ ID NO: 6935445 - DNA, 22 bp, Homo sapiens
gccattgggctgtagttttttg

SEQ ID NO: 6935446 - DNA, 22 bp, Homo sapiens
atgggacaggtactagaaaggg

SEQ ID NO: 6935447 - DNA, 22 bp, Homo sapiens
tcttggagatagggtcttaatg

SEQ ID NO: 6935448 - DNA, 22 bp, Homo sapiens
ttcacaggcttggaggtggggg

SEQ ID NO: 6935449 - DNA, 22 bp, Homo sapiens
aagcctggcacattggagtctg

SEQ ID NO: 6935450 - DNA, 22 bp, Homo sapiens
aagtgaatgtttggtagcagtg

SEQ ID NO: 6935451 - DNA, 19 bp, Homo sapiens
ctatgtttatatatccagt

SEQ ID NO: 6935452 - DNA, 22 bp, Homo sapiens
gtgcatgcagtaagtgttttaa

SEQ ID NO: 6935453 - DNA, 22 bp, Homo sapiens
gatggctgccttctccctgtgt

SEQ ID NO: 6935454 - DNA, 22 bp, Homo sapiens
taccaggcagctgcacagaggc

SEQ ID NO: 6935455 - DNA, 22 bp, Homo sapiens
attagtggtatctatcatagaa

SEQ ID NO: 6935456 - DNA, 21 bp, Homo sapiens
atcaacattgaaagagctgga

SEQ ID NO: 6935457 - DNA, 22 bp, Homo sapiens
gatcacataatttggaaacagc

SEQ ID NO: 6935458 - DNA, 22 bp, Homo sapiens
agtgctttgtgctctcactgca

SEQ ID NO: 6935459 - DNA, 22 bp, Homo sapiens
aaaagcagttatctgggaggaa

SEQ ID NO: 6935460 - DNA, 22 bp, Homo sapiens
gcagaagtcagaccatctgaat

SEQ ID NO: 6935461 - DNA, 22 bp, Homo sapiens
tcagctgctctgttgagctgaa

SEQ ID NO: 6935462 - DNA, 22 bp, Homo sapiens
agagactaagccagcatagtgc

SEQ ID NO: 6935463 - DNA, 22 bp, Homo sapiens
ttctgaggccattaccaataaa

SEQ ID NO: 6935464 - DNA, 18 bp, Homo sapiens
ctgccagtgtgctctccg

SEQ ID NO: 6935465 - DNA, 22 bp, Homo sapiens
tagcagctcactaactctgcgt

SEQ ID NO: 6935466 - DNA, 22 bp, Homo sapiens
ttattccattatttcacttagg

SEQ ID NO: 6935467 - DNA, 21 bp, Homo sapiens
caaacggatgcttagagaaat

SEQ ID NO: 6935468 - DNA, 22 bp, Homo sapiens
atgtcttgttaatctgaagcaa

SEQ ID NO: 6935469 - DNA, 22 bp, Homo sapiens
ggcacagcactgtaggcctggg

SEQ ID NO: 6935470 - DNA, 22 bp, Homo sapiens
agtcagtgtcaacaggaagtag

SEQ ID NO: 6935471 - DNA, 22 bp, Homo sapiens
caactaatcctttgaaaagaag

SEQ ID NO: 6935472 - DNA, 18 bp, Homo sapiens
ctgtacttcagcctgggt

SEQ ID NO: 6935473 - DNA, 21 bp, Homo sapiens
tcttgattttggacttcttcc

SEQ ID NO: 6935474 - DNA, 22 bp, Homo sapiens
tgtaaagctttgagtgtttatc

SEQ ID NO: 6935475 - DNA, 22 bp, Homo sapiens
tccagggccttacctcttcaga

SEQ ID NO: 6935476 - DNA, 22 bp, Homo sapiens
gagatccagatttccattcctt

SEQ ID NO: 6935477 - DNA, 22 bp, Homo sapiens
tttgttgtgaacagaataatat

SEQ ID NO: 6935478 - DNA, 22 bp, Homo sapiens
actcatatactgttgtttttaa

SEQ ID NO: 6935479 - DNA, 22 bp, Homo sapiens
catgtggcacaaagaaggaaat

SEQ ID NO: 6935480 - DNA, 23 bp, Homo sapiens
gccagccttgctctcctgcagcc

SEQ ID NO: 6935481 - DNA, 22 bp, Homo sapiens
tgtccatcactgggggggatga

SEQ ID NO: 6935482 - DNA, 22 bp, Homo sapiens
aagagtcccaaaatgattctta

SEQ ID NO: 6935483 - DNA, 22 bp, Homo sapiens
aggccccctccacccattctgg

SEQ ID NO: 6935484 - DNA, 22 bp, Homo sapiens
gccagtcagctggccaggctgg

SEQ ID NO: 6935485 - DNA, 21 bp, Homo sapiens
tgtgtatcttgctgtttccac

SEQ ID NO: 6935486 - DNA, 22 bp, Homo sapiens
atttgttccacacatatttact

SEQ ID NO: 6935487 - DNA, 22 bp, Homo sapiens
tggaagacatactgttttctta

SEQ ID NO: 6935488 - DNA, 19 bp, Homo sapiens
tttggcactctgaagtgtt

SEQ ID NO: 6935489 - DNA, 22 bp, Homo sapiens
tgccttctcccttggaccctga

SEQ ID NO: 6935490 - DNA, 21 bp, Homo sapiens
cataccattctctaagcaaaa

SEQ ID NO: 6935491 - DNA, 22 bp, Homo sapiens
ctcagctccctccacccagacc

SEQ ID NO: 6935492 - DNA, 22 bp, Homo sapiens
aacatgcaaagctatgatgtat

SEQ ID NO: 6935493 - DNA, 22 bp, Homo sapiens
ctgtgcctttgtagctgtgcct

SEQ ID NO: 6935494 - DNA, 22 bp, Homo sapiens
cccaggagagagacttgaatct

SEQ ID NO: 6935495 - DNA, 22 bp, Homo sapiens
gttattgtttatcctgcacccc

SEQ ID NO: 6935496 - DNA, 22 bp, Homo sapiens
acacaggaagagagataataat

SEQ ID NO: 6935497 - DNA, 22 bp, Homo sapiens
agtttggagtgtggtctttgag

SEQ ID NO: 6935498 - DNA, 22 bp, Homo sapiens
ttccgctggggccgcctggcgg

SEQ ID NO: 6935499 - DNA, 22 bp, Homo sapiens
atgtgcttcgccagggcgttgc

SEQ ID NO: 6935500 - DNA, 22 bp, Homo sapiens
tcagtgtgtacactgagcattt

SEQ ID NO: 6935501 - DNA, 17 bp, Homo sapiens
tgtaagcaggtgagaga

SEQ ID NO: 6935502 - DNA, 22 bp, Homo sapiens
tctgtctctttgttctgtgagt

SEQ ID NO: 6935503 - DNA, 22 bp, Homo sapiens
agcctgtgactctgtgaaacca

SEQ ID NO: 6935504 - DNA, 22 bp, Homo sapiens
ctgagggatgggctgggccgcc

SEQ ID NO: 6935505 - DNA, 22 bp, Homo sapiens
tgagcttacttctgtacacaga

SEQ ID NO: 6935506 - DNA, 19 bp, Homo sapiens
ggtttgtagaattgcttaa

SEQ ID NO: 6935507 - DNA, 21 bp, Homo sapiens
tagcacagctgtagacagttt

SEQ ID NO: 6935508 - DNA, 22 bp, Homo sapiens
aatgatgagttctaatagaccc

SEQ ID NO: 6935509 - DNA, 22 bp, Homo sapiens
aaagagcccttccatgactctt

SEQ ID NO: 6935510 - DNA, 22 bp, Homo sapiens
tgagctaagtactctcatcaag

SEQ ID NO: 6935511 - DNA, 22 bp, Homo sapiens
ctgcacaatgcaccatcaagtt

SEQ ID NO: 6935512 - DNA, 22 bp, Homo sapiens
ctgctcttcccactcactccca

SEQ ID NO: 6935513 - DNA, 22 bp, Homo sapiens
acactttgatagataatgcagg

SEQ ID NO: 6935514 - DNA, 22 bp, Homo sapiens
aattccaggatgcaggaggtgc

SEQ ID NO: 6935515 - DNA, 22 bp, Homo sapiens
aaattgcttataaagatgaatg

SEQ ID NO: 6935516 - DNA, 22 bp, Homo sapiens
agcagctgcttttcttcattgg

SEQ ID NO: 6935517 - DNA, 22 bp, Homo sapiens
tgggtgctgctttagggggtca

SEQ ID NO: 6935518 - DNA, 22 bp, Homo sapiens
gctgctgtgcctggcgtcctgt

SEQ ID NO: 6935519 - DNA, 18 bp, Homo sapiens
caaatagcatgatgtcct

SEQ ID NO: 6935520 - DNA, 22 bp, Homo sapiens
tgtgcaatcttgagcaatttat

SEQ ID NO: 6935521 - DNA, 22 bp, Homo sapiens
agggcctgtccgctcccgcccg

SEQ ID NO: 6935522 - DNA, 22 bp, Homo sapiens
agagctgtcacatagagccaga

SEQ ID NO: 6935523 - DNA, 16 bp, Homo sapiens
gctggtcaagcagcag

SEQ ID NO: 6935524 - DNA, 19 bp, Homo sapiens
gcatcgagccccaatcctg

SEQ ID NO: 6935525 - DNA, 15 bp, Homo sapiens
atgaggcatttgggg

SEQ ID NO: 6935526 - DNA, 22 bp, Homo sapiens
gctccagatgaaaggccagagg

SEQ ID NO: 6935527 - DNA, 22 bp, Homo sapiens
ttccttaggctgtttgcagtgc

SEQ ID NO: 6935528 - DNA, 22 bp, Homo sapiens
gaacaaacacatcccagcagtg

SEQ ID NO: 6935529 - DNA, 22 bp, Homo sapiens
gttgtatttgcctgaatgcagt

SEQ ID NO: 6935530 - DNA, 22 bp, Homo sapiens
gctgtgtacctactaactgctt

SEQ ID NO: 6935531 - DNA, 22 bp, Homo sapiens
aagcgccaagggaggtgctttg

SEQ ID NO: 6935532 - DNA, 22 bp, Homo sapiens
ttcatattgcttccgtggagtg

SEQ ID NO: 6935533 - DNA, 22 bp, Homo sapiens
gtttggcataggatgtgggtta

SEQ ID NO: 6935534 - DNA, 22 bp, Homo sapiens
agtgggtagggccagatacctt

SEQ ID NO: 6935535 - DNA, 22 bp, Homo sapiens
acagtaatgataaccagcattt

SEQ ID NO: 6935536 - DNA, 22 bp, Homo sapiens
tttgacaaccaggcaggtaaga

SEQ ID NO: 6935537 - DNA, 22 bp, Homo sapiens
ggcacagcacagagcacatgta

SEQ ID NO: 6935538 - DNA, 22 bp, Homo sapiens
tcctggaggcactcgctggggc

SEQ ID NO: 6935539 - DNA, 22 bp, Homo sapiens
tctgttccatgcagtgtcagat

SEQ ID NO: 6935540 - DNA, 22 bp, Homo sapiens
aagaagttaggtgtaacaatat

SEQ ID NO: 6935541 - DNA, 22 bp, Homo sapiens
tttattgggcctggaggatcta

SEQ ID NO: 6935542 - DNA, 22 bp, Homo sapiens
tgtggactaagcaagggacata

SEQ ID NO: 6935543 - DNA, 22 bp, Homo sapiens
tagaaatctacttagactttct

SEQ ID NO: 6935544 - DNA, 22 bp, Homo sapiens
agcaagatttttcaggttagta

SEQ ID NO: 6935545 - DNA, 22 bp, Homo sapiens
agtgcttgtgaaatactagagg

SEQ ID NO: 6935546 - DNA, 22 bp, Homo sapiens
aagcttgattgtagtctagaca

SEQ ID NO: 6935547 - DNA, 22 bp, Homo sapiens
aatgagatggaggactcttaat

SEQ ID NO: 6935548 - DNA, 22 bp, Homo sapiens
aggaagcctgggaggtttggga

SEQ ID NO: 6935549 - DNA, 22 bp, Homo sapiens
aaactgcagccttgagttcagg

SEQ ID NO: 6935550 - DNA, 22 bp, Homo sapiens
gttggtcaggatggtctcaaac

SEQ ID NO: 6935551 - DNA, 22 bp, Homo sapiens
tgcttctaacacttcatgagca

SEQ ID NO: 6935552 - DNA, 22 bp, Homo sapiens
tttcttcagagagagctttccc

SEQ ID NO: 6935553 - DNA, 20 bp, Homo sapiens
tctggtgccccttcctgaga

SEQ ID NO: 6935554 - DNA, 22 bp, Homo sapiens
agcctccaaatgtcaggtcccg

SEQ ID NO: 6935555 - DNA, 22 bp, Homo sapiens
gggagacacgctgcaggcataa

SEQ ID NO: 6935556 - DNA, 22 bp, Homo sapiens
ccctcgtgcatccatcatttag

SEQ ID NO: 6935557 - DNA, 22 bp, Homo sapiens
cctctgactccacacttgaact

SEQ ID NO: 6935558 - DNA, 22 bp, Homo sapiens
tccttagacaaagagtgggctt

SEQ ID NO: 6935559 - DNA, 22 bp, Homo sapiens
ctattatttcctcatctataaa

SEQ ID NO: 6935560 - DNA, 22 bp, Homo sapiens
gtcaagctaagggctttagaaa

SEQ ID NO: 6935561 - DNA, 22 bp, Homo sapiens
ggccaggctgctgggaccccgc

SEQ ID NO: 6935562 - DNA, 22 bp, Homo sapiens
agtattgtgactcaagtattct

SEQ ID NO: 6935563 - DNA, 22 bp, Homo sapiens
ctctttgggatgggctctgctg

SEQ ID NO: 6935564 - DNA, 22 bp, Homo sapiens
aggcttctgagcatggagtttt

SEQ ID NO: 6935565 - DNA, 22 bp, Homo sapiens
tgcaaatttaatgaaactatgt

SEQ ID NO: 6935566 - DNA, 22 bp, Homo sapiens
ttaaatgtcaatagattgcttg

SEQ ID NO: 6935567 - DNA, 22 bp, Homo sapiens
agccaggccttagggagaggca

SEQ ID NO: 6935568 - DNA, 22 bp, Homo sapiens
gggtcagagttcaggtcgaggg

SEQ ID NO: 6935569 - DNA, 22 bp, Homo sapiens
aaaggaatattcaaaacagtca

SEQ ID NO: 6935570 - DNA, 22 bp, Homo sapiens
cccatgagacctggtttaaggc

SEQ ID NO: 6935571 - DNA, 22 bp, Homo sapiens
gtttcccatatctagggagagg

SEQ ID NO: 6935572 - DNA, 22 bp, Homo sapiens
acatattgagctctaaaagtac

SEQ ID NO: 6935573 - DNA, 22 bp, Homo sapiens
ggaatgtaaatttactgttgta

SEQ ID NO: 6935574 - DNA, 23 bp, Homo sapiens
ataatgacattggcttaggtatg

SEQ ID NO: 6935575 - DNA, 22 bp, Homo sapiens
actgggctgttccttatttcta

SEQ ID NO: 6935576 - DNA, 23 bp, Homo sapiens
taattcacatatacattgcttca

SEQ ID NO: 6935577 - DNA, 22 bp, Homo sapiens
ttccacagtggctgtagttctg

SEQ ID NO: 6935578 - DNA, 22 bp, Homo sapiens
tcactctggcctctgcagcagt

SEQ ID NO: 6935579 - DNA, 22 bp, Homo sapiens
ggggctctgctctgagccgtgt

SEQ ID NO: 6935580 - DNA, 22 bp, Homo sapiens
acctcccctgactcgaaaccca

SEQ ID NO: 6935581 - DNA, 22 bp, Homo sapiens
ttgtgtccatttgagtcatgtg

SEQ ID NO: 6935582 - DNA, 22 bp, Homo sapiens
tcttgctgaaaacaaatctctt

SEQ ID NO: 6935583 - DNA, 22 bp, Homo sapiens
ttgtagaaaattagatgcatgg

SEQ ID NO: 6935584 - DNA, 22 bp, Homo sapiens
ctgtctatcccttccttccttt

SEQ ID NO: 6935585 - DNA, 22 bp, Homo sapiens
ggccatgagcagccctgtggga

SEQ ID NO: 6935586 - DNA, 22 bp, Homo sapiens
agaaatcccaaggcatcaacca

SEQ ID NO: 6935587 - DNA, 22 bp, Homo sapiens
ggggtcctcggagcctgggtct

SEQ ID NO: 6935588 - DNA, 22 bp, Homo sapiens
tccaaattctagggccttggtt

SEQ ID NO: 6935589 - DNA, 15 bp, Homo sapiens
tatgcactgaagtat

SEQ ID NO: 6935590 - DNA, 22 bp, Homo sapiens
taccattttgaaacatttcatc

SEQ ID NO: 6935591 - DNA, 22 bp, Homo sapiens
gtacagtgccagacttctaggt

SEQ ID NO: 6935592 - DNA, 22 bp, Homo sapiens
tgaaagcaacctgtaacagtga

SEQ ID NO: 6935593 - DNA, 22 bp, Homo sapiens
ctggttaaatgaaaaagtatta

SEQ ID NO: 6935594 - DNA, 23 bp, Homo sapiens
actccccagtctcttcttgccaa

SEQ ID NO: 6935595 - DNA, 22 bp, Homo sapiens
cggacaggctcctggagctcct

SEQ ID NO: 6935596 - DNA, 22 bp, Homo sapiens
taaagcagtgttgggtcggacg

SEQ ID NO: 6935597 - DNA, 22 bp, Homo sapiens
acagcatttaaagaaaatgaac

SEQ ID NO: 6935598 - DNA, 22 bp, Homo sapiens
tacagtggggagctcaggagag

SEQ ID NO: 6935599 - DNA, 22 bp, Homo sapiens
gtccttccccagccagctctgg

SEQ ID NO: 6935600 - DNA, 22 bp, Homo sapiens
atctttgaagaggacttgaagt

SEQ ID NO: 6935601 - DNA, 22 bp, Homo sapiens
aaagacttgggagcagtatgct

SEQ ID NO: 6935602 - DNA, 22 bp, Homo sapiens
gtcacaaatcccctcagcaact

SEQ ID NO: 6935603 - DNA, 22 bp, Homo sapiens
atggtcaaatatttgaaatttg

SEQ ID NO: 6935604 - DNA, 22 bp, Homo sapiens
tagaagattctgccaagagcgc

SEQ ID NO: 6935605 - DNA, 23 bp, Homo sapiens
ttgcttccactgtaagtggagaa

SEQ ID NO: 6935606 - DNA, 22 bp, Homo sapiens
tgtagatatagaaaaagactga

SEQ ID NO: 6935607 - DNA, 22 bp, Homo sapiens
agggagctaggatcctgaaggt

SEQ ID NO: 6935608 - DNA, 22 bp, Homo sapiens
ggcccacttgaaatggagctca

SEQ ID NO: 6935609 - DNA, 22 bp, Homo sapiens
aggatgttcgggtcacatagcc

SEQ ID NO: 6935610 - DNA, 22 bp, Homo sapiens
tctaagaaatcagatgatgagg

SEQ ID NO: 6935611 - DNA, 22 bp, Homo sapiens
tctcacccaacgtgcaatgagt

SEQ ID NO: 6935612 - DNA, 22 bp, Homo sapiens
atacacctgtggagtgtctctc

SEQ ID NO: 6935613 - DNA, 22 bp, Homo sapiens
tcctggaactgggctgggcgga

SEQ ID NO: 6935614 - DNA, 22 bp, Homo sapiens
tcctagaaagatgtcttttcac

SEQ ID NO: 6935615 - DNA, 22 bp, Homo sapiens
agtttatgtctttacttcagct

SEQ ID NO: 6935616 - DNA, 22 bp, Homo sapiens
attcccacagctggtataaata

SEQ ID NO: 6935617 - DNA, 21 bp, Homo sapiens
tctttgagaataggtttttca

SEQ ID NO: 6935618 - DNA, 22 bp, Homo sapiens
tatacagataatgaagaccaag

SEQ ID NO: 6935619 - DNA, 21 bp, Homo sapiens
tgtggcagatgttgggaggca

SEQ ID NO: 6935620 - DNA, 22 bp, Homo sapiens
gaagtgttgacttctgtgaatt

SEQ ID NO: 6935621 - DNA, 22 bp, Homo sapiens
tgaaggccacttcctgtgagct

SEQ ID NO: 6935622 - DNA, 22 bp, Homo sapiens
aaagttctattggatagtgctg

SEQ ID NO: 6935623 - DNA, 22 bp, Homo sapiens
cacaaggttctgtaaaatcaaa

SEQ ID NO: 6935624 - DNA, 18 bp, Homo sapiens
actgtggctcagagttgc

SEQ ID NO: 6935625 - DNA, 23 bp, Homo sapiens
aggtttgtctcagaggcagagtt

SEQ ID NO: 6935626 - DNA, 22 bp, Homo sapiens
gtctttatttgagattgtcatt

SEQ ID NO: 6935627 - DNA, 22 bp, Homo sapiens
tccatccctgactcctcctgga

SEQ ID NO: 6935628 - DNA, 22 bp, Homo sapiens
agtgattgttttaaaaatgcct

SEQ ID NO: 6935629 - DNA, 22 bp, Homo sapiens
gaaggctagaaacgatgcttat

SEQ ID NO: 6935630 - DNA, 22 bp, Homo sapiens
catctttgagacagcattaccc

SEQ ID NO: 6935631 - DNA, 22 bp, Homo sapiens
actgcatgataataatagcaga

SEQ ID NO: 6935632 - DNA, 22 bp, Homo sapiens
caacattatatagccacatgcc

SEQ ID NO: 6935633 - DNA, 22 bp, Homo sapiens
tggctgagttacgaacagagca

SEQ ID NO: 6935634 - DNA, 22 bp, Homo sapiens
atttagcaaaaaatgatgaagc

SEQ ID NO: 6935635 - DNA, 22 bp, Homo sapiens
tccaggcacgaggccctgtgca

SEQ ID NO: 6935636 - DNA, 22 bp, Homo sapiens
ttgcagttgttgccttccctga

SEQ ID NO: 6935637 - DNA, 22 bp, Homo sapiens
tctcttaaatacttcacatctc

SEQ ID NO: 6935638 - DNA, 22 bp, Homo sapiens
ctcacagcatggaattttctgg

SEQ ID NO: 6935639 - DNA, 22 bp, Homo sapiens
cactgcactccagcctggcctg

SEQ ID NO: 6935640 - DNA, 22 bp, Homo sapiens
atggatcttccctcatttctga

SEQ ID NO: 6935641 - DNA, 22 bp, Homo sapiens
tgcctgctgctaagctctttgt

SEQ ID NO: 6935642 - DNA, 20 bp, Homo sapiens
tttgggaaatgcaggtttca

SEQ ID NO: 6935643 - DNA, 22 bp, Homo sapiens
gtagtccagagctaaggattat

SEQ ID NO: 6935644 - DNA, 22 bp, Homo sapiens
tgggaagaggatgaggcatatg

SEQ ID NO: 6935645 - DNA, 22 bp, Homo sapiens
cagcaggtgggctttgcggatg

SEQ ID NO: 6935646 - DNA, 22 bp, Homo sapiens
ttggttcagtaggcatgcctgg

SEQ ID NO: 6935647 - DNA, 22 bp, Homo sapiens
aagtaaaatgtttcctttatta

SEQ ID NO: 6935648 - DNA, 22 bp, Homo sapiens
tacttacataaaaactgaatgt

SEQ ID NO: 6935649 - DNA, 22 bp, Homo sapiens
agtctctttgtggactctgcct

SEQ ID NO: 6935650 - DNA, 22 bp, Homo sapiens
ttgaagaattaacagctgtgga

SEQ ID NO: 6935651 - DNA, 22 bp, Homo sapiens
tcatgtgttaaactccaagata

SEQ ID NO: 6935652 - DNA, 22 bp, Homo sapiens
tctgccaggaagaaagcacaat

SEQ ID NO: 6935653 - DNA, 22 bp, Homo sapiens
ttctgcttggttcttggtatga

SEQ ID NO: 6935654 - DNA, 22 bp, Homo sapiens
tgattttattggtgaggaaatt

SEQ ID NO: 6935655 - DNA, 22 bp, Homo sapiens
ggaacatgtagagggcctgtag

SEQ ID NO: 6935656 - DNA, 22 bp, Homo sapiens
tgttctaaattgctagctggaa

SEQ ID NO: 6935657 - DNA, 22 bp, Homo sapiens
caccccacatcaggcttctcca

SEQ ID NO: 6935658 - DNA, 22 bp, Homo sapiens
tcaggaaaatactgcttatcca

SEQ ID NO: 6935659 - DNA, 22 bp, Homo sapiens
gatctgtcaggttcatccgcaa

SEQ ID NO: 6935660 - DNA, 22 bp, Homo sapiens
gtagctccccatgtctgttgca

SEQ ID NO: 6935661 - DNA, 22 bp, Homo sapiens
tccttcatgcctgtaatcccag

SEQ ID NO: 6935662 - DNA, 22 bp, Homo sapiens
aaaggcttgagcatttgttgaa

SEQ ID NO: 6935663 - DNA, 22 bp, Homo sapiens
tgggctgcactgctctttatcg

SEQ ID NO: 6935664 - DNA, 22 bp, Homo sapiens
cactgcttgcagtatgagtgga

SEQ ID NO: 6935665 - DNA, 21 bp, Homo sapiens
gccaagggggtagctattcct

SEQ ID NO: 6935666 - DNA, 22 bp, Homo sapiens
tcaatgttcttggtatatcctt

SEQ ID NO: 6935667 - DNA, 22 bp, Homo sapiens
ttgtgtccctggagcttctgtg

SEQ ID NO: 6935668 - DNA, 22 bp, Homo sapiens
tggctcagaagaaaaggtaaac

SEQ ID NO: 6935669 - DNA, 22 bp, Homo sapiens
ctgagagtcagcttctcctcct

SEQ ID NO: 6935670 - DNA, 22 bp, Homo sapiens
aattatgtagccatatgaaaca

SEQ ID NO: 6935671 - DNA, 22 bp, Homo sapiens
tagatcaagaatgtccacttgt

SEQ ID NO: 6935672 - DNA, 22 bp, Homo sapiens
agacagacttgaaaatgttctt

SEQ ID NO: 6935673 - DNA, 22 bp, Homo sapiens
gttctatgttgagatagctaat

SEQ ID NO: 6935674 - DNA, 22 bp, Homo sapiens
gagtgccttccccatgctttgg

SEQ ID NO: 6935675 - DNA, 22 bp, Homo sapiens
gccaggtgtagtggccacacct

SEQ ID NO: 6935676 - DNA, 22 bp, Homo sapiens
gctttgacactcgcccagccct

SEQ ID NO: 6935677 - DNA, 22 bp, Homo sapiens
ccagggaagctggtcacgcagg

SEQ ID NO: 6935678 - DNA, 22 bp, Homo sapiens
aggagccagtggagttcctgcc

SEQ ID NO: 6935679 - DNA, 22 bp, Homo sapiens
tgatgccatctttccacctata

SEQ ID NO: 6935680 - DNA, 23 bp, Homo sapiens
ggatggagccactttgaaaccac

SEQ ID NO: 6935681 - DNA, 21 bp, Homo sapiens
tgtgaaatagctatgctacat

SEQ ID NO: 6935682 - DNA, 23 bp, Homo sapiens
cccagaggagcagggcgtgagat

SEQ ID NO: 6935683 - DNA, 22 bp, Homo sapiens
ctgatttacatatacaaaagat

SEQ ID NO: 6935684 - DNA, 22 bp, Homo sapiens
atgaagctactgaatatttggt

SEQ ID NO: 6935685 - DNA, 22 bp, Homo sapiens
ctggtcaataatcatgtagtac

SEQ ID NO: 6935686 - DNA, 22 bp, Homo sapiens
gcagcattgtgaggtcctgccc

SEQ ID NO: 6935687 - DNA, 22 bp, Homo sapiens
tactatttttgcaacgtataca

SEQ ID NO: 6935688 - DNA, 22 bp, Homo sapiens
ccatggctaagtatctgtagaa

SEQ ID NO: 6935689 - DNA, 23 bp, Homo sapiens
acagccttctggggcttctgggc

SEQ ID NO: 6935690 - DNA, 22 bp, Homo sapiens
ccaggccagcctggagcatggc

SEQ ID NO: 6935691 - DNA, 19 bp, Homo sapiens
cctctcccatgcttacctc

SEQ ID NO: 6935692 - DNA, 22 bp, Homo sapiens
tcagtgttttccagggtctact

SEQ ID NO: 6935693 - DNA, 22 bp, Homo sapiens
cagttcatccccatgttttcaa

SEQ ID NO: 6935694 - DNA, 18 bp, Homo sapiens
tttagtggtgcatttgac

SEQ ID NO: 6935695 - DNA, 22 bp, Homo sapiens
cattatgttcagtagcttaaaa

SEQ ID NO: 6935696 - DNA, 22 bp, Homo sapiens
ggtctgaattccagcccctctg

SEQ ID NO: 6935697 - DNA, 22 bp, Homo sapiens
actagaaagtttccagagttat

SEQ ID NO: 6935698 - DNA, 22 bp, Homo sapiens
tcagcatgttcttaggtcacag

SEQ ID NO: 6935699 - DNA, 22 bp, Homo sapiens
taagtgatgaaagcagatgtct

SEQ ID NO: 6935700 - DNA, 22 bp, Homo sapiens
aggacagcccttgagagcacat

SEQ ID NO: 6935701 - DNA, 22 bp, Homo sapiens
gttccgcttcatatttggagtc

SEQ ID NO: 6935702 - DNA, 22 bp, Homo sapiens
ggccttggtgccatggccagtt

SEQ ID NO: 6935703 - DNA, 22 bp, Homo sapiens
attccaattgtacttgctttta

SEQ ID NO: 6935704 - DNA, 22 bp, Homo sapiens
gctctgacacatttgttctacc

SEQ ID NO: 6935705 - DNA, 22 bp, Homo sapiens
ggcctagcctctcctgagagag

SEQ ID NO: 6935706 - DNA, 22 bp, Homo sapiens
aacctagagttgccttttttaa

SEQ ID NO: 6935707 - DNA, 22 bp, Homo sapiens
gatgtgtgtgccctgggcctgc

SEQ ID NO: 6935708 - DNA, 22 bp, Homo sapiens
ataaaagtaggaccaacttaca

SEQ ID NO: 6935709 - DNA, 22 bp, Homo sapiens
ttgccccttggccgttaaaaca

SEQ ID NO: 6935710 - DNA, 22 bp, Homo sapiens
tatcttgcctttaactgctcat

SEQ ID NO: 6935711 - DNA, 22 bp, Homo sapiens
tcctccagagatttgagttatt

SEQ ID NO: 6935712 - DNA, 22 bp, Homo sapiens
caacagctcagacacgggacct

SEQ ID NO: 6935713 - DNA, 22 bp, Homo sapiens
aaacctctccactacatgacag

SEQ ID NO: 6935714 - DNA, 22 bp, Homo sapiens
attgatttctgcttactcactg

SEQ ID NO: 6935715 - DNA, 23 bp, Homo sapiens
tgacacaggtcaaaaataagatg

SEQ ID NO: 6935716 - DNA, 22 bp, Homo sapiens
ataacttcagggctgtgacaga

SEQ ID NO: 6935717 - DNA, 22 bp, Homo sapiens
tcagtgttggtcaagaatcagt

SEQ ID NO: 6935718 - DNA, 22 bp, Homo sapiens
attcttcacaaatatatagaag

SEQ ID NO: 6935719 - DNA, 22 bp, Homo sapiens
aatccctgaggcatcaagtaca

SEQ ID NO: 6935720 - DNA, 22 bp, Homo sapiens
aacttgtaaaatagagtgtaca

SEQ ID NO: 6935721 - DNA, 22 bp, Homo sapiens
gccaataacctaagatgggtag

SEQ ID NO: 6935722 - DNA, 21 bp, Homo sapiens
atctgcttaggtttgttcaga

SEQ ID NO: 6935723 - DNA, 22 bp, Homo sapiens
aacatgaaggtaggatggtttt

SEQ ID NO: 6935724 - DNA, 22 bp, Homo sapiens
aagatgtgcatgggtatgcaat

SEQ ID NO: 6935725 - DNA, 22 bp, Homo sapiens
atttgtacaaatttatgttagt

SEQ ID NO: 6935726 - DNA, 22 bp, Homo sapiens
taacagctctgtgtggctgtaa

SEQ ID NO: 6935727 - DNA, 22 bp, Homo sapiens
gagcacctgcctcctcatttga

SEQ ID NO: 6935728 - DNA, 22 bp, Homo sapiens
tcagcttcgcctgaggtatggg

SEQ ID NO: 6935729 - DNA, 22 bp, Homo sapiens
cacatgcatcacgacttccttt

SEQ ID NO: 6935730 - DNA, 22 bp, Homo sapiens
tttttccttaggggttactcac

SEQ ID NO: 6935731 - DNA, 22 bp, Homo sapiens
ctctgtagccatgggtatattc

SEQ ID NO: 6935732 - DNA, 22 bp, Homo sapiens
gtgccagaggccccaaacaagt

SEQ ID NO: 6935733 - DNA, 22 bp, Homo sapiens
taccaaagattaaatagcaaca

SEQ ID NO: 6935734 - DNA, 22 bp, Homo sapiens
gcacagccagcatctgagggat

SEQ ID NO: 6935735 - DNA, 19 bp, Homo sapiens
agcagggagtggttgtggg

SEQ ID NO: 6935736 - DNA, 22 bp, Homo sapiens
tgaggcctcttggtatggtgtg

SEQ ID NO: 6935737 - DNA, 22 bp, Homo sapiens
ctctgctgtctcagatgggcca

SEQ ID NO: 6935738 - DNA, 22 bp, Homo sapiens
tctctgtagagacagcactgtg

SEQ ID NO: 6935739 - DNA, 22 bp, Homo sapiens
taacacagttctctgttgcaca

SEQ ID NO: 6935740 - DNA, 22 bp, Homo sapiens
tacatatttgtctttgtactgt

SEQ ID NO: 6935741 - DNA, 21 bp, Homo sapiens
tgaggatgtgcagcagcagga

SEQ ID NO: 6935742 - DNA, 22 bp, Homo sapiens
agtagaaagaaggcactgggcc

SEQ ID NO: 6935743 - DNA, 22 bp, Homo sapiens
tttgtttagatggtaaatcagt

SEQ ID NO: 6935744 - DNA, 22 bp, Homo sapiens
cagttagcactcagtttccaga

SEQ ID NO: 6935745 - DNA, 22 bp, Homo sapiens
agaagtggtgtgtggccgagct

SEQ ID NO: 6935746 - DNA, 22 bp, Homo sapiens
agctgttttactcagaaacata

SEQ ID NO: 6935747 - DNA, 22 bp, Homo sapiens
attagcataagtgttcggtgca

SEQ ID NO: 6935748 - DNA, 20 bp, Homo sapiens
gagatttccaatcatgccca

SEQ ID NO: 6935749 - DNA, 22 bp, Homo sapiens
gatgttcagtggttgaccataa

SEQ ID NO: 6935750 - DNA, 22 bp, Homo sapiens
gtaatttaattctctgacttga

SEQ ID NO: 6935751 - DNA, 22 bp, Homo sapiens
gtgatgtagccctaattctgca

SEQ ID NO: 6935752 - DNA, 22 bp, Homo sapiens
gcagatgaagtttacaggaaac

SEQ ID NO: 6935753 - DNA, 22 bp, Homo sapiens
tcataaagttatcaccaaatcc

SEQ ID NO: 6935754 - DNA, 21 bp, Homo sapiens
gccatcttgcaagatgagaaa

SEQ ID NO: 6935755 - DNA, 22 bp, Homo sapiens
tccaaaggccctgagttcactt

SEQ ID NO: 6935756 - DNA, 22 bp, Homo sapiens
cctgctcagctgtcctcacgct

SEQ ID NO: 6935757 - DNA, 19 bp, Homo sapiens
gccgaccgttggggtgccc

SEQ ID NO: 6935758 - DNA, 22 bp, Homo sapiens
atggcttctcgctggcacctgt

SEQ ID NO: 6935759 - DNA, 22 bp, Homo sapiens
cctgtgggcctgcacgtgggga

SEQ ID NO: 6935760 - DNA, 22 bp, Homo sapiens
tcctgggctttgtttctctcct

SEQ ID NO: 6935761 - DNA, 22 bp, Homo sapiens
ttctgattcatgatccagttct

SEQ ID NO: 6935762 - DNA, 22 bp, Homo sapiens
aggcaatcagtgtagagtaaca

SEQ ID NO: 6935763 - DNA, 22 bp, Homo sapiens
ccctctgcctgcgccctggtgt

SEQ ID NO: 6935764 - DNA, 22 bp, Homo sapiens
tatttcagcaagaagaatgtgg

SEQ ID NO: 6935765 - DNA, 22 bp, Homo sapiens
ttctctgggacaggaacagttt

SEQ ID NO: 6935766 - DNA, 22 bp, Homo sapiens
gctgcctgggcaggaggcgctg

SEQ ID NO: 6935767 - DNA, 22 bp, Homo sapiens
ggtcctgcattgccagcaagct

SEQ ID NO: 6935768 - DNA, 22 bp, Homo sapiens
catgtttgtacaaaggtacaca

SEQ ID NO: 6935769 - DNA, 22 bp, Homo sapiens
gttcttcacatttcattgagga

SEQ ID NO: 6935770 - DNA, 22 bp, Homo sapiens
ctggctccaccccaggaggatg

SEQ ID NO: 6935771 - DNA, 22 bp, Homo sapiens
gtgtgtttcaccctgacaccaa

SEQ ID NO: 6935772 - DNA, 18 bp, Homo sapiens
aggcaggctggagtgact

SEQ ID NO: 6935773 - DNA, 22 bp, Homo sapiens
gcacctgctggaatcagtctgt

SEQ ID NO: 6935774 - DNA, 22 bp, Homo sapiens
taagaatgacaaccataccatt

SEQ ID NO: 6935775 - DNA, 22 bp, Homo sapiens
atggtagggaacttgtctattt

SEQ ID NO: 6935776 - DNA, 22 bp, Homo sapiens
ccaaagtgctggggttacaggc

SEQ ID NO: 6935777 - DNA, 22 bp, Homo sapiens
atggctggctttacttgctttg

SEQ ID NO: 6935778 - DNA, 22 bp, Homo sapiens
tctgaggtcagtgctgcagtta

SEQ ID NO: 6935779 - DNA, 22 bp, Homo sapiens
aagtatacttaaaagagttgat

SEQ ID NO: 6935780 - DNA, 22 bp, Homo sapiens
ctctgagctgtgggaaatgaga

SEQ ID NO: 6935781 - DNA, 22 bp, Homo sapiens
ttcagtgtttgtagagataact

SEQ ID NO: 6935782 - DNA, 22 bp, Homo sapiens
ttcactgtatgagagggcttga

SEQ ID NO: 6935783 - DNA, 22 bp, Homo sapiens
cagtgcaggtttagggctgggg

SEQ ID NO: 6935784 - DNA, 22 bp, Homo sapiens
ctccagaaatttggatgcagca

SEQ ID NO: 6935785 - DNA, 22 bp, Homo sapiens
ttcacaagtctggaatatgcta

SEQ ID NO: 6935786 - DNA, 21 bp, Homo sapiens
tggctgcactgtggctttcat

SEQ ID NO: 6935787 - DNA, 22 bp, Homo sapiens
tctgggcatgtctgtgaacacg

SEQ ID NO: 6935788 - DNA, 22 bp, Homo sapiens
tccattttgtaggtatgctaca

SEQ ID NO: 6935789 - DNA, 22 bp, Homo sapiens
aggcatctaacagagatcttta

SEQ ID NO: 6935790 - DNA, 22 bp, Homo sapiens
cgtgtggtcccggcaaggcaag

SEQ ID NO: 6935791 - DNA, 22 bp, Homo sapiens
ttctttggtgggagattgaggt

SEQ ID NO: 6935792 - DNA, 22 bp, Homo sapiens
tctctgaatgagattactgcct

SEQ ID NO: 6935793 - DNA, 22 bp, Homo sapiens
tcacatctgattagtgactgat

SEQ ID NO: 6935794 - DNA, 20 bp, Homo sapiens
tcactgtaacatttgggggg

SEQ ID NO: 6935795 - DNA, 22 bp, Homo sapiens
ttccacttagtggaagggcatg

SEQ ID NO: 6935796 - DNA, 20 bp, Homo sapiens
aactatagccgatctgctgg

SEQ ID NO: 6935797 - DNA, 22 bp, Homo sapiens
atctgggctcgaatcctagctc

SEQ ID NO: 6935798 - DNA, 22 bp, Homo sapiens
gtggaattgctggataatatca

SEQ ID NO: 6935799 - DNA, 22 bp, Homo sapiens
ctgggcctccagctctgccagc

SEQ ID NO: 6935800 - DNA, 22 bp, Homo sapiens
gcacacagaatcagtgggcata

SEQ ID NO: 6935801 - DNA, 22 bp, Homo sapiens
tcttgggaggagcacctgcctg

SEQ ID NO: 6935802 - DNA, 22 bp, Homo sapiens
agaggagtttgctggtgtgtgc

SEQ ID NO: 6935803 - DNA, 22 bp, Homo sapiens
ttgctgaggttgttttgaggag

SEQ ID NO: 6935804 - DNA, 22 bp, Homo sapiens
caggtaggggagagctccaaca

SEQ ID NO: 6935805 - DNA, 22 bp, Homo sapiens
tttggtcattgaggaagtaaag

SEQ ID NO: 6935806 - DNA, 23 bp, Homo sapiens
aagacgctgcgaagcctttcagc

SEQ ID NO: 6935807 - DNA, 22 bp, Homo sapiens
gcagtgccttgcttctctgtct

SEQ ID NO: 6935808 - DNA, 22 bp, Homo sapiens
aggatctgggtattccttttct

SEQ ID NO: 6935809 - DNA, 22 bp, Homo sapiens
ccctttctgggacccctgtctc

SEQ ID NO: 6935810 - DNA, 22 bp, Homo sapiens
tgtccaggcactgggactctag

SEQ ID NO: 6935811 - DNA, 22 bp, Homo sapiens
gggcttgcttaaggtcacccgg

SEQ ID NO: 6935812 - DNA, 22 bp, Homo sapiens
agcaggtggccacgaggaggag

SEQ ID NO: 6935813 - DNA, 22 bp, Homo sapiens
tctgcaggcctcgacaaggcca

SEQ ID NO: 6935814 - DNA, 18 bp, Homo sapiens
gcctctgttgcttgcctg

SEQ ID NO: 6935815 - DNA, 22 bp, Homo sapiens
agcatagaaaagattcccagag

SEQ ID NO: 6935816 - DNA, 22 bp, Homo sapiens
ttgctttaactagtaaatgggg

SEQ ID NO: 6935817 - DNA, 22 bp, Homo sapiens
ttgagggagaaagccgaggtgt

SEQ ID NO: 6935818 - DNA, 22 bp, Homo sapiens
ttcacagttcctgggaaaacag

SEQ ID NO: 6935819 - DNA, 22 bp, Homo sapiens
ccaccgccatggcgttgtacag

SEQ ID NO: 6935820 - DNA, 22 bp, Homo sapiens
acctgcccatgaaaatggggag

SEQ ID NO: 6935821 - DNA, 22 bp, Homo sapiens
gatacactggccaagtggagga

SEQ ID NO: 6935822 - DNA, 22 bp, Homo sapiens
tatttccagatgaggttacatt

SEQ ID NO: 6935823 - DNA, 21 bp, Homo sapiens
agagcctgagatcttccagca

SEQ ID NO: 6935824 - DNA, 22 bp, Homo sapiens
aagtggctttgagcttctgcca

SEQ ID NO: 6935825 - DNA, 22 bp, Homo sapiens
ctccctctctaaggcaaagaga

SEQ ID NO: 6935826 - DNA, 22 bp, Homo sapiens
caggcaccctctgaggggaagc

SEQ ID NO: 6935827 - DNA, 22 bp, Homo sapiens
tttctaagtctgagggagtata

SEQ ID NO: 6935828 - DNA, 19 bp, Homo sapiens
ggtattcaagctatattag

SEQ ID NO: 6935829 - DNA, 22 bp, Homo sapiens
aaaatgaacagaacaatgggga

SEQ ID NO: 6935830 - DNA, 22 bp, Homo sapiens
tgcaggtctatttaaatgattg

SEQ ID NO: 6935831 - DNA, 22 bp, Homo sapiens
cctgctcccgggacgcgttcac

SEQ ID NO: 6935832 - DNA, 22 bp, Homo sapiens
gaattcatcgtcttagctgcca

SEQ ID NO: 6935833 - DNA, 22 bp, Homo sapiens
ctgtagaggaacaagagctctt

SEQ ID NO: 6935834 - DNA, 22 bp, Homo sapiens
ccatgcttaaataagaggcagc

SEQ ID NO: 6935835 - DNA, 22 bp, Homo sapiens
cttcctgaacaatgccatcaat

SEQ ID NO: 6935836 - DNA, 19 bp, Homo sapiens
tgtcctgtcctgctctgac

SEQ ID NO: 6935837 - DNA, 22 bp, Homo sapiens
ttctgtgattagttgtctggct

SEQ ID NO: 6935838 - DNA, 22 bp, Homo sapiens
tgggagaaactgtctctcccac

SEQ ID NO: 6935839 - DNA, 22 bp, Homo sapiens
ttaattacaaaacacataggtt

SEQ ID NO: 6935840 - DNA, 22 bp, Homo sapiens
gggaggctcagtggtgtcctct

SEQ ID NO: 6935841 - DNA, 22 bp, Homo sapiens
tttggtgagctgcgagtgagga

SEQ ID NO: 6935842 - DNA, 22 bp, Homo sapiens
tcctagaacagcccacctggaa

SEQ ID NO: 6935843 - DNA, 22 bp, Homo sapiens
gagcccaggaagtggaggctga

SEQ ID NO: 6935844 - DNA, 22 bp, Homo sapiens
aggctgcagaggtgctgccaga

SEQ ID NO: 6935845 - DNA, 21 bp, Homo sapiens
tcatgaagcatcacttctgcc

SEQ ID NO: 6935846 - DNA, 22 bp, Homo sapiens
aggtctggtgggctttagattg

SEQ ID NO: 6935847 - DNA, 22 bp, Homo sapiens
gcatgcacacctgtgcacattt

SEQ ID NO: 6935848 - DNA, 22 bp, Homo sapiens
gaaatatacatgaagtcggctg

SEQ ID NO: 6935849 - DNA, 20 bp, Homo sapiens
tgctggaaaaagtcactcat

SEQ ID NO: 6935850 - DNA, 22 bp, Homo sapiens
tcctggcagagggcggcctcga

SEQ ID NO: 6935851 - DNA, 22 bp, Homo sapiens
aggaaaacacagtattgatgga

SEQ ID NO: 6935852 - DNA, 22 bp, Homo sapiens
tgtatgaacctttaatatagtg

SEQ ID NO: 6935853 - DNA, 22 bp, Homo sapiens
tggctcatattgagtgatttct

SEQ ID NO: 6935854 - DNA, 22 bp, Homo sapiens
gggtcaaggctacatggagacc

SEQ ID NO: 6935855 - DNA, 22 bp, Homo sapiens
ttcaaaccttcacttgcagagt

SEQ ID NO: 6935856 - DNA, 22 bp, Homo sapiens
tcagggaactacttctccctat

SEQ ID NO: 6935857 - DNA, 16 bp, Homo sapiens
gggaatgtgtcttctc

SEQ ID NO: 6935858 - DNA, 22 bp, Homo sapiens
gaggatgtaaaatagacaaaat

SEQ ID NO: 6935859 - DNA, 22 bp, Homo sapiens
tcctgcttgaaactctgccttc

SEQ ID NO: 6935860 - DNA, 17 bp, Homo sapiens
tgtatgcatatgctttt

SEQ ID NO: 6935861 - DNA, 22 bp, Homo sapiens
actcctgcttcttccctgagga

SEQ ID NO: 6935862 - DNA, 22 bp, Homo sapiens
atattgatggaggtgttagaca

SEQ ID NO: 6935863 - DNA, 16 bp, Homo sapiens
tcaggtgtgacttttt

SEQ ID NO: 6935864 - DNA, 22 bp, Homo sapiens
ttggatccatctcaggcatagg

SEQ ID NO: 6935865 - DNA, 22 bp, Homo sapiens
tagaatgagaaagtgtagcagg

SEQ ID NO: 6935866 - DNA, 22 bp, Homo sapiens
tagaacatttgtagcagctgag

SEQ ID NO: 6935867 - DNA, 22 bp, Homo sapiens
tcacagggtttggaagcctcct

SEQ ID NO: 6935868 - DNA, 22 bp, Homo sapiens
caaattcacatgattgcttctg

SEQ ID NO: 6935869 - DNA, 22 bp, Homo sapiens
tcacagtatcaggtggagtgga

SEQ ID NO: 6935870 - DNA, 22 bp, Homo sapiens
attctcagttcactagtttctt

SEQ ID NO: 6935871 - DNA, 22 bp, Homo sapiens
gtctggaagaactagggatgtt

SEQ ID NO: 6935872 - DNA, 22 bp, Homo sapiens
agaattgtaataataatagcat

SEQ ID NO: 6935873 - DNA, 22 bp, Homo sapiens
ctggcaggcactcatgaaataa

SEQ ID NO: 6935874 - DNA, 22 bp, Homo sapiens
ctggcctgagaatgctaccctt

SEQ ID NO: 6935875 - DNA, 22 bp, Homo sapiens
ttgcattgttgcaatgaagtat

SEQ ID NO: 6935876 - DNA, 22 bp, Homo sapiens
gggtccaggcgtggcccagatg

SEQ ID NO: 6935877 - DNA, 22 bp, Homo sapiens
acctcccagaaagttttgcagg

SEQ ID NO: 6935878 - DNA, 22 bp, Homo sapiens
tctatgttgtgtgtcacacaga

SEQ ID NO: 6935879 - DNA, 22 bp, Homo sapiens
tgactctcccaagtttgaggga

SEQ ID NO: 6935880 - DNA, 22 bp, Homo sapiens
tggggaggaagtcagatttcag

SEQ ID NO: 6935881 - DNA, 22 bp, Homo sapiens
acacattaggcagtgcttaaat

SEQ ID NO: 6935882 - DNA, 22 bp, Homo sapiens
taccagtaattgcttgtgctgt

SEQ ID NO: 6935883 - DNA, 22 bp, Homo sapiens
ctcaccttccggctgctccctg

SEQ ID NO: 6935884 - DNA, 23 bp, Homo sapiens
gcctgcctgacctgtgcaaagtc

SEQ ID NO: 6935885 - DNA, 22 bp, Homo sapiens
tttcccatcttagcagattaaa

SEQ ID NO: 6935886 - DNA, 22 bp, Homo sapiens
tcagctgccccgggcactgccc

SEQ ID NO: 6935887 - DNA, 18 bp, Homo sapiens
ctgtgactcctagatctc

SEQ ID NO: 6935888 - DNA, 19 bp, Homo sapiens
gcctctgagggcaggacac

SEQ ID NO: 6935889 - DNA, 22 bp, Homo sapiens
atttgaaatctgggttactctg

SEQ ID NO: 6935890 - DNA, 22 bp, Homo sapiens
agaaagtttattcctatctagc

SEQ ID NO: 6935891 - DNA, 22 bp, Homo sapiens
cacagcctcctctggctcacgg

SEQ ID NO: 6935892 - DNA, 22 bp, Homo sapiens
ccagcagagtggggtttagagt

SEQ ID NO: 6935893 - DNA, 22 bp, Homo sapiens
cacagcaggcactatacagggc

SEQ ID NO: 6935894 - DNA, 22 bp, Homo sapiens
ctatttcattgtgctgagtctg

SEQ ID NO: 6935895 - DNA, 22 bp, Homo sapiens
agaatccttgactcaggctgag

SEQ ID NO: 6935896 - DNA, 22 bp, Homo sapiens
cctgcgcacagggcacccgaga

SEQ ID NO: 6935897 - DNA, 22 bp, Homo sapiens
ttgcagttgcatatgcccctac

SEQ ID NO: 6935898 - DNA, 21 bp, Homo sapiens
aaatactgtcaaatggtgggt

SEQ ID NO: 6935899 - DNA, 23 bp, Homo sapiens
ggagctgctgttgggggagctgc

SEQ ID NO: 6935900 - DNA, 22 bp, Homo sapiens
tgaaacaagatccacagacttg

SEQ ID NO: 6935901 - DNA, 22 bp, Homo sapiens
ctgtgcatgtgttctctggtaa

SEQ ID NO: 6935902 - DNA, 22 bp, Homo sapiens
ttctcctgcccttggacttcca

SEQ ID NO: 6935903 - DNA, 22 bp, Homo sapiens
aaatcctaccaagaaattccct

SEQ ID NO: 6935904 - DNA, 22 bp, Homo sapiens
aatactttgccaagttcgaaga

SEQ ID NO: 6935905 - DNA, 22 bp, Homo sapiens
catggccaaagaattatatttt

SEQ ID NO: 6935906 - DNA, 22 bp, Homo sapiens
tccttgaacagagggcctgggt

SEQ ID NO: 6935907 - DNA, 22 bp, Homo sapiens
agagcggggatagttaatattc

SEQ ID NO: 6935908 - DNA, 21 bp, Homo sapiens
gatttcacttaccttcattta

SEQ ID NO: 6935909 - DNA, 20 bp, Homo sapiens
gaggatgcagacagagggca

SEQ ID NO: 6935910 - DNA, 22 bp, Homo sapiens
acatgccatggttgtttgctgc

SEQ ID NO: 6935911 - DNA, 22 bp, Homo sapiens
ctgctgtttctcaaaattaagt

SEQ ID NO: 6935912 - DNA, 22 bp, Homo sapiens
ctctggagtgggtggccgggag

SEQ ID NO: 6935913 - DNA, 22 bp, Homo sapiens
cagcaacggaaaatacacatag

SEQ ID NO: 6935914 - DNA, 22 bp, Homo sapiens
acaacacagcaaaaccccatct

SEQ ID NO: 6935915 - DNA, 19 bp, Homo sapiens
tgttcttaaactgatggca

SEQ ID NO: 6935916 - DNA, 22 bp, Homo sapiens
gtgccctggggtgaacccctgg

SEQ ID NO: 6935917 - DNA, 22 bp, Homo sapiens
aggtattagaagagtcatggga

SEQ ID NO: 6935918 - DNA, 22 bp, Homo sapiens
tattggtctgcttaagtggatt

SEQ ID NO: 6935919 - DNA, 22 bp, Homo sapiens
ctgggacagctgagacaggaga

SEQ ID NO: 6935920 - DNA, 22 bp, Homo sapiens
acacagccccacggtgagcaaa

SEQ ID NO: 6935921 - DNA, 22 bp, Homo sapiens
ccgaggtcctggacttggccct

SEQ ID NO: 6935922 - DNA, 22 bp, Homo sapiens
gtctgcctgcaatccagagact

SEQ ID NO: 6935923 - DNA, 22 bp, Homo sapiens
agcaaagctgattaagagcaca

SEQ ID NO: 6935924 - DNA, 22 bp, Homo sapiens
aagacagtgacagtcacaattg

SEQ ID NO: 6935925 - DNA, 22 bp, Homo sapiens
ttaaaacagcgtgaatctggca

SEQ ID NO: 6935926 - DNA, 17 bp, Homo sapiens
ggacacagctcatggct

SEQ ID NO: 6935927 - DNA, 22 bp, Homo sapiens
tcaggaacagcagggaggaaag

SEQ ID NO: 6935928 - DNA, 22 bp, Homo sapiens
caatttggtttatgtgttcaga

SEQ ID NO: 6935929 - DNA, 22 bp, Homo sapiens
tttcacatgtggaatgccaggt

SEQ ID NO: 6935930 - DNA, 22 bp, Homo sapiens
agtaggcatagaaagaagcacc

SEQ ID NO: 6935931 - DNA, 22 bp, Homo sapiens
ttggtttatctgtggatctctt

SEQ ID NO: 6935932 - DNA, 22 bp, Homo sapiens
tttgagcagcagatgcacttag

SEQ ID NO: 6935933 - DNA, 22 bp, Homo sapiens
gttagggagggtgcatatgtgt

SEQ ID NO: 6935934 - DNA, 22 bp, Homo sapiens
aagtacatatatttatgattct

SEQ ID NO: 6935935 - DNA, 22 bp, Homo sapiens
attaatacattatagggattgt

SEQ ID NO: 6935936 - DNA, 22 bp, Homo sapiens
ctgggtgccaattcatgtttat

SEQ ID NO: 6935937 - DNA, 22 bp, Homo sapiens
tcataatgcacaggcccctgtg

SEQ ID NO: 6935938 - DNA, 22 bp, Homo sapiens
ttgtggggaaacactgtttctt

SEQ ID NO: 6935939 - DNA, 22 bp, Homo sapiens
gaggggagcatgatctagattg

SEQ ID NO: 6935940 - DNA, 22 bp, Homo sapiens
tgaaggtgattatgaatgtata

SEQ ID NO: 6935941 - DNA, 22 bp, Homo sapiens
cttgcccaccagtcagtggctt

SEQ ID NO: 6935942 - DNA, 22 bp, Homo sapiens
tgttttcacaatgatgtcagat

SEQ ID NO: 6935943 - DNA, 22 bp, Homo sapiens
cctgagagtgcgtgcctcctta

SEQ ID NO: 6935944 - DNA, 22 bp, Homo sapiens
tcacatggcgagctttaaaata

SEQ ID NO: 6935945 - DNA, 22 bp, Homo sapiens
ttggcacagagctgcagcctgg

SEQ ID NO: 6935946 - DNA, 22 bp, Homo sapiens
catgcaaatgtgctaatctgaa

SEQ ID NO: 6935947 - DNA, 22 bp, Homo sapiens
ctcctgggagcagggatggatg

SEQ ID NO: 6935948 - DNA, 22 bp, Homo sapiens
ttcttaagcacctaaaaagtgg

SEQ ID NO: 6935949 - DNA, 22 bp, Homo sapiens
tgtcagcattgcgtcactgagc

SEQ ID NO: 6935950 - DNA, 19 bp, Homo sapiens
agcaacctgtcagagatgc

SEQ ID NO: 6935951 - DNA, 20 bp, Homo sapiens
gaagacacagagttcatctc

SEQ ID NO: 6935952 - DNA, 22 bp, Homo sapiens
ggcagcatgggtgcctttgtga

SEQ ID NO: 6935953 - DNA, 19 bp, Homo sapiens
tagagcttgttttaggaag

SEQ ID NO: 6935954 - DNA, 22 bp, Homo sapiens
gctctgtagtatttagtaaata

SEQ ID NO: 6935955 - DNA, 22 bp, Homo sapiens
ctgtcattggcagggagtgtgt

SEQ ID NO: 6935956 - DNA, 21 bp, Homo sapiens
ttctagaaaagtatgggactg

SEQ ID NO: 6935957 - DNA, 21 bp, Homo sapiens
aactggcagaccaactatggc

SEQ ID NO: 6935958 - DNA, 22 bp, Homo sapiens
atggcagtatttcagtacagag

SEQ ID NO: 6935959 - DNA, 22 bp, Homo sapiens
tcaagtgagcgtagctgaatgg

SEQ ID NO: 6935960 - DNA, 22 bp, Homo sapiens
tgcagcttcaaagaacctttcc

SEQ ID NO: 6935961 - DNA, 22 bp, Homo sapiens
gctggcaggataacttctaagc

SEQ ID NO: 6935962 - DNA, 22 bp, Homo sapiens
agtccaagatcaaggtgtcagg

SEQ ID NO: 6935963 - DNA, 22 bp, Homo sapiens
tttagttgaaggcagtcctcaa

SEQ ID NO: 6935964 - DNA, 19 bp, Homo sapiens
ctgtgctttaaactcctat

SEQ ID NO: 6935965 - DNA, 22 bp, Homo sapiens
gaggagagagggactgtctgca

SEQ ID NO: 6935966 - DNA, 22 bp, Homo sapiens
gtttggtgagctaagattattt

SEQ ID NO: 6935967 - DNA, 22 bp, Homo sapiens
ccctgcagagggatgggggcag

SEQ ID NO: 6935968 - DNA, 22 bp, Homo sapiens
tggaaattgctattaccgatga

SEQ ID NO: 6935969 - DNA, 22 bp, Homo sapiens
aattagggaaaatttacttgta

SEQ ID NO: 6935970 - DNA, 22 bp, Homo sapiens
tgcatcgaacagtggagacaat

SEQ ID NO: 6935971 - DNA, 22 bp, Homo sapiens
tgcagcaatggtccctgccctc

SEQ ID NO: 6935972 - DNA, 22 bp, Homo sapiens
tagaaatgcccagattctgcta

SEQ ID NO: 6935973 - DNA, 22 bp, Homo sapiens
aagtaaactcagtggtcattca

SEQ ID NO: 6935974 - DNA, 22 bp, Homo sapiens
ccaggaagacacatgctcatcc

SEQ ID NO: 6935975 - DNA, 22 bp, Homo sapiens
gaactttgtggggctgagagga

SEQ ID NO: 6935976 - DNA, 22 bp, Homo sapiens
gctcctgtcatcaaacaatcct

SEQ ID NO: 6935977 - DNA, 22 bp, Homo sapiens
ctccgaacagtggctccaaggc

SEQ ID NO: 6935978 - DNA, 21 bp, Homo sapiens
atggaaaaacaggtagagcat

SEQ ID NO: 6935979 - DNA, 22 bp, Homo sapiens
ttcctaacacagtgtaagcaag

SEQ ID NO: 6935980 - DNA, 22 bp, Homo sapiens
catccttcaaaggctacaatta

SEQ ID NO: 6935981 - DNA, 22 bp, Homo sapiens
tacagcaagacagaccgctcaa

SEQ ID NO: 6935982 - DNA, 22 bp, Homo sapiens
tactggtggaaagagtgaatga

SEQ ID NO: 6935983 - DNA, 22 bp, Homo sapiens
tggaggacgtgtccaccatgaa

SEQ ID NO: 6935984 - DNA, 22 bp, Homo sapiens
ttcaaggctaaggaagggaagg

SEQ ID NO: 6935985 - DNA, 19 bp, Homo sapiens
tcagggttcctccatggag

SEQ ID NO: 6935986 - DNA, 22 bp, Homo sapiens
taggttttcctaaaattctggt

SEQ ID NO: 6935987 - DNA, 22 bp, Homo sapiens
ctgcagagcatgaggaggtctg

SEQ ID NO: 6935988 - DNA, 22 bp, Homo sapiens
ttcaggatcaagttgccagtag

SEQ ID NO: 6935989 - DNA, 22 bp, Homo sapiens
atgtaactgaaggaaatgcatg

SEQ ID NO: 6935990 - DNA, 22 bp, Homo sapiens
acccagagtcagacagccatgg

SEQ ID NO: 6935991 - DNA, 22 bp, Homo sapiens
ttcctgggggcagcagtcttga

SEQ ID NO: 6935992 - DNA, 22 bp, Homo sapiens
tatttggtgaatctatggtcag

SEQ ID NO: 6935993 - DNA, 22 bp, Homo sapiens
aaattccaccagaatcagtaat

SEQ ID NO: 6935994 - DNA, 22 bp, Homo sapiens
tcttcctcaatgtaacaacccc

SEQ ID NO: 6935995 - DNA, 22 bp, Homo sapiens
gatccttatccttaaagatgct

SEQ ID NO: 6935996 - DNA, 22 bp, Homo sapiens
gtctcagtgtcacctccagctg

SEQ ID NO: 6935997 - DNA, 22 bp, Homo sapiens
tcagagtgaggcccagcaatct

SEQ ID NO: 6935998 - DNA, 23 bp, Homo sapiens
agaaaaacaggattgtgttccta

SEQ ID NO: 6935999 - DNA, 22 bp, Homo sapiens
gttctctggaaactatgattca

SEQ ID NO: 6936000 - DNA, 22 bp, Homo sapiens
agatgtgatctgttcaggacaa

SEQ ID NO: 6936001 - DNA, 22 bp, Homo sapiens
ctggacaggctggggactgcaa

SEQ ID NO: 6936002 - DNA, 22 bp, Homo sapiens
tcaatgatgctgaaggtagcgt

SEQ ID NO: 6936003 - DNA, 22 bp, Homo sapiens
aactgctttttgatctcaggag

SEQ ID NO: 6936004 - DNA, 22 bp, Homo sapiens
gtaactttggatttagggtacc

SEQ ID NO: 6936005 - DNA, 22 bp, Homo sapiens
gaggggcacagtaaagggtccc

SEQ ID NO: 6936006 - DNA, 22 bp, Homo sapiens
atgttgagagctgagatcagcc

SEQ ID NO: 6936007 - DNA, 22 bp, Homo sapiens
tacctggcaagggtcccaggat

SEQ ID NO: 6936008 - DNA, 22 bp, Homo sapiens
taagtgatgtcttggttaatga

SEQ ID NO: 6936009 - DNA, 22 bp, Homo sapiens
tgctgcctcagcttcctgggct

SEQ ID NO: 6936010 - DNA, 22 bp, Homo sapiens
atgtgttgtgttactccctcaa

SEQ ID NO: 6936011 - DNA, 23 bp, Homo sapiens
tcctggctctgcacttgctaatg

SEQ ID NO: 6936012 - DNA, 22 bp, Homo sapiens
cagtggcaagaacagtaataat

SEQ ID NO: 6936013 - DNA, 22 bp, Homo sapiens
tagaggcctgaaagaatgatca

SEQ ID NO: 6936014 - DNA, 22 bp, Homo sapiens
tctgggagcgctgtttttccca

SEQ ID NO: 6936015 - DNA, 22 bp, Homo sapiens
ccgtggttgcccaggcgactgt

SEQ ID NO: 6936016 - DNA, 22 bp, Homo sapiens
tcacagcaccaggatctctcca

SEQ ID NO: 6936017 - DNA, 22 bp, Homo sapiens
taattgcagaactttgggaggc

SEQ ID NO: 6936018 - DNA, 22 bp, Homo sapiens
ctggacttacttgctgaggact

SEQ ID NO: 6936019 - DNA, 22 bp, Homo sapiens
ggcagctttctcacccatgacc

SEQ ID NO: 6936020 - DNA, 22 bp, Homo sapiens
tttagcaagtatttactgacta

SEQ ID NO: 6936021 - DNA, 22 bp, Homo sapiens
gtgcagctgcttgcctggttag

SEQ ID NO: 6936022 - DNA, 22 bp, Homo sapiens
ttcttatttcccccttcatcat

SEQ ID NO: 6936023 - DNA, 22 bp, Homo sapiens
ccttcctaacattgccatgaca

SEQ ID NO: 6936024 - DNA, 22 bp, Homo sapiens
atacaatagtgtttgttttgag

SEQ ID NO: 6936025 - DNA, 22 bp, Homo sapiens
tgactgagagagaactcagctt

SEQ ID NO: 6936026 - DNA, 22 bp, Homo sapiens
ccagggctgccgcatccctggt

SEQ ID NO: 6936027 - DNA, 22 bp, Homo sapiens
gctcctggcaggcagtgtgtgt

SEQ ID NO: 6936028 - DNA, 22 bp, Homo sapiens
aaatgcacacaccaggaaacta

SEQ ID NO: 6936029 - DNA, 19 bp, Homo sapiens
atgaattgagcacttacta

SEQ ID NO: 6936030 - DNA, 22 bp, Homo sapiens
tgcctgctccagtcctgtccac

SEQ ID NO: 6936031 - DNA, 22 bp, Homo sapiens
cagtggcaggggaagcaggtgt

SEQ ID NO: 6936032 - DNA, 22 bp, Homo sapiens
aaatcaaaagacatgtgtttta

SEQ ID NO: 6936033 - DNA, 22 bp, Homo sapiens
actgttgaagtgccagcttgat

SEQ ID NO: 6936034 - DNA, 22 bp, Homo sapiens
tctggctctaactaggcatcag

SEQ ID NO: 6936035 - DNA, 22 bp, Homo sapiens
taggtagtttcctgttgttggg

SEQ ID NO: 6936036 - DNA, 22 bp, Homo sapiens
agcagcccctcggcgggtgcgc

SEQ ID NO: 6936037 - DNA, 22 bp, Homo sapiens
ctcaggccaggtttctcccaca

SEQ ID NO: 6936038 - DNA, 22 bp, Homo sapiens
tcatttatgcaggaatggcata

SEQ ID NO: 6936039 - DNA, 22 bp, Homo sapiens
aaggggcatgcttttgccagga

SEQ ID NO: 6936040 - DNA, 21 bp, Homo sapiens
tctggaccaccttgtaaagct

SEQ ID NO: 6936041 - DNA, 22 bp, Homo sapiens
aaacagagtttggtaaatagcc

SEQ ID NO: 6936042 - DNA, 22 bp, Homo sapiens
gtctggctgtccagcttatcta

SEQ ID NO: 6936043 - DNA, 22 bp, Homo sapiens
tctctgctgagaagggctggca

SEQ ID NO: 6936044 - DNA, 22 bp, Homo sapiens
ctagtttggttagataagtctc

SEQ ID NO: 6936045 - DNA, 19 bp, Homo sapiens
tccctccctgtaatctcac

SEQ ID NO: 6936046 - DNA, 22 bp, Homo sapiens
agcaaatcagctgctcaggaaa

SEQ ID NO: 6936047 - DNA, 22 bp, Homo sapiens
tagataggtgattaggaaaagc

SEQ ID NO: 6936048 - DNA, 22 bp, Homo sapiens
agaaagacaaaatgcagtggct

SEQ ID NO: 6936049 - DNA, 22 bp, Homo sapiens
aggtcccagtgttagggtgaca

SEQ ID NO: 6936050 - DNA, 20 bp, Homo sapiens
ctactttaggcactgagaat

SEQ ID NO: 6936051 - DNA, 20 bp, Homo sapiens
tctatttgtaaagggctgtg

SEQ ID NO: 6936052 - DNA, 22 bp, Homo sapiens
gttaatgcaaagcagagggcaa

SEQ ID NO: 6936053 - DNA, 22 bp, Homo sapiens
tcagccagggggagagaatgga

SEQ ID NO: 6936054 - DNA, 21 bp, Homo sapiens
taaatgtgagcagggctgggc

SEQ ID NO: 6936055 - DNA, 22 bp, Homo sapiens
tttagtgtaattctgccttttg

SEQ ID NO: 6936056 - DNA, 22 bp, Homo sapiens
tatcttacttatgctgatgtcc

SEQ ID NO: 6936057 - DNA, 22 bp, Homo sapiens
tttattgttatcatgggtgagt

SEQ ID NO: 6936058 - DNA, 21 bp, Homo sapiens
aggaggccagtactgctgaac

SEQ ID NO: 6936059 - DNA, 22 bp, Homo sapiens
agtgttcactctgtggagccca

SEQ ID NO: 6936060 - DNA, 22 bp, Homo sapiens
catccctgattcctagtacagt

SEQ ID NO: 6936061 - DNA, 22 bp, Homo sapiens
gagttcaatttccagctgttct

SEQ ID NO: 6936062 - DNA, 22 bp, Homo sapiens
tttccagtcaccactagatcag

SEQ ID NO: 6936063 - DNA, 22 bp, Homo sapiens
aggagtcaggaattatttatga

SEQ ID NO: 6936064 - DNA, 22 bp, Homo sapiens
gttcattgtgtgtggtcttctt

SEQ ID NO: 6936065 - DNA, 23 bp, Homo sapiens
tttgacagcgtggtttctgtggg

SEQ ID NO: 6936066 - DNA, 22 bp, Homo sapiens
gacacatgaccataaatgctaa

SEQ ID NO: 6936067 - DNA, 22 bp, Homo sapiens
ttttttcctctgtgatggcaaa

SEQ ID NO: 6936068 - DNA, 22 bp, Homo sapiens
tagtgattttctgtttccatca

SEQ ID NO: 6936069 - DNA, 22 bp, Homo sapiens
tcagaattgtctggggaatgtt

SEQ ID NO: 6936070 - DNA, 21 bp, Homo sapiens
ttcaatgaaaacaaagtgagg

SEQ ID NO: 6936071 - DNA, 22 bp, Homo sapiens
gaaatcatattctcagtccttc

SEQ ID NO: 6936072 - DNA, 22 bp, Homo sapiens
tctttgcattttatgccgttat

SEQ ID NO: 6936073 - DNA, 22 bp, Homo sapiens
caggagcccgttgctccggcgg

SEQ ID NO: 6936074 - DNA, 22 bp, Homo sapiens
tgtcaggtcagtatttgatgcc

SEQ ID NO: 6936075 - DNA, 22 bp, Homo sapiens
tcttagcatttgttaataccca

SEQ ID NO: 6936076 - DNA, 22 bp, Homo sapiens
gtgggtcagcaagccaggagta

SEQ ID NO: 6936077 - DNA, 22 bp, Homo sapiens
cacagggaggacatcaacagtg

SEQ ID NO: 6936078 - DNA, 23 bp, Homo sapiens
tgatggccgccctttgccctgtc

SEQ ID NO: 6936079 - DNA, 18 bp, Homo sapiens
aaatgctgctcaaattcc

SEQ ID NO: 6936080 - DNA, 22 bp, Homo sapiens
tgtgtgcacaggagtgtttgaa

SEQ ID NO: 6936081 - DNA, 22 bp, Homo sapiens
ttaatggactaggcagttgtaa

SEQ ID NO: 6936082 - DNA, 22 bp, Homo sapiens
ttgacacaaacagtgatgtagt

SEQ ID NO: 6936083 - DNA, 22 bp, Homo sapiens
tttgctgaccccattctgagtc

SEQ ID NO: 6936084 - DNA, 22 bp, Homo sapiens
aaggccagagcagactggagtt

SEQ ID NO: 6936085 - DNA, 22 bp, Homo sapiens
aaactactgatgcctgggccct

SEQ ID NO: 6936086 - DNA, 21 bp, Homo sapiens
gaagtacaccaggaaggccac

SEQ ID NO: 6936087 - DNA, 22 bp, Homo sapiens
atgttagtgtcactttgtacaa

SEQ ID NO: 6936088 - DNA, 22 bp, Homo sapiens
tgaggcccagccgccctgagag

SEQ ID NO: 6936089 - DNA, 22 bp, Homo sapiens
aaaggttttgccctgggtattc

SEQ ID NO: 6936090 - DNA, 22 bp, Homo sapiens
tgcagcaatgtagtttgggaca

SEQ ID NO: 6936091 - DNA, 20 bp, Homo sapiens
gtgggcagcaggcatactgg

SEQ ID NO: 6936092 - DNA, 22 bp, Homo sapiens
tccctgtggatatctgcagctg

SEQ ID NO: 6936093 - DNA, 20 bp, Homo sapiens
ctgcactgaacatgtctgag

SEQ ID NO: 6936094 - DNA, 22 bp, Homo sapiens
ctaaacttttataacattgaga

SEQ ID NO: 6936095 - DNA, 22 bp, Homo sapiens
aaacttgagccaagggcttggg

SEQ ID NO: 6936096 - DNA, 22 bp, Homo sapiens
gcccttcatttatagttggaat

SEQ ID NO: 6936097 - DNA, 22 bp, Homo sapiens
cagatagcgtttgagagcataa

SEQ ID NO: 6936098 - DNA, 22 bp, Homo sapiens
ttcacagaagaggtcacatttc

SEQ ID NO: 6936099 - DNA, 22 bp, Homo sapiens
atttctagaggcagcttctagg

SEQ ID NO: 6936100 - DNA, 22 bp, Homo sapiens
gagtttagccaatttggtcccc

SEQ ID NO: 6936101 - DNA, 22 bp, Homo sapiens
gctctgctaatattgtagtacc

SEQ ID NO: 6936102 - DNA, 22 bp, Homo sapiens
ttgattggcagatggcttgaca

SEQ ID NO: 6936103 - DNA, 22 bp, Homo sapiens
tggtgcagagagggatctaggg

SEQ ID NO: 6936104 - DNA, 22 bp, Homo sapiens
caggtgggagcgaggagctact

SEQ ID NO: 6936105 - DNA, 21 bp, Homo sapiens
cgtggtctggatttgggtttg

SEQ ID NO: 6936106 - DNA, 22 bp, Homo sapiens
tgaactatacgataacatgatt

SEQ ID NO: 6936107 - DNA, 22 bp, Homo sapiens
tgccaggctttggtcaaaggct

SEQ ID NO: 6936108 - DNA, 22 bp, Homo sapiens
gcgggaagaacgaccaggctcg

SEQ ID NO: 6936109 - DNA, 21 bp, Homo sapiens
aaaatgtgagcgtgatgctta

SEQ ID NO: 6936110 - DNA, 22 bp, Homo sapiens
gagacacaatttccccatccta

SEQ ID NO: 6936111 - DNA, 22 bp, Homo sapiens
ttcctgaatcccaaggagagct

SEQ ID NO: 6936112 - DNA, 19 bp, Homo sapiens
atttactgcctaaaatctc

SEQ ID NO: 6936113 - DNA, 22 bp, Homo sapiens
aaacattgatgggaagtttaat

SEQ ID NO: 6936114 - DNA, 22 bp, Homo sapiens
caacactgattatggctgagct

SEQ ID NO: 6936115 - DNA, 22 bp, Homo sapiens
gcaactgttttgagcacccagt

SEQ ID NO: 6936116 - DNA, 22 bp, Homo sapiens
cttggtttacctaaacaatagg

SEQ ID NO: 6936117 - DNA, 22 bp, Homo sapiens
gctttaatgcaatttcacctca

SEQ ID NO: 6936118 - DNA, 22 bp, Homo sapiens
ttctccatttaacttccttatg

SEQ ID NO: 6936119 - DNA, 22 bp, Homo sapiens
tagattatccctgatttgtcca

SEQ ID NO: 6936120 - DNA, 22 bp, Homo sapiens
acttggcttaaagtagtgatcg

SEQ ID NO: 6936121 - DNA, 22 bp, Homo sapiens
ttagggagaaatgcttccctca

SEQ ID NO: 6936122 - DNA, 22 bp, Homo sapiens
tccaggaacagaatgttagtgc

SEQ ID NO: 6936123 - DNA, 20 bp, Homo sapiens
tgagagctgggcagggatac

SEQ ID NO: 6936124 - DNA, 22 bp, Homo sapiens
tgtcctgtccttcctggaagtc

SEQ ID NO: 6936125 - DNA, 22 bp, Homo sapiens
tgaactgtggccagtaattaat

SEQ ID NO: 6936126 - DNA, 22 bp, Homo sapiens
tactttggtatcaaactaaaac

SEQ ID NO: 6936127 - DNA, 22 bp, Homo sapiens
acagtcttcatgctagaatggc

SEQ ID NO: 6936128 - DNA, 20 bp, Homo sapiens
gagtacctttagtatgttac

SEQ ID NO: 6936129 - DNA, 22 bp, Homo sapiens
taatacagaagtgtattaaaat

SEQ ID NO: 6936130 - DNA, 22 bp, Homo sapiens
ttcatagacccagaactcatta

SEQ ID NO: 6936131 - DNA, 22 bp, Homo sapiens
gcagggaagtttgatctttttc

SEQ ID NO: 6936132 - DNA, 22 bp, Homo sapiens
gtgtacacacatcgtttgtcat

SEQ ID NO: 6936133 - DNA, 22 bp, Homo sapiens
aggtgcatgatgcagagtgcag

SEQ ID NO: 6936134 - DNA, 22 bp, Homo sapiens
gcagctgcctaaagtgctaaga

SEQ ID NO: 6936135 - DNA, 22 bp, Homo sapiens
tatcctgctttgttcctcttga

SEQ ID NO: 6936136 - DNA, 21 bp, Homo sapiens
cctgagtgagacctggcccgt

SEQ ID NO: 6936137 - DNA, 22 bp, Homo sapiens
tgctctcagagtcaggaggtaa

SEQ ID NO: 6936138 - DNA, 19 bp, Homo sapiens
cccaacttgactattttct

SEQ ID NO: 6936139 - DNA, 22 bp, Homo sapiens
tctgtgatcttgcatttatatg

SEQ ID NO: 6936140 - DNA, 22 bp, Homo sapiens
tgtctgagcacctgtgctgaac

SEQ ID NO: 6936141 - DNA, 22 bp, Homo sapiens
tgcattccacacccatagagat

SEQ ID NO: 6936142 - DNA, 22 bp, Homo sapiens
aaatggaagaagtgcaatactg

SEQ ID NO: 6936143 - DNA, 22 bp, Homo sapiens
taagataataagtatgtctatg

SEQ ID NO: 6936144 - DNA, 22 bp, Homo sapiens
ctggaatgtatgtatcttaaga

SEQ ID NO: 6936145 - DNA, 22 bp, Homo sapiens
ataaagcaatagattgtgtaat

SEQ ID NO: 6936146 - DNA, 22 bp, Homo sapiens
tcaaagcttagataatttcttt

SEQ ID NO: 6936147 - DNA, 22 bp, Homo sapiens
ttaattaactagccaaccacta

SEQ ID NO: 6936148 - DNA, 22 bp, Homo sapiens
ctaatttaatgaatgagtctta

SEQ ID NO: 6936149 - DNA, 22 bp, Homo sapiens
tgtgtcctgcaggtgctgcctg

SEQ ID NO: 6936150 - DNA, 22 bp, Homo sapiens
gaagcttggtgttgtcttaagt

SEQ ID NO: 6936151 - DNA, 21 bp, Homo sapiens
aatttagtcaacagactgtgg

SEQ ID NO: 6936152 - DNA, 22 bp, Homo sapiens
ggcgtctgtttgaaggcaacgt

SEQ ID NO: 6936153 - DNA, 22 bp, Homo sapiens
agtggcaggcagaagcttctca

SEQ ID NO: 6936154 - DNA, 21 bp, Homo sapiens
gccacgtttcagtcttctcag

SEQ ID NO: 6936155 - DNA, 22 bp, Homo sapiens
tctccaggtggcttgggcttct

SEQ ID NO: 6936156 - DNA, 22 bp, Homo sapiens
tcagatgcctgtggggtctagg

SEQ ID NO: 6936157 - DNA, 22 bp, Homo sapiens
cattgtaagctgttgaatcctc

SEQ ID NO: 6936158 - DNA, 22 bp, Homo sapiens
atatattggtgtcagaaagagt

SEQ ID NO: 6936159 - DNA, 19 bp, Homo sapiens
gcagccaccgcggcggccg

SEQ ID NO: 6936160 - DNA, 22 bp, Homo sapiens
agaggggttaagtgctagtccg

SEQ ID NO: 6936161 - DNA, 19 bp, Homo sapiens
cccagtccttgtcctgggc

SEQ ID NO: 6936162 - DNA, 22 bp, Homo sapiens
aatcctgtcttgccatccaata

SEQ ID NO: 6936163 - DNA, 22 bp, Homo sapiens
tctctacataacctcaatactc

SEQ ID NO: 6936164 - DNA, 22 bp, Homo sapiens
tctttcctgtaactgctgttca

SEQ ID NO: 6936165 - DNA, 20 bp, Homo sapiens
tgcagcagaagcccatgctc

SEQ ID NO: 6936166 - DNA, 22 bp, Homo sapiens
tgccttttccagtttctagggg

SEQ ID NO: 6936167 - DNA, 22 bp, Homo sapiens
tgcagtgtgacctgtagcgagc

SEQ ID NO: 6936168 - DNA, 22 bp, Homo sapiens
tccattgctcaatatagagttt

SEQ ID NO: 6936169 - DNA, 22 bp, Homo sapiens
ttccagcctttatccatccaga

SEQ ID NO: 6936170 - DNA, 22 bp, Homo sapiens
tttatgcacaattagtcttata

SEQ ID NO: 6936171 - DNA, 21 bp, Homo sapiens
tagagatgacgagctctagca

SEQ ID NO: 6936172 - DNA, 22 bp, Homo sapiens
agtgaacaagtcgcgatgtttt

SEQ ID NO: 6936173 - DNA, 22 bp, Homo sapiens
caagatttgccagtggccaact

SEQ ID NO: 6936174 - DNA, 22 bp, Homo sapiens
atctggaagttaagcttggtgc

SEQ ID NO: 6936175 - DNA, 22 bp, Homo sapiens
attcttactccatagaatgaat

SEQ ID NO: 6936176 - DNA, 22 bp, Homo sapiens
tgatttcaggaatgtcttagca

SEQ ID NO: 6936177 - DNA, 20 bp, Homo sapiens
ccttgatcttggacttccag

SEQ ID NO: 6936178 - DNA, 22 bp, Homo sapiens
tctatattatacatccaggatt

SEQ ID NO: 6936179 - DNA, 22 bp, Homo sapiens
agatcactggttacttaatgaa

SEQ ID NO: 6936180 - DNA, 22 bp, Homo sapiens
gtccagtgcttatagaatcagt

SEQ ID NO: 6936181 - DNA, 22 bp, Homo sapiens
tgccctctgcaggccgccatgg

SEQ ID NO: 6936182 - DNA, 22 bp, Homo sapiens
aggctctgtgactaaagaggat

SEQ ID NO: 6936183 - DNA, 22 bp, Homo sapiens
agtccttagaacactgtatctg

SEQ ID NO: 6936184 - DNA, 22 bp, Homo sapiens
atgtttcatcagtaaggttttg

SEQ ID NO: 6936185 - DNA, 22 bp, Homo sapiens
tgaatctttttggaaataaaga

SEQ ID NO: 6936186 - DNA, 22 bp, Homo sapiens
gtattaggaggaacacaggcct

SEQ ID NO: 6936187 - DNA, 22 bp, Homo sapiens
tcttgagaagcggctgtctcag

SEQ ID NO: 6936188 - DNA, 22 bp, Homo sapiens
aggcaggcactccggaagtgtc

SEQ ID NO: 6936189 - DNA, 22 bp, Homo sapiens
ctcttcttggaatgctgactgt

SEQ ID NO: 6936190 - DNA, 22 bp, Homo sapiens
taggacatttataaagctgaaa

SEQ ID NO: 6936191 - DNA, 22 bp, Homo sapiens
gcttcagactggagcagaggaa

SEQ ID NO: 6936192 - DNA, 22 bp, Homo sapiens
gcagagtgctgtcgtacgcccc

SEQ ID NO: 6936193 - DNA, 22 bp, Homo sapiens
gaggtctgtgtcactttagtgc

SEQ ID NO: 6936194 - DNA, 22 bp, Homo sapiens
tttgttctgcatcacagaaaaa

SEQ ID NO: 6936195 - DNA, 22 bp, Homo sapiens
cttcattaactattggaatgca

SEQ ID NO: 6936196 - DNA, 22 bp, Homo sapiens
atggaccatgagttttctctgg

SEQ ID NO: 6936197 - DNA, 22 bp, Homo sapiens
aatgccattccatcacacacct

SEQ ID NO: 6936198 - DNA, 22 bp, Homo sapiens
agtgatgttgattttaccactt

SEQ ID NO: 6936199 - DNA, 22 bp, Homo sapiens
tgtatttgatgagaggagggtc

SEQ ID NO: 6936200 - DNA, 22 bp, Homo sapiens
gttttcaattataagatggctt

SEQ ID NO: 6936201 - DNA, 22 bp, Homo sapiens
aattcctaggtatgatttttgg

SEQ ID NO: 6936202 - DNA, 22 bp, Homo sapiens
ggtgccttttccgtgtggccca

SEQ ID NO: 6936203 - DNA, 22 bp, Homo sapiens
agcagacaacccagatgaccca

SEQ ID NO: 6936204 - DNA, 22 bp, Homo sapiens
tgagtgacattttatattgcca

SEQ ID NO: 6936205 - DNA, 19 bp, Homo sapiens
tttagacattgtctggtat

SEQ ID NO: 6936206 - DNA, 19 bp, Homo sapiens
cagagtacaccagatagga

SEQ ID NO: 6936207 - DNA, 22 bp, Homo sapiens
tgaggagtgtggatggagcttg

SEQ ID NO: 6936208 - DNA, 22 bp, Homo sapiens
tgaaatgattatatggtgtttg

SEQ ID NO: 6936209 - DNA, 22 bp, Homo sapiens
acatccttatataggccaatga

SEQ ID NO: 6936210 - DNA, 20 bp, Homo sapiens
ggtctctgacagctggttgc

SEQ ID NO: 6936211 - DNA, 22 bp, Homo sapiens
gaatgaacaaggatgttcatcc

SEQ ID NO: 6936212 - DNA, 22 bp, Homo sapiens
ggtgagcctggagtcttgctgg

SEQ ID NO: 6936213 - DNA, 22 bp, Homo sapiens
agtgaccatatatcatttttgt

SEQ ID NO: 6936214 - DNA, 22 bp, Homo sapiens
cagtagacacatttgtttttcc

SEQ ID NO: 6936215 - DNA, 22 bp, Homo sapiens
caattcatgggctgaggaaggg

SEQ ID NO: 6936216 - DNA, 22 bp, Homo sapiens
cagaagttagacttcaactaat

SEQ ID NO: 6936217 - DNA, 22 bp, Homo sapiens
tagtcacaaccttcaagttgtc

SEQ ID NO: 6936218 - DNA, 22 bp, Homo sapiens
acacggcactttaggaaggggc

SEQ ID NO: 6936219 - DNA, 22 bp, Homo sapiens
gtgatttagtgttaagtatgtt

SEQ ID NO: 6936220 - DNA, 22 bp, Homo sapiens
cctttacatctgacttctttca

SEQ ID NO: 6936221 - DNA, 22 bp, Homo sapiens
caatgcatacttcgaaatttca

SEQ ID NO: 6936222 - DNA, 22 bp, Homo sapiens
agcagcatgtatgagggtgaac

SEQ ID NO: 6936223 - DNA, 22 bp, Homo sapiens
gatattgataataaccatgaat

SEQ ID NO: 6936224 - DNA, 22 bp, Homo sapiens
tagagctggccgggacagctgg

SEQ ID NO: 6936225 - DNA, 22 bp, Homo sapiens
ttgcaaatctcttgtgtttggt

SEQ ID NO: 6936226 - DNA, 22 bp, Homo sapiens
tctctgagtatcctgaactgcc

SEQ ID NO: 6936227 - DNA, 22 bp, Homo sapiens
tctttcttgtgggtgccctttt

SEQ ID NO: 6936228 - DNA, 22 bp, Homo sapiens
tatcaacttttcagaaggggct

SEQ ID NO: 6936229 - DNA, 22 bp, Homo sapiens
ctcggtggacatttcagaggtg

SEQ ID NO: 6936230 - DNA, 22 bp, Homo sapiens
ccaaagtctggagcagcagagc

SEQ ID NO: 6936231 - DNA, 18 bp, Homo sapiens
acctggctgtgtgagctg

SEQ ID NO: 6936232 - DNA, 22 bp, Homo sapiens
gctgccagggaggtggtggagg

SEQ ID NO: 6936233 - DNA, 22 bp, Homo sapiens
aactggtagaaagcagtaagtg

SEQ ID NO: 6936234 - DNA, 22 bp, Homo sapiens
gaccaggcccaggtgcaaggga

SEQ ID NO: 6936235 - DNA, 22 bp, Homo sapiens
aagtgattaaccatgctctgct

SEQ ID NO: 6936236 - DNA, 22 bp, Homo sapiens
taagcattaactctgctgcaag

SEQ ID NO: 6936237 - DNA, 22 bp, Homo sapiens
taggcctattgtattcttatct

SEQ ID NO: 6936238 - DNA, 22 bp, Homo sapiens
cagagctggtgtgtcctggcat

SEQ ID NO: 6936239 - DNA, 22 bp, Homo sapiens
aacaggaaaacagcacaatagc

SEQ ID NO: 6936240 - DNA, 22 bp, Homo sapiens
aagctgaagatgccagtgggag

SEQ ID NO: 6936241 - DNA, 21 bp, Homo sapiens
tggtggagtgtgctgagcatg

SEQ ID NO: 6936242 - DNA, 22 bp, Homo sapiens
ctctgagctttgcagcccctgg

SEQ ID NO: 6936243 - DNA, 22 bp, Homo sapiens
cagtcagtcaatactctttgag

SEQ ID NO: 6936244 - DNA, 22 bp, Homo sapiens
cttagtaccatcaggtagcttg

SEQ ID NO: 6936245 - DNA, 22 bp, Homo sapiens
agccagagcagggaattggaca

SEQ ID NO: 6936246 - DNA, 22 bp, Homo sapiens
gtattagctgccttggagctaa

SEQ ID NO: 6936247 - DNA, 22 bp, Homo sapiens
aatcagaatttgtcccctgagt

SEQ ID NO: 6936248 - DNA, 22 bp, Homo sapiens
agcacttaagttaattgaactg

SEQ ID NO: 6936249 - DNA, 22 bp, Homo sapiens
taccagcaactggaagtcagat

SEQ ID NO: 6936250 - DNA, 21 bp, Homo sapiens
acagtagctgacacacagttt

SEQ ID NO: 6936251 - DNA, 22 bp, Homo sapiens
cctaccagtaggaggccagaga

SEQ ID NO: 6936252 - DNA, 22 bp, Homo sapiens
agagaatctgggaagatgttaa

SEQ ID NO: 6936253 - DNA, 22 bp, Homo sapiens
tccaggcatcccccaggacaga

SEQ ID NO: 6936254 - DNA, 22 bp, Homo sapiens
tagatgtgaggattcaggagtt

SEQ ID NO: 6936255 - DNA, 22 bp, Homo sapiens
tttgctttctgttgaacagagt

SEQ ID NO: 6936256 - DNA, 22 bp, Homo sapiens
agacacttggcagagagctgtt

SEQ ID NO: 6936257 - DNA, 21 bp, Homo sapiens
tcaaggagtttctcttttcca

SEQ ID NO: 6936258 - DNA, 21 bp, Homo sapiens
aggctcagagagaaactcttg

SEQ ID NO: 6936259 - DNA, 22 bp, Homo sapiens
tactgtctaataagattgatgg

SEQ ID NO: 6936260 - DNA, 22 bp, Homo sapiens
tctcctggatagatactatcca

SEQ ID NO: 6936261 - DNA, 22 bp, Homo sapiens
ttatgtacaatgttaatgtaaa

SEQ ID NO: 6936262 - DNA, 22 bp, Homo sapiens
cagtggcttaaataagattagg

SEQ ID NO: 6936263 - DNA, 23 bp, Homo sapiens
ccacagctatagggtagtgcagt

SEQ ID NO: 6936264 - DNA, 20 bp, Homo sapiens
ctcagtgctttcattgcctc

SEQ ID NO: 6936265 - DNA, 22 bp, Homo sapiens
gtgtacaggatgactgtactta

SEQ ID NO: 6936266 - DNA, 22 bp, Homo sapiens
ttagctttagagccattactgg

SEQ ID NO: 6936267 - DNA, 22 bp, Homo sapiens
tgattctatctaggtagaactg

SEQ ID NO: 6936268 - DNA, 22 bp, Homo sapiens
cagtgggaagaatgcagcctcc

SEQ ID NO: 6936269 - DNA, 22 bp, Homo sapiens
tgcagaagtattccaggcccca

SEQ ID NO: 6936270 - DNA, 22 bp, Homo sapiens
ggggatggaggcgtgtggtcct

SEQ ID NO: 6936271 - DNA, 22 bp, Homo sapiens
tgagcagggagctgggctgagc

SEQ ID NO: 6936272 - DNA, 22 bp, Homo sapiens
agtctagaggatgggtccagat

SEQ ID NO: 6936273 - DNA, 22 bp, Homo sapiens
tggctcagctgactcggcttct

SEQ ID NO: 6936274 - DNA, 22 bp, Homo sapiens
attttgaatcaccttggaagaa

SEQ ID NO: 6936275 - DNA, 22 bp, Homo sapiens
tgtaaagacagataaaacagca

SEQ ID NO: 6936276 - DNA, 21 bp, Homo sapiens
agctctggagcagcaatcaag

SEQ ID NO: 6936277 - DNA, 22 bp, Homo sapiens
aggctctttccactctggtgca

SEQ ID NO: 6936278 - DNA, 20 bp, Homo sapiens
ggctctgcttgtgagcagcc

SEQ ID NO: 6936279 - DNA, 22 bp, Homo sapiens
cataactttaaagacagtgtgg

SEQ ID NO: 6936280 - DNA, 23 bp, Homo sapiens
ccagggctacgggcaccgtcctg

SEQ ID NO: 6936281 - DNA, 22 bp, Homo sapiens
ttgcagggttaaagtaaggtag

SEQ ID NO: 6936282 - DNA, 22 bp, Homo sapiens
ctggaagggtcagagtgatgag

SEQ ID NO: 6936283 - DNA, 17 bp, Homo sapiens
ccaagatgatagaggga

SEQ ID NO: 6936284 - DNA, 22 bp, Homo sapiens
caacttcagggaaacatgaagc

SEQ ID NO: 6936285 - DNA, 22 bp, Homo sapiens
cacagaatctgtgactccaaga

SEQ ID NO: 6936286 - DNA, 22 bp, Homo sapiens
tattggccgggcgcggtggctc

SEQ ID NO: 6936287 - DNA, 23 bp, Homo sapiens
gcctcctagcagtaaacatgtta

SEQ ID NO: 6936288 - DNA, 22 bp, Homo sapiens
ttataagactgtagtgagtatt

SEQ ID NO: 6936289 - DNA, 22 bp, Homo sapiens
tgaaatgtagtgaagcatggaa

SEQ ID NO: 6936290 - DNA, 22 bp, Homo sapiens
ttggccctagactctaagtccg

SEQ ID NO: 6936291 - DNA, 22 bp, Homo sapiens
aaggatttgtccaaagtcacac

SEQ ID NO: 6936292 - DNA, 22 bp, Homo sapiens
taatactgaaggtaaaatttct

SEQ ID NO: 6936293 - DNA, 22 bp, Homo sapiens
tccttcagctgctaggaaatga

SEQ ID NO: 6936294 - DNA, 22 bp, Homo sapiens
tggctgggagctggaactgggc

SEQ ID NO: 6936295 - DNA, 22 bp, Homo sapiens
ttgctttatgtgtatgacttga

SEQ ID NO: 6936296 - DNA, 22 bp, Homo sapiens
gacagcaggtaattagttaaca

SEQ ID NO: 6936297 - DNA, 20 bp, Homo sapiens
agtatgatccactctgctct

SEQ ID NO: 6936298 - DNA, 22 bp, Homo sapiens
acttctgtaaagggaagacagt

SEQ ID NO: 6936299 - DNA, 22 bp, Homo sapiens
tagcactatatgttagctatta

SEQ ID NO: 6936300 - DNA, 22 bp, Homo sapiens
tgctcagttcaaggaaggtgga

SEQ ID NO: 6936301 - DNA, 22 bp, Homo sapiens
aaagtattcaaaaatatttggt

SEQ ID NO: 6936302 - DNA, 22 bp, Homo sapiens
agatacattgttctaagcattg

SEQ ID NO: 6936303 - DNA, 22 bp, Homo sapiens
cacagcggcctccgatgctgat

SEQ ID NO: 6936304 - DNA, 22 bp, Homo sapiens
ctcagcagctgctgctggtggg

SEQ ID NO: 6936305 - DNA, 22 bp, Homo sapiens
ccagccagtccagcattggtgt

SEQ ID NO: 6936306 - DNA, 22 bp, Homo sapiens
ctgggccaggaccagggttgaa

SEQ ID NO: 6936307 - DNA, 22 bp, Homo sapiens
tgctctgaactgaacttagggt

SEQ ID NO: 6936308 - DNA, 22 bp, Homo sapiens
caagatgatccctgaaggcagc

SEQ ID NO: 6936309 - DNA, 22 bp, Homo sapiens
tagggatgaggatagatttttc

SEQ ID NO: 6936310 - DNA, 22 bp, Homo sapiens
ttccctgtgtgcagatgggtgt

SEQ ID NO: 6936311 - DNA, 22 bp, Homo sapiens
agttagtgaagctcatcacagc

SEQ ID NO: 6936312 - DNA, 22 bp, Homo sapiens
cactggtgtctgagcagggtga

SEQ ID NO: 6936313 - DNA, 22 bp, Homo sapiens
tgtaaagagaaggcttataaag

SEQ ID NO: 6936314 - DNA, 22 bp, Homo sapiens
gggtgacagcagctaatgacag

SEQ ID NO: 6936315 - DNA, 22 bp, Homo sapiens
gcaggccaagccctcgcagaga

SEQ ID NO: 6936316 - DNA, 22 bp, Homo sapiens
cagggcctcgaagcctctgggc

SEQ ID NO: 6936317 - DNA, 22 bp, Homo sapiens
atgctctgggcaggagccctgg

SEQ ID NO: 6936318 - DNA, 22 bp, Homo sapiens
cacatgcataaggataattact

SEQ ID NO: 6936319 - DNA, 22 bp, Homo sapiens
gtgcctgctgcagagtcgctgt

SEQ ID NO: 6936320 - DNA, 22 bp, Homo sapiens
tggggggcacttcagcacaatg

SEQ ID NO: 6936321 - DNA, 22 bp, Homo sapiens
gagagtgtcgggggccccagga

SEQ ID NO: 6936322 - DNA, 22 bp, Homo sapiens
gcctgagatcagccaagcccct

SEQ ID NO: 6936323 - DNA, 22 bp, Homo sapiens
gctaagaaaaattcatgtatat

SEQ ID NO: 6936324 - DNA, 22 bp, Homo sapiens
gcagtggaagcctctttaagca

SEQ ID NO: 6936325 - DNA, 22 bp, Homo sapiens
gcggagcggagctgccggtgat

SEQ ID NO: 6936326 - DNA, 22 bp, Homo sapiens
actgaagttcatacaacagact

SEQ ID NO: 6936327 - DNA, 22 bp, Homo sapiens
gaacatcaaggtctgtgtctag

SEQ ID NO: 6936328 - DNA, 19 bp, Homo sapiens
tgtagcagtttaaaacaac

SEQ ID NO: 6936329 - DNA, 22 bp, Homo sapiens
aaagttgagttttatgtgttac

SEQ ID NO: 6936330 - DNA, 22 bp, Homo sapiens
tgatcaaattcaggagtctgga

SEQ ID NO: 6936331 - DNA, 20 bp, Homo sapiens
ctgtaactgtcccttttgcc

SEQ ID NO: 6936332 - DNA, 22 bp, Homo sapiens
tcccacattaccctgactgaca

SEQ ID NO: 6936333 - DNA, 19 bp, Homo sapiens
acacaccagtgcctgtgac

SEQ ID NO: 6936334 - DNA, 22 bp, Homo sapiens
cacatgaattgatgccaagtgc

SEQ ID NO: 6936335 - DNA, 22 bp, Homo sapiens
tgaagcctgaaagctggacagg

SEQ ID NO: 6936336 - DNA, 22 bp, Homo sapiens
tttcattgaactaaagaatctg

SEQ ID NO: 6936337 - DNA, 22 bp, Homo sapiens
ctgggcatttttctctgttaca

SEQ ID NO: 6936338 - DNA, 22 bp, Homo sapiens
ttcaattctaaactaatattct

SEQ ID NO: 6936339 - DNA, 22 bp, Homo sapiens
aaaaggcatggaggttgatagt

SEQ ID NO: 6936340 - DNA, 19 bp, Homo sapiens
aagcccagtgtatgctctt

SEQ ID NO: 6936341 - DNA, 23 bp, Homo sapiens
aggctccacatgggcactttgca

SEQ ID NO: 6936342 - DNA, 22 bp, Homo sapiens
agtctcagagtacctgagggac

SEQ ID NO: 6936343 - DNA, 22 bp, Homo sapiens
taaattgaaaatctacagaaca

SEQ ID NO: 6936344 - DNA, 21 bp, Homo sapiens
tctgggctttcttataaggca

SEQ ID NO: 6936345 - DNA, 22 bp, Homo sapiens
aaaaggatcagattttgagcag

SEQ ID NO: 6936346 - DNA, 22 bp, Homo sapiens
ctgggagattgctagagatgca

SEQ ID NO: 6936347 - DNA, 20 bp, Homo sapiens
tggctttaagttttttgcta

SEQ ID NO: 6936348 - DNA, 22 bp, Homo sapiens
ccagctccgggagttgctgctg

SEQ ID NO: 6936349 - DNA, 22 bp, Homo sapiens
tcattgaagacttactggcttc

SEQ ID NO: 6936350 - DNA, 22 bp, Homo sapiens
tttgaaagctactttcgggtca

SEQ ID NO: 6936351 - DNA, 22 bp, Homo sapiens
ccaggaagctgtctgatatgaa

SEQ ID NO: 6936352 - DNA, 22 bp, Homo sapiens
actctgtgtgagtagagcctgt

SEQ ID NO: 6936353 - DNA, 22 bp, Homo sapiens
cccagggactcgggattctagg

SEQ ID NO: 6936354 - DNA, 22 bp, Homo sapiens
tgtttagcataaagattttcca

SEQ ID NO: 6936355 - DNA, 22 bp, Homo sapiens
gtatggaagtataagttttgaa

SEQ ID NO: 6936356 - DNA, 22 bp, Homo sapiens
gccaccctgcaaatgcccagga

SEQ ID NO: 6936357 - DNA, 22 bp, Homo sapiens
tctggagtctaaagaaccaaaa

SEQ ID NO: 6936358 - DNA, 22 bp, Homo sapiens
tgtctatttgaattatcctaat

SEQ ID NO: 6936359 - DNA, 22 bp, Homo sapiens
atgtagcttgtcccacatcata

SEQ ID NO: 6936360 - DNA, 22 bp, Homo sapiens
atctccagctggctgtgataaa

SEQ ID NO: 6936361 - DNA, 22 bp, Homo sapiens
atgcacccttatgaatatgatc

SEQ ID NO: 6936362 - DNA, 22 bp, Homo sapiens
gtcctgtgcctggccaaaagct

SEQ ID NO: 6936363 - DNA, 22 bp, Homo sapiens
accgctgtgcccgtctcagtct

SEQ ID NO: 6936364 - DNA, 22 bp, Homo sapiens
tttgtacatgaatgtgcaccca

SEQ ID NO: 6936365 - DNA, 22 bp, Homo sapiens
tacagtaaccttatttgtcatt

SEQ ID NO: 6936366 - DNA, 22 bp, Homo sapiens
tgtctttctatctctagattta

SEQ ID NO: 6936367 - DNA, 22 bp, Homo sapiens
tgggaagctgcattttaacaag

SEQ ID NO: 6936368 - DNA, 22 bp, Homo sapiens
actgtagaatggaaccaattgt

SEQ ID NO: 6936369 - DNA, 22 bp, Homo sapiens
tagcaaatgtctgaaggaatag

SEQ ID NO: 6936370 - DNA, 22 bp, Homo sapiens
tcactgcaacctccacctcctg

SEQ ID NO: 6936371 - DNA, 22 bp, Homo sapiens
tgacagtgaacaggttaccact

SEQ ID NO: 6936372 - DNA, 22 bp, Homo sapiens
tttcatgaggctgcataaggag

SEQ ID NO: 6936373 - DNA, 22 bp, Homo sapiens
atgatattttagtaaagtgata

SEQ ID NO: 6936374 - DNA, 22 bp, Homo sapiens
cgtatacatgaagacattgctg

SEQ ID NO: 6936375 - DNA, 22 bp, Homo sapiens
atatgcttgactctttcacatc

SEQ ID NO: 6936376 - DNA, 22 bp, Homo sapiens
gcaggggtggaggctgtcctgt

SEQ ID NO: 6936377 - DNA, 22 bp, Homo sapiens
aagggtccaaggctttgcgttt

SEQ ID NO: 6936378 - DNA, 22 bp, Homo sapiens
ctccatatgttcagttatgcag

SEQ ID NO: 6936379 - DNA, 22 bp, Homo sapiens
gagtattcctcagtcattttgt

SEQ ID NO: 6936380 - DNA, 22 bp, Homo sapiens
ctgctctgaagccaggattctg

SEQ ID NO: 6936381 - DNA, 22 bp, Homo sapiens
aaagccacagttctatgtctgc

SEQ ID NO: 6936382 - DNA, 22 bp, Homo sapiens
gagtgttccagaaactggccct

SEQ ID NO: 6936383 - DNA, 22 bp, Homo sapiens
gaacagcagtcactcatgttat

SEQ ID NO: 6936384 - DNA, 22 bp, Homo sapiens
cagagaccccgctgcccttctg

SEQ ID NO: 6936385 - DNA, 22 bp, Homo sapiens
ttgtgacagagatcacgtggcc

SEQ ID NO: 6936386 - DNA, 20 bp, Homo sapiens
ctgaagagtggcctgatctg

SEQ ID NO: 6936387 - DNA, 22 bp, Homo sapiens
acaggtggacacagcagcagtc

SEQ ID NO: 6936388 - DNA, 22 bp, Homo sapiens
aggaggccattctctcagtagc

SEQ ID NO: 6936389 - DNA, 22 bp, Homo sapiens
cctcagctcttccctgtgcaca

SEQ ID NO: 6936390 - DNA, 22 bp, Homo sapiens
tctggcaaaggcaaccacagtt

SEQ ID NO: 6936391 - DNA, 22 bp, Homo sapiens
tacttttagcctatttgattct

SEQ ID NO: 6936392 - DNA, 20 bp, Homo sapiens
ccagggctggctcctgggat

SEQ ID NO: 6936393 - DNA, 22 bp, Homo sapiens
atacctttaggcattttgcatc

SEQ ID NO: 6936394 - DNA, 22 bp, Homo sapiens
tcccagaggaaatggcagctga

SEQ ID NO: 6936395 - DNA, 19 bp, Homo sapiens
tcagactgaaagtttagat

SEQ ID NO: 6936396 - DNA, 22 bp, Homo sapiens
gcttgcagtggttggcatgacc

SEQ ID NO: 6936397 - DNA, 16 bp, Homo sapiens
taaacagcagacagtt

SEQ ID NO: 6936398 - DNA, 22 bp, Homo sapiens
tgggggagattgtgcatctcta

SEQ ID NO: 6936399 - DNA, 19 bp, Homo sapiens
tggggcctcctgtccctgg

SEQ ID NO: 6936400 - DNA, 22 bp, Homo sapiens
actttgttttcatgaaacagct

SEQ ID NO: 6936401 - DNA, 20 bp, Homo sapiens
tgctcaggatggagaggtgt

SEQ ID NO: 6936402 - DNA, 22 bp, Homo sapiens
tgtgaaaaaagttctagaagga

SEQ ID NO: 6936403 - DNA, 22 bp, Homo sapiens
tatgtgtatatctgtatgtgca

SEQ ID NO: 6936404 - DNA, 22 bp, Homo sapiens
ctctcagactgaagggcctgtg

SEQ ID NO: 6936405 - DNA, 22 bp, Homo sapiens
tttgttataacaataaaaagtc

SEQ ID NO: 6936406 - DNA, 21 bp, Homo sapiens
gcaggctggtcaaacctcagt

SEQ ID NO: 6936407 - DNA, 22 bp, Homo sapiens
aagtatttcgttctgaaaaagt

SEQ ID NO: 6936408 - DNA, 22 bp, Homo sapiens
ctccagggaggagcacgggttc

SEQ ID NO: 6936409 - DNA, 22 bp, Homo sapiens
tttgattcctggggcagggctg

SEQ ID NO: 6936410 - DNA, 22 bp, Homo sapiens
ctgtccagcgactaggggatgg

SEQ ID NO: 6936411 - DNA, 22 bp, Homo sapiens
atctgggtttcaaagaagcctt

SEQ ID NO: 6936412 - DNA, 22 bp, Homo sapiens
acatttgaggatgttaagaatg

SEQ ID NO: 6936413 - DNA, 22 bp, Homo sapiens
ccagccctcactgaggcctctc

SEQ ID NO: 6936414 - DNA, 22 bp, Homo sapiens
tctttgatggagagatagatat

SEQ ID NO: 6936415 - DNA, 22 bp, Homo sapiens
ttgagcaaaggagtaaaatgca

SEQ ID NO: 6936416 - DNA, 21 bp, Homo sapiens
tgggggagaattggttgcttt

SEQ ID NO: 6936417 - DNA, 22 bp, Homo sapiens
tcagccagaggcttcttggttt

SEQ ID NO: 6936418 - DNA, 17 bp, Homo sapiens
agaactgtagtagctcc

SEQ ID NO: 6936419 - DNA, 22 bp, Homo sapiens
gagagggctgcctggtgtgagg

SEQ ID NO: 6936420 - DNA, 22 bp, Homo sapiens
tctggccatggcaagccgagtg

SEQ ID NO: 6936421 - DNA, 22 bp, Homo sapiens
cacaaccatgcacagctaattt

SEQ ID NO: 6936422 - DNA, 22 bp, Homo sapiens
tcagggcaagattggttaataa

SEQ ID NO: 6936423 - DNA, 22 bp, Homo sapiens
accatgtgttttacacatggta

SEQ ID NO: 6936424 - DNA, 22 bp, Homo sapiens
tctgggaaatgctgttccttgt

SEQ ID NO: 6936425 - DNA, 22 bp, Homo sapiens
atatgcatttacctggcatata

SEQ ID NO: 6936426 - DNA, 22 bp, Homo sapiens
aacatgctgcctttctacgagt

SEQ ID NO: 6936427 - DNA, 22 bp, Homo sapiens
tccttaattctgtgcaatatgt

SEQ ID NO: 6936428 - DNA, 22 bp, Homo sapiens
tatgggtaaagggctagggttt

SEQ ID NO: 6936429 - DNA, 22 bp, Homo sapiens
ctggcactgagtggcttatgac

SEQ ID NO: 6936430 - DNA, 22 bp, Homo sapiens
atgggtgagtatgagttgactt

SEQ ID NO: 6936431 - DNA, 22 bp, Homo sapiens
ctttacagataggaactactca

SEQ ID NO: 6936432 - DNA, 22 bp, Homo sapiens
tattctcattagtctgtattcc

SEQ ID NO: 6936433 - DNA, 22 bp, Homo sapiens
cagtgttttgagaagggcacgt

SEQ ID NO: 6936434 - DNA, 22 bp, Homo sapiens
aatgctgcaagaggtgaaaaga

SEQ ID NO: 6936435 - DNA, 21 bp, Homo sapiens
gatgatggcaggcagcactgg

SEQ ID NO: 6936436 - DNA, 20 bp, Homo sapiens
tctctaacatgaatgctatc

SEQ ID NO: 6936437 - DNA, 22 bp, Homo sapiens
tgggcagatgtggctctccttg

SEQ ID NO: 6936438 - DNA, 22 bp, Homo sapiens
gcagtgttcttgttgcttttat

SEQ ID NO: 6936439 - DNA, 22 bp, Homo sapiens
catttaatctggctcatgagca

SEQ ID NO: 6936440 - DNA, 22 bp, Homo sapiens
gattgtaaaacagatcattatc

SEQ ID NO: 6936441 - DNA, 22 bp, Homo sapiens
agaacagctgcaaaacttaatc

SEQ ID NO: 6936442 - DNA, 22 bp, Homo sapiens
aggaatgttagttctgtataca

SEQ ID NO: 6936443 - DNA, 22 bp, Homo sapiens
ttgcaggacaatgatggtccct

SEQ ID NO: 6936444 - DNA, 22 bp, Homo sapiens
aaattcatttttcttagtgtgc

SEQ ID NO: 6936445 - DNA, 22 bp, Homo sapiens
ttcagaaaggctgtgccagcca

SEQ ID NO: 6936446 - DNA, 22 bp, Homo sapiens
tctccagggtgagctaggccag

SEQ ID NO: 6936447 - DNA, 22 bp, Homo sapiens
gaggtatagttctattagatga

SEQ ID NO: 6936448 - DNA, 22 bp, Homo sapiens
aaggcagcaccgcctcctgaaa

SEQ ID NO: 6936449 - DNA, 22 bp, Homo sapiens
ggctttattaactcatccgtaa

SEQ ID NO: 6936450 - DNA, 22 bp, Homo sapiens
agtccaggagttgggtgacatt

SEQ ID NO: 6936451 - DNA, 22 bp, Homo sapiens
gtttacatatgtctgtctgcac

SEQ ID NO: 6936452 - DNA, 22 bp, Homo sapiens
tctgttccatgttttgttccat

SEQ ID NO: 6936453 - DNA, 23 bp, Homo sapiens
agcacaaagtgttttccttgtag

SEQ ID NO: 6936454 - DNA, 22 bp, Homo sapiens
tcactgtttcctgtactggaca

SEQ ID NO: 6936455 - DNA, 22 bp, Homo sapiens
atttgttcacaatcagggcagg

SEQ ID NO: 6936456 - DNA, 22 bp, Homo sapiens
tgatacttttcttttagactaa

SEQ ID NO: 6936457 - DNA, 22 bp, Homo sapiens
accagctcttctgctctagttg

SEQ ID NO: 6936458 - DNA, 22 bp, Homo sapiens
attgtgctaagcccaggaggga

SEQ ID NO: 6936459 - DNA, 22 bp, Homo sapiens
atgcaaacatgaagagaaagag

SEQ ID NO: 6936460 - DNA, 22 bp, Homo sapiens
ccagttgtttgccttgaaatga

SEQ ID NO: 6936461 - DNA, 18 bp, Homo sapiens
aagtagatcatgagccac

SEQ ID NO: 6936462 - DNA, 22 bp, Homo sapiens
tgcatgatgactaaggtggtga

SEQ ID NO: 6936463 - DNA, 22 bp, Homo sapiens
tactatgtgaaaatactatagt

SEQ ID NO: 6936464 - DNA, 22 bp, Homo sapiens
ctgcagtcttccttccttaggc

SEQ ID NO: 6936465 - DNA, 22 bp, Homo sapiens
aatctgtcgtagtaaaaagcag

SEQ ID NO: 6936466 - DNA, 22 bp, Homo sapiens
tgttatctcagactgagttact

SEQ ID NO: 6936467 - DNA, 22 bp, Homo sapiens
gtgtatgtgccttacattttat

SEQ ID NO: 6936468 - DNA, 22 bp, Homo sapiens
gctcttgaccttggagaactcg

SEQ ID NO: 6936469 - DNA, 22 bp, Homo sapiens
aggtctcttgctgtctctgggc

SEQ ID NO: 6936470 - DNA, 19 bp, Homo sapiens
gcatttcatttaaccatca

SEQ ID NO: 6936471 - DNA, 22 bp, Homo sapiens
tttctcagttctctgcaaggag

SEQ ID NO: 6936472 - DNA, 22 bp, Homo sapiens
tttggaatagcatagaagctca

SEQ ID NO: 6936473 - DNA, 22 bp, Homo sapiens
agaccaaagaaaacacatctgg

SEQ ID NO: 6936474 - DNA, 22 bp, Homo sapiens
agtggctgttccaggtgaggac

SEQ ID NO: 6936475 - DNA, 22 bp, Homo sapiens
aacaggctcactctgacttcta

SEQ ID NO: 6936476 - DNA, 22 bp, Homo sapiens
ttccttgttctacatccctgcc

SEQ ID NO: 6936477 - DNA, 22 bp, Homo sapiens
tcatgctggcccagaatggagg

SEQ ID NO: 6936478 - DNA, 21 bp, Homo sapiens
atgaagtctatgcttctgtgt

SEQ ID NO: 6936479 - DNA, 22 bp, Homo sapiens
ttcatactaaagtgtaagatgt

SEQ ID NO: 6936480 - DNA, 21 bp, Homo sapiens
tatgcctgatttctaatgatg

SEQ ID NO: 6936481 - DNA, 22 bp, Homo sapiens
agtctcttgctagaatcagcca

SEQ ID NO: 6936482 - DNA, 22 bp, Homo sapiens
cacacctgtaatcctagcactt

SEQ ID NO: 6936483 - DNA, 22 bp, Homo sapiens
cagctcaggcactggcgcggga

SEQ ID NO: 6936484 - DNA, 22 bp, Homo sapiens
ttagccatgttgaagatttaga

SEQ ID NO: 6936485 - DNA, 20 bp, Homo sapiens
atgttctgtggctgtcatgg

SEQ ID NO: 6936486 - DNA, 22 bp, Homo sapiens
caggcctctccttagtctggca

SEQ ID NO: 6936487 - DNA, 22 bp, Homo sapiens
accctgcctctgcttcctgtag

SEQ ID NO: 6936488 - DNA, 22 bp, Homo sapiens
tcttctggatgagagcggaggc

SEQ ID NO: 6936489 - DNA, 22 bp, Homo sapiens
ctttgggcactgaagtatgggt

SEQ ID NO: 6936490 - DNA, 22 bp, Homo sapiens
actggaatgtcatcgtgacttt

SEQ ID NO: 6936491 - DNA, 22 bp, Homo sapiens
gcagcgctactcacagctctga

SEQ ID NO: 6936492 - DNA, 22 bp, Homo sapiens
tagcagaggaaaagagaacatt

SEQ ID NO: 6936493 - DNA, 22 bp, Homo sapiens
cagttcacactgtgctatctgc

SEQ ID NO: 6936494 - DNA, 20 bp, Homo sapiens
aggaagtattgtcatgaagg

SEQ ID NO: 6936495 - DNA, 20 bp, Homo sapiens
ctggacttgctgctcacctg

SEQ ID NO: 6936496 - DNA, 22 bp, Homo sapiens
gggaaattgtcaacactctcaa

SEQ ID NO: 6936497 - DNA, 22 bp, Homo sapiens
tgtcaggtctacaaaaatgctg

SEQ ID NO: 6936498 - DNA, 20 bp, Homo sapiens
gctgaggtggaggaaggaga

SEQ ID NO: 6936499 - DNA, 22 bp, Homo sapiens
gctggcacatggctcagggcct

SEQ ID NO: 6936500 - DNA, 22 bp, Homo sapiens
aaacagtttctaatcatggaga

SEQ ID NO: 6936501 - DNA, 22 bp, Homo sapiens
tagaaaggaagctacttagggg

SEQ ID NO: 6936502 - DNA, 22 bp, Homo sapiens
actgggagagcgaccagattct

SEQ ID NO: 6936503 - DNA, 22 bp, Homo sapiens
cactggttggctgagatccata

SEQ ID NO: 6936504 - DNA, 22 bp, Homo sapiens
gagctctttcatggttctgtga

SEQ ID NO: 6936505 - DNA, 22 bp, Homo sapiens
actgcacacttagcatctggga

SEQ ID NO: 6936506 - DNA, 22 bp, Homo sapiens
gaatctgtcacttggccactct

SEQ ID NO: 6936507 - DNA, 22 bp, Homo sapiens
ataacatggagtttgtcattta

SEQ ID NO: 6936508 - DNA, 22 bp, Homo sapiens
gctgtcttccttgctccaaggg

SEQ ID NO: 6936509 - DNA, 23 bp, Homo sapiens
aacgtcctcaacaggattgcacc

SEQ ID NO: 6936510 - DNA, 20 bp, Homo sapiens
tttagcccccaacctgatgt

SEQ ID NO: 6936511 - DNA, 22 bp, Homo sapiens
aactgcaagtggggcttgtcat

SEQ ID NO: 6936512 - DNA, 22 bp, Homo sapiens
agcagtttagctatactgcttg

SEQ ID NO: 6936513 - DNA, 22 bp, Homo sapiens
tgggaaatcagtatagtatcag

SEQ ID NO: 6936514 - DNA, 22 bp, Homo sapiens
ccttgaaatgttctcactgggg

SEQ ID NO: 6936515 - DNA, 22 bp, Homo sapiens
aaggagcttgttcgccttcctc

SEQ ID NO: 6936516 - DNA, 22 bp, Homo sapiens
agcacagatgcatgatcaccag

SEQ ID NO: 6936517 - DNA, 22 bp, Homo sapiens
ggcttctttgtaacgtgccagc

SEQ ID NO: 6936518 - DNA, 22 bp, Homo sapiens
ggtgtctgatggtggcttctca

SEQ ID NO: 6936519 - DNA, 22 bp, Homo sapiens
tatgacatcagaagactttaaa

SEQ ID NO: 6936520 - DNA, 22 bp, Homo sapiens
gaagcccacgtttggtgatgta

SEQ ID NO: 6936521 - DNA, 22 bp, Homo sapiens
tagaacaggctgtcagagcggg

SEQ ID NO: 6936522 - DNA, 22 bp, Homo sapiens
cacatgcaggagccaatgtaca

SEQ ID NO: 6936523 - DNA, 22 bp, Homo sapiens
aatacatatggaattccatgtt

SEQ ID NO: 6936524 - DNA, 22 bp, Homo sapiens
agaagctcgggtaagctccatt

SEQ ID NO: 6936525 - DNA, 22 bp, Homo sapiens
ccaggggaaacagggagcactc

SEQ ID NO: 6936526 - DNA, 22 bp, Homo sapiens
gataatggggaatgataagtca

SEQ ID NO: 6936527 - DNA, 22 bp, Homo sapiens
agctgtggaaatcaggcaatga

SEQ ID NO: 6936528 - DNA, 22 bp, Homo sapiens
agaaatctattatttcagagtt

SEQ ID NO: 6936529 - DNA, 22 bp, Homo sapiens
cattgtcacccaaagctcatag

SEQ ID NO: 6936530 - DNA, 21 bp, Homo sapiens
tccttctctatgattgtctga

SEQ ID NO: 6936531 - DNA, 22 bp, Homo sapiens
ctgggacatggtgctgtcttta

SEQ ID NO: 6936532 - DNA, 19 bp, Homo sapiens
tcacagcatctgtctgaac

SEQ ID NO: 6936533 - DNA, 22 bp, Homo sapiens
caagagctttagaaatgctcat

SEQ ID NO: 6936534 - DNA, 22 bp, Homo sapiens
ctgggctcaaatcctatctcca

SEQ ID NO: 6936535 - DNA, 22 bp, Homo sapiens
tctgctgtgattctactagtgt

SEQ ID NO: 6936536 - DNA, 23 bp, Homo sapiens
aaatagagataggccagctttgc

SEQ ID NO: 6936537 - DNA, 22 bp, Homo sapiens
tgtgccaggccggggcaggaca

SEQ ID NO: 6936538 - DNA, 22 bp, Homo sapiens
tagtgtctgtccatcagtaact

SEQ ID NO: 6936539 - DNA, 22 bp, Homo sapiens
gcttgggagaggcttcctcttt

SEQ ID NO: 6936540 - DNA, 22 bp, Homo sapiens
tgaacctgtttccaggctcatt

SEQ ID NO: 6936541 - DNA, 22 bp, Homo sapiens
ggagggagcatccccttgctga

SEQ ID NO: 6936542 - DNA, 22 bp, Homo sapiens
gacatccatcatttcctgttga

SEQ ID NO: 6936543 - DNA, 22 bp, Homo sapiens
agtgcattctccatcatctagg

SEQ ID NO: 6936544 - DNA, 22 bp, Homo sapiens
tcattcggcaatagtgtgttag

SEQ ID NO: 6936545 - DNA, 22 bp, Homo sapiens
tgcttttaggagattaaaatta

SEQ ID NO: 6936546 - DNA, 21 bp, Homo sapiens
gttctgagttagagttggcca

SEQ ID NO: 6936547 - DNA, 20 bp, Homo sapiens
aggcttcaaccatacacctt

SEQ ID NO: 6936548 - DNA, 22 bp, Homo sapiens
gtgacagatttgctgcgcatgg

SEQ ID NO: 6936549 - DNA, 22 bp, Homo sapiens
ttttcaagggcagggaaatcat

SEQ ID NO: 6936550 - DNA, 22 bp, Homo sapiens
gccaaactacaagttaaatttt

SEQ ID NO: 6936551 - DNA, 22 bp, Homo sapiens
tgagcctggcggaagcagcgtg

SEQ ID NO: 6936552 - DNA, 22 bp, Homo sapiens
tgtggaatgtcctcagcatcct

SEQ ID NO: 6936553 - DNA, 22 bp, Homo sapiens
agcatagagtcctgagggcagg

SEQ ID NO: 6936554 - DNA, 22 bp, Homo sapiens
tcttcacagtcctggtcagtgg

SEQ ID NO: 6936555 - DNA, 22 bp, Homo sapiens
gctgacagagtgcctggcctca

SEQ ID NO: 6936556 - DNA, 22 bp, Homo sapiens
ccccagagaaagtcagcagcat

SEQ ID NO: 6936557 - DNA, 22 bp, Homo sapiens
tacttacacagctgtagaaggt

SEQ ID NO: 6936558 - DNA, 22 bp, Homo sapiens
cacagggccactttcccagtaa

SEQ ID NO: 6936559 - DNA, 22 bp, Homo sapiens
tctggcaggaccatgaagcgta

SEQ ID NO: 6936560 - DNA, 22 bp, Homo sapiens
tgttttgtgcacttctatagca

SEQ ID NO: 6936561 - DNA, 22 bp, Homo sapiens
cctgaggctccacctccagaga

SEQ ID NO: 6936562 - DNA, 17 bp, Homo sapiens
aatgctccaacctgaag

SEQ ID NO: 6936563 - DNA, 22 bp, Homo sapiens
aagcagacagagaatgggtttg

SEQ ID NO: 6936564 - DNA, 22 bp, Homo sapiens
tggcaagaatattggaccagaa

SEQ ID NO: 6936565 - DNA, 22 bp, Homo sapiens
gaccccaagggatgcgtgtgct

SEQ ID NO: 6936566 - DNA, 22 bp, Homo sapiens
acaggaagtgctggcacttaca

SEQ ID NO: 6936567 - DNA, 22 bp, Homo sapiens
agaatttaggcttgtctgctgt

SEQ ID NO: 6936568 - DNA, 22 bp, Homo sapiens
atgtggctttctgcgttttctc

SEQ ID NO: 6936569 - DNA, 22 bp, Homo sapiens
tgacaggtgctgggggcagtgt

SEQ ID NO: 6936570 - DNA, 22 bp, Homo sapiens
gggcagctggccaggtattctg

SEQ ID NO: 6936571 - DNA, 22 bp, Homo sapiens
gaaatgtagagtatctgaggat

SEQ ID NO: 6936572 - DNA, 22 bp, Homo sapiens
agccttggccgtaaggtatgct

SEQ ID NO: 6936573 - DNA, 22 bp, Homo sapiens
aggagtgccttttcatgagtgt

SEQ ID NO: 6936574 - DNA, 22 bp, Homo sapiens
aaggcttgttggacggcggggc

SEQ ID NO: 6936575 - DNA, 22 bp, Homo sapiens
cttgaagagtaaattggtacac

SEQ ID NO: 6936576 - DNA, 22 bp, Homo sapiens
tagcccaggctggagtgcaggg

SEQ ID NO: 6936577 - DNA, 22 bp, Homo sapiens
tagcccaggctgtagtgcagtg

SEQ ID NO: 6936578 - DNA, 22 bp, Homo sapiens
ctgtgtccccctcagccaggtg

SEQ ID NO: 6936579 - DNA, 22 bp, Homo sapiens
cattgtattgaggatacttaag

SEQ ID NO: 6936580 - DNA, 22 bp, Homo sapiens
agatatctgatgaaaatactct

SEQ ID NO: 6936581 - DNA, 22 bp, Homo sapiens
ttcgctcacctgtccccggctg

SEQ ID NO: 6936582 - DNA, 22 bp, Homo sapiens
agctgccacatgcccaagggca

SEQ ID NO: 6936583 - DNA, 22 bp, Homo sapiens
tctggagaggaggatgtggaca

SEQ ID NO: 6936584 - DNA, 22 bp, Homo sapiens
atcctcacattctcaggacaac

SEQ ID NO: 6936585 - DNA, 22 bp, Homo sapiens
tacatatactgagtgatttgct

SEQ ID NO: 6936586 - DNA, 22 bp, Homo sapiens
cctgtgtcaccggaacggagga

SEQ ID NO: 6936587 - DNA, 22 bp, Homo sapiens
ccagttatccagcatgctgtct

SEQ ID NO: 6936588 - DNA, 22 bp, Homo sapiens
tgtgtgtaaggaagctttatgg

SEQ ID NO: 6936589 - DNA, 22 bp, Homo sapiens
aatagtgcttacattatcatga

SEQ ID NO: 6936590 - DNA, 17 bp, Homo sapiens
aggaagcgagctggcct

SEQ ID NO: 6936591 - DNA, 19 bp, Homo sapiens
agcacctatctggataagg

SEQ ID NO: 6936592 - DNA, 23 bp, Homo sapiens
cctggagtactaaggggatggaa

SEQ ID NO: 6936593 - DNA, 22 bp, Homo sapiens
tgcaaactagcatcaactagta

SEQ ID NO: 6936594 - DNA, 22 bp, Homo sapiens
cttatgtacacacatatattgt

SEQ ID NO: 6936595 - DNA, 22 bp, Homo sapiens
ggaaggtcacgattggaaccca

SEQ ID NO: 6936596 - DNA, 22 bp, Homo sapiens
ggtctctttccttggcttgcac

SEQ ID NO: 6936597 - DNA, 20 bp, Homo sapiens
ttcttagtagagcatgtatt

SEQ ID NO: 6936598 - DNA, 22 bp, Homo sapiens
agttcactatagaagacagtgt

SEQ ID NO: 6936599 - DNA, 22 bp, Homo sapiens
gagagaaattagttggtttgct

SEQ ID NO: 6936600 - DNA, 22 bp, Homo sapiens
ttaatgacaggataggctctga

SEQ ID NO: 6936601 - DNA, 16 bp, Homo sapiens
agccctgccgtgtact

SEQ ID NO: 6936602 - DNA, 21 bp, Homo sapiens
acagccttacctggggtgtga

SEQ ID NO: 6936603 - DNA, 22 bp, Homo sapiens
gaaggtgtccatcaccaactgt

SEQ ID NO: 6936604 - DNA, 22 bp, Homo sapiens
atttccgagggtttgccaaggg

SEQ ID NO: 6936605 - DNA, 22 bp, Homo sapiens
accaggaaactctcgtctagtt

SEQ ID NO: 6936606 - DNA, 22 bp, Homo sapiens
accctgccgtgggctgcttgtg

SEQ ID NO: 6936607 - DNA, 22 bp, Homo sapiens
cagctgttgttatgtctgcagg

SEQ ID NO: 6936608 - DNA, 22 bp, Homo sapiens
tcccacaaacacccacttgagc

SEQ ID NO: 6936609 - DNA, 22 bp, Homo sapiens
cactgcacttcagcctgggtga

SEQ ID NO: 6936610 - DNA, 22 bp, Homo sapiens
actgcacctgtgtaccaagatg

SEQ ID NO: 6936611 - DNA, 22 bp, Homo sapiens
agaacagccaactgtgtaggag

SEQ ID NO: 6936612 - DNA, 23 bp, Homo sapiens
tgctggagtttactcaggccagc

SEQ ID NO: 6936613 - DNA, 20 bp, Homo sapiens
cagatgggacgtggaggagt

SEQ ID NO: 6936614 - DNA, 22 bp, Homo sapiens
tgcataaaacaccagcagggtg

SEQ ID NO: 6936615 - DNA, 20 bp, Homo sapiens
atagaatcacaagtcctgaa

SEQ ID NO: 6936616 - DNA, 22 bp, Homo sapiens
taaacactgccttggtgggtca

SEQ ID NO: 6936617 - DNA, 22 bp, Homo sapiens
acatagcataaagaatgactct

SEQ ID NO: 6936618 - DNA, 22 bp, Homo sapiens
atgtatacgtgcaagtcacagg

SEQ ID NO: 6936619 - DNA, 22 bp, Homo sapiens
ccagagagattgcttctaaaga

SEQ ID NO: 6936620 - DNA, 23 bp, Homo sapiens
tcagtcccaacagcttctcctgg

SEQ ID NO: 6936621 - DNA, 22 bp, Homo sapiens
tctggacatgcttgaataatat

SEQ ID NO: 6936622 - DNA, 22 bp, Homo sapiens
caagtaaacaatatgtgattca

SEQ ID NO: 6936623 - DNA, 22 bp, Homo sapiens
taagttcaaatcatcccaactt

SEQ ID NO: 6936624 - DNA, 17 bp, Homo sapiens
ttaaaccataaagaagg

SEQ ID NO: 6936625 - DNA, 22 bp, Homo sapiens
tgatggcctttttcaccaggct

SEQ ID NO: 6936626 - DNA, 22 bp, Homo sapiens
agtccttcaagaaatctggaaa

SEQ ID NO: 6936627 - DNA, 22 bp, Homo sapiens
ctgagctatggaggcaagacat

SEQ ID NO: 6936628 - DNA, 22 bp, Homo sapiens
gtccaggagtttccaattaagc

SEQ ID NO: 6936629 - DNA, 22 bp, Homo sapiens
tgcaaacaggagagtaagtata

SEQ ID NO: 6936630 - DNA, 23 bp, Homo sapiens
ccagaaggagccacactccttgc

SEQ ID NO: 6936631 - DNA, 22 bp, Homo sapiens
cagccatcagtaaagacagctt

SEQ ID NO: 6936632 - DNA, 22 bp, Homo sapiens
tcgctcacttacctcgcgccgg

SEQ ID NO: 6936633 - DNA, 22 bp, Homo sapiens
aagtcaggacttatgctacctg

SEQ ID NO: 6936634 - DNA, 22 bp, Homo sapiens
tgacttgtcaaagaaatgtgtg

SEQ ID NO: 6936635 - DNA, 22 bp, Homo sapiens
tgcctttaggggcctctccctc

SEQ ID NO: 6936636 - DNA, 22 bp, Homo sapiens
ctcagagctcagctttgttagt

SEQ ID NO: 6936637 - DNA, 22 bp, Homo sapiens
ctgaacttattgagtgcttgct

SEQ ID NO: 6936638 - DNA, 22 bp, Homo sapiens
gttttctctgtgtttggatgat

SEQ ID NO: 6936639 - DNA, 22 bp, Homo sapiens
acttagtatttttcagctttga

SEQ ID NO: 6936640 - DNA, 18 bp, Homo sapiens
tctgttgagcagagaggc

SEQ ID NO: 6936641 - DNA, 20 bp, Homo sapiens
attgtacttcagtgtgaagc

SEQ ID NO: 6936642 - DNA, 22 bp, Homo sapiens
tccctgtgtgtatataaacggt

SEQ ID NO: 6936643 - DNA, 22 bp, Homo sapiens
agatatgttaggcttgttccct

SEQ ID NO: 6936644 - DNA, 22 bp, Homo sapiens
actagagtttcacagcaaagtt

SEQ ID NO: 6936645 - DNA, 22 bp, Homo sapiens
ccagcagggaaaaacccaccaa

SEQ ID NO: 6936646 - DNA, 22 bp, Homo sapiens
agaggacaaaatgagaagtgct

SEQ ID NO: 6936647 - DNA, 16 bp, Homo sapiens
ttgcccacttgttcat

SEQ ID NO: 6936648 - DNA, 22 bp, Homo sapiens
atttcctggtaccaggctttct

SEQ ID NO: 6936649 - DNA, 22 bp, Homo sapiens
cacatgtgtgctgaggactgtg

SEQ ID NO: 6936650 - DNA, 22 bp, Homo sapiens
cagcctgccgtcagccaggtag

SEQ ID NO: 6936651 - DNA, 20 bp, Homo sapiens
ggctgctgtgggcagagagg

SEQ ID NO: 6936652 - DNA, 22 bp, Homo sapiens
tatttagctggagtcagtgctt

SEQ ID NO: 6936653 - DNA, 22 bp, Homo sapiens
gaagtggaattactgggtcata

SEQ ID NO: 6936654 - DNA, 22 bp, Homo sapiens
acttttggttctgtaactgtga

SEQ ID NO: 6936655 - DNA, 22 bp, Homo sapiens
ggactgaatggaagatatatgg

SEQ ID NO: 6936656 - DNA, 22 bp, Homo sapiens
tcagggacagttcttagggtgg

SEQ ID NO: 6936657 - DNA, 22 bp, Homo sapiens
cagctttagagaaaacatattt

SEQ ID NO: 6936658 - DNA, 22 bp, Homo sapiens
tttatcaaacaaattatccagc

SEQ ID NO: 6936659 - DNA, 22 bp, Homo sapiens
agaaagggatgaggtagctgct

SEQ ID NO: 6936660 - DNA, 22 bp, Homo sapiens
tccaggaggttgagactgcagt

SEQ ID NO: 6936661 - DNA, 22 bp, Homo sapiens
taccttggaggccaagcagttt

SEQ ID NO: 6936662 - DNA, 16 bp, Homo sapiens
gacacatgggggaaaa

SEQ ID NO: 6936663 - DNA, 22 bp, Homo sapiens
agctgcaattctggacatagtc

SEQ ID NO: 6936664 - DNA, 22 bp, Homo sapiens
tgggcatgagtggacagagaag

SEQ ID NO: 6936665 - DNA, 22 bp, Homo sapiens
tcttctatgaatcattggaaca

SEQ ID NO: 6936666 - DNA, 22 bp, Homo sapiens
tgttaatatactaaaatccact

SEQ ID NO: 6936667 - DNA, 22 bp, Homo sapiens
ctctgcaggggaggcatgcact

SEQ ID NO: 6936668 - DNA, 22 bp, Homo sapiens
ggagggggaattcagccccagc

SEQ ID NO: 6936669 - DNA, 17 bp, Homo sapiens
ccagagatgcctcaggc

SEQ ID NO: 6936670 - DNA, 22 bp, Homo sapiens
tgagccagtctctcagaaccct

SEQ ID NO: 6936671 - DNA, 22 bp, Homo sapiens
tccaggctacttggattcctgg

SEQ ID NO: 6936672 - DNA, 22 bp, Homo sapiens
catttctgtgacacttccatct

SEQ ID NO: 6936673 - DNA, 22 bp, Homo sapiens
ctgtggcagggaagaggccatg

SEQ ID NO: 6936674 - DNA, 22 bp, Homo sapiens
ctggctcagttcttggttttca

SEQ ID NO: 6936675 - DNA, 22 bp, Homo sapiens
tccatgtgcttcctcaggggaa

SEQ ID NO: 6936676 - DNA, 22 bp, Homo sapiens
ctgagcccctctgacctcagag

SEQ ID NO: 6936677 - DNA, 22 bp, Homo sapiens
tcacacatactcatgtgtgagt

SEQ ID NO: 6936678 - DNA, 22 bp, Homo sapiens
ctgctgccctagacccagtcct

SEQ ID NO: 6936679 - DNA, 22 bp, Homo sapiens
ctccagagagtccagctctggg

SEQ ID NO: 6936680 - DNA, 22 bp, Homo sapiens
tccaggaggcacctttggacca

SEQ ID NO: 6936681 - DNA, 22 bp, Homo sapiens
gagggctgctggaaaaatgcag

SEQ ID NO: 6936682 - DNA, 22 bp, Homo sapiens
ccaaaccatccatctccaggct

SEQ ID NO: 6936683 - DNA, 22 bp, Homo sapiens
gactctatcgtatctcaagtgg

SEQ ID NO: 6936684 - DNA, 22 bp, Homo sapiens
ccaggtacttggtatgcattca

SEQ ID NO: 6936685 - DNA, 22 bp, Homo sapiens
aagaacagattcagcctgaact

SEQ ID NO: 6936686 - DNA, 22 bp, Homo sapiens
tcaagcagagtcaaaagtacca

SEQ ID NO: 6936687 - DNA, 22 bp, Homo sapiens
ttactgtaaaggtcacatggtg

SEQ ID NO: 6936688 - DNA, 22 bp, Homo sapiens
aggaatgtcaagtagatgtgcg

SEQ ID NO: 6936689 - DNA, 23 bp, Homo sapiens
ctctcctgaaggacaagctgccg

SEQ ID NO: 6936690 - DNA, 22 bp, Homo sapiens
aagacacacacatatgctgagt

SEQ ID NO: 6936691 - DNA, 22 bp, Homo sapiens
ttgcattacatttgctcagtct

SEQ ID NO: 6936692 - DNA, 22 bp, Homo sapiens
acattaacactggtgctggtgt

SEQ ID NO: 6936693 - DNA, 21 bp, Homo sapiens
tcctgctgctcctgtcgtgtt

SEQ ID NO: 6936694 - DNA, 22 bp, Homo sapiens
gcaggagtgtggtgggacatcc

SEQ ID NO: 6936695 - DNA, 22 bp, Homo sapiens
catctgctgacttgacaagtac

SEQ ID NO: 6936696 - DNA, 22 bp, Homo sapiens
ccagccagccttgatctgagta

SEQ ID NO: 6936697 - DNA, 22 bp, Homo sapiens
ttctagttctgaaagcctgaca

SEQ ID NO: 6936698 - DNA, 22 bp, Homo sapiens
tgtagacatgcttttctgatga

SEQ ID NO: 6936699 - DNA, 22 bp, Homo sapiens
tcagcagttgccccctcccagc

SEQ ID NO: 6936700 - DNA, 22 bp, Homo sapiens
gaagcatactttctatactgct

SEQ ID NO: 6936701 - DNA, 22 bp, Homo sapiens
tgatttacccgtccaggcccta

SEQ ID NO: 6936702 - DNA, 22 bp, Homo sapiens
caggggtggctgcagcagaggt

SEQ ID NO: 6936703 - DNA, 22 bp, Homo sapiens
aaagagcaccctcaatgtctga

SEQ ID NO: 6936704 - DNA, 22 bp, Homo sapiens
cttgggtaccttccatgtgtca

SEQ ID NO: 6936705 - DNA, 22 bp, Homo sapiens
tggcagtcggacttctatctca

SEQ ID NO: 6936706 - DNA, 22 bp, Homo sapiens
tactggtccaacaaggttggca

SEQ ID NO: 6936707 - DNA, 22 bp, Homo sapiens
gcacaaggagaattcattagtg

SEQ ID NO: 6936708 - DNA, 17 bp, Homo sapiens
tatctcatacaattata

SEQ ID NO: 6936709 - DNA, 22 bp, Homo sapiens
taaggcatgagtttatttcata

SEQ ID NO: 6936710 - DNA, 22 bp, Homo sapiens
ataaactatgtaatttgctcta

SEQ ID NO: 6936711 - DNA, 22 bp, Homo sapiens
aggcttcacgatgggtgaggtg

SEQ ID NO: 6936712 - DNA, 20 bp, Homo sapiens
tggagtgctgtgttgagaag

SEQ ID NO: 6936713 - DNA, 22 bp, Homo sapiens
cagcacatagcatgcttgtcag

SEQ ID NO: 6936714 - DNA, 22 bp, Homo sapiens
tccagtcatttccattgttccc

SEQ ID NO: 6936715 - DNA, 22 bp, Homo sapiens
tacattgtatcaaccctcaact

SEQ ID NO: 6936716 - DNA, 16 bp, Homo sapiens
gcaggagtaccacttg

SEQ ID NO: 6936717 - DNA, 22 bp, Homo sapiens
atatactgaggagactttatat

SEQ ID NO: 6936718 - DNA, 22 bp, Homo sapiens
gacaaatgaagtcactgacctt

SEQ ID NO: 6936719 - DNA, 22 bp, Homo sapiens
tatttcattctttatcaggagc

SEQ ID NO: 6936720 - DNA, 22 bp, Homo sapiens
actggctgtgcagagggcagta

SEQ ID NO: 6936721 - DNA, 22 bp, Homo sapiens
tcctttagctttcttggacaaa

SEQ ID NO: 6936722 - DNA, 23 bp, Homo sapiens
gtcaccataatccgttagaccag

SEQ ID NO: 6936723 - DNA, 22 bp, Homo sapiens
tcaggaacacaggggcccatgc

SEQ ID NO: 6936724 - DNA, 22 bp, Homo sapiens
tactttgaagacaatatctgga

SEQ ID NO: 6936725 - DNA, 21 bp, Homo sapiens
aggtggtctgcagcagctgaa

SEQ ID NO: 6936726 - DNA, 22 bp, Homo sapiens
gaacatcagtcataatttaacg

SEQ ID NO: 6936727 - DNA, 22 bp, Homo sapiens
agacagcagggagcaggattca

SEQ ID NO: 6936728 - DNA, 22 bp, Homo sapiens
ctttgcttactggtgtctgcat

SEQ ID NO: 6936729 - DNA, 22 bp, Homo sapiens
aaaggtcagacttaggctgggc

SEQ ID NO: 6936730 - DNA, 22 bp, Homo sapiens
actaaagtcatcaaagaacttt

SEQ ID NO: 6936731 - DNA, 22 bp, Homo sapiens
tcaggtactgcagggcacgcag

SEQ ID NO: 6936732 - DNA, 22 bp, Homo sapiens
tgagtattccttatctgaaatg

SEQ ID NO: 6936733 - DNA, 19 bp, Homo sapiens
tgaagcaataccatttttg

SEQ ID NO: 6936734 - DNA, 22 bp, Homo sapiens
taacctttggtgaaatattaac

SEQ ID NO: 6936735 - DNA, 22 bp, Homo sapiens
cattatctcagttgaacttatg

SEQ ID NO: 6936736 - DNA, 22 bp, Homo sapiens
aaaggagaaaacatacaggact

SEQ ID NO: 6936737 - DNA, 22 bp, Homo sapiens
gggcagcagccactcatttagc

SEQ ID NO: 6936738 - DNA, 22 bp, Homo sapiens
acatgctaattgcaaagtcttg

SEQ ID NO: 6936739 - DNA, 22 bp, Homo sapiens
agatggctgatggcaggagcca

SEQ ID NO: 6936740 - DNA, 22 bp, Homo sapiens
agagagttgtaccacactcata

SEQ ID NO: 6936741 - DNA, 22 bp, Homo sapiens
aaagttacccaatctctatgaa

SEQ ID NO: 6936742 - DNA, 22 bp, Homo sapiens
caagtcaaagactagaactagt

SEQ ID NO: 6936743 - DNA, 22 bp, Homo sapiens
aagattctcagagtgaaagaat

SEQ ID NO: 6936744 - DNA, 22 bp, Homo sapiens
acatgccatctttgtcaggagt

SEQ ID NO: 6936745 - DNA, 22 bp, Homo sapiens
tgccatttttgagtggggcctc

SEQ ID NO: 6936746 - DNA, 22 bp, Homo sapiens
aagttttaacaagtacttacta

SEQ ID NO: 6936747 - DNA, 22 bp, Homo sapiens
tcctggcctctgagtcaagaac

SEQ ID NO: 6936748 - DNA, 22 bp, Homo sapiens
gagcatctctatagtgactgtg

SEQ ID NO: 6936749 - DNA, 22 bp, Homo sapiens
ggttcctgatagattccttttg

SEQ ID NO: 6936750 - DNA, 22 bp, Homo sapiens
ggaagagcctggggtgtcaggc

SEQ ID NO: 6936751 - DNA, 22 bp, Homo sapiens
caaggattctcactagactaga

SEQ ID NO: 6936752 - DNA, 22 bp, Homo sapiens
aaggtggtgagtacagttaggt

SEQ ID NO: 6936753 - DNA, 19 bp, Homo sapiens
ggcctgtgcagagcccgtc

SEQ ID NO: 6936754 - DNA, 22 bp, Homo sapiens
atctgtagaagatactctgaga

SEQ ID NO: 6936755 - DNA, 22 bp, Homo sapiens
aggtccttaacatagtgatatc

SEQ ID NO: 6936756 - DNA, 20 bp, Homo sapiens
agagtagaggtagatttatg

SEQ ID NO: 6936757 - DNA, 22 bp, Homo sapiens
ctggcgtgaaggtggccatgag

SEQ ID NO: 6936758 - DNA, 22 bp, Homo sapiens
aatctaagggaaattggagatg

SEQ ID NO: 6936759 - DNA, 22 bp, Homo sapiens
ttatttcaaaagagcttggggt

SEQ ID NO: 6936760 - DNA, 22 bp, Homo sapiens
agtgttgtaataaatatcatct

SEQ ID NO: 6936761 - DNA, 22 bp, Homo sapiens
tggaatcattgctgtgttgctt

SEQ ID NO: 6936762 - DNA, 22 bp, Homo sapiens
atagttattagagaagctggta

SEQ ID NO: 6936763 - DNA, 22 bp, Homo sapiens
aaaggctggggactgaggaagg

SEQ ID NO: 6936764 - DNA, 22 bp, Homo sapiens
tgccacactcccctgctgcagt

SEQ ID NO: 6936765 - DNA, 22 bp, Homo sapiens
gcacagcacagcaacatgtttt

SEQ ID NO: 6936766 - DNA, 22 bp, Homo sapiens
tggtggacatcccagggtgaaa

SEQ ID NO: 6936767 - DNA, 23 bp, Homo sapiens
tccagggattaatgaagtcagtc

SEQ ID NO: 6936768 - DNA, 22 bp, Homo sapiens
tatttcactccgagactctatg

SEQ ID NO: 6936769 - DNA, 20 bp, Homo sapiens
gtttccaaattgtgcatttt

SEQ ID NO: 6936770 - DNA, 21 bp, Homo sapiens
tagctgtgcaactttgggcaa

SEQ ID NO: 6936771 - DNA, 22 bp, Homo sapiens
tgaggcccatctgagattttga

SEQ ID NO: 6936772 - DNA, 22 bp, Homo sapiens
acattctaaagcatgctcagga

SEQ ID NO: 6936773 - DNA, 22 bp, Homo sapiens
gctggagccaagctgctcttgg

SEQ ID NO: 6936774 - DNA, 22 bp, Homo sapiens
ctggctggaagttagagaactt

SEQ ID NO: 6936775 - DNA, 22 bp, Homo sapiens
cagcaccagcatattccagggc

SEQ ID NO: 6936776 - DNA, 22 bp, Homo sapiens
ggctttcaacacaggctttcct

SEQ ID NO: 6936777 - DNA, 22 bp, Homo sapiens
gatgaatgggtacacaggatga

SEQ ID NO: 6936778 - DNA, 22 bp, Homo sapiens
gtggcagaaactggcagaggag

SEQ ID NO: 6936779 - DNA, 22 bp, Homo sapiens
tctgggctggctttatgctgac

SEQ ID NO: 6936780 - DNA, 22 bp, Homo sapiens
aggcctcagcctgccaggcctg

SEQ ID NO: 6936781 - DNA, 22 bp, Homo sapiens
caagttatcagaaggcactttt

SEQ ID NO: 6936782 - DNA, 22 bp, Homo sapiens
aagtgggtcataaaaaattgca

SEQ ID NO: 6936783 - DNA, 22 bp, Homo sapiens
catgtgtgaatcttgtgatcat

SEQ ID NO: 6936784 - DNA, 22 bp, Homo sapiens
aggctctgacccatgggaccca

SEQ ID NO: 6936785 - DNA, 22 bp, Homo sapiens
tcatttatcgctgccttttaaa

SEQ ID NO: 6936786 - DNA, 22 bp, Homo sapiens
tttaacacctgtagcaggataa

SEQ ID NO: 6936787 - DNA, 22 bp, Homo sapiens
ccagagagtaggaggcattatt

SEQ ID NO: 6936788 - DNA, 20 bp, Homo sapiens
ctgtgcctaaacctccgggt

SEQ ID NO: 6936789 - DNA, 22 bp, Homo sapiens
aactgcattcagaaagctcact

SEQ ID NO: 6936790 - DNA, 22 bp, Homo sapiens
tctgacctgcaggcacagcaat

SEQ ID NO: 6936791 - DNA, 22 bp, Homo sapiens
agaggcaccgtctgcagcgtgc

SEQ ID NO: 6936792 - DNA, 22 bp, Homo sapiens
gggaactgtgtggtgctctgat

SEQ ID NO: 6936793 - DNA, 18 bp, Homo sapiens
ctttatgtgcagagcttt

SEQ ID NO: 6936794 - DNA, 22 bp, Homo sapiens
tgcaatgtgttagatggtttta

SEQ ID NO: 6936795 - DNA, 22 bp, Homo sapiens
aggccacggcgggtggattact

SEQ ID NO: 6936796 - DNA, 22 bp, Homo sapiens
gtcaataattttatggagagaa

SEQ ID NO: 6936797 - DNA, 22 bp, Homo sapiens
tgaaccctgacctctggaagga

SEQ ID NO: 6936798 - DNA, 22 bp, Homo sapiens
agtgtatgtcctgaggggagaa

SEQ ID NO: 6936799 - DNA, 22 bp, Homo sapiens
tttgtttatcaaggtctagcat

SEQ ID NO: 6936800 - DNA, 22 bp, Homo sapiens
tctcttggtgacttaaaatgtt

SEQ ID NO: 6936801 - DNA, 22 bp, Homo sapiens
tctaaagtactactactgttgg

SEQ ID NO: 6936802 - DNA, 22 bp, Homo sapiens
attcatttaggtattcacttac

SEQ ID NO: 6936803 - DNA, 22 bp, Homo sapiens
ttttcaattttgaggcagtggt

SEQ ID NO: 6936804 - DNA, 22 bp, Homo sapiens
taagagctaggattttaaatca

SEQ ID NO: 6936805 - DNA, 22 bp, Homo sapiens
ttgacaagtggagatatttaag

SEQ ID NO: 6936806 - DNA, 22 bp, Homo sapiens
gcttttttaggtaagacccagg

SEQ ID NO: 6936807 - DNA, 22 bp, Homo sapiens
ctggcctctgtgttcaccatag

SEQ ID NO: 6936808 - DNA, 22 bp, Homo sapiens
tttgtaactttagaattgatcc

SEQ ID NO: 6936809 - DNA, 23 bp, Homo sapiens
tcatgcccaggctccagatgtca

SEQ ID NO: 6936810 - DNA, 22 bp, Homo sapiens
cccctcaggtacccgtgcagca

SEQ ID NO: 6936811 - DNA, 22 bp, Homo sapiens
ttattgagtatctgcttggtgt

SEQ ID NO: 6936812 - DNA, 22 bp, Homo sapiens
tgaggcctcataatgagatttc

SEQ ID NO: 6936813 - DNA, 21 bp, Homo sapiens
gaatagttctgtggcagcagt

SEQ ID NO: 6936814 - DNA, 22 bp, Homo sapiens
tgagatcttcgctcttcacaga

SEQ ID NO: 6936815 - DNA, 22 bp, Homo sapiens
ggctcagagttaggacccatgt

SEQ ID NO: 6936816 - DNA, 21 bp, Homo sapiens
ttacttttgcaccaacctaat

SEQ ID NO: 6936817 - DNA, 22 bp, Homo sapiens
ggaaggggttaggggtccctga

SEQ ID NO: 6936818 - DNA, 22 bp, Homo sapiens
atggtcttgtgagagtaacagt

SEQ ID NO: 6936819 - DNA, 22 bp, Homo sapiens
tcagagattcacgtcagtccca

SEQ ID NO: 6936820 - DNA, 22 bp, Homo sapiens
ccagtaaaaagcgacaggaagt

SEQ ID NO: 6936821 - DNA, 22 bp, Homo sapiens
caggtggccagtactcaaggat

SEQ ID NO: 6936822 - DNA, 21 bp, Homo sapiens
tcctctgcagtgaggtggcct

SEQ ID NO: 6936823 - DNA, 22 bp, Homo sapiens
tattgtctgtccgggtcaaagc

SEQ ID NO: 6936824 - DNA, 22 bp, Homo sapiens
gctgccgacccacaggggttaa

SEQ ID NO: 6936825 - DNA, 22 bp, Homo sapiens
gcagtgataactttactctttt

SEQ ID NO: 6936826 - DNA, 22 bp, Homo sapiens
aatgcacaaaaattgtatgtaa

SEQ ID NO: 6936827 - DNA, 17 bp, Homo sapiens
acatgactgcacaaagt

SEQ ID NO: 6936828 - DNA, 22 bp, Homo sapiens
ctctcatagtgagtgtggtcca

SEQ ID NO: 6936829 - DNA, 22 bp, Homo sapiens
ggcagtgatgtcaaacagtgaa

SEQ ID NO: 6936830 - DNA, 21 bp, Homo sapiens
agcagaggggacatgtttgat

SEQ ID NO: 6936831 - DNA, 22 bp, Homo sapiens
gtgggtccctaaacacatccca

SEQ ID NO: 6936832 - DNA, 22 bp, Homo sapiens
gtatactataataggaacaaat

SEQ ID NO: 6936833 - DNA, 21 bp, Homo sapiens
aagcatcctctcaggagctgt

SEQ ID NO: 6936834 - DNA, 21 bp, Homo sapiens
cactgtatagcaggagaaaac

SEQ ID NO: 6936835 - DNA, 22 bp, Homo sapiens
cagcaaagcaggctcctagaac

SEQ ID NO: 6936836 - DNA, 20 bp, Homo sapiens
tccagctgacattctctttc

SEQ ID NO: 6936837 - DNA, 22 bp, Homo sapiens
tggagaagtcaaagtgaacagg

SEQ ID NO: 6936838 - DNA, 22 bp, Homo sapiens
cataagaatcttccagggcatg

SEQ ID NO: 6936839 - DNA, 22 bp, Homo sapiens
ctacattctgggaaatcagatg

SEQ ID NO: 6936840 - DNA, 22 bp, Homo sapiens
acctgggtctggtgttgggacg

SEQ ID NO: 6936841 - DNA, 22 bp, Homo sapiens
tacaagtttcaaagagatcatg

SEQ ID NO: 6936842 - DNA, 22 bp, Homo sapiens
cagcacacagtgactcgcacct

SEQ ID NO: 6936843 - DNA, 22 bp, Homo sapiens
cttatttaatgagggttagaat

SEQ ID NO: 6936844 - DNA, 22 bp, Homo sapiens
taattggtgagagagctgagtc

SEQ ID NO: 6936845 - DNA, 22 bp, Homo sapiens
ctttgtatggtggcacttccgt

SEQ ID NO: 6936846 - DNA, 22 bp, Homo sapiens
tgtccatggagaagctcagggc

SEQ ID NO: 6936847 - DNA, 22 bp, Homo sapiens
taaagacaatttcgagctgtag

SEQ ID NO: 6936848 - DNA, 22 bp, Homo sapiens
gactccccacgttaaggaatgt

SEQ ID NO: 6936849 - DNA, 22 bp, Homo sapiens
ttatgagactgttttacacact

SEQ ID NO: 6936850 - DNA, 22 bp, Homo sapiens
gcagaaagcttagagggtttgc

SEQ ID NO: 6936851 - DNA, 22 bp, Homo sapiens
ggctcacacatgactgggctct

SEQ ID NO: 6936852 - DNA, 22 bp, Homo sapiens
gctgtactagggctggagcttc

SEQ ID NO: 6936853 - DNA, 19 bp, Homo sapiens
agcaacctgggccaatgta

SEQ ID NO: 6936854 - DNA, 22 bp, Homo sapiens
gcctgctttgtgcctgatcttt

SEQ ID NO: 6936855 - DNA, 22 bp, Homo sapiens
aagaactgtgctccaggctcca

SEQ ID NO: 6936856 - DNA, 22 bp, Homo sapiens
acccaggcgggagtgcagtgtc

SEQ ID NO: 6936857 - DNA, 18 bp, Homo sapiens
cctccctcattttcccag

SEQ ID NO: 6936858 - DNA, 22 bp, Homo sapiens
ttgaagttctgcatttctaata

SEQ ID NO: 6936859 - DNA, 22 bp, Homo sapiens
tacatgtacatgcataggtaga

SEQ ID NO: 6936860 - DNA, 22 bp, Homo sapiens
actctgagcatcccaagtctta

SEQ ID NO: 6936861 - DNA, 20 bp, Homo sapiens
agcaaagcctttagagtttg

SEQ ID NO: 6936862 - DNA, 22 bp, Homo sapiens
agtaaacatcaccctggggtga

SEQ ID NO: 6936863 - DNA, 22 bp, Homo sapiens
ctggtcaggggatggggctcag

SEQ ID NO: 6936864 - DNA, 18 bp, Homo sapiens
ctcttaagcctttgtcaa

SEQ ID NO: 6936865 - DNA, 22 bp, Homo sapiens
ctgggacctcctcactgttcta

SEQ ID NO: 6936866 - DNA, 22 bp, Homo sapiens
ctgtggctttctctgcctcctt

SEQ ID NO: 6936867 - DNA, 22 bp, Homo sapiens
aaaactgcccagtcagtaagca

SEQ ID NO: 6936868 - DNA, 22 bp, Homo sapiens
aaacttattttatcacagttca

SEQ ID NO: 6936869 - DNA, 22 bp, Homo sapiens
ttgctttgcagtgcctatagga

SEQ ID NO: 6936870 - DNA, 22 bp, Homo sapiens
tgctgggcctcttccctggata

SEQ ID NO: 6936871 - DNA, 22 bp, Homo sapiens
tggcactgtggatttcacaagt

SEQ ID NO: 6936872 - DNA, 22 bp, Homo sapiens
gacccaggagtgcagagagtgg

SEQ ID NO: 6936873 - DNA, 22 bp, Homo sapiens
tcacatctgtgtgattgtcatt

SEQ ID NO: 6936874 - DNA, 20 bp, Homo sapiens
agtctggcatgatgcaggca

SEQ ID NO: 6936875 - DNA, 22 bp, Homo sapiens
aggaccattgtgtagcagacat

SEQ ID NO: 6936876 - DNA, 22 bp, Homo sapiens
tccagaggtgaacacccaggca

SEQ ID NO: 6936877 - DNA, 22 bp, Homo sapiens
gcaccggagagcaatctgaaga

SEQ ID NO: 6936878 - DNA, 22 bp, Homo sapiens
cagtatctgtcagtaatcaggt

SEQ ID NO: 6936879 - DNA, 22 bp, Homo sapiens
ctagagggatgttaggatagca

SEQ ID NO: 6936880 - DNA, 22 bp, Homo sapiens
tattagtaatacctgtctcata

SEQ ID NO: 6936881 - DNA, 22 bp, Homo sapiens
tggagcccaggtgcaagagagt

SEQ ID NO: 6936882 - DNA, 22 bp, Homo sapiens
agcgagcacattgagtgaagaa

SEQ ID NO: 6936883 - DNA, 22 bp, Homo sapiens
tatgggtaaataataattttag

SEQ ID NO: 6936884 - DNA, 22 bp, Homo sapiens
ttgcctggactctgctggtatt

SEQ ID NO: 6936885 - DNA, 22 bp, Homo sapiens
aggcatggatggatccagggct

SEQ ID NO: 6936886 - DNA, 23 bp, Homo sapiens
tctgcttctgtattttttcccat

SEQ ID NO: 6936887 - DNA, 22 bp, Homo sapiens
tctgaatatgtttatcatctct

SEQ ID NO: 6936888 - DNA, 22 bp, Homo sapiens
aggcttcctggaggaagaggta

SEQ ID NO: 6936889 - DNA, 22 bp, Homo sapiens
aatgtctgaaaatcagactgca

SEQ ID NO: 6936890 - DNA, 22 bp, Homo sapiens
gttacacacaatatatcctaaa

SEQ ID NO: 6936891 - DNA, 22 bp, Homo sapiens
gagtaaaagatgaggcagtaga

SEQ ID NO: 6936892 - DNA, 22 bp, Homo sapiens
tttcagatcactttcaggaaag

SEQ ID NO: 6936893 - DNA, 22 bp, Homo sapiens
atgaggcagtctggcctgaggg

SEQ ID NO: 6936894 - DNA, 21 bp, Homo sapiens
attcaaagaagaggaaggccc

SEQ ID NO: 6936895 - DNA, 22 bp, Homo sapiens
taatagtcattgtataccttgg

SEQ ID NO: 6936896 - DNA, 22 bp, Homo sapiens
ttggcagtgctttaatttccag

SEQ ID NO: 6936897 - DNA, 22 bp, Homo sapiens
ggagaagcagcttcttgatgaa

SEQ ID NO: 6936898 - DNA, 22 bp, Homo sapiens
caaagtgcagaaggaactgggt

SEQ ID NO: 6936899 - DNA, 20 bp, Homo sapiens
gaccagatcccttaccagct

SEQ ID NO: 6936900 - DNA, 20 bp, Homo sapiens
tgacagtttcatatggttca

SEQ ID NO: 6936901 - DNA, 22 bp, Homo sapiens
ttattgaagcaagcttttctga

SEQ ID NO: 6936902 - DNA, 22 bp, Homo sapiens
cctgggctcacagccaaggctc

SEQ ID NO: 6936903 - DNA, 18 bp, Homo sapiens
gagtcgtcggagagtctg

SEQ ID NO: 6936904 - DNA, 22 bp, Homo sapiens
tccaaggactaaattctagatt

SEQ ID NO: 6936905 - DNA, 22 bp, Homo sapiens
cccttacatcagctccttcacc

SEQ ID NO: 6936906 - DNA, 22 bp, Homo sapiens
agttcttcccttttctatggag

SEQ ID NO: 6936907 - DNA, 22 bp, Homo sapiens
acagaatttttacacagggtaa

SEQ ID NO: 6936908 - DNA, 22 bp, Homo sapiens
acagccttgagctcaaaaggaa

SEQ ID NO: 6936909 - DNA, 22 bp, Homo sapiens
aagtagcattttcaaaatgtat

SEQ ID NO: 6936910 - DNA, 22 bp, Homo sapiens
acacatgaaataatattatgca

SEQ ID NO: 6936911 - DNA, 22 bp, Homo sapiens
aaatgtgacagatgcagtacag

SEQ ID NO: 6936912 - DNA, 22 bp, Homo sapiens
cctctggttgcccaggactagg

SEQ ID NO: 6936913 - DNA, 22 bp, Homo sapiens
aagtcaggtgagactctctggg

SEQ ID NO: 6936914 - DNA, 22 bp, Homo sapiens
tttcacattttatacttaagcc

SEQ ID NO: 6936915 - DNA, 22 bp, Homo sapiens
attacacttgttcatcatcacc

SEQ ID NO: 6936916 - DNA, 22 bp, Homo sapiens
aagatgattatgtagattggga

SEQ ID NO: 6936917 - DNA, 22 bp, Homo sapiens
caggagtgaaatgaggcccagg

SEQ ID NO: 6936918 - DNA, 23 bp, Homo sapiens
cccatttagcggatgagggaagt

SEQ ID NO: 6936919 - DNA, 22 bp, Homo sapiens
tttgtcatcccttttgaaactg

SEQ ID NO: 6936920 - DNA, 22 bp, Homo sapiens
gagtgcgtgtttggggatgtgg

SEQ ID NO: 6936921 - DNA, 18 bp, Homo sapiens
tcatgcaaacgcttcata

SEQ ID NO: 6936922 - DNA, 22 bp, Homo sapiens
cactgcccactccttcgtccaa

SEQ ID NO: 6936923 - DNA, 20 bp, Homo sapiens
ttgcacagaggtttcaagtg

SEQ ID NO: 6936924 - DNA, 22 bp, Homo sapiens
tctcctgacatgtctggaggaa

SEQ ID NO: 6936925 - DNA, 22 bp, Homo sapiens
agcaggaacgagttcatgggga

SEQ ID NO: 6936926 - DNA, 22 bp, Homo sapiens
tgggctcatgtttatacatatc

SEQ ID NO: 6936927 - DNA, 22 bp, Homo sapiens
ttctggaaatgcacaactaatt

SEQ ID NO: 6936928 - DNA, 22 bp, Homo sapiens
gaaagtttcttcattaagatgt

SEQ ID NO: 6936929 - DNA, 20 bp, Homo sapiens
tggcccagcacgacgaggac

SEQ ID NO: 6936930 - DNA, 22 bp, Homo sapiens
tcctgcccacagctgctggaca

SEQ ID NO: 6936931 - DNA, 22 bp, Homo sapiens
cttttttcctaaggcaacatga

SEQ ID NO: 6936932 - DNA, 22 bp, Homo sapiens
tgcaggcctcagacttagccat

SEQ ID NO: 6936933 - DNA, 22 bp, Homo sapiens
aagccttttccacctaatagag

SEQ ID NO: 6936934 - DNA, 22 bp, Homo sapiens
agtgagatatgtctcactgtcc

SEQ ID NO: 6936935 - DNA, 23 bp, Homo sapiens
agtgggctcagtcctccaacccc

SEQ ID NO: 6936936 - DNA, 22 bp, Homo sapiens
tgttttatataagcagagcggt

SEQ ID NO: 6936937 - DNA, 22 bp, Homo sapiens
gaaagacttcctttgagagtac

SEQ ID NO: 6936938 - DNA, 22 bp, Homo sapiens
agggctgcatctgcctggtgaa

SEQ ID NO: 6936939 - DNA, 22 bp, Homo sapiens
caggcttaggagtcagcctgct

SEQ ID NO: 6936940 - DNA, 22 bp, Homo sapiens
gccacaggtaggaacctacctc

SEQ ID NO: 6936941 - DNA, 22 bp, Homo sapiens
tggagaataggggccactggtg

SEQ ID NO: 6936942 - DNA, 22 bp, Homo sapiens
aacattcttcaaatatcactct

SEQ ID NO: 6936943 - DNA, 22 bp, Homo sapiens
acagttagggactataatcatt

SEQ ID NO: 6936944 - DNA, 22 bp, Homo sapiens
agatttgtatgtctaaatgtaa

SEQ ID NO: 6936945 - DNA, 22 bp, Homo sapiens
aaatgcacaggttttaaatcct

SEQ ID NO: 6936946 - DNA, 22 bp, Homo sapiens
acatttctaatttaatgtaaca

SEQ ID NO: 6936947 - DNA, 22 bp, Homo sapiens
gtgaccagaaaggcttccattt

SEQ ID NO: 6936948 - DNA, 22 bp, Homo sapiens
tggaagggaaagtttggggtcc

SEQ ID NO: 6936949 - DNA, 22 bp, Homo sapiens
gggtggtcatctgaaggtctgg

SEQ ID NO: 6936950 - DNA, 22 bp, Homo sapiens
acatttggcaagaaagagaaac

SEQ ID NO: 6936951 - DNA, 18 bp, Homo sapiens
accctttattggtagaga

SEQ ID NO: 6936952 - DNA, 22 bp, Homo sapiens
gtttcctgaaatagagtactgg

SEQ ID NO: 6936953 - DNA, 22 bp, Homo sapiens
taaggcttagaagctatctgct

SEQ ID NO: 6936954 - DNA, 22 bp, Homo sapiens
gagctaaggcacaggcaggctt

SEQ ID NO: 6936955 - DNA, 22 bp, Homo sapiens
gctggttagaaaacagagctca

SEQ ID NO: 6936956 - DNA, 22 bp, Homo sapiens
tttgaagagccacagtgaaatt

SEQ ID NO: 6936957 - DNA, 22 bp, Homo sapiens
ttggaactggatttcatgtagc

SEQ ID NO: 6936958 - DNA, 22 bp, Homo sapiens
actgtatatacagctcaaggaa

SEQ ID NO: 6936959 - DNA, 22 bp, Homo sapiens
caccaggagccatcaggagtcc

SEQ ID NO: 6936960 - DNA, 22 bp, Homo sapiens
ctgtgacagtttctcagaattt

SEQ ID NO: 6936961 - DNA, 22 bp, Homo sapiens
ccagtgttccagagagctgatg

SEQ ID NO: 6936962 - DNA, 22 bp, Homo sapiens
cccagcttgcccaggactgagg

SEQ ID NO: 6936963 - DNA, 22 bp, Homo sapiens
agtcacatagctctggtttctt

SEQ ID NO: 6936964 - DNA, 22 bp, Homo sapiens
tctcagggatgggaggccccag

SEQ ID NO: 6936965 - DNA, 22 bp, Homo sapiens
ccataaggtttggggccatgca

SEQ ID NO: 6936966 - DNA, 22 bp, Homo sapiens
agccgcaagaagtacagcagca

SEQ ID NO: 6936967 - DNA, 22 bp, Homo sapiens
cctggcagctgtttggcttggc

SEQ ID NO: 6936968 - DNA, 23 bp, Homo sapiens
tgcgtacggctgccagtgtgact

SEQ ID NO: 6936969 - DNA, 22 bp, Homo sapiens
ttcaccagattttgtatagtca

SEQ ID NO: 6936970 - DNA, 22 bp, Homo sapiens
ctaaatctcatcatgtacctcc

SEQ ID NO: 6936971 - DNA, 19 bp, Homo sapiens
agacacatcacatttctcc

SEQ ID NO: 6936972 - DNA, 22 bp, Homo sapiens
ggctactaggtaccatttagaa

SEQ ID NO: 6936973 - DNA, 22 bp, Homo sapiens
acaacaagagctaagggtaagg

SEQ ID NO: 6936974 - DNA, 22 bp, Homo sapiens
gcaagagtggaacaaaggcagc

SEQ ID NO: 6936975 - DNA, 22 bp, Homo sapiens
gcttttctccttagtgtccctg

SEQ ID NO: 6936976 - DNA, 19 bp, Homo sapiens
aatgactgagtacattgtc

SEQ ID NO: 6936977 - DNA, 22 bp, Homo sapiens
gcagaatattatggaaaaagta

SEQ ID NO: 6936978 - DNA, 22 bp, Homo sapiens
tccaactaggcacacagctggt

SEQ ID NO: 6936979 - DNA, 22 bp, Homo sapiens
ctcagatgtagaaagattgtga

SEQ ID NO: 6936980 - DNA, 22 bp, Homo sapiens
agttctttgtaaaaggtctcta

SEQ ID NO: 6936981 - DNA, 22 bp, Homo sapiens
gtgatatgtctggtttggttca

SEQ ID NO: 6936982 - DNA, 22 bp, Homo sapiens
ctcagttttgaaaaggtaagct

SEQ ID NO: 6936983 - DNA, 22 bp, Homo sapiens
ttagaaagagtataccagaaac

SEQ ID NO: 6936984 - DNA, 22 bp, Homo sapiens
cctgggagggcaagtgctgatg

SEQ ID NO: 6936985 - DNA, 22 bp, Homo sapiens
tggaagcacttgggttttgttg

SEQ ID NO: 6936986 - DNA, 22 bp, Homo sapiens
gagaggcctgagaggctgcgga

SEQ ID NO: 6936987 - DNA, 19 bp, Homo sapiens
aggtggccatgtccagcct

SEQ ID NO: 6936988 - DNA, 22 bp, Homo sapiens
tgaatggtcactgagcatctgt

SEQ ID NO: 6936989 - DNA, 22 bp, Homo sapiens
ttccacaaggccttgtcctgct

SEQ ID NO: 6936990 - DNA, 20 bp, Homo sapiens
ctttggagaaagctaacaga

SEQ ID NO: 6936991 - DNA, 22 bp, Homo sapiens
ctgttcatgctgattctgtatg

SEQ ID NO: 6936992 - DNA, 22 bp, Homo sapiens
tgcttgtctcagataaaactat

SEQ ID NO: 6936993 - DNA, 22 bp, Homo sapiens
agctgagagcccctgccctgtg

SEQ ID NO: 6936994 - DNA, 22 bp, Homo sapiens
cttggtgcaggggacagggcaa

SEQ ID NO: 6936995 - DNA, 22 bp, Homo sapiens
ccagctagtaagcacctgcatc

SEQ ID NO: 6936996 - DNA, 22 bp, Homo sapiens
acatagagtatcatactggatg

SEQ ID NO: 6936997 - DNA, 22 bp, Homo sapiens
tgtgaatgttaatattggatta

SEQ ID NO: 6936998 - DNA, 22 bp, Homo sapiens
atgctaaatgctgggggtacat

SEQ ID NO: 6936999 - DNA, 22 bp, Homo sapiens
tctaagaaagattaagaaattt

SEQ ID NO: 6937000 - DNA, 22 bp, Homo sapiens
tcaatgtcagctggtaggaaat

SEQ ID NO: 6937001 - DNA, 22 bp, Homo sapiens
ctgctgaagttcagctcctttt

SEQ ID NO: 6937002 - DNA, 18 bp, Homo sapiens
tgtaatgcagcgggtggc

SEQ ID NO: 6937003 - DNA, 22 bp, Homo sapiens
catatgttgacatttaaacctc

SEQ ID NO: 6937004 - DNA, 22 bp, Homo sapiens
tcttccagcttctggtggctgc

SEQ ID NO: 6937005 - DNA, 22 bp, Homo sapiens
cagctgctttcagcaggaggga

SEQ ID NO: 6937006 - DNA, 22 bp, Homo sapiens
ccactgaggaggtgaggacaga

SEQ ID NO: 6937007 - DNA, 22 bp, Homo sapiens
ttgtacattctatgggtttgga

SEQ ID NO: 6937008 - DNA, 22 bp, Homo sapiens
tgcatacttggggcctccactc

SEQ ID NO: 6937009 - DNA, 22 bp, Homo sapiens
tgcagcatgcaggagaggctct

SEQ ID NO: 6937010 - DNA, 22 bp, Homo sapiens
ctcaggaggaggaagttcattg

SEQ ID NO: 6937011 - DNA, 22 bp, Homo sapiens
gggactccagggccactgggcc

SEQ ID NO: 6937012 - DNA, 22 bp, Homo sapiens
gccagagcacaggctggtagta

SEQ ID NO: 6937013 - DNA, 20 bp, Homo sapiens
cagaggcattttcagactct

SEQ ID NO: 6937014 - DNA, 22 bp, Homo sapiens
tagtgattgctgatattccatt

SEQ ID NO: 6937015 - DNA, 22 bp, Homo sapiens
cctggctgctctgatgagcgcc

SEQ ID NO: 6937016 - DNA, 22 bp, Homo sapiens
ttttatctacctatgctcattt

SEQ ID NO: 6937017 - DNA, 22 bp, Homo sapiens
gaagacatgtggattctagttt

SEQ ID NO: 6937018 - DNA, 19 bp, Homo sapiens
aacaagtaggaatggaaga

SEQ ID NO: 6937019 - DNA, 22 bp, Homo sapiens
aactggatttaggaacagagaa

SEQ ID NO: 6937020 - DNA, 15 bp, Homo sapiens
ctacatgctggagca

SEQ ID NO: 6937021 - DNA, 22 bp, Homo sapiens
caggaatgacccaacagtttca

SEQ ID NO: 6937022 - DNA, 22 bp, Homo sapiens
tggccactgctctcaagctcag

SEQ ID NO: 6937023 - DNA, 22 bp, Homo sapiens
actgtccattcactcatattca

SEQ ID NO: 6937024 - DNA, 22 bp, Homo sapiens
atctgcttcgcgccaatttcat

SEQ ID NO: 6937025 - DNA, 23 bp, Homo sapiens
agggcctggcgtggagtgtgtgc

SEQ ID NO: 6937026 - DNA, 22 bp, Homo sapiens
caggagtgcaggtggtgaggca

SEQ ID NO: 6937027 - DNA, 22 bp, Homo sapiens
acaggctgagcgtccatcttca

SEQ ID NO: 6937028 - DNA, 22 bp, Homo sapiens
atatcttctttattttgtgagg

SEQ ID NO: 6937029 - DNA, 22 bp, Homo sapiens
aaggcaatgggatggatcatgt

SEQ ID NO: 6937030 - DNA, 22 bp, Homo sapiens
tcactcagagatagcctcattt

SEQ ID NO: 6937031 - DNA, 22 bp, Homo sapiens
attcttggcccgtcctcacgca

SEQ ID NO: 6937032 - DNA, 22 bp, Homo sapiens
actgccacctggtggtcctgga

SEQ ID NO: 6937033 - DNA, 22 bp, Homo sapiens
gagaaaatcttgggtcaagaat

SEQ ID NO: 6937034 - DNA, 22 bp, Homo sapiens
tggctgaagtgggcaggaggga

SEQ ID NO: 6937035 - DNA, 22 bp, Homo sapiens
aagctctgtagctcatgtgata

SEQ ID NO: 6937036 - DNA, 22 bp, Homo sapiens
agtggtctctaaatgtttaaat

SEQ ID NO: 6937037 - DNA, 22 bp, Homo sapiens
gccctccctacagcctatttct

SEQ ID NO: 6937038 - DNA, 22 bp, Homo sapiens
ggctgcttctcactcatttgca

SEQ ID NO: 6937039 - DNA, 22 bp, Homo sapiens
tgtttgaattttgctaacgtgt

SEQ ID NO: 6937040 - DNA, 22 bp, Homo sapiens
atttcctgcaaggagtgggttt

SEQ ID NO: 6937041 - DNA, 22 bp, Homo sapiens
tgtgaggtaacgctgctctgtt

SEQ ID NO: 6937042 - DNA, 22 bp, Homo sapiens
ccagagtagctgccctgcacct

SEQ ID NO: 6937043 - DNA, 22 bp, Homo sapiens
ggagctgaggaatagctttgat

SEQ ID NO: 6937044 - DNA, 22 bp, Homo sapiens
taaatagggtaagcgtgtttac

SEQ ID NO: 6937045 - DNA, 22 bp, Homo sapiens
atgcaacacatttgatgagcga

SEQ ID NO: 6937046 - DNA, 22 bp, Homo sapiens
ttggatcttatgaaggtggcat

SEQ ID NO: 6937047 - DNA, 22 bp, Homo sapiens
gccaagaatgcgacagccgtca

SEQ ID NO: 6937048 - DNA, 22 bp, Homo sapiens
ggcaggcatcatcagttgatca

SEQ ID NO: 6937049 - DNA, 21 bp, Homo sapiens
tctgccagtttctcttacttt

SEQ ID NO: 6937050 - DNA, 22 bp, Homo sapiens
ttctaacttaacactcctgtga

SEQ ID NO: 6937051 - DNA, 19 bp, Homo sapiens
ttcttagtctcatgcatga

SEQ ID NO: 6937052 - DNA, 22 bp, Homo sapiens
tgtgccagtcatccagatgtgt

SEQ ID NO: 6937053 - DNA, 22 bp, Homo sapiens
ccccagctcagtgcagggacat

SEQ ID NO: 6937054 - DNA, 22 bp, Homo sapiens
tcatttcagccatttttaaatg

SEQ ID NO: 6937055 - DNA, 22 bp, Homo sapiens
tggctctgttgaggtatggatt

SEQ ID NO: 6937056 - DNA, 22 bp, Homo sapiens
tgtggtggggtctggtattcca

SEQ ID NO: 6937057 - DNA, 22 bp, Homo sapiens
ggcctgtgcaagacagcacccc

SEQ ID NO: 6937058 - DNA, 23 bp, Homo sapiens
aaagccaagtcagtctactggaa

SEQ ID NO: 6937059 - DNA, 22 bp, Homo sapiens
ctatttctaaacctataagtga

SEQ ID NO: 6937060 - DNA, 22 bp, Homo sapiens
agatcacagcccccagatgcca

SEQ ID NO: 6937061 - DNA, 22 bp, Homo sapiens
agaaaaatcttggcgcttgtct

SEQ ID NO: 6937062 - DNA, 22 bp, Homo sapiens
gattatgattgaagccaggtgt

SEQ ID NO: 6937063 - DNA, 22 bp, Homo sapiens
ttgggcagtgattagttcatga

SEQ ID NO: 6937064 - DNA, 22 bp, Homo sapiens
ctcccaggcacagggaggagcc

SEQ ID NO: 6937065 - DNA, 18 bp, Homo sapiens
ctggattaagacagtgct

SEQ ID NO: 6937066 - DNA, 22 bp, Homo sapiens
attctcttctgatgtcttgcca

SEQ ID NO: 6937067 - DNA, 22 bp, Homo sapiens
ctgtggcaggtgtctggggcag

SEQ ID NO: 6937068 - DNA, 22 bp, Homo sapiens
tctgttggttctgtttctctga

SEQ ID NO: 6937069 - DNA, 22 bp, Homo sapiens
gtttcagcttcctttactgcag

SEQ ID NO: 6937070 - DNA, 22 bp, Homo sapiens
tgagattctgcatttctaataa

SEQ ID NO: 6937071 - DNA, 22 bp, Homo sapiens
tcacaaggttcactataaattg

SEQ ID NO: 6937072 - DNA, 19 bp, Homo sapiens
atcctaaatccagtttcta

SEQ ID NO: 6937073 - DNA, 22 bp, Homo sapiens
agacagaccatggctattcaga

SEQ ID NO: 6937074 - DNA, 22 bp, Homo sapiens
acactgttgctggcacagacag

SEQ ID NO: 6937075 - DNA, 22 bp, Homo sapiens
ctacataaatatttatgtgtct

SEQ ID NO: 6937076 - DNA, 22 bp, Homo sapiens
tcagatggcacacagagcctgc

SEQ ID NO: 6937077 - DNA, 23 bp, Homo sapiens
gtagacagatgggccaaggtaat

SEQ ID NO: 6937078 - DNA, 22 bp, Homo sapiens
aggcagcccacaggacacagga

SEQ ID NO: 6937079 - DNA, 22 bp, Homo sapiens
tcctggagggaggcggtgctac

SEQ ID NO: 6937080 - DNA, 22 bp, Homo sapiens
ggcctgctaacctgaaacggag

SEQ ID NO: 6937081 - DNA, 22 bp, Homo sapiens
ctggctgcctggagtgagggag

SEQ ID NO: 6937082 - DNA, 22 bp, Homo sapiens
tatccaaagtttctcagaaact

SEQ ID NO: 6937083 - DNA, 22 bp, Homo sapiens
tacagtagacaatgttagtatg

SEQ ID NO: 6937084 - DNA, 22 bp, Homo sapiens
gtaaacatcagccactctattt

SEQ ID NO: 6937085 - DNA, 22 bp, Homo sapiens
attgagtattgtaaataaaaca

SEQ ID NO: 6937086 - DNA, 22 bp, Homo sapiens
ttgcttatttgattaaatgtct

SEQ ID NO: 6937087 - DNA, 18 bp, Homo sapiens
atacaagcagcagagatt

SEQ ID NO: 6937088 - DNA, 22 bp, Homo sapiens
tgctttggagagaccattttca

SEQ ID NO: 6937089 - DNA, 22 bp, Homo sapiens
cctggaattgggttaggagcca

SEQ ID NO: 6937090 - DNA, 20 bp, Homo sapiens
agacaccccctgacagggaa

SEQ ID NO: 6937091 - DNA, 22 bp, Homo sapiens
tgcaggcccagtgtagaggctc

SEQ ID NO: 6937092 - DNA, 18 bp, Homo sapiens
tctgccctgccattcact

SEQ ID NO: 6937093 - DNA, 22 bp, Homo sapiens
gacaccattacctttctatatt

SEQ ID NO: 6937094 - DNA, 22 bp, Homo sapiens
actgactttggaatatttctag

SEQ ID NO: 6937095 - DNA, 22 bp, Homo sapiens
acagcctggactggctctctgc

SEQ ID NO: 6937096 - DNA, 22 bp, Homo sapiens
attcttacaaatgaaactgcaa

SEQ ID NO: 6937097 - DNA, 22 bp, Homo sapiens
tcacagcacatggaccgagtcc

SEQ ID NO: 6937098 - DNA, 22 bp, Homo sapiens
cttctgggagagcttttgcttc

SEQ ID NO: 6937099 - DNA, 22 bp, Homo sapiens
catttgtaatactgacttgcag

SEQ ID NO: 6937100 - DNA, 22 bp, Homo sapiens
ctctgctgtgccgccagggcct

SEQ ID NO: 6937101 - DNA, 22 bp, Homo sapiens
tttcacagtcaatttggagtca

SEQ ID NO: 6937102 - DNA, 22 bp, Homo sapiens
gactgcattcatttggttggca

SEQ ID NO: 6937103 - DNA, 22 bp, Homo sapiens
taatccagggtattctagtttc

SEQ ID NO: 6937104 - DNA, 22 bp, Homo sapiens
caggaaatatctcaacacttta

SEQ ID NO: 6937105 - DNA, 22 bp, Homo sapiens
ccacactgtctaacaaggcata

SEQ ID NO: 6937106 - DNA, 22 bp, Homo sapiens
cagctgttcacatttccaaaac

SEQ ID NO: 6937107 - DNA, 22 bp, Homo sapiens
caccagatgaatgtttgatgct

SEQ ID NO: 6937108 - DNA, 22 bp, Homo sapiens
tggaggctggagtgcagtggcg

SEQ ID NO: 6937109 - DNA, 22 bp, Homo sapiens
actggagttgattacataaaac

SEQ ID NO: 6937110 - DNA, 22 bp, Homo sapiens
tcctttgttcgggtgtgctgtc

SEQ ID NO: 6937111 - DNA, 22 bp, Homo sapiens
gtctgccatgtggagaaagcca

SEQ ID NO: 6937112 - DNA, 22 bp, Homo sapiens
aagaatatctgttttatttagg

SEQ ID NO: 6937113 - DNA, 22 bp, Homo sapiens
atcctgaagcatgaatgtcaaa

SEQ ID NO: 6937114 - DNA, 20 bp, Homo sapiens
ctgagctgagctccatgggt

SEQ ID NO: 6937115 - DNA, 22 bp, Homo sapiens
tacttacagttacggcaagtgg

SEQ ID NO: 6937116 - DNA, 22 bp, Homo sapiens
tacctggaatagagtctctcca

SEQ ID NO: 6937117 - DNA, 22 bp, Homo sapiens
cctggctggttgtctgattcta

SEQ ID NO: 6937118 - DNA, 22 bp, Homo sapiens
ttgttagtaagtgacaaaaatc

SEQ ID NO: 6937119 - DNA, 22 bp, Homo sapiens
gcatttgtttgggctaatctta

SEQ ID NO: 6937120 - DNA, 22 bp, Homo sapiens
ggctgaaattcagagtaaattc

SEQ ID NO: 6937121 - DNA, 20 bp, Homo sapiens
ggttacattgtctacatgtg

SEQ ID NO: 6937122 - DNA, 22 bp, Homo sapiens
tgtgcccatctcccagcttgac

SEQ ID NO: 6937123 - DNA, 22 bp, Homo sapiens
tcctgaagagccctgctctgtg

SEQ ID NO: 6937124 - DNA, 22 bp, Homo sapiens
tgttgcctgactttaaaatgtg

SEQ ID NO: 6937125 - DNA, 16 bp, Homo sapiens
tgctccagaggaccca

SEQ ID NO: 6937126 - DNA, 22 bp, Homo sapiens
agctccttgaagggctctggga

SEQ ID NO: 6937127 - DNA, 22 bp, Homo sapiens
cttggtcaggcttttgtaactg

SEQ ID NO: 6937128 - DNA, 22 bp, Homo sapiens
aggctgtgagtagttcttgttg

SEQ ID NO: 6937129 - DNA, 22 bp, Homo sapiens
caatgcacgctcagatttgacc

SEQ ID NO: 6937130 - DNA, 22 bp, Homo sapiens
atcttctcatgtgtaatgaggt

SEQ ID NO: 6937131 - DNA, 22 bp, Homo sapiens
ctagcagcattcttctagttag

SEQ ID NO: 6937132 - DNA, 22 bp, Homo sapiens
aaaaccaggcttgctgtgctcg

SEQ ID NO: 6937133 - DNA, 22 bp, Homo sapiens
gtctgcccttcctctccacgat

SEQ ID NO: 6937134 - DNA, 22 bp, Homo sapiens
catgggctttggaggctggagg

SEQ ID NO: 6937135 - DNA, 22 bp, Homo sapiens
tatcagtgtggtttctggactg

SEQ ID NO: 6937136 - DNA, 22 bp, Homo sapiens
agaacagtgctgataaatcata

SEQ ID NO: 6937137 - DNA, 22 bp, Homo sapiens
tgcaggagcccttgggctctgg

SEQ ID NO: 6937138 - DNA, 22 bp, Homo sapiens
aaggtggaggttgcagtgagct

SEQ ID NO: 6937139 - DNA, 22 bp, Homo sapiens
ttcacatataatgtctttaaaa

SEQ ID NO: 6937140 - DNA, 22 bp, Homo sapiens
agcagcaataataaagtaatac

SEQ ID NO: 6937141 - DNA, 22 bp, Homo sapiens
atgaggtcacagtgtttggcat

SEQ ID NO: 6937142 - DNA, 21 bp, Homo sapiens
gggaggaagctgcttctctct

SEQ ID NO: 6937143 - DNA, 22 bp, Homo sapiens
gcagggtttagcacctgtagct

SEQ ID NO: 6937144 - DNA, 22 bp, Homo sapiens
ggtggccaggagacatttgtca

SEQ ID NO: 6937145 - DNA, 22 bp, Homo sapiens
atggacttaagagtcagaagct

SEQ ID NO: 6937146 - DNA, 22 bp, Homo sapiens
gtgcaaatgattctaatgggta

SEQ ID NO: 6937147 - DNA, 22 bp, Homo sapiens
gagctgagcagggagcctcact

SEQ ID NO: 6937148 - DNA, 22 bp, Homo sapiens
tagaaatgtcgtctccacattt

SEQ ID NO: 6937149 - DNA, 20 bp, Homo sapiens
tgagtggccactgggtcgca

SEQ ID NO: 6937150 - DNA, 22 bp, Homo sapiens
ttccaatttgtggtgagttaat

SEQ ID NO: 6937151 - DNA, 22 bp, Homo sapiens
ccacagtgttctttttaaaatt

SEQ ID NO: 6937152 - DNA, 21 bp, Homo sapiens
aattagtgctccttgtttcaa

SEQ ID NO: 6937153 - DNA, 22 bp, Homo sapiens
atgtgttgcagaagattaagct

SEQ ID NO: 6937154 - DNA, 22 bp, Homo sapiens
ccacatcttttttcctgaacag

SEQ ID NO: 6937155 - DNA, 22 bp, Homo sapiens
ttgtgaaatcgtgtttggaagc

SEQ ID NO: 6937156 - DNA, 22 bp, Homo sapiens
tatctgttaggatcagagctgg

SEQ ID NO: 6937157 - DNA, 22 bp, Homo sapiens
gatgaggtaagaatgtaacacc

SEQ ID NO: 6937158 - DNA, 22 bp, Homo sapiens
tacagtgactggactttgtcat

SEQ ID NO: 6937159 - DNA, 22 bp, Homo sapiens
aagaagttggaaatgattgaga

SEQ ID NO: 6937160 - DNA, 19 bp, Homo sapiens
acagaaatgtaagtgagac

SEQ ID NO: 6937161 - DNA, 23 bp, Homo sapiens
gtttctatgtcttgtgccttcat

SEQ ID NO: 6937162 - DNA, 22 bp, Homo sapiens
aggccagcaagaaagagagtct

SEQ ID NO: 6937163 - DNA, 22 bp, Homo sapiens
cacttacacttctgaaagccta

SEQ ID NO: 6937164 - DNA, 20 bp, Homo sapiens
tgtaaaacaaggtgaatcct

SEQ ID NO: 6937165 - DNA, 22 bp, Homo sapiens
aaatactgtccaccatggagca

SEQ ID NO: 6937166 - DNA, 20 bp, Homo sapiens
tttgtccagcgtctactctg

SEQ ID NO: 6937167 - DNA, 22 bp, Homo sapiens
gaatcagactgacctgagttca

SEQ ID NO: 6937168 - DNA, 22 bp, Homo sapiens
cacaattttcctttaagtgtat

SEQ ID NO: 6937169 - DNA, 20 bp, Homo sapiens
ttgaggagatattgaatact

SEQ ID NO: 6937170 - DNA, 22 bp, Homo sapiens
ttgttgaattagttgactgtgt

SEQ ID NO: 6937171 - DNA, 22 bp, Homo sapiens
tcagaagcaggagtgtgcacaa

SEQ ID NO: 6937172 - DNA, 22 bp, Homo sapiens
aagattcttacctatacccagt

SEQ ID NO: 6937173 - DNA, 23 bp, Homo sapiens
tctcagtgaatctcagaattcgc

SEQ ID NO: 6937174 - DNA, 22 bp, Homo sapiens
ggctggcacgaagccctgctgg

SEQ ID NO: 6937175 - DNA, 22 bp, Homo sapiens
gggacagcagaaagaaggcaag

SEQ ID NO: 6937176 - DNA, 22 bp, Homo sapiens
acatcagacaattaattattaa

SEQ ID NO: 6937177 - DNA, 22 bp, Homo sapiens
tgctggaaagaattttctgtta

SEQ ID NO: 6937178 - DNA, 19 bp, Homo sapiens
tgagtgtgtgtttctctaa

SEQ ID NO: 6937179 - DNA, 22 bp, Homo sapiens
tggtaattgagatgtcttttct

SEQ ID NO: 6937180 - DNA, 22 bp, Homo sapiens
gtcagcgtgctcagcctattat

SEQ ID NO: 6937181 - DNA, 22 bp, Homo sapiens
atccaattctaatattgtgttt

SEQ ID NO: 6937182 - DNA, 22 bp, Homo sapiens
taaagtcaaggtactgtttcac

SEQ ID NO: 6937183 - DNA, 22 bp, Homo sapiens
gcaggctgtctaaagttagagt

SEQ ID NO: 6937184 - DNA, 17 bp, Homo sapiens
agtttatttagccttct

SEQ ID NO: 6937185 - DNA, 22 bp, Homo sapiens
agggtaaagtacatccttctca

SEQ ID NO: 6937186 - DNA, 22 bp, Homo sapiens
ttcacagttgggcaggttgtgt

SEQ ID NO: 6937187 - DNA, 22 bp, Homo sapiens
ggaaaagaaagggactgattgg

SEQ ID NO: 6937188 - DNA, 22 bp, Homo sapiens
gagtcaccttggccgctgtccc

SEQ ID NO: 6937189 - DNA, 22 bp, Homo sapiens
tggatttgagatgtgttcagat

SEQ ID NO: 6937190 - DNA, 22 bp, Homo sapiens
gtcagctactgcagggaacttt

SEQ ID NO: 6937191 - DNA, 21 bp, Homo sapiens
ggtggccttggtgagagacct

SEQ ID NO: 6937192 - DNA, 22 bp, Homo sapiens
tgcctgtgtccccttcttggca

SEQ ID NO: 6937193 - DNA, 22 bp, Homo sapiens
agtgcagccttctgggccgctt

SEQ ID NO: 6937194 - DNA, 22 bp, Homo sapiens
gcgctcctgagggttctgcatc

SEQ ID NO: 6937195 - DNA, 22 bp, Homo sapiens
ttggagtcagatgactgtagga

SEQ ID NO: 6937196 - DNA, 18 bp, Homo sapiens
agatatggagggggtggg

SEQ ID NO: 6937197 - DNA, 22 bp, Homo sapiens
ttctagaaccatgacttcaggg

SEQ ID NO: 6937198 - DNA, 22 bp, Homo sapiens
ggatttggaagaccgggtcaca

SEQ ID NO: 6937199 - DNA, 22 bp, Homo sapiens
ttccttggtgcccgatgtattt

SEQ ID NO: 6937200 - DNA, 22 bp, Homo sapiens
atttgctgtgtgctttagagac

SEQ ID NO: 6937201 - DNA, 22 bp, Homo sapiens
agagggcatgcttggtggcctg

SEQ ID NO: 6937202 - DNA, 22 bp, Homo sapiens
ttgttgcataaagtaggaaata

SEQ ID NO: 6937203 - DNA, 20 bp, Homo sapiens
cagataaacgggaaagaagc

SEQ ID NO: 6937204 - DNA, 22 bp, Homo sapiens
gctggatccacaaataactttg

SEQ ID NO: 6937205 - DNA, 21 bp, Homo sapiens
tgcaatccagcctgggcgaca

SEQ ID NO: 6937206 - DNA, 22 bp, Homo sapiens
agccttgttgctaccagatgcc

SEQ ID NO: 6937207 - DNA, 22 bp, Homo sapiens
accagaagacagaaatattatt

SEQ ID NO: 6937208 - DNA, 22 bp, Homo sapiens
tcatggaagaaaggtttgtttc

SEQ ID NO: 6937209 - DNA, 22 bp, Homo sapiens
ctgagaggtaagcagcgcagtg

SEQ ID NO: 6937210 - DNA, 23 bp, Homo sapiens
agcattctctccaacatttaaca

SEQ ID NO: 6937211 - DNA, 22 bp, Homo sapiens
gaagagcttagttgtcctagaa

SEQ ID NO: 6937212 - DNA, 22 bp, Homo sapiens
ctgggcttaggacctggtgcgg

SEQ ID NO: 6937213 - DNA, 22 bp, Homo sapiens
aggcacaggaacaggaaaagag

SEQ ID NO: 6937214 - DNA, 22 bp, Homo sapiens
tgggactgctcttgctggggtc

SEQ ID NO: 6937215 - DNA, 22 bp, Homo sapiens
atgtttctagagctttgtccca

SEQ ID NO: 6937216 - DNA, 22 bp, Homo sapiens
ctagcaccagcctgagagtttt

SEQ ID NO: 6937217 - DNA, 22 bp, Homo sapiens
caggtgaacccagtctaatcat

SEQ ID NO: 6937218 - DNA, 22 bp, Homo sapiens
cctagaacacaacctatattag

SEQ ID NO: 6937219 - DNA, 22 bp, Homo sapiens
agcttgttagaaatgtagactc

SEQ ID NO: 6937220 - DNA, 23 bp, Homo sapiens
tggctaaaggctctagtcctgct

SEQ ID NO: 6937221 - DNA, 22 bp, Homo sapiens
gcagagctgcagcgaggcctgg

SEQ ID NO: 6937222 - DNA, 18 bp, Homo sapiens
ggtgtgtaacgtgttttc

SEQ ID NO: 6937223 - DNA, 22 bp, Homo sapiens
aactggtagctgattaagtata

SEQ ID NO: 6937224 - DNA, 22 bp, Homo sapiens
ccagcagagttggtttctggta

SEQ ID NO: 6937225 - DNA, 22 bp, Homo sapiens
aaagccaggaggagggcgctcg

SEQ ID NO: 6937226 - DNA, 22 bp, Homo sapiens
tgctgagataagctatgaccag

SEQ ID NO: 6937227 - DNA, 22 bp, Homo sapiens
tttcattgatgggtgatagaaa

SEQ ID NO: 6937228 - DNA, 22 bp, Homo sapiens
tgagagtgattggttcgaatgt

SEQ ID NO: 6937229 - DNA, 22 bp, Homo sapiens
gtggatacatttgtttggagtg

SEQ ID NO: 6937230 - DNA, 22 bp, Homo sapiens
ggctggctcatgcaaagggtga

SEQ ID NO: 6937231 - DNA, 17 bp, Homo sapiens
agtgttctgggttgccc

SEQ ID NO: 6937232 - DNA, 22 bp, Homo sapiens
tcctcctttccccgctggagcc

SEQ ID NO: 6937233 - DNA, 22 bp, Homo sapiens
aggccctctcattccagaggca

SEQ ID NO: 6937234 - DNA, 22 bp, Homo sapiens
gcttcccaaacttgtggataga

SEQ ID NO: 6937235 - DNA, 22 bp, Homo sapiens
gagagctgtccggctgagcagc

SEQ ID NO: 6937236 - DNA, 22 bp, Homo sapiens
tcaaacaggactacattctcat

SEQ ID NO: 6937237 - DNA, 22 bp, Homo sapiens
attagagcagtaattgtggcag

SEQ ID NO: 6937238 - DNA, 22 bp, Homo sapiens
cagggctgaggacacaagtaaa

SEQ ID NO: 6937239 - DNA, 22 bp, Homo sapiens
ttgaggcagggcatggtggccc

SEQ ID NO: 6937240 - DNA, 22 bp, Homo sapiens
agtgactactgatttttacttt

SEQ ID NO: 6937241 - DNA, 22 bp, Homo sapiens
gcccagtggtaaaagcaggcct

SEQ ID NO: 6937242 - DNA, 22 bp, Homo sapiens
aaggtacagggtattagattat

SEQ ID NO: 6937243 - DNA, 22 bp, Homo sapiens
gagacagtgtcagccattgaaa

SEQ ID NO: 6937244 - DNA, 19 bp, Homo sapiens
aatgcttaggacagtgcct

SEQ ID NO: 6937245 - DNA, 22 bp, Homo sapiens
cagacatatccctgctccctta

SEQ ID NO: 6937246 - DNA, 22 bp, Homo sapiens
cctgggttattttggtctagtg

SEQ ID NO: 6937247 - DNA, 22 bp, Homo sapiens
actgcaggccttggtgccagca

SEQ ID NO: 6937248 - DNA, 22 bp, Homo sapiens
aaaagagaatcctgtacagaga

SEQ ID NO: 6937249 - DNA, 22 bp, Homo sapiens
tttcagtttcatggcacagcta

SEQ ID NO: 6937250 - DNA, 22 bp, Homo sapiens
agcatttagtctttattgcagc

SEQ ID NO: 6937251 - DNA, 22 bp, Homo sapiens
ggtcgggcactctccagggctg

SEQ ID NO: 6937252 - DNA, 22 bp, Homo sapiens
caaaggcagttactgaatgaag

SEQ ID NO: 6937253 - DNA, 20 bp, Homo sapiens
tgcatctagtaagagtgtca

SEQ ID NO: 6937254 - DNA, 22 bp, Homo sapiens
tctggctccacctcctttacta

SEQ ID NO: 6937255 - DNA, 22 bp, Homo sapiens
ttatggctagactagtttttga

SEQ ID NO: 6937256 - DNA, 22 bp, Homo sapiens
ttattagagatatttggttagg

SEQ ID NO: 6937257 - DNA, 22 bp, Homo sapiens
tggcctggtgtctgcgaggcct

SEQ ID NO: 6937258 - DNA, 22 bp, Homo sapiens
gatgaggaaaccaaggctcagg

SEQ ID NO: 6937259 - DNA, 19 bp, Homo sapiens
tgcagctgtctctatatta

SEQ ID NO: 6937260 - DNA, 22 bp, Homo sapiens
gggatgactacttatgggaagt

SEQ ID NO: 6937261 - DNA, 22 bp, Homo sapiens
tatgatagttttttaaatgtcc

SEQ ID NO: 6937262 - DNA, 22 bp, Homo sapiens
actggccatgggatttatattt

SEQ ID NO: 6937263 - DNA, 22 bp, Homo sapiens
agtgaatttcatgtaagtgtgt

SEQ ID NO: 6937264 - DNA, 23 bp, Homo sapiens
aatggcggaaagaacacagaggg

SEQ ID NO: 6937265 - DNA, 22 bp, Homo sapiens
gaggtggctccaggagcaatgc

SEQ ID NO: 6937266 - DNA, 22 bp, Homo sapiens
ttgctctagtggcccctgaatg

SEQ ID NO: 6937267 - DNA, 22 bp, Homo sapiens
cattcaaaatgggctgacctgt

SEQ ID NO: 6937268 - DNA, 22 bp, Homo sapiens
tgtctttagccacttgcctctt

SEQ ID NO: 6937269 - DNA, 22 bp, Homo sapiens
gctgacagcaaggggctgccct

SEQ ID NO: 6937270 - DNA, 22 bp, Homo sapiens
gggaagtgagctggaatcaagg

SEQ ID NO: 6937271 - DNA, 22 bp, Homo sapiens
atgtctttctagttaagagcta

SEQ ID NO: 6937272 - DNA, 22 bp, Homo sapiens
tggctacagcttggccacagag

SEQ ID NO: 6937273 - DNA, 22 bp, Homo sapiens
catatacttttctatagctttc

SEQ ID NO: 6937274 - DNA, 22 bp, Homo sapiens
agtgctctgggtccactccaga

SEQ ID NO: 6937275 - DNA, 22 bp, Homo sapiens
ctccatggctttcgcatctgca

SEQ ID NO: 6937276 - DNA, 22 bp, Homo sapiens
ttgggtctacgtagaaagaaca

SEQ ID NO: 6937277 - DNA, 22 bp, Homo sapiens
ggggcttctttctgccaccgac

SEQ ID NO: 6937278 - DNA, 22 bp, Homo sapiens
aatctgtcccttaactagtcat

SEQ ID NO: 6937279 - DNA, 22 bp, Homo sapiens
agctgtcctggctcaggctgtg

SEQ ID NO: 6937280 - DNA, 22 bp, Homo sapiens
tgcttagggctcctccaataga

SEQ ID NO: 6937281 - DNA, 22 bp, Homo sapiens
taatgatgtttcctatcttcca

SEQ ID NO: 6937282 - DNA, 22 bp, Homo sapiens
catttactgttgaatccctagc

SEQ ID NO: 6937283 - DNA, 22 bp, Homo sapiens
tccagaccatggatggctgcaa

SEQ ID NO: 6937284 - DNA, 22 bp, Homo sapiens
acagaatgggatttgaatattt

SEQ ID NO: 6937285 - DNA, 22 bp, Homo sapiens
agtgatccacccgcctcaacct

SEQ ID NO: 6937286 - DNA, 22 bp, Homo sapiens
ggtgcagagcagtgtcagagca

SEQ ID NO: 6937287 - DNA, 22 bp, Homo sapiens
ggggtgtgtctgacaatggtat

SEQ ID NO: 6937288 - DNA, 22 bp, Homo sapiens
ctcagggtgagaaattgatcca

SEQ ID NO: 6937289 - DNA, 22 bp, Homo sapiens
ttgggagaaggctgggacttta

SEQ ID NO: 6937290 - DNA, 22 bp, Homo sapiens
gacagggccaaaccggctgatc

SEQ ID NO: 6937291 - DNA, 22 bp, Homo sapiens
tacagagagaggggttaccagg

SEQ ID NO: 6937292 - DNA, 21 bp, Homo sapiens
cccaggaggagctccggctcc

SEQ ID NO: 6937293 - DNA, 22 bp, Homo sapiens
gtgatgttatgaagatgaatgt

SEQ ID NO: 6937294 - DNA, 22 bp, Homo sapiens
acagcaggtagctttgtgcctc

SEQ ID NO: 6937295 - DNA, 22 bp, Homo sapiens
aagtgtttcaataatttggacc

SEQ ID NO: 6937296 - DNA, 22 bp, Homo sapiens
tactttgcagcttgataaaatg

SEQ ID NO: 6937297 - DNA, 22 bp, Homo sapiens
tgagcagggactttggagtctg

SEQ ID NO: 6937298 - DNA, 22 bp, Homo sapiens
agagcttatatcttggccatcc

SEQ ID NO: 6937299 - DNA, 22 bp, Homo sapiens
ttgaaatgtagtcctgccttca

SEQ ID NO: 6937300 - DNA, 22 bp, Homo sapiens
ggccctgcatgagattaaggtt

SEQ ID NO: 6937301 - DNA, 22 bp, Homo sapiens
ttggaaagggaggaatgtagac

SEQ ID NO: 6937302 - DNA, 22 bp, Homo sapiens
tggctctgcgtctgttcgtggg

SEQ ID NO: 6937303 - DNA, 22 bp, Homo sapiens
agggatggcaagttaacctgag

SEQ ID NO: 6937304 - DNA, 22 bp, Homo sapiens
tctgctgaatggagccaacctc

SEQ ID NO: 6937305 - DNA, 22 bp, Homo sapiens
atgcactgggtgaggaaggaga

SEQ ID NO: 6937306 - DNA, 22 bp, Homo sapiens
ttctggaattcttgcagccact

SEQ ID NO: 6937307 - DNA, 21 bp, Homo sapiens
taggagctgatggggaagtag

SEQ ID NO: 6937308 - DNA, 22 bp, Homo sapiens
aggtggatctgacagaaatgaa

SEQ ID NO: 6937309 - DNA, 22 bp, Homo sapiens
tcttctttatgtcatatgccag

SEQ ID NO: 6937310 - DNA, 22 bp, Homo sapiens
tgttaaaaatgcagattcctat

SEQ ID NO: 6937311 - DNA, 22 bp, Homo sapiens
agggtcaagtcactggttcacg

SEQ ID NO: 6937312 - DNA, 22 bp, Homo sapiens
gctccactgtttattggcagaa

SEQ ID NO: 6937313 - DNA, 22 bp, Homo sapiens
aaagtcttgttacgttccattg

SEQ ID NO: 6937314 - DNA, 22 bp, Homo sapiens
tgcaggtgacaccactcttcct

SEQ ID NO: 6937315 - DNA, 22 bp, Homo sapiens
cagcagcccacgcgtgctgtcc

SEQ ID NO: 6937316 - DNA, 17 bp, Homo sapiens
tatctgtatgatggata

SEQ ID NO: 6937317 - DNA, 22 bp, Homo sapiens
cctcaagtcaattctgtctcgc

SEQ ID NO: 6937318 - DNA, 22 bp, Homo sapiens
agctcctgggggttccaagcag

SEQ ID NO: 6937319 - DNA, 22 bp, Homo sapiens
agagaacacgtgcatctgcaat

SEQ ID NO: 6937320 - DNA, 22 bp, Homo sapiens
tcagaattagagctcttcttga

SEQ ID NO: 6937321 - DNA, 22 bp, Homo sapiens
ctggcattgagggtcacaaggc

SEQ ID NO: 6937322 - DNA, 22 bp, Homo sapiens
ttagcaattccaggtaagttat

SEQ ID NO: 6937323 - DNA, 21 bp, Homo sapiens
gtcaactggaagggcagggat

SEQ ID NO: 6937324 - DNA, 22 bp, Homo sapiens
tgcattatggctgagtctctca

SEQ ID NO: 6937325 - DNA, 22 bp, Homo sapiens
aatacagatgagcttctgcctc

SEQ ID NO: 6937326 - DNA, 22 bp, Homo sapiens
gcctggagttgtggtgaagcca

SEQ ID NO: 6937327 - DNA, 22 bp, Homo sapiens
gcaccactagagtagagatggt

SEQ ID NO: 6937328 - DNA, 22 bp, Homo sapiens
tacccagttccacacactgatg

SEQ ID NO: 6937329 - DNA, 20 bp, Homo sapiens
tcctggcctccctggggctc

SEQ ID NO: 6937330 - DNA, 22 bp, Homo sapiens
taatgccaatttaatgatccat

SEQ ID NO: 6937331 - DNA, 22 bp, Homo sapiens
atacttaatgtcagtttgatgt

SEQ ID NO: 6937332 - DNA, 22 bp, Homo sapiens
caagaataaaatacatgttgat

SEQ ID NO: 6937333 - DNA, 22 bp, Homo sapiens
aggctcagcatctgattcatat

SEQ ID NO: 6937334 - DNA, 20 bp, Homo sapiens
cagtcccaatccagggccag

SEQ ID NO: 6937335 - DNA, 22 bp, Homo sapiens
ggagcatgggtcagaactcagt

SEQ ID NO: 6937336 - DNA, 22 bp, Homo sapiens
gacttgtttcaggtttgattgc

SEQ ID NO: 6937337 - DNA, 19 bp, Homo sapiens
acagatagactccaaagca

SEQ ID NO: 6937338 - DNA, 23 bp, Homo sapiens
atcataggccctagagagaaggc

SEQ ID NO: 6937339 - DNA, 22 bp, Homo sapiens
tccatccatggatggaaatgtg

SEQ ID NO: 6937340 - DNA, 22 bp, Homo sapiens
gcctgcagcctcaagggctgag

SEQ ID NO: 6937341 - DNA, 22 bp, Homo sapiens
agtgaattgttgccacagagac

SEQ ID NO: 6937342 - DNA, 22 bp, Homo sapiens
ttcctagctataaagctcttcc

SEQ ID NO: 6937343 - DNA, 22 bp, Homo sapiens
gacaaagtcaacagtactctca

SEQ ID NO: 6937344 - DNA, 22 bp, Homo sapiens
tttggcagcacccgccatctat

SEQ ID NO: 6937345 - DNA, 22 bp, Homo sapiens
tgccaatcagctttgcaacttg

SEQ ID NO: 6937346 - DNA, 22 bp, Homo sapiens
gtttgaaagttcaacaggaaaa

SEQ ID NO: 6937347 - DNA, 22 bp, Homo sapiens
acagcttgtctggtttcaggtc

SEQ ID NO: 6937348 - DNA, 21 bp, Homo sapiens
tggctacagtggtaagaactg

SEQ ID NO: 6937349 - DNA, 22 bp, Homo sapiens
ttctttggggtctccagcatag

SEQ ID NO: 6937350 - DNA, 22 bp, Homo sapiens
ctgtatttcttggacagttgct

SEQ ID NO: 6937351 - DNA, 22 bp, Homo sapiens
tgtttactatgatgtaacctat

SEQ ID NO: 6937352 - DNA, 22 bp, Homo sapiens
caccaggatgggcaggtaggtc

SEQ ID NO: 6937353 - DNA, 22 bp, Homo sapiens
tgggaagttgtaccttctgtta

SEQ ID NO: 6937354 - DNA, 22 bp, Homo sapiens
tctgcccagggacaggacacag

SEQ ID NO: 6937355 - DNA, 22 bp, Homo sapiens
ctccagcctcagatgacggtac

SEQ ID NO: 6937356 - DNA, 22 bp, Homo sapiens
acagagtacagacaaaggtcag

SEQ ID NO: 6937357 - DNA, 22 bp, Homo sapiens
attgtcttaaacaaatgtgttt

SEQ ID NO: 6937358 - DNA, 22 bp, Homo sapiens
cctcaaattggcattaattaag

SEQ ID NO: 6937359 - DNA, 22 bp, Homo sapiens
caggaagtgtgcctgagcacct

SEQ ID NO: 6937360 - DNA, 22 bp, Homo sapiens
tacaattactcagctctgctgt

SEQ ID NO: 6937361 - DNA, 22 bp, Homo sapiens
tgtgtcaaggcatcagcccagc

SEQ ID NO: 6937362 - DNA, 22 bp, Homo sapiens
aggtccctgagtcagcggcgct

SEQ ID NO: 6937363 - DNA, 23 bp, Homo sapiens
tgcagtcaactctaactgctaag

SEQ ID NO: 6937364 - DNA, 22 bp, Homo sapiens
tttttacacttagcattgagcg

SEQ ID NO: 6937365 - DNA, 22 bp, Homo sapiens
aggccaagtagccgctgtccta

SEQ ID NO: 6937366 - DNA, 22 bp, Homo sapiens
agacagcgaggacagaggggtg

SEQ ID NO: 6937367 - DNA, 22 bp, Homo sapiens
gatgatgggatccagcaatgta

SEQ ID NO: 6937368 - DNA, 22 bp, Homo sapiens
acagtaattgtgaacttaacgt

SEQ ID NO: 6937369 - DNA, 22 bp, Homo sapiens
ggcaggggttcattttgtctta

SEQ ID NO: 6937370 - DNA, 22 bp, Homo sapiens
gagtccaggctggtcaaatagc

SEQ ID NO: 6937371 - DNA, 20 bp, Homo sapiens
tgacatagctcttggggtgc

SEQ ID NO: 6937372 - DNA, 22 bp, Homo sapiens
catgcattttctattcactcag

SEQ ID NO: 6937373 - DNA, 22 bp, Homo sapiens
taggtacttaagatctcagcta

SEQ ID NO: 6937374 - DNA, 22 bp, Homo sapiens
agagcctggcaaaaggtcctgc

SEQ ID NO: 6937375 - DNA, 22 bp, Homo sapiens
agcagaaagcttattttgactg

SEQ ID NO: 6937376 - DNA, 22 bp, Homo sapiens
agttgtacattgtgaacattca

SEQ ID NO: 6937377 - DNA, 22 bp, Homo sapiens
gcccttggggtgtctgtaataa

SEQ ID NO: 6937378 - DNA, 22 bp, Homo sapiens
ctcataaacattattcattatt

SEQ ID NO: 6937379 - DNA, 22 bp, Homo sapiens
tacaatcacccaaagagccaga

SEQ ID NO: 6937380 - DNA, 22 bp, Homo sapiens
gaacaaattggagaaatcagga

SEQ ID NO: 6937381 - DNA, 22 bp, Homo sapiens
gtgggactcttctttggcagtg

SEQ ID NO: 6937382 - DNA, 22 bp, Homo sapiens
agggggctcagtgactgaagtg

SEQ ID NO: 6937383 - DNA, 22 bp, Homo sapiens
tgggaagtcgtagagttcatgt

SEQ ID NO: 6937384 - DNA, 22 bp, Homo sapiens
gtggcatgacagtgaatgggca

SEQ ID NO: 6937385 - DNA, 22 bp, Homo sapiens
tagggagaggaagcaggccgct

SEQ ID NO: 6937386 - DNA, 22 bp, Homo sapiens
ttgctgatgcccttgtccaggc

SEQ ID NO: 6937387 - DNA, 22 bp, Homo sapiens
agacattttgcaatgggtagct

SEQ ID NO: 6937388 - DNA, 22 bp, Homo sapiens
tctttccttagaataattcttt

SEQ ID NO: 6937389 - DNA, 22 bp, Homo sapiens
tcatggccaaagtcaggagtgt

SEQ ID NO: 6937390 - DNA, 22 bp, Homo sapiens
ctggatgctgagaggtaccaag

SEQ ID NO: 6937391 - DNA, 22 bp, Homo sapiens
gatgataactctttatgatgaa

SEQ ID NO: 6937392 - DNA, 22 bp, Homo sapiens
tcatcctgtatcctcagaccat

SEQ ID NO: 6937393 - DNA, 22 bp, Homo sapiens
aggaatgtaaatctagatttta

SEQ ID NO: 6937394 - DNA, 22 bp, Homo sapiens
ctccccaaagataacggcttct

SEQ ID NO: 6937395 - DNA, 22 bp, Homo sapiens
tgtatcagatcaaatactggct

SEQ ID NO: 6937396 - DNA, 22 bp, Homo sapiens
caggtacaaagctactgcctga

SEQ ID NO: 6937397 - DNA, 22 bp, Homo sapiens
ggcctcgcggcttctggtggct

SEQ ID NO: 6937398 - DNA, 22 bp, Homo sapiens
ttgaatctgggtacttgtaata

SEQ ID NO: 6937399 - DNA, 22 bp, Homo sapiens
ctagtggaaactaactggaatt

SEQ ID NO: 6937400 - DNA, 22 bp, Homo sapiens
caggaggcagaggatgcccagt

SEQ ID NO: 6937401 - DNA, 22 bp, Homo sapiens
atcttggggatagcctaactca

SEQ ID NO: 6937402 - DNA, 22 bp, Homo sapiens
caaatagtatgagcaatgattc

SEQ ID NO: 6937403 - DNA, 22 bp, Homo sapiens
tgccgtggggctgaggctggag

SEQ ID NO: 6937404 - DNA, 22 bp, Homo sapiens
taggaagctatgggagatgtga

SEQ ID NO: 6937405 - DNA, 22 bp, Homo sapiens
ggctggcgctctcccagcgctg

SEQ ID NO: 6937406 - DNA, 22 bp, Homo sapiens
tcctgacttaactactctctgg

SEQ ID NO: 6937407 - DNA, 21 bp, Homo sapiens
aaatgctttgtatatatctgt

SEQ ID NO: 6937408 - DNA, 22 bp, Homo sapiens
gctgtttagctgggtaaatgga

SEQ ID NO: 6937409 - DNA, 22 bp, Homo sapiens
aggctccaccctacagagctcc

SEQ ID NO: 6937410 - DNA, 22 bp, Homo sapiens
ggacactgttcatggggagggg

SEQ ID NO: 6937411 - DNA, 22 bp, Homo sapiens
ggaaatgtattatatttggaat

SEQ ID NO: 6937412 - DNA, 22 bp, Homo sapiens
catttactgtaaaagattctct

SEQ ID NO: 6937413 - DNA, 22 bp, Homo sapiens
ggggccagatatcactaaggtt

SEQ ID NO: 6937414 - DNA, 22 bp, Homo sapiens
agtaaacagtaggaactgagaa

SEQ ID NO: 6937415 - DNA, 22 bp, Homo sapiens
ctcgattgagtaggccagcact

SEQ ID NO: 6937416 - DNA, 22 bp, Homo sapiens
tgggcctgctggggcattttca

SEQ ID NO: 6937417 - DNA, 22 bp, Homo sapiens
ttcacaagtcattagctgcata

SEQ ID NO: 6937418 - DNA, 22 bp, Homo sapiens
gtggtgagagtaggtgtcctct

SEQ ID NO: 6937419 - DNA, 22 bp, Homo sapiens
ccattctgtgtctctccacagc

SEQ ID NO: 6937420 - DNA, 22 bp, Homo sapiens
tatgctttgcaattggaaaagg

SEQ ID NO: 6937421 - DNA, 22 bp, Homo sapiens
actgagcacttggtatatttcc

SEQ ID NO: 6937422 - DNA, 22 bp, Homo sapiens
tcctctgaaatgtgtgttcggc

SEQ ID NO: 6937423 - DNA, 22 bp, Homo sapiens
tttgttacattaaaaagtaggt

SEQ ID NO: 6937424 - DNA, 22 bp, Homo sapiens
aagaaggaagtgtggacatcac

SEQ ID NO: 6937425 - DNA, 22 bp, Homo sapiens
aggctctcctccccaggaccat

SEQ ID NO: 6937426 - DNA, 23 bp, Homo sapiens
cccaacacattccttttcttctg

SEQ ID NO: 6937427 - DNA, 22 bp, Homo sapiens
actctggagatggatgtcagga

SEQ ID NO: 6937428 - DNA, 17 bp, Homo sapiens
gcacaaatcaattacta

SEQ ID NO: 6937429 - DNA, 22 bp, Homo sapiens
atccccagggagtgagctgtct

SEQ ID NO: 6937430 - DNA, 16 bp, Homo sapiens
tttatttactagtgtt

SEQ ID NO: 6937431 - DNA, 22 bp, Homo sapiens
atgtctatgttctttactgtgt

SEQ ID NO: 6937432 - DNA, 22 bp, Homo sapiens
gacattctgtcaatgttgactc

SEQ ID NO: 6937433 - DNA, 22 bp, Homo sapiens
gtgcctatgcctgttaatgtct

SEQ ID NO: 6937434 - DNA, 22 bp, Homo sapiens
tccaccagagccttcccatgct

SEQ ID NO: 6937435 - DNA, 22 bp, Homo sapiens
gaccccaggcagatcagggggt

SEQ ID NO: 6937436 - DNA, 22 bp, Homo sapiens
ttcctgggtttacgtattgggt

SEQ ID NO: 6937437 - DNA, 22 bp, Homo sapiens
accaatctgcttaaatgctgac

SEQ ID NO: 6937438 - DNA, 18 bp, Homo sapiens
aggccagccctgctactg

SEQ ID NO: 6937439 - DNA, 22 bp, Homo sapiens
ggaagctgttgtgagtgcagca

SEQ ID NO: 6937440 - DNA, 22 bp, Homo sapiens
tagtaagttctcgcattgttat

SEQ ID NO: 6937441 - DNA, 22 bp, Homo sapiens
atcgcaatgtttagaattttgt

SEQ ID NO: 6937442 - DNA, 22 bp, Homo sapiens
caggaggcagcgctctcaggac

SEQ ID NO: 6937443 - DNA, 22 bp, Homo sapiens
gcacccaggcttgggcagcaac

SEQ ID NO: 6937444 - DNA, 22 bp, Homo sapiens
gccaccctggacgcactgttcg

SEQ ID NO: 6937445 - DNA, 22 bp, Homo sapiens
ttacaggtggagaagtaaggct

SEQ ID NO: 6937446 - DNA, 22 bp, Homo sapiens
tggctgggggtgctatagctgc

SEQ ID NO: 6937447 - DNA, 22 bp, Homo sapiens
tcaaaacaacactcaggtgtaa

SEQ ID NO: 6937448 - DNA, 21 bp, Homo sapiens
agggtcaggaaccagggtacc

SEQ ID NO: 6937449 - DNA, 22 bp, Homo sapiens
gttaccttgaagtaagtattgt

SEQ ID NO: 6937450 - DNA, 22 bp, Homo sapiens
ctcttagagagttgttgatcag

SEQ ID NO: 6937451 - DNA, 22 bp, Homo sapiens
tttagattgtgacctcccccca

SEQ ID NO: 6937452 - DNA, 22 bp, Homo sapiens
aagtactttaggatatgtaact

SEQ ID NO: 6937453 - DNA, 22 bp, Homo sapiens
aggaatcccgcaccagctgctg

SEQ ID NO: 6937454 - DNA, 22 bp, Homo sapiens
gcaacactttgcaggcgggcag

SEQ ID NO: 6937455 - DNA, 22 bp, Homo sapiens
ttcatgcttggtgtggggatta

SEQ ID NO: 6937456 - DNA, 22 bp, Homo sapiens
aatgcgtattgagcatctacta

SEQ ID NO: 6937457 - DNA, 22 bp, Homo sapiens
tcctggtgtaatggtaagcatg

SEQ ID NO: 6937458 - DNA, 22 bp, Homo sapiens
atcagctcaagaacgttcccca

SEQ ID NO: 6937459 - DNA, 22 bp, Homo sapiens
ttatagaatccagttgttgtat

SEQ ID NO: 6937460 - DNA, 22 bp, Homo sapiens
aactgtagaagggacacaaaag

SEQ ID NO: 6937461 - DNA, 22 bp, Homo sapiens
acttggctttaggcatccacat

SEQ ID NO: 6937462 - DNA, 22 bp, Homo sapiens
gtggttcagtgtcatattaacg

SEQ ID NO: 6937463 - DNA, 22 bp, Homo sapiens
tgcaaatattagcattcgatat

SEQ ID NO: 6937464 - DNA, 22 bp, Homo sapiens
cagtcccaccaggatcgctctt

SEQ ID NO: 6937465 - DNA, 22 bp, Homo sapiens
cactggtagcagttaagttagg

SEQ ID NO: 6937466 - DNA, 22 bp, Homo sapiens
tttctaggcacagtgtcttccc

SEQ ID NO: 6937467 - DNA, 22 bp, Homo sapiens
tgagaagcagtttcagtaagaa

SEQ ID NO: 6937468 - DNA, 22 bp, Homo sapiens
aaggccattgtaatgtaaatat

SEQ ID NO: 6937469 - DNA, 22 bp, Homo sapiens
tgtctctcatttagttttgcac

SEQ ID NO: 6937470 - DNA, 22 bp, Homo sapiens
aggcggggaggcgctgctgtag

SEQ ID NO: 6937471 - DNA, 22 bp, Homo sapiens
tcacccctaccaaggagcactg

SEQ ID NO: 6937472 - DNA, 22 bp, Homo sapiens
ctactataaaatacacatctgt

SEQ ID NO: 6937473 - DNA, 22 bp, Homo sapiens
ttgaagttgtagttcagtgaag

SEQ ID NO: 6937474 - DNA, 20 bp, Homo sapiens
aagaatgctgtggttggaag

SEQ ID NO: 6937475 - DNA, 22 bp, Homo sapiens
tcttcccattagtaatgaagtg

SEQ ID NO: 6937476 - DNA, 17 bp, Homo sapiens
aagaacactcaatagca

SEQ ID NO: 6937477 - DNA, 22 bp, Homo sapiens
tggccctgctgtatcatctgct

SEQ ID NO: 6937478 - DNA, 21 bp, Homo sapiens
acaggataggacagtgttcct

SEQ ID NO: 6937479 - DNA, 22 bp, Homo sapiens
aagtgtggggtctcagagctga

SEQ ID NO: 6937480 - DNA, 22 bp, Homo sapiens
tggaagacaaagattcaatatt

SEQ ID NO: 6937481 - DNA, 22 bp, Homo sapiens
caggcttcagcatccacttagt

SEQ ID NO: 6937482 - DNA, 22 bp, Homo sapiens
atgtgctttaggtttgtttaca

SEQ ID NO: 6937483 - DNA, 22 bp, Homo sapiens
tgggtcctggctttgtcagggt

SEQ ID NO: 6937484 - DNA, 18 bp, Homo sapiens
cctttgcaaagggggtta

SEQ ID NO: 6937485 - DNA, 22 bp, Homo sapiens
gctgaagataagtgaagaggct

SEQ ID NO: 6937486 - DNA, 22 bp, Homo sapiens
tatagaagagacatgtgcatag

SEQ ID NO: 6937487 - DNA, 20 bp, Homo sapiens
agtctgcctgctccttctcc

SEQ ID NO: 6937488 - DNA, 22 bp, Homo sapiens
gcaggtctcaatctgagcaggc

SEQ ID NO: 6937489 - DNA, 22 bp, Homo sapiens
gagcttctgccatagagggact

SEQ ID NO: 6937490 - DNA, 22 bp, Homo sapiens
cctcccacatcctagctctgct

SEQ ID NO: 6937491 - DNA, 22 bp, Homo sapiens
acaatttgtgtcttttgcttat

SEQ ID NO: 6937492 - DNA, 22 bp, Homo sapiens
catggcttgcaagcataggaga

SEQ ID NO: 6937493 - DNA, 21 bp, Homo sapiens
aggcagaaagagcccaggctg

SEQ ID NO: 6937494 - DNA, 22 bp, Homo sapiens
agtatgaatctctttattctgc

SEQ ID NO: 6937495 - DNA, 22 bp, Homo sapiens
agtgtcctttctgttccagcca

SEQ ID NO: 6937496 - DNA, 22 bp, Homo sapiens
tgtcaacagatctcaaagctgg

SEQ ID NO: 6937497 - DNA, 22 bp, Homo sapiens
aacccagaaacgcaggcggtca

SEQ ID NO: 6937498 - DNA, 22 bp, Homo sapiens
cccagcagtacccaagcccttg

SEQ ID NO: 6937499 - DNA, 22 bp, Homo sapiens
tttgctggagatgagcgtgggt

SEQ ID NO: 6937500 - DNA, 19 bp, Homo sapiens
ctgtcaggggctggatgtt

SEQ ID NO: 6937501 - DNA, 22 bp, Homo sapiens
tgaagccatctcagagtcaaga

SEQ ID NO: 6937502 - DNA, 22 bp, Homo sapiens
acatgttgtttgccccagttgt

SEQ ID NO: 6937503 - DNA, 22 bp, Homo sapiens
tctgtgcactaacattcctggt

SEQ ID NO: 6937504 - DNA, 22 bp, Homo sapiens
gcgccccatctacagtactttt

SEQ ID NO: 6937505 - DNA, 22 bp, Homo sapiens
agccacagctccttggtggaga

SEQ ID NO: 6937506 - DNA, 22 bp, Homo sapiens
tgcaataagtattgcttacatg

SEQ ID NO: 6937507 - DNA, 22 bp, Homo sapiens
tcctgggatgaggaaacaagga

SEQ ID NO: 6937508 - DNA, 21 bp, Homo sapiens
tgccagcattaaacagtcatt

SEQ ID NO: 6937509 - DNA, 22 bp, Homo sapiens
ccaaggcaacgttggtgtcagg

SEQ ID NO: 6937510 - DNA, 22 bp, Homo sapiens
cctgtgggcttgagtgtagggt

SEQ ID NO: 6937511 - DNA, 18 bp, Homo sapiens
aagaagttggccaaagag

SEQ ID NO: 6937512 - DNA, 22 bp, Homo sapiens
taagcaacaaggtgtttaaatt

SEQ ID NO: 6937513 - DNA, 22 bp, Homo sapiens
atactgatgatgtgaagaaaca

SEQ ID NO: 6937514 - DNA, 22 bp, Homo sapiens
agagggggtgttccagaagcat

SEQ ID NO: 6937515 - DNA, 22 bp, Homo sapiens
cagagccaggtggtgttggggc

SEQ ID NO: 6937516 - DNA, 22 bp, Homo sapiens
atttgtctaatgagtgtgtact

SEQ ID NO: 6937517 - DNA, 22 bp, Homo sapiens
catcctggttaccccatagtca

SEQ ID NO: 6937518 - DNA, 19 bp, Homo sapiens
gcaggcccagtcgggctgg

SEQ ID NO: 6937519 - DNA, 22 bp, Homo sapiens
gtcagcacctctttggggagct

SEQ ID NO: 6937520 - DNA, 22 bp, Homo sapiens
gtccatccgtggtagcatggat

SEQ ID NO: 6937521 - DNA, 22 bp, Homo sapiens
acaaatgactcaaacaccactt

SEQ ID NO: 6937522 - DNA, 22 bp, Homo sapiens
tgaggaagggcacacggaccct

SEQ ID NO: 6937523 - DNA, 22 bp, Homo sapiens
gattcacagaacttagtcaagc

SEQ ID NO: 6937524 - DNA, 22 bp, Homo sapiens
tagttaatgtgaggcacctagt

SEQ ID NO: 6937525 - DNA, 22 bp, Homo sapiens
tctggctcggatttgtctagca

SEQ ID NO: 6937526 - DNA, 16 bp, Homo sapiens
gcaggacactcagaca

SEQ ID NO: 6937527 - DNA, 19 bp, Homo sapiens
ctttggaggatgaggctgg

SEQ ID NO: 6937528 - DNA, 22 bp, Homo sapiens
ataaattaggatctggggttcc

SEQ ID NO: 6937529 - DNA, 22 bp, Homo sapiens
ctcaagtccatagaatcaggaa

SEQ ID NO: 6937530 - DNA, 18 bp, Homo sapiens
ctgacctctgagcccctc

SEQ ID NO: 6937531 - DNA, 22 bp, Homo sapiens
catgcacagagcttggtcattg

SEQ ID NO: 6937532 - DNA, 22 bp, Homo sapiens
gctgggtcagaatctccctgtg

SEQ ID NO: 6937533 - DNA, 22 bp, Homo sapiens
tcctaggatctggggtgttttt

SEQ ID NO: 6937534 - DNA, 22 bp, Homo sapiens
gaagagagcagcaaactggagt

SEQ ID NO: 6937535 - DNA, 22 bp, Homo sapiens
tttcttcttgagtaaccagatt

SEQ ID NO: 6937536 - DNA, 22 bp, Homo sapiens
tatctgaacaacctttattact

SEQ ID NO: 6937537 - DNA, 22 bp, Homo sapiens
caggtaagaccgtttaggcagt

SEQ ID NO: 6937538 - DNA, 22 bp, Homo sapiens
aggccttgccaatgagagaact

SEQ ID NO: 6937539 - DNA, 22 bp, Homo sapiens
gggctcagtctggcgtggaatg

SEQ ID NO: 6937540 - DNA, 22 bp, Homo sapiens
caggcaagcaaggggtcttgaa

SEQ ID NO: 6937541 - DNA, 22 bp, Homo sapiens
ttcctacatttgtacaataaga

SEQ ID NO: 6937542 - DNA, 22 bp, Homo sapiens
tgctggcagccatgccttggaa

SEQ ID NO: 6937543 - DNA, 22 bp, Homo sapiens
ttattctcatctccctacttag

SEQ ID NO: 6937544 - DNA, 19 bp, Homo sapiens
agctgtgcagacacttcgc

SEQ ID NO: 6937545 - DNA, 17 bp, Homo sapiens
attccacagggaatctg

SEQ ID NO: 6937546 - DNA, 22 bp, Homo sapiens
ttctggctctcccctgctgggt

SEQ ID NO: 6937547 - DNA, 22 bp, Homo sapiens
caagatcagggtgccagaatgg

SEQ ID NO: 6937548 - DNA, 22 bp, Homo sapiens
tgaggtcagcccttcctatgat

SEQ ID NO: 6937549 - DNA, 22 bp, Homo sapiens
atcaggccagcaatccctgggc

SEQ ID NO: 6937550 - DNA, 22 bp, Homo sapiens
ttagaagtcagtatataggtgg

SEQ ID NO: 6937551 - DNA, 22 bp, Homo sapiens
gattctttactcagattttgtt

SEQ ID NO: 6937552 - DNA, 17 bp, Homo sapiens
gcaaccagcccccatct

SEQ ID NO: 6937553 - DNA, 22 bp, Homo sapiens
gccaggtctgggtagcagagga

SEQ ID NO: 6937554 - DNA, 22 bp, Homo sapiens
atttcagggtaaaaagtgttca

SEQ ID NO: 6937555 - DNA, 19 bp, Homo sapiens
agtgtagctaggatgtgct

SEQ ID NO: 6937556 - DNA, 22 bp, Homo sapiens
tatgcagtgtacgatgtttagt

SEQ ID NO: 6937557 - DNA, 22 bp, Homo sapiens
tgaaggtggggcttaggaatct

SEQ ID NO: 6937558 - DNA, 22 bp, Homo sapiens
cagctttggagtgtgagtgctg

SEQ ID NO: 6937559 - DNA, 22 bp, Homo sapiens
atgggctgtgggaccctggacc

SEQ ID NO: 6937560 - DNA, 22 bp, Homo sapiens
tacagtaactggaattcttctt

SEQ ID NO: 6937561 - DNA, 22 bp, Homo sapiens
ctcagttttgctagctggagtt

SEQ ID NO: 6937562 - DNA, 22 bp, Homo sapiens
atgttctgaataatgtgcatta

SEQ ID NO: 6937563 - DNA, 22 bp, Homo sapiens
tttgatcatgaagaggataaac

SEQ ID NO: 6937564 - DNA, 22 bp, Homo sapiens
aaggatagtcacatttttatgt

SEQ ID NO: 6937565 - DNA, 22 bp, Homo sapiens
tagaaagcagtatctccatttt

SEQ ID NO: 6937566 - DNA, 22 bp, Homo sapiens
tctgagagtctttcttcaagtg

SEQ ID NO: 6937567 - DNA, 22 bp, Homo sapiens
acttaggttttatttcctccaa

SEQ ID NO: 6937568 - DNA, 22 bp, Homo sapiens
gcctgcagcatgctaggtcttg

SEQ ID NO: 6937569 - DNA, 22 bp, Homo sapiens
taagacaattcttcagtcacaa

SEQ ID NO: 6937570 - DNA, 22 bp, Homo sapiens
ggctaggctcacctggagagtt

SEQ ID NO: 6937571 - DNA, 22 bp, Homo sapiens
ggtcattttcactttcaagtta

SEQ ID NO: 6937572 - DNA, 22 bp, Homo sapiens
ttgtcctgttacttgtttggat

SEQ ID NO: 6937573 - DNA, 22 bp, Homo sapiens
taggaagctctttgttttgtga

SEQ ID NO: 6937574 - DNA, 22 bp, Homo sapiens
cttcgatttaattcttaacctt

SEQ ID NO: 6937575 - DNA, 22 bp, Homo sapiens
tggaagcaacaactatggacca

SEQ ID NO: 6937576 - DNA, 22 bp, Homo sapiens
ttgtggggttggcagttcttta

SEQ ID NO: 6937577 - DNA, 21 bp, Homo sapiens
cttttacattcagtcatgatg

SEQ ID NO: 6937578 - DNA, 22 bp, Homo sapiens
tctttgaattcaaactgttcaa

SEQ ID NO: 6937579 - DNA, 22 bp, Homo sapiens
aagttgatggcgtctttgagat

SEQ ID NO: 6937580 - DNA, 22 bp, Homo sapiens
gaggccttcctctcaagcacat

SEQ ID NO: 6937581 - DNA, 21 bp, Homo sapiens
ttagagttgccattatatgta

SEQ ID NO: 6937582 - DNA, 22 bp, Homo sapiens
gtgtctggcttatgggaactgg

SEQ ID NO: 6937583 - DNA, 22 bp, Homo sapiens
aactctgattagctcaagttaa

SEQ ID NO: 6937584 - DNA, 22 bp, Homo sapiens
gtcacctcgctgtcttcctgag

SEQ ID NO: 6937585 - DNA, 22 bp, Homo sapiens
ctcacagcaaggaggtaaggta

SEQ ID NO: 6937586 - DNA, 22 bp, Homo sapiens
ttacttgtgcaccaccctaata

SEQ ID NO: 6937587 - DNA, 22 bp, Homo sapiens
aaagcaataggttaggtcaaga

SEQ ID NO: 6937588 - DNA, 22 bp, Homo sapiens
attctccctgttcctcgacacc

SEQ ID NO: 6937589 - DNA, 22 bp, Homo sapiens
tgccaggcccagcagggcggcc

SEQ ID NO: 6937590 - DNA, 22 bp, Homo sapiens
taatttagtccaatgtgaatat

SEQ ID NO: 6937591 - DNA, 22 bp, Homo sapiens
tgtacaagaataattttatata

SEQ ID NO: 6937592 - DNA, 22 bp, Homo sapiens
aatgggattaagaaagatcttg

SEQ ID NO: 6937593 - DNA, 22 bp, Homo sapiens
gtccctctgggccatcaggtcc

SEQ ID NO: 6937594 - DNA, 22 bp, Homo sapiens
gatgtctgtgagatcaaactaa

SEQ ID NO: 6937595 - DNA, 22 bp, Homo sapiens
aatgagggggatgggaaagtgt

SEQ ID NO: 6937596 - DNA, 20 bp, Homo sapiens
tctgtccaccagcctcgcct

SEQ ID NO: 6937597 - DNA, 22 bp, Homo sapiens
tggattgataaaatgggatgtt

SEQ ID NO: 6937598 - DNA, 22 bp, Homo sapiens
gttgaatacttgagaaatccat

SEQ ID NO: 6937599 - DNA, 22 bp, Homo sapiens
aagaagtctggagcaatgcaat

SEQ ID NO: 6937600 - DNA, 18 bp, Homo sapiens
taagcaatgacattgcaa

SEQ ID NO: 6937601 - DNA, 22 bp, Homo sapiens
ctgaagttattcagtgggctga

SEQ ID NO: 6937602 - DNA, 22 bp, Homo sapiens
aaactgcacatgaggctggtgc

SEQ ID NO: 6937603 - DNA, 22 bp, Homo sapiens
atgttttctttcagacttccct

SEQ ID NO: 6937604 - DNA, 22 bp, Homo sapiens
tatcagtttaaaatctgtgaat

SEQ ID NO: 6937605 - DNA, 22 bp, Homo sapiens
tctgtatttatgttggtggtgc

SEQ ID NO: 6937606 - DNA, 22 bp, Homo sapiens
gcagagtctgggctacctcttg

SEQ ID NO: 6937607 - DNA, 22 bp, Homo sapiens
gtgtccttatttctgtctctca

SEQ ID NO: 6937608 - DNA, 22 bp, Homo sapiens
cagagtacataggagcaaatca

SEQ ID NO: 6937609 - DNA, 17 bp, Homo sapiens
gagacccccactacacc

SEQ ID NO: 6937610 - DNA, 22 bp, Homo sapiens
tggtcacttttgccagtggatg

SEQ ID NO: 6937611 - DNA, 22 bp, Homo sapiens
gtgcctccaggctcgactagtc

SEQ ID NO: 6937612 - DNA, 22 bp, Homo sapiens
ctggtctgcgggaaggcgtggg

SEQ ID NO: 6937613 - DNA, 22 bp, Homo sapiens
aggggagcaaggccgtggtgta

SEQ ID NO: 6937614 - DNA, 19 bp, Homo sapiens
gcctgtccagtagcatttt

SEQ ID NO: 6937615 - DNA, 22 bp, Homo sapiens
tcctaggcctggcctggtggat

SEQ ID NO: 6937616 - DNA, 22 bp, Homo sapiens
ggtggcctcgccgcggctctgc

SEQ ID NO: 6937617 - DNA, 22 bp, Homo sapiens
ttgtaacaggtactaaataact

SEQ ID NO: 6937618 - DNA, 20 bp, Homo sapiens
tctgaggctgagctctactt

SEQ ID NO: 6937619 - DNA, 22 bp, Homo sapiens
aggagttgattacgtttatttt

SEQ ID NO: 6937620 - DNA, 22 bp, Homo sapiens
gccaagggaactgagccggagg

SEQ ID NO: 6937621 - DNA, 16 bp, Homo sapiens
tgaggccagccatttc

SEQ ID NO: 6937622 - DNA, 18 bp, Homo sapiens
acatttaggagagtcaat

SEQ ID NO: 6937623 - DNA, 22 bp, Homo sapiens
agctgcagtgaactgttttgtc

SEQ ID NO: 6937624 - DNA, 21 bp, Homo sapiens
tagcatttttgtattgctgaa

SEQ ID NO: 6937625 - DNA, 22 bp, Homo sapiens
agagacaggaatggcattaaga

SEQ ID NO: 6937626 - DNA, 22 bp, Homo sapiens
ccaggatggggagcagatagaa

SEQ ID NO: 6937627 - DNA, 22 bp, Homo sapiens
agcagcattctctggtatgggg

SEQ ID NO: 6937628 - DNA, 22 bp, Homo sapiens
ttgagcaattaggaaataaaga

SEQ ID NO: 6937629 - DNA, 22 bp, Homo sapiens
gccaggaagttgggccagtcta

SEQ ID NO: 6937630 - DNA, 22 bp, Homo sapiens
attctcaattttgccaaagggt

SEQ ID NO: 6937631 - DNA, 22 bp, Homo sapiens
ccagtactgtctccaatattcc

SEQ ID NO: 6937632 - DNA, 22 bp, Homo sapiens
aaggccactttaccttaaatcc

SEQ ID NO: 6937633 - DNA, 23 bp, Homo sapiens
gaatggctaagcacatagacttg

SEQ ID NO: 6937634 - DNA, 22 bp, Homo sapiens
tggcctctctaccaggcagcct

SEQ ID NO: 6937635 - DNA, 22 bp, Homo sapiens
ctggccttgaggaggccaccaa

SEQ ID NO: 6937636 - DNA, 18 bp, Homo sapiens
ttactgttatcaaaacag

SEQ ID NO: 6937637 - DNA, 22 bp, Homo sapiens
cagatatgataggattagcaca

SEQ ID NO: 6937638 - DNA, 22 bp, Homo sapiens
agtggtaactaagtcctgctta

SEQ ID NO: 6937639 - DNA, 22 bp, Homo sapiens
gtgcttttaacttttgaaagga

SEQ ID NO: 6937640 - DNA, 22 bp, Homo sapiens
agtcctgccttggtggggtggt

SEQ ID NO: 6937641 - DNA, 22 bp, Homo sapiens
tataggactgatcacattttca

SEQ ID NO: 6937642 - DNA, 22 bp, Homo sapiens
agtgatgtctaacttgatccct

SEQ ID NO: 6937643 - DNA, 22 bp, Homo sapiens
tagtgcttattactgtgctgtc

SEQ ID NO: 6937644 - DNA, 22 bp, Homo sapiens
ttccctccatttcattttataa

SEQ ID NO: 6937645 - DNA, 22 bp, Homo sapiens
ttgtcttagagtgaaaacttta

SEQ ID NO: 6937646 - DNA, 22 bp, Homo sapiens
tgggaagactcctcaggaggcg

SEQ ID NO: 6937647 - DNA, 22 bp, Homo sapiens
tcctggagagtgggcgagcaca

SEQ ID NO: 6937648 - DNA, 18 bp, Homo sapiens
agtggtctgttatatcat

SEQ ID NO: 6937649 - DNA, 22 bp, Homo sapiens
gagtcctgttttgaggacttga

SEQ ID NO: 6937650 - DNA, 22 bp, Homo sapiens
acatttaggatgttttgagaga

SEQ ID NO: 6937651 - DNA, 22 bp, Homo sapiens
gcaagcagggttccttagggca

SEQ ID NO: 6937652 - DNA, 22 bp, Homo sapiens
tccctgtcctgggcaatcccag

SEQ ID NO: 6937653 - DNA, 22 bp, Homo sapiens
cactgttgagcaatgtacagtg

SEQ ID NO: 6937654 - DNA, 22 bp, Homo sapiens
cttctgcaggagtcaactctgg

SEQ ID NO: 6937655 - DNA, 22 bp, Homo sapiens
aagcaagtaggtatttgacaaa

SEQ ID NO: 6937656 - DNA, 22 bp, Homo sapiens
tttcttcagccttcacaacctg

SEQ ID NO: 6937657 - DNA, 22 bp, Homo sapiens
atggccctctccttaggtcagc

SEQ ID NO: 6937658 - DNA, 22 bp, Homo sapiens
tctgccttctatcttttgtctg

SEQ ID NO: 6937659 - DNA, 22 bp, Homo sapiens
gcctctggagtcgcagcgtctt

SEQ ID NO: 6937660 - DNA, 22 bp, Homo sapiens
cctgattattgtaaatatattt

SEQ ID NO: 6937661 - DNA, 22 bp, Homo sapiens
gctgggcttcacagagccttta

SEQ ID NO: 6937662 - DNA, 22 bp, Homo sapiens
gtatcacactagaatgcattca

SEQ ID NO: 6937663 - DNA, 22 bp, Homo sapiens
caaataggtaaatgtatgctgt

SEQ ID NO: 6937664 - DNA, 22 bp, Homo sapiens
agggatcatcctgcaagtgcct

SEQ ID NO: 6937665 - DNA, 22 bp, Homo sapiens
gggcagtggctcacgcctgtaa

SEQ ID NO: 6937666 - DNA, 22 bp, Homo sapiens
tacaaaggagtagagaaggctt

SEQ ID NO: 6937667 - DNA, 22 bp, Homo sapiens
gaggccagatgtcatgtcttat

SEQ ID NO: 6937668 - DNA, 22 bp, Homo sapiens
ctcatcagaaatacctgacaaa

SEQ ID NO: 6937669 - DNA, 22 bp, Homo sapiens
atacaagactcagcacagacgg

SEQ ID NO: 6937670 - DNA, 22 bp, Homo sapiens
tgagatgtcatagttcagttca

SEQ ID NO: 6937671 - DNA, 22 bp, Homo sapiens
aatttgattccctgcacctgtt

SEQ ID NO: 6937672 - DNA, 22 bp, Homo sapiens
agataatctctaggcttcatgt

SEQ ID NO: 6937673 - DNA, 22 bp, Homo sapiens
tcccagtgggtgactggaggct

SEQ ID NO: 6937674 - DNA, 22 bp, Homo sapiens
gcctgcagccagggagttctct

SEQ ID NO: 6937675 - DNA, 22 bp, Homo sapiens
tctggcagatcttcccacgttt

SEQ ID NO: 6937676 - DNA, 22 bp, Homo sapiens
tgctgctgcttctgtacagcct

SEQ ID NO: 6937677 - DNA, 22 bp, Homo sapiens
tttatgcatctctaggaagggc

SEQ ID NO: 6937678 - DNA, 18 bp, Homo sapiens
tcagtattacctcaggca

SEQ ID NO: 6937679 - DNA, 22 bp, Homo sapiens
cctgccagagcagcttgtcctc

SEQ ID NO: 6937680 - DNA, 22 bp, Homo sapiens
aggggatggagctggaaggcag

SEQ ID NO: 6937681 - DNA, 22 bp, Homo sapiens
aagctgcatgaagttgagtaga

SEQ ID NO: 6937682 - DNA, 20 bp, Homo sapiens
cagggccacgctccaaggca

SEQ ID NO: 6937683 - DNA, 22 bp, Homo sapiens
tcattgtatactttatttatga

SEQ ID NO: 6937684 - DNA, 22 bp, Homo sapiens
gctgttcaaaagccacagttac

SEQ ID NO: 6937685 - DNA, 22 bp, Homo sapiens
tctgccagccctgtgagtcttg

SEQ ID NO: 6937686 - DNA, 22 bp, Homo sapiens
ctggtgcacgtggctgcagtcg

SEQ ID NO: 6937687 - DNA, 22 bp, Homo sapiens
tatgaagaagacaaatgacact

SEQ ID NO: 6937688 - DNA, 22 bp, Homo sapiens
ttcagtgttaaattcaaagagt

SEQ ID NO: 6937689 - DNA, 22 bp, Homo sapiens
tatcagtcctattcccagtgag

SEQ ID NO: 6937690 - DNA, 22 bp, Homo sapiens
ttgcattttggttgtaaatatg

SEQ ID NO: 6937691 - DNA, 22 bp, Homo sapiens
ccccaccttgcaattgttccct

SEQ ID NO: 6937692 - DNA, 22 bp, Homo sapiens
gtgcctgtccattcccaggctc

SEQ ID NO: 6937693 - DNA, 20 bp, Homo sapiens
ggctgctttatagggcccct

SEQ ID NO: 6937694 - DNA, 22 bp, Homo sapiens
accgtatatgtttgctgtgccc

SEQ ID NO: 6937695 - DNA, 22 bp, Homo sapiens
tacagtattatgagtgattgaa

SEQ ID NO: 6937696 - DNA, 22 bp, Homo sapiens
actaggggctcaggcccaggga

SEQ ID NO: 6937697 - DNA, 22 bp, Homo sapiens
ctaccactggctctgtgacttt

SEQ ID NO: 6937698 - DNA, 22 bp, Homo sapiens
gtgaggtcatatagcgaactcc

SEQ ID NO: 6937699 - DNA, 22 bp, Homo sapiens
gtggcctgcaggcaccttgggg

SEQ ID NO: 6937700 - DNA, 22 bp, Homo sapiens
gaagccctggggtcagtgtcgt

SEQ ID NO: 6937701 - DNA, 21 bp, Homo sapiens
acagctgcctgccatgggggt

SEQ ID NO: 6937702 - DNA, 22 bp, Homo sapiens
ctggcttgggtctacctgcctt

SEQ ID NO: 6937703 - DNA, 22 bp, Homo sapiens
tcctcttccttctgtccaaatg

SEQ ID NO: 6937704 - DNA, 17 bp, Homo sapiens
tgacttaacagcaaggc

SEQ ID NO: 6937705 - DNA, 22 bp, Homo sapiens
atcctgtgtgccacctgcctgc

SEQ ID NO: 6937706 - DNA, 22 bp, Homo sapiens
caggtggtacttaaagtcagaa

SEQ ID NO: 6937707 - DNA, 22 bp, Homo sapiens
tttcttctgagatcagggagaa

SEQ ID NO: 6937708 - DNA, 22 bp, Homo sapiens
tgctacactcaatcagtgctat

SEQ ID NO: 6937709 - DNA, 20 bp, Homo sapiens
cagaaatttgtaaaagggat

SEQ ID NO: 6937710 - DNA, 22 bp, Homo sapiens
tacaatgtctctcacctgactt

SEQ ID NO: 6937711 - DNA, 22 bp, Homo sapiens
caaattcagaaaattggtagag

SEQ ID NO: 6937712 - DNA, 22 bp, Homo sapiens
ttttcagtttgcactgcagtgc

SEQ ID NO: 6937713 - DNA, 22 bp, Homo sapiens
tcaagcaaatgtccttttgttc

SEQ ID NO: 6937714 - DNA, 22 bp, Homo sapiens
tgtagatattaattattccttt

SEQ ID NO: 6937715 - DNA, 20 bp, Homo sapiens
attgacagaaagtgttcacc

SEQ ID NO: 6937716 - DNA, 22 bp, Homo sapiens
gtccacagatctcttgttgacc

SEQ ID NO: 6937717 - DNA, 22 bp, Homo sapiens
ttgggtctgtttagctgagaag

SEQ ID NO: 6937718 - DNA, 22 bp, Homo sapiens
tatgtctggaatttgaggttca

SEQ ID NO: 6937719 - DNA, 22 bp, Homo sapiens
tacagttcacagtatcataaat

SEQ ID NO: 6937720 - DNA, 22 bp, Homo sapiens
ccatcagtggcaaataaacacc

SEQ ID NO: 6937721 - DNA, 22 bp, Homo sapiens
cagagggtgtgaaggggatgaa

SEQ ID NO: 6937722 - DNA, 22 bp, Homo sapiens
cagcccacttcccagcacctac

SEQ ID NO: 6937723 - DNA, 22 bp, Homo sapiens
cttctaattcttatgtaagctt

SEQ ID NO: 6937724 - DNA, 20 bp, Homo sapiens
cctgtctggagacaaagaga

SEQ ID NO: 6937725 - DNA, 22 bp, Homo sapiens
tgtcaaaaagctgggacaagca

SEQ ID NO: 6937726 - DNA, 21 bp, Homo sapiens
gggaaactctgcttaacagag

SEQ ID NO: 6937727 - DNA, 22 bp, Homo sapiens
agttatattccatagattcaga

SEQ ID NO: 6937728 - DNA, 22 bp, Homo sapiens
tgggaggcttccagaccttgct

SEQ ID NO: 6937729 - DNA, 22 bp, Homo sapiens
ttacatgaatacataaccattc

SEQ ID NO: 6937730 - DNA, 22 bp, Homo sapiens
attagctaggaaattttgtgtc

SEQ ID NO: 6937731 - DNA, 22 bp, Homo sapiens
tgctcattggcgatctgaggga

SEQ ID NO: 6937732 - DNA, 22 bp, Homo sapiens
ttatagaacagcctcctctaga

SEQ ID NO: 6937733 - DNA, 22 bp, Homo sapiens
aaaggcaggctttcacatctca

SEQ ID NO: 6937734 - DNA, 22 bp, Homo sapiens
gcagctgaagctgcagttccag

SEQ ID NO: 6937735 - DNA, 22 bp, Homo sapiens
acaaatttattgaagggcatat

SEQ ID NO: 6937736 - DNA, 22 bp, Homo sapiens
aggcagactcaatggctagata

SEQ ID NO: 6937737 - DNA, 22 bp, Homo sapiens
ttcatctgcttcttgattttgc

SEQ ID NO: 6937738 - DNA, 22 bp, Homo sapiens
gtgctctaggaccttagaagtg

SEQ ID NO: 6937739 - DNA, 22 bp, Homo sapiens
gaggtggggttttgttcttgaa

SEQ ID NO: 6937740 - DNA, 22 bp, Homo sapiens
tgctcagttccatgagtggagt

SEQ ID NO: 6937741 - DNA, 22 bp, Homo sapiens
tggatgctatggagtatttaga

SEQ ID NO: 6937742 - DNA, 22 bp, Homo sapiens
actctgcctttcagcagatgaa

SEQ ID NO: 6937743 - DNA, 22 bp, Homo sapiens
cgcaaggtcaggtcccggcggg

SEQ ID NO: 6937744 - DNA, 22 bp, Homo sapiens
cagcttccgaccgggggctgca

SEQ ID NO: 6937745 - DNA, 22 bp, Homo sapiens
ctacaggctcagggagccctct

SEQ ID NO: 6937746 - DNA, 22 bp, Homo sapiens
gctctctgcaagtcagcagcct

SEQ ID NO: 6937747 - DNA, 22 bp, Homo sapiens
gaagccaccctccttccagccc

SEQ ID NO: 6937748 - DNA, 22 bp, Homo sapiens
actgtgagtgatttccttctgg

SEQ ID NO: 6937749 - DNA, 22 bp, Homo sapiens
aggtatgtggttccatgatgag

SEQ ID NO: 6937750 - DNA, 22 bp, Homo sapiens
aacgcccagccttgatcaaatg

SEQ ID NO: 6937751 - DNA, 22 bp, Homo sapiens
gtgtgctgggaccacgctgggt

SEQ ID NO: 6937752 - DNA, 22 bp, Homo sapiens
tctggctctttgggtgattgta

SEQ ID NO: 6937753 - DNA, 22 bp, Homo sapiens
gttctctcagcctttgttatta

SEQ ID NO: 6937754 - DNA, 22 bp, Homo sapiens
accattctttacatcagcacag

SEQ ID NO: 6937755 - DNA, 22 bp, Homo sapiens
ttttggtagaatgatattggat

SEQ ID NO: 6937756 - DNA, 22 bp, Homo sapiens
ccaggcactggctgggttcttt

SEQ ID NO: 6937757 - DNA, 22 bp, Homo sapiens
gtttggggagttcctttaggcc

SEQ ID NO: 6937758 - DNA, 22 bp, Homo sapiens
agatttactcagctcctggaaa

SEQ ID NO: 6937759 - DNA, 16 bp, Homo sapiens
ggggaaggcaagaggg

SEQ ID NO: 6937760 - DNA, 22 bp, Homo sapiens
ctgtcctgtgctttttactgtc

SEQ ID NO: 6937761 - DNA, 18 bp, Homo sapiens
ccaaggatgctgccggcc

SEQ ID NO: 6937762 - DNA, 22 bp, Homo sapiens
tatggaactgggtgaaggcacg

SEQ ID NO: 6937763 - DNA, 22 bp, Homo sapiens
caggaacattgtagaattgaaa

SEQ ID NO: 6937764 - DNA, 22 bp, Homo sapiens
taatccaaaactgaatctgtgg

SEQ ID NO: 6937765 - DNA, 22 bp, Homo sapiens
tgggcatcaccagcagctttat

SEQ ID NO: 6937766 - DNA, 22 bp, Homo sapiens
gccttccttttaccaccagcca

SEQ ID NO: 6937767 - DNA, 22 bp, Homo sapiens
ccctggaactcctaggcaagca

SEQ ID NO: 6937768 - DNA, 22 bp, Homo sapiens
cttgtgcataagaagacctgag

SEQ ID NO: 6937769 - DNA, 21 bp, Homo sapiens
aggacctagaaaagtgcctag

SEQ ID NO: 6937770 - DNA, 23 bp, Homo sapiens
acattcttgattcaggccttagc

SEQ ID NO: 6937771 - DNA, 22 bp, Homo sapiens
ggcacatttataagtggacata

SEQ ID NO: 6937772 - DNA, 22 bp, Homo sapiens
ctcagaattaataaccacaagg

SEQ ID NO: 6937773 - DNA, 22 bp, Homo sapiens
ccctgaccagcagtacttggta

SEQ ID NO: 6937774 - DNA, 22 bp, Homo sapiens
aagagttctcagaaacgtgggt

SEQ ID NO: 6937775 - DNA, 22 bp, Homo sapiens
aaatttctgttgttttgagcca

SEQ ID NO: 6937776 - DNA, 22 bp, Homo sapiens
tcctcctgctgttagtcttgaa

SEQ ID NO: 6937777 - DNA, 22 bp, Homo sapiens
tggagagtttagcctactggaa

SEQ ID NO: 6937778 - DNA, 22 bp, Homo sapiens
ttggctcagcatcttggtgcca

SEQ ID NO: 6937779 - DNA, 22 bp, Homo sapiens
tatctctgttccaagccttatc

SEQ ID NO: 6937780 - DNA, 22 bp, Homo sapiens
tacattgaactatgagttcagt

SEQ ID NO: 6937781 - DNA, 22 bp, Homo sapiens
cagaggtagaaggcatgcagtg

SEQ ID NO: 6937782 - DNA, 22 bp, Homo sapiens
aggtatattttgtatatactct

SEQ ID NO: 6937783 - DNA, 21 bp, Homo sapiens
aggagccagcctgtcagtcta

SEQ ID NO: 6937784 - DNA, 22 bp, Homo sapiens
tggaagaatatgggggtacaga

SEQ ID NO: 6937785 - DNA, 22 bp, Homo sapiens
agccagggtgggtgaatgctat

SEQ ID NO: 6937786 - DNA, 22 bp, Homo sapiens
tggccctgacttggaggcctga

SEQ ID NO: 6937787 - DNA, 22 bp, Homo sapiens
caactttaatttgggtgtcaga

SEQ ID NO: 6937788 - DNA, 22 bp, Homo sapiens
ttagctgccctcagatccaagt

SEQ ID NO: 6937789 - DNA, 22 bp, Homo sapiens
ttgaagaagtaattttaagtct

SEQ ID NO: 6937790 - DNA, 22 bp, Homo sapiens
tgtaacaaaataccttggattg

SEQ ID NO: 6937791 - DNA, 21 bp, Homo sapiens
agtaacattttgttgtttaca

SEQ ID NO: 6937792 - DNA, 22 bp, Homo sapiens
tgatcttttcaaagacaagctt

SEQ ID NO: 6937793 - DNA, 22 bp, Homo sapiens
catgccattccctgatcctaac

SEQ ID NO: 6937794 - DNA, 23 bp, Homo sapiens
agctactaggattcattcaccct

SEQ ID NO: 6937795 - DNA, 21 bp, Homo sapiens
aactggttcaattcaactaga

SEQ ID NO: 6937796 - DNA, 22 bp, Homo sapiens
gccaggcactgctctaagccct

SEQ ID NO: 6937797 - DNA, 22 bp, Homo sapiens
tgtgggggtacacgtacacatg

SEQ ID NO: 6937798 - DNA, 22 bp, Homo sapiens
catcagaaggccagagggtagc

SEQ ID NO: 6937799 - DNA, 22 bp, Homo sapiens
ttcagtttcaagtccctctggg

SEQ ID NO: 6937800 - DNA, 20 bp, Homo sapiens
aggaggtcaaatggaatctg

SEQ ID NO: 6937801 - DNA, 22 bp, Homo sapiens
ttcttcaatgtgccctgttttc

SEQ ID NO: 6937802 - DNA, 19 bp, Homo sapiens
cattttcccatcatccttt

SEQ ID NO: 6937803 - DNA, 22 bp, Homo sapiens
tccagcagtgctctagagcgtg

SEQ ID NO: 6937804 - DNA, 22 bp, Homo sapiens
cgtccagggcgggctcccctca

SEQ ID NO: 6937805 - DNA, 22 bp, Homo sapiens
cagaccagctctatgaacccaa

SEQ ID NO: 6937806 - DNA, 22 bp, Homo sapiens
tctggctgtcattggaggcccc

SEQ ID NO: 6937807 - DNA, 22 bp, Homo sapiens
tggatggatctcaagggaatta

SEQ ID NO: 6937808 - DNA, 22 bp, Homo sapiens
ctgaagctttacttcaaataca

SEQ ID NO: 6937809 - DNA, 22 bp, Homo sapiens
agcaagaagggcaaggaagttt

SEQ ID NO: 6937810 - DNA, 22 bp, Homo sapiens
gagcctggagctggaacgaagc

SEQ ID NO: 6937811 - DNA, 23 bp, Homo sapiens
aaagttctagaatgacttcctgt

SEQ ID NO: 6937812 - DNA, 22 bp, Homo sapiens
tcaggagacttatgtcacagtg

SEQ ID NO: 6937813 - DNA, 22 bp, Homo sapiens
tgccatggcctagacctgtgat

SEQ ID NO: 6937814 - DNA, 22 bp, Homo sapiens
gagccctttccactgccctctg

SEQ ID NO: 6937815 - DNA, 22 bp, Homo sapiens
tggaggcgagagcgcgcgggct

SEQ ID NO: 6937816 - DNA, 23 bp, Homo sapiens
cctggctggattctctgcattca

SEQ ID NO: 6937817 - DNA, 22 bp, Homo sapiens
ttttggtaatgcctaacttcgt

SEQ ID NO: 6937818 - DNA, 22 bp, Homo sapiens
ggacatttagaacagagtattt

SEQ ID NO: 6937819 - DNA, 23 bp, Homo sapiens
aaggtgtcattgatgggattcta

SEQ ID NO: 6937820 - DNA, 23 bp, Homo sapiens
ctagacttggaggtcttgaggac

SEQ ID NO: 6937821 - DNA, 22 bp, Homo sapiens
tcaaaagtggcctgtaaaatct

SEQ ID NO: 6937822 - DNA, 22 bp, Homo sapiens
tattccctatttagtaattctg

SEQ ID NO: 6937823 - DNA, 22 bp, Homo sapiens
cagagcctggcgatgtcatgga

SEQ ID NO: 6937824 - DNA, 22 bp, Homo sapiens
aagacattgcatgataatgctg

SEQ ID NO: 6937825 - DNA, 21 bp, Homo sapiens
tagcagaaacagttcaggcca

SEQ ID NO: 6937826 - DNA, 22 bp, Homo sapiens
actaattcaattaggaaaggaa

SEQ ID NO: 6937827 - DNA, 22 bp, Homo sapiens
attccagatggcttcaagtaag

SEQ ID NO: 6937828 - DNA, 22 bp, Homo sapiens
gtcctgggcggagggctgctgt

SEQ ID NO: 6937829 - DNA, 22 bp, Homo sapiens
ttgcaggtatatttacttttcc

SEQ ID NO: 6937830 - DNA, 22 bp, Homo sapiens
gccacattgcgctaaacccact

SEQ ID NO: 6937831 - DNA, 22 bp, Homo sapiens
gcccccagctctcaagctcaaa

SEQ ID NO: 6937832 - DNA, 21 bp, Homo sapiens
gagaatctgttttcttgtctt

SEQ ID NO: 6937833 - DNA, 22 bp, Homo sapiens
ttctgtggcagtttgggaggtg

SEQ ID NO: 6937834 - DNA, 22 bp, Homo sapiens
atgtgtttgtacctttaaatat

SEQ ID NO: 6937835 - DNA, 22 bp, Homo sapiens
tagcaatagaaacatataaagt

SEQ ID NO: 6937836 - DNA, 22 bp, Homo sapiens
ccactggattttcttactgtag

SEQ ID NO: 6937837 - DNA, 22 bp, Homo sapiens
taaaggcactgcgtccctcaaa

SEQ ID NO: 6937838 - DNA, 22 bp, Homo sapiens
catgcaggcccgcctgaatggg

SEQ ID NO: 6937839 - DNA, 22 bp, Homo sapiens
catttgtaagcatggcgttgga

SEQ ID NO: 6937840 - DNA, 23 bp, Homo sapiens
ctcagtgtgtgacccatggcctc

SEQ ID NO: 6937841 - DNA, 22 bp, Homo sapiens
gcagccttggttgtgagatgaa

SEQ ID NO: 6937842 - DNA, 23 bp, Homo sapiens
ttcatgatgattaatcagctaca

SEQ ID NO: 6937843 - DNA, 22 bp, Homo sapiens
agatgtggtagttgaagggaag

SEQ ID NO: 6937844 - DNA, 22 bp, Homo sapiens
cataagaaataatgatgatgac

SEQ ID NO: 6937845 - DNA, 22 bp, Homo sapiens
cacattcacatttttccctcta

SEQ ID NO: 6937846 - DNA, 22 bp, Homo sapiens
actttatgacaccctttagtga

SEQ ID NO: 6937847 - DNA, 22 bp, Homo sapiens
gcagtgtgtttctgagatatgg

SEQ ID NO: 6937848 - DNA, 22 bp, Homo sapiens
aggcagccagttcaggtttctt

SEQ ID NO: 6937849 - DNA, 22 bp, Homo sapiens
cttaaccagaaaatgcacttgt

SEQ ID NO: 6937850 - DNA, 22 bp, Homo sapiens
ggctaaggacgggcaagtccca

SEQ ID NO: 6937851 - DNA, 22 bp, Homo sapiens
caggaaatttaagagtgtacaa

SEQ ID NO: 6937852 - DNA, 22 bp, Homo sapiens
cataatccttgattcaaataat

SEQ ID NO: 6937853 - DNA, 19 bp, Homo sapiens
ggaaacaggggccagagga

SEQ ID NO: 6937854 - DNA, 22 bp, Homo sapiens
caggaaggcgcggctgtgcctg

SEQ ID NO: 6937855 - DNA, 22 bp, Homo sapiens
cttatacacgaacacaaggtgt

SEQ ID NO: 6937856 - DNA, 22 bp, Homo sapiens
gcagtgccgaaggtagtggttg

SEQ ID NO: 6937857 - DNA, 22 bp, Homo sapiens
acaggctcagttcactggattt

SEQ ID NO: 6937858 - DNA, 22 bp, Homo sapiens
ctcagaagttcagcctagagta

SEQ ID NO: 6937859 - DNA, 22 bp, Homo sapiens
gacaagatgagcagctcagtgt

SEQ ID NO: 6937860 - DNA, 22 bp, Homo sapiens
gcacaggcaatagatacagcta

SEQ ID NO: 6937861 - DNA, 22 bp, Homo sapiens
atgctgtgagtgtgccgcagag

SEQ ID NO: 6937862 - DNA, 22 bp, Homo sapiens
attttcagagacatctggactt

SEQ ID NO: 6937863 - DNA, 17 bp, Homo sapiens
ttgtttgttcttgcccc

SEQ ID NO: 6937864 - DNA, 22 bp, Homo sapiens
cggtggtcacaaacaatgacta

SEQ ID NO: 6937865 - DNA, 22 bp, Homo sapiens
cagttgaatggtcagacaaggc

SEQ ID NO: 6937866 - DNA, 22 bp, Homo sapiens
cctaaagtggaaatataactat

SEQ ID NO: 6937867 - DNA, 22 bp, Homo sapiens
tcagccagtatttgagtgctca

SEQ ID NO: 6937868 - DNA, 22 bp, Homo sapiens
tttctgaataactctatgatat

SEQ ID NO: 6937869 - DNA, 22 bp, Homo sapiens
cccaaggctgcagtgagcatga

SEQ ID NO: 6937870 - DNA, 22 bp, Homo sapiens
tattgtctaggaattgtttaaa

SEQ ID NO: 6937871 - DNA, 22 bp, Homo sapiens
tgccagtgaaacatggaagaat

SEQ ID NO: 6937872 - DNA, 22 bp, Homo sapiens
tggctcagttccatcatctgga

SEQ ID NO: 6937873 - DNA, 22 bp, Homo sapiens
agcaacagaagatagagtgaat

SEQ ID NO: 6937874 - DNA, 22 bp, Homo sapiens
acacatagaaaataaatagtta

SEQ ID NO: 6937875 - DNA, 22 bp, Homo sapiens
atctttgattgaagggaccctg

SEQ ID NO: 6937876 - DNA, 22 bp, Homo sapiens
tggctgtggtttatcccagttc

SEQ ID NO: 6937877 - DNA, 22 bp, Homo sapiens
gacaaagcagacaagataattc

SEQ ID NO: 6937878 - DNA, 22 bp, Homo sapiens
cattgattatggaaagcagtgg

SEQ ID NO: 6937879 - DNA, 22 bp, Homo sapiens
tccagctgtactttgtcctggc

SEQ ID NO: 6937880 - DNA, 22 bp, Homo sapiens
ttgaaggtcaccccgtagccat

SEQ ID NO: 6937881 - DNA, 22 bp, Homo sapiens
gagcacccgtcggtggtaggaa

SEQ ID NO: 6937882 - DNA, 22 bp, Homo sapiens
ctgtttgtgatttctacgattt

SEQ ID NO: 6937883 - DNA, 22 bp, Homo sapiens
tgcagacaagtgcatctaaccc

SEQ ID NO: 6937884 - DNA, 19 bp, Homo sapiens
cctgctgcccaccctctgc

SEQ ID NO: 6937885 - DNA, 22 bp, Homo sapiens
gacctgaaagagattaaatgac

SEQ ID NO: 6937886 - DNA, 22 bp, Homo sapiens
ctctgacagccacatagaggct

SEQ ID NO: 6937887 - DNA, 22 bp, Homo sapiens
attccacatgaaaggagctgaa

SEQ ID NO: 6937888 - DNA, 22 bp, Homo sapiens
atgctgtcagtattatgtgcag

SEQ ID NO: 6937889 - DNA, 22 bp, Homo sapiens
tttattgctgagaaggattcca

SEQ ID NO: 6937890 - DNA, 22 bp, Homo sapiens
gtgaaagacagcattaatggct

SEQ ID NO: 6937891 - DNA, 22 bp, Homo sapiens
tttcctttgggcacccgagctc

SEQ ID NO: 6937892 - DNA, 22 bp, Homo sapiens
ctacagagaattgtgtgatttt

SEQ ID NO: 6937893 - DNA, 22 bp, Homo sapiens
ccacagtaaagaaacaacttcg

SEQ ID NO: 6937894 - DNA, 22 bp, Homo sapiens
ccagtgcacaatggaacaactc

SEQ ID NO: 6937895 - DNA, 22 bp, Homo sapiens
tctggccccggtcttcacagct

SEQ ID NO: 6937896 - DNA, 22 bp, Homo sapiens
gtcaggatgagggatgaggagt

SEQ ID NO: 6937897 - DNA, 22 bp, Homo sapiens
accattaaagagatcctgggga

SEQ ID NO: 6937898 - DNA, 21 bp, Homo sapiens
aggcatggaaatggcacactg

SEQ ID NO: 6937899 - DNA, 22 bp, Homo sapiens
aaggtgggcagatcacaaggtc

SEQ ID NO: 6937900 - DNA, 22 bp, Homo sapiens
agtttatttttgataagtcttg

SEQ ID NO: 6937901 - DNA, 22 bp, Homo sapiens
gtgaataaagggagttttcaaa

SEQ ID NO: 6937902 - DNA, 22 bp, Homo sapiens
agtaatagagattttaatgtcc

SEQ ID NO: 6937903 - DNA, 22 bp, Homo sapiens
tgctgaaattagaacattgagg

SEQ ID NO: 6937904 - DNA, 22 bp, Homo sapiens
tcacagaaggcatcacagaaga

SEQ ID NO: 6937905 - DNA, 22 bp, Homo sapiens
actgaaggaaacttttgtgttt

SEQ ID NO: 6937906 - DNA, 22 bp, Homo sapiens
ggtgctgacattcagagtctgg

SEQ ID NO: 6937907 - DNA, 22 bp, Homo sapiens
aaacaggctctgcgggatgctc

SEQ ID NO: 6937908 - DNA, 22 bp, Homo sapiens
aagattctgtatttctaacaat

SEQ ID NO: 6937909 - DNA, 22 bp, Homo sapiens
ggttttcagtttgtgagctctg

SEQ ID NO: 6937910 - DNA, 22 bp, Homo sapiens
tcttccaattagaatatttggg

SEQ ID NO: 6937911 - DNA, 22 bp, Homo sapiens
ggcaccagggacaatcctcttc

SEQ ID NO: 6937912 - DNA, 22 bp, Homo sapiens
agtgcacaacatgcaggtttgt

SEQ ID NO: 6937913 - DNA, 22 bp, Homo sapiens
ctgtatctgtgttggatgagtt

SEQ ID NO: 6937914 - DNA, 20 bp, Homo sapiens
cgcagcagtggaagtggaat

SEQ ID NO: 6937915 - DNA, 22 bp, Homo sapiens
gtctgctgacagagcatggacc

SEQ ID NO: 6937916 - DNA, 23 bp, Homo sapiens
taattggccttttaaaccaactc

SEQ ID NO: 6937917 - DNA, 18 bp, Homo sapiens
tgtagacagggcatggaa

SEQ ID NO: 6937918 - DNA, 22 bp, Homo sapiens
cctgcacaatgccagcgggtgg

SEQ ID NO: 6937919 - DNA, 22 bp, Homo sapiens
gcagagccagaatggccaggac

SEQ ID NO: 6937920 - DNA, 18 bp, Homo sapiens
tagcacagagcaggatgt

SEQ ID NO: 6937921 - DNA, 23 bp, Homo sapiens
actgctgtctttgaagtgcttga

SEQ ID NO: 6937922 - DNA, 19 bp, Homo sapiens
gctggggaatggatattga

SEQ ID NO: 6937923 - DNA, 22 bp, Homo sapiens
cgcaacagcgtggcgcccagct

SEQ ID NO: 6937924 - DNA, 22 bp, Homo sapiens
ggagaagattggaattaagcac

SEQ ID NO: 6937925 - DNA, 22 bp, Homo sapiens
gtttgtcccacttctggcagaa

SEQ ID NO: 6937926 - DNA, 17 bp, Homo sapiens
atgtgtctagtgcaacc

SEQ ID NO: 6937927 - DNA, 22 bp, Homo sapiens
tagtagacttggctagtcactg

SEQ ID NO: 6937928 - DNA, 22 bp, Homo sapiens
tacagtgtttcccccaggatag

SEQ ID NO: 6937929 - DNA, 22 bp, Homo sapiens
aagacaacagagatgacagact

SEQ ID NO: 6937930 - DNA, 22 bp, Homo sapiens
ccagccagctggttggacgcct

SEQ ID NO: 6937931 - DNA, 22 bp, Homo sapiens
taagtcatagattaatggccac

SEQ ID NO: 6937932 - DNA, 22 bp, Homo sapiens
attagcttatcacacaagctgc

SEQ ID NO: 6937933 - DNA, 22 bp, Homo sapiens
gataggctggccttgggcaaaa

SEQ ID NO: 6937934 - DNA, 22 bp, Homo sapiens
gtgattcattcgattagtattt

SEQ ID NO: 6937935 - DNA, 18 bp, Homo sapiens
acaggcttaggaaatgtg

SEQ ID NO: 6937936 - DNA, 22 bp, Homo sapiens
aggggggtggatcacctgaggt

SEQ ID NO: 6937937 - DNA, 18 bp, Homo sapiens
tacagaactggagtagaa

SEQ ID NO: 6937938 - DNA, 22 bp, Homo sapiens
acagatggtgagccgctgatgt

SEQ ID NO: 6937939 - DNA, 22 bp, Homo sapiens
cacacattagagccaatgtcag

SEQ ID NO: 6937940 - DNA, 18 bp, Homo sapiens
cttctcccatcttggcca

SEQ ID NO: 6937941 - DNA, 22 bp, Homo sapiens
aatcacatgaaaactgtgtgtt

SEQ ID NO: 6937942 - DNA, 22 bp, Homo sapiens
acacattataggcaatcaaaag

SEQ ID NO: 6937943 - DNA, 22 bp, Homo sapiens
aaaggcctctgtcctagtgcct

SEQ ID NO: 6937944 - DNA, 21 bp, Homo sapiens
gggcactgaaagggaatagca

SEQ ID NO: 6937945 - DNA, 22 bp, Homo sapiens
tgggaaagtgtagcctgcaggc

SEQ ID NO: 6937946 - DNA, 22 bp, Homo sapiens
tgagcatctactatgaactggg

SEQ ID NO: 6937947 - DNA, 22 bp, Homo sapiens
ttgagagtctgagtttggacta

SEQ ID NO: 6937948 - DNA, 22 bp, Homo sapiens
tctttggtcatcatgggaagca

SEQ ID NO: 6937949 - DNA, 22 bp, Homo sapiens
tatgaacattatttttgtctag

SEQ ID NO: 6937950 - DNA, 22 bp, Homo sapiens
gaggacagcttagggcttcctg

SEQ ID NO: 6937951 - DNA, 22 bp, Homo sapiens
aaagtgccttctattttagtga

SEQ ID NO: 6937952 - DNA, 22 bp, Homo sapiens
ttgaacattaacttcagtctat

SEQ ID NO: 6937953 - DNA, 18 bp, Homo sapiens
atgtgtctttcttgtttg

SEQ ID NO: 6937954 - DNA, 22 bp, Homo sapiens
aatggcttcatgtctgtggaaa

SEQ ID NO: 6937955 - DNA, 22 bp, Homo sapiens
agttataaaaggagcactgatt

SEQ ID NO: 6937956 - DNA, 22 bp, Homo sapiens
attttgataatcatgttagaga

SEQ ID NO: 6937957 - DNA, 22 bp, Homo sapiens
aggaaagaaaggaggtgcattt

SEQ ID NO: 6937958 - DNA, 22 bp, Homo sapiens
tctgggtggtgtcttccaagac

SEQ ID NO: 6937959 - DNA, 19 bp, Homo sapiens
aaaaacttagtccagaaag

SEQ ID NO: 6937960 - DNA, 22 bp, Homo sapiens
caactcctggctgttaggcaca

SEQ ID NO: 6937961 - DNA, 22 bp, Homo sapiens
caccccaagttctgtccactgc

SEQ ID NO: 6937962 - DNA, 22 bp, Homo sapiens
aatggcttctgaagcacacttt

SEQ ID NO: 6937963 - DNA, 22 bp, Homo sapiens
tccagtgcaatggctcattcat

SEQ ID NO: 6937964 - DNA, 22 bp, Homo sapiens
ttttaacttaaaatacatagat

SEQ ID NO: 6937965 - DNA, 22 bp, Homo sapiens
tttgctgtcagccgctattttc

SEQ ID NO: 6937966 - DNA, 20 bp, Homo sapiens
tgttaaaggacacttgcttt

SEQ ID NO: 6937967 - DNA, 22 bp, Homo sapiens
atcaacttaaagaaaagatact

SEQ ID NO: 6937968 - DNA, 22 bp, Homo sapiens
attctgagaaatgcattgtcag

SEQ ID NO: 6937969 - DNA, 22 bp, Homo sapiens
tcctggcttctgtctccttatt

SEQ ID NO: 6937970 - DNA, 22 bp, Homo sapiens
ttgcagggcatctatgtctggt

SEQ ID NO: 6937971 - DNA, 22 bp, Homo sapiens
aatgcctggcgattagtgtagc

SEQ ID NO: 6937972 - DNA, 22 bp, Homo sapiens
gtcagcagcatgtttaatcaaa

SEQ ID NO: 6937973 - DNA, 22 bp, Homo sapiens
ttgcttcctcctagccacttgc

SEQ ID NO: 6937974 - DNA, 22 bp, Homo sapiens
tgaaaagggtagatccctaagt

SEQ ID NO: 6937975 - DNA, 22 bp, Homo sapiens
ccatgtgtcgggcctgcagtgg

SEQ ID NO: 6937976 - DNA, 22 bp, Homo sapiens
cacgagggcacacgtgggaggg

SEQ ID NO: 6937977 - DNA, 22 bp, Homo sapiens
ttataaacttgccaagaaggag

SEQ ID NO: 6937978 - DNA, 18 bp, Homo sapiens
ggagccagtctgtctctg

SEQ ID NO: 6937979 - DNA, 22 bp, Homo sapiens
tggctgagctgcagcgtggctt

SEQ ID NO: 6937980 - DNA, 22 bp, Homo sapiens
cctgcctcccagaggtcctcta

SEQ ID NO: 6937981 - DNA, 22 bp, Homo sapiens
tgtgctcatggtccagcatggt

SEQ ID NO: 6937982 - DNA, 22 bp, Homo sapiens
cactctaacctccatcttccat

SEQ ID NO: 6937983 - DNA, 23 bp, Homo sapiens
acattacttagccagagtctcag

SEQ ID NO: 6937984 - DNA, 22 bp, Homo sapiens
ccaatcagagctattaatgcac

SEQ ID NO: 6937985 - DNA, 20 bp, Homo sapiens
gcctccaccccaggcttcag

SEQ ID NO: 6937986 - DNA, 22 bp, Homo sapiens
aaggcttcttatgcaattgttt

SEQ ID NO: 6937987 - DNA, 22 bp, Homo sapiens
ggcactgctgtaggcagtgagg

SEQ ID NO: 6937988 - DNA, 22 bp, Homo sapiens
actgtactccagccttggggac

SEQ ID NO: 6937989 - DNA, 17 bp, Homo sapiens
tgcatgtcctttgttcc

SEQ ID NO: 6937990 - DNA, 22 bp, Homo sapiens
tgacaatgaggccctccacaaa

SEQ ID NO: 6937991 - DNA, 22 bp, Homo sapiens
ggacaggggcgtggggattgtt

SEQ ID NO: 6937992 - DNA, 22 bp, Homo sapiens
gtgacagcatgaggaatcaatg

SEQ ID NO: 6937993 - DNA, 20 bp, Homo sapiens
tgcattaagtggcattgagc

SEQ ID NO: 6937994 - DNA, 22 bp, Homo sapiens
agctgggcagactgcagtggtt

SEQ ID NO: 6937995 - DNA, 22 bp, Homo sapiens
tcaggctgctttcatgcttaga

SEQ ID NO: 6937996 - DNA, 22 bp, Homo sapiens
tgctcttcacagtttcagcatc

SEQ ID NO: 6937997 - DNA, 22 bp, Homo sapiens
aaagtgatttaagtacctcagg

SEQ ID NO: 6937998 - DNA, 22 bp, Homo sapiens
aggcacttgtgactgtctgcat

SEQ ID NO: 6937999 - DNA, 22 bp, Homo sapiens
tgactcaggaggaaagactcca

SEQ ID NO: 6938000 - DNA, 22 bp, Homo sapiens
gaacaagtttccaaattataac

SEQ ID NO: 6938001 - DNA, 22 bp, Homo sapiens
aacccagagctggaggagagta

SEQ ID NO: 6938002 - DNA, 20 bp, Homo sapiens
ttccagagatctgcatttta

SEQ ID NO: 6938003 - DNA, 22 bp, Homo sapiens
cagcctttaagcttggataggt

SEQ ID NO: 6938004 - DNA, 22 bp, Homo sapiens
cttattgtgtctttgaataagt

SEQ ID NO: 6938005 - DNA, 22 bp, Homo sapiens
ggccacagcaatgctgtgatgt

SEQ ID NO: 6938006 - DNA, 22 bp, Homo sapiens
ttacttacaaaggcaaaggaag

SEQ ID NO: 6938007 - DNA, 22 bp, Homo sapiens
tgaagcaaattgtttagcctga

SEQ ID NO: 6938008 - DNA, 22 bp, Homo sapiens
agcagggggccacagtcacagc

SEQ ID NO: 6938009 - DNA, 22 bp, Homo sapiens
tccactggaacaactctgaggc

SEQ ID NO: 6938010 - DNA, 22 bp, Homo sapiens
tctgagctgggtcttgacagct

SEQ ID NO: 6938011 - DNA, 22 bp, Homo sapiens
agcagcatggctgactaaagac

SEQ ID NO: 6938012 - DNA, 22 bp, Homo sapiens
tctgagctccatgcaggaggct

SEQ ID NO: 6938013 - DNA, 22 bp, Homo sapiens
cctctcccaggcgcggcggcag

SEQ ID NO: 6938014 - DNA, 22 bp, Homo sapiens
atctatcacctttaggtttgtt

SEQ ID NO: 6938015 - DNA, 22 bp, Homo sapiens
cactgcactgcagcctggagac

SEQ ID NO: 6938016 - DNA, 22 bp, Homo sapiens
ctgggctcttcccagatccaga

SEQ ID NO: 6938017 - DNA, 22 bp, Homo sapiens
ctggtggggagtcctggtctcc

SEQ ID NO: 6938018 - DNA, 22 bp, Homo sapiens
cgtccttgcaagatctgtacaa

SEQ ID NO: 6938019 - DNA, 22 bp, Homo sapiens
aagcatattttaattagccaca

SEQ ID NO: 6938020 - DNA, 20 bp, Homo sapiens
agtctggcacctattcctgt

SEQ ID NO: 6938021 - DNA, 22 bp, Homo sapiens
tgcattttcttccaccaatatc

SEQ ID NO: 6938022 - DNA, 22 bp, Homo sapiens
tggcggaatgtgagattacctg

SEQ ID NO: 6938023 - DNA, 22 bp, Homo sapiens
tcaggagacattcttaaagtag

SEQ ID NO: 6938024 - DNA, 17 bp, Homo sapiens
ctggtttatgggcagtg

SEQ ID NO: 6938025 - DNA, 22 bp, Homo sapiens
tgcacgtgtgagcattcacatg

SEQ ID NO: 6938026 - DNA, 22 bp, Homo sapiens
acaggcttacaggctgcaagta

SEQ ID NO: 6938027 - DNA, 22 bp, Homo sapiens
tttcttcagcaggtttgtgaga

SEQ ID NO: 6938028 - DNA, 22 bp, Homo sapiens
gcagcagtggtctgtagaagga

SEQ ID NO: 6938029 - DNA, 22 bp, Homo sapiens
tgagctttgttgttagtatatt

SEQ ID NO: 6938030 - DNA, 22 bp, Homo sapiens
attccagacaggtaaattaggt

SEQ ID NO: 6938031 - DNA, 22 bp, Homo sapiens
tcgctttaatggtcttcacagc

SEQ ID NO: 6938032 - DNA, 22 bp, Homo sapiens
acatgtgtacatatatatgtgc

SEQ ID NO: 6938033 - DNA, 22 bp, Homo sapiens
tggtaaatgctccaagcagtac

SEQ ID NO: 6938034 - DNA, 22 bp, Homo sapiens
taaggaggcagtcattatcagg

SEQ ID NO: 6938035 - DNA, 22 bp, Homo sapiens
gtcttaggcacccggatgtggt

SEQ ID NO: 6938036 - DNA, 19 bp, Homo sapiens
ccagagagctaggtacaga

SEQ ID NO: 6938037 - DNA, 22 bp, Homo sapiens
tctctaattgacattacttgac

SEQ ID NO: 6938038 - DNA, 22 bp, Homo sapiens
agaaagttaaacagtgataaga

SEQ ID NO: 6938039 - DNA, 20 bp, Homo sapiens
tgcaagatgggtggggagaa

SEQ ID NO: 6938040 - DNA, 22 bp, Homo sapiens
aggctgctggaggatttatgcc

SEQ ID NO: 6938041 - DNA, 22 bp, Homo sapiens
tgtctgagctggggcagacaga

SEQ ID NO: 6938042 - DNA, 22 bp, Homo sapiens
caagtgactgtgctggcaacat

SEQ ID NO: 6938043 - DNA, 17 bp, Homo sapiens
cagtgaggcctttcctc

SEQ ID NO: 6938044 - DNA, 19 bp, Homo sapiens
tgagactgggtgcagtact

SEQ ID NO: 6938045 - DNA, 22 bp, Homo sapiens
ttatggctgaataaattatggt

SEQ ID NO: 6938046 - DNA, 22 bp, Homo sapiens
ggtctccttgggaaagcaggaa

SEQ ID NO: 6938047 - DNA, 22 bp, Homo sapiens
tcaagtcatttgactgtgtgtt

SEQ ID NO: 6938048 - DNA, 22 bp, Homo sapiens
aagaacattttgtagaatgaca

SEQ ID NO: 6938049 - DNA, 19 bp, Homo sapiens
ctactttataatatgcctc

SEQ ID NO: 6938050 - DNA, 22 bp, Homo sapiens
aaatgatgtggagtgaaattgt

SEQ ID NO: 6938051 - DNA, 22 bp, Homo sapiens
actccagaatcctagggtcagc

SEQ ID NO: 6938052 - DNA, 22 bp, Homo sapiens
ctgaaatcaattttgattatct

SEQ ID NO: 6938053 - DNA, 22 bp, Homo sapiens
agcaggtggcctcctgtctgtc

SEQ ID NO: 6938054 - DNA, 21 bp, Homo sapiens
ctcaggcatttgaggagagtc

SEQ ID NO: 6938055 - DNA, 22 bp, Homo sapiens
gaggctccgtgctgctgccctg

SEQ ID NO: 6938056 - DNA, 18 bp, Homo sapiens
tgtctcttcttatgtggg

SEQ ID NO: 6938057 - DNA, 22 bp, Homo sapiens
ctgatatttctcttaacactag

SEQ ID NO: 6938058 - DNA, 22 bp, Homo sapiens
gtgaccatttgacatatccttg

SEQ ID NO: 6938059 - DNA, 22 bp, Homo sapiens
tgagtgctggctaaatagaaaa

SEQ ID NO: 6938060 - DNA, 22 bp, Homo sapiens
ttacaggtgtggaaattgagta

SEQ ID NO: 6938061 - DNA, 22 bp, Homo sapiens
aaggtctgtattagagtttcat

SEQ ID NO: 6938062 - DNA, 22 bp, Homo sapiens
tgagagctgtccacctgtggga

SEQ ID NO: 6938063 - DNA, 22 bp, Homo sapiens
gggataagagagtatttatgca

SEQ ID NO: 6938064 - DNA, 22 bp, Homo sapiens
tctctgagcccctgcctctttc

SEQ ID NO: 6938065 - DNA, 22 bp, Homo sapiens
ccatggcctgaaggagtgcatc

SEQ ID NO: 6938066 - DNA, 23 bp, Homo sapiens
gtctcccatagcgctcccaggct

SEQ ID NO: 6938067 - DNA, 22 bp, Homo sapiens
agctggtccacttttgtatctt

SEQ ID NO: 6938068 - DNA, 21 bp, Homo sapiens
tccataagagaccatctccta

SEQ ID NO: 6938069 - DNA, 22 bp, Homo sapiens
gctggtgattgcctcaggaggc

SEQ ID NO: 6938070 - DNA, 22 bp, Homo sapiens
gaagtctgagtgggggccaggc

SEQ ID NO: 6938071 - DNA, 21 bp, Homo sapiens
tcacaagtactcatctctgcc

SEQ ID NO: 6938072 - DNA, 22 bp, Homo sapiens
ggcctgaggcgtcccagctgtg

SEQ ID NO: 6938073 - DNA, 18 bp, Homo sapiens
gcagtctctctggtcttc

SEQ ID NO: 6938074 - DNA, 22 bp, Homo sapiens
tgctgggcacacagtaggtgct

SEQ ID NO: 6938075 - DNA, 22 bp, Homo sapiens
gacctgtgttcaggtcgtggtg

SEQ ID NO: 6938076 - DNA, 22 bp, Homo sapiens
tatttggaaaggacatgtaagt

SEQ ID NO: 6938077 - DNA, 22 bp, Homo sapiens
ctcctctcaaaagtaggttgac

SEQ ID NO: 6938078 - DNA, 22 bp, Homo sapiens
tgttagtattggcaaatttgtt

SEQ ID NO: 6938079 - DNA, 16 bp, Homo sapiens
gaaggagattcagaaa

SEQ ID NO: 6938080 - DNA, 22 bp, Homo sapiens
gctatacacatttcttggtagt

SEQ ID NO: 6938081 - DNA, 22 bp, Homo sapiens
gttgttttaaaatactccagaa

SEQ ID NO: 6938082 - DNA, 22 bp, Homo sapiens
ctgccttccaaccccagactcc

SEQ ID NO: 6938083 - DNA, 21 bp, Homo sapiens
cattaagtaccagggcactgt

SEQ ID NO: 6938084 - DNA, 22 bp, Homo sapiens
gagctggggcggatactcagct

SEQ ID NO: 6938085 - DNA, 22 bp, Homo sapiens
aggggtgaaggcccgataggag

SEQ ID NO: 6938086 - DNA, 22 bp, Homo sapiens
agattcaggcatgtcttcattt

SEQ ID NO: 6938087 - DNA, 22 bp, Homo sapiens
acaggagggacaccttcctgct

SEQ ID NO: 6938088 - DNA, 22 bp, Homo sapiens
gggtctggagatccgggtgaag

SEQ ID NO: 6938089 - DNA, 22 bp, Homo sapiens
tagcacaaagagtctttcagag

SEQ ID NO: 6938090 - DNA, 22 bp, Homo sapiens
taacacatatttgcagtaagca

SEQ ID NO: 6938091 - DNA, 22 bp, Homo sapiens
caagatatatgtatgattccat

SEQ ID NO: 6938092 - DNA, 22 bp, Homo sapiens
tctgaaagtctgaaacagtgtc

SEQ ID NO: 6938093 - DNA, 20 bp, Homo sapiens
gagatggacagatgaagggg

SEQ ID NO: 6938094 - DNA, 22 bp, Homo sapiens
aggcagagagcagtggccgtct

SEQ ID NO: 6938095 - DNA, 22 bp, Homo sapiens
gcacaccctctcaccagcactg

SEQ ID NO: 6938096 - DNA, 22 bp, Homo sapiens
ttattattttgtgtacagcaaa

SEQ ID NO: 6938097 - DNA, 22 bp, Homo sapiens
cttggcagctacacaggtaaga

SEQ ID NO: 6938098 - DNA, 22 bp, Homo sapiens
ctggccctgtggcctaaggact

SEQ ID NO: 6938099 - DNA, 22 bp, Homo sapiens
caataactttgatattttgcgg

SEQ ID NO: 6938100 - DNA, 19 bp, Homo sapiens
ttgctggagaaaaaggaga

SEQ ID NO: 6938101 - DNA, 22 bp, Homo sapiens
atgtcactgtgaggcagctgtc

SEQ ID NO: 6938102 - DNA, 22 bp, Homo sapiens
tctggagggcccacatccacaa

SEQ ID NO: 6938103 - DNA, 23 bp, Homo sapiens
agctcaaggcagtccacatttcc

SEQ ID NO: 6938104 - DNA, 22 bp, Homo sapiens
gactttgattaaatcaagcaaa

SEQ ID NO: 6938105 - DNA, 22 bp, Homo sapiens
gccacctgccaacttgctggaa

SEQ ID NO: 6938106 - DNA, 23 bp, Homo sapiens
tcagagagctgttgagagctgcc

SEQ ID NO: 6938107 - DNA, 22 bp, Homo sapiens
gtgggtaattggagggctgcct

SEQ ID NO: 6938108 - DNA, 22 bp, Homo sapiens
cagtgttccctgaacatatgtt

SEQ ID NO: 6938109 - DNA, 22 bp, Homo sapiens
ggaccttcaagtgggttcgaat

SEQ ID NO: 6938110 - DNA, 23 bp, Homo sapiens
agggagatgccacaaagatgccc

SEQ ID NO: 6938111 - DNA, 16 bp, Homo sapiens
atgggcagtgaggaag

SEQ ID NO: 6938112 - DNA, 22 bp, Homo sapiens
tctggagataagacagacagat

SEQ ID NO: 6938113 - DNA, 22 bp, Homo sapiens
ggtggatagctcagctccacgt

SEQ ID NO: 6938114 - DNA, 22 bp, Homo sapiens
ttctagttaatgtagcatcttg

SEQ ID NO: 6938115 - DNA, 22 bp, Homo sapiens
agcttttattggctgtcatttg

SEQ ID NO: 6938116 - DNA, 22 bp, Homo sapiens
ttttcctggggcttctggactc

SEQ ID NO: 6938117 - DNA, 22 bp, Homo sapiens
ttgtgagactcgtaagagaagg

SEQ ID NO: 6938118 - DNA, 23 bp, Homo sapiens
ttaaaggcagatgttgagtatta

SEQ ID NO: 6938119 - DNA, 22 bp, Homo sapiens
agggttgcctctgagtgctccg

SEQ ID NO: 6938120 - DNA, 22 bp, Homo sapiens
cctgtgcttggccagagaggtt

SEQ ID NO: 6938121 - DNA, 22 bp, Homo sapiens
ggcttctctcccccagctccac

SEQ ID NO: 6938122 - DNA, 22 bp, Homo sapiens
cctgtctgtattattcaccact

SEQ ID NO: 6938123 - DNA, 23 bp, Homo sapiens
aagcttgtcaccatttctttcag

SEQ ID NO: 6938124 - DNA, 22 bp, Homo sapiens
aaagtgctggtattacaggtgt

SEQ ID NO: 6938125 - DNA, 22 bp, Homo sapiens
tgtgggcactaatgacatgcag

SEQ ID NO: 6938126 - DNA, 22 bp, Homo sapiens
cattcttgaaccaggcactgtg

SEQ ID NO: 6938127 - DNA, 22 bp, Homo sapiens
tgatgcagtgtcctcccatgca

SEQ ID NO: 6938128 - DNA, 22 bp, Homo sapiens
tgtacatttagagctcaataga

SEQ ID NO: 6938129 - DNA, 22 bp, Homo sapiens
tcccatgtaagaaggagacagg

SEQ ID NO: 6938130 - DNA, 18 bp, Homo sapiens
agcagtgtgacctgaaga

SEQ ID NO: 6938131 - DNA, 22 bp, Homo sapiens
ctccagaattgtccattggaaa

SEQ ID NO: 6938132 - DNA, 22 bp, Homo sapiens
agctggttgacttcaggcaagt

SEQ ID NO: 6938133 - DNA, 22 bp, Homo sapiens
tctttaagagtaattattttgg

SEQ ID NO: 6938134 - DNA, 22 bp, Homo sapiens
tgtcacctctttggctgcagct

SEQ ID NO: 6938135 - DNA, 22 bp, Homo sapiens
ggtttaatggagatatttcaga

SEQ ID NO: 6938136 - DNA, 22 bp, Homo sapiens
tgtaccttaggtgccttgcttg

SEQ ID NO: 6938137 - DNA, 22 bp, Homo sapiens
tcctggcctagctcaccctgga

SEQ ID NO: 6938138 - DNA, 22 bp, Homo sapiens
acagcatggataacaaggcact

SEQ ID NO: 6938139 - DNA, 22 bp, Homo sapiens
ctttcaaagagtaggaggtttt

SEQ ID NO: 6938140 - DNA, 21 bp, Homo sapiens
agaattaaattggatttgtgt

SEQ ID NO: 6938141 - DNA, 22 bp, Homo sapiens
ggcaggctttgagaaagagcat

SEQ ID NO: 6938142 - DNA, 22 bp, Homo sapiens
gctgtcccgaacccctggtaat

SEQ ID NO: 6938143 - DNA, 22 bp, Homo sapiens
tataagcacatccttgactgat

SEQ ID NO: 6938144 - DNA, 22 bp, Homo sapiens
gacattcaagtttgcagttagg

SEQ ID NO: 6938145 - DNA, 22 bp, Homo sapiens
tgacaggattggttgcttctga

SEQ ID NO: 6938146 - DNA, 22 bp, Homo sapiens
tgcagagctcttggcacttcag

SEQ ID NO: 6938147 - DNA, 22 bp, Homo sapiens
atgaagctaaaccctgcagcca

SEQ ID NO: 6938148 - DNA, 22 bp, Homo sapiens
ccagagccggattgtgaagtgc

SEQ ID NO: 6938149 - DNA, 22 bp, Homo sapiens
caggaaggcccacctgtcctgt

SEQ ID NO: 6938150 - DNA, 22 bp, Homo sapiens
tttatctgtagagcttcaccta

SEQ ID NO: 6938151 - DNA, 22 bp, Homo sapiens
agggctcagaaagcaggttttc

SEQ ID NO: 6938152 - DNA, 22 bp, Homo sapiens
ttgcactcaccacatttcaggt

SEQ ID NO: 6938153 - DNA, 22 bp, Homo sapiens
gctgttcccatgtggggctcag

SEQ ID NO: 6938154 - DNA, 18 bp, Homo sapiens
ctgaaggatccaggtgta

SEQ ID NO: 6938155 - DNA, 21 bp, Homo sapiens
tctctacaaattatgttaggt

SEQ ID NO: 6938156 - DNA, 23 bp, Homo sapiens
tgcatgtgattcatagagtccag

SEQ ID NO: 6938157 - DNA, 22 bp, Homo sapiens
tcctccaagcgtgggtgtttga

SEQ ID NO: 6938158 - DNA, 22 bp, Homo sapiens
tttagtgtttgcgtgtactcct

SEQ ID NO: 6938159 - DNA, 22 bp, Homo sapiens
ctgcagtttgaccttgttttct

SEQ ID NO: 6938160 - DNA, 22 bp, Homo sapiens
ttacagtcagtgaatggaaggg

SEQ ID NO: 6938161 - DNA, 22 bp, Homo sapiens
tcaggcattgtgcagagccttg

SEQ ID NO: 6938162 - DNA, 22 bp, Homo sapiens
aggctaagagcatttgctgaag

SEQ ID NO: 6938163 - DNA, 23 bp, Homo sapiens
tatgagaattaagtgcgagtgcc

SEQ ID NO: 6938164 - DNA, 22 bp, Homo sapiens
ttgcttagcgactccccttcct

SEQ ID NO: 6938165 - DNA, 22 bp, Homo sapiens
acactttacagaatgttttgat

SEQ ID NO: 6938166 - DNA, 22 bp, Homo sapiens
ggtgctgagagcctaggagggc

SEQ ID NO: 6938167 - DNA, 20 bp, Homo sapiens
gctgtcccaggccaaagggc

SEQ ID NO: 6938168 - DNA, 20 bp, Homo sapiens
gattcctctgagaactggag

SEQ ID NO: 6938169 - DNA, 22 bp, Homo sapiens
agggccagatgaagccacaagc

SEQ ID NO: 6938170 - DNA, 22 bp, Homo sapiens
ccaggagagcagaagcccaggc

SEQ ID NO: 6938171 - DNA, 22 bp, Homo sapiens
agacacccagtgattgagactt

SEQ ID NO: 6938172 - DNA, 22 bp, Homo sapiens
tgtccaggaattgaccctgcaa

SEQ ID NO: 6938173 - DNA, 23 bp, Homo sapiens
tggttcttatgattttactacca

SEQ ID NO: 6938174 - DNA, 22 bp, Homo sapiens
gaggctgaacaggttctcatga

SEQ ID NO: 6938175 - DNA, 22 bp, Homo sapiens
acagcagactttctacagctca

SEQ ID NO: 6938176 - DNA, 20 bp, Homo sapiens
tcaggtagatctttgaggtc

SEQ ID NO: 6938177 - DNA, 22 bp, Homo sapiens
gcagtcatgggtagaactcaag

SEQ ID NO: 6938178 - DNA, 21 bp, Homo sapiens
tgcaggaagtatggtgcctat

SEQ ID NO: 6938179 - DNA, 22 bp, Homo sapiens
actcttgtttgtagagcccacc

SEQ ID NO: 6938180 - DNA, 22 bp, Homo sapiens
atgcatatttcttgggcttacc

SEQ ID NO: 6938181 - DNA, 22 bp, Homo sapiens
gataatgttaagtcataggcta

SEQ ID NO: 6938182 - DNA, 22 bp, Homo sapiens
cccactctccatgaggttccca

SEQ ID NO: 6938183 - DNA, 22 bp, Homo sapiens
ctgtggctcatatctgtaatct

SEQ ID NO: 6938184 - DNA, 22 bp, Homo sapiens
aaatgttcccaatatgaagctg

SEQ ID NO: 6938185 - DNA, 22 bp, Homo sapiens
aggacttcttagatgccttccg

SEQ ID NO: 6938186 - DNA, 22 bp, Homo sapiens
acactggaaatagggaggtttt

SEQ ID NO: 6938187 - DNA, 22 bp, Homo sapiens
gggctgtgtaatgtgctctttt

SEQ ID NO: 6938188 - DNA, 22 bp, Homo sapiens
ccagggttataaatgcatctgt

SEQ ID NO: 6938189 - DNA, 22 bp, Homo sapiens
ttctgtatgccaatgggttttt

SEQ ID NO: 6938190 - DNA, 22 bp, Homo sapiens
tccttctttccccctagtcatt

SEQ ID NO: 6938191 - DNA, 22 bp, Homo sapiens
tctatgtcagcatctttctacc

SEQ ID NO: 6938192 - DNA, 22 bp, Homo sapiens
agtgtgctattgcaccatcata

SEQ ID NO: 6938193 - DNA, 22 bp, Homo sapiens
actccaggggttgctatttaca

SEQ ID NO: 6938194 - DNA, 22 bp, Homo sapiens
aaagatctgacttagacacaga

SEQ ID NO: 6938195 - DNA, 22 bp, Homo sapiens
ttaagtgcaaaaatgaaagtat

SEQ ID NO: 6938196 - DNA, 22 bp, Homo sapiens
tgtaaggacaacaggagaaaaa

SEQ ID NO: 6938197 - DNA, 22 bp, Homo sapiens
acccagggctcaagcgtaggca

SEQ ID NO: 6938198 - DNA, 22 bp, Homo sapiens
aggctctgcatccaggctttat

SEQ ID NO: 6938199 - DNA, 22 bp, Homo sapiens
aaagatacttaatagttgtctg

SEQ ID NO: 6938200 - DNA, 22 bp, Homo sapiens
ggctgtgcctcaaggctactca

SEQ ID NO: 6938201 - DNA, 22 bp, Homo sapiens
aattcacagttctgcaccttac

SEQ ID NO: 6938202 - DNA, 22 bp, Homo sapiens
attgagcacatactgtgggcca

SEQ ID NO: 6938203 - DNA, 22 bp, Homo sapiens
tctgggctttgtaatgggaggt

SEQ ID NO: 6938204 - DNA, 22 bp, Homo sapiens
atacttgatggtgtctgtcaaa

SEQ ID NO: 6938205 - DNA, 22 bp, Homo sapiens
atgtgtatccatctgtctattt

SEQ ID NO: 6938206 - DNA, 22 bp, Homo sapiens
cagcctctgagccttggcagat

SEQ ID NO: 6938207 - DNA, 22 bp, Homo sapiens
tggccagaaggtttaaaagagg

SEQ ID NO: 6938208 - DNA, 22 bp, Homo sapiens
gccacttctgcctggcagggcc

SEQ ID NO: 6938209 - DNA, 22 bp, Homo sapiens
ttctagggatctgctgctgttt

SEQ ID NO: 6938210 - DNA, 22 bp, Homo sapiens
cctccttctggggccttctgct

SEQ ID NO: 6938211 - DNA, 22 bp, Homo sapiens
aggctctcactatcctcctagc

SEQ ID NO: 6938212 - DNA, 22 bp, Homo sapiens
tcagtcttttgccctgaggagt

SEQ ID NO: 6938213 - DNA, 22 bp, Homo sapiens
cttgcaggcctttctagctcta

SEQ ID NO: 6938214 - DNA, 22 bp, Homo sapiens
cagcaagccaaatgtggcccga

SEQ ID NO: 6938215 - DNA, 17 bp, Homo sapiens
tatgtgtgtttgcagca

SEQ ID NO: 6938216 - DNA, 21 bp, Homo sapiens
ggcagcactacctgaagcata

SEQ ID NO: 6938217 - DNA, 22 bp, Homo sapiens
ttgccagatggcgctgttgctc

SEQ ID NO: 6938218 - DNA, 22 bp, Homo sapiens
ttgtgaaacattcatggatttg

SEQ ID NO: 6938219 - DNA, 22 bp, Homo sapiens
ctgctgggtctatgcaagtgga

SEQ ID NO: 6938220 - DNA, 22 bp, Homo sapiens
ctgttgtctcctctcagattat

SEQ ID NO: 6938221 - DNA, 22 bp, Homo sapiens
ttgcttgcttctattttataca

SEQ ID NO: 6938222 - DNA, 22 bp, Homo sapiens
ctttagtttaagaacatgatga

SEQ ID NO: 6938223 - DNA, 22 bp, Homo sapiens
ctccacccaaatctcaccttga

SEQ ID NO: 6938224 - DNA, 22 bp, Homo sapiens
gccaataaatggaaaagatgga

SEQ ID NO: 6938225 - DNA, 18 bp, Homo sapiens
ttttaatttcaggggtgg

SEQ ID NO: 6938226 - DNA, 21 bp, Homo sapiens
aagtcagtcagttctatacta

SEQ ID NO: 6938227 - DNA, 22 bp, Homo sapiens
aaaactctgcagttagtttcta

SEQ ID NO: 6938228 - DNA, 22 bp, Homo sapiens
agggagctcacagtccagtaga

SEQ ID NO: 6938229 - DNA, 22 bp, Homo sapiens
ttgactgttaagacttggctct

SEQ ID NO: 6938230 - DNA, 22 bp, Homo sapiens
tgcaaacagttaagatgcaggc

SEQ ID NO: 6938231 - DNA, 22 bp, Homo sapiens
ggaagctggacaggctttgagt

SEQ ID NO: 6938232 - DNA, 22 bp, Homo sapiens
atgtacacatacagtggagtgg

SEQ ID NO: 6938233 - DNA, 22 bp, Homo sapiens
tcctgtgctgttaatagtgata

SEQ ID NO: 6938234 - DNA, 22 bp, Homo sapiens
gggggcagaatgtactcttgtc

SEQ ID NO: 6938235 - DNA, 22 bp, Homo sapiens
gaagtgtagtcttgagccccca

SEQ ID NO: 6938236 - DNA, 22 bp, Homo sapiens
aggacagttagttaggaagttt

SEQ ID NO: 6938237 - DNA, 22 bp, Homo sapiens
agagcatcaccgttacccactt

SEQ ID NO: 6938238 - DNA, 22 bp, Homo sapiens
aaaagcatctcaaaggagcttc

SEQ ID NO: 6938239 - DNA, 22 bp, Homo sapiens
acagcagcctgcagccctgtgt

SEQ ID NO: 6938240 - DNA, 22 bp, Homo sapiens
tagacatttgtcaagaatgact

SEQ ID NO: 6938241 - DNA, 22 bp, Homo sapiens
tctggaaatggaagtaactatg

SEQ ID NO: 6938242 - DNA, 22 bp, Homo sapiens
ttcctgtattctaaagggaaag

SEQ ID NO: 6938243 - DNA, 22 bp, Homo sapiens
caagagctcccagacctgggca

SEQ ID NO: 6938244 - DNA, 22 bp, Homo sapiens
cttctgcaagagcatcagttgt

SEQ ID NO: 6938245 - DNA, 23 bp, Homo sapiens
tggctactttatgaggttgagga

SEQ ID NO: 6938246 - DNA, 22 bp, Homo sapiens
tcttgggagtcccaggacatag

SEQ ID NO: 6938247 - DNA, 22 bp, Homo sapiens
ggttctcttcctcctgactgag

SEQ ID NO: 6938248 - DNA, 19 bp, Homo sapiens
tggtccagcttcttctcct

SEQ ID NO: 6938249 - DNA, 22 bp, Homo sapiens
ctgaagcatatcatgccaagtt

SEQ ID NO: 6938250 - DNA, 22 bp, Homo sapiens
tgcattccacagaagggaaaac

SEQ ID NO: 6938251 - DNA, 18 bp, Homo sapiens
ggggtgcccagactgtct

SEQ ID NO: 6938252 - DNA, 22 bp, Homo sapiens
agctgcctggagccagagttga

SEQ ID NO: 6938253 - DNA, 22 bp, Homo sapiens
ctgctctaatatcagatagact

SEQ ID NO: 6938254 - DNA, 21 bp, Homo sapiens
ttgtagcttgttagaccatgt

SEQ ID NO: 6938255 - DNA, 22 bp, Homo sapiens
tttgtgtgtatatgtatataga

SEQ ID NO: 6938256 - DNA, 22 bp, Homo sapiens
cagtgcaggctgggggccctgc

SEQ ID NO: 6938257 - DNA, 19 bp, Homo sapiens
gctcagagacacctgttgc

SEQ ID NO: 6938258 - DNA, 22 bp, Homo sapiens
caggtgggcgtggcgagaaggc

SEQ ID NO: 6938259 - DNA, 22 bp, Homo sapiens
caaggctggagtgtaatggcat

SEQ ID NO: 6938260 - DNA, 22 bp, Homo sapiens
tcatgcaaatactgttccagaa

SEQ ID NO: 6938261 - DNA, 22 bp, Homo sapiens
agagatgtcgccttgcccaggg

SEQ ID NO: 6938262 - DNA, 22 bp, Homo sapiens
cagtcttccactgtcccgcctc

SEQ ID NO: 6938263 - DNA, 22 bp, Homo sapiens
tgctggcacgtgactgggaagt

SEQ ID NO: 6938264 - DNA, 22 bp, Homo sapiens
atgcatgtggatagacggagat

SEQ ID NO: 6938265 - DNA, 22 bp, Homo sapiens
cccaggtagtgagaaatggagg

SEQ ID NO: 6938266 - DNA, 22 bp, Homo sapiens
gtggctgcagcggctgtggaga

SEQ ID NO: 6938267 - DNA, 19 bp, Homo sapiens
acagggctctggacgccat

SEQ ID NO: 6938268 - DNA, 22 bp, Homo sapiens
agtgctcctttcattgctgccc

SEQ ID NO: 6938269 - DNA, 22 bp, Homo sapiens
attcaagtacagttttcttctt

SEQ ID NO: 6938270 - DNA, 22 bp, Homo sapiens
atcagaggaagacgacggaatg

SEQ ID NO: 6938271 - DNA, 22 bp, Homo sapiens
tgggtcccttcagctctcatgg

SEQ ID NO: 6938272 - DNA, 22 bp, Homo sapiens
agttttatgtagacaattcatt

SEQ ID NO: 6938273 - DNA, 22 bp, Homo sapiens
tggcctgcctgggagcagcagg

SEQ ID NO: 6938274 - DNA, 22 bp, Homo sapiens
atcatgaatcttgtgttctatg

SEQ ID NO: 6938275 - DNA, 19 bp, Homo sapiens
ttactcgagaatgactaca

SEQ ID NO: 6938276 - DNA, 20 bp, Homo sapiens
tttctgtagctcagtattca

SEQ ID NO: 6938277 - DNA, 22 bp, Homo sapiens
tacacagcctgtaatgatgact

SEQ ID NO: 6938278 - DNA, 22 bp, Homo sapiens
tactgccttggtaggaataacc

SEQ ID NO: 6938279 - DNA, 22 bp, Homo sapiens
caggcagtgtcccaggaagcca

SEQ ID NO: 6938280 - DNA, 22 bp, Homo sapiens
ctgggcagtggtggcatctttg

SEQ ID NO: 6938281 - DNA, 22 bp, Homo sapiens
gtctcagagagctactctctta

SEQ ID NO: 6938282 - DNA, 22 bp, Homo sapiens
gcagctctctggcctgccctgg

SEQ ID NO: 6938283 - DNA, 22 bp, Homo sapiens
ctaaggaagtgacagtgggatt

SEQ ID NO: 6938284 - DNA, 22 bp, Homo sapiens
ctggagcttattgggagcagaa

SEQ ID NO: 6938285 - DNA, 23 bp, Homo sapiens
tcaagcaataattggtaatagtg

SEQ ID NO: 6938286 - DNA, 22 bp, Homo sapiens
aatgttgttggtatcctaccca

SEQ ID NO: 6938287 - DNA, 22 bp, Homo sapiens
gcattgtcaaaagtggtatgac

SEQ ID NO: 6938288 - DNA, 22 bp, Homo sapiens
tgggagcagttcaggtgtggct

SEQ ID NO: 6938289 - DNA, 22 bp, Homo sapiens
gggcccagccctctgctcactg

SEQ ID NO: 6938290 - DNA, 22 bp, Homo sapiens
gccatgtcctgggcatctgcca

SEQ ID NO: 6938291 - DNA, 22 bp, Homo sapiens
gttctattccccttatctgtga

SEQ ID NO: 6938292 - DNA, 22 bp, Homo sapiens
ctgctgctgctatctacccagg

SEQ ID NO: 6938293 - DNA, 20 bp, Homo sapiens
tgcttcctggccactgcggg

SEQ ID NO: 6938294 - DNA, 22 bp, Homo sapiens
tgggggaactgttgcgcgcggg

SEQ ID NO: 6938295 - DNA, 22 bp, Homo sapiens
ttgtaatttttcatggtatcac

SEQ ID NO: 6938296 - DNA, 22 bp, Homo sapiens
ggcatgagtggcagtgggcagt

SEQ ID NO: 6938297 - DNA, 22 bp, Homo sapiens
gaagcagtttctgtaatgaaat

SEQ ID NO: 6938298 - DNA, 19 bp, Homo sapiens
tagtggagtgacaagttct

SEQ ID NO: 6938299 - DNA, 22 bp, Homo sapiens
gaggaaaatgggacaggctgta

SEQ ID NO: 6938300 - DNA, 22 bp, Homo sapiens
gctctggatccggctgggtctg

SEQ ID NO: 6938301 - DNA, 22 bp, Homo sapiens
ggtgcagtgcagggtaattata

SEQ ID NO: 6938302 - DNA, 22 bp, Homo sapiens
gatttctttgtacccacaatcc

SEQ ID NO: 6938303 - DNA, 22 bp, Homo sapiens
attgaacttaacagtaagtggc

SEQ ID NO: 6938304 - DNA, 22 bp, Homo sapiens
ttagaaacccagactcttaggt

SEQ ID NO: 6938305 - DNA, 22 bp, Homo sapiens
aggtcaaggttcacaggggatc

SEQ ID NO: 6938306 - DNA, 23 bp, Homo sapiens
tggacagcagcagcagtgtcacc

SEQ ID NO: 6938307 - DNA, 22 bp, Homo sapiens
tagataacagcactggcctcgc

SEQ ID NO: 6938308 - DNA, 22 bp, Homo sapiens
tgcaggagcagagatggctgga

SEQ ID NO: 6938309 - DNA, 22 bp, Homo sapiens
tctggcaggggttctgcacttg

SEQ ID NO: 6938310 - DNA, 22 bp, Homo sapiens
ccagcactgttctaaggaaaca

SEQ ID NO: 6938311 - DNA, 22 bp, Homo sapiens
attagcaaaacaacttttctat

SEQ ID NO: 6938312 - DNA, 22 bp, Homo sapiens
tctgacagtgtgaatattgact

SEQ ID NO: 6938313 - DNA, 22 bp, Homo sapiens
tccaagaatacagatttgtgaa

SEQ ID NO: 6938314 - DNA, 19 bp, Homo sapiens
tcccaggcaaaggcttctc

SEQ ID NO: 6938315 - DNA, 22 bp, Homo sapiens
ttcatcttgatggcttcctaat

SEQ ID NO: 6938316 - DNA, 22 bp, Homo sapiens
atactgaaaataagtgagttga

SEQ ID NO: 6938317 - DNA, 22 bp, Homo sapiens
ctggctgcgctagtccagaaga

SEQ ID NO: 6938318 - DNA, 22 bp, Homo sapiens
tgtaattaacgttcttgttaga

SEQ ID NO: 6938319 - DNA, 22 bp, Homo sapiens
atcaagttctgtcacatttgtc

SEQ ID NO: 6938320 - DNA, 22 bp, Homo sapiens
atgcatgtaggctaaggtgtgt

SEQ ID NO: 6938321 - DNA, 22 bp, Homo sapiens
tctgggcagagggtcttagtca

SEQ ID NO: 6938322 - DNA, 22 bp, Homo sapiens
gctgagcaggtttgatgctttt

SEQ ID NO: 6938323 - DNA, 22 bp, Homo sapiens
catctttatttatatagacagg

SEQ ID NO: 6938324 - DNA, 22 bp, Homo sapiens
gtcaaatgcacagaaccattaa

SEQ ID NO: 6938325 - DNA, 22 bp, Homo sapiens
tttacaacccaagtccagagag

SEQ ID NO: 6938326 - DNA, 22 bp, Homo sapiens
tttcagaaatcaaaaccagggt

SEQ ID NO: 6938327 - DNA, 21 bp, Homo sapiens
cagtgcaggggttagcgtgta

SEQ ID NO: 6938328 - DNA, 22 bp, Homo sapiens
aaagctggttattctgaggcag

SEQ ID NO: 6938329 - DNA, 22 bp, Homo sapiens
acatggaatgtgtactaagtta

SEQ ID NO: 6938330 - DNA, 22 bp, Homo sapiens
tgaggaatgctgagcagaggaa

SEQ ID NO: 6938331 - DNA, 22 bp, Homo sapiens
tcatagaagcaccagaagatat

SEQ ID NO: 6938332 - DNA, 22 bp, Homo sapiens
ccttttctgtgtgggtaattta

SEQ ID NO: 6938333 - DNA, 22 bp, Homo sapiens
taagatggtccagaagggaggc

SEQ ID NO: 6938334 - DNA, 22 bp, Homo sapiens
tctgtggcttgggcctgcctgt

SEQ ID NO: 6938335 - DNA, 22 bp, Homo sapiens
ttttagttactgcagtagcaaa

SEQ ID NO: 6938336 - DNA, 19 bp, Homo sapiens
catatttttgggctggcat

SEQ ID NO: 6938337 - DNA, 22 bp, Homo sapiens
gtccacttggcacaaggcactt

SEQ ID NO: 6938338 - DNA, 22 bp, Homo sapiens
aaggaggttatcccagtggact

SEQ ID NO: 6938339 - DNA, 22 bp, Homo sapiens
tccaggctagagtgcagtggcc

SEQ ID NO: 6938340 - DNA, 21 bp, Homo sapiens
tttgagaattggtcagagtgc

SEQ ID NO: 6938341 - DNA, 22 bp, Homo sapiens
aataagttgcctgttgaatcat

SEQ ID NO: 6938342 - DNA, 22 bp, Homo sapiens
agaacatctgaagatacaaagt

SEQ ID NO: 6938343 - DNA, 22 bp, Homo sapiens
acacagagctggaactgcttca

SEQ ID NO: 6938344 - DNA, 22 bp, Homo sapiens
aggcttggctggcagccctggg

SEQ ID NO: 6938345 - DNA, 22 bp, Homo sapiens
gcattagaagggacctctgggg

SEQ ID NO: 6938346 - DNA, 22 bp, Homo sapiens
gattgcaaatcattacaaagga

SEQ ID NO: 6938347 - DNA, 22 bp, Homo sapiens
ctgctccacctccgggtcaggc

SEQ ID NO: 6938348 - DNA, 22 bp, Homo sapiens
gcagtcatggaaaaatgtatac

SEQ ID NO: 6938349 - DNA, 22 bp, Homo sapiens
gtgactgtgatcttatttgcaa

SEQ ID NO: 6938350 - DNA, 22 bp, Homo sapiens
ttaaaatagccagtgcccctct

SEQ ID NO: 6938351 - DNA, 22 bp, Homo sapiens
gaagtatagcagatgttattta

SEQ ID NO: 6938352 - DNA, 22 bp, Homo sapiens
atgaggcaggaaaggcgtatct

SEQ ID NO: 6938353 - DNA, 18 bp, Homo sapiens
ggctggaagctgttgctg

SEQ ID NO: 6938354 - DNA, 19 bp, Homo sapiens
ctttggagtcttttactct

SEQ ID NO: 6938355 - DNA, 22 bp, Homo sapiens
ttgcagttgctttctatattga

SEQ ID NO: 6938356 - DNA, 22 bp, Homo sapiens
aggcacagatttggggaaagca

SEQ ID NO: 6938357 - DNA, 22 bp, Homo sapiens
catctcttcattagcattattg

SEQ ID NO: 6938358 - DNA, 22 bp, Homo sapiens
aatgaacagtgggtgaggtacc

SEQ ID NO: 6938359 - DNA, 22 bp, Homo sapiens
gaagagaagcatcaataggtaa

SEQ ID NO: 6938360 - DNA, 22 bp, Homo sapiens
cagtttattgttgcgttcacat

SEQ ID NO: 6938361 - DNA, 22 bp, Homo sapiens
gtttgcatttcttgaactatat

SEQ ID NO: 6938362 - DNA, 22 bp, Homo sapiens
cagcacattgatcagagacgct

SEQ ID NO: 6938363 - DNA, 22 bp, Homo sapiens
ggtccagtcagatattcatgca

SEQ ID NO: 6938364 - DNA, 22 bp, Homo sapiens
tgggctcagcctcagtctgtgg

SEQ ID NO: 6938365 - DNA, 23 bp, Homo sapiens
taggcaggactcagatatgacag

SEQ ID NO: 6938366 - DNA, 22 bp, Homo sapiens
aagtctggaacctcatgctggc

SEQ ID NO: 6938367 - DNA, 22 bp, Homo sapiens
gccctcgggctgccctaggctg

SEQ ID NO: 6938368 - DNA, 22 bp, Homo sapiens
tttaatgcaatttctggtctgc

SEQ ID NO: 6938369 - DNA, 22 bp, Homo sapiens
agggctcaccactgtgcactcc

SEQ ID NO: 6938370 - DNA, 20 bp, Homo sapiens
tgctggggacatacagggtg

SEQ ID NO: 6938371 - DNA, 22 bp, Homo sapiens
caatggctctagagggttgtgt

SEQ ID NO: 6938372 - DNA, 22 bp, Homo sapiens
ggggagctgagacactgccctc

SEQ ID NO: 6938373 - DNA, 20 bp, Homo sapiens
agcctgctgtagaagtttgg

SEQ ID NO: 6938374 - DNA, 22 bp, Homo sapiens
ctcaggcttgggaggaggccca

SEQ ID NO: 6938375 - DNA, 22 bp, Homo sapiens
ctgggctggacacacttaacct

SEQ ID NO: 6938376 - DNA, 22 bp, Homo sapiens
attcactaggttgcaaaactgt

SEQ ID NO: 6938377 - DNA, 22 bp, Homo sapiens
aatgtgtagcatttaatgcagt

SEQ ID NO: 6938378 - DNA, 22 bp, Homo sapiens
ctgaaggatgtgtggtgggagt

SEQ ID NO: 6938379 - DNA, 22 bp, Homo sapiens
ctaaactgctctggggttctaa

SEQ ID NO: 6938380 - DNA, 22 bp, Homo sapiens
ttctgggcagagctggagctgc

SEQ ID NO: 6938381 - DNA, 22 bp, Homo sapiens
gtcacagagttattaattgtgt

SEQ ID NO: 6938382 - DNA, 20 bp, Homo sapiens
tgtgtcaggccctgattaaa

SEQ ID NO: 6938383 - DNA, 22 bp, Homo sapiens
aacagtgagttgatgactgaat

SEQ ID NO: 6938384 - DNA, 22 bp, Homo sapiens
atgatggtgggagatgacccag

SEQ ID NO: 6938385 - DNA, 22 bp, Homo sapiens
tgaggggccgcccaagcacttc

SEQ ID NO: 6938386 - DNA, 23 bp, Homo sapiens
tcctccagaggccctccttggcc

SEQ ID NO: 6938387 - DNA, 22 bp, Homo sapiens
cagcaggtgcaggtgcggccgc

SEQ ID NO: 6938388 - DNA, 22 bp, Homo sapiens
atctttacagtgtaagtgcaga

SEQ ID NO: 6938389 - DNA, 22 bp, Homo sapiens
cccttggggtggaggttgcagt

SEQ ID NO: 6938390 - DNA, 22 bp, Homo sapiens
acactaattaagctgctttact

SEQ ID NO: 6938391 - DNA, 22 bp, Homo sapiens
atgggtccctggccgccctcgg

SEQ ID NO: 6938392 - DNA, 22 bp, Homo sapiens
caaatgtatgttttcctatgta

SEQ ID NO: 6938393 - DNA, 22 bp, Homo sapiens
tagtaatgatattttgattatg

SEQ ID NO: 6938394 - DNA, 22 bp, Homo sapiens
acaggcaatatataaattatga

SEQ ID NO: 6938395 - DNA, 22 bp, Homo sapiens
agaggggagagctaagcaattc

SEQ ID NO: 6938396 - DNA, 20 bp, Homo sapiens
tgcagggctgcctcccagct

SEQ ID NO: 6938397 - DNA, 22 bp, Homo sapiens
ctccaggcccctggccttctgc

SEQ ID NO: 6938398 - DNA, 22 bp, Homo sapiens
gggttaaagagcccaatgtatg

SEQ ID NO: 6938399 - DNA, 19 bp, Homo sapiens
tgctctggagccagctctc

SEQ ID NO: 6938400 - DNA, 22 bp, Homo sapiens
tctggaatgtagtgagttcctg

SEQ ID NO: 6938401 - DNA, 23 bp, Homo sapiens
ttacttttgcaccaacctaatat

SEQ ID NO: 6938402 - DNA, 22 bp, Homo sapiens
gtgaaaagcaacattgtggacc

SEQ ID NO: 6938403 - DNA, 23 bp, Homo sapiens
ggaccctgtggagggtgagagtc

SEQ ID NO: 6938404 - DNA, 22 bp, Homo sapiens
ttccagagttgggggagtggtt

SEQ ID NO: 6938405 - DNA, 22 bp, Homo sapiens
ctggataaatgtttgctttaga

SEQ ID NO: 6938406 - DNA, 22 bp, Homo sapiens
cccatgactctcattcacagtc

SEQ ID NO: 6938407 - DNA, 22 bp, Homo sapiens
ttatattagttagacttgctgt

SEQ ID NO: 6938408 - DNA, 19 bp, Homo sapiens
atgagcaggcaagacaagc

SEQ ID NO: 6938409 - DNA, 21 bp, Homo sapiens
acctttgagagcccctagtga

SEQ ID NO: 6938410 - DNA, 21 bp, Homo sapiens
ggatgccacgaagcaccagga

SEQ ID NO: 6938411 - DNA, 22 bp, Homo sapiens
caggagactcagcatccaggat

SEQ ID NO: 6938412 - DNA, 22 bp, Homo sapiens
atggtctgatgtcccatggctt

SEQ ID NO: 6938413 - DNA, 22 bp, Homo sapiens
ttgcaaattattttagtccctt

SEQ ID NO: 6938414 - DNA, 22 bp, Homo sapiens
tgccctcctcctgagcccatgt

SEQ ID NO: 6938415 - DNA, 20 bp, Homo sapiens
cctgcctgcctcggctcatt

SEQ ID NO: 6938416 - DNA, 22 bp, Homo sapiens
agaccctgtatgtgtttagttt

SEQ ID NO: 6938417 - DNA, 22 bp, Homo sapiens
aagtaaaccacagagaagccac

SEQ ID NO: 6938418 - DNA, 22 bp, Homo sapiens
ggctgcaggcagggtatccact

SEQ ID NO: 6938419 - DNA, 22 bp, Homo sapiens
attgagaatatgatttagtata

SEQ ID NO: 6938420 - DNA, 22 bp, Homo sapiens
aggaggcctacgcacatgtcta

SEQ ID NO: 6938421 - DNA, 22 bp, Homo sapiens
agctgagaggtggcaagctgta

SEQ ID NO: 6938422 - DNA, 22 bp, Homo sapiens
cacattgcagacgtatattatt

SEQ ID NO: 6938423 - DNA, 22 bp, Homo sapiens
tacatactccataatgacagca

SEQ ID NO: 6938424 - DNA, 22 bp, Homo sapiens
ttcctccttgtcctagttactg

SEQ ID NO: 6938425 - DNA, 22 bp, Homo sapiens
tgaagcaggatcgtttgcttca

SEQ ID NO: 6938426 - DNA, 22 bp, Homo sapiens
tggcactgaaaaaggagaggtt

SEQ ID NO: 6938427 - DNA, 21 bp, Homo sapiens
acaatagaatagagtgtggtg

SEQ ID NO: 6938428 - DNA, 22 bp, Homo sapiens
agggagaggttgaaacctcagt

SEQ ID NO: 6938429 - DNA, 22 bp, Homo sapiens
tcataggctaaggatttttccc

SEQ ID NO: 6938430 - DNA, 22 bp, Homo sapiens
ggaaagagctaaaagggtgaga

SEQ ID NO: 6938431 - DNA, 21 bp, Homo sapiens
ttctgcattaaggtggagata

SEQ ID NO: 6938432 - DNA, 22 bp, Homo sapiens
aagttctatatctgcctcacca

SEQ ID NO: 6938433 - DNA, 22 bp, Homo sapiens
ttggctgggcacagtgtctcat

SEQ ID NO: 6938434 - DNA, 22 bp, Homo sapiens
tggaggtctgcaaggcgctgga

SEQ ID NO: 6938435 - DNA, 22 bp, Homo sapiens
gacaaagctttggcatccttac

SEQ ID NO: 6938436 - DNA, 22 bp, Homo sapiens
ctgctgtgagtttggaggtcta

SEQ ID NO: 6938437 - DNA, 22 bp, Homo sapiens
tccagctgtgctccaggaggtg

SEQ ID NO: 6938438 - DNA, 22 bp, Homo sapiens
tccaaggagcagtcttcaacct

SEQ ID NO: 6938439 - DNA, 22 bp, Homo sapiens
gatttctaaggaggctgaactt

SEQ ID NO: 6938440 - DNA, 22 bp, Homo sapiens
tctttgtcattaaactagtaac

SEQ ID NO: 6938441 - DNA, 22 bp, Homo sapiens
tgtcaggcaaaggaaggtattt

SEQ ID NO: 6938442 - DNA, 22 bp, Homo sapiens
tctcatttgtgtgcaattcaga

SEQ ID NO: 6938443 - DNA, 22 bp, Homo sapiens
cacagtggctttgctggtctcg

SEQ ID NO: 6938444 - DNA, 22 bp, Homo sapiens
attgctcagcacaagcagcaga

SEQ ID NO: 6938445 - DNA, 22 bp, Homo sapiens
tttgacatcaataccctagaat

SEQ ID NO: 6938446 - DNA, 22 bp, Homo sapiens
cagaggtgctggagtgagtcct

SEQ ID NO: 6938447 - DNA, 22 bp, Homo sapiens
tcactttaatgatttgtagaat

SEQ ID NO: 6938448 - DNA, 22 bp, Homo sapiens
gtgcgcttcttcctgagccagg

SEQ ID NO: 6938449 - DNA, 22 bp, Homo sapiens
tgtcttaatatgtgcattctgt

SEQ ID NO: 6938450 - DNA, 22 bp, Homo sapiens
tgatctcctgaccttgtaatcc

SEQ ID NO: 6938451 - DNA, 22 bp, Homo sapiens
caggaatgtatgatacagtggt

SEQ ID NO: 6938452 - DNA, 22 bp, Homo sapiens
tgtggctggattgattttacct

SEQ ID NO: 6938453 - DNA, 22 bp, Homo sapiens
tgtgcagagttgaagacaggag

SEQ ID NO: 6938454 - DNA, 22 bp, Homo sapiens
cctgtgtccagttccaggttgt

SEQ ID NO: 6938455 - DNA, 22 bp, Homo sapiens
aggtcctggactgctcttgtta

SEQ ID NO: 6938456 - DNA, 22 bp, Homo sapiens
tgccctgctaaccttggttcca

SEQ ID NO: 6938457 - DNA, 22 bp, Homo sapiens
tcctcagagcagccctccgcat

SEQ ID NO: 6938458 - DNA, 22 bp, Homo sapiens
aggtgactggtttatctggcag

SEQ ID NO: 6938459 - DNA, 21 bp, Homo sapiens
agaagagaagcaggaccctct

SEQ ID NO: 6938460 - DNA, 22 bp, Homo sapiens
gctacccagagcctcaccctgt

SEQ ID NO: 6938461 - DNA, 17 bp, Homo sapiens
gcaccgtgggcacactc

SEQ ID NO: 6938462 - DNA, 22 bp, Homo sapiens
tatgaagattgcggtctggaat

SEQ ID NO: 6938463 - DNA, 20 bp, Homo sapiens
tttattcacagagaagagtt

SEQ ID NO: 6938464 - DNA, 22 bp, Homo sapiens
tccctgagcttctctgaaatgg

SEQ ID NO: 6938465 - DNA, 22 bp, Homo sapiens
gtgctgaggtgggtgggcagcc

SEQ ID NO: 6938466 - DNA, 22 bp, Homo sapiens
ccagatgaggtcatgctgggtt

SEQ ID NO: 6938467 - DNA, 22 bp, Homo sapiens
tggggcctgaggtggagctgca

SEQ ID NO: 6938468 - DNA, 22 bp, Homo sapiens
aatttcactgtggagcacattt

SEQ ID NO: 6938469 - DNA, 22 bp, Homo sapiens
tgcctgcaagagttggggctac

SEQ ID NO: 6938470 - DNA, 22 bp, Homo sapiens
actgtagagaatctgagaaaaa

SEQ ID NO: 6938471 - DNA, 22 bp, Homo sapiens
gcaatacagaagagtggcaagg

SEQ ID NO: 6938472 - DNA, 22 bp, Homo sapiens
aaatactgttttattccatgat

SEQ ID NO: 6938473 - DNA, 22 bp, Homo sapiens
atacgtgctgttttaagataca

SEQ ID NO: 6938474 - DNA, 22 bp, Homo sapiens
ctggtaggggtgactgttatcg

SEQ ID NO: 6938475 - DNA, 22 bp, Homo sapiens
gctgtcacatttggagcactgg

SEQ ID NO: 6938476 - DNA, 22 bp, Homo sapiens
caaagtcataaaacttgtaagt

SEQ ID NO: 6938477 - DNA, 22 bp, Homo sapiens
tggcttctctggcatccccatc

SEQ ID NO: 6938478 - DNA, 22 bp, Homo sapiens
tcatttactggatccataagca

SEQ ID NO: 6938479 - DNA, 22 bp, Homo sapiens
ccacagtagaattcatctccct

SEQ ID NO: 6938480 - DNA, 22 bp, Homo sapiens
tggtctgattccacctaactga

SEQ ID NO: 6938481 - DNA, 22 bp, Homo sapiens
attcgacaaccttgttttgtac

SEQ ID NO: 6938482 - DNA, 22 bp, Homo sapiens
tggcaggtgccatgggctcaga

SEQ ID NO: 6938483 - DNA, 21 bp, Homo sapiens
cacattgttccaggtttgggt

SEQ ID NO: 6938484 - DNA, 22 bp, Homo sapiens
tgaacaggcattatcagggatc

SEQ ID NO: 6938485 - DNA, 22 bp, Homo sapiens
accagctgcctggtctatctgc

SEQ ID NO: 6938486 - DNA, 21 bp, Homo sapiens
tgcattctagcagctctgagg

SEQ ID NO: 6938487 - DNA, 22 bp, Homo sapiens
ctcagacatctgaaatgggtta

SEQ ID NO: 6938488 - DNA, 22 bp, Homo sapiens
tcagtattgctagagttcactg

SEQ ID NO: 6938489 - DNA, 22 bp, Homo sapiens
ctgggttacaagaagcaaaaac

SEQ ID NO: 6938490 - DNA, 22 bp, Homo sapiens
cctgttcacggtgtgttgttag

SEQ ID NO: 6938491 - DNA, 21 bp, Homo sapiens
tgacttcctaatcgccagctg

SEQ ID NO: 6938492 - DNA, 19 bp, Homo sapiens
tcccaagatttctgtatca

SEQ ID NO: 6938493 - DNA, 22 bp, Homo sapiens
tggcagctgaggggaggctttg

SEQ ID NO: 6938494 - DNA, 22 bp, Homo sapiens
tagctgtttgaagtatttttct

SEQ ID NO: 6938495 - DNA, 22 bp, Homo sapiens
actctgtagatctcccgggagc

SEQ ID NO: 6938496 - DNA, 22 bp, Homo sapiens
gagatatttattcatactgtca

SEQ ID NO: 6938497 - DNA, 22 bp, Homo sapiens
caggctccattaatcatcctgc

SEQ ID NO: 6938498 - DNA, 22 bp, Homo sapiens
atggaattaaaagtcaagtaat

SEQ ID NO: 6938499 - DNA, 22 bp, Homo sapiens
tagtaataagttgtgctttgat

SEQ ID NO: 6938500 - DNA, 22 bp, Homo sapiens
tatgggtaggcctgccgcctgt

SEQ ID NO: 6938501 - DNA, 22 bp, Homo sapiens
caggttagcaacatggttagag

SEQ ID NO: 6938502 - DNA, 18 bp, Homo sapiens
gctttctgtgcagcggag

SEQ ID NO: 6938503 - DNA, 23 bp, Homo sapiens
agttccagaaaaatgctcaagca

SEQ ID NO: 6938504 - DNA, 22 bp, Homo sapiens
tggcatgtggcaatgttgggat

SEQ ID NO: 6938505 - DNA, 22 bp, Homo sapiens
agtcccagtgagatgagccacg

SEQ ID NO: 6938506 - DNA, 22 bp, Homo sapiens
ctatggaaacctaatcaggaga

SEQ ID NO: 6938507 - DNA, 22 bp, Homo sapiens
tcctctggctctttccctagga

SEQ ID NO: 6938508 - DNA, 22 bp, Homo sapiens
gaggatgctgcagtgcaggaca

SEQ ID NO: 6938509 - DNA, 22 bp, Homo sapiens
aaagcacttgaaatctggcagt

SEQ ID NO: 6938510 - DNA, 22 bp, Homo sapiens
attctgatgcttcacaaaggta

SEQ ID NO: 6938511 - DNA, 22 bp, Homo sapiens
aaagtcaggctgtgtacctaac

SEQ ID NO: 6938512 - DNA, 18 bp, Homo sapiens
taggaaatagggctgtga

SEQ ID NO: 6938513 - DNA, 22 bp, Homo sapiens
ctggcacatgctccctgagtgg

SEQ ID NO: 6938514 - DNA, 22 bp, Homo sapiens
aacagggctttggaagtctccg

SEQ ID NO: 6938515 - DNA, 19 bp, Homo sapiens
agtgagaacatgtgcacac

SEQ ID NO: 6938516 - DNA, 22 bp, Homo sapiens
tttgctgaactaaaattctgaa

SEQ ID NO: 6938517 - DNA, 22 bp, Homo sapiens
aattaattcagtttttaaggga

SEQ ID NO: 6938518 - DNA, 22 bp, Homo sapiens
aactgcataatatatcatgcag

SEQ ID NO: 6938519 - DNA, 19 bp, Homo sapiens
ctccggccagcaactgcat

SEQ ID NO: 6938520 - DNA, 23 bp, Homo sapiens
aggaaggaggtcctaacagtatc

SEQ ID NO: 6938521 - DNA, 22 bp, Homo sapiens
tcagctctcacagatctcaacc

SEQ ID NO: 6938522 - DNA, 22 bp, Homo sapiens
acaatgaaccaaatttaccaat

SEQ ID NO: 6938523 - DNA, 22 bp, Homo sapiens
aaagttggatttcatcctcatg

SEQ ID NO: 6938524 - DNA, 19 bp, Homo sapiens
ttttaagtgccctttcttc

SEQ ID NO: 6938525 - DNA, 22 bp, Homo sapiens
cttctaacatcctacaatgcaa

SEQ ID NO: 6938526 - DNA, 22 bp, Homo sapiens
tggttaaatgctccgatcttgg

SEQ ID NO: 6938527 - DNA, 22 bp, Homo sapiens
tagttctggtatttgctgacaa

SEQ ID NO: 6938528 - DNA, 22 bp, Homo sapiens
tttcaggagagaccagaaatga

SEQ ID NO: 6938529 - DNA, 22 bp, Homo sapiens
cccaggaatgagcaggcagggg

SEQ ID NO: 6938530 - DNA, 22 bp, Homo sapiens
caggcgagtgaacagactctca

SEQ ID NO: 6938531 - DNA, 22 bp, Homo sapiens
attgaacatacatatccacacc

SEQ ID NO: 6938532 - DNA, 22 bp, Homo sapiens
tggctcaagtaacaaaaatata

SEQ ID NO: 6938533 - DNA, 21 bp, Homo sapiens
gcactgagcatctcctctgcc

SEQ ID NO: 6938534 - DNA, 22 bp, Homo sapiens
ttcccatgcctggcccctatcc

SEQ ID NO: 6938535 - DNA, 22 bp, Homo sapiens
atctgaataaatttcttttagt

SEQ ID NO: 6938536 - DNA, 22 bp, Homo sapiens
ttcttggaaactgattccttgt

SEQ ID NO: 6938537 - DNA, 20 bp, Homo sapiens
tgagaaagtagagactcagg

SEQ ID NO: 6938538 - DNA, 18 bp, Homo sapiens
ttccatgattcctttcac

SEQ ID NO: 6938539 - DNA, 17 bp, Homo sapiens
cttgtggccagttttta

SEQ ID NO: 6938540 - DNA, 22 bp, Homo sapiens
ctgaggtctctttccatagtga

SEQ ID NO: 6938541 - DNA, 19 bp, Homo sapiens
cctctgccagcccgcctct

SEQ ID NO: 6938542 - DNA, 22 bp, Homo sapiens
atgcaaaaactgcacttacgct

SEQ ID NO: 6938543 - DNA, 22 bp, Homo sapiens
agggtgcccaccgcttctgccc

SEQ ID NO: 6938544 - DNA, 22 bp, Homo sapiens
caggccctcctgtgatctgcct

SEQ ID NO: 6938545 - DNA, 22 bp, Homo sapiens
aagttactatgactcttctttt

SEQ ID NO: 6938546 - DNA, 21 bp, Homo sapiens
ggcagagaagctggaagttgg

SEQ ID NO: 6938547 - DNA, 20 bp, Homo sapiens
cagtattgatccattgtctg

SEQ ID NO: 6938548 - DNA, 22 bp, Homo sapiens
catagagtgatgtaaggtatgt

SEQ ID NO: 6938549 - DNA, 22 bp, Homo sapiens
caattttttccatgctcttaca

SEQ ID NO: 6938550 - DNA, 22 bp, Homo sapiens
ttacttcttacaaaagaaatat

SEQ ID NO: 6938551 - DNA, 22 bp, Homo sapiens
tgggacacagaaaaggcaggtt

SEQ ID NO: 6938552 - DNA, 22 bp, Homo sapiens
ctctttgtgctattatgatcct

SEQ ID NO: 6938553 - DNA, 22 bp, Homo sapiens
caaggcagctgtagggatttgg

SEQ ID NO: 6938554 - DNA, 22 bp, Homo sapiens
gcctgtttgagaatagtcaggg

SEQ ID NO: 6938555 - DNA, 22 bp, Homo sapiens
tgctctgtgataaaggcgtatg

SEQ ID NO: 6938556 - DNA, 22 bp, Homo sapiens
cattagggtaattgaacactta

SEQ ID NO: 6938557 - DNA, 22 bp, Homo sapiens
ggatatctgccccatgagtcac

SEQ ID NO: 6938558 - DNA, 22 bp, Homo sapiens
cggggcaccgacctcctgccgc

SEQ ID NO: 6938559 - DNA, 18 bp, Homo sapiens
tagagggggcctgggcat

SEQ ID NO: 6938560 - DNA, 22 bp, Homo sapiens
tcaggcagcattaaacttcagc

SEQ ID NO: 6938561 - DNA, 22 bp, Homo sapiens
tgagcaaaagttgatggtgctt

SEQ ID NO: 6938562 - DNA, 21 bp, Homo sapiens
gcctctgctgtcttattgtga

SEQ ID NO: 6938563 - DNA, 16 bp, Homo sapiens
ctacccagtgagaagg

SEQ ID NO: 6938564 - DNA, 22 bp, Homo sapiens
tttgcattctagaaaaatttct

SEQ ID NO: 6938565 - DNA, 22 bp, Homo sapiens
gacagcagggacatgtaggaag

SEQ ID NO: 6938566 - DNA, 22 bp, Homo sapiens
actttggtgatacagatacggc

SEQ ID NO: 6938567 - DNA, 22 bp, Homo sapiens
gctggcttgtcccaggacaaag

SEQ ID NO: 6938568 - DNA, 22 bp, Homo sapiens
gtgaaacttcacattttgatag

SEQ ID NO: 6938569 - DNA, 22 bp, Homo sapiens
tttcaaagtcaagaaggatact

SEQ ID NO: 6938570 - DNA, 22 bp, Homo sapiens
ctctggggaaatggatatgtac

SEQ ID NO: 6938571 - DNA, 22 bp, Homo sapiens
tcagcatatgtttggagtgtcc

SEQ ID NO: 6938572 - DNA, 22 bp, Homo sapiens
agtgccaaggtattaatttata

SEQ ID NO: 6938573 - DNA, 22 bp, Homo sapiens
agaggggaggcgaaccagagtc

SEQ ID NO: 6938574 - DNA, 22 bp, Homo sapiens
ttggtaaaatcatagtggtaac

SEQ ID NO: 6938575 - DNA, 22 bp, Homo sapiens
atctccaggaagtgtcatttac

SEQ ID NO: 6938576 - DNA, 22 bp, Homo sapiens
aaggtaatcagcctttccacaa

SEQ ID NO: 6938577 - DNA, 22 bp, Homo sapiens
tataacctggattctggcacta

SEQ ID NO: 6938578 - DNA, 22 bp, Homo sapiens
ttgcactgtaagcatctgtgtc

SEQ ID NO: 6938579 - DNA, 22 bp, Homo sapiens
aagtcaccccacactcttggga

SEQ ID NO: 6938580 - DNA, 22 bp, Homo sapiens
acagggccattatctgttctag

SEQ ID NO: 6938581 - DNA, 22 bp, Homo sapiens
ttctgctatgaaaaaagtgctg

SEQ ID NO: 6938582 - DNA, 21 bp, Homo sapiens
gccccctggactcctcatcca

SEQ ID NO: 6938583 - DNA, 22 bp, Homo sapiens
gcttccaagcggtagatagcat

SEQ ID NO: 6938584 - DNA, 22 bp, Homo sapiens
tgtcttcttcataaggagagtg

SEQ ID NO: 6938585 - DNA, 22 bp, Homo sapiens
taaatatgcatgtatccttatc

SEQ ID NO: 6938586 - DNA, 22 bp, Homo sapiens
tgaggatggtgttggagagggc

SEQ ID NO: 6938587 - DNA, 18 bp, Homo sapiens
ccagtacctcctcctctc

SEQ ID NO: 6938588 - DNA, 22 bp, Homo sapiens
atattagtgtaggtagctaata

SEQ ID NO: 6938589 - DNA, 23 bp, Homo sapiens
agccttcaggcaatgtcagtaga

SEQ ID NO: 6938590 - DNA, 22 bp, Homo sapiens
aggcctcaggaaggtaaagaag

SEQ ID NO: 6938591 - DNA, 22 bp, Homo sapiens
ttcagaggctgtatgactagat

SEQ ID NO: 6938592 - DNA, 22 bp, Homo sapiens
ggggctcatgctgtttggtctt

SEQ ID NO: 6938593 - DNA, 22 bp, Homo sapiens
ttccacaatgccaggggcatca

SEQ ID NO: 6938594 - DNA, 22 bp, Homo sapiens
tgtaaggtgctcatgtatttct

SEQ ID NO: 6938595 - DNA, 22 bp, Homo sapiens
caggaacaatatctgtcctggt

SEQ ID NO: 6938596 - DNA, 21 bp, Homo sapiens
aggcttggatagatattcata

SEQ ID NO: 6938597 - DNA, 22 bp, Homo sapiens
accttgtccatcccaggccctc

SEQ ID NO: 6938598 - DNA, 22 bp, Homo sapiens
aggatttggggaagaaaacact

SEQ ID NO: 6938599 - DNA, 22 bp, Homo sapiens
actgagtgtccactatgagcca

SEQ ID NO: 6938600 - DNA, 22 bp, Homo sapiens
cctggtcctaggggtggaacca

SEQ ID NO: 6938601 - DNA, 22 bp, Homo sapiens
tgggcagcaaagactgtgtgct

SEQ ID NO: 6938602 - DNA, 17 bp, Homo sapiens
tgagtagggaagaggag

SEQ ID NO: 6938603 - DNA, 22 bp, Homo sapiens
agcctgagaaaggagtttggag

SEQ ID NO: 6938604 - DNA, 22 bp, Homo sapiens
gacccaggggcagggagaaagt

SEQ ID NO: 6938605 - DNA, 22 bp, Homo sapiens
aacagaaaaggtaggtggcttt

SEQ ID NO: 6938606 - DNA, 22 bp, Homo sapiens
actttgaatctcagataaccaa

SEQ ID NO: 6938607 - DNA, 22 bp, Homo sapiens
gtctgggcaagggagatggcgc

SEQ ID NO: 6938608 - DNA, 22 bp, Homo sapiens
tggctattgtgccaaatgaaca

SEQ ID NO: 6938609 - DNA, 22 bp, Homo sapiens
agagaactgtttctggggtctt

SEQ ID NO: 6938610 - DNA, 22 bp, Homo sapiens
gtagaatcccagtggctatatt

SEQ ID NO: 6938611 - DNA, 22 bp, Homo sapiens
gtcccattccctgtatcttaga

SEQ ID NO: 6938612 - DNA, 22 bp, Homo sapiens
aggctggatgtgcctcaccgag

SEQ ID NO: 6938613 - DNA, 22 bp, Homo sapiens
ttgcatcagaaaatatgggaag

SEQ ID NO: 6938614 - DNA, 22 bp, Homo sapiens
gtgaaggcaatgataagagtga

SEQ ID NO: 6938615 - DNA, 22 bp, Homo sapiens
ctctgggctccttcagcccttt

SEQ ID NO: 6938616 - DNA, 22 bp, Homo sapiens
ttcctgtgaaatataggtccat

SEQ ID NO: 6938617 - DNA, 22 bp, Homo sapiens
gaattcattagggaagctatct

SEQ ID NO: 6938618 - DNA, 22 bp, Homo sapiens
gccctgaaggcagaggtggagc

SEQ ID NO: 6938619 - DNA, 22 bp, Homo sapiens
ctctgtccttgcacagttccta

SEQ ID NO: 6938620 - DNA, 22 bp, Homo sapiens
cagtgccaaggagaaggacagc

SEQ ID NO: 6938621 - DNA, 22 bp, Homo sapiens
tacatgaatgtttcaatattgt

SEQ ID NO: 6938622 - DNA, 21 bp, Homo sapiens
tcttgattattggcctcacac

SEQ ID NO: 6938623 - DNA, 22 bp, Homo sapiens
ttgcttttaattaatcattgct

SEQ ID NO: 6938624 - DNA, 22 bp, Homo sapiens
aaatagcttttcataattctca

SEQ ID NO: 6938625 - DNA, 22 bp, Homo sapiens
atatgcatctgtgtgcgtgtct

SEQ ID NO: 6938626 - DNA, 22 bp, Homo sapiens
ggcttcaagtcgtatatttggg

SEQ ID NO: 6938627 - DNA, 22 bp, Homo sapiens
ctgggcagtgcagctatagaac

SEQ ID NO: 6938628 - DNA, 22 bp, Homo sapiens
tttggctctggttctggctcca

SEQ ID NO: 6938629 - DNA, 22 bp, Homo sapiens
taacaagtcattttaaattatg

SEQ ID NO: 6938630 - DNA, 22 bp, Homo sapiens
atgacattgaatatgttaacta

SEQ ID NO: 6938631 - DNA, 22 bp, Homo sapiens
tctggatcaccacttctgcctc

SEQ ID NO: 6938632 - DNA, 22 bp, Homo sapiens
attctttggacaataagtggtg

SEQ ID NO: 6938633 - DNA, 22 bp, Homo sapiens
cacaggctccggccttgcagcc

SEQ ID NO: 6938634 - DNA, 22 bp, Homo sapiens
agacatgcattgcaatatccat

SEQ ID NO: 6938635 - DNA, 22 bp, Homo sapiens
ggtggcagtagcactgggcctg

SEQ ID NO: 6938636 - DNA, 22 bp, Homo sapiens
tttatgaaccactctacacctt

SEQ ID NO: 6938637 - DNA, 22 bp, Homo sapiens
ctcaagactgatcgcagtggaa

SEQ ID NO: 6938638 - DNA, 22 bp, Homo sapiens
tagaaacagatgtttttgaaga

SEQ ID NO: 6938639 - DNA, 22 bp, Homo sapiens
cacagagaccccttctggggcc

SEQ ID NO: 6938640 - DNA, 22 bp, Homo sapiens
gaggagtgtattccacaccact

SEQ ID NO: 6938641 - DNA, 22 bp, Homo sapiens
ccttttcccatgtttctggagc

SEQ ID NO: 6938642 - DNA, 22 bp, Homo sapiens
aggacacacagaatacaaatcc

SEQ ID NO: 6938643 - DNA, 22 bp, Homo sapiens
cattgacagttctttaagttgc

SEQ ID NO: 6938644 - DNA, 22 bp, Homo sapiens
aatatttttgaggccctgttat

SEQ ID NO: 6938645 - DNA, 19 bp, Homo sapiens
ccagcccatagtccatcac

SEQ ID NO: 6938646 - DNA, 22 bp, Homo sapiens
gatactgtaggtgaaagtgttt

SEQ ID NO: 6938647 - DNA, 22 bp, Homo sapiens
taaagctctagtgttttggata

SEQ ID NO: 6938648 - DNA, 22 bp, Homo sapiens
taacacataagctgagaccatg

SEQ ID NO: 6938649 - DNA, 22 bp, Homo sapiens
aaactatcaagtgttgggggag

SEQ ID NO: 6938650 - DNA, 22 bp, Homo sapiens
gatgggaggaacctgggtccct

SEQ ID NO: 6938651 - DNA, 20 bp, Homo sapiens
aagaaaacgtcttcagggga

SEQ ID NO: 6938652 - DNA, 22 bp, Homo sapiens
agttgcagccttcaggagaccc

SEQ ID NO: 6938653 - DNA, 23 bp, Homo sapiens
cctcatgaaggtctgcttcctgg

SEQ ID NO: 6938654 - DNA, 22 bp, Homo sapiens
ctttgcaagtgctttgtagtcc

SEQ ID NO: 6938655 - DNA, 22 bp, Homo sapiens
aatctagagttcccagcataaa

SEQ ID NO: 6938656 - DNA, 22 bp, Homo sapiens
tgacaacaaggatcctgcctgg

SEQ ID NO: 6938657 - DNA, 22 bp, Homo sapiens
gagcaccctttgcacatcagtc

SEQ ID NO: 6938658 - DNA, 22 bp, Homo sapiens
aaaggtttgccgacctctgctt

SEQ ID NO: 6938659 - DNA, 21 bp, Homo sapiens
tctgtgcttttttggctccta

SEQ ID NO: 6938660 - DNA, 22 bp, Homo sapiens
ctgtgtcctgtctcctaaggtg

SEQ ID NO: 6938661 - DNA, 21 bp, Homo sapiens
agttcacaggaacaagcaggg

SEQ ID NO: 6938662 - DNA, 22 bp, Homo sapiens
ggtcacatatcctcggtttgga

SEQ ID NO: 6938663 - DNA, 17 bp, Homo sapiens
tggatgtgggatctgga

SEQ ID NO: 6938664 - DNA, 22 bp, Homo sapiens
tttccttgttcatttgccctat

SEQ ID NO: 6938665 - DNA, 22 bp, Homo sapiens
ggggcagagaataaaaacctaa

SEQ ID NO: 6938666 - DNA, 22 bp, Homo sapiens
gcctggaggaatgtagctgagg

SEQ ID NO: 6938667 - DNA, 22 bp, Homo sapiens
tgtgcccaacgtgcaggtttgt

SEQ ID NO: 6938668 - DNA, 22 bp, Homo sapiens
agcataagttggtacagccact

SEQ ID NO: 6938669 - DNA, 22 bp, Homo sapiens
tggcagcagacatctgaggtct

SEQ ID NO: 6938670 - DNA, 22 bp, Homo sapiens
acttgagaaaccaagtagaaag

SEQ ID NO: 6938671 - DNA, 22 bp, Homo sapiens
tctaggtaggctgtgtgtggaa

SEQ ID NO: 6938672 - DNA, 22 bp, Homo sapiens
gagcacagcagggctctgggtg

SEQ ID NO: 6938673 - DNA, 22 bp, Homo sapiens
cagacaagaaagaatcaagcca

SEQ ID NO: 6938674 - DNA, 22 bp, Homo sapiens
tcaagtcttgatgagacaaacc

SEQ ID NO: 6938675 - DNA, 22 bp, Homo sapiens
ccacagcaccgctgccagtccc

SEQ ID NO: 6938676 - DNA, 22 bp, Homo sapiens
ctatttttctgtaccctaattt

SEQ ID NO: 6938677 - DNA, 22 bp, Homo sapiens
tttacaaggatcaagggatctc

SEQ ID NO: 6938678 - DNA, 22 bp, Homo sapiens
actttgaatttttgtgggtagc

SEQ ID NO: 6938679 - DNA, 23 bp, Homo sapiens
gcactgccatgtgctctgcaggc

SEQ ID NO: 6938680 - DNA, 22 bp, Homo sapiens
aagatttattagatgcttacct

SEQ ID NO: 6938681 - DNA, 22 bp, Homo sapiens
tcccaaagtcaagctgtgtctt

SEQ ID NO: 6938682 - DNA, 22 bp, Homo sapiens
ggtgtagataatgatgctctcc

SEQ ID NO: 6938683 - DNA, 22 bp, Homo sapiens
agattcctgttgtatggagggg

SEQ ID NO: 6938684 - DNA, 22 bp, Homo sapiens
aactgtaatttttacatagtaa

SEQ ID NO: 6938685 - DNA, 22 bp, Homo sapiens
acctctgctcaagacccctccg

SEQ ID NO: 6938686 - DNA, 22 bp, Homo sapiens
cttgggaggggagcattggcct

SEQ ID NO: 6938687 - DNA, 23 bp, Homo sapiens
agacagaggctgaggctggccgc

SEQ ID NO: 6938688 - DNA, 23 bp, Homo sapiens
ctgtccaggattcttgagagaac

SEQ ID NO: 6938689 - DNA, 23 bp, Homo sapiens
tattttccaaatgatgactacat

SEQ ID NO: 6938690 - DNA, 22 bp, Homo sapiens
gaattgcttctggtatgttact

SEQ ID NO: 6938691 - DNA, 22 bp, Homo sapiens
gtagagcagggagcaggaagct

SEQ ID NO: 6938692 - DNA, 22 bp, Homo sapiens
gcctgaggaatgctcctgactt

SEQ ID NO: 6938693 - DNA, 22 bp, Homo sapiens
gctaggagtggtgggtcaagga

SEQ ID NO: 6938694 - DNA, 20 bp, Homo sapiens
cagccctttatcctcctatg

SEQ ID NO: 6938695 - DNA, 22 bp, Homo sapiens
agagggggaaaatagaggtgtt

SEQ ID NO: 6938696 - DNA, 22 bp, Homo sapiens
taagtgaaataagtcagataca

SEQ ID NO: 6938697 - DNA, 22 bp, Homo sapiens
ctctgtatgaatcatatggagt

SEQ ID NO: 6938698 - DNA, 22 bp, Homo sapiens
tacaaatgggttaaaatatagt

SEQ ID NO: 6938699 - DNA, 22 bp, Homo sapiens
tttgagaagcatctggtccact

SEQ ID NO: 6938700 - DNA, 22 bp, Homo sapiens
atctgttatttacccatctctg

SEQ ID NO: 6938701 - DNA, 22 bp, Homo sapiens
taaggcaatggcattcttgaca

SEQ ID NO: 6938702 - DNA, 22 bp, Homo sapiens
cccagcctctgggttctgccgg

SEQ ID NO: 6938703 - DNA, 22 bp, Homo sapiens
aggggcacggatgacctgttag

SEQ ID NO: 6938704 - DNA, 22 bp, Homo sapiens
cataaaagccacctatttaaag

SEQ ID NO: 6938705 - DNA, 22 bp, Homo sapiens
aggtgcccatcacctcacagtc

SEQ ID NO: 6938706 - DNA, 22 bp, Homo sapiens
tgagggcacctgggattaatgg

SEQ ID NO: 6938707 - DNA, 22 bp, Homo sapiens
aagaacttcctaatatattttc

SEQ ID NO: 6938708 - DNA, 22 bp, Homo sapiens
aaggaagagtctagaacaggca

SEQ ID NO: 6938709 - DNA, 22 bp, Homo sapiens
tttggctatgtgatacatgtca

SEQ ID NO: 6938710 - DNA, 22 bp, Homo sapiens
aacaggaggccttccagtccag

SEQ ID NO: 6938711 - DNA, 22 bp, Homo sapiens
atatgtttttcacaggtttaag

SEQ ID NO: 6938712 - DNA, 22 bp, Homo sapiens
ttctaactaaagtctttgtttt

SEQ ID NO: 6938713 - DNA, 22 bp, Homo sapiens
atccctggccacgaagctgccc

SEQ ID NO: 6938714 - DNA, 23 bp, Homo sapiens
tgtgtacatacatatgtacacac

SEQ ID NO: 6938715 - DNA, 18 bp, Homo sapiens
agaattaccaaagtgctt

SEQ ID NO: 6938716 - DNA, 22 bp, Homo sapiens
tggcactgccaacctgctaggt

SEQ ID NO: 6938717 - DNA, 22 bp, Homo sapiens
atggctgcctgggcgctggccg

SEQ ID NO: 6938718 - DNA, 22 bp, Homo sapiens
aataactgcacttgttgaatgc

SEQ ID NO: 6938719 - DNA, 22 bp, Homo sapiens
atgagtgatacagcaagctctc

SEQ ID NO: 6938720 - DNA, 22 bp, Homo sapiens
agaaaggtcacttagcctcagc

SEQ ID NO: 6938721 - DNA, 21 bp, Homo sapiens
gacaatgcagtcttttttgga

SEQ ID NO: 6938722 - DNA, 22 bp, Homo sapiens
agtgctttccttcttgtgacat

SEQ ID NO: 6938723 - DNA, 22 bp, Homo sapiens
cgatagacattcattttctgat

SEQ ID NO: 6938724 - DNA, 22 bp, Homo sapiens
agtgaagtaaaagatgtgcatc

SEQ ID NO: 6938725 - DNA, 22 bp, Homo sapiens
agtgatgtaacaaacagagtta

SEQ ID NO: 6938726 - DNA, 22 bp, Homo sapiens
ctgctgtgcaggtgcctatgat

SEQ ID NO: 6938727 - DNA, 20 bp, Homo sapiens
tttcctttcattttagtacc

SEQ ID NO: 6938728 - DNA, 22 bp, Homo sapiens
cctgccagggccttggaagaaa

SEQ ID NO: 6938729 - DNA, 22 bp, Homo sapiens
ggaaagggcagaggccttggag

SEQ ID NO: 6938730 - DNA, 22 bp, Homo sapiens
agatgttatcattcagagtagc

SEQ ID NO: 6938731 - DNA, 22 bp, Homo sapiens
agtgataaccatgtgtgaatta

SEQ ID NO: 6938732 - DNA, 22 bp, Homo sapiens
accatgagttatttgacaggcc

SEQ ID NO: 6938733 - DNA, 22 bp, Homo sapiens
ttactttgctttctcattacag

SEQ ID NO: 6938734 - DNA, 22 bp, Homo sapiens
tcctgccactgcacatatactt

SEQ ID NO: 6938735 - DNA, 22 bp, Homo sapiens
ggaattgtctagtactcacggc

SEQ ID NO: 6938736 - DNA, 22 bp, Homo sapiens
agtttgagatgacatgttataa

SEQ ID NO: 6938737 - DNA, 22 bp, Homo sapiens
tgcatttccagatttctggagt

SEQ ID NO: 6938738 - DNA, 22 bp, Homo sapiens
ctgagtggaacataggatgata

SEQ ID NO: 6938739 - DNA, 22 bp, Homo sapiens
gctcctggtgctgtagagattt

SEQ ID NO: 6938740 - DNA, 22 bp, Homo sapiens
gggagctgtcatcagtgttgtc

SEQ ID NO: 6938741 - DNA, 22 bp, Homo sapiens
ttcagtcctcacaacctcacta

SEQ ID NO: 6938742 - DNA, 22 bp, Homo sapiens
cagcttgtgcaaaggtcctggg

SEQ ID NO: 6938743 - DNA, 22 bp, Homo sapiens
catctcatagtgcagtgctgta

SEQ ID NO: 6938744 - DNA, 21 bp, Homo sapiens
ttccaggattgcttattttta

SEQ ID NO: 6938745 - DNA, 22 bp, Homo sapiens
gtgcagcaaagtttgagatata

SEQ ID NO: 6938746 - DNA, 22 bp, Homo sapiens
ctggccccaggcagcctgctgg

SEQ ID NO: 6938747 - DNA, 22 bp, Homo sapiens
cctgaggttatccatctacctg

SEQ ID NO: 6938748 - DNA, 22 bp, Homo sapiens
caggcactgtgcaagggtctcg

SEQ ID NO: 6938749 - DNA, 22 bp, Homo sapiens
tgagccttcctcagaagctcct

SEQ ID NO: 6938750 - DNA, 22 bp, Homo sapiens
tccatgagacagatactgtaag

SEQ ID NO: 6938751 - DNA, 22 bp, Homo sapiens
atatttgtttggcagagttcag

SEQ ID NO: 6938752 - DNA, 22 bp, Homo sapiens
agttgctacctctctgtgctcc

SEQ ID NO: 6938753 - DNA, 22 bp, Homo sapiens
ggctcaggctggagtgcagtgg

SEQ ID NO: 6938754 - DNA, 22 bp, Homo sapiens
tcagggtgggaggacccttgag

SEQ ID NO: 6938755 - DNA, 22 bp, Homo sapiens
acacaggcaagagtgcaggtct

SEQ ID NO: 6938756 - DNA, 22 bp, Homo sapiens
tggcacttggtaaatatgtgtt

SEQ ID NO: 6938757 - DNA, 22 bp, Homo sapiens
acatgctaatggagatgccaag

SEQ ID NO: 6938758 - DNA, 22 bp, Homo sapiens
gcctctgatggaggccagcgct

SEQ ID NO: 6938759 - DNA, 22 bp, Homo sapiens
attgaaagcatggatttggatt

SEQ ID NO: 6938760 - DNA, 22 bp, Homo sapiens
tttcccctgaaagcaacctcct

SEQ ID NO: 6938761 - DNA, 22 bp, Homo sapiens
actgggaagactggaattgctc

SEQ ID NO: 6938762 - DNA, 22 bp, Homo sapiens
ccctgggcaccaggcctggtaa

SEQ ID NO: 6938763 - DNA, 23 bp, Homo sapiens
tctaccagctagtctccccagca

SEQ ID NO: 6938764 - DNA, 20 bp, Homo sapiens
tccttgaaagtggggtatat

SEQ ID NO: 6938765 - DNA, 22 bp, Homo sapiens
tccttcatgatgcttagcagag

SEQ ID NO: 6938766 - DNA, 22 bp, Homo sapiens
acttctgcaggtggtgactgaa

SEQ ID NO: 6938767 - DNA, 22 bp, Homo sapiens
gcggcggcggtcattgagcatg

SEQ ID NO: 6938768 - DNA, 22 bp, Homo sapiens
gtgtcccaggcctctggaatta

SEQ ID NO: 6938769 - DNA, 21 bp, Homo sapiens
ccctttctccatacttcatcc

SEQ ID NO: 6938770 - DNA, 19 bp, Homo sapiens
gggagcacaagcgttaaga

SEQ ID NO: 6938771 - DNA, 23 bp, Homo sapiens
tgctggagaagcaaagttctgag

SEQ ID NO: 6938772 - DNA, 19 bp, Homo sapiens
gaattttaggacttcagca

SEQ ID NO: 6938773 - DNA, 22 bp, Homo sapiens
acactagatgccaatagcaccc

SEQ ID NO: 6938774 - DNA, 22 bp, Homo sapiens
gctcccacgcaattcttttcag

SEQ ID NO: 6938775 - DNA, 18 bp, Homo sapiens
gcagggctgcacacgcat

SEQ ID NO: 6938776 - DNA, 22 bp, Homo sapiens
cattggtttgatattgccatgg

SEQ ID NO: 6938777 - DNA, 23 bp, Homo sapiens
acttgggcctcacaaatgttagc

SEQ ID NO: 6938778 - DNA, 16 bp, Homo sapiens
gtgacagacaataggc

SEQ ID NO: 6938779 - DNA, 22 bp, Homo sapiens
tgtgcaatttcaatttacacag

SEQ ID NO: 6938780 - DNA, 19 bp, Homo sapiens
tacatacttattctaaaag

SEQ ID NO: 6938781 - DNA, 22 bp, Homo sapiens
atgaaggcagttttataagatt

SEQ ID NO: 6938782 - DNA, 22 bp, Homo sapiens
tcagtgtcctgtgcggtgcagc

SEQ ID NO: 6938783 - DNA, 22 bp, Homo sapiens
aaggtggtttgattatcccact

SEQ ID NO: 6938784 - DNA, 22 bp, Homo sapiens
gacactacgtggctcacatttc

SEQ ID NO: 6938785 - DNA, 22 bp, Homo sapiens
gggctcctcctctgactgtggc

SEQ ID NO: 6938786 - DNA, 21 bp, Homo sapiens
tgcaatatatatttgcctgaa

SEQ ID NO: 6938787 - DNA, 22 bp, Homo sapiens
cagctggcgactctcctcgatg

SEQ ID NO: 6938788 - DNA, 22 bp, Homo sapiens
tttggaatgtatttgaccaaag

SEQ ID NO: 6938789 - DNA, 22 bp, Homo sapiens
gaggcatgtctggcctgtccca

SEQ ID NO: 6938790 - DNA, 22 bp, Homo sapiens
aggcagaggaagggtggatttg

SEQ ID NO: 6938791 - DNA, 22 bp, Homo sapiens
ggttctgaagtggtcccattcc

SEQ ID NO: 6938792 - DNA, 22 bp, Homo sapiens
tgccaggagagtgcatgcaggg

SEQ ID NO: 6938793 - DNA, 22 bp, Homo sapiens
cagggactgagatccagactgt

SEQ ID NO: 6938794 - DNA, 22 bp, Homo sapiens
atgttcatgattggttttggcg

SEQ ID NO: 6938795 - DNA, 22 bp, Homo sapiens
tgattatattctaacttcataa

SEQ ID NO: 6938796 - DNA, 22 bp, Homo sapiens
accctctagagggaagcacttt

SEQ ID NO: 6938797 - DNA, 22 bp, Homo sapiens
ccagcttaaaaccatttattta

SEQ ID NO: 6938798 - DNA, 18 bp, Homo sapiens
tatgagaagattagcaat

SEQ ID NO: 6938799 - DNA, 22 bp, Homo sapiens
tgctttctgtttttcatataat

SEQ ID NO: 6938800 - DNA, 22 bp, Homo sapiens
aactactctgctcatgtttata

SEQ ID NO: 6938801 - DNA, 22 bp, Homo sapiens
gcaagcaagtatctggcaggga

SEQ ID NO: 6938802 - DNA, 22 bp, Homo sapiens
taatttttccacgtacactggg

SEQ ID NO: 6938803 - DNA, 22 bp, Homo sapiens
tttcagagaattagaagctgat

SEQ ID NO: 6938804 - DNA, 22 bp, Homo sapiens
gaatcaggattcaagatcagct

SEQ ID NO: 6938805 - DNA, 22 bp, Homo sapiens
ggcctgcttctctgggctttct

SEQ ID NO: 6938806 - DNA, 22 bp, Homo sapiens
agagtgtgttccccaagaaaga

SEQ ID NO: 6938807 - DNA, 22 bp, Homo sapiens
agaccctggtaaacactccagg

SEQ ID NO: 6938808 - DNA, 22 bp, Homo sapiens
tcctgcaggtggatgattctct

SEQ ID NO: 6938809 - DNA, 22 bp, Homo sapiens
gagaagttagctctgtttaggt

SEQ ID NO: 6938810 - DNA, 22 bp, Homo sapiens
gctctttagttgatggcctgcc

SEQ ID NO: 6938811 - DNA, 21 bp, Homo sapiens
tgagtctcccttagcccacgc

SEQ ID NO: 6938812 - DNA, 22 bp, Homo sapiens
aagaggtcacactaggtcctag

SEQ ID NO: 6938813 - DNA, 22 bp, Homo sapiens
tttgaatgtaaatgctgcagct

SEQ ID NO: 6938814 - DNA, 22 bp, Homo sapiens
cagctcaatagcctaccttaat

SEQ ID NO: 6938815 - DNA, 22 bp, Homo sapiens
ggttttggagcatggagagcct

SEQ ID NO: 6938816 - DNA, 22 bp, Homo sapiens
tgaagaatcagattggcctgcg

SEQ ID NO: 6938817 - DNA, 22 bp, Homo sapiens
tctctttgaccctttagctcca

SEQ ID NO: 6938818 - DNA, 22 bp, Homo sapiens
cagtagtagttaaactgtgtat

SEQ ID NO: 6938819 - DNA, 22 bp, Homo sapiens
agagatcagttaaaatcttttt

SEQ ID NO: 6938820 - DNA, 22 bp, Homo sapiens
tgaaagcatatgctaaagacca

SEQ ID NO: 6938821 - DNA, 22 bp, Homo sapiens
gtatcttttacaccaggaaatt

SEQ ID NO: 6938822 - DNA, 22 bp, Homo sapiens
gtgtgggctgcagaggcacagc

SEQ ID NO: 6938823 - DNA, 22 bp, Homo sapiens
gctgagggccgcatagggtcat

SEQ ID NO: 6938824 - DNA, 22 bp, Homo sapiens
gctggagatactgctcagtatc

SEQ ID NO: 6938825 - DNA, 23 bp, Homo sapiens
tttagcttccctttagttagggg

SEQ ID NO: 6938826 - DNA, 22 bp, Homo sapiens
ggaagctgttatcatctgtatc

SEQ ID NO: 6938827 - DNA, 22 bp, Homo sapiens
gagtgccatgtgttacctctgg

SEQ ID NO: 6938828 - DNA, 22 bp, Homo sapiens
gagaaatagattcatggtagat

SEQ ID NO: 6938829 - DNA, 22 bp, Homo sapiens
caaggcattcttgcaggtaggg

SEQ ID NO: 6938830 - DNA, 22 bp, Homo sapiens
ccctcaccaggctccaggcatg

SEQ ID NO: 6938831 - DNA, 22 bp, Homo sapiens
ccaggagatgggaaagtagcag

SEQ ID NO: 6938832 - DNA, 22 bp, Homo sapiens
ttgagaaccactgagttagata

SEQ ID NO: 6938833 - DNA, 22 bp, Homo sapiens
tcagttgctagaagggggaacc

SEQ ID NO: 6938834 - DNA, 22 bp, Homo sapiens
aggcagatgggagctggaagtt

SEQ ID NO: 6938835 - DNA, 22 bp, Homo sapiens
aatggtatcacctcacagaatt

SEQ ID NO: 6938836 - DNA, 22 bp, Homo sapiens
ctcttatacatatttttaggcg

SEQ ID NO: 6938837 - DNA, 22 bp, Homo sapiens
tttaatcaggcaaagcataata

SEQ ID NO: 6938838 - DNA, 22 bp, Homo sapiens
gtgtggcagggcgtttgcagac

SEQ ID NO: 6938839 - DNA, 22 bp, Homo sapiens
actgtcctcgaagtacctgtgc

SEQ ID NO: 6938840 - DNA, 22 bp, Homo sapiens
ggtgccctgtaaaagccatgca

SEQ ID NO: 6938841 - DNA, 22 bp, Homo sapiens
attcactgtggtgtctgatata

SEQ ID NO: 6938842 - DNA, 22 bp, Homo sapiens
agcactagacatgtaagtgagc

SEQ ID NO: 6938843 - DNA, 22 bp, Homo sapiens
tggctacagacattcctaggga

SEQ ID NO: 6938844 - DNA, 22 bp, Homo sapiens
tctgaattagaggatacgtctt

SEQ ID NO: 6938845 - DNA, 22 bp, Homo sapiens
tgaggagtttttctagagctaa

SEQ ID NO: 6938846 - DNA, 22 bp, Homo sapiens
tgggttttctgccgattgttcc

SEQ ID NO: 6938847 - DNA, 22 bp, Homo sapiens
aatgcagtttcatttgtagaat

SEQ ID NO: 6938848 - DNA, 22 bp, Homo sapiens
atgtaccagatgtatgttctca

SEQ ID NO: 6938849 - DNA, 22 bp, Homo sapiens
gagctcttctaaagatggcaat

SEQ ID NO: 6938850 - DNA, 20 bp, Homo sapiens
atcttgggacagggcacatg

SEQ ID NO: 6938851 - DNA, 17 bp, Homo sapiens
aaccagctgtcccctcc

SEQ ID NO: 6938852 - DNA, 22 bp, Homo sapiens
ttgcaacacaaagtttgattcc

SEQ ID NO: 6938853 - DNA, 22 bp, Homo sapiens
tctcttccttgacctattgtaa

SEQ ID NO: 6938854 - DNA, 22 bp, Homo sapiens
tttgagtaggcttatattttgg

SEQ ID NO: 6938855 - DNA, 22 bp, Homo sapiens
tagtacagtggagagcaaagaa

SEQ ID NO: 6938856 - DNA, 22 bp, Homo sapiens
gtgttctgcagaccagcatcat

SEQ ID NO: 6938857 - DNA, 22 bp, Homo sapiens
ggtgccagagtggcccaggggc

SEQ ID NO: 6938858 - DNA, 22 bp, Homo sapiens
tggggaggacgggcgccttcct

SEQ ID NO: 6938859 - DNA, 22 bp, Homo sapiens
tgctgggctgttcctgtccatg

SEQ ID NO: 6938860 - DNA, 22 bp, Homo sapiens
atttcattgaagttaattcttc

SEQ ID NO: 6938861 - DNA, 22 bp, Homo sapiens
tttatgttatgggtaggatcaa

SEQ ID NO: 6938862 - DNA, 22 bp, Homo sapiens
aatgtctttctgttctatgaga

SEQ ID NO: 6938863 - DNA, 22 bp, Homo sapiens
acagaagataactgggaccaga

SEQ ID NO: 6938864 - DNA, 22 bp, Homo sapiens
gccagttggccccgggcatgca

SEQ ID NO: 6938865 - DNA, 22 bp, Homo sapiens
ctgagctggtctatggacttgg

SEQ ID NO: 6938866 - DNA, 22 bp, Homo sapiens
tgtctgactttattaattcaca

SEQ ID NO: 6938867 - DNA, 22 bp, Homo sapiens
gagccagggtttgaaactagac

SEQ ID NO: 6938868 - DNA, 23 bp, Homo sapiens
tccagctgcagtgggatggggaa

SEQ ID NO: 6938869 - DNA, 22 bp, Homo sapiens
aggtaagcatggtggctgctgt

SEQ ID NO: 6938870 - DNA, 22 bp, Homo sapiens
cactccaggtcccagttcctgg

SEQ ID NO: 6938871 - DNA, 22 bp, Homo sapiens
tttcaagttgttgcattaaatg

SEQ ID NO: 6938872 - DNA, 22 bp, Homo sapiens
ttcacataggagcatggttttt

SEQ ID NO: 6938873 - DNA, 22 bp, Homo sapiens
ttattgtgggtaggttgtgaaa

SEQ ID NO: 6938874 - DNA, 22 bp, Homo sapiens
agtgaaatttgtttagataggt

SEQ ID NO: 6938875 - DNA, 22 bp, Homo sapiens
ctctggaaaaccactagcagga

SEQ ID NO: 6938876 - DNA, 22 bp, Homo sapiens
gactggatttatagatatcata

SEQ ID NO: 6938877 - DNA, 22 bp, Homo sapiens
agaaggaagccaggagggtgca

SEQ ID NO: 6938878 - DNA, 22 bp, Homo sapiens
tctcaggaagtgatattgagac

SEQ ID NO: 6938879 - DNA, 22 bp, Homo sapiens
ctggagttcagtggcgtgaaca

SEQ ID NO: 6938880 - DNA, 22 bp, Homo sapiens
atttacagacgtggattagtgc

SEQ ID NO: 6938881 - DNA, 22 bp, Homo sapiens
atcttgggaattttccaggagt

SEQ ID NO: 6938882 - DNA, 22 bp, Homo sapiens
agtggacccggaacagaggccc

SEQ ID NO: 6938883 - DNA, 19 bp, Homo sapiens
gaggaggaaaactagtgta

SEQ ID NO: 6938884 - DNA, 18 bp, Homo sapiens
gttggctgctgtggctgg

SEQ ID NO: 6938885 - DNA, 22 bp, Homo sapiens
atatattcttaaagaatctgac

SEQ ID NO: 6938886 - DNA, 22 bp, Homo sapiens
ggggctgttgaagttagttgag

SEQ ID NO: 6938887 - DNA, 22 bp, Homo sapiens
cacatcaagcatccatgagttt

SEQ ID NO: 6938888 - DNA, 22 bp, Homo sapiens
atacagcagcccttgctttgca

SEQ ID NO: 6938889 - DNA, 22 bp, Homo sapiens
tcatttttttccggtaggaata

SEQ ID NO: 6938890 - DNA, 22 bp, Homo sapiens
aggaatgacagatgtccgcacc

SEQ ID NO: 6938891 - DNA, 18 bp, Homo sapiens
cctggaatgcaccccatt

SEQ ID NO: 6938892 - DNA, 19 bp, Homo sapiens
gaggtcagcaagaagtatt

SEQ ID NO: 6938893 - DNA, 22 bp, Homo sapiens
tgcagagaaaactcctgggtac

SEQ ID NO: 6938894 - DNA, 22 bp, Homo sapiens
cctggcctcgtgctcacggctc

SEQ ID NO: 6938895 - DNA, 22 bp, Homo sapiens
tgccctggtgaagtgctctcct

SEQ ID NO: 6938896 - DNA, 22 bp, Homo sapiens
gacatgtgagagctcggttttc

SEQ ID NO: 6938897 - DNA, 22 bp, Homo sapiens
ttgtactttggggaaatgttga

SEQ ID NO: 6938898 - DNA, 22 bp, Homo sapiens
tgcctgtgttgattactttgtc

SEQ ID NO: 6938899 - DNA, 22 bp, Homo sapiens
gggcatggaggtctgtctgcag

SEQ ID NO: 6938900 - DNA, 22 bp, Homo sapiens
tgcagctcgggcttagggtggg

SEQ ID NO: 6938901 - DNA, 22 bp, Homo sapiens
cagggccagggacacgctgtca

SEQ ID NO: 6938902 - DNA, 22 bp, Homo sapiens
gcagcccacaccactctgctca

SEQ ID NO: 6938903 - DNA, 22 bp, Homo sapiens
tgagcacatgccagcccttctc

SEQ ID NO: 6938904 - DNA, 22 bp, Homo sapiens
accagtgttctggaatcctatg

SEQ ID NO: 6938905 - DNA, 22 bp, Homo sapiens
tgctattaaattaaattgatat

SEQ ID NO: 6938906 - DNA, 22 bp, Homo sapiens
tacctggggctgggctttgatt

SEQ ID NO: 6938907 - DNA, 22 bp, Homo sapiens
gtgtgagcatcaaagcctgtca

SEQ ID NO: 6938908 - DNA, 22 bp, Homo sapiens
atccagtatgaggtagggcttg

SEQ ID NO: 6938909 - DNA, 22 bp, Homo sapiens
gacaggacttcactgtgttgcc

SEQ ID NO: 6938910 - DNA, 22 bp, Homo sapiens
actcaaatagctgcccctagtg

SEQ ID NO: 6938911 - DNA, 22 bp, Homo sapiens
gatgagttctttctattctatt

SEQ ID NO: 6938912 - DNA, 22 bp, Homo sapiens
ggggtgggcgtgcagggacacc

SEQ ID NO: 6938913 - DNA, 23 bp, Homo sapiens
gttttcaacacaataaatgtaac

SEQ ID NO: 6938914 - DNA, 22 bp, Homo sapiens
tttccttgcacattggtttcca

SEQ ID NO: 6938915 - DNA, 22 bp, Homo sapiens
agtcccagctctgccacttact

SEQ ID NO: 6938916 - DNA, 22 bp, Homo sapiens
acattctgaatgcctgacagta

SEQ ID NO: 6938917 - DNA, 22 bp, Homo sapiens
cagtgcatatgattctgcagtt

SEQ ID NO: 6938918 - DNA, 22 bp, Homo sapiens
attggacactgtggatgactta

SEQ ID NO: 6938919 - DNA, 22 bp, Homo sapiens
aacaggcaatttaggactcttt

SEQ ID NO: 6938920 - DNA, 22 bp, Homo sapiens
tctggctctgtgtccccaccca

SEQ ID NO: 6938921 - DNA, 22 bp, Homo sapiens
ttctatgtacctagcgttgtat

SEQ ID NO: 6938922 - DNA, 22 bp, Homo sapiens
gagttctggccggttcttggac

SEQ ID NO: 6938923 - DNA, 22 bp, Homo sapiens
tctcattgtccaattgaattta

SEQ ID NO: 6938924 - DNA, 22 bp, Homo sapiens
tggcattgaggagcaaaattta

SEQ ID NO: 6938925 - DNA, 22 bp, Homo sapiens
gcttctgtggattggctggctt

SEQ ID NO: 6938926 - DNA, 22 bp, Homo sapiens
ctgaaagaataagatgtttaca

SEQ ID NO: 6938927 - DNA, 22 bp, Homo sapiens
agacaggcatgaggctggattg

SEQ ID NO: 6938928 - DNA, 22 bp, Homo sapiens
agctcagttggccactctttca

SEQ ID NO: 6938929 - DNA, 22 bp, Homo sapiens
gaatccgggaggcaaaagttgc

SEQ ID NO: 6938930 - DNA, 22 bp, Homo sapiens
atgtgtggtttgtaaatgattt

SEQ ID NO: 6938931 - DNA, 22 bp, Homo sapiens
acctgggttgctggcgtgaggg

SEQ ID NO: 6938932 - DNA, 22 bp, Homo sapiens
gagttaaatgacttggttaagg

SEQ ID NO: 6938933 - DNA, 22 bp, Homo sapiens
gcacacagagaggtggtatgtc

SEQ ID NO: 6938934 - DNA, 22 bp, Homo sapiens
tgaagagaagaaaattatcttt

SEQ ID NO: 6938935 - DNA, 22 bp, Homo sapiens
ttgctctcggggaggctgcagg

SEQ ID NO: 6938936 - DNA, 22 bp, Homo sapiens
tctgaggcatacccaggccccc

SEQ ID NO: 6938937 - DNA, 22 bp, Homo sapiens
aaacttcattttcaactgcaaa

SEQ ID NO: 6938938 - DNA, 22 bp, Homo sapiens
gctagggatctgatttgctgtt

SEQ ID NO: 6938939 - DNA, 22 bp, Homo sapiens
ctacacttgatggagtttcctt

SEQ ID NO: 6938940 - DNA, 22 bp, Homo sapiens
gcctgtccactaaacagccaag

SEQ ID NO: 6938941 - DNA, 22 bp, Homo sapiens
tctgggaaatggctacttgtca

SEQ ID NO: 6938942 - DNA, 22 bp, Homo sapiens
ctgctgtgcatatttatctagg

SEQ ID NO: 6938943 - DNA, 22 bp, Homo sapiens
tacaagagacaccagggaggct

SEQ ID NO: 6938944 - DNA, 22 bp, Homo sapiens
tctgcctgtagtcccacacctc

SEQ ID NO: 6938945 - DNA, 22 bp, Homo sapiens
aatccttatttgtctagttcca

SEQ ID NO: 6938946 - DNA, 22 bp, Homo sapiens
cccagggttgcctgcctctgct

SEQ ID NO: 6938947 - DNA, 22 bp, Homo sapiens
actgagggttagtggaccgtgt

SEQ ID NO: 6938948 - DNA, 22 bp, Homo sapiens
ggaggcacacctcagactggga

SEQ ID NO: 6938949 - DNA, 22 bp, Homo sapiens
accaggcactcttgtggcagtg

SEQ ID NO: 6938950 - DNA, 22 bp, Homo sapiens
tcaactcatgttattctgtgaa

SEQ ID NO: 6938951 - DNA, 22 bp, Homo sapiens
acaccccaccagtaactgaggg

SEQ ID NO: 6938952 - DNA, 21 bp, Homo sapiens
tctctgtgttcaaggtgccag

SEQ ID NO: 6938953 - DNA, 22 bp, Homo sapiens
atttggaaaagcggtaacttgc

SEQ ID NO: 6938954 - DNA, 22 bp, Homo sapiens
taacagtacatccttttctctt

SEQ ID NO: 6938955 - DNA, 22 bp, Homo sapiens
tttgtcaatcccttgaaaacct

SEQ ID NO: 6938956 - DNA, 22 bp, Homo sapiens
tagtctctatgagtgaatcaca

SEQ ID NO: 6938957 - DNA, 21 bp, Homo sapiens
tgctcctttaccccacaagac

SEQ ID NO: 6938958 - DNA, 22 bp, Homo sapiens
tagagtggttaacagtttagaa

SEQ ID NO: 6938959 - DNA, 22 bp, Homo sapiens
tccctgctgcactcacacctac

SEQ ID NO: 6938960 - DNA, 22 bp, Homo sapiens
ctgagatggagtttcgctcttc

SEQ ID NO: 6938961 - DNA, 22 bp, Homo sapiens
gcttcagaaatgaacactgtct

SEQ ID NO: 6938962 - DNA, 22 bp, Homo sapiens
ctgggaggcagtctctctagaa

SEQ ID NO: 6938963 - DNA, 21 bp, Homo sapiens
aatccttaatgaggagttggt

SEQ ID NO: 6938964 - DNA, 22 bp, Homo sapiens
tttggaatggaatagagattgc

SEQ ID NO: 6938965 - DNA, 22 bp, Homo sapiens
cagctcagcttcctgggtgtgt

SEQ ID NO: 6938966 - DNA, 22 bp, Homo sapiens
gagtagaaggaagttatctacc

SEQ ID NO: 6938967 - DNA, 22 bp, Homo sapiens
tggctaatggcatttcctgggt

SEQ ID NO: 6938968 - DNA, 22 bp, Homo sapiens
caaaagtcttcctattctctta

SEQ ID NO: 6938969 - DNA, 22 bp, Homo sapiens
tttggattgcttggatgcttcg

SEQ ID NO: 6938970 - DNA, 22 bp, Homo sapiens
gaatgctggtgttcagaatttt

SEQ ID NO: 6938971 - DNA, 22 bp, Homo sapiens
agggaagggaaaaacactcgtc

SEQ ID NO: 6938972 - DNA, 22 bp, Homo sapiens
gctggacttcatgcattcctgt

SEQ ID NO: 6938973 - DNA, 22 bp, Homo sapiens
tggagctgagagttaataagga

SEQ ID NO: 6938974 - DNA, 22 bp, Homo sapiens
tcaggctagaagtaattgtgtt

SEQ ID NO: 6938975 - DNA, 22 bp, Homo sapiens
ttgctttacatgttctggtaaa

SEQ ID NO: 6938976 - DNA, 22 bp, Homo sapiens
ggcttcacagttgtagcagctc

SEQ ID NO: 6938977 - DNA, 22 bp, Homo sapiens
tgctggcaccattttcggacat

SEQ ID NO: 6938978 - DNA, 22 bp, Homo sapiens
gctgccctgtggtagagggtgg

SEQ ID NO: 6938979 - DNA, 22 bp, Homo sapiens
ctgaaatgttaaatacttggct

SEQ ID NO: 6938980 - DNA, 22 bp, Homo sapiens
gtgggaagagccaattggggta

SEQ ID NO: 6938981 - DNA, 22 bp, Homo sapiens
tctcattatccatcactgcact

SEQ ID NO: 6938982 - DNA, 22 bp, Homo sapiens
tcagggactaggtgctgcctga

SEQ ID NO: 6938983 - DNA, 22 bp, Homo sapiens
tagatgtttgagaagtttatgt

SEQ ID NO: 6938984 - DNA, 23 bp, Homo sapiens
tactataacgctgtgtcagctcc

SEQ ID NO: 6938985 - DNA, 22 bp, Homo sapiens
tctgttctattggtctatgtgt

SEQ ID NO: 6938986 - DNA, 22 bp, Homo sapiens
tgagcctggcctgcagagacca

SEQ ID NO: 6938987 - DNA, 22 bp, Homo sapiens
atatgcttccccttctttttgg

SEQ ID NO: 6938988 - DNA, 22 bp, Homo sapiens
aagcatctgtaaagacccttat

SEQ ID NO: 6938989 - DNA, 23 bp, Homo sapiens
ttacaaggaagtgcacagatggg

SEQ ID NO: 6938990 - DNA, 22 bp, Homo sapiens
agtggcaaagtcttcagaagtt

SEQ ID NO: 6938991 - DNA, 22 bp, Homo sapiens
ctgctactcttgtatgtgtatt

SEQ ID NO: 6938992 - DNA, 22 bp, Homo sapiens
taggaaattggaaactcttcac

SEQ ID NO: 6938993 - DNA, 22 bp, Homo sapiens
catgttctcttaatgttaacta

SEQ ID NO: 6938994 - DNA, 17 bp, Homo sapiens
gaataagtggatggcac

SEQ ID NO: 6938995 - DNA, 22 bp, Homo sapiens
tagctgggtctctgttttctca

SEQ ID NO: 6938996 - DNA, 22 bp, Homo sapiens
actgtccgggacaggcccatcc

SEQ ID NO: 6938997 - DNA, 22 bp, Homo sapiens
agatcccaaatcacctgcttat

SEQ ID NO: 6938998 - DNA, 22 bp, Homo sapiens
tctgaggccctgcaggcagtgt

SEQ ID NO: 6938999 - DNA, 22 bp, Homo sapiens
ttacatgtacaaacaattctta

SEQ ID NO: 6939000 - DNA, 22 bp, Homo sapiens
ggaagcaaattccagaaccaca

SEQ ID NO: 6939001 - DNA, 22 bp, Homo sapiens
agacaatgaatagatttgagaa

SEQ ID NO: 6939002 - DNA, 22 bp, Homo sapiens
gaggttgggatgagggatacag

SEQ ID NO: 6939003 - DNA, 22 bp, Homo sapiens
aaaagtaattgtggtttttgct

SEQ ID NO: 6939004 - DNA, 22 bp, Homo sapiens
cttcctctagcctagtaatgcc

SEQ ID NO: 6939005 - DNA, 22 bp, Homo sapiens
gaggtcaggcttgcagcagggt

SEQ ID NO: 6939006 - DNA, 18 bp, Homo sapiens
ctttgctataaattgtat

SEQ ID NO: 6939007 - DNA, 22 bp, Homo sapiens
gagcagcacttgaggcatgtca

SEQ ID NO: 6939008 - DNA, 22 bp, Homo sapiens
tgtttctgggtgtgtctcacct

SEQ ID NO: 6939009 - DNA, 22 bp, Homo sapiens
ccatgtccagaatgtgtcacgt

SEQ ID NO: 6939010 - DNA, 22 bp, Homo sapiens
tttagagaagttaggaaataaa

SEQ ID NO: 6939011 - DNA, 22 bp, Homo sapiens
cagagccataaaggtgaaagag

SEQ ID NO: 6939012 - DNA, 22 bp, Homo sapiens
tgtatacaattcacacttccca

SEQ ID NO: 6939013 - DNA, 22 bp, Homo sapiens
tggcggctcaggaggggcagtt

SEQ ID NO: 6939014 - DNA, 22 bp, Homo sapiens
ggactgcctctgtcaccccagc

SEQ ID NO: 6939015 - DNA, 22 bp, Homo sapiens
gcactctgtttctcctgtcagc

SEQ ID NO: 6939016 - DNA, 22 bp, Homo sapiens
atcagactcagaaatgacgtgg

SEQ ID NO: 6939017 - DNA, 22 bp, Homo sapiens
cacagagacagatctattttgc

SEQ ID NO: 6939018 - DNA, 22 bp, Homo sapiens
acagagaaagttcctctcaggc

SEQ ID NO: 6939019 - DNA, 22 bp, Homo sapiens
tggcacttccgtctgccttgtg

SEQ ID NO: 6939020 - DNA, 22 bp, Homo sapiens
aggccatcaaatcatgtagtgc

SEQ ID NO: 6939021 - DNA, 22 bp, Homo sapiens
cagcccagctctgactaaccct

SEQ ID NO: 6939022 - DNA, 22 bp, Homo sapiens
gattaggcagtcaaggctaaga

SEQ ID NO: 6939023 - DNA, 21 bp, Homo sapiens
gggctggacatggtggctcat

SEQ ID NO: 6939024 - DNA, 22 bp, Homo sapiens
acacaggagatatgtaatggct

SEQ ID NO: 6939025 - DNA, 22 bp, Homo sapiens
aaagaataccctgggtcataaa

SEQ ID NO: 6939026 - DNA, 22 bp, Homo sapiens
tgccttctcttccctgggagct

SEQ ID NO: 6939027 - DNA, 22 bp, Homo sapiens
aggatggcttgcaggaggctgt

SEQ ID NO: 6939028 - DNA, 19 bp, Homo sapiens
ccacagagactagaagaca

SEQ ID NO: 6939029 - DNA, 22 bp, Homo sapiens
cagagctgagaatgttgatgct

SEQ ID NO: 6939030 - DNA, 22 bp, Homo sapiens
tgtagcatgtaaattggttatt

SEQ ID NO: 6939031 - DNA, 22 bp, Homo sapiens
tcagcatctacagctttgctat

SEQ ID NO: 6939032 - DNA, 22 bp, Homo sapiens
gtcacagggtccccatatggag

SEQ ID NO: 6939033 - DNA, 22 bp, Homo sapiens
cagagctgcttcccagtttgtg

SEQ ID NO: 6939034 - DNA, 17 bp, Homo sapiens
gggcgcgggtagagccc

SEQ ID NO: 6939035 - DNA, 22 bp, Homo sapiens
atgcagaatgagttcacgatct

SEQ ID NO: 6939036 - DNA, 22 bp, Homo sapiens
gccatgttcttgaatctgggtc

SEQ ID NO: 6939037 - DNA, 22 bp, Homo sapiens
tcagaggagatggttaccaggg

SEQ ID NO: 6939038 - DNA, 22 bp, Homo sapiens
ttgctcatttgcctttaggttt

SEQ ID NO: 6939039 - DNA, 19 bp, Homo sapiens
agatgtctatttgactatc

SEQ ID NO: 6939040 - DNA, 22 bp, Homo sapiens
ttcctcctacgcttatcacttt

SEQ ID NO: 6939041 - DNA, 22 bp, Homo sapiens
aaaatgtgtttatgcatttcgt

SEQ ID NO: 6939042 - DNA, 22 bp, Homo sapiens
atggcagcaaatgtctggctgg

SEQ ID NO: 6939043 - DNA, 22 bp, Homo sapiens
tgttcattacccatcccaggtc

SEQ ID NO: 6939044 - DNA, 22 bp, Homo sapiens
gctgctagggcattatgataaa

SEQ ID NO: 6939045 - DNA, 22 bp, Homo sapiens
tcctggtggatagaagccaagg

SEQ ID NO: 6939046 - DNA, 20 bp, Homo sapiens
attgaaatttttctgagatt

SEQ ID NO: 6939047 - DNA, 22 bp, Homo sapiens
tggcaaagacgctagctaagat

SEQ ID NO: 6939048 - DNA, 22 bp, Homo sapiens
tgcaggccggccctaggcctca

SEQ ID NO: 6939049 - DNA, 20 bp, Homo sapiens
agtggcaggcgatcattact

SEQ ID NO: 6939050 - DNA, 22 bp, Homo sapiens
tacagtctctgataactgtcag

SEQ ID NO: 6939051 - DNA, 22 bp, Homo sapiens
ctgaggtgatgtcaaatgggtt

SEQ ID NO: 6939052 - DNA, 21 bp, Homo sapiens
aagcagcttaataaagtatgt

SEQ ID NO: 6939053 - DNA, 22 bp, Homo sapiens
tcaaccatccggcttatcctgc

SEQ ID NO: 6939054 - DNA, 22 bp, Homo sapiens
gtcagaagcatttgtggctgaa

SEQ ID NO: 6939055 - DNA, 22 bp, Homo sapiens
gtctccagggctgctggcgcct

SEQ ID NO: 6939056 - DNA, 22 bp, Homo sapiens
atatgccattagctagaaataa

SEQ ID NO: 6939057 - DNA, 19 bp, Homo sapiens
gctgggagcagaccctccc

SEQ ID NO: 6939058 - DNA, 22 bp, Homo sapiens
ttggaccagtggattatggtgg

SEQ ID NO: 6939059 - DNA, 22 bp, Homo sapiens
agtccttagaacagtgcctggg

SEQ ID NO: 6939060 - DNA, 22 bp, Homo sapiens
agtgcagagagcaatactctac

SEQ ID NO: 6939061 - DNA, 22 bp, Homo sapiens
gtctgctcgctgctcagccctg

SEQ ID NO: 6939062 - DNA, 22 bp, Homo sapiens
caagcttaagacagaagaggca

SEQ ID NO: 6939063 - DNA, 22 bp, Homo sapiens
acctcttaatattgcaccttct

SEQ ID NO: 6939064 - DNA, 21 bp, Homo sapiens
tcattcgatttcctctatctc

SEQ ID NO: 6939065 - DNA, 19 bp, Homo sapiens
tagcttcacgtggtctaga

SEQ ID NO: 6939066 - DNA, 22 bp, Homo sapiens
agcagggttccaggagttgcag

SEQ ID NO: 6939067 - DNA, 22 bp, Homo sapiens
gcagtttgaggttttctgatgt

SEQ ID NO: 6939068 - DNA, 22 bp, Homo sapiens
tattatgtaaaggttattgcag

SEQ ID NO: 6939069 - DNA, 22 bp, Homo sapiens
tgtacagtattggtgttagtag

SEQ ID NO: 6939070 - DNA, 22 bp, Homo sapiens
ttaagactaaatgaggtcataa

SEQ ID NO: 6939071 - DNA, 22 bp, Homo sapiens
ttgagctctcctcatcaccctg

SEQ ID NO: 6939072 - DNA, 22 bp, Homo sapiens
ttgtactatcaccatgtcatgt

SEQ ID NO: 6939073 - DNA, 22 bp, Homo sapiens
tgccatattgcaaagtgtctgc

SEQ ID NO: 6939074 - DNA, 22 bp, Homo sapiens
actggacatttctagaaagcag

SEQ ID NO: 6939075 - DNA, 22 bp, Homo sapiens
aagcctgctttgttccacagca

SEQ ID NO: 6939076 - DNA, 22 bp, Homo sapiens
tgtgtaatatttcgtggcatgt

SEQ ID NO: 6939077 - DNA, 22 bp, Homo sapiens
ctgggagtctaagctagcaccg

SEQ ID NO: 6939078 - DNA, 22 bp, Homo sapiens
cagcatcttctagatccaggct

SEQ ID NO: 6939079 - DNA, 22 bp, Homo sapiens
acactggttgttaatagtaaca

SEQ ID NO: 6939080 - DNA, 20 bp, Homo sapiens
tgtccccacccaaatctcat

SEQ ID NO: 6939081 - DNA, 18 bp, Homo sapiens
tactgtttaattgattac

SEQ ID NO: 6939082 - DNA, 22 bp, Homo sapiens
tcctgaccattccttgtctcca

SEQ ID NO: 6939083 - DNA, 22 bp, Homo sapiens
ctgggggcaagcagacagctgt

SEQ ID NO: 6939084 - DNA, 22 bp, Homo sapiens
ctggctaattgtcagttgttac

SEQ ID NO: 6939085 - DNA, 22 bp, Homo sapiens
aaacagtagaagtgtattttat

SEQ ID NO: 6939086 - DNA, 23 bp, Homo sapiens
taacaatggactcctcttagcta

SEQ ID NO: 6939087 - DNA, 22 bp, Homo sapiens
tgaactttttctctacgggcca

SEQ ID NO: 6939088 - DNA, 22 bp, Homo sapiens
ttggccaatggtgattcccggc

SEQ ID NO: 6939089 - DNA, 22 bp, Homo sapiens
cagcgcagtgtaggtggggggc

SEQ ID NO: 6939090 - DNA, 22 bp, Homo sapiens
aacttttctgtgttgtccggga

SEQ ID NO: 6939091 - DNA, 22 bp, Homo sapiens
ttgggtaggattcagcagtgtg

SEQ ID NO: 6939092 - DNA, 22 bp, Homo sapiens
gctgctgtaacactaagtgcag

SEQ ID NO: 6939093 - DNA, 22 bp, Homo sapiens
acactggataccactgttatta

SEQ ID NO: 6939094 - DNA, 22 bp, Homo sapiens
caggaatgatctgctgagtgat

SEQ ID NO: 6939095 - DNA, 22 bp, Homo sapiens
ttgaactttcagaaaatggcag

SEQ ID NO: 6939096 - DNA, 22 bp, Homo sapiens
ctgagaggcggaggttgcagtg

SEQ ID NO: 6939097 - DNA, 22 bp, Homo sapiens
ggccaagctctcattccagcac

SEQ ID NO: 6939098 - DNA, 22 bp, Homo sapiens
agtaattggctacagtgtaatt

SEQ ID NO: 6939099 - DNA, 22 bp, Homo sapiens
acaatttggacatgtgcaggat

SEQ ID NO: 6939100 - DNA, 21 bp, Homo sapiens
gtcagggattcaagtgctcac

SEQ ID NO: 6939101 - DNA, 22 bp, Homo sapiens
gaattctaccagggcaagaggg

SEQ ID NO: 6939102 - DNA, 22 bp, Homo sapiens
cagacagaaggaaggccaacat

SEQ ID NO: 6939103 - DNA, 22 bp, Homo sapiens
ggcactgggcaccggctgaggg

SEQ ID NO: 6939104 - DNA, 22 bp, Homo sapiens
aactattctgtggactcttata

SEQ ID NO: 6939105 - DNA, 22 bp, Homo sapiens
ttattcagtgcatatattaaaa

SEQ ID NO: 6939106 - DNA, 22 bp, Homo sapiens
cttggactttccagcttctaaa

SEQ ID NO: 6939107 - DNA, 22 bp, Homo sapiens
tgatgtgaactcttgatatgat

SEQ ID NO: 6939108 - DNA, 22 bp, Homo sapiens
gggctccagcagaggcagccgg

SEQ ID NO: 6939109 - DNA, 22 bp, Homo sapiens
ttctgtgtgtctcagcaagctg

SEQ ID NO: 6939110 - DNA, 22 bp, Homo sapiens
cagatttcagctcatatattat

SEQ ID NO: 6939111 - DNA, 22 bp, Homo sapiens
tgctcagaagacttactggtta

SEQ ID NO: 6939112 - DNA, 22 bp, Homo sapiens
gaggttccccattgtactggct

SEQ ID NO: 6939113 - DNA, 22 bp, Homo sapiens
tcagggaatgtgatacaggaag

SEQ ID NO: 6939114 - DNA, 22 bp, Homo sapiens
acttctgataaagagcatgtgc

SEQ ID NO: 6939115 - DNA, 22 bp, Homo sapiens
ggggagctgggaggtgagttac

SEQ ID NO: 6939116 - DNA, 22 bp, Homo sapiens
tggtatcatgacctcagcagag

SEQ ID NO: 6939117 - DNA, 22 bp, Homo sapiens
tattagaggaaccaaggtggag

SEQ ID NO: 6939118 - DNA, 20 bp, Homo sapiens
ttgagcttccaagtctttgt

SEQ ID NO: 6939119 - DNA, 22 bp, Homo sapiens
gtggtcaggcagtgggagagaa

SEQ ID NO: 6939120 - DNA, 22 bp, Homo sapiens
gtgcacagagcccagggccgcg

SEQ ID NO: 6939121 - DNA, 22 bp, Homo sapiens
tgggcccatcattgctgtgggc

SEQ ID NO: 6939122 - DNA, 22 bp, Homo sapiens
ccaggcttgaagggaagaatgg

SEQ ID NO: 6939123 - DNA, 21 bp, Homo sapiens
acagagccgggcacaaagctg

SEQ ID NO: 6939124 - DNA, 22 bp, Homo sapiens
tctgtttcaagtagggcttata

SEQ ID NO: 6939125 - DNA, 22 bp, Homo sapiens
aaatacagagttatggacctca

SEQ ID NO: 6939126 - DNA, 22 bp, Homo sapiens
ccagtgttccatggagtgatta

SEQ ID NO: 6939127 - DNA, 22 bp, Homo sapiens
atgcaagagcaatatggtatgc

SEQ ID NO: 6939128 - DNA, 22 bp, Homo sapiens
tgaagcaatagagacaagacca

SEQ ID NO: 6939129 - DNA, 22 bp, Homo sapiens
atggctgctgccttcccctgct

SEQ ID NO: 6939130 - DNA, 22 bp, Homo sapiens
acaaggattaaggtatgcaaca

SEQ ID NO: 6939131 - DNA, 18 bp, Homo sapiens
ttaagtgctatgcaattg

SEQ ID NO: 6939132 - DNA, 22 bp, Homo sapiens
caaatgtttggtggcattttgt

SEQ ID NO: 6939133 - DNA, 22 bp, Homo sapiens
taaatgtctttgtcacgttggg

SEQ ID NO: 6939134 - DNA, 22 bp, Homo sapiens
tgctgcttcctggtagatagga

SEQ ID NO: 6939135 - DNA, 22 bp, Homo sapiens
tcatactagtttaatgatcttc

SEQ ID NO: 6939136 - DNA, 20 bp, Homo sapiens
gacaggagagttaggtaggt

SEQ ID NO: 6939137 - DNA, 22 bp, Homo sapiens
agaacctttctttagaaattca

SEQ ID NO: 6939138 - DNA, 22 bp, Homo sapiens
atcttagggttctgtttttaag

SEQ ID NO: 6939139 - DNA, 22 bp, Homo sapiens
ctggacttaggcaggcaccccg

SEQ ID NO: 6939140 - DNA, 22 bp, Homo sapiens
aagcgccatggttcctgcgcag

SEQ ID NO: 6939141 - DNA, 22 bp, Homo sapiens
atggcagcatgggattggtaga

SEQ ID NO: 6939142 - DNA, 22 bp, Homo sapiens
caagggaagaggacagggacct

SEQ ID NO: 6939143 - DNA, 22 bp, Homo sapiens
ccagcttttcagaatctgcctg

SEQ ID NO: 6939144 - DNA, 22 bp, Homo sapiens
catgtacccctgagagtcttgc

SEQ ID NO: 6939145 - DNA, 22 bp, Homo sapiens
tttggcactgttctaggtgcaa

SEQ ID NO: 6939146 - DNA, 22 bp, Homo sapiens
tttgggaactggacttcctgct

SEQ ID NO: 6939147 - DNA, 22 bp, Homo sapiens
ttggctttcagaatccctatct

SEQ ID NO: 6939148 - DNA, 22 bp, Homo sapiens
atgaggtaaagtttaagctaag

SEQ ID NO: 6939149 - DNA, 22 bp, Homo sapiens
ttgcctgattagtctcagattg

SEQ ID NO: 6939150 - DNA, 22 bp, Homo sapiens
tgggtcccaggaaggaccagca

SEQ ID NO: 6939151 - DNA, 20 bp, Homo sapiens
agaccctgtgtcctgtggcc

SEQ ID NO: 6939152 - DNA, 17 bp, Homo sapiens
ttcagcagtgtttctcc

SEQ ID NO: 6939153 - DNA, 22 bp, Homo sapiens
gtccatctcttattgatcctaa

SEQ ID NO: 6939154 - DNA, 18 bp, Homo sapiens
tgtttatttttctcttac

SEQ ID NO: 6939155 - DNA, 22 bp, Homo sapiens
tagaaagtaaacacgaagtctc

SEQ ID NO: 6939156 - DNA, 23 bp, Homo sapiens
tacattgtggatggagtcctggg

SEQ ID NO: 6939157 - DNA, 22 bp, Homo sapiens
caggcacctcacgtgggtccca

SEQ ID NO: 6939158 - DNA, 22 bp, Homo sapiens
tagcagagtaatactttggagc

SEQ ID NO: 6939159 - DNA, 22 bp, Homo sapiens
ccagccacgaagctcccttcat

SEQ ID NO: 6939160 - DNA, 22 bp, Homo sapiens
acactgtgacaaaggctgttct

SEQ ID NO: 6939161 - DNA, 22 bp, Homo sapiens
gaatgtaataggaaacgtgtgg

SEQ ID NO: 6939162 - DNA, 18 bp, Homo sapiens
taagtcattttgccagca

SEQ ID NO: 6939163 - DNA, 22 bp, Homo sapiens
ttctggcttatcctaactctaa

SEQ ID NO: 6939164 - DNA, 22 bp, Homo sapiens
ctgaagtggacaaatggagtgg

SEQ ID NO: 6939165 - DNA, 22 bp, Homo sapiens
aaagagccgctgatgtcagccc

SEQ ID NO: 6939166 - DNA, 22 bp, Homo sapiens
gaggctcaaacctggacagagc

SEQ ID NO: 6939167 - DNA, 22 bp, Homo sapiens
tgcccttgaaatacgcttgggg

SEQ ID NO: 6939168 - DNA, 22 bp, Homo sapiens
cctcctggaaaaattccctggc

SEQ ID NO: 6939169 - DNA, 22 bp, Homo sapiens
gacaggcaattaccagcgccca

SEQ ID NO: 6939170 - DNA, 22 bp, Homo sapiens
ttacacaattactcactcctgg

SEQ ID NO: 6939171 - DNA, 22 bp, Homo sapiens
aggctctgcaggtatttcttga

SEQ ID NO: 6939172 - DNA, 22 bp, Homo sapiens
ctttattagatgtagactttct

SEQ ID NO: 6939173 - DNA, 22 bp, Homo sapiens
aagagactggaaactagggtca

SEQ ID NO: 6939174 - DNA, 22 bp, Homo sapiens
ttgcatttgatcttgggttctc

SEQ ID NO: 6939175 - DNA, 22 bp, Homo sapiens
gaaaccctgagaggtggtctgg

SEQ ID NO: 6939176 - DNA, 22 bp, Homo sapiens
tacaggaaccagattgttcagc

SEQ ID NO: 6939177 - DNA, 22 bp, Homo sapiens
gtcctggggattatagagtgtt

SEQ ID NO: 6939178 - DNA, 22 bp, Homo sapiens
cagcagagctgggaataaaatt

SEQ ID NO: 6939179 - DNA, 22 bp, Homo sapiens
ggctgagggtatagctgtccca

SEQ ID NO: 6939180 - DNA, 20 bp, Homo sapiens
gccaattgtgtggtgggctg

SEQ ID NO: 6939181 - DNA, 22 bp, Homo sapiens
tgaaatctgcatgcaaagtcct

SEQ ID NO: 6939182 - DNA, 22 bp, Homo sapiens
atggaagtgcaacttgctcatc

SEQ ID NO: 6939183 - DNA, 22 bp, Homo sapiens
gggctctggggtcagacagcct

SEQ ID NO: 6939184 - DNA, 22 bp, Homo sapiens
cgagagccggaaggggcggtgc

SEQ ID NO: 6939185 - DNA, 22 bp, Homo sapiens
gcagcgaggtgatgaaatagct

SEQ ID NO: 6939186 - DNA, 22 bp, Homo sapiens
gtgggcaggagtgagcaacagg

SEQ ID NO: 6939187 - DNA, 22 bp, Homo sapiens
tgttaaatgagattggaatttg

SEQ ID NO: 6939188 - DNA, 22 bp, Homo sapiens
aatttccagaccccatccacag

SEQ ID NO: 6939189 - DNA, 22 bp, Homo sapiens
tagatttcaggagacaaaatgg

SEQ ID NO: 6939190 - DNA, 22 bp, Homo sapiens
tgtgtgttctcaattattgatg

SEQ ID NO: 6939191 - DNA, 22 bp, Homo sapiens
cacaaagtggcaggagaggaga

SEQ ID NO: 6939192 - DNA, 22 bp, Homo sapiens
gagcttgggtgccatgctgagc

SEQ ID NO: 6939193 - DNA, 19 bp, Homo sapiens
taactggttaaaaagcttg

SEQ ID NO: 6939194 - DNA, 22 bp, Homo sapiens
acaaggacgtcacttccacggt

SEQ ID NO: 6939195 - DNA, 22 bp, Homo sapiens
atttgagcttggtagaggagag

SEQ ID NO: 6939196 - DNA, 22 bp, Homo sapiens
catgcttatatggaaaggaaga

SEQ ID NO: 6939197 - DNA, 19 bp, Homo sapiens
aaggaaccctgggttgctc

SEQ ID NO: 6939198 - DNA, 20 bp, Homo sapiens
aagggagaataatgattgta

SEQ ID NO: 6939199 - DNA, 22 bp, Homo sapiens
aagcataaaacgttacaacatg

SEQ ID NO: 6939200 - DNA, 22 bp, Homo sapiens
cctggctccaaagctgtgactc

SEQ ID NO: 6939201 - DNA, 22 bp, Homo sapiens
attgaatgcttgctaacacttt

SEQ ID NO: 6939202 - DNA, 22 bp, Homo sapiens
ctgcttcctgctgggatactga

SEQ ID NO: 6939203 - DNA, 22 bp, Homo sapiens
ctacagtgtgacaggcttggtg

SEQ ID NO: 6939204 - DNA, 22 bp, Homo sapiens
atttctccttgttgcaatgcag

SEQ ID NO: 6939205 - DNA, 22 bp, Homo sapiens
agtttggaagtcaggcttttct

SEQ ID NO: 6939206 - DNA, 22 bp, Homo sapiens
ggcagcagtaggagctaatctt

SEQ ID NO: 6939207 - DNA, 22 bp, Homo sapiens
tccaggacctgactgggcctgc

SEQ ID NO: 6939208 - DNA, 22 bp, Homo sapiens
cgatcaccgtggccactttgag

SEQ ID NO: 6939209 - DNA, 22 bp, Homo sapiens
gtgcccctggcaaatttccctg

SEQ ID NO: 6939210 - DNA, 22 bp, Homo sapiens
tctaaagagagtgggtacatgt

SEQ ID NO: 6939211 - DNA, 22 bp, Homo sapiens
gaaatttacaactttctcatgg

SEQ ID NO: 6939212 - DNA, 23 bp, Homo sapiens
agatctgatgttaccaagaattg

SEQ ID NO: 6939213 - DNA, 22 bp, Homo sapiens
tagtcacctgtgagctgcgtag

SEQ ID NO: 6939214 - DNA, 19 bp, Homo sapiens
tgggcctctcatatctgcc

SEQ ID NO: 6939215 - DNA, 17 bp, Homo sapiens
gcaaaggtgaggagaga

SEQ ID NO: 6939216 - DNA, 22 bp, Homo sapiens
aaacctcttctcaagatttctg

SEQ ID NO: 6939217 - DNA, 22 bp, Homo sapiens
tcagtcttgtttttctggtcca

SEQ ID NO: 6939218 - DNA, 22 bp, Homo sapiens
aacattcagctgggtggagcag

SEQ ID NO: 6939219 - DNA, 23 bp, Homo sapiens
tgtgccattgaggctgaggctca

SEQ ID NO: 6939220 - DNA, 22 bp, Homo sapiens
tgtaaattgtcacctaaatgct

SEQ ID NO: 6939221 - DNA, 22 bp, Homo sapiens
tagatgcttgttcagaaatagg

SEQ ID NO: 6939222 - DNA, 22 bp, Homo sapiens
ccttggggaactggacgtgctg

SEQ ID NO: 6939223 - DNA, 22 bp, Homo sapiens
aacacctaaaaatcattgttga

SEQ ID NO: 6939224 - DNA, 22 bp, Homo sapiens
aagtcacaaagtgctgtacatg

SEQ ID NO: 6939225 - DNA, 18 bp, Homo sapiens
tcagtgtagatctgtgta

SEQ ID NO: 6939226 - DNA, 22 bp, Homo sapiens
gagaggctggtaaagtctgaac

SEQ ID NO: 6939227 - DNA, 22 bp, Homo sapiens
tgagttattgagaaataactgc

SEQ ID NO: 6939228 - DNA, 20 bp, Homo sapiens
gtgcagcacttgggggtagg

SEQ ID NO: 6939229 - DNA, 22 bp, Homo sapiens
tcaggcctgcaaggagagtccc

SEQ ID NO: 6939230 - DNA, 22 bp, Homo sapiens
agtgcagctttttctttacatg

SEQ ID NO: 6939231 - DNA, 22 bp, Homo sapiens
agcagaacagtcttctagttct

SEQ ID NO: 6939232 - DNA, 22 bp, Homo sapiens
gtatatgtgtgggcctgcatat

SEQ ID NO: 6939233 - DNA, 21 bp, Homo sapiens
tgacaggtatttatctggaaa

SEQ ID NO: 6939234 - DNA, 22 bp, Homo sapiens
ttattcccaggctgtctggttg

SEQ ID NO: 6939235 - DNA, 22 bp, Homo sapiens
taggcagcagtgctatgattct

SEQ ID NO: 6939236 - DNA, 22 bp, Homo sapiens
gtccaagagggagctacagagc

SEQ ID NO: 6939237 - DNA, 22 bp, Homo sapiens
ttttacacctgttaactctaag

SEQ ID NO: 6939238 - DNA, 22 bp, Homo sapiens
ctgctggagggagctgatagtg

SEQ ID NO: 6939239 - DNA, 17 bp, Homo sapiens
tgtataacctctggctt

SEQ ID NO: 6939240 - DNA, 22 bp, Homo sapiens
gatttagattcgctggggctgg

SEQ ID NO: 6939241 - DNA, 22 bp, Homo sapiens
attaaagtgaagttctcagatg

SEQ ID NO: 6939242 - DNA, 22 bp, Homo sapiens
aggctgtgtggataatattggg

SEQ ID NO: 6939243 - DNA, 22 bp, Homo sapiens
atacatagatagataatctggc

SEQ ID NO: 6939244 - DNA, 22 bp, Homo sapiens
tcttagaagttcatgttccagc

SEQ ID NO: 6939245 - DNA, 22 bp, Homo sapiens
gaaagcatgtagcctgtatcca

SEQ ID NO: 6939246 - DNA, 18 bp, Homo sapiens
ctggagtcacagtgggga

SEQ ID NO: 6939247 - DNA, 22 bp, Homo sapiens
agctgtgtgtgcttgggattat

SEQ ID NO: 6939248 - DNA, 22 bp, Homo sapiens
gagcctgtgtttcctgtagcca

SEQ ID NO: 6939249 - DNA, 22 bp, Homo sapiens
accaggacttcattaggttctt

SEQ ID NO: 6939250 - DNA, 22 bp, Homo sapiens
ttccaaaacagtatggcatgtg

SEQ ID NO: 6939251 - DNA, 22 bp, Homo sapiens
ctctggttcaaagtagtataat

SEQ ID NO: 6939252 - DNA, 22 bp, Homo sapiens
gtttagaacacggaaatactga

SEQ ID NO: 6939253 - DNA, 20 bp, Homo sapiens
aggaggcaatgtagataagc

SEQ ID NO: 6939254 - DNA, 22 bp, Homo sapiens
gtcgttctctgccagggcgttg

SEQ ID NO: 6939255 - DNA, 19 bp, Homo sapiens
aactgcttctgaaggagcc

SEQ ID NO: 6939256 - DNA, 22 bp, Homo sapiens
caagtgtccatgatagtcttag

SEQ ID NO: 6939257 - DNA, 22 bp, Homo sapiens
aaacatgagcacttgcttcata

SEQ ID NO: 6939258 - DNA, 22 bp, Homo sapiens
tgtgtgtgacaacctagttcag

SEQ ID NO: 6939259 - DNA, 22 bp, Homo sapiens
gcaagtgaatgaggttgagatt

SEQ ID NO: 6939260 - DNA, 23 bp, Homo sapiens
tctggacataacggagaagcaaa

SEQ ID NO: 6939261 - DNA, 22 bp, Homo sapiens
tgcaggtaaatttgtggaggat

SEQ ID NO: 6939262 - DNA, 22 bp, Homo sapiens
gtgctaataatgtgttaatttc

SEQ ID NO: 6939263 - DNA, 22 bp, Homo sapiens
atcagagccttatgcttctcat

SEQ ID NO: 6939264 - DNA, 22 bp, Homo sapiens
tacatacatggtggaatggtta

SEQ ID NO: 6939265 - DNA, 16 bp, Homo sapiens
ttctctgttccttgtg

SEQ ID NO: 6939266 - DNA, 21 bp, Homo sapiens
tccagggtcagaagttcagtg

SEQ ID NO: 6939267 - DNA, 22 bp, Homo sapiens
ggagggggactgacactgattt

SEQ ID NO: 6939268 - DNA, 22 bp, Homo sapiens
aaccagtatgtttaggaggtga

SEQ ID NO: 6939269 - DNA, 22 bp, Homo sapiens
gggtgggtggtccgcagacata

SEQ ID NO: 6939270 - DNA, 22 bp, Homo sapiens
ctgtgccttctgcctggaacat

SEQ ID NO: 6939271 - DNA, 22 bp, Homo sapiens
caggtgtttcctgaagttgatg

SEQ ID NO: 6939272 - DNA, 22 bp, Homo sapiens
tgaggcagtattctccattcca

SEQ ID NO: 6939273 - DNA, 23 bp, Homo sapiens
ttgctgagataaagaatgcaggg

SEQ ID NO: 6939274 - DNA, 22 bp, Homo sapiens
acatttcagcgtgcatgacatg

SEQ ID NO: 6939275 - DNA, 22 bp, Homo sapiens
ctagtgaaatttgcaagtaatt

SEQ ID NO: 6939276 - DNA, 22 bp, Homo sapiens
gcaccttgggaagcgccagttg

SEQ ID NO: 6939277 - DNA, 22 bp, Homo sapiens
aggcttcaaggacagcagccac

SEQ ID NO: 6939278 - DNA, 22 bp, Homo sapiens
caaagataatcacagaataccc

SEQ ID NO: 6939279 - DNA, 22 bp, Homo sapiens
tcttccttctttgatgacaagg

SEQ ID NO: 6939280 - DNA, 22 bp, Homo sapiens
gcaaagttcctactttactgga

SEQ ID NO: 6939281 - DNA, 22 bp, Homo sapiens
aacatgcacaattttaggcctg

SEQ ID NO: 6939282 - DNA, 22 bp, Homo sapiens
tgctaggggtcagcaccatatc

SEQ ID NO: 6939283 - DNA, 22 bp, Homo sapiens
cgtgacagggtctggctggtca

SEQ ID NO: 6939284 - DNA, 22 bp, Homo sapiens
ctgacagatacttatgacataa

SEQ ID NO: 6939285 - DNA, 22 bp, Homo sapiens
caggaacatgtctccaattaga

SEQ ID NO: 6939286 - DNA, 22 bp, Homo sapiens
ttggaatgttttaatataaatt

SEQ ID NO: 6939287 - DNA, 21 bp, Homo sapiens
caaatgctggctggatgagga

SEQ ID NO: 6939288 - DNA, 22 bp, Homo sapiens
ttccacaaatcaattctgctga

SEQ ID NO: 6939289 - DNA, 22 bp, Homo sapiens
gggctcctgcctcctggcacct

SEQ ID NO: 6939290 - DNA, 22 bp, Homo sapiens
tgctctgtaacaaattgacatg

SEQ ID NO: 6939291 - DNA, 22 bp, Homo sapiens
ttaagctcccagaagagggaga

SEQ ID NO: 6939292 - DNA, 22 bp, Homo sapiens
gacgtgaaggcagcggggctcg

SEQ ID NO: 6939293 - DNA, 22 bp, Homo sapiens
aggatataaaaagactatttgg

SEQ ID NO: 6939294 - DNA, 22 bp, Homo sapiens
tatgacatttctctgatttgtg

SEQ ID NO: 6939295 - DNA, 22 bp, Homo sapiens
tggtccttcacagccacactct

SEQ ID NO: 6939296 - DNA, 22 bp, Homo sapiens
tctcattgtagaaagactgatt

SEQ ID NO: 6939297 - DNA, 22 bp, Homo sapiens
taatgttataaattcttggttt

SEQ ID NO: 6939298 - DNA, 22 bp, Homo sapiens
gcaggaaccactgcccccctgt

SEQ ID NO: 6939299 - DNA, 22 bp, Homo sapiens
aaattcagttcctcagccacat

SEQ ID NO: 6939300 - DNA, 22 bp, Homo sapiens
agagggataatatgtattgtaa

SEQ ID NO: 6939301 - DNA, 22 bp, Homo sapiens
gatttcctcactaacatccatc

SEQ ID NO: 6939302 - DNA, 22 bp, Homo sapiens
gtgaggtctttgggaggtgatt

SEQ ID NO: 6939303 - DNA, 22 bp, Homo sapiens
atggcttccaaggccctccgtg

SEQ ID NO: 6939304 - DNA, 22 bp, Homo sapiens
acaaagtgcacaagatgagaac

SEQ ID NO: 6939305 - DNA, 22 bp, Homo sapiens
tagaaactcaggatactcttcc

SEQ ID NO: 6939306 - DNA, 22 bp, Homo sapiens
tttcacatcagaggtagattag

SEQ ID NO: 6939307 - DNA, 22 bp, Homo sapiens
cacttcagctacaatcacatga

SEQ ID NO: 6939308 - DNA, 22 bp, Homo sapiens
ctcagtggggcgacagggtgct

SEQ ID NO: 6939309 - DNA, 22 bp, Homo sapiens
ctgttttaatggagactgatgt

SEQ ID NO: 6939310 - DNA, 22 bp, Homo sapiens
cctttctctttgctgatcatgt

SEQ ID NO: 6939311 - DNA, 22 bp, Homo sapiens
gatggaggagatggcagggtgc

SEQ ID NO: 6939312 - DNA, 22 bp, Homo sapiens
ggcagagacaccgaatgactct

SEQ ID NO: 6939313 - DNA, 22 bp, Homo sapiens
actgcacagaagaaactatcaa

SEQ ID NO: 6939314 - DNA, 22 bp, Homo sapiens
tcggactcggcaaggctatgca

SEQ ID NO: 6939315 - DNA, 22 bp, Homo sapiens
aaagtatatttacttactgtga

SEQ ID NO: 6939316 - DNA, 22 bp, Homo sapiens
ttatgtcttaagtatgctaatt

SEQ ID NO: 6939317 - DNA, 22 bp, Homo sapiens
aaactgtatatttatggcatgt

SEQ ID NO: 6939318 - DNA, 22 bp, Homo sapiens
aagctggcaaacaagcatcatt

SEQ ID NO: 6939319 - DNA, 22 bp, Homo sapiens
gtggtcaggggctgtggctatg

SEQ ID NO: 6939320 - DNA, 22 bp, Homo sapiens
ggagatagacttggtgagccac

SEQ ID NO: 6939321 - DNA, 22 bp, Homo sapiens
aaggtccttttgcagtgtgatc

SEQ ID NO: 6939322 - DNA, 22 bp, Homo sapiens
gctccccagcttagccctggct

SEQ ID NO: 6939323 - DNA, 22 bp, Homo sapiens
cacaggtttgacaaggataaaa

SEQ ID NO: 6939324 - DNA, 23 bp, Homo sapiens
cgcccagcctcagtgacctgggc

SEQ ID NO: 6939325 - DNA, 22 bp, Homo sapiens
tctctgagttttaaggatgatg

SEQ ID NO: 6939326 - DNA, 22 bp, Homo sapiens
ctaaatgatggatttaaacttt

SEQ ID NO: 6939327 - DNA, 22 bp, Homo sapiens
ttggaattcaagttgtagctta

SEQ ID NO: 6939328 - DNA, 22 bp, Homo sapiens
catttcacgcacactcattact

SEQ ID NO: 6939329 - DNA, 21 bp, Homo sapiens
cagtgaggtccccagcctagg

SEQ ID NO: 6939330 - DNA, 22 bp, Homo sapiens
ccctgtgccagagaggcaggag

SEQ ID NO: 6939331 - DNA, 22 bp, Homo sapiens
tgataactttaatttgatctga

SEQ ID NO: 6939332 - DNA, 22 bp, Homo sapiens
agatatgtgccaattgttataa

SEQ ID NO: 6939333 - DNA, 19 bp, Homo sapiens
cacacccatgcttgccaag

SEQ ID NO: 6939334 - DNA, 22 bp, Homo sapiens
tgtcaggtcagacttggttttt

SEQ ID NO: 6939335 - DNA, 22 bp, Homo sapiens
acgggtggctgaggaggcctct

SEQ ID NO: 6939336 - DNA, 21 bp, Homo sapiens
agctgcagcccaaaggcctgt

SEQ ID NO: 6939337 - DNA, 22 bp, Homo sapiens
ttggaaggttctggtcatggtt

SEQ ID NO: 6939338 - DNA, 22 bp, Homo sapiens
tcagcaaaggcaattcattatt

SEQ ID NO: 6939339 - DNA, 18 bp, Homo sapiens
tggagcaggtaggcatga

SEQ ID NO: 6939340 - DNA, 22 bp, Homo sapiens
aggctgctgccttggagagtgt

SEQ ID NO: 6939341 - DNA, 22 bp, Homo sapiens
gaactgggtccttgagtctaga

SEQ ID NO: 6939342 - DNA, 22 bp, Homo sapiens
aaacatgaatagatattaaaca

SEQ ID NO: 6939343 - DNA, 22 bp, Homo sapiens
ttccttgcctcggggtaccttg

SEQ ID NO: 6939344 - DNA, 22 bp, Homo sapiens
tggtgtctcttagtacatagat

SEQ ID NO: 6939345 - DNA, 22 bp, Homo sapiens
tagcagcccagtttctggccaa

SEQ ID NO: 6939346 - DNA, 22 bp, Homo sapiens
ctggaagaggacacacgaatca

SEQ ID NO: 6939347 - DNA, 22 bp, Homo sapiens
taaaactagtggttgggactaa

SEQ ID NO: 6939348 - DNA, 22 bp, Homo sapiens
agaggatctaagtgagtcctca

SEQ ID NO: 6939349 - DNA, 22 bp, Homo sapiens
gggcttctggctactgtatgag

SEQ ID NO: 6939350 - DNA, 19 bp, Homo sapiens
ttctgctagaccatttgtt

SEQ ID NO: 6939351 - DNA, 20 bp, Homo sapiens
atctgaggctgtcgctggaa

SEQ ID NO: 6939352 - DNA, 22 bp, Homo sapiens
tatgtggaaaatgcacttaaaa

SEQ ID NO: 6939353 - DNA, 22 bp, Homo sapiens
cccagcagtggttctcaaactt

SEQ ID NO: 6939354 - DNA, 22 bp, Homo sapiens
gcagtttcagacatatctccat

SEQ ID NO: 6939355 - DNA, 22 bp, Homo sapiens
tcagagctgcccatgcaagggg

SEQ ID NO: 6939356 - DNA, 22 bp, Homo sapiens
gtctttggaaagacaaagttca

SEQ ID NO: 6939357 - DNA, 22 bp, Homo sapiens
gatcagtttaatcttcaggggt

SEQ ID NO: 6939358 - DNA, 22 bp, Homo sapiens
tcccagccacagtttccacctg

SEQ ID NO: 6939359 - DNA, 22 bp, Homo sapiens
acagatttgatctgagaacaaa

SEQ ID NO: 6939360 - DNA, 22 bp, Homo sapiens
agcagtgtgggctgcacgctgg

SEQ ID NO: 6939361 - DNA, 16 bp, Homo sapiens
gcactgccttgggccc

SEQ ID NO: 6939362 - DNA, 22 bp, Homo sapiens
aggcagacaaggtccctggtct

SEQ ID NO: 6939363 - DNA, 22 bp, Homo sapiens
gctgtcccatggttgcaagatg

SEQ ID NO: 6939364 - DNA, 22 bp, Homo sapiens
ttccaaatgagttccatcgaat

SEQ ID NO: 6939365 - DNA, 19 bp, Homo sapiens
ttcttctacctctaccact

SEQ ID NO: 6939366 - DNA, 22 bp, Homo sapiens
tatgtcttaatccttccttagg

SEQ ID NO: 6939367 - DNA, 22 bp, Homo sapiens
cgtttccaactgtgatgaggtc

SEQ ID NO: 6939368 - DNA, 22 bp, Homo sapiens
agaaatatgctgattagatgaa

SEQ ID NO: 6939369 - DNA, 22 bp, Homo sapiens
tcacatttaaacaggaggatta

SEQ ID NO: 6939370 - DNA, 22 bp, Homo sapiens
atcattgaattgctttgttctt

SEQ ID NO: 6939371 - DNA, 22 bp, Homo sapiens
ccagggaatgtgggatgactct

SEQ ID NO: 6939372 - DNA, 22 bp, Homo sapiens
tttccaggtatcaagcttcagg

SEQ ID NO: 6939373 - DNA, 22 bp, Homo sapiens
caccagacaggtgtatgcatat

SEQ ID NO: 6939374 - DNA, 22 bp, Homo sapiens
cctcccttcagtagagcccaat

SEQ ID NO: 6939375 - DNA, 22 bp, Homo sapiens
cagtcccagggttggttcagct

SEQ ID NO: 6939376 - DNA, 20 bp, Homo sapiens
agctgcaacagactgtatgg

SEQ ID NO: 6939377 - DNA, 20 bp, Homo sapiens
tgacctcctgggctcaagcc

SEQ ID NO: 6939378 - DNA, 22 bp, Homo sapiens
catcagctaaacttagtgaaat

SEQ ID NO: 6939379 - DNA, 22 bp, Homo sapiens
gaccccaaccctagagtctgac

SEQ ID NO: 6939380 - DNA, 22 bp, Homo sapiens
tactcctgctgatcctgccagc

SEQ ID NO: 6939381 - DNA, 19 bp, Homo sapiens
tgtgttgtgccttctcccc

SEQ ID NO: 6939382 - DNA, 22 bp, Homo sapiens
acctgtacaattcctgcactga

SEQ ID NO: 6939383 - DNA, 22 bp, Homo sapiens
cagtcccagaagagcctgggag

SEQ ID NO: 6939384 - DNA, 22 bp, Homo sapiens
ggccctgggcagaggagtgggc

SEQ ID NO: 6939385 - DNA, 22 bp, Homo sapiens
tttacccagtaactgcttggct

SEQ ID NO: 6939386 - DNA, 22 bp, Homo sapiens
tttgtcttatccaatctctcag

SEQ ID NO: 6939387 - DNA, 22 bp, Homo sapiens
aaatgcaccttgctgtgagact

SEQ ID NO: 6939388 - DNA, 22 bp, Homo sapiens
tacattctggtggagaaagtaa

SEQ ID NO: 6939389 - DNA, 22 bp, Homo sapiens
tggtggagagacagtgtattgg

SEQ ID NO: 6939390 - DNA, 18 bp, Homo sapiens
gaaaggagagacagtagg

SEQ ID NO: 6939391 - DNA, 22 bp, Homo sapiens
gctaagtaaatcgtgggaggtt

SEQ ID NO: 6939392 - DNA, 22 bp, Homo sapiens
agttccatccttccactgccct

SEQ ID NO: 6939393 - DNA, 22 bp, Homo sapiens
ttcaagactgcgactaatgccc

SEQ ID NO: 6939394 - DNA, 22 bp, Homo sapiens
gcttgactaggctctggcgaca

SEQ ID NO: 6939395 - DNA, 22 bp, Homo sapiens
tcaaatgcggtcatggctttta

SEQ ID NO: 6939396 - DNA, 21 bp, Homo sapiens
gttctacagttttagaattcc

SEQ ID NO: 6939397 - DNA, 22 bp, Homo sapiens
aagcaactaaggcaaggaaatg

SEQ ID NO: 6939398 - DNA, 22 bp, Homo sapiens
tgccctgggaacacagatgcca

SEQ ID NO: 6939399 - DNA, 19 bp, Homo sapiens
gtgcagttcagagttcaat

SEQ ID NO: 6939400 - DNA, 22 bp, Homo sapiens
catgataacacttctgtttaat

SEQ ID NO: 6939401 - DNA, 22 bp, Homo sapiens
ttacactaagctacttctatat

SEQ ID NO: 6939402 - DNA, 22 bp, Homo sapiens
tgccatctcctggtcaactggt

SEQ ID NO: 6939403 - DNA, 22 bp, Homo sapiens
catggaggagttaggtgtgagt

SEQ ID NO: 6939404 - DNA, 22 bp, Homo sapiens
tgctggctcccaggagccgctg

SEQ ID NO: 6939405 - DNA, 22 bp, Homo sapiens
aagctcttatgatatttattta

SEQ ID NO: 6939406 - DNA, 22 bp, Homo sapiens
atttccacataagggaaataag

SEQ ID NO: 6939407 - DNA, 22 bp, Homo sapiens
aaactgaattcaagtatccagt

SEQ ID NO: 6939408 - DNA, 22 bp, Homo sapiens
aagctcttgagtaaactagttt

SEQ ID NO: 6939409 - DNA, 22 bp, Homo sapiens
atatgttagggaacaatttgag

SEQ ID NO: 6939410 - DNA, 22 bp, Homo sapiens
ttttgctgcattgaagtcagat

SEQ ID NO: 6939411 - DNA, 22 bp, Homo sapiens
cccagaatgattcagcgacagt

SEQ ID NO: 6939412 - DNA, 22 bp, Homo sapiens
aggctccaccagtcaggtgcat

SEQ ID NO: 6939413 - DNA, 22 bp, Homo sapiens
gctgtgggtacaaatacacaat

SEQ ID NO: 6939414 - DNA, 20 bp, Homo sapiens
cctaggcatgctgagtctcc

SEQ ID NO: 6939415 - DNA, 22 bp, Homo sapiens
aatttgaaacatagtcaccact

SEQ ID NO: 6939416 - DNA, 22 bp, Homo sapiens
tcagattttattttcctgttac

SEQ ID NO: 6939417 - DNA, 22 bp, Homo sapiens
aggctccattttcctgcagctg

SEQ ID NO: 6939418 - DNA, 19 bp, Homo sapiens
aagcagtttatatatttgt

SEQ ID NO: 6939419 - DNA, 22 bp, Homo sapiens
tgagcaggactgaccggcctta

SEQ ID NO: 6939420 - DNA, 19 bp, Homo sapiens
aagttgatcattttgacag

SEQ ID NO: 6939421 - DNA, 22 bp, Homo sapiens
gagaaggggtgatgtgggtaat

SEQ ID NO: 6939422 - DNA, 22 bp, Homo sapiens
cagggtggaacaggcaatactt

SEQ ID NO: 6939423 - DNA, 22 bp, Homo sapiens
ttaggcaaagatattacgtagt

SEQ ID NO: 6939424 - DNA, 22 bp, Homo sapiens
atcctaaatccctggagagttg

SEQ ID NO: 6939425 - DNA, 22 bp, Homo sapiens
agtacagacctgtctcttcctg

SEQ ID NO: 6939426 - DNA, 22 bp, Homo sapiens
ctggctctgtcaccctttctcc

SEQ ID NO: 6939427 - DNA, 22 bp, Homo sapiens
agatccactcgaatccaggaat

SEQ ID NO: 6939428 - DNA, 22 bp, Homo sapiens
aggcactgtggaagacatggtt

SEQ ID NO: 6939429 - DNA, 22 bp, Homo sapiens
tctgggagagtcacaggcattg

SEQ ID NO: 6939430 - DNA, 22 bp, Homo sapiens
ctgaggtgttgatgacctatgc

SEQ ID NO: 6939431 - DNA, 22 bp, Homo sapiens
cacattgtattgtggaaagtta

SEQ ID NO: 6939432 - DNA, 22 bp, Homo sapiens
aatgaggcttgtggggtagggc

SEQ ID NO: 6939433 - DNA, 22 bp, Homo sapiens
ggcaggggtgaggccactctga

SEQ ID NO: 6939434 - DNA, 22 bp, Homo sapiens
attgtcacttaaaagtgcatgt

SEQ ID NO: 6939435 - DNA, 22 bp, Homo sapiens
tcacacatttctcaagtgtagg

SEQ ID NO: 6939436 - DNA, 22 bp, Homo sapiens
cttcaaggtggctaaatggggc

SEQ ID NO: 6939437 - DNA, 22 bp, Homo sapiens
agacacttatttagtgggagtt

SEQ ID NO: 6939438 - DNA, 21 bp, Homo sapiens
ccataatcttaggatcaaaat

SEQ ID NO: 6939439 - DNA, 22 bp, Homo sapiens
caacatgccagacattagtttg

SEQ ID NO: 6939440 - DNA, 22 bp, Homo sapiens
cagtggtacttatatgaagcat

SEQ ID NO: 6939441 - DNA, 22 bp, Homo sapiens
agggaccacatcccctctgtgg

SEQ ID NO: 6939442 - DNA, 22 bp, Homo sapiens
gtaagggcctaataggacgcag

SEQ ID NO: 6939443 - DNA, 22 bp, Homo sapiens
ctatactactatacagatgtaa

SEQ ID NO: 6939444 - DNA, 22 bp, Homo sapiens
gtctttggagaggtgccatttc

SEQ ID NO: 6939445 - DNA, 21 bp, Homo sapiens
ctctggagtcaagagcttcca

SEQ ID NO: 6939446 - DNA, 20 bp, Homo sapiens
tcccaaggatgcctgggtgt

SEQ ID NO: 6939447 - DNA, 22 bp, Homo sapiens
gccagtaaaacaaaggccatgt

SEQ ID NO: 6939448 - DNA, 22 bp, Homo sapiens
cagacatgagatacagctgcta

SEQ ID NO: 6939449 - DNA, 22 bp, Homo sapiens
gatttcttctctcccaagagga

SEQ ID NO: 6939450 - DNA, 23 bp, Homo sapiens
aggcccaggtatgtttgttttgg

SEQ ID NO: 6939451 - DNA, 20 bp, Homo sapiens
tgtgtgaacacggactctgt

SEQ ID NO: 6939452 - DNA, 19 bp, Homo sapiens
agcctggagggctggtcac

SEQ ID NO: 6939453 - DNA, 16 bp, Homo sapiens
tctcccttgtcacctg

SEQ ID NO: 6939454 - DNA, 22 bp, Homo sapiens
tttcacagaaaggataacatta

SEQ ID NO: 6939455 - DNA, 22 bp, Homo sapiens
ctcagcttttcccggataggtg

SEQ ID NO: 6939456 - DNA, 22 bp, Homo sapiens
ccttgctgcgtgctagcacaga

SEQ ID NO: 6939457 - DNA, 22 bp, Homo sapiens
aaaggccttaaagagcatgcct

SEQ ID NO: 6939458 - DNA, 21 bp, Homo sapiens
tgggctctttaacccaggcac

SEQ ID NO: 6939459 - DNA, 22 bp, Homo sapiens
ccagaggaattgggaaacatgt

SEQ ID NO: 6939460 - DNA, 22 bp, Homo sapiens
tgacacagattagagacatacc

SEQ ID NO: 6939461 - DNA, 22 bp, Homo sapiens
attcccaccaacaatgtacagg

SEQ ID NO: 6939462 - DNA, 22 bp, Homo sapiens
gaaacctttgccgatggggtcc

SEQ ID NO: 6939463 - DNA, 22 bp, Homo sapiens
gagatggttgggttaacaacta

SEQ ID NO: 6939464 - DNA, 22 bp, Homo sapiens
tccaggaggttgagtgagttcc

SEQ ID NO: 6939465 - DNA, 22 bp, Homo sapiens
ccagcactcctgtctcaagtct

SEQ ID NO: 6939466 - DNA, 22 bp, Homo sapiens
agccctgcgctcacgttctgca

SEQ ID NO: 6939467 - DNA, 22 bp, Homo sapiens
ttccacagccatcactgttgct

SEQ ID NO: 6939468 - DNA, 19 bp, Homo sapiens
aagagggaaagtgctatgc

SEQ ID NO: 6939469 - DNA, 22 bp, Homo sapiens
tagaaaagctctaaggcctctc

SEQ ID NO: 6939470 - DNA, 22 bp, Homo sapiens
atgatttaaagtcattgtgaac

SEQ ID NO: 6939471 - DNA, 22 bp, Homo sapiens
taagcaagtggtagaaggacaa

SEQ ID NO: 6939472 - DNA, 21 bp, Homo sapiens
ttcaggacaggaaaaacaggg

SEQ ID NO: 6939473 - DNA, 22 bp, Homo sapiens
tatcacaattcctatagtttgt

SEQ ID NO: 6939474 - DNA, 22 bp, Homo sapiens
ccagcagccaccttctcgaaat

SEQ ID NO: 6939475 - DNA, 22 bp, Homo sapiens
gccaagtcaggcagggcttctg

SEQ ID NO: 6939476 - DNA, 22 bp, Homo sapiens
tttgaaaggtgtcgagatgtgt

SEQ ID NO: 6939477 - DNA, 21 bp, Homo sapiens
cctgggacactcaccagctcc

SEQ ID NO: 6939478 - DNA, 22 bp, Homo sapiens
ttgaccagttccccaaattgct

SEQ ID NO: 6939479 - DNA, 22 bp, Homo sapiens
aaaatagttaacgttcagagta

SEQ ID NO: 6939480 - DNA, 22 bp, Homo sapiens
attttgtgggttctgctgatgt

SEQ ID NO: 6939481 - DNA, 23 bp, Homo sapiens
tcagggctcacacgttttctggc

SEQ ID NO: 6939482 - DNA, 22 bp, Homo sapiens
aagattctcagaaaaaggctat

SEQ ID NO: 6939483 - DNA, 23 bp, Homo sapiens
gggctccagtctctgctcagttg

SEQ ID NO: 6939484 - DNA, 22 bp, Homo sapiens
actcaggaatggggctgggact

SEQ ID NO: 6939485 - DNA, 22 bp, Homo sapiens
ttgatgaatctgaagggaacca

SEQ ID NO: 6939486 - DNA, 17 bp, Homo sapiens
agagggaaaatgcggtt

SEQ ID NO: 6939487 - DNA, 22 bp, Homo sapiens
ctcccgcaggagcagctcgcag

SEQ ID NO: 6939488 - DNA, 22 bp, Homo sapiens
caggcagctctaatggaaagtg

SEQ ID NO: 6939489 - DNA, 22 bp, Homo sapiens
tcaatttctagcttggtcggtt

SEQ ID NO: 6939490 - DNA, 22 bp, Homo sapiens
aaccaggaacttttgtgagagc

SEQ ID NO: 6939491 - DNA, 22 bp, Homo sapiens
tggactaaagaaacattccgtg

SEQ ID NO: 6939492 - DNA, 22 bp, Homo sapiens
actctttatggtaagccgacca

SEQ ID NO: 6939493 - DNA, 22 bp, Homo sapiens
gggcatggtgagggatatgaag

SEQ ID NO: 6939494 - DNA, 22 bp, Homo sapiens
caaggtgcagctggctgtgtga

SEQ ID NO: 6939495 - DNA, 22 bp, Homo sapiens
ttgaagctgtctttcagaatca

SEQ ID NO: 6939496 - DNA, 22 bp, Homo sapiens
gtggccctgagccctttgacag

SEQ ID NO: 6939497 - DNA, 22 bp, Homo sapiens
tcactgcgctgactgctacgat

SEQ ID NO: 6939498 - DNA, 22 bp, Homo sapiens
ggccggtgtcatggcttggtct

SEQ ID NO: 6939499 - DNA, 22 bp, Homo sapiens
ctggctctaagtgtcagctccc

SEQ ID NO: 6939500 - DNA, 21 bp, Homo sapiens
atgtcaggcacttatgaggaa

SEQ ID NO: 6939501 - DNA, 22 bp, Homo sapiens
tcctgagctgacacttggggag

SEQ ID NO: 6939502 - DNA, 22 bp, Homo sapiens
attggcagggccagcatctccc

SEQ ID NO: 6939503 - DNA, 21 bp, Homo sapiens
tgggcagatggcagtgtggct

SEQ ID NO: 6939504 - DNA, 22 bp, Homo sapiens
actgggcaataaattcagagaa

SEQ ID NO: 6939505 - DNA, 22 bp, Homo sapiens
atagacatttactgagcacgta

SEQ ID NO: 6939506 - DNA, 22 bp, Homo sapiens
atattaggtgctcaatacatgc

SEQ ID NO: 6939507 - DNA, 22 bp, Homo sapiens
ctggatgtccaggtagaagttt

SEQ ID NO: 6939508 - DNA, 22 bp, Homo sapiens
cttctataaactgtgatctttc

SEQ ID NO: 6939509 - DNA, 22 bp, Homo sapiens
tctgtgtgcccacctgacacct

SEQ ID NO: 6939510 - DNA, 22 bp, Homo sapiens
tctgaaatcctttatcttggct

SEQ ID NO: 6939511 - DNA, 23 bp, Homo sapiens
tcagagaactcgggcagatgacc

SEQ ID NO: 6939512 - DNA, 22 bp, Homo sapiens
agcttaacgctcctaccagatg

SEQ ID NO: 6939513 - DNA, 22 bp, Homo sapiens
gagctagactgggctctgatgt

SEQ ID NO: 6939514 - DNA, 20 bp, Homo sapiens
ggccagctggaggcgccggg

SEQ ID NO: 6939515 - DNA, 22 bp, Homo sapiens
tctggaaggaagagctgagtcc

SEQ ID NO: 6939516 - DNA, 22 bp, Homo sapiens
cagagttcaaagcctgctggga

SEQ ID NO: 6939517 - DNA, 22 bp, Homo sapiens
attgtacttttattacatgtag

SEQ ID NO: 6939518 - DNA, 22 bp, Homo sapiens
agtgtgacattttcatgaattt

SEQ ID NO: 6939519 - DNA, 22 bp, Homo sapiens
tagaaagcatgcaagtttgatg

SEQ ID NO: 6939520 - DNA, 22 bp, Homo sapiens
ctgcagggatgtgaggcccgtt

SEQ ID NO: 6939521 - DNA, 22 bp, Homo sapiens
tgcaaagcaatgtaggtcagct

SEQ ID NO: 6939522 - DNA, 22 bp, Homo sapiens
aagtgctgagactacaggcatg

SEQ ID NO: 6939523 - DNA, 22 bp, Homo sapiens
tccacgctgtgtgaccttgggc

SEQ ID NO: 6939524 - DNA, 22 bp, Homo sapiens
ttactcattgctggatctagaa

SEQ ID NO: 6939525 - DNA, 22 bp, Homo sapiens
gaattttagaatatgtgggctt

SEQ ID NO: 6939526 - DNA, 22 bp, Homo sapiens
ttcaggcttcagtctttcttaa

SEQ ID NO: 6939527 - DNA, 19 bp, Homo sapiens
ctcagcacttttacacagg

SEQ ID NO: 6939528 - DNA, 22 bp, Homo sapiens
gggcttctctcagaaactatca

SEQ ID NO: 6939529 - DNA, 22 bp, Homo sapiens
gttcattcagctgggtaggagg

SEQ ID NO: 6939530 - DNA, 22 bp, Homo sapiens
catgttggtgtgctgcacccat

SEQ ID NO: 6939531 - DNA, 22 bp, Homo sapiens
ataatcttgtatttcctaaagt

SEQ ID NO: 6939532 - DNA, 22 bp, Homo sapiens
aggcgcagaaggccaggggcct

SEQ ID NO: 6939533 - DNA, 22 bp, Homo sapiens
ttgtgctgctgacttaagatat

SEQ ID NO: 6939534 - DNA, 22 bp, Homo sapiens
tctcagggtttcctgggggctg

SEQ ID NO: 6939535 - DNA, 22 bp, Homo sapiens
aacctagactgacatatgtgta

SEQ ID NO: 6939536 - DNA, 22 bp, Homo sapiens
agaggaagtaatcaggacctgc

SEQ ID NO: 6939537 - DNA, 22 bp, Homo sapiens
ttctgctgcctactcctgggga

SEQ ID NO: 6939538 - DNA, 22 bp, Homo sapiens
agtgtctgaaccaccggggcat

SEQ ID NO: 6939539 - DNA, 22 bp, Homo sapiens
gaaatggtaaacattttaatgg

SEQ ID NO: 6939540 - DNA, 22 bp, Homo sapiens
ctggatcttcagagatcaccag

SEQ ID NO: 6939541 - DNA, 22 bp, Homo sapiens
tggctgcagtgcttgagatgtc

SEQ ID NO: 6939542 - DNA, 22 bp, Homo sapiens
gctgaggctcctcgggaggaca

SEQ ID NO: 6939543 - DNA, 22 bp, Homo sapiens
cagcagttcaatccagtgcacg

SEQ ID NO: 6939544 - DNA, 22 bp, Homo sapiens
acatccatcttatgagataggt

SEQ ID NO: 6939545 - DNA, 22 bp, Homo sapiens
tgtgtcaaagtgtggagtattt

SEQ ID NO: 6939546 - DNA, 22 bp, Homo sapiens
gccctctggcagccttggctgg

SEQ ID NO: 6939547 - DNA, 22 bp, Homo sapiens
tcttgatagagtgctttcagag

SEQ ID NO: 6939548 - DNA, 22 bp, Homo sapiens
caaattcaaatttcatcagtgt

SEQ ID NO: 6939549 - DNA, 22 bp, Homo sapiens
aggcctgaggttcctgtgctca

SEQ ID NO: 6939550 - DNA, 22 bp, Homo sapiens
gtttaaccaagagcattgtgca

SEQ ID NO: 6939551 - DNA, 22 bp, Homo sapiens
atgtgtaggtgaatcgaggctg

SEQ ID NO: 6939552 - DNA, 22 bp, Homo sapiens
ttagcagcttttaaatggttct

SEQ ID NO: 6939553 - DNA, 22 bp, Homo sapiens
taacaaagtattgtttgtgtat

SEQ ID NO: 6939554 - DNA, 16 bp, Homo sapiens
tctgttaggtagtaaa

SEQ ID NO: 6939555 - DNA, 22 bp, Homo sapiens
acaggggattgattggaagtct

SEQ ID NO: 6939556 - DNA, 22 bp, Homo sapiens
ccttcctttgcatcatttctag

SEQ ID NO: 6939557 - DNA, 21 bp, Homo sapiens
ctagcacgattccaagtaata

SEQ ID NO: 6939558 - DNA, 22 bp, Homo sapiens
ccagtcccagctctgccatgct

SEQ ID NO: 6939559 - DNA, 22 bp, Homo sapiens
gtggcacagggtgtggcacaca

SEQ ID NO: 6939560 - DNA, 22 bp, Homo sapiens
acaatgaaaggtattctgaact

SEQ ID NO: 6939561 - DNA, 22 bp, Homo sapiens
ttagctttgaattccatggagg

SEQ ID NO: 6939562 - DNA, 22 bp, Homo sapiens
tgtgtatgtctgtatgcacaca

SEQ ID NO: 6939563 - DNA, 22 bp, Homo sapiens
acagtgcttttgttcctctcct

SEQ ID NO: 6939564 - DNA, 22 bp, Homo sapiens
gtctgcccatctccgggcgggg

SEQ ID NO: 6939565 - DNA, 22 bp, Homo sapiens
tgctggaatttttctaggattt

SEQ ID NO: 6939566 - DNA, 22 bp, Homo sapiens
tcttgcaggcggctcagcaacc

SEQ ID NO: 6939567 - DNA, 22 bp, Homo sapiens
tcagccaagcagccatcatctg

SEQ ID NO: 6939568 - DNA, 22 bp, Homo sapiens
tcatccagttcacatggtgagt

SEQ ID NO: 6939569 - DNA, 22 bp, Homo sapiens
agatccaggatgtcccaaaata

SEQ ID NO: 6939570 - DNA, 22 bp, Homo sapiens
gccctctgttattgcatcctta

SEQ ID NO: 6939571 - DNA, 22 bp, Homo sapiens
gctggccagccctcttcctcca

SEQ ID NO: 6939572 - DNA, 22 bp, Homo sapiens
agcccgcatctcgctaaagata

SEQ ID NO: 6939573 - DNA, 22 bp, Homo sapiens
ttcagaaatgaatattggtatt

SEQ ID NO: 6939574 - DNA, 22 bp, Homo sapiens
gaagattaaacatatttagtgt

SEQ ID NO: 6939575 - DNA, 22 bp, Homo sapiens
tcacagagaaatgtggcacaaa

SEQ ID NO: 6939576 - DNA, 22 bp, Homo sapiens
cttcttcagaggccagcctctg

SEQ ID NO: 6939577 - DNA, 22 bp, Homo sapiens
ctagcccagttcttctcattag

SEQ ID NO: 6939578 - DNA, 22 bp, Homo sapiens
actcagctgatgaagcacaagt

SEQ ID NO: 6939579 - DNA, 22 bp, Homo sapiens
ctactttaattttctgcagaga

SEQ ID NO: 6939580 - DNA, 22 bp, Homo sapiens
cagtggccaacttcctgcctct

SEQ ID NO: 6939581 - DNA, 22 bp, Homo sapiens
agttcatgtggtttaacttaat

SEQ ID NO: 6939582 - DNA, 22 bp, Homo sapiens
tttagtattctctatttccatc

SEQ ID NO: 6939583 - DNA, 21 bp, Homo sapiens
ggtgcctttgagtcatgtaac

SEQ ID NO: 6939584 - DNA, 22 bp, Homo sapiens
ctctgggatagagcctcggtct

SEQ ID NO: 6939585 - DNA, 22 bp, Homo sapiens
cagcttgtttacatgcttattc

SEQ ID NO: 6939586 - DNA, 22 bp, Homo sapiens
tgaggaaggaattgaggtttta

SEQ ID NO: 6939587 - DNA, 21 bp, Homo sapiens
aaatctcagctggcctctgtg

SEQ ID NO: 6939588 - DNA, 22 bp, Homo sapiens
ttattcacaaatgttgccctgt

SEQ ID NO: 6939589 - DNA, 21 bp, Homo sapiens
ctttttactcgttcatatgca

SEQ ID NO: 6939590 - DNA, 22 bp, Homo sapiens
tcagagtcttggcaataggtta

SEQ ID NO: 6939591 - DNA, 22 bp, Homo sapiens
aggcccatgtgagtcttgtcct

SEQ ID NO: 6939592 - DNA, 22 bp, Homo sapiens
tgaggatgagatgagataacac

SEQ ID NO: 6939593 - DNA, 22 bp, Homo sapiens
ggccttgggatgtggctgcagc

SEQ ID NO: 6939594 - DNA, 22 bp, Homo sapiens
ggtgctcaagagggcatcctct

SEQ ID NO: 6939595 - DNA, 22 bp, Homo sapiens
tatttcttcgggattcaagcta

SEQ ID NO: 6939596 - DNA, 22 bp, Homo sapiens
tacagtttaacactttggagaa

SEQ ID NO: 6939597 - DNA, 22 bp, Homo sapiens
agctaggataagcagagactgg

SEQ ID NO: 6939598 - DNA, 22 bp, Homo sapiens
ttgcagatgaagaaagtggtag

SEQ ID NO: 6939599 - DNA, 22 bp, Homo sapiens
ctccaggaaaatagggaatgag

SEQ ID NO: 6939600 - DNA, 22 bp, Homo sapiens
ccagaatttgaactcaggcaat

SEQ ID NO: 6939601 - DNA, 22 bp, Homo sapiens
ttttggtagtccagagtttagt

SEQ ID NO: 6939602 - DNA, 22 bp, Homo sapiens
tttctagagtgggcatgtctta

SEQ ID NO: 6939603 - DNA, 20 bp, Homo sapiens
tgtcttattccagtgtttac

SEQ ID NO: 6939604 - DNA, 22 bp, Homo sapiens
tggaaagcagttcttagaatcg

SEQ ID NO: 6939605 - DNA, 22 bp, Homo sapiens
cagcaggccatgctgcttttca

SEQ ID NO: 6939606 - DNA, 22 bp, Homo sapiens
agtgtacatcagaacatatcaa

SEQ ID NO: 6939607 - DNA, 22 bp, Homo sapiens
tcaaaattctagggagaatggt

SEQ ID NO: 6939608 - DNA, 22 bp, Homo sapiens
aaaaagatgtcctgaagtttag

SEQ ID NO: 6939609 - DNA, 22 bp, Homo sapiens
agctctctgataaattgataaa

SEQ ID NO: 6939610 - DNA, 22 bp, Homo sapiens
ggttccacggtgtttggaggca

SEQ ID NO: 6939611 - DNA, 23 bp, Homo sapiens
gctctgaggaagttgggcacggg

SEQ ID NO: 6939612 - DNA, 22 bp, Homo sapiens
tgctgaggaaagaggataaaag

SEQ ID NO: 6939613 - DNA, 22 bp, Homo sapiens
agcaagaaaatctctgtccaat

SEQ ID NO: 6939614 - DNA, 22 bp, Homo sapiens
ttgtacaaatgcatattcctgg

SEQ ID NO: 6939615 - DNA, 23 bp, Homo sapiens
tgaagtgaaatttcacaagggac

SEQ ID NO: 6939616 - DNA, 20 bp, Homo sapiens
agtgaggcagttcagtgggc

SEQ ID NO: 6939617 - DNA, 21 bp, Homo sapiens
tggtcattgcggtggaaggag

SEQ ID NO: 6939618 - DNA, 22 bp, Homo sapiens
agttattgagtatctataatgt

SEQ ID NO: 6939619 - DNA, 22 bp, Homo sapiens
tacgaacagggccatagaaact

SEQ ID NO: 6939620 - DNA, 22 bp, Homo sapiens
ttatgcttttagaatttagcat

SEQ ID NO: 6939621 - DNA, 23 bp, Homo sapiens
tattgcacaaagagatgcacagg

SEQ ID NO: 6939622 - DNA, 22 bp, Homo sapiens
atgaaagtttgcattcctcagt

SEQ ID NO: 6939623 - DNA, 22 bp, Homo sapiens
tgtttattcatggctaatgaaa

SEQ ID NO: 6939624 - DNA, 22 bp, Homo sapiens
aagagaagaaagtgtctacaca

SEQ ID NO: 6939625 - DNA, 22 bp, Homo sapiens
agtctcagccacacagacctat

SEQ ID NO: 6939626 - DNA, 22 bp, Homo sapiens
gtcaggccaatactctccagca

SEQ ID NO: 6939627 - DNA, 20 bp, Homo sapiens
ttcaaagaccctcaggtcca

SEQ ID NO: 6939628 - DNA, 22 bp, Homo sapiens
ccagatccctgtttgcctctgg

SEQ ID NO: 6939629 - DNA, 22 bp, Homo sapiens
gtttcagatttggtttcagaag

SEQ ID NO: 6939630 - DNA, 22 bp, Homo sapiens
gagccagcgccttgcctctggg

SEQ ID NO: 6939631 - DNA, 23 bp, Homo sapiens
tgagtctactcaccacaactggg

SEQ ID NO: 6939632 - DNA, 22 bp, Homo sapiens
actgcctgctcctggctccaca

SEQ ID NO: 6939633 - DNA, 19 bp, Homo sapiens
accaaaggagtggggtata

SEQ ID NO: 6939634 - DNA, 22 bp, Homo sapiens
ggcccccagggtgggtgtagac

SEQ ID NO: 6939635 - DNA, 22 bp, Homo sapiens
gatataggttcatagtgttaca

SEQ ID NO: 6939636 - DNA, 22 bp, Homo sapiens
gtgtgccagtcctgactcctga

SEQ ID NO: 6939637 - DNA, 22 bp, Homo sapiens
gagggaaaggttaatacatgat

SEQ ID NO: 6939638 - DNA, 22 bp, Homo sapiens
tctatagtttctgagtttcttc

SEQ ID NO: 6939639 - DNA, 22 bp, Homo sapiens
tagctgacagatacaatcagat

SEQ ID NO: 6939640 - DNA, 22 bp, Homo sapiens
agtggctgcttctggttgctcc

SEQ ID NO: 6939641 - DNA, 22 bp, Homo sapiens
ccaggacatgttgcaagtttat

SEQ ID NO: 6939642 - DNA, 22 bp, Homo sapiens
agccagccagttcactaggaaa

SEQ ID NO: 6939643 - DNA, 22 bp, Homo sapiens
cctaaatagagtcagatgtaat

SEQ ID NO: 6939644 - DNA, 22 bp, Homo sapiens
agagcctttggagctgctatta

SEQ ID NO: 6939645 - DNA, 18 bp, Homo sapiens
tactgatttttcagagtc

SEQ ID NO: 6939646 - DNA, 22 bp, Homo sapiens
gtgattctcatgttcctgaagt

SEQ ID NO: 6939647 - DNA, 22 bp, Homo sapiens
tgaagaaaatatgattacccca

SEQ ID NO: 6939648 - DNA, 22 bp, Homo sapiens
ctgattttcaaaatgtgttaaa

SEQ ID NO: 6939649 - DNA, 22 bp, Homo sapiens
ctttaagactaaattagagttt

SEQ ID NO: 6939650 - DNA, 22 bp, Homo sapiens
agcaagcattgctggttaggtc

SEQ ID NO: 6939651 - DNA, 22 bp, Homo sapiens
acagccttgggttctctggggg

SEQ ID NO: 6939652 - DNA, 22 bp, Homo sapiens
tcagcctacactccaacagcat

SEQ ID NO: 6939653 - DNA, 22 bp, Homo sapiens
taaagctagccaaccactgtct

SEQ ID NO: 6939654 - DNA, 22 bp, Homo sapiens
catcctgacccatgggagggga

SEQ ID NO: 6939655 - DNA, 22 bp, Homo sapiens
gtaccagtcttcggagggacag

SEQ ID NO: 6939656 - DNA, 22 bp, Homo sapiens
ttgaaaagttttgaaacactct

SEQ ID NO: 6939657 - DNA, 22 bp, Homo sapiens
aggttggcctcagggaggctct

SEQ ID NO: 6939658 - DNA, 22 bp, Homo sapiens
atgcaagagatggacttgtgtt

SEQ ID NO: 6939659 - DNA, 22 bp, Homo sapiens
aagccagggtttgtggatctat

SEQ ID NO: 6939660 - DNA, 22 bp, Homo sapiens
gtgtgaaagttcctaagactat

SEQ ID NO: 6939661 - DNA, 22 bp, Homo sapiens
tttcttcagtaacacaaaccat

SEQ ID NO: 6939662 - DNA, 22 bp, Homo sapiens
ttagacctcattacctagccag

SEQ ID NO: 6939663 - DNA, 21 bp, Homo sapiens
ttcatgatacagttttagagt

SEQ ID NO: 6939664 - DNA, 22 bp, Homo sapiens
aggttcattcccaaatttggag

SEQ ID NO: 6939665 - DNA, 22 bp, Homo sapiens
ctggccctgctccgcgccgcgg

SEQ ID NO: 6939666 - DNA, 18 bp, Homo sapiens
cttgagctaagggacccc

SEQ ID NO: 6939667 - DNA, 22 bp, Homo sapiens
actgcacacatgtttaagtgga

SEQ ID NO: 6939668 - DNA, 22 bp, Homo sapiens
tttcagaggtgcttggaatgct

SEQ ID NO: 6939669 - DNA, 22 bp, Homo sapiens
tagaaagcagttgtgggggctc

SEQ ID NO: 6939670 - DNA, 22 bp, Homo sapiens
taccaaaagcttgtttcataca

SEQ ID NO: 6939671 - DNA, 22 bp, Homo sapiens
gagtgcatcgtggccattttaa

SEQ ID NO: 6939672 - DNA, 22 bp, Homo sapiens
tgggggagatagagtctgatgg

SEQ ID NO: 6939673 - DNA, 22 bp, Homo sapiens
gcataggccactagtgccagga

SEQ ID NO: 6939674 - DNA, 23 bp, Homo sapiens
cccaggagcctgagtcctctctg

SEQ ID NO: 6939675 - DNA, 22 bp, Homo sapiens
aatcacttgtgccatgggtacc

SEQ ID NO: 6939676 - DNA, 22 bp, Homo sapiens
tggtgctgccaggctcctgcca

SEQ ID NO: 6939677 - DNA, 22 bp, Homo sapiens
aaaatcagtacactttattttg

SEQ ID NO: 6939678 - DNA, 22 bp, Homo sapiens
agtggcagtggggcagggccct

SEQ ID NO: 6939679 - DNA, 17 bp, Homo sapiens
tggccaggccccgccag

SEQ ID NO: 6939680 - DNA, 22 bp, Homo sapiens
tgcatcttacgttttgaaaggg

SEQ ID NO: 6939681 - DNA, 22 bp, Homo sapiens
taggtcccagcatcttctgagc

SEQ ID NO: 6939682 - DNA, 22 bp, Homo sapiens
gtgccccagacacgcatgtggg

SEQ ID NO: 6939683 - DNA, 22 bp, Homo sapiens
gttaatttgcagctttcgagct

SEQ ID NO: 6939684 - DNA, 22 bp, Homo sapiens
ggaaagaatcaagtgatcctgt

SEQ ID NO: 6939685 - DNA, 22 bp, Homo sapiens
gagaatttgctggcttcattgt

SEQ ID NO: 6939686 - DNA, 22 bp, Homo sapiens
atgagcccagaaatctcccttt

SEQ ID NO: 6939687 - DNA, 20 bp, Homo sapiens
tcttggagagggtggactta

SEQ ID NO: 6939688 - DNA, 22 bp, Homo sapiens
atgcatgtgtgagagcaagagg

SEQ ID NO: 6939689 - DNA, 17 bp, Homo sapiens
tggccagagcaggcccc

SEQ ID NO: 6939690 - DNA, 22 bp, Homo sapiens
gtagcaatgttgaacactgcgt

SEQ ID NO: 6939691 - DNA, 22 bp, Homo sapiens
agctcagggctccaggaccgct

SEQ ID NO: 6939692 - DNA, 22 bp, Homo sapiens
cacctcatggataagataaact

SEQ ID NO: 6939693 - DNA, 22 bp, Homo sapiens
ttgcacttaaggtaggtgtgaa

SEQ ID NO: 6939694 - DNA, 22 bp, Homo sapiens
tgaggtagggagtttgttgttg

SEQ ID NO: 6939695 - DNA, 21 bp, Homo sapiens
attgtgaccatcattttggaa

SEQ ID NO: 6939696 - DNA, 22 bp, Homo sapiens
ctggacaaccactcagcctcag

SEQ ID NO: 6939697 - DNA, 22 bp, Homo sapiens
tggtggggccagacttcagctc

SEQ ID NO: 6939698 - DNA, 20 bp, Homo sapiens
gcttggcacctgctcattgt

SEQ ID NO: 6939699 - DNA, 17 bp, Homo sapiens
tgggtgctgggatgagg

SEQ ID NO: 6939700 - DNA, 22 bp, Homo sapiens
cctcccagtgccggggccggct

SEQ ID NO: 6939701 - DNA, 22 bp, Homo sapiens
ttctaagtttctcagtttcagt

SEQ ID NO: 6939702 - DNA, 21 bp, Homo sapiens
tccagggctttgattctctca

SEQ ID NO: 6939703 - DNA, 22 bp, Homo sapiens
tcccaagatacgctgtaagaag

SEQ ID NO: 6939704 - DNA, 22 bp, Homo sapiens
aagttctaaggtgcattattct

SEQ ID NO: 6939705 - DNA, 22 bp, Homo sapiens
gcagggctcattgccaggcatt

SEQ ID NO: 6939706 - DNA, 22 bp, Homo sapiens
ctgcagactagatagaaactga

SEQ ID NO: 6939707 - DNA, 22 bp, Homo sapiens
ctggaatgattgaaaaggaatg

SEQ ID NO: 6939708 - DNA, 22 bp, Homo sapiens
ttgcagaagggcacagtgatca

SEQ ID NO: 6939709 - DNA, 22 bp, Homo sapiens
ctgtgggagaagctagcacagg

SEQ ID NO: 6939710 - DNA, 22 bp, Homo sapiens
tgggtagagtggagggataaga

SEQ ID NO: 6939711 - DNA, 22 bp, Homo sapiens
gctcccagggaccgcagggcag

SEQ ID NO: 6939712 - DNA, 22 bp, Homo sapiens
tctgttattctgctcagtatag

SEQ ID NO: 6939713 - DNA, 22 bp, Homo sapiens
actctctcacacacgcctatat

SEQ ID NO: 6939714 - DNA, 22 bp, Homo sapiens
atgtaaacttagataagcagta

SEQ ID NO: 6939715 - DNA, 21 bp, Homo sapiens
tggcaggttcaaaggcctatc

SEQ ID NO: 6939716 - DNA, 22 bp, Homo sapiens
acaaattctttctgcctattgg

SEQ ID NO: 6939717 - DNA, 22 bp, Homo sapiens
cttgggctctaaatgccagtga

SEQ ID NO: 6939718 - DNA, 22 bp, Homo sapiens
gtggcctttcttgggctacaga

SEQ ID NO: 6939719 - DNA, 22 bp, Homo sapiens
gtcttaaaatcagaggatatag

SEQ ID NO: 6939720 - DNA, 22 bp, Homo sapiens
gctgtggctgacattgcagaca

SEQ ID NO: 6939721 - DNA, 22 bp, Homo sapiens
tatccatcagtcacactataga

SEQ ID NO: 6939722 - DNA, 23 bp, Homo sapiens
aggatgggtggcaatagaaagac

SEQ ID NO: 6939723 - DNA, 22 bp, Homo sapiens
tgccaaattagagttcccaggc

SEQ ID NO: 6939724 - DNA, 22 bp, Homo sapiens
agtgtcagttgccttgtcataa

SEQ ID NO: 6939725 - DNA, 17 bp, Homo sapiens
ttgtctacctagcagaa

SEQ ID NO: 6939726 - DNA, 22 bp, Homo sapiens
aaagtttattttccctggttag

SEQ ID NO: 6939727 - DNA, 22 bp, Homo sapiens
tctgtgcagaatcaaggagctt

SEQ ID NO: 6939728 - DNA, 22 bp, Homo sapiens
gtcttcatcgggggaatagaaa

SEQ ID NO: 6939729 - DNA, 22 bp, Homo sapiens
acttctcttccccggaactcta

SEQ ID NO: 6939730 - DNA, 23 bp, Homo sapiens
tcaggatattgtgtgccaaggtg

SEQ ID NO: 6939731 - DNA, 22 bp, Homo sapiens
gaaattcaccttttacgtggcc

SEQ ID NO: 6939732 - DNA, 22 bp, Homo sapiens
agctcctgatacatgcaggaat

SEQ ID NO: 6939733 - DNA, 22 bp, Homo sapiens
aaagccactgcatgtgtagtat

SEQ ID NO: 6939734 - DNA, 22 bp, Homo sapiens
gtgctctagggtcattatggta

SEQ ID NO: 6939735 - DNA, 22 bp, Homo sapiens
aggaggttgccagtctgggggt

SEQ ID NO: 6939736 - DNA, 22 bp, Homo sapiens
agggtatgtttttatctactgt

SEQ ID NO: 6939737 - DNA, 22 bp, Homo sapiens
gaagattagggttagcataagt

SEQ ID NO: 6939738 - DNA, 22 bp, Homo sapiens
gtgtgtgccatcaagagctttc

SEQ ID NO: 6939739 - DNA, 22 bp, Homo sapiens
ctgcagcagtactcagcagcca

SEQ ID NO: 6939740 - DNA, 22 bp, Homo sapiens
agttaaatcatggccattggaa

SEQ ID NO: 6939741 - DNA, 22 bp, Homo sapiens
caagtatttgcggagttccacg

SEQ ID NO: 6939742 - DNA, 22 bp, Homo sapiens
tgagaatttgtgaacttttctc

SEQ ID NO: 6939743 - DNA, 22 bp, Homo sapiens
acaggagtagggctggtggaga

SEQ ID NO: 6939744 - DNA, 22 bp, Homo sapiens
attggtctccacttgttttaga

SEQ ID NO: 6939745 - DNA, 21 bp, Homo sapiens
ccacagctggtctctgagccc

SEQ ID NO: 6939746 - DNA, 22 bp, Homo sapiens
gtggcctgccgtgtggtatggg

SEQ ID NO: 6939747 - DNA, 22 bp, Homo sapiens
aaatgttcctttggattaaact

SEQ ID NO: 6939748 - DNA, 22 bp, Homo sapiens
gtattagtcaattacagtgggg

SEQ ID NO: 6939749 - DNA, 22 bp, Homo sapiens
tgtgtttgggggagatgcattt

SEQ ID NO: 6939750 - DNA, 22 bp, Homo sapiens
taggacaggctaaaagggataa

SEQ ID NO: 6939751 - DNA, 22 bp, Homo sapiens
ggagtcacacaggaagaaggac

SEQ ID NO: 6939752 - DNA, 22 bp, Homo sapiens
tctgccttccccataatctgat

SEQ ID NO: 6939753 - DNA, 18 bp, Homo sapiens
tgagcagagtaaggcttt

SEQ ID NO: 6939754 - DNA, 22 bp, Homo sapiens
caggaagccacaggacaggtag

SEQ ID NO: 6939755 - DNA, 22 bp, Homo sapiens
tgggacacccaggagggagtgg

SEQ ID NO: 6939756 - DNA, 22 bp, Homo sapiens
aggatattgtatccatctgagt

SEQ ID NO: 6939757 - DNA, 22 bp, Homo sapiens
cagcttgctaactggtaggggt

SEQ ID NO: 6939758 - DNA, 22 bp, Homo sapiens
gaagaacacctgctgcccagtg

SEQ ID NO: 6939759 - DNA, 22 bp, Homo sapiens
cattacaaagttataaacagtt

SEQ ID NO: 6939760 - DNA, 14 bp, Homo sapiens
ggtttccattttta

SEQ ID NO: 6939761 - DNA, 22 bp, Homo sapiens
cagggcagaaggcactctactc

SEQ ID NO: 6939762 - DNA, 22 bp, Homo sapiens
tggctccagatctgtctcctgt

SEQ ID NO: 6939763 - DNA, 22 bp, Homo sapiens
catgcttgctgcctcattgttc

SEQ ID NO: 6939764 - DNA, 22 bp, Homo sapiens
atgaacaataatcatgtctatg

SEQ ID NO: 6939765 - DNA, 19 bp, Homo sapiens
ttagaaactgttgacactg

SEQ ID NO: 6939766 - DNA, 21 bp, Homo sapiens
gggtggggttccagccttttc

SEQ ID NO: 6939767 - DNA, 22 bp, Homo sapiens
tgaaagatgctcaatgaatggt

SEQ ID NO: 6939768 - DNA, 22 bp, Homo sapiens
ctggaggagaacttgaggaagg

SEQ ID NO: 6939769 - DNA, 22 bp, Homo sapiens
agaccaggaaggcctacagata

SEQ ID NO: 6939770 - DNA, 22 bp, Homo sapiens
atctcacactgggtttgagggt

SEQ ID NO: 6939771 - DNA, 22 bp, Homo sapiens
ttcttctttcctataattaatt

SEQ ID NO: 6939772 - DNA, 20 bp, Homo sapiens
accagaggaaagagcagtga

SEQ ID NO: 6939773 - DNA, 22 bp, Homo sapiens
atgcagaagcagaacttacaca

SEQ ID NO: 6939774 - DNA, 22 bp, Homo sapiens
ctcaccccactaccccttggtg

SEQ ID NO: 6939775 - DNA, 22 bp, Homo sapiens
gagcagctggacaggcctccct

SEQ ID NO: 6939776 - DNA, 22 bp, Homo sapiens
gcattcccaaaagacacttacc

SEQ ID NO: 6939777 - DNA, 16 bp, Homo sapiens
gtaaaggcagggaatt

SEQ ID NO: 6939778 - DNA, 20 bp, Homo sapiens
agactgaagccatgtgacta

SEQ ID NO: 6939779 - DNA, 22 bp, Homo sapiens
ccagatcactcaaccagagctc

SEQ ID NO: 6939780 - DNA, 22 bp, Homo sapiens
tggaacacatctcgctgcaggg

SEQ ID NO: 6939781 - DNA, 22 bp, Homo sapiens
taatttatgatgcaaagaaaag

SEQ ID NO: 6939782 - DNA, 22 bp, Homo sapiens
tggaggttgggatgcttgtgat

SEQ ID NO: 6939783 - DNA, 22 bp, Homo sapiens
cctagggagcctgagagcagtg

SEQ ID NO: 6939784 - DNA, 22 bp, Homo sapiens
caggccctgccttgagggacct

SEQ ID NO: 6939785 - DNA, 22 bp, Homo sapiens
catctgctctgtctgccatgtt

SEQ ID NO: 6939786 - DNA, 22 bp, Homo sapiens
tggctggcaaggctggagtcag

SEQ ID NO: 6939787 - DNA, 22 bp, Homo sapiens
ggtcctaagtggcagctggtat

SEQ ID NO: 6939788 - DNA, 22 bp, Homo sapiens
agatatgttgtttaaggcacca

SEQ ID NO: 6939789 - DNA, 22 bp, Homo sapiens
cacaactttccttgactgtaag

SEQ ID NO: 6939790 - DNA, 22 bp, Homo sapiens
acactacagggagaagactcac

SEQ ID NO: 6939791 - DNA, 18 bp, Homo sapiens
atctgctggcaggtctgg

SEQ ID NO: 6939792 - DNA, 22 bp, Homo sapiens
gggagacaaggagaaccaaaga

SEQ ID NO: 6939793 - DNA, 22 bp, Homo sapiens
tagaaactgatagtcttgtgct

SEQ ID NO: 6939794 - DNA, 22 bp, Homo sapiens
cctgctggccactgctccacct

SEQ ID NO: 6939795 - DNA, 22 bp, Homo sapiens
ttcattcatgtattgtctatgg

SEQ ID NO: 6939796 - DNA, 16 bp, Homo sapiens
agaggctcctccttgc

SEQ ID NO: 6939797 - DNA, 22 bp, Homo sapiens
cacagtgcactaagctccgggg

SEQ ID NO: 6939798 - DNA, 22 bp, Homo sapiens
ggagtaaggctcagaggaaatg

SEQ ID NO: 6939799 - DNA, 22 bp, Homo sapiens
tttttggaaggagatccacact

SEQ ID NO: 6939800 - DNA, 22 bp, Homo sapiens
aaacctggtggaacggtgaata

SEQ ID NO: 6939801 - DNA, 22 bp, Homo sapiens
ccatttggcaaacattttacag

SEQ ID NO: 6939802 - DNA, 22 bp, Homo sapiens
agcaggtgtagggctctttgta

SEQ ID NO: 6939803 - DNA, 22 bp, Homo sapiens
gattcaaaaataagctcctatt

SEQ ID NO: 6939804 - DNA, 22 bp, Homo sapiens
gcggcccgagcaggacgggtgg

SEQ ID NO: 6939805 - DNA, 22 bp, Homo sapiens
tttgactcagcaaattcacagg

SEQ ID NO: 6939806 - DNA, 21 bp, Homo sapiens
ttctttctgaatctgaagtat

SEQ ID NO: 6939807 - DNA, 22 bp, Homo sapiens
cactgcactccagcactccagc

SEQ ID NO: 6939808 - DNA, 22 bp, Homo sapiens
agagggtgctggagagacattg

SEQ ID NO: 6939809 - DNA, 19 bp, Homo sapiens
tcctgttatggagcttagg

SEQ ID NO: 6939810 - DNA, 19 bp, Homo sapiens
gccttgaagcaactcttgt

SEQ ID NO: 6939811 - DNA, 22 bp, Homo sapiens
tgcagttttggccattgaaggc

SEQ ID NO: 6939812 - DNA, 22 bp, Homo sapiens
cccatgaggtggaggttgcagt

SEQ ID NO: 6939813 - DNA, 22 bp, Homo sapiens
ctcctctgtattgattgggact

SEQ ID NO: 6939814 - DNA, 22 bp, Homo sapiens
cctggacaagtggcttacttgg

SEQ ID NO: 6939815 - DNA, 22 bp, Homo sapiens
ccaaggctggagtgcagtggcg

SEQ ID NO: 6939816 - DNA, 22 bp, Homo sapiens
agtcccctctaacccaacttta

SEQ ID NO: 6939817 - DNA, 22 bp, Homo sapiens
ggaccacagtgcatggcctgta

SEQ ID NO: 6939818 - DNA, 22 bp, Homo sapiens
taacagaaaggggacagaaata

SEQ ID NO: 6939819 - DNA, 22 bp, Homo sapiens
ttcctctggggccaggccaaca

SEQ ID NO: 6939820 - DNA, 22 bp, Homo sapiens
agtctctatgttcctgcaatat

SEQ ID NO: 6939821 - DNA, 22 bp, Homo sapiens
gacttcaaaagctgacattcat

SEQ ID NO: 6939822 - DNA, 22 bp, Homo sapiens
taagatgaagcagaagagttat

SEQ ID NO: 6939823 - DNA, 22 bp, Homo sapiens
agaggcactccagccactggtc

SEQ ID NO: 6939824 - DNA, 22 bp, Homo sapiens
tttaccagtgttaaacaccagc

SEQ ID NO: 6939825 - DNA, 22 bp, Homo sapiens
tagcagtagcatttaacatata

SEQ ID NO: 6939826 - DNA, 22 bp, Homo sapiens
cttggaggtggaagttgcagtg

SEQ ID NO: 6939827 - DNA, 22 bp, Homo sapiens
agagtctggtgcatgataagca

SEQ ID NO: 6939828 - DNA, 22 bp, Homo sapiens
aggagtccatgagcagctagag

SEQ ID NO: 6939829 - DNA, 22 bp, Homo sapiens
ccgtagcacatgctcctggggc

SEQ ID NO: 6939830 - DNA, 22 bp, Homo sapiens
aaatccaacgacaggtgtactt

SEQ ID NO: 6939831 - DNA, 22 bp, Homo sapiens
taatacctagagatgatacaaa

SEQ ID NO: 6939832 - DNA, 21 bp, Homo sapiens
gcagggtttgtgctgtgagtt

SEQ ID NO: 6939833 - DNA, 22 bp, Homo sapiens
aactctggtttcagactcactt

SEQ ID NO: 6939834 - DNA, 22 bp, Homo sapiens
aaagtgctaagtcacccagcta

SEQ ID NO: 6939835 - DNA, 20 bp, Homo sapiens
agcacattaaacatactcct

SEQ ID NO: 6939836 - DNA, 22 bp, Homo sapiens
gatgcattgcatcgagtagctt

SEQ ID NO: 6939837 - DNA, 18 bp, Homo sapiens
tttaggaaatatgtgcct

SEQ ID NO: 6939838 - DNA, 20 bp, Homo sapiens
agcttcttctgtctaatttt

SEQ ID NO: 6939839 - DNA, 19 bp, Homo sapiens
ttctcagttcaggagaaga

SEQ ID NO: 6939840 - DNA, 22 bp, Homo sapiens
gattatgttcgactttagaaat

SEQ ID NO: 6939841 - DNA, 22 bp, Homo sapiens
tttccttccttgctagcctgag

SEQ ID NO: 6939842 - DNA, 22 bp, Homo sapiens
tatttgcgtcaataaccagttt

SEQ ID NO: 6939843 - DNA, 22 bp, Homo sapiens
tgaagcagagaatttgacagtc

SEQ ID NO: 6939844 - DNA, 22 bp, Homo sapiens
gtgccctgaaagagttaattca

SEQ ID NO: 6939845 - DNA, 22 bp, Homo sapiens
cccagaaggcttgccaggaagc

SEQ ID NO: 6939846 - DNA, 22 bp, Homo sapiens
tcagcccaggtcacgtaatcaa

SEQ ID NO: 6939847 - DNA, 22 bp, Homo sapiens
tattcactgtaactcagcaata

SEQ ID NO: 6939848 - DNA, 22 bp, Homo sapiens
gggtcgcttaatatatgtttaa

SEQ ID NO: 6939849 - DNA, 22 bp, Homo sapiens
tttgtttattaggggagagttg

SEQ ID NO: 6939850 - DNA, 22 bp, Homo sapiens
aaagtagatttctcatggcgaa

SEQ ID NO: 6939851 - DNA, 22 bp, Homo sapiens
tccccagccgtgaaggagagga

SEQ ID NO: 6939852 - DNA, 22 bp, Homo sapiens
agcaccaaagtcctgttagggt

SEQ ID NO: 6939853 - DNA, 22 bp, Homo sapiens
ggccagctacccatctgcgtca

SEQ ID NO: 6939854 - DNA, 22 bp, Homo sapiens
ctcctccctctttgccacacat

SEQ ID NO: 6939855 - DNA, 22 bp, Homo sapiens
gctcaaagaatattcagaatga

SEQ ID NO: 6939856 - DNA, 22 bp, Homo sapiens
tttaacatgttcaagaaacata

SEQ ID NO: 6939857 - DNA, 22 bp, Homo sapiens
ggagagaggctggccgtgatga

SEQ ID NO: 6939858 - DNA, 22 bp, Homo sapiens
aatacttgaatttcatgtcagg

SEQ ID NO: 6939859 - DNA, 22 bp, Homo sapiens
ttgcttctggaactttctgttc

SEQ ID NO: 6939860 - DNA, 22 bp, Homo sapiens
ttgagacacagtttcactctgt

SEQ ID NO: 6939861 - DNA, 22 bp, Homo sapiens
aagacctgcgttatcctgcctg

SEQ ID NO: 6939862 - DNA, 20 bp, Homo sapiens
gctcagtggagaaatgcacc

SEQ ID NO: 6939863 - DNA, 22 bp, Homo sapiens
gcctctgggtgacgaaaggtga

SEQ ID NO: 6939864 - DNA, 22 bp, Homo sapiens
aaacctgaatgtatgtcagaag

SEQ ID NO: 6939865 - DNA, 22 bp, Homo sapiens
atgcatgtattcatgtgtgaca

SEQ ID NO: 6939866 - DNA, 22 bp, Homo sapiens
gcacccagccagcatctcagag

SEQ ID NO: 6939867 - DNA, 22 bp, Homo sapiens
gagcatctgtggtccatcagaa

SEQ ID NO: 6939868 - DNA, 22 bp, Homo sapiens
tttgcaaatatgtgtttctatt

SEQ ID NO: 6939869 - DNA, 22 bp, Homo sapiens
gtgtctgctttcagctagtagg

SEQ ID NO: 6939870 - DNA, 22 bp, Homo sapiens
tcacagcattcgcaatggacag

SEQ ID NO: 6939871 - DNA, 22 bp, Homo sapiens
gtgggctgaggggacaccaagg

SEQ ID NO: 6939872 - DNA, 22 bp, Homo sapiens
atataggctaacaactattgag

SEQ ID NO: 6939873 - DNA, 22 bp, Homo sapiens
tggaggtgagtgtggtacagca

SEQ ID NO: 6939874 - DNA, 22 bp, Homo sapiens
ccctgaaatcctgtgctctgtg

SEQ ID NO: 6939875 - DNA, 22 bp, Homo sapiens
aggctgtggggttctgctttca

SEQ ID NO: 6939876 - DNA, 22 bp, Homo sapiens
gctttggaatgtgctgttatag

SEQ ID NO: 6939877 - DNA, 22 bp, Homo sapiens
tgctggaagaattccatgctgg

SEQ ID NO: 6939878 - DNA, 22 bp, Homo sapiens
tcctggtggctctttgggaagg

SEQ ID NO: 6939879 - DNA, 22 bp, Homo sapiens
gtacccaaagcccattgggcca

SEQ ID NO: 6939880 - DNA, 22 bp, Homo sapiens
acaggtggcagaagcatttact

SEQ ID NO: 6939881 - DNA, 22 bp, Homo sapiens
ggctgcaaataacaactagctt

SEQ ID NO: 6939882 - DNA, 22 bp, Homo sapiens
actgctggaaacccagaatggt

SEQ ID NO: 6939883 - DNA, 22 bp, Homo sapiens
actttacacatcttttctcatt

SEQ ID NO: 6939884 - DNA, 22 bp, Homo sapiens
ttgagcaaagcagccattcatt

SEQ ID NO: 6939885 - DNA, 17 bp, Homo sapiens
agcaggaccccagagca

SEQ ID NO: 6939886 - DNA, 22 bp, Homo sapiens
agctggcaatgtaagtccctgg

SEQ ID NO: 6939887 - DNA, 22 bp, Homo sapiens
actggtgtgcttttgttacata

SEQ ID NO: 6939888 - DNA, 22 bp, Homo sapiens
gcttctgtggtgcatctttgct

SEQ ID NO: 6939889 - DNA, 22 bp, Homo sapiens
tgtgtgtcagtcttgtttaggg

SEQ ID NO: 6939890 - DNA, 22 bp, Homo sapiens
ggaggctgaggcaggcggatca

SEQ ID NO: 6939891 - DNA, 22 bp, Homo sapiens
agctggggcatttatccactaa

SEQ ID NO: 6939892 - DNA, 18 bp, Homo sapiens
aatatcaataagggggag

SEQ ID NO: 6939893 - DNA, 22 bp, Homo sapiens
aagtccgcatttgtgttctctg

SEQ ID NO: 6939894 - DNA, 22 bp, Homo sapiens
tatggcttttggcttctctctg

SEQ ID NO: 6939895 - DNA, 20 bp, Homo sapiens
cgcatagtttccatcattcc

SEQ ID NO: 6939896 - DNA, 22 bp, Homo sapiens
tcacatgtcaagaagataattt

SEQ ID NO: 6939897 - DNA, 22 bp, Homo sapiens
aaactgtaagtgcctcaaggtc

SEQ ID NO: 6939898 - DNA, 22 bp, Homo sapiens
gttagtgggttactctcagccc

SEQ ID NO: 6939899 - DNA, 22 bp, Homo sapiens
atctacaacccctcaaactgtg

SEQ ID NO: 6939900 - DNA, 22 bp, Homo sapiens
cagccctgcagagggcgctcct

SEQ ID NO: 6939901 - DNA, 22 bp, Homo sapiens
ccagctcttttggctgagtgag

SEQ ID NO: 6939902 - DNA, 22 bp, Homo sapiens
ggagtagctgcattccgagcac

SEQ ID NO: 6939903 - DNA, 22 bp, Homo sapiens
actatataagattggcattttt

SEQ ID NO: 6939904 - DNA, 22 bp, Homo sapiens
cagaggctgggacctcaggcat

SEQ ID NO: 6939905 - DNA, 23 bp, Homo sapiens
ccagaatctactcattggaatga

SEQ ID NO: 6939906 - DNA, 22 bp, Homo sapiens
tgttgctgtatgaataggaagg

SEQ ID NO: 6939907 - DNA, 22 bp, Homo sapiens
cacacatcaacctagacattgt

SEQ ID NO: 6939908 - DNA, 21 bp, Homo sapiens
tgtctgctaagctcagcttcc

SEQ ID NO: 6939909 - DNA, 22 bp, Homo sapiens
ccccagccagcttgtagtagaa

SEQ ID NO: 6939910 - DNA, 22 bp, Homo sapiens
gactatttagtttcagattagt

SEQ ID NO: 6939911 - DNA, 22 bp, Homo sapiens
acactttgtcctttttcattgt

SEQ ID NO: 6939912 - DNA, 22 bp, Homo sapiens
tgcagaaagcattgactcttcc

SEQ ID NO: 6939913 - DNA, 22 bp, Homo sapiens
ctgcccaggggagtgctgtcgg

SEQ ID NO: 6939914 - DNA, 22 bp, Homo sapiens
tttcattgagaatataagattt

SEQ ID NO: 6939915 - DNA, 19 bp, Homo sapiens
gtgctgagatgtggtacta

SEQ ID NO: 6939916 - DNA, 22 bp, Homo sapiens
cagcaacttggacagcagtctt

SEQ ID NO: 6939917 - DNA, 22 bp, Homo sapiens
aactcagtgtgtttcttagtat

SEQ ID NO: 6939918 - DNA, 22 bp, Homo sapiens
tctcccagaggatcccagtgga

SEQ ID NO: 6939919 - DNA, 22 bp, Homo sapiens
gagctggtggtgagaaagctct

SEQ ID NO: 6939920 - DNA, 22 bp, Homo sapiens
agaggagtattttctaagggaa

SEQ ID NO: 6939921 - DNA, 22 bp, Homo sapiens
ttctcatagatgctatagacag

SEQ ID NO: 6939922 - DNA, 22 bp, Homo sapiens
tggccttgggtccttagcatca

SEQ ID NO: 6939923 - DNA, 22 bp, Homo sapiens
tgttaaggggatatagcagggc

SEQ ID NO: 6939924 - DNA, 22 bp, Homo sapiens
tctcagtggacgtgtctgtctt

SEQ ID NO: 6939925 - DNA, 22 bp, Homo sapiens
atgaaacatgctttgtggatga

SEQ ID NO: 6939926 - DNA, 22 bp, Homo sapiens
cagtgctaggtcgtgtgctggg

SEQ ID NO: 6939927 - DNA, 22 bp, Homo sapiens
caggaggcagtttcagaagtca

SEQ ID NO: 6939928 - DNA, 22 bp, Homo sapiens
tggaatgcattagggactttag

SEQ ID NO: 6939929 - DNA, 19 bp, Homo sapiens
ctgtgagtcttgtggcctc

SEQ ID NO: 6939930 - DNA, 22 bp, Homo sapiens
ggctgctttgggatggtccgga

SEQ ID NO: 6939931 - DNA, 22 bp, Homo sapiens
tgccaggggacctagggatgtc

SEQ ID NO: 6939932 - DNA, 22 bp, Homo sapiens
gggctgtaggagctggaatggg

SEQ ID NO: 6939933 - DNA, 22 bp, Homo sapiens
tcatttctgagccttccatgat

SEQ ID NO: 6939934 - DNA, 22 bp, Homo sapiens
ggcacagctcaggtcccagctc

SEQ ID NO: 6939935 - DNA, 22 bp, Homo sapiens
attgcactccagcctgggtgac

SEQ ID NO: 6939936 - DNA, 22 bp, Homo sapiens
atacactttagaaaaacgctgc

SEQ ID NO: 6939937 - DNA, 22 bp, Homo sapiens
aatgctgagggatgagagaggc

SEQ ID NO: 6939938 - DNA, 22 bp, Homo sapiens
ttttggctgtagctggaaatct

SEQ ID NO: 6939939 - DNA, 22 bp, Homo sapiens
ggtcttttctgctgcaggttgt

SEQ ID NO: 6939940 - DNA, 22 bp, Homo sapiens
ctggcctggagcctctgggtgg

SEQ ID NO: 6939941 - DNA, 22 bp, Homo sapiens
atggcagtgtttcagtttttgg

SEQ ID NO: 6939942 - DNA, 22 bp, Homo sapiens
ttgagtttcctgacagcgaagg

SEQ ID NO: 6939943 - DNA, 23 bp, Homo sapiens
aggtgtgcttctgggcacctggg

SEQ ID NO: 6939944 - DNA, 22 bp, Homo sapiens
gaactcagagcctgagctagga

SEQ ID NO: 6939945 - DNA, 22 bp, Homo sapiens
tcatttggccttctttgcattg

SEQ ID NO: 6939946 - DNA, 22 bp, Homo sapiens
atgatgtatgactgtgttcaaa

SEQ ID NO: 6939947 - DNA, 22 bp, Homo sapiens
gctgaagctgcagcaggaggaa

SEQ ID NO: 6939948 - DNA, 22 bp, Homo sapiens
tcagcatcagtattgtttagga

SEQ ID NO: 6939949 - DNA, 22 bp, Homo sapiens
ttagaggatatcatcagcctac

SEQ ID NO: 6939950 - DNA, 22 bp, Homo sapiens
gagctggtgctcttgtcaagac

SEQ ID NO: 6939951 - DNA, 22 bp, Homo sapiens
cctttgatttcccccgtctcag

SEQ ID NO: 6939952 - DNA, 22 bp, Homo sapiens
aacagtcacattgttcaacttt

SEQ ID NO: 6939953 - DNA, 22 bp, Homo sapiens
ttattctgcacttttaaaatat

SEQ ID NO: 6939954 - DNA, 22 bp, Homo sapiens
tcacagcaaccctgaggcgagt

SEQ ID NO: 6939955 - DNA, 22 bp, Homo sapiens
agggtgcgttctatgagaatct

SEQ ID NO: 6939956 - DNA, 19 bp, Homo sapiens
tttgaatataatgcagcta

SEQ ID NO: 6939957 - DNA, 22 bp, Homo sapiens
cccaggaggcagaggttgcagt

SEQ ID NO: 6939958 - DNA, 22 bp, Homo sapiens
tacctgaattaccaaaagcttt

SEQ ID NO: 6939959 - DNA, 22 bp, Homo sapiens
gctttggaaggggctggtggag

SEQ ID NO: 6939960 - DNA, 22 bp, Homo sapiens
tcctggccctgtggcctgcagt

SEQ ID NO: 6939961 - DNA, 18 bp, Homo sapiens
gagggagtagctgaggtt

SEQ ID NO: 6939962 - DNA, 22 bp, Homo sapiens
catcattgttagggactctaac

SEQ ID NO: 6939963 - DNA, 22 bp, Homo sapiens
cagcacatgctcatcagggaag

SEQ ID NO: 6939964 - DNA, 22 bp, Homo sapiens
acacatatctaagatagatgac

SEQ ID NO: 6939965 - DNA, 22 bp, Homo sapiens
agccaatacactgaagatctaa

SEQ ID NO: 6939966 - DNA, 22 bp, Homo sapiens
ggctgcagaagtacttccggat

SEQ ID NO: 6939967 - DNA, 22 bp, Homo sapiens
gctggctcagggggattagcaa

SEQ ID NO: 6939968 - DNA, 22 bp, Homo sapiens
agagcaattctcaaggaggtgt

SEQ ID NO: 6939969 - DNA, 22 bp, Homo sapiens
ttctggagccgggcctgggcag

SEQ ID NO: 6939970 - DNA, 22 bp, Homo sapiens
tcagaactcaagacttgacatc

SEQ ID NO: 6939971 - DNA, 22 bp, Homo sapiens
ggccagcatatagagtgaagta

SEQ ID NO: 6939972 - DNA, 22 bp, Homo sapiens
agggtggccaccaagtatgtca

SEQ ID NO: 6939973 - DNA, 23 bp, Homo sapiens
taaagtgctgatggtgagggagc

SEQ ID NO: 6939974 - DNA, 22 bp, Homo sapiens
aggctccaccccgccagacctt

SEQ ID NO: 6939975 - DNA, 22 bp, Homo sapiens
ccctggaggagcttagagcttg

SEQ ID NO: 6939976 - DNA, 18 bp, Homo sapiens
ctgtaccaccctgagggc

SEQ ID NO: 6939977 - DNA, 22 bp, Homo sapiens
tggcatgtgtggttacaggttc

SEQ ID NO: 6939978 - DNA, 22 bp, Homo sapiens
agcccctgtcctctctgatgac

SEQ ID NO: 6939979 - DNA, 22 bp, Homo sapiens
tcagccagtgtgcacctggagt

SEQ ID NO: 6939980 - DNA, 22 bp, Homo sapiens
catctgaaatctgcctacaagc

SEQ ID NO: 6939981 - DNA, 22 bp, Homo sapiens
taccctgcaggattgctgtgca

SEQ ID NO: 6939982 - DNA, 21 bp, Homo sapiens
tagcaggaggcccctgcttgc

SEQ ID NO: 6939983 - DNA, 15 bp, Homo sapiens
ggccttgctatttcc

SEQ ID NO: 6939984 - DNA, 22 bp, Homo sapiens
gaccaggctagttcagagcttc

SEQ ID NO: 6939985 - DNA, 22 bp, Homo sapiens
ctgtggagatgcagaccaggcc

SEQ ID NO: 6939986 - DNA, 21 bp, Homo sapiens
ccagctgtctgtccttaggca

SEQ ID NO: 6939987 - DNA, 22 bp, Homo sapiens
gatattgccagatgtccccgga

SEQ ID NO: 6939988 - DNA, 22 bp, Homo sapiens
tgatgggaaaatgaggcctggg

SEQ ID NO: 6939989 - DNA, 22 bp, Homo sapiens
tggaacactttgttgaaatgca

SEQ ID NO: 6939990 - DNA, 22 bp, Homo sapiens
tacagcaaagaaaccctcagtc

SEQ ID NO: 6939991 - DNA, 22 bp, Homo sapiens
gtcacagtggggtcacagtgtg

SEQ ID NO: 6939992 - DNA, 22 bp, Homo sapiens
taaatagggaatagaagaggaa

SEQ ID NO: 6939993 - DNA, 22 bp, Homo sapiens
aagacagccagctccatgggat

SEQ ID NO: 6939994 - DNA, 22 bp, Homo sapiens
ttttgctgtgtccttgagccgg

SEQ ID NO: 6939995 - DNA, 22 bp, Homo sapiens
tgccagggaccctgtcggccct

SEQ ID NO: 6939996 - DNA, 22 bp, Homo sapiens
gtcctggtataattgtttaaaa

SEQ ID NO: 6939997 - DNA, 22 bp, Homo sapiens
actgtgatgttctctatcttgg

SEQ ID NO: 6939998 - DNA, 22 bp, Homo sapiens
gaggaacttcatctctatgcca

SEQ ID NO: 6939999 - DNA, 22 bp, Homo sapiens
gggcagcatgtcactagcatgg

SEQ ID NO: 6940000 - DNA, 22 bp, Homo sapiens
tcagaagtaaggttctcccaag

SEQ ID NO: 6940001 - DNA, 22 bp, Homo sapiens
gtaacaggcaatacaactctct

SEQ ID NO: 6940002 - DNA, 22 bp, Homo sapiens
ggcagctggttctttccattaa

SEQ ID NO: 6940003 - DNA, 22 bp, Homo sapiens
cacagcagaacttaatttcaaa

SEQ ID NO: 6940004 - DNA, 21 bp, Homo sapiens
gagatggcccagtagcgggcc

SEQ ID NO: 6940005 - DNA, 22 bp, Homo sapiens
cacagcccccttgacactctgg

SEQ ID NO: 6940006 - DNA, 20 bp, Homo sapiens
tccaatttaagaatttagag

SEQ ID NO: 6940007 - DNA, 22 bp, Homo sapiens
tgcacagctgcctcctctctgc

SEQ ID NO: 6940008 - DNA, 22 bp, Homo sapiens
atggggtggagtccgggcagcg

SEQ ID NO: 6940009 - DNA, 22 bp, Homo sapiens
tctgtgaatgatgtttctttct

SEQ ID NO: 6940010 - DNA, 22 bp, Homo sapiens
ctgcctcctcacgtccacagtg

SEQ ID NO: 6940011 - DNA, 22 bp, Homo sapiens
aatctcacatagctaggagtag

SEQ ID NO: 6940012 - DNA, 22 bp, Homo sapiens
ggctcataggctcagggctttg

SEQ ID NO: 6940013 - DNA, 22 bp, Homo sapiens
ccaggctgagcatgattggagc

SEQ ID NO: 6940014 - DNA, 22 bp, Homo sapiens
tgtgctgtgggactcaggctcc

SEQ ID NO: 6940015 - DNA, 22 bp, Homo sapiens
aggactgatgatggtgctgaca

SEQ ID NO: 6940016 - DNA, 22 bp, Homo sapiens
gctgccttgaacttggcctggg

SEQ ID NO: 6940017 - DNA, 22 bp, Homo sapiens
tagctttagaaatattctcaga

SEQ ID NO: 6940018 - DNA, 22 bp, Homo sapiens
ccaggtgtgatttcatctgagg

SEQ ID NO: 6940019 - DNA, 22 bp, Homo sapiens
gtgtataatgctgtttgtacat

SEQ ID NO: 6940020 - DNA, 22 bp, Homo sapiens
ttctcctgcgcaggcccaggga

SEQ ID NO: 6940021 - DNA, 22 bp, Homo sapiens
tttgacagacagtgctgggaca

SEQ ID NO: 6940022 - DNA, 22 bp, Homo sapiens
ctgggctgtaatgtggcactga

SEQ ID NO: 6940023 - DNA, 22 bp, Homo sapiens
tgaaggcaacctctgtggtcct

SEQ ID NO: 6940024 - DNA, 22 bp, Homo sapiens
atggctttgtgttcagagctga

SEQ ID NO: 6940025 - DNA, 22 bp, Homo sapiens
tgggcagatctttggtggctag

SEQ ID NO: 6940026 - DNA, 22 bp, Homo sapiens
aaacagcaggaacatcttgcca

SEQ ID NO: 6940027 - DNA, 22 bp, Homo sapiens
acatctgttcttctcttgtccc

SEQ ID NO: 6940028 - DNA, 22 bp, Homo sapiens
tgaaagtctctgttatagagaa

SEQ ID NO: 6940029 - DNA, 22 bp, Homo sapiens
tgggacctctcttgagagagca

SEQ ID NO: 6940030 - DNA, 22 bp, Homo sapiens
aagcaatacaagtggtcattga

SEQ ID NO: 6940031 - DNA, 21 bp, Homo sapiens
cactggtagatggcccgcagg

SEQ ID NO: 6940032 - DNA, 22 bp, Homo sapiens
cagctgcactgaagcaggtttg

SEQ ID NO: 6940033 - DNA, 22 bp, Homo sapiens
ccatgcctcgggaagagtctgt

SEQ ID NO: 6940034 - DNA, 22 bp, Homo sapiens
gattgttgcctggctttgacct

SEQ ID NO: 6940035 - DNA, 22 bp, Homo sapiens
tagtatttgcagatttgtgtca

SEQ ID NO: 6940036 - DNA, 22 bp, Homo sapiens
tcaaccctgttttctttgcaat

SEQ ID NO: 6940037 - DNA, 23 bp, Homo sapiens
agcatggaataggaaagaggcag

SEQ ID NO: 6940038 - DNA, 22 bp, Homo sapiens
ttccaggctgcagttgtagtta

SEQ ID NO: 6940039 - DNA, 22 bp, Homo sapiens
aagcatcttctatcagttagac

SEQ ID NO: 6940040 - DNA, 22 bp, Homo sapiens
gcagccagaagactcagaacaa

SEQ ID NO: 6940041 - DNA, 22 bp, Homo sapiens
tcttgatgctttttctaaatgt

SEQ ID NO: 6940042 - DNA, 22 bp, Homo sapiens
acacattttgttaaaccctgtg

SEQ ID NO: 6940043 - DNA, 22 bp, Homo sapiens
cagtgttttgttacttgggcac

SEQ ID NO: 6940044 - DNA, 22 bp, Homo sapiens
agatggagttagtaccagagtc

SEQ ID NO: 6940045 - DNA, 22 bp, Homo sapiens
ggtgccaagaactacaggattc

SEQ ID NO: 6940046 - DNA, 22 bp, Homo sapiens
tctgacaatgaacaatctatag

SEQ ID NO: 6940047 - DNA, 22 bp, Homo sapiens
cttctaggcttctcagggggca

SEQ ID NO: 6940048 - DNA, 22 bp, Homo sapiens
aaagactttaggttagaggcat

SEQ ID NO: 6940049 - DNA, 22 bp, Homo sapiens
tttacagatgtggaaagtgagc

SEQ ID NO: 6940050 - DNA, 22 bp, Homo sapiens
atccggggttcattttcactga

SEQ ID NO: 6940051 - DNA, 23 bp, Homo sapiens
gccctccctcccaggtgggtgtt

SEQ ID NO: 6940052 - DNA, 19 bp, Homo sapiens
catattgtgcttgcatttt

SEQ ID NO: 6940053 - DNA, 22 bp, Homo sapiens
cagagcctgctgccttctgaag

SEQ ID NO: 6940054 - DNA, 22 bp, Homo sapiens
tttactgttacacctaccttct

SEQ ID NO: 6940055 - DNA, 22 bp, Homo sapiens
accctcaacaaattcactctat

SEQ ID NO: 6940056 - DNA, 22 bp, Homo sapiens
atggaaaaggctgatttcatta

SEQ ID NO: 6940057 - DNA, 22 bp, Homo sapiens
agtaaattatttagcttccaga

SEQ ID NO: 6940058 - DNA, 22 bp, Homo sapiens
acttcacttgtaaatgcagcct

SEQ ID NO: 6940059 - DNA, 22 bp, Homo sapiens
agtgtctgcggcggggaggcgg

SEQ ID NO: 6940060 - DNA, 22 bp, Homo sapiens
acttacaagttccctttctcag

SEQ ID NO: 6940061 - DNA, 22 bp, Homo sapiens
ccacagtctagctagaaggcat

SEQ ID NO: 6940062 - DNA, 22 bp, Homo sapiens
gagcatttttgtctgcatttta

SEQ ID NO: 6940063 - DNA, 22 bp, Homo sapiens
ttctggattttccaactcactg

SEQ ID NO: 6940064 - DNA, 22 bp, Homo sapiens
gggaatgtaagatatatactag

SEQ ID NO: 6940065 - DNA, 22 bp, Homo sapiens
gttgaaagatcatgtggctgcc

SEQ ID NO: 6940066 - DNA, 21 bp, Homo sapiens
ttgcaatgttctagtaatcta

SEQ ID NO: 6940067 - DNA, 22 bp, Homo sapiens
ctgccctttgaaagaacgtctt

SEQ ID NO: 6940068 - DNA, 22 bp, Homo sapiens
actgaattacagtctgcatttt

SEQ ID NO: 6940069 - DNA, 22 bp, Homo sapiens
aacatgatgtgaagcatgaact

SEQ ID NO: 6940070 - DNA, 22 bp, Homo sapiens
caggtgcctcaggatgagacaa

SEQ ID NO: 6940071 - DNA, 22 bp, Homo sapiens
aaggacacggggctggctctgg

SEQ ID NO: 6940072 - DNA, 22 bp, Homo sapiens
cagagctgtccaaaccctgaca

SEQ ID NO: 6940073 - DNA, 22 bp, Homo sapiens
gaggaggtctcctccgcagggg

SEQ ID NO: 6940074 - DNA, 22 bp, Homo sapiens
cagcagtggtgtatttgaggct

SEQ ID NO: 6940075 - DNA, 22 bp, Homo sapiens
aaacacatcattcatgtcgtca

SEQ ID NO: 6940076 - DNA, 22 bp, Homo sapiens
acaggtgtaatttgcccgaggt

SEQ ID NO: 6940077 - DNA, 22 bp, Homo sapiens
tttttgctaatccccagccact

SEQ ID NO: 6940078 - DNA, 22 bp, Homo sapiens
acagagcaggtccagaagtgcc

SEQ ID NO: 6940079 - DNA, 22 bp, Homo sapiens
tggcgagcatccagcgcatcca

SEQ ID NO: 6940080 - DNA, 22 bp, Homo sapiens
gagcgggggctgccgggatttg

SEQ ID NO: 6940081 - DNA, 22 bp, Homo sapiens
gaactcccagccctttgttggc

SEQ ID NO: 6940082 - DNA, 22 bp, Homo sapiens
accttcctctaagacatttagc

SEQ ID NO: 6940083 - DNA, 19 bp, Homo sapiens
tttgctggttcaggaaaga

SEQ ID NO: 6940084 - DNA, 22 bp, Homo sapiens
tgtgcacaggaagctattctct

SEQ ID NO: 6940085 - DNA, 22 bp, Homo sapiens
agcaggctactcctgtgttcgt

SEQ ID NO: 6940086 - DNA, 22 bp, Homo sapiens
aggtccaggttccgtttctgcg

SEQ ID NO: 6940087 - DNA, 22 bp, Homo sapiens
ttttccgaggtggctctgggac

SEQ ID NO: 6940088 - DNA, 22 bp, Homo sapiens
attgctgtttaggcaagtgtat

SEQ ID NO: 6940089 - DNA, 22 bp, Homo sapiens
tgcctctgtgtgcaggtgagca

SEQ ID NO: 6940090 - DNA, 22 bp, Homo sapiens
cctggctgacagcttaattcca

SEQ ID NO: 6940091 - DNA, 22 bp, Homo sapiens
ttgaggtctgtgtaggcagcaa

SEQ ID NO: 6940092 - DNA, 18 bp, Homo sapiens
gttaattttgaagttcat

SEQ ID NO: 6940093 - DNA, 22 bp, Homo sapiens
gaggtgtcgtagattattctca

SEQ ID NO: 6940094 - DNA, 22 bp, Homo sapiens
cattccacactgcaggaaatat

SEQ ID NO: 6940095 - DNA, 22 bp, Homo sapiens
aagtccagtttcatttgaggtc

SEQ ID NO: 6940096 - DNA, 22 bp, Homo sapiens
tccaggctcccctgcgtgctcc

SEQ ID NO: 6940097 - DNA, 22 bp, Homo sapiens
ctgtgtcttctgttttgaagtt

SEQ ID NO: 6940098 - DNA, 22 bp, Homo sapiens
agacctggagtggggcctcagg

SEQ ID NO: 6940099 - DNA, 22 bp, Homo sapiens
ggacaacacttcattccagcta

SEQ ID NO: 6940100 - DNA, 22 bp, Homo sapiens
ttagcaccctgatactagaatg

SEQ ID NO: 6940101 - DNA, 22 bp, Homo sapiens
ccccagcagcacctggggcagt

SEQ ID NO: 6940102 - DNA, 22 bp, Homo sapiens
aagcactggggccacagacacg

SEQ ID NO: 6940103 - DNA, 22 bp, Homo sapiens
tttggacatgagtctttaatct

SEQ ID NO: 6940104 - DNA, 22 bp, Homo sapiens
gaaatcttttccaattgtttag

SEQ ID NO: 6940105 - DNA, 22 bp, Homo sapiens
caggtaggcagccggtctctgg

SEQ ID NO: 6940106 - DNA, 22 bp, Homo sapiens
agcgattcacacactgggctgt

SEQ ID NO: 6940107 - DNA, 22 bp, Homo sapiens
tttctcagctgtggagcctatc

SEQ ID NO: 6940108 - DNA, 22 bp, Homo sapiens
tcacagcagggtaacaggaaga

SEQ ID NO: 6940109 - DNA, 22 bp, Homo sapiens
caggagctcttaaggatgtgat

SEQ ID NO: 6940110 - DNA, 22 bp, Homo sapiens
ccctccacagacaggacttgtc

SEQ ID NO: 6940111 - DNA, 22 bp, Homo sapiens
tatatagaaaagcagatgttgg

SEQ ID NO: 6940112 - DNA, 22 bp, Homo sapiens
tctggctcatacaagcctgcaa

SEQ ID NO: 6940113 - DNA, 22 bp, Homo sapiens
tgcatggtaaccaggatgtcta

SEQ ID NO: 6940114 - DNA, 22 bp, Homo sapiens
ttttgtaagaaactgccaagcc

SEQ ID NO: 6940115 - DNA, 22 bp, Homo sapiens
ggagtgtgattgttctctgtta

SEQ ID NO: 6940116 - DNA, 22 bp, Homo sapiens
aattctacattggttcacattt

SEQ ID NO: 6940117 - DNA, 22 bp, Homo sapiens
atattggtaaagtggattaaca

SEQ ID NO: 6940118 - DNA, 22 bp, Homo sapiens
catagcttaggggttaaactca

SEQ ID NO: 6940119 - DNA, 23 bp, Homo sapiens
tgaaatattcttttgcatgagct

SEQ ID NO: 6940120 - DNA, 22 bp, Homo sapiens
tcctattagaatgattaaattc

SEQ ID NO: 6940121 - DNA, 20 bp, Homo sapiens
atttggcatgaagtattgat

SEQ ID NO: 6940122 - DNA, 22 bp, Homo sapiens
gcttgcatttggaatagattaa

SEQ ID NO: 6940123 - DNA, 22 bp, Homo sapiens
aatatatgaccaggaagttctg

SEQ ID NO: 6940124 - DNA, 22 bp, Homo sapiens
tttgagaagatgtaatgttaag

SEQ ID NO: 6940125 - DNA, 18 bp, Homo sapiens
tgtacagttatgagcatt

SEQ ID NO: 6940126 - DNA, 22 bp, Homo sapiens
actgttagatgctaagcaaatg

SEQ ID NO: 6940127 - DNA, 22 bp, Homo sapiens
ctggaagtggagagtggccctc

SEQ ID NO: 6940128 - DNA, 22 bp, Homo sapiens
gaagatttctgatgagttactt

SEQ ID NO: 6940129 - DNA, 22 bp, Homo sapiens
catgccaggtttgagtatcttg

SEQ ID NO: 6940130 - DNA, 22 bp, Homo sapiens
cttcttggactactcactagag

SEQ ID NO: 6940131 - DNA, 22 bp, Homo sapiens
atgttcttatcattctttcgga

SEQ ID NO: 6940132 - DNA, 22 bp, Homo sapiens
agtcaggagctgctgcattgta

SEQ ID NO: 6940133 - DNA, 22 bp, Homo sapiens
tgtctcttcccactcagacccc

SEQ ID NO: 6940134 - DNA, 22 bp, Homo sapiens
gcctgtggcccaactgtctgtc

SEQ ID NO: 6940135 - DNA, 22 bp, Homo sapiens
taacagaaacagataagtgtaa

SEQ ID NO: 6940136 - DNA, 22 bp, Homo sapiens
atgtagtgtagagattagtctc

SEQ ID NO: 6940137 - DNA, 22 bp, Homo sapiens
tcagatgctagggctgagctat

SEQ ID NO: 6940138 - DNA, 22 bp, Homo sapiens
agggccaggctcccatgtcagg

SEQ ID NO: 6940139 - DNA, 22 bp, Homo sapiens
tgaggccaggcaaaggcgatct

SEQ ID NO: 6940140 - DNA, 22 bp, Homo sapiens
tttctgaaacatggtctttgta

SEQ ID NO: 6940141 - DNA, 22 bp, Homo sapiens
tttagtcatagatacccaaggt

SEQ ID NO: 6940142 - DNA, 22 bp, Homo sapiens
attccttctaaaacgctgccct

SEQ ID NO: 6940143 - DNA, 22 bp, Homo sapiens
tctgaagcacagcaggaagggt

SEQ ID NO: 6940144 - DNA, 22 bp, Homo sapiens
ctgagaaagtttatgtttattt

SEQ ID NO: 6940145 - DNA, 22 bp, Homo sapiens
ttggccttctcatttgcttatt

SEQ ID NO: 6940146 - DNA, 22 bp, Homo sapiens
aaccgctgccgccggccgtacg

SEQ ID NO: 6940147 - DNA, 22 bp, Homo sapiens
aaatgaaatgagtgcctggagg

SEQ ID NO: 6940148 - DNA, 22 bp, Homo sapiens
cagggcttggatctgtggtcag

SEQ ID NO: 6940149 - DNA, 20 bp, Homo sapiens
actgcaagtcacttttaggg

SEQ ID NO: 6940150 - DNA, 22 bp, Homo sapiens
aaaggcatcattagtaccaagt

SEQ ID NO: 6940151 - DNA, 22 bp, Homo sapiens
gcagctttaatctgaataagta

SEQ ID NO: 6940152 - DNA, 22 bp, Homo sapiens
tcagatatggagtctaaaacca

SEQ ID NO: 6940153 - DNA, 22 bp, Homo sapiens
tatggcttgtggagagttgtag

SEQ ID NO: 6940154 - DNA, 20 bp, Homo sapiens
accagagactggggacaagt

SEQ ID NO: 6940155 - DNA, 22 bp, Homo sapiens
gtcctgtgtgagtgcaccacct

SEQ ID NO: 6940156 - DNA, 22 bp, Homo sapiens
gaacagtactaagagctttaca

SEQ ID NO: 6940157 - DNA, 22 bp, Homo sapiens
cacaatttggggtgcccactgt

SEQ ID NO: 6940158 - DNA, 22 bp, Homo sapiens
cacattctgtgaagctgatttt

SEQ ID NO: 6940159 - DNA, 22 bp, Homo sapiens
caggcagctagatttataacaa

SEQ ID NO: 6940160 - DNA, 20 bp, Homo sapiens
tgctgtgtggcccagcatga

SEQ ID NO: 6940161 - DNA, 22 bp, Homo sapiens
tagaattcatgttactgttagc

SEQ ID NO: 6940162 - DNA, 22 bp, Homo sapiens
tagtgaaacctgacagatcatg

SEQ ID NO: 6940163 - DNA, 22 bp, Homo sapiens
gatgtctttctaatactggctt

SEQ ID NO: 6940164 - DNA, 22 bp, Homo sapiens
ccctaatgcagctgagaagggc

SEQ ID NO: 6940165 - DNA, 19 bp, Homo sapiens
tgtggggagtcagggggct

SEQ ID NO: 6940166 - DNA, 22 bp, Homo sapiens
cttcaattgccaccagctagca

SEQ ID NO: 6940167 - DNA, 22 bp, Homo sapiens
cctgggtatagaagagccgctg

SEQ ID NO: 6940168 - DNA, 22 bp, Homo sapiens
taattatacaaaaaggcatgca

SEQ ID NO: 6940169 - DNA, 21 bp, Homo sapiens
cagcctgctgctccagggcca

SEQ ID NO: 6940170 - DNA, 19 bp, Homo sapiens
tggttctccttccacagtc

SEQ ID NO: 6940171 - DNA, 20 bp, Homo sapiens
tccagcgtgtgactctgcgc

SEQ ID NO: 6940172 - DNA, 22 bp, Homo sapiens
tttcttgtacactggaatttat

SEQ ID NO: 6940173 - DNA, 22 bp, Homo sapiens
taagataaggagagtgctagta

SEQ ID NO: 6940174 - DNA, 22 bp, Homo sapiens
catttgttaatgctgcttttaa

SEQ ID NO: 6940175 - DNA, 22 bp, Homo sapiens
tagcaggacatgtgcagagaag

SEQ ID NO: 6940176 - DNA, 22 bp, Homo sapiens
cagtcagtaatgtggcacctgt

SEQ ID NO: 6940177 - DNA, 22 bp, Homo sapiens
tgtctcttggattgcttgctct

SEQ ID NO: 6940178 - DNA, 23 bp, Homo sapiens
aaaatcattaatttaccctgaaa

SEQ ID NO: 6940179 - DNA, 21 bp, Homo sapiens
tgctggcaagactcaggaata

SEQ ID NO: 6940180 - DNA, 22 bp, Homo sapiens
agtggaaagaaccctggactca

SEQ ID NO: 6940181 - DNA, 22 bp, Homo sapiens
tgtcaatatcaggcagacctaa

SEQ ID NO: 6940182 - DNA, 22 bp, Homo sapiens
tgattctctgatggagaaagac

SEQ ID NO: 6940183 - DNA, 22 bp, Homo sapiens
acaaccttctggagatatctgt

SEQ ID NO: 6940184 - DNA, 22 bp, Homo sapiens
tagccaggcgaggtcagtgtcg

SEQ ID NO: 6940185 - DNA, 22 bp, Homo sapiens
tcagagaatccgtaagtcacaa

SEQ ID NO: 6940186 - DNA, 22 bp, Homo sapiens
gggctccagcccgggaccaggt

SEQ ID NO: 6940187 - DNA, 22 bp, Homo sapiens
agcactttgagcagatgaagga

SEQ ID NO: 6940188 - DNA, 22 bp, Homo sapiens
aaaatatcagcaaagggtgaca

SEQ ID NO: 6940189 - DNA, 22 bp, Homo sapiens
agccagtagatcgggaggatgt

SEQ ID NO: 6940190 - DNA, 22 bp, Homo sapiens
aaggctgtggttctatacagaa

SEQ ID NO: 6940191 - DNA, 22 bp, Homo sapiens
ttagaagcaggctgtgtcccca

SEQ ID NO: 6940192 - DNA, 22 bp, Homo sapiens
caggaagtgggtagaaggaata

SEQ ID NO: 6940193 - DNA, 22 bp, Homo sapiens
acatttctcataggagagccac

SEQ ID NO: 6940194 - DNA, 22 bp, Homo sapiens
gcccaggctggagttcagtggt

SEQ ID NO: 6940195 - DNA, 22 bp, Homo sapiens
gagtaattcttgggagactcca

SEQ ID NO: 6940196 - DNA, 22 bp, Homo sapiens
tgaggtaggagggtgatcagca

SEQ ID NO: 6940197 - DNA, 22 bp, Homo sapiens
gaaggcctcactctgcagcata

SEQ ID NO: 6940198 - DNA, 22 bp, Homo sapiens
gaatgtaaaattgcctacaaga

SEQ ID NO: 6940199 - DNA, 22 bp, Homo sapiens
cccaggaacagcacagaacagc

SEQ ID NO: 6940200 - DNA, 16 bp, Homo sapiens
gaaggctgggtgatcc

SEQ ID NO: 6940201 - DNA, 22 bp, Homo sapiens
gtgcctgagccagctgcagctc

SEQ ID NO: 6940202 - DNA, 22 bp, Homo sapiens
acagggcagagaggcaggcttg

SEQ ID NO: 6940203 - DNA, 22 bp, Homo sapiens
gctgtgcatggagggccgttca

SEQ ID NO: 6940204 - DNA, 22 bp, Homo sapiens
tctggctctgtgtcctcaccca

SEQ ID NO: 6940205 - DNA, 22 bp, Homo sapiens
ttctctcattcaaattaaagtg

SEQ ID NO: 6940206 - DNA, 22 bp, Homo sapiens
tgactgccgattgtccttctct

SEQ ID NO: 6940207 - DNA, 22 bp, Homo sapiens
agctctttatgggtaaatgcca

SEQ ID NO: 6940208 - DNA, 19 bp, Homo sapiens
ggagcctggagcacgtgcc

SEQ ID NO: 6940209 - DNA, 22 bp, Homo sapiens
tctgagccagggtctcctccct

SEQ ID NO: 6940210 - DNA, 22 bp, Homo sapiens
tagtcctgaccagctggatgtt

SEQ ID NO: 6940211 - DNA, 22 bp, Homo sapiens
tggtcagagaagtagggacaat

SEQ ID NO: 6940212 - DNA, 22 bp, Homo sapiens
ccaattgtcctaattaattaga

SEQ ID NO: 6940213 - DNA, 22 bp, Homo sapiens
ccacaaggggactcgttaaatg

SEQ ID NO: 6940214 - DNA, 22 bp, Homo sapiens
tggcctgcagaggctgtggggc

SEQ ID NO: 6940215 - DNA, 18 bp, Homo sapiens
tgttcccggggattctga

SEQ ID NO: 6940216 - DNA, 21 bp, Homo sapiens
gctgctgtgggccagggaggc

SEQ ID NO: 6940217 - DNA, 22 bp, Homo sapiens
tggctccaggttgaactttggg

SEQ ID NO: 6940218 - DNA, 22 bp, Homo sapiens
taggcacaaaatgaaaatggca

SEQ ID NO: 6940219 - DNA, 22 bp, Homo sapiens
cacggcctgtaaggacccagga

SEQ ID NO: 6940220 - DNA, 22 bp, Homo sapiens
gaagtacactactccttgagtc

SEQ ID NO: 6940221 - DNA, 22 bp, Homo sapiens
gaagctttgtcttgtctcctgg

SEQ ID NO: 6940222 - DNA, 22 bp, Homo sapiens
tctaaacttcactttaagtgct

SEQ ID NO: 6940223 - DNA, 22 bp, Homo sapiens
tttagaagacagatgcacagcc

SEQ ID NO: 6940224 - DNA, 22 bp, Homo sapiens
cactgcaacctccatcttctgg

SEQ ID NO: 6940225 - DNA, 22 bp, Homo sapiens
gtgtgcatcttttctgcttgat

SEQ ID NO: 6940226 - DNA, 22 bp, Homo sapiens
catgcagtattcaggacagttc

SEQ ID NO: 6940227 - DNA, 22 bp, Homo sapiens
tgagaagcattaggaagaacat

SEQ ID NO: 6940228 - DNA, 22 bp, Homo sapiens
ggaggtcccaggcctggcagca

SEQ ID NO: 6940229 - DNA, 22 bp, Homo sapiens
ctgagacatggtttgactggca

SEQ ID NO: 6940230 - DNA, 22 bp, Homo sapiens
tggcttctgggatgtgttgaca

SEQ ID NO: 6940231 - DNA, 22 bp, Homo sapiens
aagagccgctccggccagggag

SEQ ID NO: 6940232 - DNA, 22 bp, Homo sapiens
aagaccctacccctggagagga

SEQ ID NO: 6940233 - DNA, 22 bp, Homo sapiens
ggctgtgagtttgtcctccatg

SEQ ID NO: 6940234 - DNA, 22 bp, Homo sapiens
gggctgagccatttgaaccttg

SEQ ID NO: 6940235 - DNA, 22 bp, Homo sapiens
taacctctctgtgcctcagttt

SEQ ID NO: 6940236 - DNA, 21 bp, Homo sapiens
tagttcaagttctttcagttc

SEQ ID NO: 6940237 - DNA, 22 bp, Homo sapiens
tcttgttacagtttattacatg

SEQ ID NO: 6940238 - DNA, 22 bp, Homo sapiens
tccagctcagatgcagggatca

SEQ ID NO: 6940239 - DNA, 20 bp, Homo sapiens
ccttctccagcttgttcttg

SEQ ID NO: 6940240 - DNA, 22 bp, Homo sapiens
ctctggagtgcagcctggtggc

SEQ ID NO: 6940241 - DNA, 21 bp, Homo sapiens
aaagttcatgctttaatattc

SEQ ID NO: 6940242 - DNA, 22 bp, Homo sapiens
cagtcctgaggaagagctgctg

SEQ ID NO: 6940243 - DNA, 22 bp, Homo sapiens
cttcatgaggccggctttatcc

SEQ ID NO: 6940244 - DNA, 22 bp, Homo sapiens
caatacttccttgttagaggca

SEQ ID NO: 6940245 - DNA, 22 bp, Homo sapiens
tgtaccatatatgttactgact

SEQ ID NO: 6940246 - DNA, 22 bp, Homo sapiens
gttacaatgtccttacatgaaa

SEQ ID NO: 6940247 - DNA, 22 bp, Homo sapiens
agatgacagccaaggagatgaa

SEQ ID NO: 6940248 - DNA, 22 bp, Homo sapiens
ttcagaatatttgttttacatg

SEQ ID NO: 6940249 - DNA, 22 bp, Homo sapiens
gccaagctctttaaaggccaaa

SEQ ID NO: 6940250 - DNA, 22 bp, Homo sapiens
ggataggaattgagatgctatt

SEQ ID NO: 6940251 - DNA, 22 bp, Homo sapiens
aggataaaggtcattattccca

SEQ ID NO: 6940252 - DNA, 22 bp, Homo sapiens
tagcagctgtgagtaaaagcca

SEQ ID NO: 6940253 - DNA, 22 bp, Homo sapiens
ggccttgctgcttccagaaggt

SEQ ID NO: 6940254 - DNA, 22 bp, Homo sapiens
gactgcttaaatatatgatgtt

SEQ ID NO: 6940255 - DNA, 22 bp, Homo sapiens
acagctctgcatggcagttatt

SEQ ID NO: 6940256 - DNA, 22 bp, Homo sapiens
caaagtcttctcattatgtctt

SEQ ID NO: 6940257 - DNA, 22 bp, Homo sapiens
agccagcatgaagacagaggcc

SEQ ID NO: 6940258 - DNA, 22 bp, Homo sapiens
ttctgcacaaattttaggttat

SEQ ID NO: 6940259 - DNA, 22 bp, Homo sapiens
ttattcacatgggctcattcta

SEQ ID NO: 6940260 - DNA, 22 bp, Homo sapiens
acaaaatcaaaggagtgattca

SEQ ID NO: 6940261 - DNA, 22 bp, Homo sapiens
atgccatcttttattcttctag

SEQ ID NO: 6940262 - DNA, 22 bp, Homo sapiens
tcctagtcacaggaaaatttca

SEQ ID NO: 6940263 - DNA, 22 bp, Homo sapiens
gtgggagctgctacctccttcc

SEQ ID NO: 6940264 - DNA, 22 bp, Homo sapiens
gtccaggctcaaaaggttgtta

SEQ ID NO: 6940265 - DNA, 21 bp, Homo sapiens
taatgcaaggaactaatgtca

SEQ ID NO: 6940266 - DNA, 22 bp, Homo sapiens
cctgcctggcttccagaagaga

SEQ ID NO: 6940267 - DNA, 22 bp, Homo sapiens
acatttctcaggtaagtcattt

SEQ ID NO: 6940268 - DNA, 22 bp, Homo sapiens
tgtgtgaagcacatgttcaagg

SEQ ID NO: 6940269 - DNA, 22 bp, Homo sapiens
gtggtcctcataattcagtgag

SEQ ID NO: 6940270 - DNA, 22 bp, Homo sapiens
ctttcagaagtatattctggaa

SEQ ID NO: 6940271 - DNA, 22 bp, Homo sapiens
cagcagcagacatttgatcttc

SEQ ID NO: 6940272 - DNA, 22 bp, Homo sapiens
atcctgtctttgttttaaatat

SEQ ID NO: 6940273 - DNA, 22 bp, Homo sapiens
ttgaatgcataaatgtactctg

SEQ ID NO: 6940274 - DNA, 21 bp, Homo sapiens
actccaaacaagttaagctgt

SEQ ID NO: 6940275 - DNA, 22 bp, Homo sapiens
tgcatcaaattctgaaattagc

SEQ ID NO: 6940276 - DNA, 22 bp, Homo sapiens
tttaaggcttcaatttttggta

SEQ ID NO: 6940277 - DNA, 22 bp, Homo sapiens
agctaaggccgcgttggggtaa

SEQ ID NO: 6940278 - DNA, 22 bp, Homo sapiens
tcttcagattgcactgagcaag

SEQ ID NO: 6940279 - DNA, 22 bp, Homo sapiens
ccttggattttgtgcccacgcc

SEQ ID NO: 6940280 - DNA, 22 bp, Homo sapiens
catagatagaggttcctaatag

SEQ ID NO: 6940281 - DNA, 22 bp, Homo sapiens
gtggtttgtgcatagctcctat

SEQ ID NO: 6940282 - DNA, 22 bp, Homo sapiens
tttcatcatcaaaatagtgagg

SEQ ID NO: 6940283 - DNA, 22 bp, Homo sapiens
atgaaatgctattttggctaga

SEQ ID NO: 6940284 - DNA, 22 bp, Homo sapiens
gtatatcttcagaaattatagg

SEQ ID NO: 6940285 - DNA, 22 bp, Homo sapiens
gaaggaagattctgttggaatc

SEQ ID NO: 6940286 - DNA, 22 bp, Homo sapiens
ttatgcagcaaagtgcttgaaa

SEQ ID NO: 6940287 - DNA, 22 bp, Homo sapiens
aacatttgtgtttgctaaaaat

SEQ ID NO: 6940288 - DNA, 22 bp, Homo sapiens
ggagatgcgactcgcggggctg

SEQ ID NO: 6940289 - DNA, 22 bp, Homo sapiens
tgatttctcttggcaatatgtt

SEQ ID NO: 6940290 - DNA, 20 bp, Homo sapiens
tccatgcaaatacagagttt

SEQ ID NO: 6940291 - DNA, 22 bp, Homo sapiens
ttccatgggtctgggggctcca

SEQ ID NO: 6940292 - DNA, 22 bp, Homo sapiens
aggaatgtcatagaataatcat

SEQ ID NO: 6940293 - DNA, 22 bp, Homo sapiens
cgcgcggccttgtggggcttgt

SEQ ID NO: 6940294 - DNA, 20 bp, Homo sapiens
ctcaagtaaggttataaggt

SEQ ID NO: 6940295 - DNA, 22 bp, Homo sapiens
ccctggtgtccactggaggaag

SEQ ID NO: 6940296 - DNA, 22 bp, Homo sapiens
tgaagtttggtggaaatttcct

SEQ ID NO: 6940297 - DNA, 22 bp, Homo sapiens
agctatgttctgtgtctgtgga

SEQ ID NO: 6940298 - DNA, 20 bp, Homo sapiens
tggagctgtaatcttgtctg

SEQ ID NO: 6940299 - DNA, 21 bp, Homo sapiens
agattcaggacagcagtcact

SEQ ID NO: 6940300 - DNA, 22 bp, Homo sapiens
cccaaaggctgtacttgtaacc

SEQ ID NO: 6940301 - DNA, 22 bp, Homo sapiens
tcttctcctttgccatgtgttt

SEQ ID NO: 6940302 - DNA, 22 bp, Homo sapiens
attcagtttttattggaccagc

SEQ ID NO: 6940303 - DNA, 22 bp, Homo sapiens
ttggccaggtccatttctccat

SEQ ID NO: 6940304 - DNA, 23 bp, Homo sapiens
atccacattacagtatcatacaa

SEQ ID NO: 6940305 - DNA, 22 bp, Homo sapiens
cagccaatcctgggaaagtgca

SEQ ID NO: 6940306 - DNA, 22 bp, Homo sapiens
gtggcaaggctggaatggaacc

SEQ ID NO: 6940307 - DNA, 22 bp, Homo sapiens
ttcggcatattaatggtgggtg

SEQ ID NO: 6940308 - DNA, 22 bp, Homo sapiens
agggagcttccgaactacagct

SEQ ID NO: 6940309 - DNA, 22 bp, Homo sapiens
ggtccagttctccctctatgtc

SEQ ID NO: 6940310 - DNA, 22 bp, Homo sapiens
ttattccaatttctcctacaaa

SEQ ID NO: 6940311 - DNA, 22 bp, Homo sapiens
tctctttaaagactcagagatt

SEQ ID NO: 6940312 - DNA, 22 bp, Homo sapiens
agggcatggggttaacctggga

SEQ ID NO: 6940313 - DNA, 22 bp, Homo sapiens
agatacagaagtttttccctat

SEQ ID NO: 6940314 - DNA, 22 bp, Homo sapiens
ccctgcctctgaagctgctcag

SEQ ID NO: 6940315 - DNA, 22 bp, Homo sapiens
tatacacatatcttctaggcct

SEQ ID NO: 6940316 - DNA, 22 bp, Homo sapiens
caagtgtcttcaaaggctaaaa

SEQ ID NO: 6940317 - DNA, 22 bp, Homo sapiens
acaaggctggctgggaaaaact

SEQ ID NO: 6940318 - DNA, 22 bp, Homo sapiens
catgtatccctaattgtgttaa

SEQ ID NO: 6940319 - DNA, 22 bp, Homo sapiens
cagggatggttgagaattggta

SEQ ID NO: 6940320 - DNA, 22 bp, Homo sapiens
gatgtctgccaaagaatcaagc

SEQ ID NO: 6940321 - DNA, 19 bp, Homo sapiens
ggacttggtttccaggctc

SEQ ID NO: 6940322 - DNA, 18 bp, Homo sapiens
agtagtgggtttagcttc

SEQ ID NO: 6940323 - DNA, 22 bp, Homo sapiens
ccgcgtcttttgttcgggccta

SEQ ID NO: 6940324 - DNA, 22 bp, Homo sapiens
gcattcatctagtatcactctg

SEQ ID NO: 6940325 - DNA, 22 bp, Homo sapiens
cagacagggtcctgtccgtcac

SEQ ID NO: 6940326 - DNA, 22 bp, Homo sapiens
aggacttagaacattatgtact

SEQ ID NO: 6940327 - DNA, 22 bp, Homo sapiens
ggagcagggaattacagcgcag

SEQ ID NO: 6940328 - DNA, 22 bp, Homo sapiens
taccacagcaaatgaggccaac

SEQ ID NO: 6940329 - DNA, 22 bp, Homo sapiens
ctgagcagatgaccagccccag

SEQ ID NO: 6940330 - DNA, 23 bp, Homo sapiens
agtgctgaattgaaagctccagg

SEQ ID NO: 6940331 - DNA, 23 bp, Homo sapiens
gggtccagagaagccattagggc

SEQ ID NO: 6940332 - DNA, 22 bp, Homo sapiens
ttggagtagctggctttgtgct

SEQ ID NO: 6940333 - DNA, 22 bp, Homo sapiens
cttgtacactcagtacttctag

SEQ ID NO: 6940334 - DNA, 22 bp, Homo sapiens
agtcttaggctccattagtaga

SEQ ID NO: 6940335 - DNA, 22 bp, Homo sapiens
gctggcagtaaagggtttggca

SEQ ID NO: 6940336 - DNA, 22 bp, Homo sapiens
tccaaacgggagccaaatgagc

SEQ ID NO: 6940337 - DNA, 22 bp, Homo sapiens
tttcagagctcagcagctagag

SEQ ID NO: 6940338 - DNA, 22 bp, Homo sapiens
ttcaagatccagcacaacagtg

SEQ ID NO: 6940339 - DNA, 22 bp, Homo sapiens
gacctccgtgtacacctcccag

SEQ ID NO: 6940340 - DNA, 22 bp, Homo sapiens
gctccctatttggccttctctg

SEQ ID NO: 6940341 - DNA, 22 bp, Homo sapiens
aggtggggtgttggatgtttat

SEQ ID NO: 6940342 - DNA, 22 bp, Homo sapiens
tgccagtgtgtgccttaagctc

SEQ ID NO: 6940343 - DNA, 22 bp, Homo sapiens
ctagagagcttttaaaaatact

SEQ ID NO: 6940344 - DNA, 22 bp, Homo sapiens
cggccttgcgcggagcagaggg

SEQ ID NO: 6940345 - DNA, 22 bp, Homo sapiens
tgtttgaagttcttctgtgact

SEQ ID NO: 6940346 - DNA, 22 bp, Homo sapiens
ccaggaaggcaggcctccccgc

SEQ ID NO: 6940347 - DNA, 21 bp, Homo sapiens
ccagggtccagctgccatggt

SEQ ID NO: 6940348 - DNA, 22 bp, Homo sapiens
aagaggtgggttggacagatac

SEQ ID NO: 6940349 - DNA, 22 bp, Homo sapiens
cctgggctttggaacagtactt

SEQ ID NO: 6940350 - DNA, 22 bp, Homo sapiens
agaggccctctctctcctgatg

SEQ ID NO: 6940351 - DNA, 22 bp, Homo sapiens
gagtcctgaatcctgtggcaac

SEQ ID NO: 6940352 - DNA, 22 bp, Homo sapiens
ctatttggggtagaagatggat

SEQ ID NO: 6940353 - DNA, 21 bp, Homo sapiens
agtctggaaaacacattcatg

SEQ ID NO: 6940354 - DNA, 22 bp, Homo sapiens
gcagggctccactgtggccaag

SEQ ID NO: 6940355 - DNA, 22 bp, Homo sapiens
ggcaggcttgatatggggggac

SEQ ID NO: 6940356 - DNA, 22 bp, Homo sapiens
gctatcgtggttgaaatgaaac

SEQ ID NO: 6940357 - DNA, 23 bp, Homo sapiens
atgcagtatatgtcagtagttta

SEQ ID NO: 6940358 - DNA, 22 bp, Homo sapiens
tcatctcaaaacccaaggggca

SEQ ID NO: 6940359 - DNA, 22 bp, Homo sapiens
acagctactctgcagataaatc

SEQ ID NO: 6940360 - DNA, 22 bp, Homo sapiens
agatgatggccatgtcctctcc

SEQ ID NO: 6940361 - DNA, 22 bp, Homo sapiens
aatctgcacaattcagtttcag

SEQ ID NO: 6940362 - DNA, 18 bp, Homo sapiens
acaaggtcaattggttac

SEQ ID NO: 6940363 - DNA, 22 bp, Homo sapiens
ccctggcagaatgtctctgggc

SEQ ID NO: 6940364 - DNA, 22 bp, Homo sapiens
tggagctgggatttgaactgca

SEQ ID NO: 6940365 - DNA, 22 bp, Homo sapiens
ataaggacttgaattagacatt

SEQ ID NO: 6940366 - DNA, 22 bp, Homo sapiens
tctcttggggaaagagaagaat

SEQ ID NO: 6940367 - DNA, 22 bp, Homo sapiens
tgaagtcctagaactcctggta

SEQ ID NO: 6940368 - DNA, 22 bp, Homo sapiens
tataaactatatgttagccaga

SEQ ID NO: 6940369 - DNA, 22 bp, Homo sapiens
tctcacagtgcaggtctgtctc

SEQ ID NO: 6940370 - DNA, 22 bp, Homo sapiens
tggaacaacatgctggaaaatt

SEQ ID NO: 6940371 - DNA, 20 bp, Homo sapiens
cttctggctggtcaaggact

SEQ ID NO: 6940372 - DNA, 22 bp, Homo sapiens
tgaatatgggcagcaggactag

SEQ ID NO: 6940373 - DNA, 20 bp, Homo sapiens
gctgccttggatggctacac

SEQ ID NO: 6940374 - DNA, 22 bp, Homo sapiens
tgcctcagtttctccatatgaa

SEQ ID NO: 6940375 - DNA, 22 bp, Homo sapiens
tattagcatatatgattcagtt

SEQ ID NO: 6940376 - DNA, 22 bp, Homo sapiens
aggtgacaggacaggagctggt

SEQ ID NO: 6940377 - DNA, 16 bp, Homo sapiens
ttctctggggttgtgc

SEQ ID NO: 6940378 - DNA, 22 bp, Homo sapiens
taaatgtggagactcaggagtc

SEQ ID NO: 6940379 - DNA, 22 bp, Homo sapiens
gctggtaaacttctggtgccat

SEQ ID NO: 6940380 - DNA, 22 bp, Homo sapiens
agttgcttctcaggaaaggagc

SEQ ID NO: 6940381 - DNA, 23 bp, Homo sapiens
tctacaaagctgtgtcaggaccc

SEQ ID NO: 6940382 - DNA, 23 bp, Homo sapiens
acattgttcaatgaaagttagga

SEQ ID NO: 6940383 - DNA, 22 bp, Homo sapiens
agggagagtttgatgtttcctc

SEQ ID NO: 6940384 - DNA, 22 bp, Homo sapiens
gtattattgtcatgaaataata

SEQ ID NO: 6940385 - DNA, 22 bp, Homo sapiens
tacaatgcattcgttgtctcgg

SEQ ID NO: 6940386 - DNA, 22 bp, Homo sapiens
ttcccaaaatataacagttaac

SEQ ID NO: 6940387 - DNA, 22 bp, Homo sapiens
ctggtccctgtaggtatttgac

SEQ ID NO: 6940388 - DNA, 22 bp, Homo sapiens
cagcagcactctgcgggtcccc

SEQ ID NO: 6940389 - DNA, 22 bp, Homo sapiens
tgtcttgtctgtgagggcattg

SEQ ID NO: 6940390 - DNA, 22 bp, Homo sapiens
acaagaaaggtaggattcaggt

SEQ ID NO: 6940391 - DNA, 22 bp, Homo sapiens
tctctgtgagatttgtattaag

SEQ ID NO: 6940392 - DNA, 22 bp, Homo sapiens
gagagacctcagaaacaatcta

SEQ ID NO: 6940393 - DNA, 22 bp, Homo sapiens
tcatttgtctggcacagggaat

SEQ ID NO: 6940394 - DNA, 22 bp, Homo sapiens
aaaatacacatactaggggaaa

SEQ ID NO: 6940395 - DNA, 22 bp, Homo sapiens
ttcataagtttgtcactgatgt

SEQ ID NO: 6940396 - DNA, 22 bp, Homo sapiens
catgttaatgaatttttgcagt

SEQ ID NO: 6940397 - DNA, 22 bp, Homo sapiens
ttgttcatggttgtaagtttga

SEQ ID NO: 6940398 - DNA, 22 bp, Homo sapiens
cttatattttaggaacagacaa

SEQ ID NO: 6940399 - DNA, 22 bp, Homo sapiens
tgtgtacaagcctgagtacaga

SEQ ID NO: 6940400 - DNA, 22 bp, Homo sapiens
gctgtactgggagagaagccgt

SEQ ID NO: 6940401 - DNA, 22 bp, Homo sapiens
acagtccttgtgtggaacatta

SEQ ID NO: 6940402 - DNA, 19 bp, Homo sapiens
tagaggagaagggaagtgg

SEQ ID NO: 6940403 - DNA, 22 bp, Homo sapiens
cctacctggggcaggcctcggg

SEQ ID NO: 6940404 - DNA, 22 bp, Homo sapiens
tttgaaacctagttatatgact

SEQ ID NO: 6940405 - DNA, 22 bp, Homo sapiens
aatgcataccatgtcatctttg

SEQ ID NO: 6940406 - DNA, 22 bp, Homo sapiens
gccccgcagtgcgtgctggtct

SEQ ID NO: 6940407 - DNA, 22 bp, Homo sapiens
caggatgcggcctgactctaag

SEQ ID NO: 6940408 - DNA, 22 bp, Homo sapiens
accaggacattttagtcatctt

SEQ ID NO: 6940409 - DNA, 22 bp, Homo sapiens
ttgaattgaaacataccctggt

SEQ ID NO: 6940410 - DNA, 22 bp, Homo sapiens
ggtgtcagaagtgggatattac

SEQ ID NO: 6940411 - DNA, 22 bp, Homo sapiens
tgtcttatgtagatactgagaa

SEQ ID NO: 6940412 - DNA, 22 bp, Homo sapiens
actgccagatattaaacatatt

SEQ ID NO: 6940413 - DNA, 22 bp, Homo sapiens
tgtcaccatgcgaggctaattt

SEQ ID NO: 6940414 - DNA, 22 bp, Homo sapiens
tgcacagcgggtgtctgtcagg

SEQ ID NO: 6940415 - DNA, 22 bp, Homo sapiens
caagtagagattacagtgtgca

SEQ ID NO: 6940416 - DNA, 22 bp, Homo sapiens
taacgtttgataacttctgttc

SEQ ID NO: 6940417 - DNA, 22 bp, Homo sapiens
ctggcttcagctgccatcaatg

SEQ ID NO: 6940418 - DNA, 22 bp, Homo sapiens
ttagaagtgaaatagctgtaca

SEQ ID NO: 6940419 - DNA, 22 bp, Homo sapiens
gattacaattcaggttgataag

SEQ ID NO: 6940420 - DNA, 22 bp, Homo sapiens
tttgtgaacttaggcaattagg

SEQ ID NO: 6940421 - DNA, 22 bp, Homo sapiens
tatttataccaggtgatcggag

SEQ ID NO: 6940422 - DNA, 22 bp, Homo sapiens
cagtcccagctgctcagaaggc

SEQ ID NO: 6940423 - DNA, 22 bp, Homo sapiens
ctagttctagatccctgaggaa

SEQ ID NO: 6940424 - DNA, 22 bp, Homo sapiens
attatgtatttggtatagtttg

SEQ ID NO: 6940425 - DNA, 22 bp, Homo sapiens
ggtggccataggaccagcctgg

SEQ ID NO: 6940426 - DNA, 22 bp, Homo sapiens
taagcaacaaatggtttctgat

SEQ ID NO: 6940427 - DNA, 22 bp, Homo sapiens
tcaatgcatgtgacaaagagta

SEQ ID NO: 6940428 - DNA, 22 bp, Homo sapiens
gtatagaagctttgctctctct

SEQ ID NO: 6940429 - DNA, 22 bp, Homo sapiens
ataaggcagaaatgattctagt

SEQ ID NO: 6940430 - DNA, 22 bp, Homo sapiens
atcactgtcgtcatctgagatt

SEQ ID NO: 6940431 - DNA, 22 bp, Homo sapiens
tgcaaatgtgtggtgaggcatt

SEQ ID NO: 6940432 - DNA, 20 bp, Homo sapiens
gggtggagttgcggtctgtg

SEQ ID NO: 6940433 - DNA, 22 bp, Homo sapiens
taaaccatgcagacagctccat

SEQ ID NO: 6940434 - DNA, 22 bp, Homo sapiens
catgagtgctatatgtgaagag

SEQ ID NO: 6940435 - DNA, 22 bp, Homo sapiens
gctaagaaggccatatcagaga

SEQ ID NO: 6940436 - DNA, 21 bp, Homo sapiens
gtgctctgggcagcagagggc

SEQ ID NO: 6940437 - DNA, 22 bp, Homo sapiens
tgtgtgtgcacgtgcgcgcgag

SEQ ID NO: 6940438 - DNA, 22 bp, Homo sapiens
gccatgaaaccagaggatggct

SEQ ID NO: 6940439 - DNA, 22 bp, Homo sapiens
tagcacctagagtattttatca

SEQ ID NO: 6940440 - DNA, 22 bp, Homo sapiens
tggcagctatggtctaagggcc

SEQ ID NO: 6940441 - DNA, 21 bp, Homo sapiens
tgacatttccaatataaagcc

SEQ ID NO: 6940442 - DNA, 21 bp, Homo sapiens
ctgtggaagggaactagaggg

SEQ ID NO: 6940443 - DNA, 21 bp, Homo sapiens
tgggcctcaggcagctgtgac

SEQ ID NO: 6940444 - DNA, 22 bp, Homo sapiens
ttcttcttctggctgcacctgg

SEQ ID NO: 6940445 - DNA, 22 bp, Homo sapiens
ccctgcccatcggggcggcctg

SEQ ID NO: 6940446 - DNA, 22 bp, Homo sapiens
tgtaaactagggctgataaggg

SEQ ID NO: 6940447 - DNA, 22 bp, Homo sapiens
acagccaaggaattaggaaggg

SEQ ID NO: 6940448 - DNA, 22 bp, Homo sapiens
ggaaggaagtgcagactttaaa

SEQ ID NO: 6940449 - DNA, 22 bp, Homo sapiens
ctgagagtctacatttttagca

SEQ ID NO: 6940450 - DNA, 22 bp, Homo sapiens
tcgtcatctgaaggctgtcaat

SEQ ID NO: 6940451 - DNA, 22 bp, Homo sapiens
agcagggctgcggccccaccac

SEQ ID NO: 6940452 - DNA, 22 bp, Homo sapiens
catggctgctggctcggtccct

SEQ ID NO: 6940453 - DNA, 21 bp, Homo sapiens
tggctgctggccctctctcca

SEQ ID NO: 6940454 - DNA, 22 bp, Homo sapiens
cacatcatagagactcaatcca

SEQ ID NO: 6940455 - DNA, 22 bp, Homo sapiens
tcctcacactatagatgaggat

SEQ ID NO: 6940456 - DNA, 23 bp, Homo sapiens
agggcctcaggagggctgcatgg

SEQ ID NO: 6940457 - DNA, 21 bp, Homo sapiens
agtgacccagggttcctggct

SEQ ID NO: 6940458 - DNA, 22 bp, Homo sapiens
ctggagtgatactcagaatgtg

SEQ ID NO: 6940459 - DNA, 22 bp, Homo sapiens
aactgctagattgttattcaag

SEQ ID NO: 6940460 - DNA, 22 bp, Homo sapiens
gtgccctgatgcaattgtctca

SEQ ID NO: 6940461 - DNA, 22 bp, Homo sapiens
ccaaagtgctgggattacaggt

SEQ ID NO: 6940462 - DNA, 22 bp, Homo sapiens
aagcaactcctaggaggaaagg

SEQ ID NO: 6940463 - DNA, 22 bp, Homo sapiens
atgttcctattgcagaggatga

SEQ ID NO: 6940464 - DNA, 22 bp, Homo sapiens
tgcattgaggggctctcttcct

SEQ ID NO: 6940465 - DNA, 22 bp, Homo sapiens
tcctggcataatggctttgctc

SEQ ID NO: 6940466 - DNA, 22 bp, Homo sapiens
actgtgcagctgagtgctaatt

SEQ ID NO: 6940467 - DNA, 22 bp, Homo sapiens
gcattgttgaaaggaatgggct

SEQ ID NO: 6940468 - DNA, 22 bp, Homo sapiens
tggctgctctcttccccagggt

SEQ ID NO: 6940469 - DNA, 22 bp, Homo sapiens
cctacatacttgggctttacct

SEQ ID NO: 6940470 - DNA, 22 bp, Homo sapiens
ggtgagaggcagtgctgtggaa

SEQ ID NO: 6940471 - DNA, 22 bp, Homo sapiens
ccaggacagggagacgggagcc

SEQ ID NO: 6940472 - DNA, 22 bp, Homo sapiens
cgtgcttttcaaccattctcaa

SEQ ID NO: 6940473 - DNA, 22 bp, Homo sapiens
ttctgtgtgccagagttgtgct

SEQ ID NO: 6940474 - DNA, 22 bp, Homo sapiens
tattgctggggtgggccatgtt

SEQ ID NO: 6940475 - DNA, 22 bp, Homo sapiens
caagctctgcgggctccaagat

SEQ ID NO: 6940476 - DNA, 18 bp, Homo sapiens
gagaaggccacttgtttt

SEQ ID NO: 6940477 - DNA, 19 bp, Homo sapiens
agtctcttcggaggaggtt

SEQ ID NO: 6940478 - DNA, 22 bp, Homo sapiens
ctatatacttttcacagatgtt

SEQ ID NO: 6940479 - DNA, 22 bp, Homo sapiens
cacaggtgtatgaatatgtcca

SEQ ID NO: 6940480 - DNA, 22 bp, Homo sapiens
aacacagagtatttgaagcatt

SEQ ID NO: 6940481 - DNA, 22 bp, Homo sapiens
tagtgcatataactagaatacc

SEQ ID NO: 6940482 - DNA, 22 bp, Homo sapiens
gtcacagtgctcccaaagtttg

SEQ ID NO: 6940483 - DNA, 22 bp, Homo sapiens
gatattgtgatgatgtctttgg

SEQ ID NO: 6940484 - DNA, 23 bp, Homo sapiens
tctgtacacatcagcatctccca

SEQ ID NO: 6940485 - DNA, 22 bp, Homo sapiens
aggcagcatttgaatccaggtc

SEQ ID NO: 6940486 - DNA, 20 bp, Homo sapiens
taggacaggcagccgagggg

SEQ ID NO: 6940487 - DNA, 22 bp, Homo sapiens
aggcaaattattgtatgcagtt

SEQ ID NO: 6940488 - DNA, 22 bp, Homo sapiens
cttgatctacatagtgaaaccc

SEQ ID NO: 6940489 - DNA, 22 bp, Homo sapiens
ctgaggcacctacagtctcggg

SEQ ID NO: 6940490 - DNA, 22 bp, Homo sapiens
aatgctgtcttttctacttcat

SEQ ID NO: 6940491 - DNA, 22 bp, Homo sapiens
tgagatgaagtgatgtaaaaca

SEQ ID NO: 6940492 - DNA, 22 bp, Homo sapiens
agtaggataagagcctgtccaa

SEQ ID NO: 6940493 - DNA, 20 bp, Homo sapiens
caaggcttctttgatggggt

SEQ ID NO: 6940494 - DNA, 22 bp, Homo sapiens
gtttcctttctattgccttgat

SEQ ID NO: 6940495 - DNA, 22 bp, Homo sapiens
ttctggagttcaggtccctaaa

SEQ ID NO: 6940496 - DNA, 22 bp, Homo sapiens
cttgagtcatataaagacagag

SEQ ID NO: 6940497 - DNA, 22 bp, Homo sapiens
gtcagtgtgagataatcttgga

SEQ ID NO: 6940498 - DNA, 22 bp, Homo sapiens
ctatgtctcactccctagtcag

SEQ ID NO: 6940499 - DNA, 23 bp, Homo sapiens
tgaatttggaactcagagaatta

SEQ ID NO: 6940500 - DNA, 22 bp, Homo sapiens
gcttctcttgtccaagggcagg

SEQ ID NO: 6940501 - DNA, 22 bp, Homo sapiens
actcaagatagggaaagtacaa

SEQ ID NO: 6940502 - DNA, 22 bp, Homo sapiens
ctcatttgtaattagttctcag

SEQ ID NO: 6940503 - DNA, 23 bp, Homo sapiens
ggggtcttggaacaggtggccct

SEQ ID NO: 6940504 - DNA, 22 bp, Homo sapiens
attgcagtgatggttgcataat

SEQ ID NO: 6940505 - DNA, 22 bp, Homo sapiens
aggaaataagggacaagacaaa

SEQ ID NO: 6940506 - DNA, 22 bp, Homo sapiens
aaaccctgctcttatggaactt

SEQ ID NO: 6940507 - DNA, 22 bp, Homo sapiens
gctggtcagggtattggaggcc

SEQ ID NO: 6940508 - DNA, 22 bp, Homo sapiens
ggtgtaactgagcatccacgtg

SEQ ID NO: 6940509 - DNA, 22 bp, Homo sapiens
gtgagtctgtggaccgggcact

SEQ ID NO: 6940510 - DNA, 22 bp, Homo sapiens
tagcagctccatttctctggca

SEQ ID NO: 6940511 - DNA, 22 bp, Homo sapiens
gagtcctgcccttgtgtagtcc

SEQ ID NO: 6940512 - DNA, 22 bp, Homo sapiens
atatgatgtgctatgtcactag

SEQ ID NO: 6940513 - DNA, 22 bp, Homo sapiens
tggccctgtccctggagcctgg

SEQ ID NO: 6940514 - DNA, 22 bp, Homo sapiens
aaagttgcacaactttgtatac

SEQ ID NO: 6940515 - DNA, 22 bp, Homo sapiens
gcatcggcgtctgttcaggttt

SEQ ID NO: 6940516 - DNA, 22 bp, Homo sapiens
gcgagcagacccccatcttctc

SEQ ID NO: 6940517 - DNA, 22 bp, Homo sapiens
tccatgccaggcagtcgatgca

SEQ ID NO: 6940518 - DNA, 22 bp, Homo sapiens
acagtaatcatatgattttctc

SEQ ID NO: 6940519 - DNA, 22 bp, Homo sapiens
agtgaattagcctatttgtaaa

SEQ ID NO: 6940520 - DNA, 22 bp, Homo sapiens
tgcttaatccaacctggctgac

SEQ ID NO: 6940521 - DNA, 22 bp, Homo sapiens
agatgtggccggctagggagag

SEQ ID NO: 6940522 - DNA, 20 bp, Homo sapiens
tgtctgtatgcagtcatata

SEQ ID NO: 6940523 - DNA, 22 bp, Homo sapiens
tggcatgggtggagagagcaca

SEQ ID NO: 6940524 - DNA, 22 bp, Homo sapiens
ttctgggtgactcacgctcccc

SEQ ID NO: 6940525 - DNA, 22 bp, Homo sapiens
ttacgagtttgcaattttaaat

SEQ ID NO: 6940526 - DNA, 22 bp, Homo sapiens
tcaggcctgctgtatgatggat

SEQ ID NO: 6940527 - DNA, 21 bp, Homo sapiens
ttcagcttgctgactgcggca

SEQ ID NO: 6940528 - DNA, 22 bp, Homo sapiens
agtacaaattatagcgcttgga

SEQ ID NO: 6940529 - DNA, 22 bp, Homo sapiens
atgctttagtgtcaagtttggg

SEQ ID NO: 6940530 - DNA, 22 bp, Homo sapiens
taatgctaacatcatatcactg

SEQ ID NO: 6940531 - DNA, 19 bp, Homo sapiens
ttacaatgacccaatctgg

SEQ ID NO: 6940532 - DNA, 22 bp, Homo sapiens
tgaccctctggccccacagcca

SEQ ID NO: 6940533 - DNA, 22 bp, Homo sapiens
tacttgtgtgtcatgtgcagag

SEQ ID NO: 6940534 - DNA, 22 bp, Homo sapiens
aagatgaatcagtatgtgtcct

SEQ ID NO: 6940535 - DNA, 22 bp, Homo sapiens
agccctcaggctttgctgggcc

SEQ ID NO: 6940536 - DNA, 22 bp, Homo sapiens
gacaactgtcagtatattgtta

SEQ ID NO: 6940537 - DNA, 22 bp, Homo sapiens
aatgctttcttataaccactgc

SEQ ID NO: 6940538 - DNA, 22 bp, Homo sapiens
ctgtcttttcttctcattgatg

SEQ ID NO: 6940539 - DNA, 22 bp, Homo sapiens
catacatttatacacatctatg

SEQ ID NO: 6940540 - DNA, 22 bp, Homo sapiens
cttcacacccactaggatggct

SEQ ID NO: 6940541 - DNA, 22 bp, Homo sapiens
cacttatctcatttaatcacca

SEQ ID NO: 6940542 - DNA, 22 bp, Homo sapiens
ctgatacatagtagcatgtcat

SEQ ID NO: 6940543 - DNA, 16 bp, Homo sapiens
tggcagaggttcagcc

SEQ ID NO: 6940544 - DNA, 22 bp, Homo sapiens
aatgatgaactcagagggaacc

SEQ ID NO: 6940545 - DNA, 22 bp, Homo sapiens
cagtgccggggctggagatgaa

SEQ ID NO: 6940546 - DNA, 22 bp, Homo sapiens
tgaaacaaaccagtaattttgt

SEQ ID NO: 6940547 - DNA, 22 bp, Homo sapiens
agagtctgtgaagtcagttact

SEQ ID NO: 6940548 - DNA, 22 bp, Homo sapiens
ccgagaacttttcctgaaaagt

SEQ ID NO: 6940549 - DNA, 22 bp, Homo sapiens
aaggttcctctctccacccagc

SEQ ID NO: 6940550 - DNA, 22 bp, Homo sapiens
actgtgagagaggttcttggta

SEQ ID NO: 6940551 - DNA, 22 bp, Homo sapiens
cagctacaaatacttttgtatg

SEQ ID NO: 6940552 - DNA, 22 bp, Homo sapiens
aaatagcagcctttagttaaca

SEQ ID NO: 6940553 - DNA, 22 bp, Homo sapiens
gctaaatagtttttggaacctc

SEQ ID NO: 6940554 - DNA, 22 bp, Homo sapiens
ggaacttgcaacctctggtcac

SEQ ID NO: 6940555 - DNA, 22 bp, Homo sapiens
tgaggctgccttgggaagaggg

SEQ ID NO: 6940556 - DNA, 22 bp, Homo sapiens
tgttgttacattcctgtgtccc

SEQ ID NO: 6940557 - DNA, 22 bp, Homo sapiens
atctgcagtttgttttctcttg

SEQ ID NO: 6940558 - DNA, 22 bp, Homo sapiens
aggaattttcacagttgggtat

SEQ ID NO: 6940559 - DNA, 22 bp, Homo sapiens
ggggctcacacctccctaaggg

SEQ ID NO: 6940560 - DNA, 22 bp, Homo sapiens
aagtgtctgcaaaatgacagag

SEQ ID NO: 6940561 - DNA, 19 bp, Homo sapiens
agggcctgcagctcaagct

SEQ ID NO: 6940562 - DNA, 22 bp, Homo sapiens
cttatgaagaccctacctccag

SEQ ID NO: 6940563 - DNA, 22 bp, Homo sapiens
agagaacttctcctaaatctca

SEQ ID NO: 6940564 - DNA, 22 bp, Homo sapiens
ttcacagtgtttctcacggtta

SEQ ID NO: 6940565 - DNA, 22 bp, Homo sapiens
tgggagaatcttgctctgctac

SEQ ID NO: 6940566 - DNA, 19 bp, Homo sapiens
cagatgttttcagttcatt

SEQ ID NO: 6940567 - DNA, 22 bp, Homo sapiens
agttacatataagaagacagac

SEQ ID NO: 6940568 - DNA, 22 bp, Homo sapiens
gcccaggatggtgtgtagtggt

SEQ ID NO: 6940569 - DNA, 22 bp, Homo sapiens
ccattggagccaagagttttac

SEQ ID NO: 6940570 - DNA, 22 bp, Homo sapiens
gtgcaaaagtaattgcggtttt

SEQ ID NO: 6940571 - DNA, 22 bp, Homo sapiens
gagggtgtgaacactggctgtg

SEQ ID NO: 6940572 - DNA, 22 bp, Homo sapiens
tacagagtggtgagatcttttg

SEQ ID NO: 6940573 - DNA, 22 bp, Homo sapiens
tggagcgagctcaaaggcagga

SEQ ID NO: 6940574 - DNA, 22 bp, Homo sapiens
cacctgagcaaccctgtgcggg

SEQ ID NO: 6940575 - DNA, 22 bp, Homo sapiens
tgtgggtttgtagttaagttct

SEQ ID NO: 6940576 - DNA, 22 bp, Homo sapiens
cagctgcagaaagcaagcaggt

SEQ ID NO: 6940577 - DNA, 22 bp, Homo sapiens
tccttttccctgaaggtattta

SEQ ID NO: 6940578 - DNA, 22 bp, Homo sapiens
taattactaagggctgcatacc

SEQ ID NO: 6940579 - DNA, 22 bp, Homo sapiens
gaagaacaagcagtgctttcct

SEQ ID NO: 6940580 - DNA, 22 bp, Homo sapiens
cttggattacccatatgattag

SEQ ID NO: 6940581 - DNA, 22 bp, Homo sapiens
ggacacaggtaaataccactga

SEQ ID NO: 6940582 - DNA, 22 bp, Homo sapiens
atgaagatgtgaaggctggatt

SEQ ID NO: 6940583 - DNA, 22 bp, Homo sapiens
aaagtatttttgacaggcatta

SEQ ID NO: 6940584 - DNA, 22 bp, Homo sapiens
atagacaaacacgaagatgaca

SEQ ID NO: 6940585 - DNA, 22 bp, Homo sapiens
tttagtgataagaattatgaaa

SEQ ID NO: 6940586 - DNA, 22 bp, Homo sapiens
aaagatctccccttcaaagagt

SEQ ID NO: 6940587 - DNA, 22 bp, Homo sapiens
aaaatgcaaacctacctacata

SEQ ID NO: 6940588 - DNA, 22 bp, Homo sapiens
gcaggctgctgagatccttagg

SEQ ID NO: 6940589 - DNA, 22 bp, Homo sapiens
ggcaggtgacggggatgagtat

SEQ ID NO: 6940590 - DNA, 19 bp, Homo sapiens
atacagatgtatccatgat

SEQ ID NO: 6940591 - DNA, 22 bp, Homo sapiens
caggtgacctcagcgcctgcag

SEQ ID NO: 6940592 - DNA, 22 bp, Homo sapiens
cttcacagcatgagctttggag

SEQ ID NO: 6940593 - DNA, 22 bp, Homo sapiens
caggaaggaccgtccagatcag

SEQ ID NO: 6940594 - DNA, 21 bp, Homo sapiens
agctgtggttttacatctttt

SEQ ID NO: 6940595 - DNA, 19 bp, Homo sapiens
gcagcagtggaaggaaaaa

SEQ ID NO: 6940596 - DNA, 22 bp, Homo sapiens
gagccctgaacaacagcaggaa

SEQ ID NO: 6940597 - DNA, 23 bp, Homo sapiens
tcttcatggccatctggttcttc

SEQ ID NO: 6940598 - DNA, 22 bp, Homo sapiens
ggtctcctgaggctgccacacc

SEQ ID NO: 6940599 - DNA, 20 bp, Homo sapiens
tatatgcagccaacactccc

SEQ ID NO: 6940600 - DNA, 22 bp, Homo sapiens
agaggcctctagggcccctcag

SEQ ID NO: 6940601 - DNA, 22 bp, Homo sapiens
tagccagctggataatgtgggg

SEQ ID NO: 6940602 - DNA, 22 bp, Homo sapiens
ctgccaaaaggtgcacctgctg

SEQ ID NO: 6940603 - DNA, 22 bp, Homo sapiens
tctctcctgtgttctgatgttt

SEQ ID NO: 6940604 - DNA, 22 bp, Homo sapiens
acaagttaggttttaatccaaa

SEQ ID NO: 6940605 - DNA, 22 bp, Homo sapiens
catgggggctgaggctgctgta

SEQ ID NO: 6940606 - DNA, 22 bp, Homo sapiens
cttggagatacagaggacattt

SEQ ID NO: 6940607 - DNA, 22 bp, Homo sapiens
tacagtttgttacattgttagt

SEQ ID NO: 6940608 - DNA, 22 bp, Homo sapiens
ggccctgttagagctcccacaa

SEQ ID NO: 6940609 - DNA, 22 bp, Homo sapiens
aggaggaattgacacagaagcc

SEQ ID NO: 6940610 - DNA, 22 bp, Homo sapiens
acaaatttggtgagagtaaata

SEQ ID NO: 6940611 - DNA, 22 bp, Homo sapiens
ttcagagccagcaacactaggc

SEQ ID NO: 6940612 - DNA, 22 bp, Homo sapiens
tctgccttggaaatttcaacag

SEQ ID NO: 6940613 - DNA, 22 bp, Homo sapiens
gtgtatgatttcaaatggctag

SEQ ID NO: 6940614 - DNA, 16 bp, Homo sapiens
gagcatggtggcgggc

SEQ ID NO: 6940615 - DNA, 22 bp, Homo sapiens
gctgggacaggcttggccctgt

SEQ ID NO: 6940616 - DNA, 22 bp, Homo sapiens
tagtttccatgttatacagttt

SEQ ID NO: 6940617 - DNA, 22 bp, Homo sapiens
tgagatgctgggaacaaggaag

SEQ ID NO: 6940618 - DNA, 22 bp, Homo sapiens
ggtagataaatgcagttactgc

SEQ ID NO: 6940619 - DNA, 22 bp, Homo sapiens
gttgtaaatacagcagataatt

SEQ ID NO: 6940620 - DNA, 22 bp, Homo sapiens
acagcagcttgcgtgtctggtc

SEQ ID NO: 6940621 - DNA, 22 bp, Homo sapiens
agggagtctggtagtctaagtg

SEQ ID NO: 6940622 - DNA, 20 bp, Homo sapiens
taccaacagcaggaagcata

SEQ ID NO: 6940623 - DNA, 22 bp, Homo sapiens
ggacttgcctttagttaaaata

SEQ ID NO: 6940624 - DNA, 22 bp, Homo sapiens
tgtcttattttgaagtgttcac

SEQ ID NO: 6940625 - DNA, 22 bp, Homo sapiens
atccagtctggggtgctgcatg

SEQ ID NO: 6940626 - DNA, 23 bp, Homo sapiens
agatttggaaagctgagtggcgt

SEQ ID NO: 6940627 - DNA, 22 bp, Homo sapiens
tgcctcattaactgtccttaat

SEQ ID NO: 6940628 - DNA, 22 bp, Homo sapiens
ggcagctgtttgtcctcctgtt

SEQ ID NO: 6940629 - DNA, 22 bp, Homo sapiens
tgaaggcttggtggcagcctct

SEQ ID NO: 6940630 - DNA, 21 bp, Homo sapiens
ccagatcctgcttcctcaccc

SEQ ID NO: 6940631 - DNA, 22 bp, Homo sapiens
caatgtctagtttcccaaatcc

SEQ ID NO: 6940632 - DNA, 20 bp, Homo sapiens
aacacagataccaaaggttg

SEQ ID NO: 6940633 - DNA, 22 bp, Homo sapiens
atagtactccaccagtacatgt

SEQ ID NO: 6940634 - DNA, 22 bp, Homo sapiens
agctcagtggctcagtgggtat

SEQ ID NO: 6940635 - DNA, 22 bp, Homo sapiens
ttctctctgagagcatctggaa

SEQ ID NO: 6940636 - DNA, 22 bp, Homo sapiens
tctctcagaactgcagctgcag

SEQ ID NO: 6940637 - DNA, 22 bp, Homo sapiens
gtgaataaaacacctgccaaga

SEQ ID NO: 6940638 - DNA, 22 bp, Homo sapiens
aaatttctggaagtgtcagagt

SEQ ID NO: 6940639 - DNA, 22 bp, Homo sapiens
aagttcgtaggtgagctgctgc

SEQ ID NO: 6940640 - DNA, 20 bp, Homo sapiens
accagagctctcagtatgtg

SEQ ID NO: 6940641 - DNA, 22 bp, Homo sapiens
tacatacaagatgtgtttaaaa

SEQ ID NO: 6940642 - DNA, 23 bp, Homo sapiens
ttccagagtccacatctgccacc

SEQ ID NO: 6940643 - DNA, 22 bp, Homo sapiens
aagacaatgcattactaagaag

SEQ ID NO: 6940644 - DNA, 22 bp, Homo sapiens
taatacagatacaaaggaggac

SEQ ID NO: 6940645 - DNA, 23 bp, Homo sapiens
atagtagcagtatgacaggccat

SEQ ID NO: 6940646 - DNA, 22 bp, Homo sapiens
ctgtacaaagtagctgctggga

SEQ ID NO: 6940647 - DNA, 22 bp, Homo sapiens
aatgccttcaagtatctgagga

SEQ ID NO: 6940648 - DNA, 22 bp, Homo sapiens
acaaggtaagaaacattggctt

SEQ ID NO: 6940649 - DNA, 22 bp, Homo sapiens
aaaagtatttatggctatgtaa

SEQ ID NO: 6940650 - DNA, 22 bp, Homo sapiens
gctgactgctcagggccagctg

SEQ ID NO: 6940651 - DNA, 22 bp, Homo sapiens
gttaatgtcactttatgtggct

SEQ ID NO: 6940652 - DNA, 22 bp, Homo sapiens
gctgataaatagttgatgtacc

SEQ ID NO: 6940653 - DNA, 22 bp, Homo sapiens
gagactgggggcttggcctttt

SEQ ID NO: 6940654 - DNA, 22 bp, Homo sapiens
taggggcttgtaatttaataga

SEQ ID NO: 6940655 - DNA, 22 bp, Homo sapiens
ttgttaagttcatggaggtcaa

SEQ ID NO: 6940656 - DNA, 22 bp, Homo sapiens
tgagtcacccacattaaaatgt

SEQ ID NO: 6940657 - DNA, 20 bp, Homo sapiens
agattggatgttaagactgg

SEQ ID NO: 6940658 - DNA, 22 bp, Homo sapiens
agcacgttcttcattacttcac

SEQ ID NO: 6940659 - DNA, 22 bp, Homo sapiens
tagaggttggccttagaaagat

SEQ ID NO: 6940660 - DNA, 22 bp, Homo sapiens
caggctttcaggacagcgagcc

SEQ ID NO: 6940661 - DNA, 22 bp, Homo sapiens
acatgtgtatagcctgtataga

SEQ ID NO: 6940662 - DNA, 22 bp, Homo sapiens
agtttacactatgaaaagacta

SEQ ID NO: 6940663 - DNA, 23 bp, Homo sapiens
gtacccactcccatatgtccatc

SEQ ID NO: 6940664 - DNA, 22 bp, Homo sapiens
gcagtgttaccttgggctggtt

SEQ ID NO: 6940665 - DNA, 22 bp, Homo sapiens
gggacagctggtctacctggta

SEQ ID NO: 6940666 - DNA, 20 bp, Homo sapiens
ctgccgaccacagccatgga

SEQ ID NO: 6940667 - DNA, 22 bp, Homo sapiens
tgtccagggggcttacctggag

SEQ ID NO: 6940668 - DNA, 22 bp, Homo sapiens
tggcacagacatttaatagcct

SEQ ID NO: 6940669 - DNA, 22 bp, Homo sapiens
agctgcaaagatctgtcagtca

SEQ ID NO: 6940670 - DNA, 22 bp, Homo sapiens
ggctacagtggctcagtgctgg

SEQ ID NO: 6940671 - DNA, 22 bp, Homo sapiens
agaactatacattactcattga

SEQ ID NO: 6940672 - DNA, 22 bp, Homo sapiens
taaatcagtaaggcatattctc

SEQ ID NO: 6940673 - DNA, 22 bp, Homo sapiens
cgcaggcaatgctccgcggggg

SEQ ID NO: 6940674 - DNA, 22 bp, Homo sapiens
aggcaggttacaaaaactttat

SEQ ID NO: 6940675 - DNA, 22 bp, Homo sapiens
tgtgctcttctgttacttgtag

SEQ ID NO: 6940676 - DNA, 22 bp, Homo sapiens
atgccttatggtgaattagttc

SEQ ID NO: 6940677 - DNA, 22 bp, Homo sapiens
ttacttcagattgtggaaggca

SEQ ID NO: 6940678 - DNA, 22 bp, Homo sapiens
cctggcatgaggagcatgaggt

SEQ ID NO: 6940679 - DNA, 22 bp, Homo sapiens
accctgtgcagagaagtgagcg

SEQ ID NO: 6940680 - DNA, 22 bp, Homo sapiens
cttgggcagggtattgtagaag

SEQ ID NO: 6940681 - DNA, 22 bp, Homo sapiens
aagtggctgctatcaactcctt

SEQ ID NO: 6940682 - DNA, 22 bp, Homo sapiens
tgctttctcctgtctgaaagat

SEQ ID NO: 6940683 - DNA, 22 bp, Homo sapiens
tccttacctcaagcttgtggtc

SEQ ID NO: 6940684 - DNA, 22 bp, Homo sapiens
agaaggcagaaagtccaggtat

SEQ ID NO: 6940685 - DNA, 22 bp, Homo sapiens
caggtgctgcagggctggcgtc

SEQ ID NO: 6940686 - DNA, 22 bp, Homo sapiens
tgacattattatcatgtcacca

SEQ ID NO: 6940687 - DNA, 19 bp, Homo sapiens
tccagcccctctgtgtgtg

SEQ ID NO: 6940688 - DNA, 20 bp, Homo sapiens
tgtctagttgtgcaagggga

SEQ ID NO: 6940689 - DNA, 22 bp, Homo sapiens
tttgaaaaaggcctttggtatg

SEQ ID NO: 6940690 - DNA, 22 bp, Homo sapiens
ccaagctacttaggagtctgag

SEQ ID NO: 6940691 - DNA, 22 bp, Homo sapiens
cccatacatctttggtaaatga

SEQ ID NO: 6940692 - DNA, 22 bp, Homo sapiens
aagagcaagtgggtagtgaagc

SEQ ID NO: 6940693 - DNA, 22 bp, Homo sapiens
aagattagacaggattatgcat

SEQ ID NO: 6940694 - DNA, 22 bp, Homo sapiens
ttgtgtcctaagcaccagatgg

SEQ ID NO: 6940695 - DNA, 22 bp, Homo sapiens
tgtctggatgtctggagcatcg

SEQ ID NO: 6940696 - DNA, 22 bp, Homo sapiens
acaaggtacaaaacagagcaca

SEQ ID NO: 6940697 - DNA, 22 bp, Homo sapiens
acatttcatgttttccagagca

SEQ ID NO: 6940698 - DNA, 22 bp, Homo sapiens
atcaaagagtgagatttttact

SEQ ID NO: 6940699 - DNA, 19 bp, Homo sapiens
ccagctggcctgggacctc

SEQ ID NO: 6940700 - DNA, 22 bp, Homo sapiens
atggctgccccaaattgttgct

SEQ ID NO: 6940701 - DNA, 22 bp, Homo sapiens
gggtaccacagcaaccttcctg

SEQ ID NO: 6940702 - DNA, 21 bp, Homo sapiens
gggtagcagaggaggccgtgg

SEQ ID NO: 6940703 - DNA, 22 bp, Homo sapiens
catccaaagcaaatatcttaaa

SEQ ID NO: 6940704 - DNA, 22 bp, Homo sapiens
tgccctggaaccatctacagtc

SEQ ID NO: 6940705 - DNA, 22 bp, Homo sapiens
gcagcaccaaccagggcctgtt

SEQ ID NO: 6940706 - DNA, 22 bp, Homo sapiens
cagagcccatcctatactctcc

SEQ ID NO: 6940707 - DNA, 22 bp, Homo sapiens
ccacacagataagtgttttcta

SEQ ID NO: 6940708 - DNA, 22 bp, Homo sapiens
cagcagagtaggtgctacttct

SEQ ID NO: 6940709 - DNA, 23 bp, Homo sapiens
caaatgtagtgtgtccacccctg

SEQ ID NO: 6940710 - DNA, 22 bp, Homo sapiens
cccagtcctaaagcagacgcca

SEQ ID NO: 6940711 - DNA, 22 bp, Homo sapiens
tcgctctagagtgcagcgcttt

SEQ ID NO: 6940712 - DNA, 22 bp, Homo sapiens
ttcctggtagtaagacatctgg

SEQ ID NO: 6940713 - DNA, 22 bp, Homo sapiens
gtgctgggccctgagaccaggg

SEQ ID NO: 6940714 - DNA, 22 bp, Homo sapiens
ttcataagttggtgttgacttt

SEQ ID NO: 6940715 - DNA, 19 bp, Homo sapiens
cttgaaatgagactgaagg

SEQ ID NO: 6940716 - DNA, 22 bp, Homo sapiens
tcctgccaggagatggtagcca

SEQ ID NO: 6940717 - DNA, 22 bp, Homo sapiens
ctcaggatcgcttgccctaggg

SEQ ID NO: 6940718 - DNA, 22 bp, Homo sapiens
ttggtcatttttcctgtgctca

SEQ ID NO: 6940719 - DNA, 22 bp, Homo sapiens
tagcaccttagcatttctagtg

SEQ ID NO: 6940720 - DNA, 22 bp, Homo sapiens
tctgtaccttattctgtgacct

SEQ ID NO: 6940721 - DNA, 22 bp, Homo sapiens
acatacagacctgcagggcagc

SEQ ID NO: 6940722 - DNA, 22 bp, Homo sapiens
tagaactggaattttgtggttt

SEQ ID NO: 6940723 - DNA, 22 bp, Homo sapiens
ctgggagcaccatacttgtttc

SEQ ID NO: 6940724 - DNA, 22 bp, Homo sapiens
acacttttatctctggaggctt

SEQ ID NO: 6940725 - DNA, 22 bp, Homo sapiens
agacaactagaaaactagacag

SEQ ID NO: 6940726 - DNA, 23 bp, Homo sapiens
cccaggtgtggaggcggtggcag

SEQ ID NO: 6940727 - DNA, 22 bp, Homo sapiens
tctggattctaaggtgtttact

SEQ ID NO: 6940728 - DNA, 21 bp, Homo sapiens
gccacctcgtctcggagcagc

SEQ ID NO: 6940729 - DNA, 22 bp, Homo sapiens
gtccgattggtatcggtgatca

SEQ ID NO: 6940730 - DNA, 22 bp, Homo sapiens
aggcggtgctgtggacagtgac

SEQ ID NO: 6940731 - DNA, 22 bp, Homo sapiens
cagcatgatgctcacacaaaac

SEQ ID NO: 6940732 - DNA, 22 bp, Homo sapiens
cctggaagttggaggttgcagt

SEQ ID NO: 6940733 - DNA, 22 bp, Homo sapiens
ctgctgggatagaagtatctca

SEQ ID NO: 6940734 - DNA, 22 bp, Homo sapiens
ctgagaaacaatgaattgtgat

SEQ ID NO: 6940735 - DNA, 22 bp, Homo sapiens
aaatggtgttgtatttagtctc

SEQ ID NO: 6940736 - DNA, 22 bp, Homo sapiens
gaatgtctccaacttggggaaa

SEQ ID NO: 6940737 - DNA, 22 bp, Homo sapiens
ttcagggagagcgggacgggtg

SEQ ID NO: 6940738 - DNA, 22 bp, Homo sapiens
agagcctgttttgtgggagatg

SEQ ID NO: 6940739 - DNA, 22 bp, Homo sapiens
cttctgtggatgttggatgcat

SEQ ID NO: 6940740 - DNA, 22 bp, Homo sapiens
ctagggtggatttgtgcagagt

SEQ ID NO: 6940741 - DNA, 22 bp, Homo sapiens
tacatgaatttgagtcagagga

SEQ ID NO: 6940742 - DNA, 22 bp, Homo sapiens
ctcatctggcttcagtaacagt

SEQ ID NO: 6940743 - DNA, 22 bp, Homo sapiens
cacctgaatggaactttgaacc

SEQ ID NO: 6940744 - DNA, 22 bp, Homo sapiens
tctcagcacgttgttttcattg

SEQ ID NO: 6940745 - DNA, 22 bp, Homo sapiens
tggtgggagtgagggcatgcca

SEQ ID NO: 6940746 - DNA, 22 bp, Homo sapiens
tacactgagcaggaagaagtgg

SEQ ID NO: 6940747 - DNA, 22 bp, Homo sapiens
ctggctcttctgggttctgtgt

SEQ ID NO: 6940748 - DNA, 22 bp, Homo sapiens
tagccagttgcccagagtagaa

SEQ ID NO: 6940749 - DNA, 22 bp, Homo sapiens
taactcttccaacactccttcc

SEQ ID NO: 6940750 - DNA, 22 bp, Homo sapiens
tgctttgggtctctctagtttc

SEQ ID NO: 6940751 - DNA, 22 bp, Homo sapiens
aaggccattattctgatatatt

SEQ ID NO: 6940752 - DNA, 22 bp, Homo sapiens
tcacttgaacctgggaggcaga

SEQ ID NO: 6940753 - DNA, 22 bp, Homo sapiens
gtatttcccccagactccctgg

SEQ ID NO: 6940754 - DNA, 22 bp, Homo sapiens
tgagcccaggagttggaggctg

SEQ ID NO: 6940755 - DNA, 22 bp, Homo sapiens
aagggcagagggaatcccacat

SEQ ID NO: 6940756 - DNA, 22 bp, Homo sapiens
actagtgcacattgtttctcaa

SEQ ID NO: 6940757 - DNA, 23 bp, Homo sapiens
tcttcacagggcttcccatgtgc

SEQ ID NO: 6940758 - DNA, 22 bp, Homo sapiens
tggtctgtcccactctgccctt

SEQ ID NO: 6940759 - DNA, 22 bp, Homo sapiens
agtgccccatgggtgcctgggg

SEQ ID NO: 6940760 - DNA, 22 bp, Homo sapiens
tgtctcagagtgttgtattaga

SEQ ID NO: 6940761 - DNA, 22 bp, Homo sapiens
taattactggaaatttcaaata

SEQ ID NO: 6940762 - DNA, 22 bp, Homo sapiens
acattctcttttagaaagctgt

SEQ ID NO: 6940763 - DNA, 23 bp, Homo sapiens
cactgggggctgctacagagagg

SEQ ID NO: 6940764 - DNA, 22 bp, Homo sapiens
gtgtgccaggaactggctgctg

SEQ ID NO: 6940765 - DNA, 22 bp, Homo sapiens
ctgcacagtcatttcctctcaa

SEQ ID NO: 6940766 - DNA, 22 bp, Homo sapiens
cagctctgtgggagcgtatgtg

SEQ ID NO: 6940767 - DNA, 20 bp, Homo sapiens
tatgataattacaaaatagt

SEQ ID NO: 6940768 - DNA, 22 bp, Homo sapiens
agcagcccaggcaaagataaaa

SEQ ID NO: 6940769 - DNA, 22 bp, Homo sapiens
attccagttctcctctctaaag

SEQ ID NO: 6940770 - DNA, 22 bp, Homo sapiens
tgcgagcccagccagctctctg

SEQ ID NO: 6940771 - DNA, 22 bp, Homo sapiens
gctggctgagcactggtttata

SEQ ID NO: 6940772 - DNA, 22 bp, Homo sapiens
agtaaaatcaccatctctttgt

SEQ ID NO: 6940773 - DNA, 22 bp, Homo sapiens
gggtgaggcccatttgaggcca

SEQ ID NO: 6940774 - DNA, 22 bp, Homo sapiens
ccactgcctatttgcagggccc

SEQ ID NO: 6940775 - DNA, 17 bp, Homo sapiens
ctacttcttctattctt

SEQ ID NO: 6940776 - DNA, 22 bp, Homo sapiens
agtctggtaaactgaaaaatat

SEQ ID NO: 6940777 - DNA, 22 bp, Homo sapiens
aaggaaatgtgcctgacactgc

SEQ ID NO: 6940778 - DNA, 22 bp, Homo sapiens
ctccgggtagctgaggccctgg

SEQ ID NO: 6940779 - DNA, 22 bp, Homo sapiens
tggcatcccttcccacccttta

SEQ ID NO: 6940780 - DNA, 22 bp, Homo sapiens
tgtcctgtacgaagccggagaa

SEQ ID NO: 6940781 - DNA, 22 bp, Homo sapiens
ccagccccgggccttaccgtgc

SEQ ID NO: 6940782 - DNA, 22 bp, Homo sapiens
cactttgaagagctttttgaca

SEQ ID NO: 6940783 - DNA, 22 bp, Homo sapiens
aggtaggatgggtggagatgat

SEQ ID NO: 6940784 - DNA, 22 bp, Homo sapiens
tttgcagaagaaaacatgaaca

SEQ ID NO: 6940785 - DNA, 22 bp, Homo sapiens
agcttattatcttatcaagctt

SEQ ID NO: 6940786 - DNA, 22 bp, Homo sapiens
ataaactgggtatcaagaggcc

SEQ ID NO: 6940787 - DNA, 22 bp, Homo sapiens
aggtggctgcctccccgcgcgg

SEQ ID NO: 6940788 - DNA, 22 bp, Homo sapiens
tataggaaacatacgtgactag

SEQ ID NO: 6940789 - DNA, 22 bp, Homo sapiens
tacagtttagaaccatagatgg

SEQ ID NO: 6940790 - DNA, 22 bp, Homo sapiens
ggaaactgagtgacactccctc

SEQ ID NO: 6940791 - DNA, 22 bp, Homo sapiens
tgagttctccaagagaaggtat

SEQ ID NO: 6940792 - DNA, 22 bp, Homo sapiens
gaagctctaaggtcattgcatt

SEQ ID NO: 6940793 - DNA, 22 bp, Homo sapiens
tccgagttgaagtaggatagcg

SEQ ID NO: 6940794 - DNA, 19 bp, Homo sapiens
tggaacctgtgccagggct

SEQ ID NO: 6940795 - DNA, 22 bp, Homo sapiens
tttccaagttgttaccttctac

SEQ ID NO: 6940796 - DNA, 22 bp, Homo sapiens
taccaccatttgcctgctgtat

SEQ ID NO: 6940797 - DNA, 22 bp, Homo sapiens
tcacatgctaaaggttgtaaac

SEQ ID NO: 6940798 - DNA, 22 bp, Homo sapiens
tggcggagttccagctgggatc

SEQ ID NO: 6940799 - DNA, 20 bp, Homo sapiens
cctgtgtggtttgcactaca

SEQ ID NO: 6940800 - DNA, 22 bp, Homo sapiens
ttcctgaattgagctttagaaa

SEQ ID NO: 6940801 - DNA, 22 bp, Homo sapiens
tgctagattttagtttggaatg

SEQ ID NO: 6940802 - DNA, 22 bp, Homo sapiens
ggcagcatgagcctggtgaatt

SEQ ID NO: 6940803 - DNA, 22 bp, Homo sapiens
tctgagtttttgcagctgctgt

SEQ ID NO: 6940804 - DNA, 22 bp, Homo sapiens
ccctgatctcagcttacccatc

SEQ ID NO: 6940805 - DNA, 22 bp, Homo sapiens
ggccctgagtctagctgctctt

SEQ ID NO: 6940806 - DNA, 22 bp, Homo sapiens
ttgttttcctgggataccaacc

SEQ ID NO: 6940807 - DNA, 22 bp, Homo sapiens
tgcttgaggggaataaaaagaa

SEQ ID NO: 6940808 - DNA, 22 bp, Homo sapiens
attttcccttctaaagggctga

SEQ ID NO: 6940809 - DNA, 22 bp, Homo sapiens
acatgagaggctgtggagtaca

SEQ ID NO: 6940810 - DNA, 22 bp, Homo sapiens
ggactgggtcactaagatagta

SEQ ID NO: 6940811 - DNA, 22 bp, Homo sapiens
ggaatcctgtgagggctgagag

SEQ ID NO: 6940812 - DNA, 20 bp, Homo sapiens
gtgcttcctcgcaagttgca

SEQ ID NO: 6940813 - DNA, 22 bp, Homo sapiens
atttccaatctctgcatatggg

SEQ ID NO: 6940814 - DNA, 22 bp, Homo sapiens
agagctggggccagagtcaagg

SEQ ID NO: 6940815 - DNA, 22 bp, Homo sapiens
gacacagttctgttctagtagg

SEQ ID NO: 6940816 - DNA, 22 bp, Homo sapiens
gtgggagtggagctcagcatgt

SEQ ID NO: 6940817 - DNA, 22 bp, Homo sapiens
tttgtgatctcctccctctaga

SEQ ID NO: 6940818 - DNA, 22 bp, Homo sapiens
gtgtgtgtatatatacacacac

SEQ ID NO: 6940819 - DNA, 22 bp, Homo sapiens
tagatgctcgctttccccctga

SEQ ID NO: 6940820 - DNA, 22 bp, Homo sapiens
tggaaaggtgtaaagcagaacc

SEQ ID NO: 6940821 - DNA, 22 bp, Homo sapiens
ggcagtgcctgatgctgcagga

SEQ ID NO: 6940822 - DNA, 22 bp, Homo sapiens
tccgttttcacactgctataaa

SEQ ID NO: 6940823 - DNA, 18 bp, Homo sapiens
tttatatggatagagacc

SEQ ID NO: 6940824 - DNA, 22 bp, Homo sapiens
tccccactctctcctggagctt

SEQ ID NO: 6940825 - DNA, 23 bp, Homo sapiens
agggctgatgccattgcagctct

SEQ ID NO: 6940826 - DNA, 22 bp, Homo sapiens
gggaagggagggacctcagtct

SEQ ID NO: 6940827 - DNA, 22 bp, Homo sapiens
tgagctcatagctcttattatg

SEQ ID NO: 6940828 - DNA, 22 bp, Homo sapiens
tttgctgactggatgcagttgg

SEQ ID NO: 6940829 - DNA, 20 bp, Homo sapiens
cagcatagcggctcacatcc

SEQ ID NO: 6940830 - DNA, 22 bp, Homo sapiens
agtgcatgccttcctgtggatg

SEQ ID NO: 6940831 - DNA, 22 bp, Homo sapiens
ttcggctttccagtttgtctcg

SEQ ID NO: 6940832 - DNA, 22 bp, Homo sapiens
atgcatatgccgtagaataagt

SEQ ID NO: 6940833 - DNA, 22 bp, Homo sapiens
tgagctgagaacacttgggcta

SEQ ID NO: 6940834 - DNA, 22 bp, Homo sapiens
aatttcagtatgaagtttcaca

SEQ ID NO: 6940835 - DNA, 22 bp, Homo sapiens
tagatgcttcatgagaaatata

SEQ ID NO: 6940836 - DNA, 22 bp, Homo sapiens
gcccttaggcaagcagaagccc

SEQ ID NO: 6940837 - DNA, 22 bp, Homo sapiens
cccgggagactcctctagggct

SEQ ID NO: 6940838 - DNA, 22 bp, Homo sapiens
gaaacgaagctctagattagaa

SEQ ID NO: 6940839 - DNA, 22 bp, Homo sapiens
gctgcccaggaagcctggggtt

SEQ ID NO: 6940840 - DNA, 22 bp, Homo sapiens
accagtaagatcctgtacatac

SEQ ID NO: 6940841 - DNA, 22 bp, Homo sapiens
tgtatattgcctgagtctttcc

SEQ ID NO: 6940842 - DNA, 22 bp, Homo sapiens
caggcttggttggggcgaggga

SEQ ID NO: 6940843 - DNA, 22 bp, Homo sapiens
gcatgataccataggttttgcc

SEQ ID NO: 6940844 - DNA, 22 bp, Homo sapiens
agtttcccccttcacagcttaa

SEQ ID NO: 6940845 - DNA, 22 bp, Homo sapiens
catgctctctggcaacttgtgt

SEQ ID NO: 6940846 - DNA, 22 bp, Homo sapiens
tgcagggccttctagaccatgg

SEQ ID NO: 6940847 - DNA, 22 bp, Homo sapiens
tattacagggctagttatgagt

SEQ ID NO: 6940848 - DNA, 22 bp, Homo sapiens
tgggctcagaagatagtttcca

SEQ ID NO: 6940849 - DNA, 17 bp, Homo sapiens
tttctgcatgattggac

SEQ ID NO: 6940850 - DNA, 22 bp, Homo sapiens
cctgtacttgtattaaaggtcc

SEQ ID NO: 6940851 - DNA, 19 bp, Homo sapiens
gacaggaaggctaccagta

SEQ ID NO: 6940852 - DNA, 22 bp, Homo sapiens
tcagtacttctgcatcttccag

SEQ ID NO: 6940853 - DNA, 22 bp, Homo sapiens
ctaaggaaaaggatatatatgt

SEQ ID NO: 6940854 - DNA, 22 bp, Homo sapiens
tccagtgtctgagcccttagct

SEQ ID NO: 6940855 - DNA, 22 bp, Homo sapiens
ttacatcatgtaactggatata

SEQ ID NO: 6940856 - DNA, 22 bp, Homo sapiens
ttgtcatcaagatgcattggtc

SEQ ID NO: 6940857 - DNA, 22 bp, Homo sapiens
ctggtacatagtaagaacacaa

SEQ ID NO: 6940858 - DNA, 22 bp, Homo sapiens
aagagtttgggcaagtcataaa

SEQ ID NO: 6940859 - DNA, 21 bp, Homo sapiens
tacgtgtgtgcatgtttatat

SEQ ID NO: 6940860 - DNA, 22 bp, Homo sapiens
ggaagctgcagtcccccccaag

SEQ ID NO: 6940861 - DNA, 22 bp, Homo sapiens
ggtgcacttcttgctagtcttt

SEQ ID NO: 6940862 - DNA, 22 bp, Homo sapiens
tcagaagaaagatgttattact

SEQ ID NO: 6940863 - DNA, 22 bp, Homo sapiens
tggtatggcctggagaatgcag

SEQ ID NO: 6940864 - DNA, 19 bp, Homo sapiens
ttacttgaagcataggtga

SEQ ID NO: 6940865 - DNA, 22 bp, Homo sapiens
aaacactgtgggacatcttact

SEQ ID NO: 6940866 - DNA, 22 bp, Homo sapiens
gatgctgctcgggtgcctggga

SEQ ID NO: 6940867 - DNA, 22 bp, Homo sapiens
ccctggcacatgcgctgtgtgg

SEQ ID NO: 6940868 - DNA, 19 bp, Homo sapiens
gcatcatttgtctcttctt

SEQ ID NO: 6940869 - DNA, 22 bp, Homo sapiens
gcagcatgtgccttaaatcatt

SEQ ID NO: 6940870 - DNA, 22 bp, Homo sapiens
ataatctggcttgtttgcttaa

SEQ ID NO: 6940871 - DNA, 22 bp, Homo sapiens
ttgctctcagaggaggaggccg

SEQ ID NO: 6940872 - DNA, 21 bp, Homo sapiens
tcttcagtacacttgcacgcc

SEQ ID NO: 6940873 - DNA, 22 bp, Homo sapiens
agaaacagcattagcatcaatt

SEQ ID NO: 6940874 - DNA, 22 bp, Homo sapiens
tctttgtaagaaattcttccgt

SEQ ID NO: 6940875 - DNA, 22 bp, Homo sapiens
agggagtctagttgatgtggaa

SEQ ID NO: 6940876 - DNA, 21 bp, Homo sapiens
tcctggggggtaggtgagttt

SEQ ID NO: 6940877 - DNA, 22 bp, Homo sapiens
ctggcttcctgagtccattacc

SEQ ID NO: 6940878 - DNA, 22 bp, Homo sapiens
agggggctcagcaggctctgga

SEQ ID NO: 6940879 - DNA, 22 bp, Homo sapiens
ttgtcacacccttttttatacc

SEQ ID NO: 6940880 - DNA, 22 bp, Homo sapiens
tggcaacatgtcgaagtgctgt

SEQ ID NO: 6940881 - DNA, 22 bp, Homo sapiens
caggagtcctgaaatctgatga

SEQ ID NO: 6940882 - DNA, 17 bp, Homo sapiens
tctgtcttgactgtcac

SEQ ID NO: 6940883 - DNA, 22 bp, Homo sapiens
ttgacctgggcacagtgagcat

SEQ ID NO: 6940884 - DNA, 22 bp, Homo sapiens
tcattacttattaaaagccttg

SEQ ID NO: 6940885 - DNA, 22 bp, Homo sapiens
tgtcatggggttgttttgtaca

SEQ ID NO: 6940886 - DNA, 22 bp, Homo sapiens
tcttcaaatacagtcatattga

SEQ ID NO: 6940887 - DNA, 22 bp, Homo sapiens
accaaggctaaaataacatgtt

SEQ ID NO: 6940888 - DNA, 21 bp, Homo sapiens
tttgctgaagattttaggctg

SEQ ID NO: 6940889 - DNA, 22 bp, Homo sapiens
tcagctttgatctcaggcaatc

SEQ ID NO: 6940890 - DNA, 22 bp, Homo sapiens
agggtcctgagcctggggcgca

SEQ ID NO: 6940891 - DNA, 22 bp, Homo sapiens
agacagctctgggttccacact

SEQ ID NO: 6940892 - DNA, 22 bp, Homo sapiens
tcctaggttttcaaaagaccac

SEQ ID NO: 6940893 - DNA, 22 bp, Homo sapiens
tttgagctaagtaggtgtcaac

SEQ ID NO: 6940894 - DNA, 22 bp, Homo sapiens
tatgcctgtctcaccattgtat

SEQ ID NO: 6940895 - DNA, 22 bp, Homo sapiens
cagtggatgatttggctgctag

SEQ ID NO: 6940896 - DNA, 22 bp, Homo sapiens
aacttattccataggctcactg

SEQ ID NO: 6940897 - DNA, 22 bp, Homo sapiens
agccactccttcagcgtctgct

SEQ ID NO: 6940898 - DNA, 22 bp, Homo sapiens
cactgctacctctgcctcccgg

SEQ ID NO: 6940899 - DNA, 21 bp, Homo sapiens
agttctgttatgctggactca

SEQ ID NO: 6940900 - DNA, 22 bp, Homo sapiens
agtgtctgagctatcattaggg

SEQ ID NO: 6940901 - DNA, 22 bp, Homo sapiens
tcttttgagggccagaggaaga

SEQ ID NO: 6940902 - DNA, 22 bp, Homo sapiens
ggctctggggaagctctcttca

SEQ ID NO: 6940903 - DNA, 22 bp, Homo sapiens
agcgggcaccctttgagggttt

SEQ ID NO: 6940904 - DNA, 22 bp, Homo sapiens
acttgcatgattttatgttgat

SEQ ID NO: 6940905 - DNA, 22 bp, Homo sapiens
acctacccttagatcacaaggg

SEQ ID NO: 6940906 - DNA, 22 bp, Homo sapiens
tttgcaaagaaattattgctgt

SEQ ID NO: 6940907 - DNA, 22 bp, Homo sapiens
aggagtccacccaggaatttaa

SEQ ID NO: 6940908 - DNA, 22 bp, Homo sapiens
tgtaaatcactgaactaaatga

SEQ ID NO: 6940909 - DNA, 22 bp, Homo sapiens
ttgtagtagtctcgttctttta

SEQ ID NO: 6940910 - DNA, 22 bp, Homo sapiens
tgtaaggaggaaaattagtggt

SEQ ID NO: 6940911 - DNA, 22 bp, Homo sapiens
cttgtattcttccacttaagat

SEQ ID NO: 6940912 - DNA, 22 bp, Homo sapiens
tagtccatcttgaattcagtga

SEQ ID NO: 6940913 - DNA, 22 bp, Homo sapiens
gcttagtcctagtgtactaaat

SEQ ID NO: 6940914 - DNA, 19 bp, Homo sapiens
ctggggctttggtactgcc

SEQ ID NO: 6940915 - DNA, 22 bp, Homo sapiens
agtctcagctacttgggaggct

SEQ ID NO: 6940916 - DNA, 22 bp, Homo sapiens
aaaaagtcatattcttgttcct

SEQ ID NO: 6940917 - DNA, 20 bp, Homo sapiens
aatgatcagcatagcaagga

SEQ ID NO: 6940918 - DNA, 22 bp, Homo sapiens
actcactagaggtagatccctg

SEQ ID NO: 6940919 - DNA, 22 bp, Homo sapiens
gcagctgtagaggggagaaaga

SEQ ID NO: 6940920 - DNA, 22 bp, Homo sapiens
aaggatttttggaatgagatgg

SEQ ID NO: 6940921 - DNA, 22 bp, Homo sapiens
ttaagaatggaatgaggaattt

SEQ ID NO: 6940922 - DNA, 22 bp, Homo sapiens
agcttaggaggatgatgaacat

SEQ ID NO: 6940923 - DNA, 20 bp, Homo sapiens
tccatcttgggcagaagcag

SEQ ID NO: 6940924 - DNA, 22 bp, Homo sapiens
cttaaactgaaagctacaagat

SEQ ID NO: 6940925 - DNA, 22 bp, Homo sapiens
ctttgcaatagaggcacacatg

SEQ ID NO: 6940926 - DNA, 22 bp, Homo sapiens
ctcttttcaaaatttcactgca

SEQ ID NO: 6940927 - DNA, 22 bp, Homo sapiens
tttataggatatgggggaagga

SEQ ID NO: 6940928 - DNA, 22 bp, Homo sapiens
tgcctgctgcctttcatcccaa

SEQ ID NO: 6940929 - DNA, 22 bp, Homo sapiens
tggctgtagaatcagagacttg

SEQ ID NO: 6940930 - DNA, 22 bp, Homo sapiens
tgcaggagttaagtgctctcct

SEQ ID NO: 6940931 - DNA, 19 bp, Homo sapiens
ctctttccattgtatttgc

SEQ ID NO: 6940932 - DNA, 22 bp, Homo sapiens
ccttctgggccaacttccagga

SEQ ID NO: 6940933 - DNA, 22 bp, Homo sapiens
tgtatctttctgtacttttatg

SEQ ID NO: 6940934 - DNA, 22 bp, Homo sapiens
ctgtgacttagagtgagtagag

SEQ ID NO: 6940935 - DNA, 22 bp, Homo sapiens
gcaagagcagacatttagattt

SEQ ID NO: 6940936 - DNA, 22 bp, Homo sapiens
actgggaagagagaattctgtc

SEQ ID NO: 6940937 - DNA, 22 bp, Homo sapiens
ttccaggaagctctcggcctct

SEQ ID NO: 6940938 - DNA, 22 bp, Homo sapiens
agcagcccagttgtactgagtg

SEQ ID NO: 6940939 - DNA, 22 bp, Homo sapiens
atgatgtgtgctgatcaagctt

SEQ ID NO: 6940940 - DNA, 22 bp, Homo sapiens
ctttgcaagggatttcatgtct

SEQ ID NO: 6940941 - DNA, 22 bp, Homo sapiens
cactgcacaatgtagcaaagaa

SEQ ID NO: 6940942 - DNA, 22 bp, Homo sapiens
tccctccttaataagaggtctg

SEQ ID NO: 6940943 - DNA, 22 bp, Homo sapiens
acatgtgaaatctcatagttag

SEQ ID NO: 6940944 - DNA, 22 bp, Homo sapiens
gaactttggatcatgttcttgg

SEQ ID NO: 6940945 - DNA, 22 bp, Homo sapiens
tatgaaacattcatacaaataa

SEQ ID NO: 6940946 - DNA, 22 bp, Homo sapiens
ctggaagtttccttcctggtca

SEQ ID NO: 6940947 - DNA, 21 bp, Homo sapiens
cctttttgcttatggacagac

SEQ ID NO: 6940948 - DNA, 22 bp, Homo sapiens
aagctcttcctgcagggacctt

SEQ ID NO: 6940949 - DNA, 22 bp, Homo sapiens
ctgcctggcctgatctccacgc

SEQ ID NO: 6940950 - DNA, 22 bp, Homo sapiens
tgacatgtaagatggaaaagcg

SEQ ID NO: 6940951 - DNA, 22 bp, Homo sapiens
catgttcaaataagtagtttct

SEQ ID NO: 6940952 - DNA, 22 bp, Homo sapiens
gacagtacaggtagaagtcact

SEQ ID NO: 6940953 - DNA, 22 bp, Homo sapiens
aacagcctcagtgagattagga

SEQ ID NO: 6940954 - DNA, 22 bp, Homo sapiens
tgcttctgactaagctgcatga

SEQ ID NO: 6940955 - DNA, 22 bp, Homo sapiens
aaacactagcaggaagcactga

SEQ ID NO: 6940956 - DNA, 22 bp, Homo sapiens
aagatctattatgagtcaggtc

SEQ ID NO: 6940957 - DNA, 22 bp, Homo sapiens
gtgtgtggacgtctgagcccag

SEQ ID NO: 6940958 - DNA, 20 bp, Homo sapiens
ttccttggattgtgtcttga

SEQ ID NO: 6940959 - DNA, 22 bp, Homo sapiens
cagtgcaagtgactgatcaagg

SEQ ID NO: 6940960 - DNA, 23 bp, Homo sapiens
ccagccctccaccagctctaggc

SEQ ID NO: 6940961 - DNA, 22 bp, Homo sapiens
aaacactggcaatttcatgcac

SEQ ID NO: 6940962 - DNA, 22 bp, Homo sapiens
gaatcatttatttttgacagca

SEQ ID NO: 6940963 - DNA, 22 bp, Homo sapiens
cttctgtgcttcacagttgcca

SEQ ID NO: 6940964 - DNA, 22 bp, Homo sapiens
ggctttaacagcagctttgctg

SEQ ID NO: 6940965 - DNA, 22 bp, Homo sapiens
aaagatgtgcctgtttcatagt

SEQ ID NO: 6940966 - DNA, 22 bp, Homo sapiens
tcctagagaatattttagcttc

SEQ ID NO: 6940967 - DNA, 22 bp, Homo sapiens
ttctccagagggctctgcagga

SEQ ID NO: 6940968 - DNA, 22 bp, Homo sapiens
gctgaggacatcatggaaggaa

SEQ ID NO: 6940969 - DNA, 22 bp, Homo sapiens
tccaattttacgtctgtataaa

SEQ ID NO: 6940970 - DNA, 18 bp, Homo sapiens
ggcaggctctctgggtca

SEQ ID NO: 6940971 - DNA, 22 bp, Homo sapiens
caggccagcggcccgcgcgttc

SEQ ID NO: 6940972 - DNA, 22 bp, Homo sapiens
aagagaaggtgaggaagccggt

SEQ ID NO: 6940973 - DNA, 22 bp, Homo sapiens
cctatgttcttggcaagcagca

SEQ ID NO: 6940974 - DNA, 22 bp, Homo sapiens
aggagggctaggaaaaccagga

SEQ ID NO: 6940975 - DNA, 22 bp, Homo sapiens
tgaatcaattgtcttaagacat

SEQ ID NO: 6940976 - DNA, 22 bp, Homo sapiens
acttgtacttaaaaattatttg

SEQ ID NO: 6940977 - DNA, 22 bp, Homo sapiens
ccccatcccacctgagtgtcac

SEQ ID NO: 6940978 - DNA, 20 bp, Homo sapiens
atatatgtatgcgtgtggtt

SEQ ID NO: 6940979 - DNA, 22 bp, Homo sapiens
actaattggaacactttttgcc

SEQ ID NO: 6940980 - DNA, 22 bp, Homo sapiens
cctggagcacagcccagtccca

SEQ ID NO: 6940981 - DNA, 22 bp, Homo sapiens
ttagtgggatattggctattca

SEQ ID NO: 6940982 - DNA, 22 bp, Homo sapiens
ctgagggcaccgacagagtgga

SEQ ID NO: 6940983 - DNA, 22 bp, Homo sapiens
cttcacatgttggagtcctttg

SEQ ID NO: 6940984 - DNA, 22 bp, Homo sapiens
tggagaggtttaaacaaaagtt

SEQ ID NO: 6940985 - DNA, 22 bp, Homo sapiens
gcaagagcgctctctttcatta

SEQ ID NO: 6940986 - DNA, 22 bp, Homo sapiens
cagaggtttgatcgagtaggtc

SEQ ID NO: 6940987 - DNA, 22 bp, Homo sapiens
acacagtagtttgtcattgcta

SEQ ID NO: 6940988 - DNA, 22 bp, Homo sapiens
aagcaagacagaagttactgcc

SEQ ID NO: 6940989 - DNA, 22 bp, Homo sapiens
atatacttgatttaactgagca

SEQ ID NO: 6940990 - DNA, 22 bp, Homo sapiens
ttgcctggcttgtagatggggg

SEQ ID NO: 6940991 - DNA, 22 bp, Homo sapiens
tatcatcacattacctcttggg

SEQ ID NO: 6940992 - DNA, 17 bp, Homo sapiens
caccctggctagtctga

SEQ ID NO: 6940993 - DNA, 19 bp, Homo sapiens
tctgctggcagaattccct

SEQ ID NO: 6940994 - DNA, 21 bp, Homo sapiens
tccaggagttctaataggtgt

SEQ ID NO: 6940995 - DNA, 22 bp, Homo sapiens
taaaaggattagcaggatgggc

SEQ ID NO: 6940996 - DNA, 22 bp, Homo sapiens
cccaggaagttgagactgcagt

SEQ ID NO: 6940997 - DNA, 21 bp, Homo sapiens
ggacttggatggtggcagtag

SEQ ID NO: 6940998 - DNA, 22 bp, Homo sapiens
acaagcttccaggtgatgctga

SEQ ID NO: 6940999 - DNA, 22 bp, Homo sapiens
tcctggtgctgacacccatagc

SEQ ID NO: 6941000 - DNA, 22 bp, Homo sapiens
tgcattatgctacccagaagct

SEQ ID NO: 6941001 - DNA, 22 bp, Homo sapiens
tatggccacaatggggagaaac

SEQ ID NO: 6941002 - DNA, 22 bp, Homo sapiens
tttcaattccaccaaagcgccc

SEQ ID NO: 6941003 - DNA, 22 bp, Homo sapiens
tgacaatggggcacatggaaag

SEQ ID NO: 6941004 - DNA, 22 bp, Homo sapiens
ttagaaccaggaactctaatat

SEQ ID NO: 6941005 - DNA, 22 bp, Homo sapiens
ttatttatggcactgttggtgg

SEQ ID NO: 6941006 - DNA, 21 bp, Homo sapiens
agctggcagtgcctggacctc

SEQ ID NO: 6941007 - DNA, 22 bp, Homo sapiens
aattagagaagcttcttccatt

SEQ ID NO: 6941008 - DNA, 22 bp, Homo sapiens
tctggcagttccttgttgatat

SEQ ID NO: 6941009 - DNA, 22 bp, Homo sapiens
tcagactgtttgcaccataggc

SEQ ID NO: 6941010 - DNA, 22 bp, Homo sapiens
tgctctgtggtccaagatggct

SEQ ID NO: 6941011 - DNA, 20 bp, Homo sapiens
ccctgcagccatgggagtgg

SEQ ID NO: 6941012 - DNA, 22 bp, Homo sapiens
tgaggcaaaaacactgattagg

SEQ ID NO: 6941013 - DNA, 22 bp, Homo sapiens
gtgtggctgtgggagatgttca

SEQ ID NO: 6941014 - DNA, 22 bp, Homo sapiens
tacagtgatagagagtagctat

SEQ ID NO: 6941015 - DNA, 22 bp, Homo sapiens
ggtctacagagagaaatgaagc

SEQ ID NO: 6941016 - DNA, 22 bp, Homo sapiens
taaatgtcaatgtgatttataa

SEQ ID NO: 6941017 - DNA, 22 bp, Homo sapiens
agcttattaaaaacggattgct

SEQ ID NO: 6941018 - DNA, 22 bp, Homo sapiens
tggaggattccacttacatgag

SEQ ID NO: 6941019 - DNA, 22 bp, Homo sapiens
cacttgcttaccggagaggtgc

SEQ ID NO: 6941020 - DNA, 22 bp, Homo sapiens
aagtgtgggcagggcatttctg

SEQ ID NO: 6941021 - DNA, 22 bp, Homo sapiens
ttgtcacctatactgagcttaa

SEQ ID NO: 6941022 - DNA, 22 bp, Homo sapiens
tgcatgtgtttgccacagtgag

SEQ ID NO: 6941023 - DNA, 22 bp, Homo sapiens
tcagcttttgtcagaaattgta

SEQ ID NO: 6941024 - DNA, 22 bp, Homo sapiens
cctcaggccagggggcggccag

SEQ ID NO: 6941025 - DNA, 22 bp, Homo sapiens
tacattcctgttagcatctaag

SEQ ID NO: 6941026 - DNA, 22 bp, Homo sapiens
cctggagaccagaggatacttc

SEQ ID NO: 6941027 - DNA, 22 bp, Homo sapiens
acgtggcggccgccgtgagcgg

SEQ ID NO: 6941028 - DNA, 22 bp, Homo sapiens
taaaggataactttcaagaatt

SEQ ID NO: 6941029 - DNA, 22 bp, Homo sapiens
atcagtcttttaatgatacctt

SEQ ID NO: 6941030 - DNA, 22 bp, Homo sapiens
aaacttcaaggatttgcaaatc

SEQ ID NO: 6941031 - DNA, 22 bp, Homo sapiens
agctggagaatgtggatgatcc

SEQ ID NO: 6941032 - DNA, 16 bp, Homo sapiens
agggagagaggaacat

SEQ ID NO: 6941033 - DNA, 20 bp, Homo sapiens
caaattctgttgaatacacc

SEQ ID NO: 6941034 - DNA, 22 bp, Homo sapiens
ttgagctgtatacctatgactg

SEQ ID NO: 6941035 - DNA, 22 bp, Homo sapiens
gtacaaatgaaaatagaccact

SEQ ID NO: 6941036 - DNA, 22 bp, Homo sapiens
atgtacataaaatgtataatga

SEQ ID NO: 6941037 - DNA, 22 bp, Homo sapiens
aattttctggtgtgtaatgaag

SEQ ID NO: 6941038 - DNA, 22 bp, Homo sapiens
tccccaggaatcaggtggttgc

SEQ ID NO: 6941039 - DNA, 23 bp, Homo sapiens
ggtcactggcaagcagtgcagag

SEQ ID NO: 6941040 - DNA, 22 bp, Homo sapiens
catttctagacaagtcctggag

SEQ ID NO: 6941041 - DNA, 22 bp, Homo sapiens
tctggcttcccactctgccggg

SEQ ID NO: 6941042 - DNA, 21 bp, Homo sapiens
tggctgagtggatgcatgaat

SEQ ID NO: 6941043 - DNA, 22 bp, Homo sapiens
ctgggcttgagttcctgctcgt

SEQ ID NO: 6941044 - DNA, 22 bp, Homo sapiens
gatccacagggccctggcccag

SEQ ID NO: 6941045 - DNA, 22 bp, Homo sapiens
tctgagaagccctgtggggagg

SEQ ID NO: 6941046 - DNA, 22 bp, Homo sapiens
tcaaatgacaagcacttttggg

SEQ ID NO: 6941047 - DNA, 22 bp, Homo sapiens
aacaggccttgtttttgttcat

SEQ ID NO: 6941048 - DNA, 22 bp, Homo sapiens
tcagctttctcttctatcgata

SEQ ID NO: 6941049 - DNA, 18 bp, Homo sapiens
tctgtccaccctgtgctg

SEQ ID NO: 6941050 - DNA, 22 bp, Homo sapiens
ttctgaaattcgactatccaat

SEQ ID NO: 6941051 - DNA, 22 bp, Homo sapiens
tatttggagataagatttttag

SEQ ID NO: 6941052 - DNA, 22 bp, Homo sapiens
tgcctttgcaattgaggaggat

SEQ ID NO: 6941053 - DNA, 22 bp, Homo sapiens
agaaggccaatagggtgcactg

SEQ ID NO: 6941054 - DNA, 22 bp, Homo sapiens
agattctcggtccgggcagccc

SEQ ID NO: 6941055 - DNA, 22 bp, Homo sapiens
ctttccagtttctaagtacagt

SEQ ID NO: 6941056 - DNA, 21 bp, Homo sapiens
ggcaagcctatgagatttcgc

SEQ ID NO: 6941057 - DNA, 22 bp, Homo sapiens
accaggttggtgtccttctggc

SEQ ID NO: 6941058 - DNA, 22 bp, Homo sapiens
agcaatgtctttttggccatct

SEQ ID NO: 6941059 - DNA, 22 bp, Homo sapiens
tggattattgtaagacaaagta

SEQ ID NO: 6941060 - DNA, 22 bp, Homo sapiens
gcccatagtctctttctttctt

SEQ ID NO: 6941061 - DNA, 20 bp, Homo sapiens
aatcccttctctggactctt

SEQ ID NO: 6941062 - DNA, 22 bp, Homo sapiens
acaacattatacatagaaagct

SEQ ID NO: 6941063 - DNA, 22 bp, Homo sapiens
ccaggcaggcgatggtgcagtg

SEQ ID NO: 6941064 - DNA, 23 bp, Homo sapiens
aatgacaggcaatgtaattgtgt

SEQ ID NO: 6941065 - DNA, 22 bp, Homo sapiens
aaatttcagttacctttacgtt

SEQ ID NO: 6941066 - DNA, 21 bp, Homo sapiens
gttcaagtgatcctcctgtct

SEQ ID NO: 6941067 - DNA, 22 bp, Homo sapiens
agtggaatggtgtcctgagctc

SEQ ID NO: 6941068 - DNA, 22 bp, Homo sapiens
gtcccccacacttccatgtcac

SEQ ID NO: 6941069 - DNA, 22 bp, Homo sapiens
tggcacagggcttggtcgctca

SEQ ID NO: 6941070 - DNA, 22 bp, Homo sapiens
ctgggccttgcatcccagagcc

SEQ ID NO: 6941071 - DNA, 22 bp, Homo sapiens
actgaggcccgaggatctcctg

SEQ ID NO: 6941072 - DNA, 22 bp, Homo sapiens
tgagaggccccagctcttggcc

SEQ ID NO: 6941073 - DNA, 22 bp, Homo sapiens
tcaggccccatcccagacttat

SEQ ID NO: 6941074 - DNA, 22 bp, Homo sapiens
gtacagttttcagtgttcactg

SEQ ID NO: 6941075 - DNA, 22 bp, Homo sapiens
cagtaatgggcaagacaatatg

SEQ ID NO: 6941076 - DNA, 22 bp, Homo sapiens
tcagtctctctatctgtaaaat

SEQ ID NO: 6941077 - DNA, 22 bp, Homo sapiens
agatggtctagttgaaccatat

SEQ ID NO: 6941078 - DNA, 21 bp, Homo sapiens
tcatttttattgctaccttgc

SEQ ID NO: 6941079 - DNA, 22 bp, Homo sapiens
ggctgatgagcttagctagaga

SEQ ID NO: 6941080 - DNA, 22 bp, Homo sapiens
tgttatgatctcactatgacta

SEQ ID NO: 6941081 - DNA, 18 bp, Homo sapiens
gctgtggaagtctttata

SEQ ID NO: 6941082 - DNA, 22 bp, Homo sapiens
tgatggaaatattgacaccaca

SEQ ID NO: 6941083 - DNA, 22 bp, Homo sapiens
accatgttggccaagctggtct

SEQ ID NO: 6941084 - DNA, 22 bp, Homo sapiens
ttttgtttaaaatcctggatgg

SEQ ID NO: 6941085 - DNA, 22 bp, Homo sapiens
cagactgtggcttcttggaggg

SEQ ID NO: 6941086 - DNA, 22 bp, Homo sapiens
gactttggagcagaaagaaatt

SEQ ID NO: 6941087 - DNA, 22 bp, Homo sapiens
agctgaggttagtataaatgtg

SEQ ID NO: 6941088 - DNA, 18 bp, Homo sapiens
aagtcacccctgctccct

SEQ ID NO: 6941089 - DNA, 22 bp, Homo sapiens
ctgagcatttgccggagcgtca

SEQ ID NO: 6941090 - DNA, 22 bp, Homo sapiens
cttttctcttacattccactgg

SEQ ID NO: 6941091 - DNA, 22 bp, Homo sapiens
aaagaggatggagtagtcagct

SEQ ID NO: 6941092 - DNA, 22 bp, Homo sapiens
agtgagcaagttgataatggcc

SEQ ID NO: 6941093 - DNA, 22 bp, Homo sapiens
cagaagcattgactccttgctc

SEQ ID NO: 6941094 - DNA, 22 bp, Homo sapiens
aaatatgactagaatgccaggt

SEQ ID NO: 6941095 - DNA, 22 bp, Homo sapiens
tcatgatctccctactctggtc

SEQ ID NO: 6941096 - DNA, 22 bp, Homo sapiens
ctgatattcttgaaatcatggt

SEQ ID NO: 6941097 - DNA, 22 bp, Homo sapiens
tactgcttttagctggatacac

SEQ ID NO: 6941098 - DNA, 22 bp, Homo sapiens
attggcatttctcacagtcccc

SEQ ID NO: 6941099 - DNA, 22 bp, Homo sapiens
tctggccaggatggcaagacca

SEQ ID NO: 6941100 - DNA, 22 bp, Homo sapiens
gactggggaaggacccgagacc

SEQ ID NO: 6941101 - DNA, 22 bp, Homo sapiens
acacatttctcccagtctccat

SEQ ID NO: 6941102 - DNA, 19 bp, Homo sapiens
tggcatcccagtaaagctt

SEQ ID NO: 6941103 - DNA, 22 bp, Homo sapiens
cagcagacttactagaatgtaa

SEQ ID NO: 6941104 - DNA, 18 bp, Homo sapiens
aagccaggtcaagataag

SEQ ID NO: 6941105 - DNA, 20 bp, Homo sapiens
actgcaaagtactctttcag

SEQ ID NO: 6941106 - DNA, 22 bp, Homo sapiens
cagtaaaagatggaaatagaat

SEQ ID NO: 6941107 - DNA, 22 bp, Homo sapiens
tttcttcctggattcctacttc

SEQ ID NO: 6941108 - DNA, 22 bp, Homo sapiens
gatggctgtcttctccctgtgt

SEQ ID NO: 6941109 - DNA, 22 bp, Homo sapiens
gtttccatctccaggacataat

SEQ ID NO: 6941110 - DNA, 22 bp, Homo sapiens
aacttctgcagaaaagtgcatg

SEQ ID NO: 6941111 - DNA, 19 bp, Homo sapiens
aatattttagcctcttcct

SEQ ID NO: 6941112 - DNA, 22 bp, Homo sapiens
atgtttgtaggtaagtgacact

SEQ ID NO: 6941113 - DNA, 22 bp, Homo sapiens
gcttcctgagagagacagttcc

SEQ ID NO: 6941114 - DNA, 22 bp, Homo sapiens
ttggcagtctcagtcagatggc

SEQ ID NO: 6941115 - DNA, 22 bp, Homo sapiens
tataaagaatccagaagagaca

SEQ ID NO: 6941116 - DNA, 22 bp, Homo sapiens
tcacagtgtggcaactcacaga

SEQ ID NO: 6941117 - DNA, 22 bp, Homo sapiens
tttacgtgaaggtgttatgtgt

SEQ ID NO: 6941118 - DNA, 22 bp, Homo sapiens
ttcttttaatttctgtctgcag

SEQ ID NO: 6941119 - DNA, 22 bp, Homo sapiens
gagcaggtgcctgtagctctct

SEQ ID NO: 6941120 - DNA, 22 bp, Homo sapiens
cagccctgctcttagtgtctcc

SEQ ID NO: 6941121 - DNA, 19 bp, Homo sapiens
ggagccgccgcccttcatt

SEQ ID NO: 6941122 - DNA, 22 bp, Homo sapiens
tgctggcttttccttcaggcag

SEQ ID NO: 6941123 - DNA, 22 bp, Homo sapiens
atcatctgtcccaaataagaga

SEQ ID NO: 6941124 - DNA, 22 bp, Homo sapiens
tatctggtttagtatgatgtta

SEQ ID NO: 6941125 - DNA, 22 bp, Homo sapiens
ttttgcccttgctagatcactg

SEQ ID NO: 6941126 - DNA, 22 bp, Homo sapiens
gaatagcttccttttttccaaa

SEQ ID NO: 6941127 - DNA, 22 bp, Homo sapiens
atgccctgcatcaagtgacact

SEQ ID NO: 6941128 - DNA, 22 bp, Homo sapiens
gagagtctaggaacctcatata

SEQ ID NO: 6941129 - DNA, 22 bp, Homo sapiens
agatacagtgttacatttttat

SEQ ID NO: 6941130 - DNA, 20 bp, Homo sapiens
tgtctctcagtgtcagtgca

SEQ ID NO: 6941131 - DNA, 22 bp, Homo sapiens
gcagaagtaggctctgtgtagg

SEQ ID NO: 6941132 - DNA, 22 bp, Homo sapiens
tgggaggatctcttgaggccag

SEQ ID NO: 6941133 - DNA, 22 bp, Homo sapiens
ttaattatgcaaaaggccccat

SEQ ID NO: 6941134 - DNA, 22 bp, Homo sapiens
aaaggattctcttgatttcagt

SEQ ID NO: 6941135 - DNA, 22 bp, Homo sapiens
accaaggagaaggtgcaagctt

SEQ ID NO: 6941136 - DNA, 22 bp, Homo sapiens
gggagctgagctggaagagaat

SEQ ID NO: 6941137 - DNA, 22 bp, Homo sapiens
ttcagcaaacacgatgcttgtt

SEQ ID NO: 6941138 - DNA, 22 bp, Homo sapiens
gcagtggcagctgagggggtat

SEQ ID NO: 6941139 - DNA, 21 bp, Homo sapiens
aacatttctgggagaactcac

SEQ ID NO: 6941140 - DNA, 22 bp, Homo sapiens
ctgagctgggctctcttgaggg

SEQ ID NO: 6941141 - DNA, 22 bp, Homo sapiens
gcagatggctcagacactgggg

SEQ ID NO: 6941142 - DNA, 22 bp, Homo sapiens
acaggcttgcactagggtggca

SEQ ID NO: 6941143 - DNA, 22 bp, Homo sapiens
attctctgtacagaaggtaccg

SEQ ID NO: 6941144 - DNA, 21 bp, Homo sapiens
gcagtcactcggttggctacc

SEQ ID NO: 6941145 - DNA, 22 bp, Homo sapiens
tttagacagatgtgaggtgggt

SEQ ID NO: 6941146 - DNA, 22 bp, Homo sapiens
atgcttctggtataagaaaaat

SEQ ID NO: 6941147 - DNA, 22 bp, Homo sapiens
tcatgctgaggggattttaaat

SEQ ID NO: 6941148 - DNA, 22 bp, Homo sapiens
tccaatcatgagtctatactag

SEQ ID NO: 6941149 - DNA, 22 bp, Homo sapiens
taatggatttcgaacctctagc

SEQ ID NO: 6941150 - DNA, 22 bp, Homo sapiens
gcccaggctggagtgcagtggc

SEQ ID NO: 6941151 - DNA, 18 bp, Homo sapiens
aagttccacaagagatct

SEQ ID NO: 6941152 - DNA, 22 bp, Homo sapiens
tcatcaggaaacttatgcagtg

SEQ ID NO: 6941153 - DNA, 22 bp, Homo sapiens
tatttggaaatgataaagtact

SEQ ID NO: 6941154 - DNA, 22 bp, Homo sapiens
agtacagtagatgtaggaatag

SEQ ID NO: 6941155 - DNA, 22 bp, Homo sapiens
gagagctggccagcttcagtat

SEQ ID NO: 6941156 - DNA, 22 bp, Homo sapiens
tcagtcagggctgtgaactgcc

SEQ ID NO: 6941157 - DNA, 22 bp, Homo sapiens
ctggtttagtaggggactgaag

SEQ ID NO: 6941158 - DNA, 22 bp, Homo sapiens
tctgtaaagatgtttatacctt

SEQ ID NO: 6941159 - DNA, 22 bp, Homo sapiens
gtacagtagagccaggttcagt

SEQ ID NO: 6941160 - DNA, 22 bp, Homo sapiens
tagaagtgaaagacttgatgtc

SEQ ID NO: 6941161 - DNA, 22 bp, Homo sapiens
taccttctaggtgatggttaca

SEQ ID NO: 6941162 - DNA, 22 bp, Homo sapiens
ccagaaaatatggctaaggtga

SEQ ID NO: 6941163 - DNA, 22 bp, Homo sapiens
tctcccctactctaaatctgca

SEQ ID NO: 6941164 - DNA, 22 bp, Homo sapiens
aggcatctatacattatgttca

SEQ ID NO: 6941165 - DNA, 22 bp, Homo sapiens
ctcaggagcttcctcagcccat

SEQ ID NO: 6941166 - DNA, 22 bp, Homo sapiens
ccacagcaggactggagccgcc

SEQ ID NO: 6941167 - DNA, 22 bp, Homo sapiens
tagggagcagccctgccactcc

SEQ ID NO: 6941168 - DNA, 22 bp, Homo sapiens
ttaccagtggtacacatgacct

SEQ ID NO: 6941169 - DNA, 22 bp, Homo sapiens
gcatagcctcgctgtttcacaa

SEQ ID NO: 6941170 - DNA, 22 bp, Homo sapiens
tataatatgaggcaggagtgat

SEQ ID NO: 6941171 - DNA, 22 bp, Homo sapiens
tccaagagtatagtttattggc

SEQ ID NO: 6941172 - DNA, 22 bp, Homo sapiens
agacagcatgagcctgctgatg

SEQ ID NO: 6941173 - DNA, 22 bp, Homo sapiens
agctccttgaaggcagtagctg

SEQ ID NO: 6941174 - DNA, 22 bp, Homo sapiens
cagggcatctggagtcgggcgg

SEQ ID NO: 6941175 - DNA, 22 bp, Homo sapiens
ttagaacactgagaaagtgatg

SEQ ID NO: 6941176 - DNA, 22 bp, Homo sapiens
aggaaggactccatggtccgtc

SEQ ID NO: 6941177 - DNA, 22 bp, Homo sapiens
acatagagttcaattttcagtc

SEQ ID NO: 6941178 - DNA, 22 bp, Homo sapiens
tttttctctaagtagtcccaaa

SEQ ID NO: 6941179 - DNA, 22 bp, Homo sapiens
acccaccctactagcagtgtcc

SEQ ID NO: 6941180 - DNA, 22 bp, Homo sapiens
gtctggatggggcttggagaaa

SEQ ID NO: 6941181 - DNA, 22 bp, Homo sapiens
ctagtataaaatgaccccatca

SEQ ID NO: 6941182 - DNA, 22 bp, Homo sapiens
acagtgctgaacgacatggaag

SEQ ID NO: 6941183 - DNA, 22 bp, Homo sapiens
tcagaaaggttctatgttttac

SEQ ID NO: 6941184 - DNA, 22 bp, Homo sapiens
agtatattggtgttattcctca

SEQ ID NO: 6941185 - DNA, 22 bp, Homo sapiens
tatttcaccatgttttccccat

SEQ ID NO: 6941186 - DNA, 22 bp, Homo sapiens
tggacaggtgagtgactcaggg

SEQ ID NO: 6941187 - DNA, 22 bp, Homo sapiens
ggcagcaacacgagtgagctaa

SEQ ID NO: 6941188 - DNA, 22 bp, Homo sapiens
tactcagattcttcatattcag

SEQ ID NO: 6941189 - DNA, 22 bp, Homo sapiens
taaagtgtcctagctaggaggc

SEQ ID NO: 6941190 - DNA, 22 bp, Homo sapiens
tagttaggggaaaaacgacagg

SEQ ID NO: 6941191 - DNA, 23 bp, Homo sapiens
acagagatcttgacttgtatgga

SEQ ID NO: 6941192 - DNA, 22 bp, Homo sapiens
atcaacatggcaatgcccatct

SEQ ID NO: 6941193 - DNA, 22 bp, Homo sapiens
gagctcttcgcctgtcgctgag

SEQ ID NO: 6941194 - DNA, 22 bp, Homo sapiens
aaactgtcctcccgaggtttcc

SEQ ID NO: 6941195 - DNA, 22 bp, Homo sapiens
agagtccagaaaacagtgtgct

SEQ ID NO: 6941196 - DNA, 22 bp, Homo sapiens
atctagaaagtgttgaagatca

SEQ ID NO: 6941197 - DNA, 22 bp, Homo sapiens
ctaggcagctttgggtgtgaag

SEQ ID NO: 6941198 - DNA, 22 bp, Homo sapiens
aatctaccttattcgatattta

SEQ ID NO: 6941199 - DNA, 22 bp, Homo sapiens
atggataatcatgaactttgag

SEQ ID NO: 6941200 - DNA, 22 bp, Homo sapiens
gtgctgagaattgatgtccttg

SEQ ID NO: 6941201 - DNA, 23 bp, Homo sapiens
tctcatgtctttcctacaagcat

SEQ ID NO: 6941202 - DNA, 22 bp, Homo sapiens
gcattcttcgaagtaagtagtg

SEQ ID NO: 6941203 - DNA, 22 bp, Homo sapiens
agtcccatatccgggttcaggg

SEQ ID NO: 6941204 - DNA, 22 bp, Homo sapiens
tgttacaactatagatcccaag

SEQ ID NO: 6941205 - DNA, 21 bp, Homo sapiens
tgagttaaaatgtcagtgcca

SEQ ID NO: 6941206 - DNA, 22 bp, Homo sapiens
gtgctttatatgtgggtatcca

SEQ ID NO: 6941207 - DNA, 20 bp, Homo sapiens
tctgtgtttcagctgcttga

SEQ ID NO: 6941208 - DNA, 22 bp, Homo sapiens
gaaagacatagttgcaagatgg

SEQ ID NO: 6941209 - DNA, 22 bp, Homo sapiens
caggcaggtcagtgaagaagga

SEQ ID NO: 6941210 - DNA, 22 bp, Homo sapiens
tgaagtgacctggggcagtgta

SEQ ID NO: 6941211 - DNA, 22 bp, Homo sapiens
tacagtagtaagaatgccttat

SEQ ID NO: 6941212 - DNA, 22 bp, Homo sapiens
caagacgtgagtcattgtttag

SEQ ID NO: 6941213 - DNA, 18 bp, Homo sapiens
tctagaaacccagactct

SEQ ID NO: 6941214 - DNA, 22 bp, Homo sapiens
aagcacacagcaaaggggagct

SEQ ID NO: 6941215 - DNA, 22 bp, Homo sapiens
agaccaagtgcaggtgccacta

SEQ ID NO: 6941216 - DNA, 22 bp, Homo sapiens
acatgcatgctttggtgggtgt

SEQ ID NO: 6941217 - DNA, 22 bp, Homo sapiens
tatggatgagttcctgaggagt

SEQ ID NO: 6941218 - DNA, 21 bp, Homo sapiens
aaatgcagtctctgagatctg

SEQ ID NO: 6941219 - DNA, 22 bp, Homo sapiens
gctacagactgagcatggctct

SEQ ID NO: 6941220 - DNA, 18 bp, Homo sapiens
agtctttaaagatgttac

SEQ ID NO: 6941221 - DNA, 22 bp, Homo sapiens
tttgaagacatattgttacata

SEQ ID NO: 6941222 - DNA, 22 bp, Homo sapiens
acctgtttctctctgagttact

SEQ ID NO: 6941223 - DNA, 22 bp, Homo sapiens
aggggaatgggtagactgttga

SEQ ID NO: 6941224 - DNA, 22 bp, Homo sapiens
agagcccttgccctcagtcacc

SEQ ID NO: 6941225 - DNA, 22 bp, Homo sapiens
gcatccttcctgctgggcctgg

SEQ ID NO: 6941226 - DNA, 22 bp, Homo sapiens
tacatgtatgtgttaatatctg

SEQ ID NO: 6941227 - DNA, 22 bp, Homo sapiens
cacagggttgttctgaggattc

SEQ ID NO: 6941228 - DNA, 21 bp, Homo sapiens
tgctgggctgcaggggatgca

SEQ ID NO: 6941229 - DNA, 22 bp, Homo sapiens
tttcaggattttatgagatagt

SEQ ID NO: 6941230 - DNA, 22 bp, Homo sapiens
gaggggctgggtagggcaaccc

SEQ ID NO: 6941231 - DNA, 22 bp, Homo sapiens
agaagcacacctgacctctagc

SEQ ID NO: 6941232 - DNA, 22 bp, Homo sapiens
tgagtggagaacagaggctctc

SEQ ID NO: 6941233 - DNA, 22 bp, Homo sapiens
cgggcttcctccagggaagtgc

SEQ ID NO: 6941234 - DNA, 22 bp, Homo sapiens
gctgaaatgggcactgaaggcc

SEQ ID NO: 6941235 - DNA, 22 bp, Homo sapiens
tattcttactctcgactgcatt

SEQ ID NO: 6941236 - DNA, 22 bp, Homo sapiens
ggccctgctgaagccgggtcta

SEQ ID NO: 6941237 - DNA, 22 bp, Homo sapiens
ttgtaatgagtggatcttaggg

SEQ ID NO: 6941238 - DNA, 22 bp, Homo sapiens
tgctacagagccaggaagagtg

SEQ ID NO: 6941239 - DNA, 23 bp, Homo sapiens
ctggccctggctctgtgatcatg

SEQ ID NO: 6941240 - DNA, 22 bp, Homo sapiens
aagtctctcatggctgacagca

SEQ ID NO: 6941241 - DNA, 22 bp, Homo sapiens
gaggagaatgcgcaccacatat

SEQ ID NO: 6941242 - DNA, 22 bp, Homo sapiens
ttcacagagttatttttatgct

SEQ ID NO: 6941243 - DNA, 22 bp, Homo sapiens
aggagggacaccaatatatgtt

SEQ ID NO: 6941244 - DNA, 22 bp, Homo sapiens
gaaagcagatgaaattgcaaca

SEQ ID NO: 6941245 - DNA, 22 bp, Homo sapiens
ctactttgctgcccagcagtgc

SEQ ID NO: 6941246 - DNA, 22 bp, Homo sapiens
gaaaggcagtacagctgagcct

SEQ ID NO: 6941247 - DNA, 22 bp, Homo sapiens
attcttggcaaggagatttaaa

SEQ ID NO: 6941248 - DNA, 22 bp, Homo sapiens
ggacagagggttgacagagtat

SEQ ID NO: 6941249 - DNA, 22 bp, Homo sapiens
agacgcggtggtgcatgcctgt

SEQ ID NO: 6941250 - DNA, 22 bp, Homo sapiens
tccaggctgcagtcttgccctc

SEQ ID NO: 6941251 - DNA, 22 bp, Homo sapiens
catggcttcgcgcgtccccgct

SEQ ID NO: 6941252 - DNA, 22 bp, Homo sapiens
tacagcctcatcacgggagctg

SEQ ID NO: 6941253 - DNA, 22 bp, Homo sapiens
cctgttcactgcacagtttccg

SEQ ID NO: 6941254 - DNA, 22 bp, Homo sapiens
agaagcattataacatgcaagg

SEQ ID NO: 6941255 - DNA, 22 bp, Homo sapiens
tgtatcccctgcaggttgctat

SEQ ID NO: 6941256 - DNA, 22 bp, Homo sapiens
tccactgctacaacctcccaga

SEQ ID NO: 6941257 - DNA, 22 bp, Homo sapiens
gctgtctagggaggctgtcacc

SEQ ID NO: 6941258 - DNA, 22 bp, Homo sapiens
agtgattaaagctaggataaaa

SEQ ID NO: 6941259 - DNA, 22 bp, Homo sapiens
agcaggtgtatcggtcacctac

SEQ ID NO: 6941260 - DNA, 21 bp, Homo sapiens
aactttagaaagactgggaag

SEQ ID NO: 6941261 - DNA, 22 bp, Homo sapiens
gggcagccccagcgcgttggct

SEQ ID NO: 6941262 - DNA, 22 bp, Homo sapiens
cagacagagctcacaagtcttt

SEQ ID NO: 6941263 - DNA, 22 bp, Homo sapiens
gcaggccagctgtgcagatggg

SEQ ID NO: 6941264 - DNA, 22 bp, Homo sapiens
aggtgcatctcgtagctcttct

SEQ ID NO: 6941265 - DNA, 22 bp, Homo sapiens
ctcaccacagagcctgtccagc

SEQ ID NO: 6941266 - DNA, 23 bp, Homo sapiens
ttgaaagattgctaagtaaaaat

SEQ ID NO: 6941267 - DNA, 22 bp, Homo sapiens
aaacctgtctgattatggagac

SEQ ID NO: 6941268 - DNA, 22 bp, Homo sapiens
tttgatcctttagccatttgac

SEQ ID NO: 6941269 - DNA, 22 bp, Homo sapiens
tcctgcacactgatgagatcac

SEQ ID NO: 6941270 - DNA, 22 bp, Homo sapiens
gagacacaaacacatttagagg

SEQ ID NO: 6941271 - DNA, 22 bp, Homo sapiens
gctttggagggcaagagctgtt

SEQ ID NO: 6941272 - DNA, 22 bp, Homo sapiens
taggctcagggctgggtgacgg

SEQ ID NO: 6941273 - DNA, 22 bp, Homo sapiens
gctctgagcagggagaaacagg

SEQ ID NO: 6941274 - DNA, 22 bp, Homo sapiens
ttgtctgagaaagtgagttgct

SEQ ID NO: 6941275 - DNA, 22 bp, Homo sapiens
gagaagtttctggtttgcatag

SEQ ID NO: 6941276 - DNA, 22 bp, Homo sapiens
ggtaggaagatagagcaaagtt

SEQ ID NO: 6941277 - DNA, 22 bp, Homo sapiens
acttagattcctggtacctccg

SEQ ID NO: 6941278 - DNA, 22 bp, Homo sapiens
gcagggttttccttagaatttc

SEQ ID NO: 6941279 - DNA, 22 bp, Homo sapiens
tcttcaccatcaacagaatgaa

SEQ ID NO: 6941280 - DNA, 22 bp, Homo sapiens
ttctgcttagagggcatttgca

SEQ ID NO: 6941281 - DNA, 22 bp, Homo sapiens
ttgccattttgagaaggatata

SEQ ID NO: 6941282 - DNA, 22 bp, Homo sapiens
ctgggcaggagaggtggttgga

SEQ ID NO: 6941283 - DNA, 23 bp, Homo sapiens
tccctgactctgggagctcccag

SEQ ID NO: 6941284 - DNA, 22 bp, Homo sapiens
tgcaggtcatccctgtgcttct

SEQ ID NO: 6941285 - DNA, 22 bp, Homo sapiens
atgtctatggaatttccacaca

SEQ ID NO: 6941286 - DNA, 22 bp, Homo sapiens
tagagtatagctaactgtatta

SEQ ID NO: 6941287 - DNA, 22 bp, Homo sapiens
ccaacacagatgtgttagtgtt

SEQ ID NO: 6941288 - DNA, 22 bp, Homo sapiens
acaacagtaggaaaacatgtct

SEQ ID NO: 6941289 - DNA, 22 bp, Homo sapiens
agtcactgtttaatctagctaa

SEQ ID NO: 6941290 - DNA, 22 bp, Homo sapiens
gaaggctgccagtggccctctt

SEQ ID NO: 6941291 - DNA, 19 bp, Homo sapiens
tgttggctgttctagctca

SEQ ID NO: 6941292 - DNA, 22 bp, Homo sapiens
aatactggactctcactattta

SEQ ID NO: 6941293 - DNA, 22 bp, Homo sapiens
ttgtgctagaaccagtacagaa

SEQ ID NO: 6941294 - DNA, 22 bp, Homo sapiens
ccaggcaagagaggctctggca

SEQ ID NO: 6941295 - DNA, 22 bp, Homo sapiens
taagagcactgaagtcttctta

SEQ ID NO: 6941296 - DNA, 22 bp, Homo sapiens
gcttagcaatgtgacaagatgc

SEQ ID NO: 6941297 - DNA, 22 bp, Homo sapiens
ggcatgagtaacgtgagtgagg

SEQ ID NO: 6941298 - DNA, 22 bp, Homo sapiens
tggctggattattggctagtac

SEQ ID NO: 6941299 - DNA, 22 bp, Homo sapiens
tctcagaagtgatcaggatgtt

SEQ ID NO: 6941300 - DNA, 22 bp, Homo sapiens
tgtcctgggtggatgcttcatt

SEQ ID NO: 6941301 - DNA, 22 bp, Homo sapiens
gctcctccctgtgcagacccag

SEQ ID NO: 6941302 - DNA, 22 bp, Homo sapiens
ttaatgtgtgtacaggattttg

SEQ ID NO: 6941303 - DNA, 22 bp, Homo sapiens
ggcagggagtggagactcccta

SEQ ID NO: 6941304 - DNA, 17 bp, Homo sapiens
acctgacagtacagtgt

SEQ ID NO: 6941305 - DNA, 22 bp, Homo sapiens
accagagtcaattattttgcca

SEQ ID NO: 6941306 - DNA, 22 bp, Homo sapiens
ttctccagaccttgtgactatg

SEQ ID NO: 6941307 - DNA, 22 bp, Homo sapiens
ataatgacagcatttaaggact

SEQ ID NO: 6941308 - DNA, 23 bp, Homo sapiens
agccagttgtagccacagaactc

SEQ ID NO: 6941309 - DNA, 22 bp, Homo sapiens
cccaagtctggcagaattaaac

SEQ ID NO: 6941310 - DNA, 18 bp, Homo sapiens
cctagagcagatgggagt

SEQ ID NO: 6941311 - DNA, 22 bp, Homo sapiens
atgggcttgaccctacagaaag

SEQ ID NO: 6941312 - DNA, 22 bp, Homo sapiens
agcacctggtctcctggcgctg

SEQ ID NO: 6941313 - DNA, 19 bp, Homo sapiens
tgacaagataatagccttg

SEQ ID NO: 6941314 - DNA, 22 bp, Homo sapiens
tggacaggggctgctgttgtca

SEQ ID NO: 6941315 - DNA, 22 bp, Homo sapiens
ttgaaatgatctatttcagtag

SEQ ID NO: 6941316 - DNA, 22 bp, Homo sapiens
gaggtgatggttgcacaatgct

SEQ ID NO: 6941317 - DNA, 22 bp, Homo sapiens
tcaagagagtgctgcttggggt

SEQ ID NO: 6941318 - DNA, 18 bp, Homo sapiens
agagtgttctcagtgaaa

SEQ ID NO: 6941319 - DNA, 22 bp, Homo sapiens
gctccctggaatgttggctgcc

SEQ ID NO: 6941320 - DNA, 22 bp, Homo sapiens
aagagcaggctgtcaatggggc

SEQ ID NO: 6941321 - DNA, 22 bp, Homo sapiens
gggaagagggagctggaatgat

SEQ ID NO: 6941322 - DNA, 22 bp, Homo sapiens
gcgaatctcagctggtgctgcg

SEQ ID NO: 6941323 - DNA, 22 bp, Homo sapiens
caaatgaatagggagtgtgatg

SEQ ID NO: 6941324 - DNA, 22 bp, Homo sapiens
tgttacacccacaaaaaattcc

SEQ ID NO: 6941325 - DNA, 22 bp, Homo sapiens
gcagggcaaacccaggtgttca

SEQ ID NO: 6941326 - DNA, 22 bp, Homo sapiens
tcccagcaggagtccagttccc

SEQ ID NO: 6941327 - DNA, 22 bp, Homo sapiens
ctgacagggtagacagagggca

SEQ ID NO: 6941328 - DNA, 22 bp, Homo sapiens
caatgcagataccttccagaga

SEQ ID NO: 6941329 - DNA, 22 bp, Homo sapiens
tagggctcactgagatgaatat

SEQ ID NO: 6941330 - DNA, 22 bp, Homo sapiens
tactgttttctttacaccatgt

SEQ ID NO: 6941331 - DNA, 23 bp, Homo sapiens
ggcctctgtgttctgcccacatg

SEQ ID NO: 6941332 - DNA, 22 bp, Homo sapiens
cttgtattgcaaactggccagg

SEQ ID NO: 6941333 - DNA, 22 bp, Homo sapiens
agagtgaagtttttgaaagtga

SEQ ID NO: 6941334 - DNA, 22 bp, Homo sapiens
acggcctggtgcagcaggtcgc

SEQ ID NO: 6941335 - DNA, 19 bp, Homo sapiens
agtgcatgggcgaggtgca

SEQ ID NO: 6941336 - DNA, 22 bp, Homo sapiens
ggcttcttgctattttccaatg

SEQ ID NO: 6941337 - DNA, 22 bp, Homo sapiens
tgtttacaagccacttgttaag

SEQ ID NO: 6941338 - DNA, 22 bp, Homo sapiens
gacggcagaaactcatgaggtc

SEQ ID NO: 6941339 - DNA, 22 bp, Homo sapiens
tctctacagcacccgcatgcta

SEQ ID NO: 6941340 - DNA, 22 bp, Homo sapiens
actggggtttaggcctgggcaa

SEQ ID NO: 6941341 - DNA, 22 bp, Homo sapiens
gtatgtcaaaatctgcatgata

SEQ ID NO: 6941342 - DNA, 22 bp, Homo sapiens
aaactggtgtcactgagggctg

SEQ ID NO: 6941343 - DNA, 22 bp, Homo sapiens
tgaagttatatatgttgaaaat

SEQ ID NO: 6941344 - DNA, 22 bp, Homo sapiens
tgggttaaaagttgaatgaatt

SEQ ID NO: 6941345 - DNA, 22 bp, Homo sapiens
cttcaacctggttttataagtg

SEQ ID NO: 6941346 - DNA, 22 bp, Homo sapiens
ggagatacaaaagtagtgcagg

SEQ ID NO: 6941347 - DNA, 22 bp, Homo sapiens
acctgtttgttaagaaagcttc

SEQ ID NO: 6941348 - DNA, 22 bp, Homo sapiens
agcacagagttgctcactgccg

SEQ ID NO: 6941349 - DNA, 22 bp, Homo sapiens
ctgtcaaattcataacacttat

SEQ ID NO: 6941350 - DNA, 22 bp, Homo sapiens
gggcagctctgcccatcagagg

SEQ ID NO: 6941351 - DNA, 22 bp, Homo sapiens
gaaacagcccctgtgtgaagca

SEQ ID NO: 6941352 - DNA, 22 bp, Homo sapiens
tccagagctgtatgattttttt

SEQ ID NO: 6941353 - DNA, 22 bp, Homo sapiens
tgatggaaacttgggtaagtca

SEQ ID NO: 6941354 - DNA, 22 bp, Homo sapiens
ctgcccatctgcagacatgcgt

SEQ ID NO: 6941355 - DNA, 22 bp, Homo sapiens
atgctgtccactcttggtgttt

SEQ ID NO: 6941356 - DNA, 22 bp, Homo sapiens
ataacactaaatgtatgtaaca

SEQ ID NO: 6941357 - DNA, 22 bp, Homo sapiens
tatagcacacagtttataaaag

SEQ ID NO: 6941358 - DNA, 19 bp, Homo sapiens
tatttcaaagtgccgtcta

SEQ ID NO: 6941359 - DNA, 22 bp, Homo sapiens
gagggcagtagcctcgtaccct

SEQ ID NO: 6941360 - DNA, 22 bp, Homo sapiens
cagggcctcattgtcagtcctg

SEQ ID NO: 6941361 - DNA, 22 bp, Homo sapiens
ctggctgtgtgcccccggcacc

SEQ ID NO: 6941362 - DNA, 22 bp, Homo sapiens
atattttcacagaacttgcaaa

SEQ ID NO: 6941363 - DNA, 22 bp, Homo sapiens
caattcatgtgagcggactctt

SEQ ID NO: 6941364 - DNA, 22 bp, Homo sapiens
gctgggcatgtgaccaacagaa

SEQ ID NO: 6941365 - DNA, 22 bp, Homo sapiens
gttcaatttagaaagcacagtt

SEQ ID NO: 6941366 - DNA, 22 bp, Homo sapiens
ttgcatgtgtgcatatatttgc

SEQ ID NO: 6941367 - DNA, 22 bp, Homo sapiens
atgaggagctgttttaactgct

SEQ ID NO: 6941368 - DNA, 22 bp, Homo sapiens
atgcctccttctgaaacagggc

SEQ ID NO: 6941369 - DNA, 22 bp, Homo sapiens
ccctgccagatgtgcttcagtt

SEQ ID NO: 6941370 - DNA, 22 bp, Homo sapiens
tgaaatgatcagtttggttact

SEQ ID NO: 6941371 - DNA, 22 bp, Homo sapiens
ttcaaggtcaactatgggattc

SEQ ID NO: 6941372 - DNA, 22 bp, Homo sapiens
atggcatgtggctgggttttca

SEQ ID NO: 6941373 - DNA, 22 bp, Homo sapiens
ttgtgtaaggctgattaggaag

SEQ ID NO: 6941374 - DNA, 20 bp, Homo sapiens
acagtggaaattgatgtctg

SEQ ID NO: 6941375 - DNA, 22 bp, Homo sapiens
aaagacatggcaagagatgggg

SEQ ID NO: 6941376 - DNA, 22 bp, Homo sapiens
actgtgtgaggctgggtgagtc

SEQ ID NO: 6941377 - DNA, 22 bp, Homo sapiens
aggtagtgtagctgagtgggat

SEQ ID NO: 6941378 - DNA, 22 bp, Homo sapiens
agagttctctctcatttgagct

SEQ ID NO: 6941379 - DNA, 22 bp, Homo sapiens
aaacctttgcctggaagggagt

SEQ ID NO: 6941380 - DNA, 22 bp, Homo sapiens
tgaaatcatgtagttattgcaa

SEQ ID NO: 6941381 - DNA, 22 bp, Homo sapiens
ataagctttgctggagagacct

SEQ ID NO: 6941382 - DNA, 22 bp, Homo sapiens
gctcagctggagagggacgggt

SEQ ID NO: 6941383 - DNA, 22 bp, Homo sapiens
aacatttgagaaaaatactctt

SEQ ID NO: 6941384 - DNA, 22 bp, Homo sapiens
aacatcttgtactgcacatttt

SEQ ID NO: 6941385 - DNA, 22 bp, Homo sapiens
ttcagaaataaaatatcccaac

SEQ ID NO: 6941386 - DNA, 22 bp, Homo sapiens
ttgtaacctgtgatttaatcaa

SEQ ID NO: 6941387 - DNA, 22 bp, Homo sapiens
gacagagcagcacccagcccct

SEQ ID NO: 6941388 - DNA, 22 bp, Homo sapiens
tctgctcagggagggtcactac

SEQ ID NO: 6941389 - DNA, 22 bp, Homo sapiens
acaaagctctggaaggctcgtc

SEQ ID NO: 6941390 - DNA, 22 bp, Homo sapiens
cgtgccactgcactctagcctg

SEQ ID NO: 6941391 - DNA, 22 bp, Homo sapiens
cctggatagctactggccaggc

SEQ ID NO: 6941392 - DNA, 22 bp, Homo sapiens
ggagtctacgacctgcttcagg

SEQ ID NO: 6941393 - DNA, 22 bp, Homo sapiens
agggccagctgcagaattagca

SEQ ID NO: 6941394 - DNA, 21 bp, Homo sapiens
aggaatgctgaggctcacttt

SEQ ID NO: 6941395 - DNA, 22 bp, Homo sapiens
aaatttaaggaggtgctcactt

SEQ ID NO: 6941396 - DNA, 22 bp, Homo sapiens
tttattgacttcagtgagtctt

SEQ ID NO: 6941397 - DNA, 22 bp, Homo sapiens
cagcgtgggatttggaaaccag

SEQ ID NO: 6941398 - DNA, 18 bp, Homo sapiens
aaagctatcatggaacac

SEQ ID NO: 6941399 - DNA, 22 bp, Homo sapiens
gggcttctggtcattcctcatc

SEQ ID NO: 6941400 - DNA, 22 bp, Homo sapiens
ttcttataagttaatatttcca

SEQ ID NO: 6941401 - DNA, 22 bp, Homo sapiens
atgcagttatgtgagggcatga

SEQ ID NO: 6941402 - DNA, 23 bp, Homo sapiens
aggcaatacaaggcatctctgga

SEQ ID NO: 6941403 - DNA, 19 bp, Homo sapiens
ccaggactttgcagacact

SEQ ID NO: 6941404 - DNA, 22 bp, Homo sapiens
ctctggggtgcttcgacacttc

SEQ ID NO: 6941405 - DNA, 22 bp, Homo sapiens
aagctgcccaagactgaagcat

SEQ ID NO: 6941406 - DNA, 22 bp, Homo sapiens
ggagtctgactctgaccctgga

SEQ ID NO: 6941407 - DNA, 22 bp, Homo sapiens
aacatacagtgagcagtggact

SEQ ID NO: 6941408 - DNA, 22 bp, Homo sapiens
tctgccactagtggttacctta

SEQ ID NO: 6941409 - DNA, 22 bp, Homo sapiens
gtggtgtaggtcacagttagga

SEQ ID NO: 6941410 - DNA, 22 bp, Homo sapiens
tgggagagcttcatgccttcag

SEQ ID NO: 6941411 - DNA, 22 bp, Homo sapiens
tcccaggccacacttggggaac

SEQ ID NO: 6941412 - DNA, 22 bp, Homo sapiens
cccaattttgggcacaacgaaa

SEQ ID NO: 6941413 - DNA, 22 bp, Homo sapiens
tttggctctcacttgcactcag

SEQ ID NO: 6941414 - DNA, 22 bp, Homo sapiens
tgagaactggtttctattcatg

SEQ ID NO: 6941415 - DNA, 22 bp, Homo sapiens
ctgcagagctaggctgagtgaa

SEQ ID NO: 6941416 - DNA, 22 bp, Homo sapiens
ttggtattttacaatgtcagtg

SEQ ID NO: 6941417 - DNA, 22 bp, Homo sapiens
gccagccctgggagacttatgg

SEQ ID NO: 6941418 - DNA, 22 bp, Homo sapiens
tgtctggcctcaaaagccattt

SEQ ID NO: 6941419 - DNA, 22 bp, Homo sapiens
tgcttctggggacaggctgcct

SEQ ID NO: 6941420 - DNA, 21 bp, Homo sapiens
aatcagaggcttcctagttgg

SEQ ID NO: 6941421 - DNA, 22 bp, Homo sapiens
tgcaggaccttgatcctggact

SEQ ID NO: 6941422 - DNA, 22 bp, Homo sapiens
ttaaatggagggggaaatacgt

SEQ ID NO: 6941423 - DNA, 22 bp, Homo sapiens
agggcgctgaaatactaacatg

SEQ ID NO: 6941424 - DNA, 22 bp, Homo sapiens
gagcttcctgcaggtcactgtg

SEQ ID NO: 6941425 - DNA, 22 bp, Homo sapiens
agataagtactgttattattgc

SEQ ID NO: 6941426 - DNA, 22 bp, Homo sapiens
cattccagctctcatactctgg

SEQ ID NO: 6941427 - DNA, 22 bp, Homo sapiens
gttcccactagactgctactta

SEQ ID NO: 6941428 - DNA, 22 bp, Homo sapiens
catagaaactgagacaaggatt

SEQ ID NO: 6941429 - DNA, 22 bp, Homo sapiens
ccagctgtcactcagaaaggcc

SEQ ID NO: 6941430 - DNA, 22 bp, Homo sapiens
atctggggtcagacagccctgg

SEQ ID NO: 6941431 - DNA, 22 bp, Homo sapiens
gctgccctgtctgcagcaggac

SEQ ID NO: 6941432 - DNA, 22 bp, Homo sapiens
caaagacacgggaaacaacgtt

SEQ ID NO: 6941433 - DNA, 22 bp, Homo sapiens
agccccttgcacttccccacgc

SEQ ID NO: 6941434 - DNA, 22 bp, Homo sapiens
atgcatatcacagtctccatgt

SEQ ID NO: 6941435 - DNA, 22 bp, Homo sapiens
tgagtggagtagtgaatgcatt

SEQ ID NO: 6941436 - DNA, 22 bp, Homo sapiens
aatcatcacgaacacaacagcg

SEQ ID NO: 6941437 - DNA, 22 bp, Homo sapiens
agggcacatctgctgggaatgg

SEQ ID NO: 6941438 - DNA, 22 bp, Homo sapiens
ggctagctcctccgcgcatcca

SEQ ID NO: 6941439 - DNA, 23 bp, Homo sapiens
atggcacatgggacagtaagtag

SEQ ID NO: 6941440 - DNA, 22 bp, Homo sapiens
ggaaaccattcccgactctcct

SEQ ID NO: 6941441 - DNA, 22 bp, Homo sapiens
caaggtttacattgggctatca

SEQ ID NO: 6941442 - DNA, 22 bp, Homo sapiens
ggtctgtaggggaaggtctgga

SEQ ID NO: 6941443 - DNA, 22 bp, Homo sapiens
ttcaaaagactcagatgtagcg

SEQ ID NO: 6941444 - DNA, 22 bp, Homo sapiens
atagctgttgccaatttccatg

SEQ ID NO: 6941445 - DNA, 22 bp, Homo sapiens
gtggcagggcaatgctccctct

SEQ ID NO: 6941446 - DNA, 22 bp, Homo sapiens
tcagggattaaggtcaaaggtg

SEQ ID NO: 6941447 - DNA, 22 bp, Homo sapiens
ccacagcacctgcagccagttg

SEQ ID NO: 6941448 - DNA, 22 bp, Homo sapiens
tggcttcctgtttcccagaaag

SEQ ID NO: 6941449 - DNA, 22 bp, Homo sapiens
aagagcactaacagagctgata

SEQ ID NO: 6941450 - DNA, 22 bp, Homo sapiens
tgggaaagccagcagtgtcacc

SEQ ID NO: 6941451 - DNA, 23 bp, Homo sapiens
ttctgccactgaaaatgcctcag

SEQ ID NO: 6941452 - DNA, 22 bp, Homo sapiens
ggcagacaatctgtctgttagg

SEQ ID NO: 6941453 - DNA, 22 bp, Homo sapiens
gacagcaaagcagagccaaggc

SEQ ID NO: 6941454 - DNA, 22 bp, Homo sapiens
cccatgcatccctctcctgggc

SEQ ID NO: 6941455 - DNA, 22 bp, Homo sapiens
tattgtacatttccaaattgct

SEQ ID NO: 6941456 - DNA, 22 bp, Homo sapiens
cagccagctggtgcggcagagc

SEQ ID NO: 6941457 - DNA, 22 bp, Homo sapiens
ccctcctcaactctggcttcca

SEQ ID NO: 6941458 - DNA, 22 bp, Homo sapiens
gggctggcatcagttgccgaga

SEQ ID NO: 6941459 - DNA, 22 bp, Homo sapiens
aagttctgccaggctgtggcag

SEQ ID NO: 6941460 - DNA, 22 bp, Homo sapiens
ctgcgtgcatgtctgcgtgcat

SEQ ID NO: 6941461 - DNA, 22 bp, Homo sapiens
aggctccttatggctttggggt

SEQ ID NO: 6941462 - DNA, 21 bp, Homo sapiens
tgtggtcttttagttccatca

SEQ ID NO: 6941463 - DNA, 22 bp, Homo sapiens
gcagtgttccttctactggggc

SEQ ID NO: 6941464 - DNA, 19 bp, Homo sapiens
aaggtggcagcaggtatta

SEQ ID NO: 6941465 - DNA, 22 bp, Homo sapiens
agatgcatgcttaattagcaca

SEQ ID NO: 6941466 - DNA, 22 bp, Homo sapiens
tcttcccagtgagacttatggg

SEQ ID NO: 6941467 - DNA, 22 bp, Homo sapiens
ttgctggacatgaatcagatat

SEQ ID NO: 6941468 - DNA, 22 bp, Homo sapiens
cctgtgacattagaatttcatt

SEQ ID NO: 6941469 - DNA, 19 bp, Homo sapiens
tgtgtgtttatatatgtat

SEQ ID NO: 6941470 - DNA, 22 bp, Homo sapiens
cttggagttagggtctttaaag

SEQ ID NO: 6941471 - DNA, 22 bp, Homo sapiens
ctggaacaagtggccttgcaag

SEQ ID NO: 6941472 - DNA, 22 bp, Homo sapiens
tttggcaaagatcaacatgtta

SEQ ID NO: 6941473 - DNA, 19 bp, Homo sapiens
ttcttacaacaccctggga

SEQ ID NO: 6941474 - DNA, 22 bp, Homo sapiens
cttatttgtactaataaatctg

SEQ ID NO: 6941475 - DNA, 22 bp, Homo sapiens
tcccgacctggtgccattatcc

SEQ ID NO: 6941476 - DNA, 22 bp, Homo sapiens
ccacatgagctggcaatgccct

SEQ ID NO: 6941477 - DNA, 18 bp, Homo sapiens
tggggggcttgtctgaag

SEQ ID NO: 6941478 - DNA, 19 bp, Homo sapiens
acatggcatcccaggaggt

SEQ ID NO: 6941479 - DNA, 22 bp, Homo sapiens
caaccgcggggcccagcggttc

SEQ ID NO: 6941480 - DNA, 22 bp, Homo sapiens
caaagggaaaagccatgtgggc

SEQ ID NO: 6941481 - DNA, 22 bp, Homo sapiens
tattggagttggtaagaagtca

SEQ ID NO: 6941482 - DNA, 22 bp, Homo sapiens
tagcaacagaaaataggagtgc

SEQ ID NO: 6941483 - DNA, 22 bp, Homo sapiens
gtcccagcttcccactagcagc

SEQ ID NO: 6941484 - DNA, 22 bp, Homo sapiens
aggaagggtggatagtaacgtg

SEQ ID NO: 6941485 - DNA, 22 bp, Homo sapiens
acctgtcatgtcaatgttcagt

SEQ ID NO: 6941486 - DNA, 22 bp, Homo sapiens
tgtctgtctgcaagccagaaag

SEQ ID NO: 6941487 - DNA, 22 bp, Homo sapiens
ctctgctgccaccagaaccact

SEQ ID NO: 6941488 - DNA, 22 bp, Homo sapiens
agggactccctgggccgacacg

SEQ ID NO: 6941489 - DNA, 19 bp, Homo sapiens
ggctgagcgccttggctgc

SEQ ID NO: 6941490 - DNA, 21 bp, Homo sapiens
ttgtttcctcccaaaatgcca

SEQ ID NO: 6941491 - DNA, 22 bp, Homo sapiens
catggccacatgataatcaagt

SEQ ID NO: 6941492 - DNA, 18 bp, Homo sapiens
cataattttctttcttta

SEQ ID NO: 6941493 - DNA, 20 bp, Homo sapiens
cactgccagaatacactgtc

SEQ ID NO: 6941494 - DNA, 22 bp, Homo sapiens
ctccctgaggacaggccctgtc

SEQ ID NO: 6941495 - DNA, 22 bp, Homo sapiens
ccataaggagccagacattcca

SEQ ID NO: 6941496 - DNA, 22 bp, Homo sapiens
tttaatggcaagaaggctgcag

SEQ ID NO: 6941497 - DNA, 22 bp, Homo sapiens
ctttagatgttgctttaactat

SEQ ID NO: 6941498 - DNA, 22 bp, Homo sapiens
ctccaggacagattcagggcca

SEQ ID NO: 6941499 - DNA, 22 bp, Homo sapiens
atgacagctctagcacacagta

SEQ ID NO: 6941500 - DNA, 22 bp, Homo sapiens
cctgtgcattgcagggtgttca

SEQ ID NO: 6941501 - DNA, 22 bp, Homo sapiens
ttcagcactggacagcgagtct

SEQ ID NO: 6941502 - DNA, 22 bp, Homo sapiens
aggccagccctgggctgagaga

SEQ ID NO: 6941503 - DNA, 22 bp, Homo sapiens
gcccaatagagaaatagtgaaa

SEQ ID NO: 6941504 - DNA, 22 bp, Homo sapiens
aggcaggcccctgagaatagac

SEQ ID NO: 6941505 - DNA, 17 bp, Homo sapiens
ctgagcatccgtgctct

SEQ ID NO: 6941506 - DNA, 22 bp, Homo sapiens
acactctgtaatgtcacactcc

SEQ ID NO: 6941507 - DNA, 22 bp, Homo sapiens
tcttccaaggtgcagatcttct

SEQ ID NO: 6941508 - DNA, 22 bp, Homo sapiens
tgacaattgcagacacagaagt

SEQ ID NO: 6941509 - DNA, 22 bp, Homo sapiens
cctggtggcttctgggtggacg

SEQ ID NO: 6941510 - DNA, 22 bp, Homo sapiens
tgcagcaagcaagtatggttct

SEQ ID NO: 6941511 - DNA, 22 bp, Homo sapiens
aaggtatagcttgcatacagaa

SEQ ID NO: 6941512 - DNA, 22 bp, Homo sapiens
ttggaaggtgagtccctgggtt

SEQ ID NO: 6941513 - DNA, 22 bp, Homo sapiens
cttgacattcttaataatttta

SEQ ID NO: 6941514 - DNA, 21 bp, Homo sapiens
accctttgtttatgaatcagc

SEQ ID NO: 6941515 - DNA, 22 bp, Homo sapiens
acagcagatttccctgggctcc

SEQ ID NO: 6941516 - DNA, 22 bp, Homo sapiens
atccaggaaggatggcattgag

SEQ ID NO: 6941517 - DNA, 22 bp, Homo sapiens
agtggcaggatctcggttcact

SEQ ID NO: 6941518 - DNA, 23 bp, Homo sapiens
aaattgtcgtaaggtggagatgt

SEQ ID NO: 6941519 - DNA, 22 bp, Homo sapiens
caggaaatagacactgtatgat

SEQ ID NO: 6941520 - DNA, 22 bp, Homo sapiens
agttctgataaaggaggaagat

SEQ ID NO: 6941521 - DNA, 22 bp, Homo sapiens
ttggcacaagcagttgggccca

SEQ ID NO: 6941522 - DNA, 22 bp, Homo sapiens
gagaggaaagaaccaatgaccc

SEQ ID NO: 6941523 - DNA, 22 bp, Homo sapiens
gcagtcataactaatattggtt

SEQ ID NO: 6941524 - DNA, 22 bp, Homo sapiens
tcttcatgacctctgtgtttta

SEQ ID NO: 6941525 - DNA, 23 bp, Homo sapiens
tggttacatagggcagatggcgc

SEQ ID NO: 6941526 - DNA, 22 bp, Homo sapiens
ctgtgagatttttaaataactt

SEQ ID NO: 6941527 - DNA, 21 bp, Homo sapiens
tttatcatcacgagcttgagc

SEQ ID NO: 6941528 - DNA, 22 bp, Homo sapiens
gctgtgtgctcacgtagtggaa

SEQ ID NO: 6941529 - DNA, 22 bp, Homo sapiens
tggcttggtcctggcccttccc

SEQ ID NO: 6941530 - DNA, 22 bp, Homo sapiens
atagacatgcaacactttttac

SEQ ID NO: 6941531 - DNA, 22 bp, Homo sapiens
tccgtacagctacaaaacctta

SEQ ID NO: 6941532 - DNA, 22 bp, Homo sapiens
agggcagctgtgagccactgtg

SEQ ID NO: 6941533 - DNA, 22 bp, Homo sapiens
atttcctggtgtggaagtattt

SEQ ID NO: 6941534 - DNA, 18 bp, Homo sapiens
agagatgggagttggaaa

SEQ ID NO: 6941535 - DNA, 22 bp, Homo sapiens
tcaggaaagagtgtatccatca

SEQ ID NO: 6941536 - DNA, 20 bp, Homo sapiens
ggcaggtgctgtcccctcct

SEQ ID NO: 6941537 - DNA, 22 bp, Homo sapiens
tgaaatcatctgccaataagtt

SEQ ID NO: 6941538 - DNA, 22 bp, Homo sapiens
tgtaagtagtaatggaaggaca

SEQ ID NO: 6941539 - DNA, 22 bp, Homo sapiens
tgtgcctggcccagtggtgtca

SEQ ID NO: 6941540 - DNA, 21 bp, Homo sapiens
tgtggctgcctctggccctgg

SEQ ID NO: 6941541 - DNA, 22 bp, Homo sapiens
tccaggcactatatatactttt

SEQ ID NO: 6941542 - DNA, 22 bp, Homo sapiens
ggcgcggtgactcagcctcgct

SEQ ID NO: 6941543 - DNA, 22 bp, Homo sapiens
ctgacttttttcagccacagtg

SEQ ID NO: 6941544 - DNA, 22 bp, Homo sapiens
attcctaaggaaggctggcaag

SEQ ID NO: 6941545 - DNA, 22 bp, Homo sapiens
tgcttctctttatttgtaggtt

SEQ ID NO: 6941546 - DNA, 22 bp, Homo sapiens
tgtctgaacaaactctgcctcc

SEQ ID NO: 6941547 - DNA, 22 bp, Homo sapiens
gctttctggttctcaaagcact

SEQ ID NO: 6941548 - DNA, 22 bp, Homo sapiens
agtggatggtcactgatccagt

SEQ ID NO: 6941549 - DNA, 22 bp, Homo sapiens
acattgatgatcccacttacag

SEQ ID NO: 6941550 - DNA, 22 bp, Homo sapiens
tggctgagcctttggggctttc

SEQ ID NO: 6941551 - DNA, 22 bp, Homo sapiens
cacaaagttggacaacgcaccc

SEQ ID NO: 6941552 - DNA, 22 bp, Homo sapiens
tgttccagattcggcgtgggac

SEQ ID NO: 6941553 - DNA, 22 bp, Homo sapiens
acttgtttgcctaaaattttga

SEQ ID NO: 6941554 - DNA, 22 bp, Homo sapiens
agtggctgacaactgggttaac

SEQ ID NO: 6941555 - DNA, 22 bp, Homo sapiens
cacatttatctgttctttctag

SEQ ID NO: 6941556 - DNA, 22 bp, Homo sapiens
caggtcgccagcaggaacgtca

SEQ ID NO: 6941557 - DNA, 22 bp, Homo sapiens
tcaggcagagctgtggagctct

SEQ ID NO: 6941558 - DNA, 22 bp, Homo sapiens
aggcagccaaaaagaagtcctc

SEQ ID NO: 6941559 - DNA, 22 bp, Homo sapiens
aagtcgtggcaggcttgcacga

SEQ ID NO: 6941560 - DNA, 22 bp, Homo sapiens
gggacagctgtagtgcttggct

SEQ ID NO: 6941561 - DNA, 22 bp, Homo sapiens
tagcacaagtatctgcttttcc

SEQ ID NO: 6941562 - DNA, 22 bp, Homo sapiens
ccggcaaaggccccttccccag

SEQ ID NO: 6941563 - DNA, 18 bp, Homo sapiens
ccaggctacttcttggcc

SEQ ID NO: 6941564 - DNA, 22 bp, Homo sapiens
tctgggaaatagaggaccctag

SEQ ID NO: 6941565 - DNA, 22 bp, Homo sapiens
aaagtcatgtttttgtttagca

SEQ ID NO: 6941566 - DNA, 22 bp, Homo sapiens
tgcactttatttcctctcacac

SEQ ID NO: 6941567 - DNA, 22 bp, Homo sapiens
cactgtggttattatcactgtt

SEQ ID NO: 6941568 - DNA, 23 bp, Homo sapiens
tgtcatctccagactcccagtgc

SEQ ID NO: 6941569 - DNA, 22 bp, Homo sapiens
ctcctgtgttcaagcgattctc

SEQ ID NO: 6941570 - DNA, 22 bp, Homo sapiens
ccataatcgtgtgttaaataat

SEQ ID NO: 6941571 - DNA, 18 bp, Homo sapiens
tccctcagaattatagaa

SEQ ID NO: 6941572 - DNA, 22 bp, Homo sapiens
gcccaggctggagtgcagtggt

SEQ ID NO: 6941573 - DNA, 18 bp, Homo sapiens
tctcattacaatctttgt

SEQ ID NO: 6941574 - DNA, 19 bp, Homo sapiens
caggaaacacctactgcta

SEQ ID NO: 6941575 - DNA, 22 bp, Homo sapiens
ttgcttctaagtataaatatga

SEQ ID NO: 6941576 - DNA, 22 bp, Homo sapiens
agcaggaaagaaaaatctgtgt

SEQ ID NO: 6941577 - DNA, 22 bp, Homo sapiens
gcaagattccttgagcctagtt

SEQ ID NO: 6941578 - DNA, 22 bp, Homo sapiens
ttgcatttgtttgagtagaatg

SEQ ID NO: 6941579 - DNA, 21 bp, Homo sapiens
tcattcacagggtattgtata

SEQ ID NO: 6941580 - DNA, 23 bp, Homo sapiens
cccttcagcgagggcattaaggt

SEQ ID NO: 6941581 - DNA, 22 bp, Homo sapiens
tccacgttgcatcaccagtcta

SEQ ID NO: 6941582 - DNA, 22 bp, Homo sapiens
cccaggaatgaggggcggaggc

SEQ ID NO: 6941583 - DNA, 19 bp, Homo sapiens
aggagccttgagcagtgag

SEQ ID NO: 6941584 - DNA, 22 bp, Homo sapiens
gtttatcttaatggactcagag

SEQ ID NO: 6941585 - DNA, 22 bp, Homo sapiens
tatattgggacttcaggacttt

SEQ ID NO: 6941586 - DNA, 22 bp, Homo sapiens
cattgtccctcaatgtctatga

SEQ ID NO: 6941587 - DNA, 22 bp, Homo sapiens
gctgatgtttcaagtatagctt

SEQ ID NO: 6941588 - DNA, 22 bp, Homo sapiens
ggctcagcaatgatgagcccct

SEQ ID NO: 6941589 - DNA, 22 bp, Homo sapiens
aggcttaactacaatttttgcc

SEQ ID NO: 6941590 - DNA, 22 bp, Homo sapiens
aatcctaaatgtcccagtggtt

SEQ ID NO: 6941591 - DNA, 22 bp, Homo sapiens
gttcagatttcatgagtaattg

SEQ ID NO: 6941592 - DNA, 22 bp, Homo sapiens
tgcaacctgacccagccagccc

SEQ ID NO: 6941593 - DNA, 22 bp, Homo sapiens
cctggactcaggctgtgggcac

SEQ ID NO: 6941594 - DNA, 22 bp, Homo sapiens
tcttcaaactgaaaatttagaa

SEQ ID NO: 6941595 - DNA, 22 bp, Homo sapiens
ttgagaaaggtaagaacccaca

SEQ ID NO: 6941596 - DNA, 22 bp, Homo sapiens
tcactttaccaaagtacaggag

SEQ ID NO: 6941597 - DNA, 23 bp, Homo sapiens
gtgactgggtctccacctcttgg

SEQ ID NO: 6941598 - DNA, 22 bp, Homo sapiens
tcagaagtattatgctaaagga

SEQ ID NO: 6941599 - DNA, 22 bp, Homo sapiens
tgtaggtcaagtccattgtgct

SEQ ID NO: 6941600 - DNA, 22 bp, Homo sapiens
gagtgggcaccgtgggcacact

SEQ ID NO: 6941601 - DNA, 22 bp, Homo sapiens
tgaggctaaaggtgaccagatt

SEQ ID NO: 6941602 - DNA, 22 bp, Homo sapiens
gccacatgcaattgcagcacgt

SEQ ID NO: 6941603 - DNA, 22 bp, Homo sapiens
ataggcttatataaaaacatct

SEQ ID NO: 6941604 - DNA, 22 bp, Homo sapiens
ctctgggtgcagcgctgaccgg

SEQ ID NO: 6941605 - DNA, 22 bp, Homo sapiens
gaaaggagggaaacagagcggt

SEQ ID NO: 6941606 - DNA, 22 bp, Homo sapiens
gaagcagtagattcctactcat

SEQ ID NO: 6941607 - DNA, 22 bp, Homo sapiens
cgaccctacagacagtgctgag

SEQ ID NO: 6941608 - DNA, 22 bp, Homo sapiens
tctctgagcgcattcctccggc

SEQ ID NO: 6941609 - DNA, 22 bp, Homo sapiens
aaatactgtgaataaaggtttt

SEQ ID NO: 6941610 - DNA, 22 bp, Homo sapiens
agtgggctggtggcagggagaa

SEQ ID NO: 6941611 - DNA, 22 bp, Homo sapiens
tgcctcctctttgccaaggtca

SEQ ID NO: 6941612 - DNA, 22 bp, Homo sapiens
ttctagcacaagatatgaaagt

SEQ ID NO: 6941613 - DNA, 22 bp, Homo sapiens
tagtccagaaactgagcttata

SEQ ID NO: 6941614 - DNA, 22 bp, Homo sapiens
tacagcacattgtgatggcact

SEQ ID NO: 6941615 - DNA, 22 bp, Homo sapiens
tacacacatgcatttgccttat

SEQ ID NO: 6941616 - DNA, 22 bp, Homo sapiens
agcaggcaggaatggtggaaca

SEQ ID NO: 6941617 - DNA, 22 bp, Homo sapiens
ttcacccaatataactagagga

SEQ ID NO: 6941618 - DNA, 22 bp, Homo sapiens
ctgctttgtgtggtccctccag

SEQ ID NO: 6941619 - DNA, 22 bp, Homo sapiens
ttaaattttagaaacagactct

SEQ ID NO: 6941620 - DNA, 17 bp, Homo sapiens
ttctcctctgtgtcctt

SEQ ID NO: 6941621 - DNA, 22 bp, Homo sapiens
tatgcaacatctggtagaaatc

SEQ ID NO: 6941622 - DNA, 22 bp, Homo sapiens
aatgttacataacccattgtcc

SEQ ID NO: 6941623 - DNA, 22 bp, Homo sapiens
atctgagggtttgggcatcagc

SEQ ID NO: 6941624 - DNA, 22 bp, Homo sapiens
cagtataatgccccctgtgggg

SEQ ID NO: 6941625 - DNA, 22 bp, Homo sapiens
tgcttgactttgtcacagcatg

SEQ ID NO: 6941626 - DNA, 22 bp, Homo sapiens
catcacatctactataagtgat

SEQ ID NO: 6941627 - DNA, 22 bp, Homo sapiens
aggaccatcctaaggtaggcaa

SEQ ID NO: 6941628 - DNA, 22 bp, Homo sapiens
taggaactagtagatgtgtaaa

SEQ ID NO: 6941629 - DNA, 22 bp, Homo sapiens
ccagatctaagtccaaagtact

SEQ ID NO: 6941630 - DNA, 22 bp, Homo sapiens
ggctccatgctgagctttgaat

SEQ ID NO: 6941631 - DNA, 22 bp, Homo sapiens
ccagaggagcatggccttgaga

SEQ ID NO: 6941632 - DNA, 22 bp, Homo sapiens
actatctcttttgtctgcagct

SEQ ID NO: 6941633 - DNA, 22 bp, Homo sapiens
cagacactattgtgtataaatc

SEQ ID NO: 6941634 - DNA, 20 bp, Homo sapiens
ccacatgagctctttctgac

SEQ ID NO: 6941635 - DNA, 22 bp, Homo sapiens
gacttcatgtgcaagcgctttg

SEQ ID NO: 6941636 - DNA, 22 bp, Homo sapiens
acaatgcaccagcatcttcacc

SEQ ID NO: 6941637 - DNA, 22 bp, Homo sapiens
gagccaggtcgggccgcggcga

SEQ ID NO: 6941638 - DNA, 22 bp, Homo sapiens
tgtcaacaccaaagcctcccag

SEQ ID NO: 6941639 - DNA, 22 bp, Homo sapiens
tgaagctagtcaagcttagata

SEQ ID NO: 6941640 - DNA, 22 bp, Homo sapiens
ctgaggtattttattgggctag

SEQ ID NO: 6941641 - DNA, 22 bp, Homo sapiens
ccaccagctttggcggtgacag

SEQ ID NO: 6941642 - DNA, 22 bp, Homo sapiens
tccaaagaacattgctgagacc

SEQ ID NO: 6941643 - DNA, 22 bp, Homo sapiens
ttctctggactatttgcactcc

SEQ ID NO: 6941644 - DNA, 22 bp, Homo sapiens
ggctgccagtgagtgcagaccg

SEQ ID NO: 6941645 - DNA, 22 bp, Homo sapiens
tagctcaaaggttaagtgtgga

SEQ ID NO: 6941646 - DNA, 22 bp, Homo sapiens
aggctgacggcttgcttgtatc

SEQ ID NO: 6941647 - DNA, 22 bp, Homo sapiens
tgggggagcgacagacataatt

SEQ ID NO: 6941648 - DNA, 22 bp, Homo sapiens
tttggagaaaagttgagaccat

SEQ ID NO: 6941649 - DNA, 22 bp, Homo sapiens
tgtgcaggtgcaggaagggggc

SEQ ID NO: 6941650 - DNA, 22 bp, Homo sapiens
gttcttgccagcatcctcaggt

SEQ ID NO: 6941651 - DNA, 22 bp, Homo sapiens
gcagcaaagctcttcatgtgat

SEQ ID NO: 6941652 - DNA, 19 bp, Homo sapiens
tggcatttggaggcaacct

SEQ ID NO: 6941653 - DNA, 22 bp, Homo sapiens
gaagttcaaaagacagatttga

SEQ ID NO: 6941654 - DNA, 22 bp, Homo sapiens
tggagacacaggaccagactgc

SEQ ID NO: 6941655 - DNA, 22 bp, Homo sapiens
ccagtgtttccgtcagtacacg

SEQ ID NO: 6941656 - DNA, 22 bp, Homo sapiens
atgtagagctccttgatcctcc

SEQ ID NO: 6941657 - DNA, 22 bp, Homo sapiens
tgggaaccatgtagctgagatg

SEQ ID NO: 6941658 - DNA, 22 bp, Homo sapiens
ctcccctttggaagaagggtct

SEQ ID NO: 6941659 - DNA, 22 bp, Homo sapiens
gtcagggctccactcaccctcc

SEQ ID NO: 6941660 - DNA, 23 bp, Homo sapiens
tggtccctgggacctttccctgt

SEQ ID NO: 6941661 - DNA, 22 bp, Homo sapiens
aagaggctttcagtgaacttgt

SEQ ID NO: 6941662 - DNA, 22 bp, Homo sapiens
ctgtgctttcgagatgtgatct

SEQ ID NO: 6941663 - DNA, 22 bp, Homo sapiens
acagcagcttcctgactgtact

SEQ ID NO: 6941664 - DNA, 22 bp, Homo sapiens
ggtgtcccaggccagctgtgtg

SEQ ID NO: 6941665 - DNA, 22 bp, Homo sapiens
ggcagctaggggcagggaattc

SEQ ID NO: 6941666 - DNA, 22 bp, Homo sapiens
cagccagtggttgaagatgcag

SEQ ID NO: 6941667 - DNA, 22 bp, Homo sapiens
atatcacaaacaagtctgtact

SEQ ID NO: 6941668 - DNA, 22 bp, Homo sapiens
aggccgaactccaactcctggg

SEQ ID NO: 6941669 - DNA, 22 bp, Homo sapiens
tttgggttaagagatggtacca

SEQ ID NO: 6941670 - DNA, 22 bp, Homo sapiens
gctgggccagccagacatgtga

SEQ ID NO: 6941671 - DNA, 19 bp, Homo sapiens
tccacagtggttgaactag

SEQ ID NO: 6941672 - DNA, 22 bp, Homo sapiens
acagaaagataggcacaaggtc

SEQ ID NO: 6941673 - DNA, 22 bp, Homo sapiens
catgtggtattgtgagatccac

SEQ ID NO: 6941674 - DNA, 22 bp, Homo sapiens
ttacccacatttgggagtatat

SEQ ID NO: 6941675 - DNA, 16 bp, Homo sapiens
agaggccttgaggaag

SEQ ID NO: 6941676 - DNA, 22 bp, Homo sapiens
cactgtattattaggaatgaca

SEQ ID NO: 6941677 - DNA, 22 bp, Homo sapiens
acagaatttacacatctctaaa

SEQ ID NO: 6941678 - DNA, 22 bp, Homo sapiens
gcataaaggactataaggatca

SEQ ID NO: 6941679 - DNA, 22 bp, Homo sapiens
gaaagaccagcatgaggcttta

SEQ ID NO: 6941680 - DNA, 22 bp, Homo sapiens
acctgcccagactcagatccta

SEQ ID NO: 6941681 - DNA, 22 bp, Homo sapiens
gagagagctctgtgcctgggat

SEQ ID NO: 6941682 - DNA, 22 bp, Homo sapiens
acgtgaactgtttttggagatt

SEQ ID NO: 6941683 - DNA, 22 bp, Homo sapiens
tgtcaaagatgtctttgaaaat

SEQ ID NO: 6941684 - DNA, 22 bp, Homo sapiens
atttcagggatgtctgtaaatt

SEQ ID NO: 6941685 - DNA, 22 bp, Homo sapiens
acagtggagctcagatgaaaat

SEQ ID NO: 6941686 - DNA, 22 bp, Homo sapiens
gcagcctctgatgatggccgta

SEQ ID NO: 6941687 - DNA, 22 bp, Homo sapiens
agctaattagaaatagattatt

SEQ ID NO: 6941688 - DNA, 18 bp, Homo sapiens
ctgtgccctgctcctact

SEQ ID NO: 6941689 - DNA, 22 bp, Homo sapiens
gtgactctcactttacctgact

SEQ ID NO: 6941690 - DNA, 22 bp, Homo sapiens
aacctgttttggttgcatttca

SEQ ID NO: 6941691 - DNA, 21 bp, Homo sapiens
aaggtagcatgggttgcagcc

SEQ ID NO: 6941692 - DNA, 22 bp, Homo sapiens
ggagactcaccccgcattctag

SEQ ID NO: 6941693 - DNA, 22 bp, Homo sapiens
agactctgaggagccctgagac

SEQ ID NO: 6941694 - DNA, 22 bp, Homo sapiens
aatacttttgaactgaaaggca

SEQ ID NO: 6941695 - DNA, 18 bp, Homo sapiens
ggctcaagtgatcctcct

SEQ ID NO: 6941696 - DNA, 19 bp, Homo sapiens
tccaggagcaaagccagtt

SEQ ID NO: 6941697 - DNA, 22 bp, Homo sapiens
tgcaaaggggacagagtccact

SEQ ID NO: 6941698 - DNA, 22 bp, Homo sapiens
gcactgggaatgtgagcagctg

SEQ ID NO: 6941699 - DNA, 22 bp, Homo sapiens
tgaagagtgattcatgcagtca

SEQ ID NO: 6941700 - DNA, 22 bp, Homo sapiens
aaggcccttccaccagtcctcg

SEQ ID NO: 6941701 - DNA, 22 bp, Homo sapiens
tacattgtctgcaattttctct

SEQ ID NO: 6941702 - DNA, 22 bp, Homo sapiens
ggctgagctcaggggcagcagg

SEQ ID NO: 6941703 - DNA, 22 bp, Homo sapiens
tactagtcttctgctattccct

SEQ ID NO: 6941704 - DNA, 22 bp, Homo sapiens
acttttatcaaggaagtgatct

SEQ ID NO: 6941705 - DNA, 22 bp, Homo sapiens
aaagtgtagagtgcctcaaaat

SEQ ID NO: 6941706 - DNA, 22 bp, Homo sapiens
cttggaaagaatatatgatgct

SEQ ID NO: 6941707 - DNA, 22 bp, Homo sapiens
gatgcacttgcccctcctcaga

SEQ ID NO: 6941708 - DNA, 22 bp, Homo sapiens
gggctgcttttttcttagcaga

SEQ ID NO: 6941709 - DNA, 22 bp, Homo sapiens
acaaggaggatatgtttaaggg

SEQ ID NO: 6941710 - DNA, 22 bp, Homo sapiens
attccacagccgataccatgac

SEQ ID NO: 6941711 - DNA, 22 bp, Homo sapiens
cctgggaatctgcattgtcagc

SEQ ID NO: 6941712 - DNA, 22 bp, Homo sapiens
aggcacaggtggacttcacagt

SEQ ID NO: 6941713 - DNA, 22 bp, Homo sapiens
gcctgctggatcaagcttatgc

SEQ ID NO: 6941714 - DNA, 22 bp, Homo sapiens
tgtggcagatacagaagatcaa

SEQ ID NO: 6941715 - DNA, 22 bp, Homo sapiens
ccagaggttacaccctcagccc

SEQ ID NO: 6941716 - DNA, 22 bp, Homo sapiens
gaagttctgaaataaaatcctg

SEQ ID NO: 6941717 - DNA, 22 bp, Homo sapiens
gtctgacttgcgggcactctgg

SEQ ID NO: 6941718 - DNA, 22 bp, Homo sapiens
gtacaggaaggagggagtttca

SEQ ID NO: 6941719 - DNA, 22 bp, Homo sapiens
ggcccttgcagcaggcgctggc

SEQ ID NO: 6941720 - DNA, 22 bp, Homo sapiens
gccttcccaccctgcgaggctg

SEQ ID NO: 6941721 - DNA, 22 bp, Homo sapiens
ctttggaagccaggcagttcac

SEQ ID NO: 6941722 - DNA, 22 bp, Homo sapiens
aggctctgtgcatcctccccaa

SEQ ID NO: 6941723 - DNA, 22 bp, Homo sapiens
gtaatgatgtctgagaagtatg

SEQ ID NO: 6941724 - DNA, 22 bp, Homo sapiens
agaaatgctcttcctgaccaga

SEQ ID NO: 6941725 - DNA, 21 bp, Homo sapiens
gccagcggccgccctccagga

SEQ ID NO: 6941726 - DNA, 22 bp, Homo sapiens
ttggcagtgatgcagcttgttc

SEQ ID NO: 6941727 - DNA, 22 bp, Homo sapiens
tgtgtgaggtggttctgagaag

SEQ ID NO: 6941728 - DNA, 22 bp, Homo sapiens
cttctattcactggtcacagtt

SEQ ID NO: 6941729 - DNA, 18 bp, Homo sapiens
gtctgccaacaactatca

SEQ ID NO: 6941730 - DNA, 22 bp, Homo sapiens
gggctctggaaatgggagctcc

SEQ ID NO: 6941731 - DNA, 22 bp, Homo sapiens
gagctgtgacacgcagcccagg

SEQ ID NO: 6941732 - DNA, 22 bp, Homo sapiens
atttgtgttgtattaagctgct

SEQ ID NO: 6941733 - DNA, 21 bp, Homo sapiens
actggccaccactggcagggg

SEQ ID NO: 6941734 - DNA, 22 bp, Homo sapiens
agtgtgtagcatttggcaggca

SEQ ID NO: 6941735 - DNA, 22 bp, Homo sapiens
atgtttcccttctgatttggga

SEQ ID NO: 6941736 - DNA, 22 bp, Homo sapiens
gctgtgaaaagaaaagccgtca

SEQ ID NO: 6941737 - DNA, 22 bp, Homo sapiens
ctccctggaggcccagacctgg

SEQ ID NO: 6941738 - DNA, 22 bp, Homo sapiens
ctcatcataaccctgtgaggat

SEQ ID NO: 6941739 - DNA, 22 bp, Homo sapiens
gcaggaacccggccgccctggc

SEQ ID NO: 6941740 - DNA, 22 bp, Homo sapiens
gcagaggagatgaagatacttt

SEQ ID NO: 6941741 - DNA, 22 bp, Homo sapiens
tgttgactcaacactgtgggca

SEQ ID NO: 6941742 - DNA, 22 bp, Homo sapiens
acagctgggaactcacacagca

SEQ ID NO: 6941743 - DNA, 22 bp, Homo sapiens
cctacagagcagcaggaccaga

SEQ ID NO: 6941744 - DNA, 23 bp, Homo sapiens
tgcaaagcacttaagaggccctg

SEQ ID NO: 6941745 - DNA, 22 bp, Homo sapiens
cagtaaatttgagggatctaat

SEQ ID NO: 6941746 - DNA, 22 bp, Homo sapiens
aatagttctagctcagaagctc

SEQ ID NO: 6941747 - DNA, 22 bp, Homo sapiens
atggagggtggtaagacagaga

SEQ ID NO: 6941748 - DNA, 22 bp, Homo sapiens
tcaccagacagttactgcatgt

SEQ ID NO: 6941749 - DNA, 22 bp, Homo sapiens
taaagtgctgggattataggcc

SEQ ID NO: 6941750 - DNA, 22 bp, Homo sapiens
tttagtgcctggtttccttctt

SEQ ID NO: 6941751 - DNA, 22 bp, Homo sapiens
gcttctggaagctgcttctgcc

SEQ ID NO: 6941752 - DNA, 21 bp, Homo sapiens
tggcatttgtacagggacttt

SEQ ID NO: 6941753 - DNA, 22 bp, Homo sapiens
tggggcgcccccactccacaga

SEQ ID NO: 6941754 - DNA, 22 bp, Homo sapiens
tacaagagcagtaagcttgtcc

SEQ ID NO: 6941755 - DNA, 18 bp, Homo sapiens
agagaaagaccaaagcat

SEQ ID NO: 6941756 - DNA, 23 bp, Homo sapiens
tgctgcccgcttggcacgctccc

SEQ ID NO: 6941757 - DNA, 22 bp, Homo sapiens
gacacagttccctatgaggtaa

SEQ ID NO: 6941758 - DNA, 22 bp, Homo sapiens
acagggcatttcctctatgtgt

SEQ ID NO: 6941759 - DNA, 21 bp, Homo sapiens
aaagcagcccatggcacagtc

SEQ ID NO: 6941760 - DNA, 22 bp, Homo sapiens
tcagtcattgtccttaaaacac

SEQ ID NO: 6941761 - DNA, 22 bp, Homo sapiens
agctggtatttgttagggagtt

SEQ ID NO: 6941762 - DNA, 22 bp, Homo sapiens
tgacagctgccacaaaggccat

SEQ ID NO: 6941763 - DNA, 22 bp, Homo sapiens
cagtccagagtatatccgcttt

SEQ ID NO: 6941764 - DNA, 22 bp, Homo sapiens
tctttgcactgtgcaagcagaa

SEQ ID NO: 6941765 - DNA, 22 bp, Homo sapiens
agtgtatgcaggttttcaatgt

SEQ ID NO: 6941766 - DNA, 22 bp, Homo sapiens
tacaaaggcggtttttctgggc

SEQ ID NO: 6941767 - DNA, 22 bp, Homo sapiens
ggtgaggcctgtacaaagctgc

SEQ ID NO: 6941768 - DNA, 22 bp, Homo sapiens
aggagaccttttgagtgtgaga

SEQ ID NO: 6941769 - DNA, 22 bp, Homo sapiens
gaggtatgtatgctacattctt

SEQ ID NO: 6941770 - DNA, 22 bp, Homo sapiens
tgccttgctggatgtcagtttt

SEQ ID NO: 6941771 - DNA, 18 bp, Homo sapiens
atgagaggtgtcagaaga

SEQ ID NO: 6941772 - DNA, 22 bp, Homo sapiens
tatttaactggaaacacaatga

SEQ ID NO: 6941773 - DNA, 22 bp, Homo sapiens
agcagaaaactttcatgctctg

SEQ ID NO: 6941774 - DNA, 22 bp, Homo sapiens
acagttctgcaagatatttttt

SEQ ID NO: 6941775 - DNA, 22 bp, Homo sapiens
ttaatacagtctccagaagtaa

SEQ ID NO: 6941776 - DNA, 22 bp, Homo sapiens
gccctgtggttccaggaagcaa

SEQ ID NO: 6941777 - DNA, 22 bp, Homo sapiens
gggctgtgctgagtaggaggtg

SEQ ID NO: 6941778 - DNA, 22 bp, Homo sapiens
agtccgcctgctgccgtggcag

SEQ ID NO: 6941779 - DNA, 22 bp, Homo sapiens
aatcagcagttggaattagata

SEQ ID NO: 6941780 - DNA, 22 bp, Homo sapiens
tgttacatcgttggctaggaga

SEQ ID NO: 6941781 - DNA, 22 bp, Homo sapiens
ggtccagagtccttgctagaga

SEQ ID NO: 6941782 - DNA, 22 bp, Homo sapiens
agagctatatacagattattga

SEQ ID NO: 6941783 - DNA, 22 bp, Homo sapiens
tggggacttgccttgttgctca

SEQ ID NO: 6941784 - DNA, 22 bp, Homo sapiens
aagggcatgagaagcttgaaag

SEQ ID NO: 6941785 - DNA, 22 bp, Homo sapiens
taaatgagggctgacatgattg

SEQ ID NO: 6941786 - DNA, 22 bp, Homo sapiens
tagatgcttgggcaaaggtaga

SEQ ID NO: 6941787 - DNA, 22 bp, Homo sapiens
agtctgcaaatatgttcatgtg

SEQ ID NO: 6941788 - DNA, 21 bp, Homo sapiens
gcctgctgttcaccctgccac

SEQ ID NO: 6941789 - DNA, 22 bp, Homo sapiens
gctggtctccgccgctccctga

SEQ ID NO: 6941790 - DNA, 22 bp, Homo sapiens
gcataatatacatgcttgatcc

SEQ ID NO: 6941791 - DNA, 22 bp, Homo sapiens
gtgggtgtcctgtgaaggctca

SEQ ID NO: 6941792 - DNA, 22 bp, Homo sapiens
atccttgacacactccagtact

SEQ ID NO: 6941793 - DNA, 22 bp, Homo sapiens
caatcaatgctgctagttcctt

SEQ ID NO: 6941794 - DNA, 22 bp, Homo sapiens
atgaatgagtgctaggtttgtc

SEQ ID NO: 6941795 - DNA, 22 bp, Homo sapiens
atggtggactcttgattcaggc

SEQ ID NO: 6941796 - DNA, 22 bp, Homo sapiens
ttcacaatggcaaaccattaaa

SEQ ID NO: 6941797 - DNA, 21 bp, Homo sapiens
tatttcagaagagtctcagag

SEQ ID NO: 6941798 - DNA, 22 bp, Homo sapiens
agtttggaagagaaaaatattt

SEQ ID NO: 6941799 - DNA, 22 bp, Homo sapiens
gattttgaatattaaagaagag

SEQ ID NO: 6941800 - DNA, 22 bp, Homo sapiens
ctgagcctccaggaggggggtg

SEQ ID NO: 6941801 - DNA, 19 bp, Homo sapiens
tctaaacacagggacaagc

SEQ ID NO: 6941802 - DNA, 21 bp, Homo sapiens
tggacatttacccttcaggga

SEQ ID NO: 6941803 - DNA, 22 bp, Homo sapiens
ccatcctatctgacctacttgt

SEQ ID NO: 6941804 - DNA, 22 bp, Homo sapiens
tgacaagctttacagaattgaa

SEQ ID NO: 6941805 - DNA, 22 bp, Homo sapiens
tgaaggcattgatgaaggaatc

SEQ ID NO: 6941806 - DNA, 22 bp, Homo sapiens
tctgagaaatttctttgtgatg

SEQ ID NO: 6941807 - DNA, 23 bp, Homo sapiens
tatggctcataaaacagagcagg

SEQ ID NO: 6941808 - DNA, 22 bp, Homo sapiens
catttgctgtaatgacaataag

SEQ ID NO: 6941809 - DNA, 21 bp, Homo sapiens
tccagcctttccctcacttcc

SEQ ID NO: 6941810 - DNA, 22 bp, Homo sapiens
tcctggatttaaccctggctct

SEQ ID NO: 6941811 - DNA, 22 bp, Homo sapiens
acactctacagagcaatctacc

SEQ ID NO: 6941812 - DNA, 22 bp, Homo sapiens
ccagcttcggcaagcagacttt

SEQ ID NO: 6941813 - DNA, 22 bp, Homo sapiens
tttatatgtattgactttgatg

SEQ ID NO: 6941814 - DNA, 22 bp, Homo sapiens
attattcattggtaggcaagct

SEQ ID NO: 6941815 - DNA, 22 bp, Homo sapiens
cactggaggtcagtggagcact

SEQ ID NO: 6941816 - DNA, 22 bp, Homo sapiens
tgcagagagttagggcccgtat

SEQ ID NO: 6941817 - DNA, 22 bp, Homo sapiens
taaaggaactgctgctatggaa

SEQ ID NO: 6941818 - DNA, 22 bp, Homo sapiens
aaggccaccaccagcgaggggg

SEQ ID NO: 6941819 - DNA, 22 bp, Homo sapiens
ttttagcacactttctttagcg

SEQ ID NO: 6941820 - DNA, 22 bp, Homo sapiens
gaagagctggaatccagtctgg

SEQ ID NO: 6941821 - DNA, 22 bp, Homo sapiens
gaggtcttgtctgatagggaaa

SEQ ID NO: 6941822 - DNA, 22 bp, Homo sapiens
tgaaatgagcatttattcttta

SEQ ID NO: 6941823 - DNA, 22 bp, Homo sapiens
agatcaagcactgtgcaaaaat

SEQ ID NO: 6941824 - DNA, 22 bp, Homo sapiens
tgtgaatggacaattaaatcta

SEQ ID NO: 6941825 - DNA, 22 bp, Homo sapiens
gccagatattcagaggtgaaag

SEQ ID NO: 6941826 - DNA, 22 bp, Homo sapiens
tgtcattttgtctcactgctat

SEQ ID NO: 6941827 - DNA, 22 bp, Homo sapiens
ctttagtggaagggtggttaat

SEQ ID NO: 6941828 - DNA, 23 bp, Homo sapiens
tttgaacatttctagattacata

SEQ ID NO: 6941829 - DNA, 22 bp, Homo sapiens
gcagaggcatttctgacgctgc

SEQ ID NO: 6941830 - DNA, 22 bp, Homo sapiens
accagcaagattttgctttgca

SEQ ID NO: 6941831 - DNA, 22 bp, Homo sapiens
tctatgtcactctttggaaaga

SEQ ID NO: 6941832 - DNA, 22 bp, Homo sapiens
cttggaaagttatcattttcct

SEQ ID NO: 6941833 - DNA, 22 bp, Homo sapiens
tggggttctttgtttcctgcct

SEQ ID NO: 6941834 - DNA, 22 bp, Homo sapiens
agggctctcttggacaactgct

SEQ ID NO: 6941835 - DNA, 22 bp, Homo sapiens
tttcaacatataccataatgcc

SEQ ID NO: 6941836 - DNA, 22 bp, Homo sapiens
aaaattgtaggaactgaatcaa

SEQ ID NO: 6941837 - DNA, 22 bp, Homo sapiens
gctgccagccaacttgctgtgc

SEQ ID NO: 6941838 - DNA, 22 bp, Homo sapiens
catctgtaggtgacacatgagt

SEQ ID NO: 6941839 - DNA, 22 bp, Homo sapiens
tgggcagactaaggtcaaagct

SEQ ID NO: 6941840 - DNA, 22 bp, Homo sapiens
ttgagttcaggggttgattgga

SEQ ID NO: 6941841 - DNA, 23 bp, Homo sapiens
atcaagtcatcagcaaaatacat

SEQ ID NO: 6941842 - DNA, 22 bp, Homo sapiens
ttgcctttcccatgtctaggag

SEQ ID NO: 6941843 - DNA, 22 bp, Homo sapiens
agaatctaagtacacagacaga

SEQ ID NO: 6941844 - DNA, 22 bp, Homo sapiens
tctacatgcagcgaggggactt

SEQ ID NO: 6941845 - DNA, 22 bp, Homo sapiens
ataaattttcttgctgtactta

SEQ ID NO: 6941846 - DNA, 22 bp, Homo sapiens
acccagagctgggcttggcaaa

SEQ ID NO: 6941847 - DNA, 23 bp, Homo sapiens
gtgtgcctttatcttctgtactc

SEQ ID NO: 6941848 - DNA, 22 bp, Homo sapiens
gacagtgagtacctcaaaggcc

SEQ ID NO: 6941849 - DNA, 22 bp, Homo sapiens
agtagacaatatggatttaatg

SEQ ID NO: 6941850 - DNA, 22 bp, Homo sapiens
agccagggctgcgagcagacag

SEQ ID NO: 6941851 - DNA, 22 bp, Homo sapiens
actgagtgggaggtttgtgtga

SEQ ID NO: 6941852 - DNA, 22 bp, Homo sapiens
cagggatgctgcttaggcagtt

SEQ ID NO: 6941853 - DNA, 22 bp, Homo sapiens
atgtataagtacacagtcggaa

SEQ ID NO: 6941854 - DNA, 22 bp, Homo sapiens
tactgaaggacttgagggtttc

SEQ ID NO: 6941855 - DNA, 22 bp, Homo sapiens
ttgctgaagaaaaaatatgtta

SEQ ID NO: 6941856 - DNA, 22 bp, Homo sapiens
tgttcattctgtatatgctgta

SEQ ID NO: 6941857 - DNA, 22 bp, Homo sapiens
gtttcacatgaaacttggggaa

SEQ ID NO: 6941858 - DNA, 21 bp, Homo sapiens
tagggggcagtgggatgctta

SEQ ID NO: 6941859 - DNA, 22 bp, Homo sapiens
tagatgaatgtgaaaggctctt

SEQ ID NO: 6941860 - DNA, 22 bp, Homo sapiens
ctgttttctacagtctgggtct

SEQ ID NO: 6941861 - DNA, 22 bp, Homo sapiens
catttacataacagtaacgctg

SEQ ID NO: 6941862 - DNA, 22 bp, Homo sapiens
cacagaggaaaggcagttggta

SEQ ID NO: 6941863 - DNA, 22 bp, Homo sapiens
tgggtggtggcagtaatgagaa

SEQ ID NO: 6941864 - DNA, 22 bp, Homo sapiens
tatgagaaattgctgatatttg

SEQ ID NO: 6941865 - DNA, 22 bp, Homo sapiens
gtgaatgccgcagtctgttgct

SEQ ID NO: 6941866 - DNA, 22 bp, Homo sapiens
tctggcttctcctagagcaatg

SEQ ID NO: 6941867 - DNA, 22 bp, Homo sapiens
ccaagaggtatcttgccataaa

SEQ ID NO: 6941868 - DNA, 22 bp, Homo sapiens
cactgcaacctctgcctcctgg

SEQ ID NO: 6941869 - DNA, 22 bp, Homo sapiens
ctcagctagtaacgtacatgtc

SEQ ID NO: 6941870 - DNA, 23 bp, Homo sapiens
aagcattcgccttcaccctcctc

SEQ ID NO: 6941871 - DNA, 22 bp, Homo sapiens
tgggttgtctttgtctccactt

SEQ ID NO: 6941872 - DNA, 22 bp, Homo sapiens
gagtcacaaagcctttcttatt

SEQ ID NO: 6941873 - DNA, 22 bp, Homo sapiens
ttaatgtcactgttttctgggc

SEQ ID NO: 6941874 - DNA, 18 bp, Homo sapiens
gggctgtgagatgggaag

SEQ ID NO: 6941875 - DNA, 22 bp, Homo sapiens
aagaggcagcccgctgaggctg

SEQ ID NO: 6941876 - DNA, 22 bp, Homo sapiens
gtacagcatttgaaattactgg

SEQ ID NO: 6941877 - DNA, 22 bp, Homo sapiens
acacagggctgcgcctgacccc

SEQ ID NO: 6941878 - DNA, 22 bp, Homo sapiens
ctgtacaggtcaatgataagat

SEQ ID NO: 6941879 - DNA, 18 bp, Homo sapiens
tctgtctgtacaagtatc

SEQ ID NO: 6941880 - DNA, 22 bp, Homo sapiens
aacaggctccttgtgaatggat

SEQ ID NO: 6941881 - DNA, 22 bp, Homo sapiens
aacactgacgacgtgaactaaa

SEQ ID NO: 6941882 - DNA, 22 bp, Homo sapiens
tagacaggagtcaggctagaat

SEQ ID NO: 6941883 - DNA, 22 bp, Homo sapiens
atacagtgagaataattcttag

SEQ ID NO: 6941884 - DNA, 22 bp, Homo sapiens
agagggtatgagtggggctaaa

SEQ ID NO: 6941885 - DNA, 20 bp, Homo sapiens
ggaggcgctgggctcgcgct

SEQ ID NO: 6941886 - DNA, 22 bp, Homo sapiens
tattactaccatctgctactat

SEQ ID NO: 6941887 - DNA, 17 bp, Homo sapiens
agagttttaagaaattt

SEQ ID NO: 6941888 - DNA, 22 bp, Homo sapiens
gcttcagtttaggggttaattg

SEQ ID NO: 6941889 - DNA, 22 bp, Homo sapiens
ggttggtgagtgcagggtgtta

SEQ ID NO: 6941890 - DNA, 20 bp, Homo sapiens
agaaggcattcctcattctt

SEQ ID NO: 6941891 - DNA, 22 bp, Homo sapiens
tcagcttgctaaaagggcatct

SEQ ID NO: 6941892 - DNA, 22 bp, Homo sapiens
ctcttaaagaatgttccagctg

SEQ ID NO: 6941893 - DNA, 22 bp, Homo sapiens
cagctctcacacttagcttcta

SEQ ID NO: 6941894 - DNA, 22 bp, Homo sapiens
aagctcagcatgtctcctagaa

SEQ ID NO: 6941895 - DNA, 22 bp, Homo sapiens
caaatactgagtttattttcaa

SEQ ID NO: 6941896 - DNA, 22 bp, Homo sapiens
taccttcaccagcgaatgtttg

SEQ ID NO: 6941897 - DNA, 22 bp, Homo sapiens
tatatgtctgtaactttgtcta

SEQ ID NO: 6941898 - DNA, 22 bp, Homo sapiens
ttaggaaatcactttgctcacc

SEQ ID NO: 6941899 - DNA, 22 bp, Homo sapiens
gtctcaagggggaactcactgt

SEQ ID NO: 6941900 - DNA, 22 bp, Homo sapiens
aaaccttttcagctgaatggag

SEQ ID NO: 6941901 - DNA, 22 bp, Homo sapiens
agatttgtcctgctttctacct

SEQ ID NO: 6941902 - DNA, 22 bp, Homo sapiens
gcctggctggtcactgcctggc

SEQ ID NO: 6941903 - DNA, 22 bp, Homo sapiens
gtggcctgagcttcagagttgg

SEQ ID NO: 6941904 - DNA, 22 bp, Homo sapiens
agagttgttgtacaaactaaat

SEQ ID NO: 6941905 - DNA, 22 bp, Homo sapiens
tagtttctagacagtaagaatt

SEQ ID NO: 6941906 - DNA, 22 bp, Homo sapiens
gtccatctgtcacttatagtcg

SEQ ID NO: 6941907 - DNA, 22 bp, Homo sapiens
tctctacacaggattcacatga

SEQ ID NO: 6941908 - DNA, 22 bp, Homo sapiens
ggaagaggctctcattgagggc

SEQ ID NO: 6941909 - DNA, 22 bp, Homo sapiens
cacggaaacacaggttataaga

SEQ ID NO: 6941910 - DNA, 22 bp, Homo sapiens
gtgagcatgtagtaatctggag

SEQ ID NO: 6941911 - DNA, 22 bp, Homo sapiens
tacaaagcagttccaacacgaa

SEQ ID NO: 6941912 - DNA, 22 bp, Homo sapiens
agtgcatgcgcttgggaggggt

SEQ ID NO: 6941913 - DNA, 22 bp, Homo sapiens
ctggatctgtcccctttttgtt

SEQ ID NO: 6941914 - DNA, 22 bp, Homo sapiens
tctccgatcacaggttttcaat

SEQ ID NO: 6941915 - DNA, 22 bp, Homo sapiens
cagagggagccctccaggagca

SEQ ID NO: 6941916 - DNA, 22 bp, Homo sapiens
gcattgagtccactctgtcttt

SEQ ID NO: 6941917 - DNA, 22 bp, Homo sapiens
aatcaggccgaggacatcagcc

SEQ ID NO: 6941918 - DNA, 22 bp, Homo sapiens
tttctcagtagtaatggcagtc

SEQ ID NO: 6941919 - DNA, 20 bp, Homo sapiens
tcagcatgttctcctccggt

SEQ ID NO: 6941920 - DNA, 22 bp, Homo sapiens
tgcattcctccacctcctgcac

SEQ ID NO: 6941921 - DNA, 22 bp, Homo sapiens
tgagataataaacatctcctta

SEQ ID NO: 6941922 - DNA, 22 bp, Homo sapiens
agcacctattatgtgccaggaa

SEQ ID NO: 6941923 - DNA, 22 bp, Homo sapiens
atcctgttgctggctcattttg

SEQ ID NO: 6941924 - DNA, 22 bp, Homo sapiens
atctcttctcccaacacctggc

SEQ ID NO: 6941925 - DNA, 22 bp, Homo sapiens
ctgatgtttctagatgcttgcc

SEQ ID NO: 6941926 - DNA, 22 bp, Homo sapiens
agattacaaatcctctgtgttt

SEQ ID NO: 6941927 - DNA, 22 bp, Homo sapiens
ggtggcagggagtgtccctggg

SEQ ID NO: 6941928 - DNA, 22 bp, Homo sapiens
caaggaaaacagatgatcaaca

SEQ ID NO: 6941929 - DNA, 22 bp, Homo sapiens
tgtgtgaagggaagatagaggt

SEQ ID NO: 6941930 - DNA, 22 bp, Homo sapiens
tctcacagaggcttgggctcat

SEQ ID NO: 6941931 - DNA, 22 bp, Homo sapiens
tttgatgatgatgataaagttt

SEQ ID NO: 6941932 - DNA, 22 bp, Homo sapiens
ttacaatgatgggattcagcca

SEQ ID NO: 6941933 - DNA, 22 bp, Homo sapiens
gtgctatgtgctaggcactgaa

SEQ ID NO: 6941934 - DNA, 22 bp, Homo sapiens
gtggagcacggaggaggcccct

SEQ ID NO: 6941935 - DNA, 22 bp, Homo sapiens
gaaatacaaagccagccatttt

SEQ ID NO: 6941936 - DNA, 22 bp, Homo sapiens
actagtctgccagggagaggca

SEQ ID NO: 6941937 - DNA, 22 bp, Homo sapiens
acacttcaggactctggggcaa

SEQ ID NO: 6941938 - DNA, 22 bp, Homo sapiens
agtgctctgtcattggtgggat

SEQ ID NO: 6941939 - DNA, 22 bp, Homo sapiens
tgaggcagctttttctgtgtgt

SEQ ID NO: 6941940 - DNA, 22 bp, Homo sapiens
ctgagcagcaccttcaagaaac

SEQ ID NO: 6941941 - DNA, 22 bp, Homo sapiens
cctgtaggaacgccttcatttg

SEQ ID NO: 6941942 - DNA, 22 bp, Homo sapiens
gttaacaacactgtgagtgctg

SEQ ID NO: 6941943 - DNA, 19 bp, Homo sapiens
aggcatgggaagagaagtc

SEQ ID NO: 6941944 - DNA, 22 bp, Homo sapiens
ttctggcagattgcgtaataaa

SEQ ID NO: 6941945 - DNA, 22 bp, Homo sapiens
gagcaggaacagatcccttgga

SEQ ID NO: 6941946 - DNA, 22 bp, Homo sapiens
gccgtccacgtgacccaagaag

SEQ ID NO: 6941947 - DNA, 22 bp, Homo sapiens
cagggtcttggcgccatcaccc

SEQ ID NO: 6941948 - DNA, 22 bp, Homo sapiens
cctgggctcaccatgccttgga

SEQ ID NO: 6941949 - DNA, 22 bp, Homo sapiens
ggccctctttagacagagtagg

SEQ ID NO: 6941950 - DNA, 22 bp, Homo sapiens
ctggttcatataggcaagttta

SEQ ID NO: 6941951 - DNA, 22 bp, Homo sapiens
ggaagctccccaagcctgccct

SEQ ID NO: 6941952 - DNA, 22 bp, Homo sapiens
tacacaggctgcctctttgcat

SEQ ID NO: 6941953 - DNA, 22 bp, Homo sapiens
tcaggtccccaactcttctcac

SEQ ID NO: 6941954 - DNA, 22 bp, Homo sapiens
taacaaactggaaattgacatt

SEQ ID NO: 6941955 - DNA, 22 bp, Homo sapiens
attcacaaataacaggtgcaga

SEQ ID NO: 6941956 - DNA, 22 bp, Homo sapiens
aaccagtcccagtgagatgaac

SEQ ID NO: 6941957 - DNA, 20 bp, Homo sapiens
gagctacacaaatgctgctt

SEQ ID NO: 6941958 - DNA, 22 bp, Homo sapiens
tcattcattcatccagcttgag

SEQ ID NO: 6941959 - DNA, 22 bp, Homo sapiens
ttgtcccattgcgaatgtgagt

SEQ ID NO: 6941960 - DNA, 21 bp, Homo sapiens
aggaagatctggaggtcggcg

SEQ ID NO: 6941961 - DNA, 22 bp, Homo sapiens
cagagcataattgacatgaggt

SEQ ID NO: 6941962 - DNA, 21 bp, Homo sapiens
atttcagagcacacaagtaaa

SEQ ID NO: 6941963 - DNA, 23 bp, Homo sapiens
tctgccagttccttgatcatgga

SEQ ID NO: 6941964 - DNA, 22 bp, Homo sapiens
tagatggacgtcaagtctactc

SEQ ID NO: 6941965 - DNA, 22 bp, Homo sapiens
atttagaagctaatttttcaga

SEQ ID NO: 6941966 - DNA, 19 bp, Homo sapiens
ggccactcctggtgactgg

SEQ ID NO: 6941967 - DNA, 22 bp, Homo sapiens
tcttttcttgcattattgcact

SEQ ID NO: 6941968 - DNA, 22 bp, Homo sapiens
tagccttttgggaagggctatt

SEQ ID NO: 6941969 - DNA, 20 bp, Homo sapiens
aggctctgcctgcaggccca

SEQ ID NO: 6941970 - DNA, 22 bp, Homo sapiens
cacagaactggttaatagcaga

SEQ ID NO: 6941971 - DNA, 22 bp, Homo sapiens
agaaatgacaagactgatcagg

SEQ ID NO: 6941972 - DNA, 22 bp, Homo sapiens
ttcattgtgtctatttttatct

SEQ ID NO: 6941973 - DNA, 22 bp, Homo sapiens
attagaagatagtgatttctgc

SEQ ID NO: 6941974 - DNA, 22 bp, Homo sapiens
cagtttctgttttaaatagcag

SEQ ID NO: 6941975 - DNA, 22 bp, Homo sapiens
ccaggcctgattgggaatcttg

SEQ ID NO: 6941976 - DNA, 22 bp, Homo sapiens
attagaactaggctaagtaaaa

SEQ ID NO: 6941977 - DNA, 22 bp, Homo sapiens
tgcaggtggatatctcatcaga

SEQ ID NO: 6941978 - DNA, 22 bp, Homo sapiens
tcttttctgtaactcagtgtct

SEQ ID NO: 6941979 - DNA, 22 bp, Homo sapiens
gctggctttgtggtctctcctc

SEQ ID NO: 6941980 - DNA, 22 bp, Homo sapiens
tgggaagatggagtgacaggca

SEQ ID NO: 6941981 - DNA, 22 bp, Homo sapiens
gaggaaaatggagtgtaattaa

SEQ ID NO: 6941982 - DNA, 22 bp, Homo sapiens
caggactggaagtctcaagaga

SEQ ID NO: 6941983 - DNA, 22 bp, Homo sapiens
atgagctgggccatccagtgat

SEQ ID NO: 6941984 - DNA, 22 bp, Homo sapiens
aatgcttataacgttagaatgt

SEQ ID NO: 6941985 - DNA, 22 bp, Homo sapiens
catgggctcttctggactgcac

SEQ ID NO: 6941986 - DNA, 22 bp, Homo sapiens
gtgccaccagatgctgttgcta

SEQ ID NO: 6941987 - DNA, 22 bp, Homo sapiens
aaagcagtataagtaacggaag

SEQ ID NO: 6941988 - DNA, 22 bp, Homo sapiens
accttggaaagtttaattgagg

SEQ ID NO: 6941989 - DNA, 22 bp, Homo sapiens
tagcttgttacacagcaatgtt

SEQ ID NO: 6941990 - DNA, 22 bp, Homo sapiens
aacttcatttataatgtcatta

SEQ ID NO: 6941991 - DNA, 22 bp, Homo sapiens
gctgtctgagtaagagaatcct

SEQ ID NO: 6941992 - DNA, 22 bp, Homo sapiens
caggcggtggctcctggctgag

SEQ ID NO: 6941993 - DNA, 22 bp, Homo sapiens
aaggagctatgcataactgatc

SEQ ID NO: 6941994 - DNA, 19 bp, Homo sapiens
tgaggggaggagaggcctg

SEQ ID NO: 6941995 - DNA, 22 bp, Homo sapiens
gggtcccagcataggggaagca

SEQ ID NO: 6941996 - DNA, 22 bp, Homo sapiens
tggcagaatgaagactggggcc

SEQ ID NO: 6941997 - DNA, 22 bp, Homo sapiens
ttacaacactacttatccttga

SEQ ID NO: 6941998 - DNA, 22 bp, Homo sapiens
tgttttcatggagatggtggcg

SEQ ID NO: 6941999 - DNA, 22 bp, Homo sapiens
cagcagccctttggctgaactg

SEQ ID NO: 6942000 - DNA, 22 bp, Homo sapiens
tctgtgaaacagctctggcatg

SEQ ID NO: 6942001 - DNA, 22 bp, Homo sapiens
acagtaacagtctatttctcag

SEQ ID NO: 6942002 - DNA, 22 bp, Homo sapiens
ctgaagatgtctgagatgctca

SEQ ID NO: 6942003 - DNA, 22 bp, Homo sapiens
tcccaggctggcaggcagcagt

SEQ ID NO: 6942004 - DNA, 22 bp, Homo sapiens
attatggatggaggcattagtc

SEQ ID NO: 6942005 - DNA, 22 bp, Homo sapiens
aaaggctctattgttttcatat

SEQ ID NO: 6942006 - DNA, 22 bp, Homo sapiens
caggcacccagcccagtcgcac

SEQ ID NO: 6942007 - DNA, 22 bp, Homo sapiens
cagcaggctctgagtggctgcc

SEQ ID NO: 6942008 - DNA, 22 bp, Homo sapiens
agaagttctggagacggaagtg

SEQ ID NO: 6942009 - DNA, 22 bp, Homo sapiens
gtgcagctactccttggtccta

SEQ ID NO: 6942010 - DNA, 22 bp, Homo sapiens
cctctttgactatagtagttaa

SEQ ID NO: 6942011 - DNA, 22 bp, Homo sapiens
tagctggttctccaggagctag

SEQ ID NO: 6942012 - DNA, 22 bp, Homo sapiens
acagtgtggtttgagcactggg

SEQ ID NO: 6942013 - DNA, 21 bp, Homo sapiens
atggagcctaagagtggaggt

SEQ ID NO: 6942014 - DNA, 22 bp, Homo sapiens
tcctgggagagtttgattcatt

SEQ ID NO: 6942015 - DNA, 22 bp, Homo sapiens
ctgagcgaggagttggagcttt

SEQ ID NO: 6942016 - DNA, 21 bp, Homo sapiens
actccctgcataagtgattta

SEQ ID NO: 6942017 - DNA, 22 bp, Homo sapiens
aagctgttctgaatcagtaagt

SEQ ID NO: 6942018 - DNA, 22 bp, Homo sapiens
gagggcttccatggggagcccc

SEQ ID NO: 6942019 - DNA, 22 bp, Homo sapiens
taattatagccgctattttgct

SEQ ID NO: 6942020 - DNA, 22 bp, Homo sapiens
tccaggaaacagcatctcagca

SEQ ID NO: 6942021 - DNA, 22 bp, Homo sapiens
tgtggcctggaaggggctgctc

SEQ ID NO: 6942022 - DNA, 22 bp, Homo sapiens
cagtttggcagcaacatggcga

SEQ ID NO: 6942023 - DNA, 22 bp, Homo sapiens
caggcacagagagaataccttt

SEQ ID NO: 6942024 - DNA, 22 bp, Homo sapiens
tgagaacggatactaagggctg

SEQ ID NO: 6942025 - DNA, 22 bp, Homo sapiens
acacttagctgagggtgcagat

SEQ ID NO: 6942026 - DNA, 22 bp, Homo sapiens
ggcttcccctccagtgctctgt

SEQ ID NO: 6942027 - DNA, 22 bp, Homo sapiens
agagctccgtgcctggctgcca

SEQ ID NO: 6942028 - DNA, 22 bp, Homo sapiens
cagggtgcttagaaatggacct

SEQ ID NO: 6942029 - DNA, 22 bp, Homo sapiens
ctctgagatagtttctatcaat

SEQ ID NO: 6942030 - DNA, 22 bp, Homo sapiens
aagatacattgtttttggtagt

SEQ ID NO: 6942031 - DNA, 17 bp, Homo sapiens
tggcacagaggtgctat

SEQ ID NO: 6942032 - DNA, 22 bp, Homo sapiens
aaagtgctgaaattacaggggt

SEQ ID NO: 6942033 - DNA, 19 bp, Homo sapiens
tcctttctgttcctgagat

SEQ ID NO: 6942034 - DNA, 22 bp, Homo sapiens
gaccacagaggtgtgggagaga

SEQ ID NO: 6942035 - DNA, 22 bp, Homo sapiens
aaatttccatcaggtccagtct

SEQ ID NO: 6942036 - DNA, 22 bp, Homo sapiens
gcctacagttggctgagggcct

SEQ ID NO: 6942037 - DNA, 22 bp, Homo sapiens
aactgctttgtgagctttctgg

SEQ ID NO: 6942038 - DNA, 21 bp, Homo sapiens
ggctcctgctttgtgaggggc

SEQ ID NO: 6942039 - DNA, 22 bp, Homo sapiens
gaaacattgtgttctacagatt

SEQ ID NO: 6942040 - DNA, 22 bp, Homo sapiens
ggtaatggaagcacgctcagtt

SEQ ID NO: 6942041 - DNA, 21 bp, Homo sapiens
tggctgagccaggtgtgtgga

SEQ ID NO: 6942042 - DNA, 22 bp, Homo sapiens
gctttcttcatactcaagcatc

SEQ ID NO: 6942043 - DNA, 22 bp, Homo sapiens
tggcattttccaatgatatgtt

SEQ ID NO: 6942044 - DNA, 20 bp, Homo sapiens
atcaggtgtattccttatct

SEQ ID NO: 6942045 - DNA, 22 bp, Homo sapiens
aatcatcctgaagtcaataaag

SEQ ID NO: 6942046 - DNA, 23 bp, Homo sapiens
atgctagctgtgccaacaccata

SEQ ID NO: 6942047 - DNA, 22 bp, Homo sapiens
ccctgaggcacaggccacgtat

SEQ ID NO: 6942048 - DNA, 22 bp, Homo sapiens
tgcagagcttcattgcataggc

SEQ ID NO: 6942049 - DNA, 22 bp, Homo sapiens
tggcagcacggcatccactctc

SEQ ID NO: 6942050 - DNA, 22 bp, Homo sapiens
agagcccagtctttgtgtgaag

SEQ ID NO: 6942051 - DNA, 21 bp, Homo sapiens
tcacatgcccattactggagc

SEQ ID NO: 6942052 - DNA, 22 bp, Homo sapiens
gatcccatgtaggagaatgtta

SEQ ID NO: 6942053 - DNA, 22 bp, Homo sapiens
ccaatgtttattttcctgctgc

SEQ ID NO: 6942054 - DNA, 22 bp, Homo sapiens
tttccttccctggatgagaagt

SEQ ID NO: 6942055 - DNA, 22 bp, Homo sapiens
gcatgcattttctgagagtcag

SEQ ID NO: 6942056 - DNA, 22 bp, Homo sapiens
ttcaaagtgcatgttcctcaga

SEQ ID NO: 6942057 - DNA, 22 bp, Homo sapiens
ataatgaatgcagagttatttt

SEQ ID NO: 6942058 - DNA, 22 bp, Homo sapiens
gcacatgcgtgcttagaaagaa

SEQ ID NO: 6942059 - DNA, 22 bp, Homo sapiens
gataggagatgatccaatggga

SEQ ID NO: 6942060 - DNA, 22 bp, Homo sapiens
gggcatgtctctaggctggcta

SEQ ID NO: 6942061 - DNA, 22 bp, Homo sapiens
gctggagtgatgcctgtgtctc

SEQ ID NO: 6942062 - DNA, 22 bp, Homo sapiens
cagcttgggagtttggttttat

SEQ ID NO: 6942063 - DNA, 22 bp, Homo sapiens
ccctgcagagccagccctgacc

SEQ ID NO: 6942064 - DNA, 22 bp, Homo sapiens
tgacagccatgatccttactgt

SEQ ID NO: 6942065 - DNA, 17 bp, Homo sapiens
aagcggagggccgggcc

SEQ ID NO: 6942066 - DNA, 22 bp, Homo sapiens
attaggtcatggggaggcccta

SEQ ID NO: 6942067 - DNA, 22 bp, Homo sapiens
tccaggactagcatttctgata

SEQ ID NO: 6942068 - DNA, 22 bp, Homo sapiens
atgagcagatatggattttaga

SEQ ID NO: 6942069 - DNA, 21 bp, Homo sapiens
agctggcagatatggtgtctg

SEQ ID NO: 6942070 - DNA, 22 bp, Homo sapiens
tgtcctgcaggctcataggctc

SEQ ID NO: 6942071 - DNA, 22 bp, Homo sapiens
ctggtcctccttgccttcagat

SEQ ID NO: 6942072 - DNA, 22 bp, Homo sapiens
tttcacacgcatctgtctgccc

SEQ ID NO: 6942073 - DNA, 22 bp, Homo sapiens
ttctggatcagcatcatgagat

SEQ ID NO: 6942074 - DNA, 22 bp, Homo sapiens
agagcagctcgctacctctcta

SEQ ID NO: 6942075 - DNA, 22 bp, Homo sapiens
gctccccaaaagctccaggaaa

SEQ ID NO: 6942076 - DNA, 22 bp, Homo sapiens
agaacctctggatacagtttaa

SEQ ID NO: 6942077 - DNA, 22 bp, Homo sapiens
agtgtacagtgtagtggcgtta

SEQ ID NO: 6942078 - DNA, 22 bp, Homo sapiens
gttcctgggaggcatgggctgg

SEQ ID NO: 6942079 - DNA, 22 bp, Homo sapiens
tcagctggcagttcagaggctg

SEQ ID NO: 6942080 - DNA, 22 bp, Homo sapiens
gatgacatggctagcactgtga

SEQ ID NO: 6942081 - DNA, 22 bp, Homo sapiens
ctctggaagatgacctgggtaa

SEQ ID NO: 6942082 - DNA, 21 bp, Homo sapiens
tttggcctctgcctgagctcc

SEQ ID NO: 6942083 - DNA, 18 bp, Homo sapiens
atgtggctagtgctactg

SEQ ID NO: 6942084 - DNA, 22 bp, Homo sapiens
gaggttcattcagctctgtcac

SEQ ID NO: 6942085 - DNA, 18 bp, Homo sapiens
tgtgatttggctggaaat

SEQ ID NO: 6942086 - DNA, 22 bp, Homo sapiens
ccactactttgtttttggtgct

SEQ ID NO: 6942087 - DNA, 22 bp, Homo sapiens
attagtattcagtttataacac

SEQ ID NO: 6942088 - DNA, 22 bp, Homo sapiens
tgtgacagtgccagcttcatag

SEQ ID NO: 6942089 - DNA, 22 bp, Homo sapiens
atacacacgtgcacgtgggaaa

SEQ ID NO: 6942090 - DNA, 22 bp, Homo sapiens
gctcagagaaaactggggcttg

SEQ ID NO: 6942091 - DNA, 22 bp, Homo sapiens
ctccaggaggttgctgcttcct

SEQ ID NO: 6942092 - DNA, 22 bp, Homo sapiens
tacaccagattatttataacat

SEQ ID NO: 6942093 - DNA, 17 bp, Homo sapiens
ggttcagttctgcattc

SEQ ID NO: 6942094 - DNA, 22 bp, Homo sapiens
gggtaggcaaagcaatgacgtt

SEQ ID NO: 6942095 - DNA, 22 bp, Homo sapiens
catagcaacagcatcaagtcaa

SEQ ID NO: 6942096 - DNA, 22 bp, Homo sapiens
aatgatctggctcaggatatca

SEQ ID NO: 6942097 - DNA, 20 bp, Homo sapiens
tggaggtggtctgctgtcct

SEQ ID NO: 6942098 - DNA, 22 bp, Homo sapiens
aagcatggcctctccgctcccc

SEQ ID NO: 6942099 - DNA, 22 bp, Homo sapiens
aacttacaaggatgatagctgc

SEQ ID NO: 6942100 - DNA, 20 bp, Homo sapiens
gaaaggagtgtccctgtgag

SEQ ID NO: 6942101 - DNA, 22 bp, Homo sapiens
caaggcatgcaatgtcttcagg

SEQ ID NO: 6942102 - DNA, 22 bp, Homo sapiens
atgggaaagaagccactgccca

SEQ ID NO: 6942103 - DNA, 22 bp, Homo sapiens
atcaatgttgggccaaagcaaa

SEQ ID NO: 6942104 - DNA, 22 bp, Homo sapiens
tcaggcctagggagccacacca

SEQ ID NO: 6942105 - DNA, 22 bp, Homo sapiens
ctcttcttatggccgtggctga

SEQ ID NO: 6942106 - DNA, 22 bp, Homo sapiens
agcatggacagtggcagcagtg

SEQ ID NO: 6942107 - DNA, 22 bp, Homo sapiens
gggaatatggaagtggacactt

SEQ ID NO: 6942108 - DNA, 22 bp, Homo sapiens
ctgcttcatgtcctgggacctg

SEQ ID NO: 6942109 - DNA, 22 bp, Homo sapiens
cagtggtactctcagatgttta

SEQ ID NO: 6942110 - DNA, 18 bp, Homo sapiens
ggcttctctgtttatttc

SEQ ID NO: 6942111 - DNA, 22 bp, Homo sapiens
agtgcattgcatctctgcttca

SEQ ID NO: 6942112 - DNA, 19 bp, Homo sapiens
actcaagtctaatgaaatc

SEQ ID NO: 6942113 - DNA, 22 bp, Homo sapiens
ttaaatgtctgtagatgtgctg

SEQ ID NO: 6942114 - DNA, 22 bp, Homo sapiens
tcaagaaactgtagcaatgggt

SEQ ID NO: 6942115 - DNA, 19 bp, Homo sapiens
ctccacagggattgtgatt

SEQ ID NO: 6942116 - DNA, 22 bp, Homo sapiens
actgggccagacactgattccc

SEQ ID NO: 6942117 - DNA, 22 bp, Homo sapiens
acccaggaggcaaggttgcagt

SEQ ID NO: 6942118 - DNA, 22 bp, Homo sapiens
tctgcacaggcgtaggttgact

SEQ ID NO: 6942119 - DNA, 22 bp, Homo sapiens
tcagagagtcctggtcatttgc

SEQ ID NO: 6942120 - DNA, 22 bp, Homo sapiens
tcaatgctgccaaatcttctag

SEQ ID NO: 6942121 - DNA, 22 bp, Homo sapiens
tcctttttggtccaaggtgacc

SEQ ID NO: 6942122 - DNA, 22 bp, Homo sapiens
gctgcaggcagaatctcccaat

SEQ ID NO: 6942123 - DNA, 22 bp, Homo sapiens
tgaagactcagaagctaagata

SEQ ID NO: 6942124 - DNA, 21 bp, Homo sapiens
gccagctgcagggcttccttg

SEQ ID NO: 6942125 - DNA, 22 bp, Homo sapiens
tttaaacctcctgattcagcta

SEQ ID NO: 6942126 - DNA, 22 bp, Homo sapiens
taggaagcatttaaagagatgg

SEQ ID NO: 6942127 - DNA, 22 bp, Homo sapiens
tccagatgctgcacattcctga

SEQ ID NO: 6942128 - DNA, 22 bp, Homo sapiens
ctgcccaccacacctgctcctg

SEQ ID NO: 6942129 - DNA, 22 bp, Homo sapiens
agaccagctgcctcccagggcc

SEQ ID NO: 6942130 - DNA, 21 bp, Homo sapiens
gctttcagaagtctcatagtt

SEQ ID NO: 6942131 - DNA, 23 bp, Homo sapiens
aacctgaactagggtcttgcata

SEQ ID NO: 6942132 - DNA, 22 bp, Homo sapiens
aatcctgacctgggcatgcttg

SEQ ID NO: 6942133 - DNA, 18 bp, Homo sapiens
ttctgcggtgacagatat

SEQ ID NO: 6942134 - DNA, 22 bp, Homo sapiens
ggtcagagggtgggctgcctgt

SEQ ID NO: 6942135 - DNA, 22 bp, Homo sapiens
ggccacaacttgctcctagccc

SEQ ID NO: 6942136 - DNA, 22 bp, Homo sapiens
ttaatttgaccataaatatctt

SEQ ID NO: 6942137 - DNA, 22 bp, Homo sapiens
agaatctctactcaagtacttg

SEQ ID NO: 6942138 - DNA, 22 bp, Homo sapiens
tgaattcacacttccaaagaga

SEQ ID NO: 6942139 - DNA, 21 bp, Homo sapiens
aggtatgttgagaactgagga

SEQ ID NO: 6942140 - DNA, 22 bp, Homo sapiens
tatgacagtgaaaaaaatcaga

SEQ ID NO: 6942141 - DNA, 22 bp, Homo sapiens
aggtgggcgctgctcccgctgg

SEQ ID NO: 6942142 - DNA, 22 bp, Homo sapiens
ttctccttcctggttttcaggc

SEQ ID NO: 6942143 - DNA, 22 bp, Homo sapiens
actagtctgcattacaaaatag

SEQ ID NO: 6942144 - DNA, 22 bp, Homo sapiens
caccaggcacagctctcctgct

SEQ ID NO: 6942145 - DNA, 22 bp, Homo sapiens
tctcactgatttgagaccaagg

SEQ ID NO: 6942146 - DNA, 22 bp, Homo sapiens
cctgccagcccccatagagaca

SEQ ID NO: 6942147 - DNA, 22 bp, Homo sapiens
tgggctaaatagagaaaggata

SEQ ID NO: 6942148 - DNA, 21 bp, Homo sapiens
cagaggcctcatgctctgtgc

SEQ ID NO: 6942149 - DNA, 22 bp, Homo sapiens
tgcaaggcacacagggggtaag

SEQ ID NO: 6942150 - DNA, 22 bp, Homo sapiens
agtctccacactggcagatgcc

SEQ ID NO: 6942151 - DNA, 22 bp, Homo sapiens
ggggtgagctgggcctgtgcct

SEQ ID NO: 6942152 - DNA, 22 bp, Homo sapiens
acgtgcatatgtatacacacat

SEQ ID NO: 6942153 - DNA, 22 bp, Homo sapiens
tctctacagaatcttattattg

SEQ ID NO: 6942154 - DNA, 20 bp, Homo sapiens
agctgggcaattatgactat

SEQ ID NO: 6942155 - DNA, 22 bp, Homo sapiens
tcttttcatcatttaataggta

SEQ ID NO: 6942156 - DNA, 22 bp, Homo sapiens
gtccttgcttgagacaggcagt

SEQ ID NO: 6942157 - DNA, 22 bp, Homo sapiens
gtctaggccatcacaggcgcca

SEQ ID NO: 6942158 - DNA, 22 bp, Homo sapiens
cagtgagcacggccagagggga

SEQ ID NO: 6942159 - DNA, 22 bp, Homo sapiens
tcctggctgcaccagtgaccct

SEQ ID NO: 6942160 - DNA, 22 bp, Homo sapiens
agggtaggtgtaagatagccct

SEQ ID NO: 6942161 - DNA, 22 bp, Homo sapiens
agttgtaaattcatagcttata

SEQ ID NO: 6942162 - DNA, 19 bp, Homo sapiens
ccattctgtctctgccaca

SEQ ID NO: 6942163 - DNA, 22 bp, Homo sapiens
tcctgtcttaatgatctcgtgc

SEQ ID NO: 6942164 - DNA, 19 bp, Homo sapiens
tatatattttggggttgtg

SEQ ID NO: 6942165 - DNA, 22 bp, Homo sapiens
tcccggcgctgggaggtgggtc

SEQ ID NO: 6942166 - DNA, 21 bp, Homo sapiens
aagagctggatcaaggataag

SEQ ID NO: 6942167 - DNA, 22 bp, Homo sapiens
agaaggctccaagtagagtttg

SEQ ID NO: 6942168 - DNA, 22 bp, Homo sapiens
gtgaggtcctccctgctgggag

SEQ ID NO: 6942169 - DNA, 22 bp, Homo sapiens
agtccataattttcatatctga

SEQ ID NO: 6942170 - DNA, 22 bp, Homo sapiens
tcctggagtttgtaaggtgagc

SEQ ID NO: 6942171 - DNA, 22 bp, Homo sapiens
gcccagagggaagaggtgtcat

SEQ ID NO: 6942172 - DNA, 22 bp, Homo sapiens
caccagcttcccatcgcgggtc

SEQ ID NO: 6942173 - DNA, 22 bp, Homo sapiens
agcttagtggttgtatgagtta

SEQ ID NO: 6942174 - DNA, 22 bp, Homo sapiens
tctgcctgcagtgtggcagggc

SEQ ID NO: 6942175 - DNA, 22 bp, Homo sapiens
gatatttacattaagcacattg

SEQ ID NO: 6942176 - DNA, 22 bp, Homo sapiens
ctggccactgcacctcttcctt

SEQ ID NO: 6942177 - DNA, 22 bp, Homo sapiens
catgagagatccttcatgagag

SEQ ID NO: 6942178 - DNA, 21 bp, Homo sapiens
gctccctggctgtgtgacctg

SEQ ID NO: 6942179 - DNA, 22 bp, Homo sapiens
tgcaggctcaccctggagctga

SEQ ID NO: 6942180 - DNA, 22 bp, Homo sapiens
atgacatcaacagtggtgctgt

SEQ ID NO: 6942181 - DNA, 18 bp, Homo sapiens
aaagccctgggtatgttt

SEQ ID NO: 6942182 - DNA, 23 bp, Homo sapiens
agtctcaagctggagaattacct

SEQ ID NO: 6942183 - DNA, 22 bp, Homo sapiens
cagctggggcagccacgtgcgg

SEQ ID NO: 6942184 - DNA, 22 bp, Homo sapiens
gccagtgcttgtggagctggca

SEQ ID NO: 6942185 - DNA, 22 bp, Homo sapiens
gtctggctaggcacgccgtgtt

SEQ ID NO: 6942186 - DNA, 22 bp, Homo sapiens
ctgggggtcgcgcctctgggca

SEQ ID NO: 6942187 - DNA, 22 bp, Homo sapiens
tgtgtcagaggtagagatggca

SEQ ID NO: 6942188 - DNA, 22 bp, Homo sapiens
atattctagccaaagtgtgagc

SEQ ID NO: 6942189 - DNA, 22 bp, Homo sapiens
ctggccagcatttttgctttag

SEQ ID NO: 6942190 - DNA, 16 bp, Homo sapiens
tccagtgttcctggat

SEQ ID NO: 6942191 - DNA, 22 bp, Homo sapiens
gtgaagtggagtggtatggttt

SEQ ID NO: 6942192 - DNA, 22 bp, Homo sapiens
tctggattgttacacagagggc

SEQ ID NO: 6942193 - DNA, 22 bp, Homo sapiens
gaatagatgaaagtgtctctta

SEQ ID NO: 6942194 - DNA, 22 bp, Homo sapiens
ttaacctgttatgcccccagag

SEQ ID NO: 6942195 - DNA, 22 bp, Homo sapiens
gtgctgatagcatcataaagtc

SEQ ID NO: 6942196 - DNA, 22 bp, Homo sapiens
gagtctctggaggggtcagacc

SEQ ID NO: 6942197 - DNA, 17 bp, Homo sapiens
tgaggcaaccatcacta

SEQ ID NO: 6942198 - DNA, 22 bp, Homo sapiens
aattccagggtacctctgattt

SEQ ID NO: 6942199 - DNA, 22 bp, Homo sapiens
ttgtctgagggtttgagagaat

SEQ ID NO: 6942200 - DNA, 22 bp, Homo sapiens
gtgtgtatgtagaactatgtat

SEQ ID NO: 6942201 - DNA, 22 bp, Homo sapiens
atttaattttctcaacagtgct

SEQ ID NO: 6942202 - DNA, 22 bp, Homo sapiens
aagccttggggctcctctgtat

SEQ ID NO: 6942203 - DNA, 22 bp, Homo sapiens
ggatccttaactatcacagtga

SEQ ID NO: 6942204 - DNA, 22 bp, Homo sapiens
ttatgcagaggcatgctcactc

SEQ ID NO: 6942205 - DNA, 22 bp, Homo sapiens
aacaccagtcccaagagaggct

SEQ ID NO: 6942206 - DNA, 22 bp, Homo sapiens
tgcatcagaggatagctgcagt

SEQ ID NO: 6942207 - DNA, 22 bp, Homo sapiens
ttttcagtgggcaatgatgtga

SEQ ID NO: 6942208 - DNA, 22 bp, Homo sapiens
cggcttcagctcaggcccctcg

SEQ ID NO: 6942209 - DNA, 23 bp, Homo sapiens
gcatgaagtgctacgtctacagc

SEQ ID NO: 6942210 - DNA, 22 bp, Homo sapiens
acctggcacagagtatgctctc

SEQ ID NO: 6942211 - DNA, 22 bp, Homo sapiens
tggcaagagcaaaatgtacagt

SEQ ID NO: 6942212 - DNA, 22 bp, Homo sapiens
gctctaggaggtgtgcttagaa

SEQ ID NO: 6942213 - DNA, 22 bp, Homo sapiens
gcctcaggtgcatctctcattc

SEQ ID NO: 6942214 - DNA, 22 bp, Homo sapiens
agccaagaatcatgagctaata

SEQ ID NO: 6942215 - DNA, 22 bp, Homo sapiens
aaaagttgcaaaattgctcttc

SEQ ID NO: 6942216 - DNA, 22 bp, Homo sapiens
atctgcaggatgttaggatgat

SEQ ID NO: 6942217 - DNA, 22 bp, Homo sapiens
aagtgacctcatggtttctcct

SEQ ID NO: 6942218 - DNA, 22 bp, Homo sapiens
tatggcttgagtttcagactat

SEQ ID NO: 6942219 - DNA, 22 bp, Homo sapiens
tggctggctgtcagtaggctgt

SEQ ID NO: 6942220 - DNA, 22 bp, Homo sapiens
ttctggctccactcagccccac

SEQ ID NO: 6942221 - DNA, 18 bp, Homo sapiens
tcacagacagctgtcttt

SEQ ID NO: 6942222 - DNA, 22 bp, Homo sapiens
agttctattgggtaggttctgt

SEQ ID NO: 6942223 - DNA, 22 bp, Homo sapiens
ttcaaacttaaggagcagcaga

SEQ ID NO: 6942224 - DNA, 18 bp, Homo sapiens
tgaaattgcatccatgag

SEQ ID NO: 6942225 - DNA, 22 bp, Homo sapiens
ttctggaaggcagggagaaccc

SEQ ID NO: 6942226 - DNA, 22 bp, Homo sapiens
aacaacttgcgttcagagatgt

SEQ ID NO: 6942227 - DNA, 22 bp, Homo sapiens
cgcggtgtagtcgtacatccca

SEQ ID NO: 6942228 - DNA, 22 bp, Homo sapiens
attttggcaacagccatgagcc

SEQ ID NO: 6942229 - DNA, 22 bp, Homo sapiens
ctggcagtctgcctcttcactg

SEQ ID NO: 6942230 - DNA, 21 bp, Homo sapiens
agccaggcaagcacccccact

SEQ ID NO: 6942231 - DNA, 22 bp, Homo sapiens
gcaggttatccaactacaatgt

SEQ ID NO: 6942232 - DNA, 22 bp, Homo sapiens
caggaacccaatgggccaggcc

SEQ ID NO: 6942233 - DNA, 19 bp, Homo sapiens
gatgtcctccatagtacgg

SEQ ID NO: 6942234 - DNA, 22 bp, Homo sapiens
aaaggctgccaggtaaaatatt

SEQ ID NO: 6942235 - DNA, 23 bp, Homo sapiens
agatgagccaacacctccatgcc

SEQ ID NO: 6942236 - DNA, 22 bp, Homo sapiens
ctgatctcaagtgatccaccca

SEQ ID NO: 6942237 - DNA, 22 bp, Homo sapiens
gaggaagggctgcctgccgggc

SEQ ID NO: 6942238 - DNA, 22 bp, Homo sapiens
agcattcaatgattggacttgc

SEQ ID NO: 6942239 - DNA, 22 bp, Homo sapiens
tctttagtgaccatctcattct

SEQ ID NO: 6942240 - DNA, 22 bp, Homo sapiens
tggagccagcccaggcccctct

SEQ ID NO: 6942241 - DNA, 22 bp, Homo sapiens
tccctcagattggcaattagat

SEQ ID NO: 6942242 - DNA, 22 bp, Homo sapiens
agacagcacttttgtatggggg

SEQ ID NO: 6942243 - DNA, 22 bp, Homo sapiens
gagagactggaatgggctgtgg

SEQ ID NO: 6942244 - DNA, 23 bp, Homo sapiens
ctgaaataccagaaaatcagtgt

SEQ ID NO: 6942245 - DNA, 22 bp, Homo sapiens
cagatctctgtgtagttcagtc

SEQ ID NO: 6942246 - DNA, 22 bp, Homo sapiens
aggcaacctacatttttttgaa

SEQ ID NO: 6942247 - DNA, 22 bp, Homo sapiens
tgttatttatttcacctccaga

SEQ ID NO: 6942248 - DNA, 22 bp, Homo sapiens
tcctggcttgtcacatctacgt

SEQ ID NO: 6942249 - DNA, 22 bp, Homo sapiens
ctacttatgggtggtaccagca

SEQ ID NO: 6942250 - DNA, 19 bp, Homo sapiens
tgcatgtgttctcccattg

SEQ ID NO: 6942251 - DNA, 22 bp, Homo sapiens
cggaggttgaggctgcagtgag

SEQ ID NO: 6942252 - DNA, 22 bp, Homo sapiens
gcaggagctcgtttccaggctg

SEQ ID NO: 6942253 - DNA, 22 bp, Homo sapiens
ttgttcttacttaagagtgaat

SEQ ID NO: 6942254 - DNA, 22 bp, Homo sapiens
cagtacaggctgccttgtccaa

SEQ ID NO: 6942255 - DNA, 22 bp, Homo sapiens
gtgacattgctaggaacagatt

SEQ ID NO: 6942256 - DNA, 22 bp, Homo sapiens
tgagtctttagaattctaactt

SEQ ID NO: 6942257 - DNA, 22 bp, Homo sapiens
tagttcacccctctttattttc

SEQ ID NO: 6942258 - DNA, 22 bp, Homo sapiens
tttagcatgtgtgccatgtggc

SEQ ID NO: 6942259 - DNA, 21 bp, Homo sapiens
ccactgtagactcattctgag

SEQ ID NO: 6942260 - DNA, 22 bp, Homo sapiens
ggagtgaagcaaataatgctgg

SEQ ID NO: 6942261 - DNA, 22 bp, Homo sapiens
aagagaatacaagcaggcagga

SEQ ID NO: 6942262 - DNA, 22 bp, Homo sapiens
gagggagtgccagagggccagc

SEQ ID NO: 6942263 - DNA, 22 bp, Homo sapiens
tttgaaaggagctttatccaga

SEQ ID NO: 6942264 - DNA, 22 bp, Homo sapiens
cactgtcttgattactatgggt

SEQ ID NO: 6942265 - DNA, 22 bp, Homo sapiens
tcaggaggccgtgtgctcagtg

SEQ ID NO: 6942266 - DNA, 22 bp, Homo sapiens
gaactctgagaggagcacaggc

SEQ ID NO: 6942267 - DNA, 22 bp, Homo sapiens
tagaatctgaatattcttattt

SEQ ID NO: 6942268 - DNA, 22 bp, Homo sapiens
tgacaaagaggaacagcagggg

SEQ ID NO: 6942269 - DNA, 20 bp, Homo sapiens
tgccatggtaacagagtgtg

SEQ ID NO: 6942270 - DNA, 22 bp, Homo sapiens
tattccaccagagatgtgaatt

SEQ ID NO: 6942271 - DNA, 22 bp, Homo sapiens
cctgtacaagagccatctggat

SEQ ID NO: 6942272 - DNA, 16 bp, Homo sapiens
gtatttcttagacttt

SEQ ID NO: 6942273 - DNA, 22 bp, Homo sapiens
ctggccggtatttgcctctggg

SEQ ID NO: 6942274 - DNA, 17 bp, Homo sapiens
gctttccttgcccctcc

SEQ ID NO: 6942275 - DNA, 22 bp, Homo sapiens
agttctgtgctcactctacccc

SEQ ID NO: 6942276 - DNA, 22 bp, Homo sapiens
ttccaggggcagcagtgatggt

SEQ ID NO: 6942277 - DNA, 22 bp, Homo sapiens
tagaacctctgattatgttact

SEQ ID NO: 6942278 - DNA, 22 bp, Homo sapiens
tgacagaaagaatatgtcaatc

SEQ ID NO: 6942279 - DNA, 23 bp, Homo sapiens
gtgttactctgataggtgctttt

SEQ ID NO: 6942280 - DNA, 22 bp, Homo sapiens
tggagcatactaacccactctg

SEQ ID NO: 6942281 - DNA, 17 bp, Homo sapiens
ttatactcgtaggtgga

SEQ ID NO: 6942282 - DNA, 22 bp, Homo sapiens
tgtttcacttaaaaccactgct

SEQ ID NO: 6942283 - DNA, 22 bp, Homo sapiens
agactgaataacaagcaaataa

SEQ ID NO: 6942284 - DNA, 22 bp, Homo sapiens
aatattctaataaatgcccatc

SEQ ID NO: 6942285 - DNA, 22 bp, Homo sapiens
ctcattccatgtgtattttgag

SEQ ID NO: 6942286 - DNA, 22 bp, Homo sapiens
atcagctattatgtgaagaaag

SEQ ID NO: 6942287 - DNA, 22 bp, Homo sapiens
aaatgtgatactgttcttttta

SEQ ID NO: 6942288 - DNA, 22 bp, Homo sapiens
ggtctagaggatgttcctttcc

SEQ ID NO: 6942289 - DNA, 22 bp, Homo sapiens
ctacagaaacactggacatgtg

SEQ ID NO: 6942290 - DNA, 22 bp, Homo sapiens
accatgataatgatgtatcatt

SEQ ID NO: 6942291 - DNA, 22 bp, Homo sapiens
gtggcccttgaagcagcttcat

SEQ ID NO: 6942292 - DNA, 22 bp, Homo sapiens
agcacagcaccatcctggtacc

SEQ ID NO: 6942293 - DNA, 22 bp, Homo sapiens
tcgctgtgaaaaccttggacaa

SEQ ID NO: 6942294 - DNA, 22 bp, Homo sapiens
cccagagtggacggtggcccct

SEQ ID NO: 6942295 - DNA, 22 bp, Homo sapiens
tcagatccgagtgtgccaagga

SEQ ID NO: 6942296 - DNA, 22 bp, Homo sapiens
acttatcagttgtctctaatgt

SEQ ID NO: 6942297 - DNA, 22 bp, Homo sapiens
actctgggccccaggtggagct

SEQ ID NO: 6942298 - DNA, 22 bp, Homo sapiens
ccaggtgtcatggataatgggt

SEQ ID NO: 6942299 - DNA, 22 bp, Homo sapiens
ccacaggatccaagggaaggca

SEQ ID NO: 6942300 - DNA, 22 bp, Homo sapiens
aggctgcctggctgtgagtgaa

SEQ ID NO: 6942301 - DNA, 22 bp, Homo sapiens
tggtccctgcctgccaagtgct

SEQ ID NO: 6942302 - DNA, 22 bp, Homo sapiens
atgcttttccaggagaaatata

SEQ ID NO: 6942303 - DNA, 22 bp, Homo sapiens
ttattgcttttgtgcaggtgag

SEQ ID NO: 6942304 - DNA, 22 bp, Homo sapiens
tgtgcccgaagtattttaaaat

SEQ ID NO: 6942305 - DNA, 22 bp, Homo sapiens
tgcaaggctattcacatgtatt

SEQ ID NO: 6942306 - DNA, 22 bp, Homo sapiens
tggcagtgaagctgtctttagg

SEQ ID NO: 6942307 - DNA, 23 bp, Homo sapiens
tggtcctgccaacggtgcccctc

SEQ ID NO: 6942308 - DNA, 22 bp, Homo sapiens
gagaaactgctctgattctgca

SEQ ID NO: 6942309 - DNA, 22 bp, Homo sapiens
atttacagtttagcatttcaag

SEQ ID NO: 6942310 - DNA, 21 bp, Homo sapiens
aggctcagagatcaaacagta

SEQ ID NO: 6942311 - DNA, 22 bp, Homo sapiens
acctcctgatgagagtaaagga

SEQ ID NO: 6942312 - DNA, 22 bp, Homo sapiens
aaactgggttgtggtcagtggt

SEQ ID NO: 6942313 - DNA, 22 bp, Homo sapiens
tagtaagagaatgcttgtttct

SEQ ID NO: 6942314 - DNA, 22 bp, Homo sapiens
agaggctctttgcttgttctta

SEQ ID NO: 6942315 - DNA, 23 bp, Homo sapiens
ttttccagaatcgactctgtaga

SEQ ID NO: 6942316 - DNA, 22 bp, Homo sapiens
tcctgcctctccatgctaacta

SEQ ID NO: 6942317 - DNA, 22 bp, Homo sapiens
atgacatgtactgctctctcat

SEQ ID NO: 6942318 - DNA, 22 bp, Homo sapiens
ttgttaaaatgaggtcattctg

SEQ ID NO: 6942319 - DNA, 22 bp, Homo sapiens
gctcatctgttttaactgtatt

SEQ ID NO: 6942320 - DNA, 22 bp, Homo sapiens
catctgtcaggcagaacccaga

SEQ ID NO: 6942321 - DNA, 22 bp, Homo sapiens
ttcaagtatatttaacatcgta

SEQ ID NO: 6942322 - DNA, 22 bp, Homo sapiens
tgccagctagagaagctagaaa

SEQ ID NO: 6942323 - DNA, 22 bp, Homo sapiens
tggctgaaggaagattcttcta

SEQ ID NO: 6942324 - DNA, 22 bp, Homo sapiens
aaagcgcatagggggcagcaag

SEQ ID NO: 6942325 - DNA, 22 bp, Homo sapiens
attaggttgaggtactcagagc

SEQ ID NO: 6942326 - DNA, 22 bp, Homo sapiens
caatactgggcaggagagtaca

SEQ ID NO: 6942327 - DNA, 22 bp, Homo sapiens
ctgggccactccagatgcccac

SEQ ID NO: 6942328 - DNA, 22 bp, Homo sapiens
cagcctctgacaccacagtcgt

SEQ ID NO: 6942329 - DNA, 22 bp, Homo sapiens
aaagtttcccaaagtaatgtga

SEQ ID NO: 6942330 - DNA, 22 bp, Homo sapiens
aggctctgtgatgtgccaggca

SEQ ID NO: 6942331 - DNA, 19 bp, Homo sapiens
tctgaacaatgcagttccc

SEQ ID NO: 6942332 - DNA, 22 bp, Homo sapiens
aacacagttagtaagggaaata

SEQ ID NO: 6942333 - DNA, 22 bp, Homo sapiens
caatgtctgggagacctgtgat

SEQ ID NO: 6942334 - DNA, 22 bp, Homo sapiens
tgaacagatgccttctcccatg

SEQ ID NO: 6942335 - DNA, 20 bp, Homo sapiens
ttggaacagtggatcagcag

SEQ ID NO: 6942336 - DNA, 22 bp, Homo sapiens
agacccaggtttcaaactactc

SEQ ID NO: 6942337 - DNA, 22 bp, Homo sapiens
aagcaagccaatctgttttgtt

SEQ ID NO: 6942338 - DNA, 22 bp, Homo sapiens
ctgcctcatgctgcctgcagcc

SEQ ID NO: 6942339 - DNA, 22 bp, Homo sapiens
tctgtcattgcaataaaatttc

SEQ ID NO: 6942340 - DNA, 22 bp, Homo sapiens
acagagacctggccttgctttg

SEQ ID NO: 6942341 - DNA, 22 bp, Homo sapiens
tatggcttcttgtgttactgtg

SEQ ID NO: 6942342 - DNA, 22 bp, Homo sapiens
atggccagggtggcactgtggt

SEQ ID NO: 6942343 - DNA, 22 bp, Homo sapiens
accagggcaaatgtttgtactc

SEQ ID NO: 6942344 - DNA, 22 bp, Homo sapiens
catgcaggaggaaaaagcagct

SEQ ID NO: 6942345 - DNA, 21 bp, Homo sapiens
tgtgcattgaactgggcgtgt

SEQ ID NO: 6942346 - DNA, 22 bp, Homo sapiens
tagtgctatggccagagccctt

SEQ ID NO: 6942347 - DNA, 22 bp, Homo sapiens
ttgtgtttctgtgatatgtaaa

SEQ ID NO: 6942348 - DNA, 22 bp, Homo sapiens
tcctggttagagctctctgggg

SEQ ID NO: 6942349 - DNA, 22 bp, Homo sapiens
tgtccttgtgacattctggctt

SEQ ID NO: 6942350 - DNA, 22 bp, Homo sapiens
cagttaatcttgccattatatc

SEQ ID NO: 6942351 - DNA, 22 bp, Homo sapiens
ttctaattattcccttgtccca

SEQ ID NO: 6942352 - DNA, 22 bp, Homo sapiens
agctgactgatgaagaggcctt

SEQ ID NO: 6942353 - DNA, 22 bp, Homo sapiens
caatgaaagcaactgcctataa

SEQ ID NO: 6942354 - DNA, 22 bp, Homo sapiens
ctggaaggcggaggttgtagtg

SEQ ID NO: 6942355 - DNA, 22 bp, Homo sapiens
ttgtgtcctatatgcatgttct

SEQ ID NO: 6942356 - DNA, 22 bp, Homo sapiens
taaacagcctaaaactttcttt

SEQ ID NO: 6942357 - DNA, 22 bp, Homo sapiens
cctggcctgctcggctcttaag

SEQ ID NO: 6942358 - DNA, 22 bp, Homo sapiens
aatgccattttctataaaaaga

SEQ ID NO: 6942359 - DNA, 22 bp, Homo sapiens
acaacagggtaaggcaggccat

SEQ ID NO: 6942360 - DNA, 22 bp, Homo sapiens
ctgctctgtttcttagctgggt

SEQ ID NO: 6942361 - DNA, 23 bp, Homo sapiens
agcagttagggatacaagttatc

SEQ ID NO: 6942362 - DNA, 22 bp, Homo sapiens
cagtgcatagatcctgaggcct

SEQ ID NO: 6942363 - DNA, 22 bp, Homo sapiens
ataacgaaggctgatgcgggat

SEQ ID NO: 6942364 - DNA, 22 bp, Homo sapiens
cagtggcctctggctttgctgt

SEQ ID NO: 6942365 - DNA, 18 bp, Homo sapiens
atgttcatatttttaggg

SEQ ID NO: 6942366 - DNA, 22 bp, Homo sapiens
agagctttgggacatttgctag

SEQ ID NO: 6942367 - DNA, 22 bp, Homo sapiens
gagccgaggcgcacagctcggg

SEQ ID NO: 6942368 - DNA, 22 bp, Homo sapiens
agggatgactcttggctgattc

SEQ ID NO: 6942369 - DNA, 21 bp, Homo sapiens
gcctggcaggtggaagggctc

SEQ ID NO: 6942370 - DNA, 22 bp, Homo sapiens
ttacagggggatgagattgtga

SEQ ID NO: 6942371 - DNA, 23 bp, Homo sapiens
gggtgggccaaattaggtagcct

SEQ ID NO: 6942372 - DNA, 22 bp, Homo sapiens
aagctgtattaatttggtttgt

SEQ ID NO: 6942373 - DNA, 17 bp, Homo sapiens
aggatgtggagaaaatt

SEQ ID NO: 6942374 - DNA, 22 bp, Homo sapiens
tctattcaggcagagtgcagca

SEQ ID NO: 6942375 - DNA, 22 bp, Homo sapiens
tacatagattttgaaactggac

SEQ ID NO: 6942376 - DNA, 22 bp, Homo sapiens
tgagaagattgggcagagtgga

SEQ ID NO: 6942377 - DNA, 22 bp, Homo sapiens
gtgaagttttagtatatgtaga

SEQ ID NO: 6942378 - DNA, 22 bp, Homo sapiens
tgccaagggtatgggcaagata

SEQ ID NO: 6942379 - DNA, 22 bp, Homo sapiens
atccgcttatctcagctggcag

SEQ ID NO: 6942380 - DNA, 22 bp, Homo sapiens
attatgcttaggaaaatatgaa

SEQ ID NO: 6942381 - DNA, 22 bp, Homo sapiens
gacaccagtaaatattcaaaag

SEQ ID NO: 6942382 - DNA, 19 bp, Homo sapiens
gcaagagcttaggaggggt

SEQ ID NO: 6942383 - DNA, 22 bp, Homo sapiens
aaacacttcaaggacttctgtc

SEQ ID NO: 6942384 - DNA, 22 bp, Homo sapiens
atacatgggtctcctgtcttag

SEQ ID NO: 6942385 - DNA, 22 bp, Homo sapiens
gtgtcaacagccgaagataaat

SEQ ID NO: 6942386 - DNA, 22 bp, Homo sapiens
tgaggctgagatatcagggagg

SEQ ID NO: 6942387 - DNA, 22 bp, Homo sapiens
agaatcctggccaggtcagagc

SEQ ID NO: 6942388 - DNA, 22 bp, Homo sapiens
gaggagggagaattaggcttaa

SEQ ID NO: 6942389 - DNA, 22 bp, Homo sapiens
ttaattctagtttaacacttag

SEQ ID NO: 6942390 - DNA, 21 bp, Homo sapiens
caccttatagataaaattaga

SEQ ID NO: 6942391 - DNA, 17 bp, Homo sapiens
tgtccatttgcctggag

SEQ ID NO: 6942392 - DNA, 22 bp, Homo sapiens
ctgggccttagggcactccctt

SEQ ID NO: 6942393 - DNA, 22 bp, Homo sapiens
aaccctggggcagctgctaggg

SEQ ID NO: 6942394 - DNA, 22 bp, Homo sapiens
gcttcccacagctggactgggg

SEQ ID NO: 6942395 - DNA, 22 bp, Homo sapiens
tcgttatagaacattcttgggt

SEQ ID NO: 6942396 - DNA, 22 bp, Homo sapiens
agccactgtgcaggagcagtgt

SEQ ID NO: 6942397 - DNA, 22 bp, Homo sapiens
gcaggctgagagtccaagaagg

SEQ ID NO: 6942398 - DNA, 22 bp, Homo sapiens
tagtgctttggagctttctcct

SEQ ID NO: 6942399 - DNA, 22 bp, Homo sapiens
cttgatcattcactggctctgt

SEQ ID NO: 6942400 - DNA, 22 bp, Homo sapiens
gcactgctccagtctctgcttt

SEQ ID NO: 6942401 - DNA, 17 bp, Homo sapiens
tttctagctgtgaaccc

SEQ ID NO: 6942402 - DNA, 22 bp, Homo sapiens
ttctctggggttcagtatctct

SEQ ID NO: 6942403 - DNA, 22 bp, Homo sapiens
gtgcagtgtgtaatccaggaac

SEQ ID NO: 6942404 - DNA, 22 bp, Homo sapiens
ttacctgtaaaactgcgatata

SEQ ID NO: 6942405 - DNA, 22 bp, Homo sapiens
gcagaaggcctcttggttaata

SEQ ID NO: 6942406 - DNA, 19 bp, Homo sapiens
tctggaagtgggggattgc

SEQ ID NO: 6942407 - DNA, 22 bp, Homo sapiens
tcctggtgtcctggtctgctag

SEQ ID NO: 6942408 - DNA, 22 bp, Homo sapiens
ggctctgggcctccaaggtctg

SEQ ID NO: 6942409 - DNA, 21 bp, Homo sapiens
agtagtttagcacagggtttg

SEQ ID NO: 6942410 - DNA, 22 bp, Homo sapiens
aagtctaagtttgtaacttgga

SEQ ID NO: 6942411 - DNA, 19 bp, Homo sapiens
gtttggcagcaaatcagac

SEQ ID NO: 6942412 - DNA, 16 bp, Homo sapiens
tggccgcagaggcctc

SEQ ID NO: 6942413 - DNA, 21 bp, Homo sapiens
aggaatgtgtatatatacaat

SEQ ID NO: 6942414 - DNA, 22 bp, Homo sapiens
gacatatactatggatggttct

SEQ ID NO: 6942415 - DNA, 22 bp, Homo sapiens
gagggctctgaaaggaggtcac

SEQ ID NO: 6942416 - DNA, 22 bp, Homo sapiens
cacctgcaaggagctttcattt

SEQ ID NO: 6942417 - DNA, 22 bp, Homo sapiens
aaccctttgttcggtgttctgg

SEQ ID NO: 6942418 - DNA, 22 bp, Homo sapiens
actgcatgctttacatgacatg

SEQ ID NO: 6942419 - DNA, 22 bp, Homo sapiens
aactcagcatcagtgtccagaa

SEQ ID NO: 6942420 - DNA, 22 bp, Homo sapiens
gagctacagagtttggtgttca

SEQ ID NO: 6942421 - DNA, 22 bp, Homo sapiens
gatgtagagggaagattttaaa

SEQ ID NO: 6942422 - DNA, 22 bp, Homo sapiens
tacctggaatttatatagctat

SEQ ID NO: 6942423 - DNA, 22 bp, Homo sapiens
aaagaaggacctggaggaggat

SEQ ID NO: 6942424 - DNA, 22 bp, Homo sapiens
atccaaagtagattaagtcaca

SEQ ID NO: 6942425 - DNA, 22 bp, Homo sapiens
tctctagttgaggactgagcag

SEQ ID NO: 6942426 - DNA, 22 bp, Homo sapiens
agggacacgaggtcctgctggg

SEQ ID NO: 6942427 - DNA, 22 bp, Homo sapiens
tctcaggctagtaaaagatggg

SEQ ID NO: 6942428 - DNA, 22 bp, Homo sapiens
atggaaatgtaacttctgattc

SEQ ID NO: 6942429 - DNA, 22 bp, Homo sapiens
gctgagggaggctgaactgagt

SEQ ID NO: 6942430 - DNA, 22 bp, Homo sapiens
gaacactgagaaagtcagcttt

SEQ ID NO: 6942431 - DNA, 22 bp, Homo sapiens
aatagcttttgtatgatgaaat

SEQ ID NO: 6942432 - DNA, 22 bp, Homo sapiens
attccacagaggactccgattg

SEQ ID NO: 6942433 - DNA, 22 bp, Homo sapiens
atggctttgaagttcagctttt

SEQ ID NO: 6942434 - DNA, 22 bp, Homo sapiens
attttttctgtaaactggcctt

SEQ ID NO: 6942435 - DNA, 22 bp, Homo sapiens
caaggtcccagcccctcttggc

SEQ ID NO: 6942436 - DNA, 22 bp, Homo sapiens
gagggcttgtaagtgggtggag

SEQ ID NO: 6942437 - DNA, 22 bp, Homo sapiens
tggcctgcaaagtcttcttgct

SEQ ID NO: 6942438 - DNA, 22 bp, Homo sapiens
gaggtatcttagagagtgtaga

SEQ ID NO: 6942439 - DNA, 22 bp, Homo sapiens
actagtgcagtcgggtaatcgc

SEQ ID NO: 6942440 - DNA, 22 bp, Homo sapiens
aagccctgagcactgcagagaa

SEQ ID NO: 6942441 - DNA, 22 bp, Homo sapiens
aatatgtctctggctagacatt

SEQ ID NO: 6942442 - DNA, 22 bp, Homo sapiens
aagtggtagagagagcataagc

SEQ ID NO: 6942443 - DNA, 22 bp, Homo sapiens
tggccagttgaagacaatgctc

SEQ ID NO: 6942444 - DNA, 22 bp, Homo sapiens
ttctaatgaaagtggaccatgg

SEQ ID NO: 6942445 - DNA, 22 bp, Homo sapiens
gagcagctggtaggtgaaccca

SEQ ID NO: 6942446 - DNA, 18 bp, Homo sapiens
gggtggtgtgctcttcgc

SEQ ID NO: 6942447 - DNA, 22 bp, Homo sapiens
tgaagcttgtatttaaataagt

SEQ ID NO: 6942448 - DNA, 22 bp, Homo sapiens
gaagagctgcagtttcctgggc

SEQ ID NO: 6942449 - DNA, 21 bp, Homo sapiens
tctgggtgctagtgtttgctt

SEQ ID NO: 6942450 - DNA, 14 bp, Homo sapiens
gcaggcagatcacc

SEQ ID NO: 6942451 - DNA, 19 bp, Homo sapiens
ttctgctgttcctaggctg

SEQ ID NO: 6942452 - DNA, 22 bp, Homo sapiens
tctctgccacagcttctgcctt

SEQ ID NO: 6942453 - DNA, 22 bp, Homo sapiens
acaattctgatggtttcccagt

SEQ ID NO: 6942454 - DNA, 22 bp, Homo sapiens
ttgccaggagacatctggagcc

SEQ ID NO: 6942455 - DNA, 22 bp, Homo sapiens
tgatgatgtttatcttggtatt

SEQ ID NO: 6942456 - DNA, 18 bp, Homo sapiens
tctcttttcccctcattg

SEQ ID NO: 6942457 - DNA, 22 bp, Homo sapiens
ttgataaaatgatatcttcttt

SEQ ID NO: 6942458 - DNA, 22 bp, Homo sapiens
agctgcagtcaagctgggccac

SEQ ID NO: 6942459 - DNA, 22 bp, Homo sapiens
gggacaaccaacttagcattac

SEQ ID NO: 6942460 - DNA, 22 bp, Homo sapiens
ccaggagcaaagatcactggga

SEQ ID NO: 6942461 - DNA, 22 bp, Homo sapiens
ggcagcttgtcctggaggatgg

SEQ ID NO: 6942462 - DNA, 22 bp, Homo sapiens
tggtgccatcatagctcactgc

SEQ ID NO: 6942463 - DNA, 20 bp, Homo sapiens
agcaagagtaaggacagcga

SEQ ID NO: 6942464 - DNA, 22 bp, Homo sapiens
ttggttttctaatgtattaagg

SEQ ID NO: 6942465 - DNA, 22 bp, Homo sapiens
gccagcagtcctgctgtgtgcc

SEQ ID NO: 6942466 - DNA, 22 bp, Homo sapiens
ggagtggcagagagggtatact

SEQ ID NO: 6942467 - DNA, 22 bp, Homo sapiens
gccatcctggattcagaccaaa

SEQ ID NO: 6942468 - DNA, 22 bp, Homo sapiens
aaccagctaaactttgctcgaa

SEQ ID NO: 6942469 - DNA, 22 bp, Homo sapiens
aatgttaaaaccttcagtgctt

SEQ ID NO: 6942470 - DNA, 21 bp, Homo sapiens
acagcctccatctcctgggct

SEQ ID NO: 6942471 - DNA, 22 bp, Homo sapiens
cacatgtcctggcgctgagccc

SEQ ID NO: 6942472 - DNA, 22 bp, Homo sapiens
ttgaaaggtgacattgttagag

SEQ ID NO: 6942473 - DNA, 22 bp, Homo sapiens
cttcatgtacagttattggaga

SEQ ID NO: 6942474 - DNA, 22 bp, Homo sapiens
cagaggaggccaccgcataggc

SEQ ID NO: 6942475 - DNA, 22 bp, Homo sapiens
gttgttttgctgtctgtcttag

SEQ ID NO: 6942476 - DNA, 22 bp, Homo sapiens
tgcagtctccacctcctgggtg

SEQ ID NO: 6942477 - DNA, 17 bp, Homo sapiens
tcaggctgggtgcagtg

SEQ ID NO: 6942478 - DNA, 22 bp, Homo sapiens
tgcagcttagtagggtaaagtt

SEQ ID NO: 6942479 - DNA, 21 bp, Homo sapiens
gtagggacagagagttggtga

SEQ ID NO: 6942480 - DNA, 22 bp, Homo sapiens
gcgggccaccttggagagcgct

SEQ ID NO: 6942481 - DNA, 23 bp, Homo sapiens
ctgctttcccactccatgctctt

SEQ ID NO: 6942482 - DNA, 22 bp, Homo sapiens
agcacagcctctggtttctgac

SEQ ID NO: 6942483 - DNA, 22 bp, Homo sapiens
tgggcagcatcctccacagtca

SEQ ID NO: 6942484 - DNA, 22 bp, Homo sapiens
aacccaggagacaggttgcagt

SEQ ID NO: 6942485 - DNA, 23 bp, Homo sapiens
actcagctttgggagatgactca

SEQ ID NO: 6942486 - DNA, 22 bp, Homo sapiens
caacagtatagcttttgactgc

SEQ ID NO: 6942487 - DNA, 19 bp, Homo sapiens
agataagagttgactgtgg

SEQ ID NO: 6942488 - DNA, 22 bp, Homo sapiens
tgtacaaattcattgaactgta

SEQ ID NO: 6942489 - DNA, 19 bp, Homo sapiens
gcttgggagagggagctaa

SEQ ID NO: 6942490 - DNA, 22 bp, Homo sapiens
tcataggctttgacttagttgt

SEQ ID NO: 6942491 - DNA, 19 bp, Homo sapiens
agacacacttgatatgtgt

SEQ ID NO: 6942492 - DNA, 22 bp, Homo sapiens
aagcatggtggatgatacagtg

SEQ ID NO: 6942493 - DNA, 22 bp, Homo sapiens
acctggattttgcttagacatg

SEQ ID NO: 6942494 - DNA, 22 bp, Homo sapiens
aggcacagtgcctggaatcaaa

SEQ ID NO: 6942495 - DNA, 22 bp, Homo sapiens
tccagagctgggtctgtgctca

SEQ ID NO: 6942496 - DNA, 22 bp, Homo sapiens
tttgagatagtctagagtaact

SEQ ID NO: 6942497 - DNA, 22 bp, Homo sapiens
cagcatctgttggatggataag

SEQ ID NO: 6942498 - DNA, 22 bp, Homo sapiens
tgctcagggacaatggagaggg

SEQ ID NO: 6942499 - DNA, 22 bp, Homo sapiens
catgcatgcctggctcacagag

SEQ ID NO: 6942500 - DNA, 22 bp, Homo sapiens
gtggccaagaggggactggata

SEQ ID NO: 6942501 - DNA, 22 bp, Homo sapiens
tgggccaggtgcagtgctttag

SEQ ID NO: 6942502 - DNA, 22 bp, Homo sapiens
atgagaataaaggtgatttcga

SEQ ID NO: 6942503 - DNA, 22 bp, Homo sapiens
tctttgtagttataaacgactt

SEQ ID NO: 6942504 - DNA, 22 bp, Homo sapiens
ctttcagtctttacaaggttgc

SEQ ID NO: 6942505 - DNA, 22 bp, Homo sapiens
ctgaatgagggattctgagggc

SEQ ID NO: 6942506 - DNA, 22 bp, Homo sapiens
tgcatctttttccaagtttatt

SEQ ID NO: 6942507 - DNA, 21 bp, Homo sapiens
acattacagggtgatgtgtct

SEQ ID NO: 6942508 - DNA, 22 bp, Homo sapiens
cctaaagaattttcatagagct

SEQ ID NO: 6942509 - DNA, 22 bp, Homo sapiens
cttgctgccagccaccatactg

SEQ ID NO: 6942510 - DNA, 23 bp, Homo sapiens
ttacaaggctagaattccagcga

SEQ ID NO: 6942511 - DNA, 22 bp, Homo sapiens
tgctgagagccagggctggcat

SEQ ID NO: 6942512 - DNA, 22 bp, Homo sapiens
ccaggtgtggggaggactcaca

SEQ ID NO: 6942513 - DNA, 22 bp, Homo sapiens
gcagcagtactcaatatcctgg

SEQ ID NO: 6942514 - DNA, 22 bp, Homo sapiens
cagggatgagcagatggagcaa

SEQ ID NO: 6942515 - DNA, 22 bp, Homo sapiens
gaggtacagagtgttccaatgt

SEQ ID NO: 6942516 - DNA, 22 bp, Homo sapiens
tgctgaagtccatctgtttgac

SEQ ID NO: 6942517 - DNA, 22 bp, Homo sapiens
tgtatgtattggtcagggttct

SEQ ID NO: 6942518 - DNA, 22 bp, Homo sapiens
tggggagaaatgtctttgttcc

SEQ ID NO: 6942519 - DNA, 22 bp, Homo sapiens
atcacctgatggtgaacaaggg

SEQ ID NO: 6942520 - DNA, 22 bp, Homo sapiens
atacttctagaaatactatgca

SEQ ID NO: 6942521 - DNA, 22 bp, Homo sapiens
tgtcaagatgacagatagatga

SEQ ID NO: 6942522 - DNA, 22 bp, Homo sapiens
taagagctacagcccagggttc

SEQ ID NO: 6942523 - DNA, 22 bp, Homo sapiens
agaattttatctaaagggagta

SEQ ID NO: 6942524 - DNA, 22 bp, Homo sapiens
caagcagaggtttatgtattag

SEQ ID NO: 6942525 - DNA, 22 bp, Homo sapiens
aataagccagcccatgtgaccc

SEQ ID NO: 6942526 - DNA, 22 bp, Homo sapiens
tttcctggagggtccccagcag

SEQ ID NO: 6942527 - DNA, 22 bp, Homo sapiens
ttctttgggcaattgctggccc

SEQ ID NO: 6942528 - DNA, 22 bp, Homo sapiens
aggtggctgagctgtgcccctg

SEQ ID NO: 6942529 - DNA, 22 bp, Homo sapiens
tctgtcattttgtatctacatg

SEQ ID NO: 6942530 - DNA, 22 bp, Homo sapiens
ttggaagttcttagccttttca

SEQ ID NO: 6942531 - DNA, 22 bp, Homo sapiens
tcaggtggaattaattaagaga

SEQ ID NO: 6942532 - DNA, 22 bp, Homo sapiens
gtagggacttgttttactagta

SEQ ID NO: 6942533 - DNA, 22 bp, Homo sapiens
atttttgtatccccagctcctg

SEQ ID NO: 6942534 - DNA, 22 bp, Homo sapiens
ttagagaagctgtaattattca

SEQ ID NO: 6942535 - DNA, 22 bp, Homo sapiens
aagactgtctgggacaagatga

SEQ ID NO: 6942536 - DNA, 22 bp, Homo sapiens
actgtaacgccagctttaaatg

SEQ ID NO: 6942537 - DNA, 22 bp, Homo sapiens
gatgtgtaacatgctgtgacat

SEQ ID NO: 6942538 - DNA, 22 bp, Homo sapiens
tgcataaatagtacctgctttt

SEQ ID NO: 6942539 - DNA, 22 bp, Homo sapiens
gggcactgtgctgggtgcttta

SEQ ID NO: 6942540 - DNA, 22 bp, Homo sapiens
gtgcatcgtgctgtaggctgac

SEQ ID NO: 6942541 - DNA, 22 bp, Homo sapiens
tgactatctagagtggggcaaa

SEQ ID NO: 6942542 - DNA, 22 bp, Homo sapiens
gactgtggcgtagatgctggga

SEQ ID NO: 6942543 - DNA, 22 bp, Homo sapiens
acctctgagatgagtcagggga

SEQ ID NO: 6942544 - DNA, 22 bp, Homo sapiens
ctcctccttcctgtgttgtgca

SEQ ID NO: 6942545 - DNA, 22 bp, Homo sapiens
tattgctttgtgtcataagcaa

SEQ ID NO: 6942546 - DNA, 22 bp, Homo sapiens
tgcacattcacttaggtattgt

SEQ ID NO: 6942547 - DNA, 22 bp, Homo sapiens
tgcttctggagtaacagggtga

SEQ ID NO: 6942548 - DNA, 22 bp, Homo sapiens
tgcatttagttttaataaagga

SEQ ID NO: 6942549 - DNA, 22 bp, Homo sapiens
gggccctggatttaagcatgga

SEQ ID NO: 6942550 - DNA, 22 bp, Homo sapiens
tagatgctgggaaggctgctgg

SEQ ID NO: 6942551 - DNA, 22 bp, Homo sapiens
aaagtttttaagcaagaccctt

SEQ ID NO: 6942552 - DNA, 22 bp, Homo sapiens
ggcctgctctggctgtggtcag

SEQ ID NO: 6942553 - DNA, 22 bp, Homo sapiens
aagaacgaactttgctaattgt

SEQ ID NO: 6942554 - DNA, 22 bp, Homo sapiens
tttggcctctgggagaatattc

SEQ ID NO: 6942555 - DNA, 22 bp, Homo sapiens
aaagtgctttcccacatttgtt

SEQ ID NO: 6942556 - DNA, 22 bp, Homo sapiens
ttccagatttctacacaagacc

SEQ ID NO: 6942557 - DNA, 22 bp, Homo sapiens
gaagccccaaaccctcgccatc

SEQ ID NO: 6942558 - DNA, 22 bp, Homo sapiens
tgttcctggttcctgcatgatg

SEQ ID NO: 6942559 - DNA, 22 bp, Homo sapiens
tttggacaaatgtctgactttc

SEQ ID NO: 6942560 - DNA, 22 bp, Homo sapiens
agtagaccaaacatttaaaacc

SEQ ID NO: 6942561 - DNA, 21 bp, Homo sapiens
tgtgacctgatgtagtacatt

SEQ ID NO: 6942562 - DNA, 22 bp, Homo sapiens
tcagtgtttcctgtggtacagc

SEQ ID NO: 6942563 - DNA, 22 bp, Homo sapiens
atattagtttggagactacaat

SEQ ID NO: 6942564 - DNA, 22 bp, Homo sapiens
actgactagacttacaacagag

SEQ ID NO: 6942565 - DNA, 22 bp, Homo sapiens
ggaggcggggaaggcatcccat

SEQ ID NO: 6942566 - DNA, 22 bp, Homo sapiens
gcacttggagggagggttcaag

SEQ ID NO: 6942567 - DNA, 22 bp, Homo sapiens
gccacaggtgggctctgggaaa

SEQ ID NO: 6942568 - DNA, 22 bp, Homo sapiens
attctctgttcaaggatggtga

SEQ ID NO: 6942569 - DNA, 22 bp, Homo sapiens
tagactggaagctccttgaggc

SEQ ID NO: 6942570 - DNA, 22 bp, Homo sapiens
cagtttccctgcttgaaaacgt

SEQ ID NO: 6942571 - DNA, 22 bp, Homo sapiens
tcctggagcttccttcatggta

SEQ ID NO: 6942572 - DNA, 22 bp, Homo sapiens
gaggactgaaacttacaggaaa

SEQ ID NO: 6942573 - DNA, 22 bp, Homo sapiens
tgactcttggtgattactgggt

SEQ ID NO: 6942574 - DNA, 22 bp, Homo sapiens
cagctggttatcagagaggcct

SEQ ID NO: 6942575 - DNA, 22 bp, Homo sapiens
tctagggaacctatcctatgat

SEQ ID NO: 6942576 - DNA, 23 bp, Homo sapiens
tgggaattgcagggggttctgcc

SEQ ID NO: 6942577 - DNA, 22 bp, Homo sapiens
tcagagcatgtgggctgcagtt

SEQ ID NO: 6942578 - DNA, 22 bp, Homo sapiens
tctgtacagtaccagatagtaa

SEQ ID NO: 6942579 - DNA, 22 bp, Homo sapiens
aacctctctgtgccctgacttt

SEQ ID NO: 6942580 - DNA, 22 bp, Homo sapiens
tgaaaggcagttagaggtgttt

SEQ ID NO: 6942581 - DNA, 22 bp, Homo sapiens
aggcactgggtaattagtagct

SEQ ID NO: 6942582 - DNA, 18 bp, Homo sapiens
ctgccacttaatgtggtg

SEQ ID NO: 6942583 - DNA, 21 bp, Homo sapiens
atcattgcagagcacattaaa

SEQ ID NO: 6942584 - DNA, 16 bp, Homo sapiens
tttctcattgtcatca

SEQ ID NO: 6942585 - DNA, 23 bp, Homo sapiens
tcagtgtctagttgtggaattga

SEQ ID NO: 6942586 - DNA, 20 bp, Homo sapiens
gagggctcgtggatggataa

SEQ ID NO: 6942587 - DNA, 22 bp, Homo sapiens
tgcaggcagctaaaccatgtaa

SEQ ID NO: 6942588 - DNA, 22 bp, Homo sapiens
acccagttcctaagcatccatg

SEQ ID NO: 6942589 - DNA, 22 bp, Homo sapiens
cagcttggcgaatgtaggtatg

SEQ ID NO: 6942590 - DNA, 22 bp, Homo sapiens
ggaggagacagtaaaaagcacg

SEQ ID NO: 6942591 - DNA, 22 bp, Homo sapiens
ttccagaaaacgctttatttag

SEQ ID NO: 6942592 - DNA, 16 bp, Homo sapiens
aggcagcatgttagtg

SEQ ID NO: 6942593 - DNA, 22 bp, Homo sapiens
tcagttgccagtattttatata

SEQ ID NO: 6942594 - DNA, 22 bp, Homo sapiens
ggacaaaggtagacagtctctg

SEQ ID NO: 6942595 - DNA, 21 bp, Homo sapiens
gagcccaggcatctcattaat

SEQ ID NO: 6942596 - DNA, 22 bp, Homo sapiens
tacagggaatgggacataaatc

SEQ ID NO: 6942597 - DNA, 22 bp, Homo sapiens
gttcccaccatgctgcacccat

SEQ ID NO: 6942598 - DNA, 22 bp, Homo sapiens
gaatttgtgctcaggaagatta

SEQ ID NO: 6942599 - DNA, 20 bp, Homo sapiens
ctccaaattcctgaggataa

SEQ ID NO: 6942600 - DNA, 22 bp, Homo sapiens
gagagttattattatccccatt

SEQ ID NO: 6942601 - DNA, 22 bp, Homo sapiens
atcttgattccattatctttgt

SEQ ID NO: 6942602 - DNA, 22 bp, Homo sapiens
atatacttccccattatggggg

SEQ ID NO: 6942603 - DNA, 22 bp, Homo sapiens
atcagtgacttcttccaaagtt

SEQ ID NO: 6942604 - DNA, 22 bp, Homo sapiens
aagaggccttggtctgacctga

SEQ ID NO: 6942605 - DNA, 18 bp, Homo sapiens
ccattgtcctgaggatcc

SEQ ID NO: 6942606 - DNA, 22 bp, Homo sapiens
atgtgccacatgatattgtctc

SEQ ID NO: 6942607 - DNA, 22 bp, Homo sapiens
tctcactaagttatgataatca

SEQ ID NO: 6942608 - DNA, 22 bp, Homo sapiens
tggccagtgcctgccagtgcag

SEQ ID NO: 6942609 - DNA, 22 bp, Homo sapiens
gcctggagggttgaggttttgt

SEQ ID NO: 6942610 - DNA, 22 bp, Homo sapiens
ccacatcagaaatgtttactca

SEQ ID NO: 6942611 - DNA, 22 bp, Homo sapiens
acacatatgccattacagcaaa

SEQ ID NO: 6942612 - DNA, 22 bp, Homo sapiens
tgcattaagggcctggagatac

SEQ ID NO: 6942613 - DNA, 22 bp, Homo sapiens
atggaaatatctttagagctta

SEQ ID NO: 6942614 - DNA, 22 bp, Homo sapiens
acagttaaggaaatggaggttc

SEQ ID NO: 6942615 - DNA, 22 bp, Homo sapiens
atgaggtagctgtggctggctg

SEQ ID NO: 6942616 - DNA, 22 bp, Homo sapiens
tgagttcatatagttcaagata

SEQ ID NO: 6942617 - DNA, 22 bp, Homo sapiens
ccttggtgctctgctgggatgg

SEQ ID NO: 6942618 - DNA, 20 bp, Homo sapiens
agggcaaaatccaaaagtct

SEQ ID NO: 6942619 - DNA, 23 bp, Homo sapiens
tcactgtgcccattgaggtagag

SEQ ID NO: 6942620 - DNA, 22 bp, Homo sapiens
tctgatgtaagttcttccagag

SEQ ID NO: 6942621 - DNA, 22 bp, Homo sapiens
ttgttcactatgaagaggttgg

SEQ ID NO: 6942622 - DNA, 22 bp, Homo sapiens
aagaaagggctattgttctcca

SEQ ID NO: 6942623 - DNA, 22 bp, Homo sapiens
ctcctcttggaatgcgtggctc

SEQ ID NO: 6942624 - DNA, 22 bp, Homo sapiens
attaaatgatggcatgtcttat

SEQ ID NO: 6942625 - DNA, 22 bp, Homo sapiens
acagggaatggagggatcagta

SEQ ID NO: 6942626 - DNA, 22 bp, Homo sapiens
ttatgttatgctatttcagata

SEQ ID NO: 6942627 - DNA, 22 bp, Homo sapiens
gggctgacatatttggtgctct

SEQ ID NO: 6942628 - DNA, 19 bp, Homo sapiens
gttcccattgcagttgtgg

SEQ ID NO: 6942629 - DNA, 22 bp, Homo sapiens
ccctgtgcatattgccagatac

SEQ ID NO: 6942630 - DNA, 22 bp, Homo sapiens
caggacaatggtcatactggat

SEQ ID NO: 6942631 - DNA, 22 bp, Homo sapiens
tattgatatgcagaactgactt

SEQ ID NO: 6942632 - DNA, 22 bp, Homo sapiens
tagaaatgtgataatagcttaa

SEQ ID NO: 6942633 - DNA, 22 bp, Homo sapiens
cccagctcttcaagtcaccccc

SEQ ID NO: 6942634 - DNA, 22 bp, Homo sapiens
gaagatctgcagcctcaggcga

SEQ ID NO: 6942635 - DNA, 22 bp, Homo sapiens
ctggctgggagcgagctgctca

SEQ ID NO: 6942636 - DNA, 22 bp, Homo sapiens
gtgggcagaggagagaacatta

SEQ ID NO: 6942637 - DNA, 22 bp, Homo sapiens
agaagctatttagctgcacttt

SEQ ID NO: 6942638 - DNA, 22 bp, Homo sapiens
tgctccagcaccaagagctcca

SEQ ID NO: 6942639 - DNA, 22 bp, Homo sapiens
tctctgggtaaagttctctcat

SEQ ID NO: 6942640 - DNA, 21 bp, Homo sapiens
tcccattgttcccctccagtg

SEQ ID NO: 6942641 - DNA, 22 bp, Homo sapiens
aatgtctatttgctacaaagcc

SEQ ID NO: 6942642 - DNA, 22 bp, Homo sapiens
gctctatggtgagtgtctgtga

SEQ ID NO: 6942643 - DNA, 22 bp, Homo sapiens
tgcagcatctccttaaatcttg

SEQ ID NO: 6942644 - DNA, 22 bp, Homo sapiens
ggacacaaaagtgaataaaata

SEQ ID NO: 6942645 - DNA, 22 bp, Homo sapiens
ttaatatgttgaaatttattag

SEQ ID NO: 6942646 - DNA, 22 bp, Homo sapiens
aatggctttggcaggaatttca

SEQ ID NO: 6942647 - DNA, 22 bp, Homo sapiens
caggcagccaggggacctgtcc

SEQ ID NO: 6942648 - DNA, 22 bp, Homo sapiens
catctcatttattccaactcag

SEQ ID NO: 6942649 - DNA, 22 bp, Homo sapiens
cctgtgatattgttcataatat

SEQ ID NO: 6942650 - DNA, 22 bp, Homo sapiens
aggcagccacatgagctcctga

SEQ ID NO: 6942651 - DNA, 22 bp, Homo sapiens
tgcaggtggcagcggggcacca

SEQ ID NO: 6942652 - DNA, 22 bp, Homo sapiens
tctccaatgcttaggaaagttt

SEQ ID NO: 6942653 - DNA, 22 bp, Homo sapiens
tttcctttctagaagcctaaat

SEQ ID NO: 6942654 - DNA, 22 bp, Homo sapiens
ctaggccacttgctctcatgga

SEQ ID NO: 6942655 - DNA, 22 bp, Homo sapiens
tacatagtattcacattgtttt

SEQ ID NO: 6942656 - DNA, 22 bp, Homo sapiens
ttccatgaaagtgaaatggagc

SEQ ID NO: 6942657 - DNA, 22 bp, Homo sapiens
ggcctcagtttcttcaactgta

SEQ ID NO: 6942658 - DNA, 22 bp, Homo sapiens
aagtagttaggaacattctctc

SEQ ID NO: 6942659 - DNA, 22 bp, Homo sapiens
acacatgtacagattagtattt

SEQ ID NO: 6942660 - DNA, 22 bp, Homo sapiens
aggccagcctgcccaaagctgc

SEQ ID NO: 6942661 - DNA, 22 bp, Homo sapiens
agtctttacatgtgttatatat

SEQ ID NO: 6942662 - DNA, 22 bp, Homo sapiens
aacagcagaaactgcaagctac

SEQ ID NO: 6942663 - DNA, 22 bp, Homo sapiens
ggccagagagcagccaggattc

SEQ ID NO: 6942664 - DNA, 22 bp, Homo sapiens
atacatgactcacacattctgc

SEQ ID NO: 6942665 - DNA, 22 bp, Homo sapiens
agatgtttgtaaacacactgct

SEQ ID NO: 6942666 - DNA, 22 bp, Homo sapiens
gtcacagtgtcctacaggttga

SEQ ID NO: 6942667 - DNA, 22 bp, Homo sapiens
cctgctatcattctaggcttcc

SEQ ID NO: 6942668 - DNA, 22 bp, Homo sapiens
tgcttatccaggcaatgcattc

SEQ ID NO: 6942669 - DNA, 22 bp, Homo sapiens
gtgccgtgggccttagtgatct

SEQ ID NO: 6942670 - DNA, 20 bp, Homo sapiens
agtgtttgctcacagtctcc

SEQ ID NO: 6942671 - DNA, 21 bp, Homo sapiens
tggcagactagagtatagatg

SEQ ID NO: 6942672 - DNA, 22 bp, Homo sapiens
actttccacaccattttgtggt

SEQ ID NO: 6942673 - DNA, 22 bp, Homo sapiens
gaaggcctctccccttctccag

SEQ ID NO: 6942674 - DNA, 19 bp, Homo sapiens
cattttaagcatccccagt

SEQ ID NO: 6942675 - DNA, 22 bp, Homo sapiens
tctagagacaaaggaaggaggg

SEQ ID NO: 6942676 - DNA, 22 bp, Homo sapiens
gtggatgatgagtgactacaga

SEQ ID NO: 6942677 - DNA, 22 bp, Homo sapiens
atccagacacctactgctactt

SEQ ID NO: 6942678 - DNA, 22 bp, Homo sapiens
cacaacttagcagcttgaaaca

SEQ ID NO: 6942679 - DNA, 19 bp, Homo sapiens
ggtaaatgatacatgctga

SEQ ID NO: 6942680 - DNA, 22 bp, Homo sapiens
cacccaggcaaggattctgcaa

SEQ ID NO: 6942681 - DNA, 22 bp, Homo sapiens
ttgaggtcaagtaaccactgga

SEQ ID NO: 6942682 - DNA, 22 bp, Homo sapiens
aaggaaatctttgtaacatctt

SEQ ID NO: 6942683 - DNA, 22 bp, Homo sapiens
agttcacagaatggccagaact

SEQ ID NO: 6942684 - DNA, 22 bp, Homo sapiens
ttggtttactaggattcaaatt

SEQ ID NO: 6942685 - DNA, 22 bp, Homo sapiens
ttgtgagagaaaatgtgtatat

SEQ ID NO: 6942686 - DNA, 22 bp, Homo sapiens
ctctgtccacaggtttgtccct

SEQ ID NO: 6942687 - DNA, 22 bp, Homo sapiens
gaagtcagaaaagaattaggga

SEQ ID NO: 6942688 - DNA, 16 bp, Homo sapiens
gctgaagtgagtatag

SEQ ID NO: 6942689 - DNA, 17 bp, Homo sapiens
tcagcatacacagagaa

SEQ ID NO: 6942690 - DNA, 22 bp, Homo sapiens
gctgtgtctgttttacgtcaag

SEQ ID NO: 6942691 - DNA, 22 bp, Homo sapiens
tgcaatttttatcaattcagca

SEQ ID NO: 6942692 - DNA, 19 bp, Homo sapiens
ggaagccaggtcagcccac

SEQ ID NO: 6942693 - DNA, 22 bp, Homo sapiens
acagtagagcatttgttttgat

SEQ ID NO: 6942694 - DNA, 22 bp, Homo sapiens
taggaatgtctatgcagtgagg

SEQ ID NO: 6942695 - DNA, 21 bp, Homo sapiens
agagggagagtggcccttcca

SEQ ID NO: 6942696 - DNA, 22 bp, Homo sapiens
agcttgtctaaggacacagctt

SEQ ID NO: 6942697 - DNA, 22 bp, Homo sapiens
gccactggcgctgtgcagagtg

SEQ ID NO: 6942698 - DNA, 22 bp, Homo sapiens
gatctcagacaggtggacaggg

SEQ ID NO: 6942699 - DNA, 22 bp, Homo sapiens
aaaggactgatgctgagtacct

SEQ ID NO: 6942700 - DNA, 22 bp, Homo sapiens
gcagtagtttcaaaacaagaaa

SEQ ID NO: 6942701 - DNA, 22 bp, Homo sapiens
tatatactttcttcctgggtag

SEQ ID NO: 6942702 - DNA, 22 bp, Homo sapiens
atagggcatcctttattgagat

SEQ ID NO: 6942703 - DNA, 22 bp, Homo sapiens
atcagagtcagaggctagagct

SEQ ID NO: 6942704 - DNA, 22 bp, Homo sapiens
ttcaagcaccaaattagtaggc

SEQ ID NO: 6942705 - DNA, 22 bp, Homo sapiens
ggctccctgggggtcggagagt

SEQ ID NO: 6942706 - DNA, 22 bp, Homo sapiens
tctggctctccagtgctcttag

SEQ ID NO: 6942707 - DNA, 22 bp, Homo sapiens
ccaggaagtatgacccaacaga

SEQ ID NO: 6942708 - DNA, 22 bp, Homo sapiens
acaaatttgaatcctgacttct

SEQ ID NO: 6942709 - DNA, 22 bp, Homo sapiens
aaaaggcattttgtcaaccata

SEQ ID NO: 6942710 - DNA, 22 bp, Homo sapiens
cagtacgctcacgtatatgatt

SEQ ID NO: 6942711 - DNA, 19 bp, Homo sapiens
tctagacaccaaagttgtc

SEQ ID NO: 6942712 - DNA, 22 bp, Homo sapiens
agttctggcgcccatgagcaga

SEQ ID NO: 6942713 - DNA, 22 bp, Homo sapiens
aaagagactggtggcattttgc

SEQ ID NO: 6942714 - DNA, 22 bp, Homo sapiens
tgacaagatcacagtcaagtgt

SEQ ID NO: 6942715 - DNA, 22 bp, Homo sapiens
gtcctgggagatgggaccctga

SEQ ID NO: 6942716 - DNA, 22 bp, Homo sapiens
cactgtctgagctggtgattag

SEQ ID NO: 6942717 - DNA, 22 bp, Homo sapiens
ttcatactgtttaagttctgtt

SEQ ID NO: 6942718 - DNA, 22 bp, Homo sapiens
aggtccctcgcacatgcagggt

SEQ ID NO: 6942719 - DNA, 22 bp, Homo sapiens
ccttcgaaggtgctgggatggt

SEQ ID NO: 6942720 - DNA, 22 bp, Homo sapiens
ggacagtggcctggtggtatag

SEQ ID NO: 6942721 - DNA, 22 bp, Homo sapiens
aggcagcatccagaggagaatg

SEQ ID NO: 6942722 - DNA, 22 bp, Homo sapiens
tctttggcacttctgttttaag

SEQ ID NO: 6942723 - DNA, 22 bp, Homo sapiens
gcttcagggttatgcaagagtg

SEQ ID NO: 6942724 - DNA, 17 bp, Homo sapiens
tgcatgcgtctgtgata

SEQ ID NO: 6942725 - DNA, 22 bp, Homo sapiens
gctcaggcctggctatccattg

SEQ ID NO: 6942726 - DNA, 22 bp, Homo sapiens
gggcatgtacataatctagaaa

SEQ ID NO: 6942727 - DNA, 22 bp, Homo sapiens
gctgcattgctataaaatacaa

SEQ ID NO: 6942728 - DNA, 22 bp, Homo sapiens
agaataaccagtgtttcacagt

SEQ ID NO: 6942729 - DNA, 22 bp, Homo sapiens
acactgttttagggaagaaaat

SEQ ID NO: 6942730 - DNA, 22 bp, Homo sapiens
ggggctctcaggtctccccaaa

SEQ ID NO: 6942731 - DNA, 22 bp, Homo sapiens
tctctcttcatgcttttagaat

SEQ ID NO: 6942732 - DNA, 22 bp, Homo sapiens
agaagtttggatgccatcatag

SEQ ID NO: 6942733 - DNA, 22 bp, Homo sapiens
tagtgattttcatattacatta

SEQ ID NO: 6942734 - DNA, 22 bp, Homo sapiens
ccttgatggtgagagctgcaga

SEQ ID NO: 6942735 - DNA, 22 bp, Homo sapiens
caggtggcagaggtctctggaa

SEQ ID NO: 6942736 - DNA, 22 bp, Homo sapiens
ttgacaggaatctttttgttat

SEQ ID NO: 6942737 - DNA, 22 bp, Homo sapiens
agaatcattatatttattaagc

SEQ ID NO: 6942738 - DNA, 22 bp, Homo sapiens
caagcagaagcctcaggggcat

SEQ ID NO: 6942739 - DNA, 22 bp, Homo sapiens
ccagactggggctccttgaggg

SEQ ID NO: 6942740 - DNA, 22 bp, Homo sapiens
tttgaaaagaaccatcgcctta

SEQ ID NO: 6942741 - DNA, 22 bp, Homo sapiens
gcaccagcctgagcctcttgca

SEQ ID NO: 6942742 - DNA, 22 bp, Homo sapiens
tgaaggaggaatgtggcctcca

SEQ ID NO: 6942743 - DNA, 22 bp, Homo sapiens
cttgctctagatgttcagagct

SEQ ID NO: 6942744 - DNA, 22 bp, Homo sapiens
catgttggtgtgctgcacccgt

SEQ ID NO: 6942745 - DNA, 22 bp, Homo sapiens
ctcctggagcagcaggcgcagg

SEQ ID NO: 6942746 - DNA, 22 bp, Homo sapiens
ctgaactcatgatatgcttttg

SEQ ID NO: 6942747 - DNA, 22 bp, Homo sapiens
attgtctctgaattttcagctg

SEQ ID NO: 6942748 - DNA, 22 bp, Homo sapiens
cttgtatacagagaaggctcat

SEQ ID NO: 6942749 - DNA, 20 bp, Homo sapiens
tgatggtattaggaggtgtg

SEQ ID NO: 6942750 - DNA, 22 bp, Homo sapiens
tcccacaacctttctgtaaatc

SEQ ID NO: 6942751 - DNA, 22 bp, Homo sapiens
gaatgttcctcagacttcccca

SEQ ID NO: 6942752 - DNA, 22 bp, Homo sapiens
atcataaaccactttgtaatct

SEQ ID NO: 6942753 - DNA, 22 bp, Homo sapiens
tgctggttctttccttcccttc

SEQ ID NO: 6942754 - DNA, 22 bp, Homo sapiens
aattgcttgtcttcttccctac

SEQ ID NO: 6942755 - DNA, 22 bp, Homo sapiens
tgagttcaaagacaggtatagg

SEQ ID NO: 6942756 - DNA, 22 bp, Homo sapiens
tttaaaatttagacctctccac

SEQ ID NO: 6942757 - DNA, 22 bp, Homo sapiens
caggcctcccggtgcacactga

SEQ ID NO: 6942758 - DNA, 22 bp, Homo sapiens
tataactaatactggccatgag

SEQ ID NO: 6942759 - DNA, 22 bp, Homo sapiens
aacctgcatgtttctaaaagca

SEQ ID NO: 6942760 - DNA, 22 bp, Homo sapiens
agctgctcacagggattcatgc

SEQ ID NO: 6942761 - DNA, 22 bp, Homo sapiens
aggctcagtctgttcatgcact

SEQ ID NO: 6942762 - DNA, 22 bp, Homo sapiens
ctgtccagtcagaacgtcatta

SEQ ID NO: 6942763 - DNA, 22 bp, Homo sapiens
tctgagctggagcccatcacct

SEQ ID NO: 6942764 - DNA, 22 bp, Homo sapiens
attcagttccttgtgattgtag

SEQ ID NO: 6942765 - DNA, 19 bp, Homo sapiens
agttattgatctattcagg

SEQ ID NO: 6942766 - DNA, 22 bp, Homo sapiens
tgtctgtaatcaactgagtttc

SEQ ID NO: 6942767 - DNA, 22 bp, Homo sapiens
aaggatagaataactcttgact

SEQ ID NO: 6942768 - DNA, 22 bp, Homo sapiens
tgttcacaggaggggcttatgg

SEQ ID NO: 6942769 - DNA, 22 bp, Homo sapiens
aagagattggttataagagatt

SEQ ID NO: 6942770 - DNA, 22 bp, Homo sapiens
gggcagtgtcgaggtctggtcc

SEQ ID NO: 6942771 - DNA, 21 bp, Homo sapiens
agcctcaggttgttggttctt

SEQ ID NO: 6942772 - DNA, 22 bp, Homo sapiens
agcagggtcctgaggtgagtca

SEQ ID NO: 6942773 - DNA, 22 bp, Homo sapiens
tcagagctttggagaccaggaa

SEQ ID NO: 6942774 - DNA, 22 bp, Homo sapiens
ggcacaatcatgaagttgagtt

SEQ ID NO: 6942775 - DNA, 22 bp, Homo sapiens
tcagttgctaaatggtgtagtg

SEQ ID NO: 6942776 - DNA, 22 bp, Homo sapiens
tgatacatgattggtatggcga

SEQ ID NO: 6942777 - DNA, 23 bp, Homo sapiens
catcagaggttgccactccctgg

SEQ ID NO: 6942778 - DNA, 22 bp, Homo sapiens
gtcttatttaaggacaagaaga

SEQ ID NO: 6942779 - DNA, 22 bp, Homo sapiens
ctgtgccctctttgctggcctt

SEQ ID NO: 6942780 - DNA, 22 bp, Homo sapiens
aatgacctcagagcacccagaa

SEQ ID NO: 6942781 - DNA, 22 bp, Homo sapiens
gccctttattagagctgccatt

SEQ ID NO: 6942782 - DNA, 22 bp, Homo sapiens
ctgggccttgccaggggtgtct

SEQ ID NO: 6942783 - DNA, 22 bp, Homo sapiens
ataaacctatgctaagctgtgg

SEQ ID NO: 6942784 - DNA, 22 bp, Homo sapiens
tcgtaaggttgtttacaacaat

SEQ ID NO: 6942785 - DNA, 22 bp, Homo sapiens
gaacattcctggaagagtgctt

SEQ ID NO: 6942786 - DNA, 22 bp, Homo sapiens
agggctctgagtgggaaagagg

SEQ ID NO: 6942787 - DNA, 22 bp, Homo sapiens
gatctccatctgcagtgtctgg

SEQ ID NO: 6942788 - DNA, 22 bp, Homo sapiens
actgtaatatgaaggtcctatt

SEQ ID NO: 6942789 - DNA, 19 bp, Homo sapiens
tctggctgccaaggattga

SEQ ID NO: 6942790 - DNA, 22 bp, Homo sapiens
atggctgcagtccgtgccctgg

SEQ ID NO: 6942791 - DNA, 22 bp, Homo sapiens
cataggaaaagcattcttcttg

SEQ ID NO: 6942792 - DNA, 22 bp, Homo sapiens
tctgggaagcctgtatgcagaa

SEQ ID NO: 6942793 - DNA, 22 bp, Homo sapiens
ggttccagaccacgggtgttct

SEQ ID NO: 6942794 - DNA, 22 bp, Homo sapiens
agtccaaacaaacttcccgagg

SEQ ID NO: 6942795 - DNA, 22 bp, Homo sapiens
gtggaacagggagcctggaatg

SEQ ID NO: 6942796 - DNA, 22 bp, Homo sapiens
ctggctgcagctccgaggaaga

SEQ ID NO: 6942797 - DNA, 22 bp, Homo sapiens
ggaagtttcaggaatctgcatt

SEQ ID NO: 6942798 - DNA, 22 bp, Homo sapiens
tcctgaggccctgttagggtct

SEQ ID NO: 6942799 - DNA, 22 bp, Homo sapiens
gcaaccatttggaatgtaaaaa

SEQ ID NO: 6942800 - DNA, 22 bp, Homo sapiens
cagtgtctgggacagaaagtca

SEQ ID NO: 6942801 - DNA, 22 bp, Homo sapiens
cccctcttgtgggctcaggtca

SEQ ID NO: 6942802 - DNA, 22 bp, Homo sapiens
tgagttaaatgagaacatgaaa

SEQ ID NO: 6942803 - DNA, 22 bp, Homo sapiens
gatgtctctcacatagaaggta

SEQ ID NO: 6942804 - DNA, 22 bp, Homo sapiens
tctgtaaacacccgtaagcttt

SEQ ID NO: 6942805 - DNA, 22 bp, Homo sapiens
ttgtgataacagaattcactct

SEQ ID NO: 6942806 - DNA, 22 bp, Homo sapiens
cacagggagaggaacagcgcag

SEQ ID NO: 6942807 - DNA, 22 bp, Homo sapiens
cagtcttttgtatattagcaga

SEQ ID NO: 6942808 - DNA, 22 bp, Homo sapiens
actgaggtcaggggtatgtgat

SEQ ID NO: 6942809 - DNA, 22 bp, Homo sapiens
gtgcaggctctcgttcttgaca

SEQ ID NO: 6942810 - DNA, 22 bp, Homo sapiens
attaacatgcagccagacacac

SEQ ID NO: 6942811 - DNA, 22 bp, Homo sapiens
ggtttgcattctgaaaggctca

SEQ ID NO: 6942812 - DNA, 23 bp, Homo sapiens
aggtgccaactgagagctgagag

SEQ ID NO: 6942813 - DNA, 22 bp, Homo sapiens
tcccaggctgggggcctgaagt

SEQ ID NO: 6942814 - DNA, 22 bp, Homo sapiens
atgcccctggcctggggaacat

SEQ ID NO: 6942815 - DNA, 22 bp, Homo sapiens
tttctgcaggtattgcataagt

SEQ ID NO: 6942816 - DNA, 22 bp, Homo sapiens
ctgaaggctaaaatggactgaa

SEQ ID NO: 6942817 - DNA, 21 bp, Homo sapiens
tctctgggaggacttgtgaga

SEQ ID NO: 6942818 - DNA, 22 bp, Homo sapiens
ttgattaatcccatgtgagtag

SEQ ID NO: 6942819 - DNA, 22 bp, Homo sapiens
ttcattcaaagaggcatccaag

SEQ ID NO: 6942820 - DNA, 22 bp, Homo sapiens
ctcactgtgccttttcccaaac

SEQ ID NO: 6942821 - DNA, 22 bp, Homo sapiens
ctctaggctgcccaggagctga

SEQ ID NO: 6942822 - DNA, 23 bp, Homo sapiens
caggacatgggaggaagtatggc

SEQ ID NO: 6942823 - DNA, 20 bp, Homo sapiens
tttctgcagatgtttacatg

SEQ ID NO: 6942824 - DNA, 22 bp, Homo sapiens
ggtggcattcagtaagtatata

SEQ ID NO: 6942825 - DNA, 22 bp, Homo sapiens
catggcactgagcaggtatgca

SEQ ID NO: 6942826 - DNA, 22 bp, Homo sapiens
gctgcctggagctcagcctgcc

SEQ ID NO: 6942827 - DNA, 22 bp, Homo sapiens
tcttgaagaaagtcaagttatt

SEQ ID NO: 6942828 - DNA, 22 bp, Homo sapiens
tggggctcacctaggctggaag

SEQ ID NO: 6942829 - DNA, 22 bp, Homo sapiens
tggctggttttggtgagctccg

SEQ ID NO: 6942830 - DNA, 22 bp, Homo sapiens
agcagatagtagaacatgtata

SEQ ID NO: 6942831 - DNA, 22 bp, Homo sapiens
tcacctctactcagcctagttc

SEQ ID NO: 6942832 - DNA, 22 bp, Homo sapiens
tccaggctgcaaggccacaggg

SEQ ID NO: 6942833 - DNA, 22 bp, Homo sapiens
tatgaactgctcttgtgttttg

SEQ ID NO: 6942834 - DNA, 22 bp, Homo sapiens
atgccttatagtccacagtgga

SEQ ID NO: 6942835 - DNA, 22 bp, Homo sapiens
caggacatcttctgtgttttta

SEQ ID NO: 6942836 - DNA, 22 bp, Homo sapiens
ttggatgtttgaaatcacgtac

SEQ ID NO: 6942837 - DNA, 22 bp, Homo sapiens
tgttaaatgtattatgtgttct

SEQ ID NO: 6942838 - DNA, 22 bp, Homo sapiens
agtttatgttgtttataagcca

SEQ ID NO: 6942839 - DNA, 22 bp, Homo sapiens
agaggacagacggaaagtgcca

SEQ ID NO: 6942840 - DNA, 22 bp, Homo sapiens
tttctgggactggggagattct

SEQ ID NO: 6942841 - DNA, 22 bp, Homo sapiens
ctgtaaaactgcttaagtatgc

SEQ ID NO: 6942842 - DNA, 22 bp, Homo sapiens
ctggcagtgcccagtcactgtt

SEQ ID NO: 6942843 - DNA, 22 bp, Homo sapiens
ctgaaactatggggaggggagc

SEQ ID NO: 6942844 - DNA, 22 bp, Homo sapiens
tatcataggtgtcataatagca

SEQ ID NO: 6942845 - DNA, 22 bp, Homo sapiens
cgctgcagtttatgtgttcctg

SEQ ID NO: 6942846 - DNA, 22 bp, Homo sapiens
ggcaggcaggagcgtgcttggg

SEQ ID NO: 6942847 - DNA, 23 bp, Homo sapiens
tatgatcatgatattgcagggga

SEQ ID NO: 6942848 - DNA, 22 bp, Homo sapiens
tcacaacttgaagctgatttaa

SEQ ID NO: 6942849 - DNA, 22 bp, Homo sapiens
atacccagtccaatctcttagc

SEQ ID NO: 6942850 - DNA, 22 bp, Homo sapiens
ctcctggacatggagcggagga

SEQ ID NO: 6942851 - DNA, 22 bp, Homo sapiens
ggtggttcacgcctataatccc

SEQ ID NO: 6942852 - DNA, 22 bp, Homo sapiens
caattcccagctgccgggctgc

SEQ ID NO: 6942853 - DNA, 22 bp, Homo sapiens
atcctgttagcaccttcaaact

SEQ ID NO: 6942854 - DNA, 21 bp, Homo sapiens
acagagtagttgaaacagaga

SEQ ID NO: 6942855 - DNA, 22 bp, Homo sapiens
ggcgcagaacatgctatacaca

SEQ ID NO: 6942856 - DNA, 22 bp, Homo sapiens
tagcagtctttctttgggacta

SEQ ID NO: 6942857 - DNA, 23 bp, Homo sapiens
ccactctcccaccatatctgtat

SEQ ID NO: 6942858 - DNA, 22 bp, Homo sapiens
ttacagtttaagaggaaacaaa

SEQ ID NO: 6942859 - DNA, 22 bp, Homo sapiens
attctcaatggctactttcata

SEQ ID NO: 6942860 - DNA, 22 bp, Homo sapiens
gccttgggcacaggcagggccc

SEQ ID NO: 6942861 - DNA, 22 bp, Homo sapiens
caggctgcggtcggctctggtc

SEQ ID NO: 6942862 - DNA, 22 bp, Homo sapiens
ggcctgtgagcccttgcatgta

SEQ ID NO: 6942863 - DNA, 22 bp, Homo sapiens
aatctccatttaccctgcatct

SEQ ID NO: 6942864 - DNA, 20 bp, Homo sapiens
gcaagtgaaaactatgggtg

SEQ ID NO: 6942865 - DNA, 22 bp, Homo sapiens
ttacacaaacacattccagata

SEQ ID NO: 6942866 - DNA, 22 bp, Homo sapiens
tttagagtcattttatattgac

SEQ ID NO: 6942867 - DNA, 23 bp, Homo sapiens
tcagaatgcactgaatttaccct

SEQ ID NO: 6942868 - DNA, 22 bp, Homo sapiens
tagaccattttacaatagtgtg

SEQ ID NO: 6942869 - DNA, 17 bp, Homo sapiens
tctagaagtgcttacat

SEQ ID NO: 6942870 - DNA, 22 bp, Homo sapiens
cagctattattttctctaaatt

SEQ ID NO: 6942871 - DNA, 22 bp, Homo sapiens
tagcatttggcaccagttattt

SEQ ID NO: 6942872 - DNA, 22 bp, Homo sapiens
tcttggctttctcctagggatg

SEQ ID NO: 6942873 - DNA, 22 bp, Homo sapiens
atggaattaataggggaatact

SEQ ID NO: 6942874 - DNA, 22 bp, Homo sapiens
tacttctgttcttaaaccaaga

SEQ ID NO: 6942875 - DNA, 22 bp, Homo sapiens
tgctccagcgctgccaccagtt

SEQ ID NO: 6942876 - DNA, 22 bp, Homo sapiens
actggcaaaatagtatattcct

SEQ ID NO: 6942877 - DNA, 22 bp, Homo sapiens
ggatgctgatatagagcattct

SEQ ID NO: 6942878 - DNA, 17 bp, Homo sapiens
agtttttggacctgtgt

SEQ ID NO: 6942879 - DNA, 22 bp, Homo sapiens
ttctcacagaagcacgaagcct

SEQ ID NO: 6942880 - DNA, 22 bp, Homo sapiens
aggcaggcaaccacctgggaag

SEQ ID NO: 6942881 - DNA, 22 bp, Homo sapiens
atatttcagctttacttaggaa

SEQ ID NO: 6942882 - DNA, 22 bp, Homo sapiens
tcacaagaactttggagggata

SEQ ID NO: 6942883 - DNA, 22 bp, Homo sapiens
gcagaatatattactgagcctc

SEQ ID NO: 6942884 - DNA, 17 bp, Homo sapiens
tgtaaaacccagaggtc

SEQ ID NO: 6942885 - DNA, 22 bp, Homo sapiens
aaaggttagttcttagaagtgc

SEQ ID NO: 6942886 - DNA, 22 bp, Homo sapiens
aagatacattatgtctctctga

SEQ ID NO: 6942887 - DNA, 22 bp, Homo sapiens
taggccttgaaagtagctctgc

SEQ ID NO: 6942888 - DNA, 22 bp, Homo sapiens
tgtttgtgagatgtgaggtacg

SEQ ID NO: 6942889 - DNA, 22 bp, Homo sapiens
gggctgatgtgacagaactctc

SEQ ID NO: 6942890 - DNA, 22 bp, Homo sapiens
tcatggaaggagtggccaagtg

SEQ ID NO: 6942891 - DNA, 22 bp, Homo sapiens
tatttgctctcggcccggcccc

SEQ ID NO: 6942892 - DNA, 22 bp, Homo sapiens
gcagcccaggctcgctcactgc

SEQ ID NO: 6942893 - DNA, 22 bp, Homo sapiens
gcttctctggcctgcagggcat

SEQ ID NO: 6942894 - DNA, 22 bp, Homo sapiens
ttcaggaaattggagtccttct

SEQ ID NO: 6942895 - DNA, 22 bp, Homo sapiens
gatttacagctatacccaatgg

SEQ ID NO: 6942896 - DNA, 22 bp, Homo sapiens
tgtctgagtgtgcctgggcatt

SEQ ID NO: 6942897 - DNA, 22 bp, Homo sapiens
tgtgcgctccggcgagtcagcg

SEQ ID NO: 6942898 - DNA, 19 bp, Homo sapiens
tttggaactttttgatgcc

SEQ ID NO: 6942899 - DNA, 22 bp, Homo sapiens
ctgcagttgactccctgtttgc

SEQ ID NO: 6942900 - DNA, 22 bp, Homo sapiens
agaagcttccacggatgtgtct

SEQ ID NO: 6942901 - DNA, 22 bp, Homo sapiens
tcagctctgcaaggtcacctcc

SEQ ID NO: 6942902 - DNA, 22 bp, Homo sapiens
ttggcccagcatgcgggtctgt

SEQ ID NO: 6942903 - DNA, 22 bp, Homo sapiens
ggtgctattcctatacagcatt

SEQ ID NO: 6942904 - DNA, 22 bp, Homo sapiens
agtgatgtaggtggattctggc

SEQ ID NO: 6942905 - DNA, 22 bp, Homo sapiens
tcttttaagcctctggcatagg

SEQ ID NO: 6942906 - DNA, 22 bp, Homo sapiens
ggaacaggaaaggagggatgct

SEQ ID NO: 6942907 - DNA, 22 bp, Homo sapiens
gaggtggccaagcgaggaaggg

SEQ ID NO: 6942908 - DNA, 16 bp, Homo sapiens
tctctgagtgctaagt

SEQ ID NO: 6942909 - DNA, 22 bp, Homo sapiens
aatcttagagtgtttttgaagc

SEQ ID NO: 6942910 - DNA, 22 bp, Homo sapiens
gctttagatctgactttctgtg

SEQ ID NO: 6942911 - DNA, 22 bp, Homo sapiens
atagagtacagtctttgattat

SEQ ID NO: 6942912 - DNA, 22 bp, Homo sapiens
aggaatgtgactattttttcag

SEQ ID NO: 6942913 - DNA, 18 bp, Homo sapiens
tctgtaatttttccttga

SEQ ID NO: 6942914 - DNA, 22 bp, Homo sapiens
aatgtggttaacccatttaaga

SEQ ID NO: 6942915 - DNA, 22 bp, Homo sapiens
atgcctggtcccacctctaggt

SEQ ID NO: 6942916 - DNA, 22 bp, Homo sapiens
caggagtccagagtgtcatttt

SEQ ID NO: 6942917 - DNA, 21 bp, Homo sapiens
tctatcacctaaattaaacag

SEQ ID NO: 6942918 - DNA, 22 bp, Homo sapiens
ggttaagccatcagatggatct

SEQ ID NO: 6942919 - DNA, 22 bp, Homo sapiens
ccaagtactctcaccaaagctt

SEQ ID NO: 6942920 - DNA, 22 bp, Homo sapiens
gctgagaaatgcagacatgctg

SEQ ID NO: 6942921 - DNA, 22 bp, Homo sapiens
gtttacagtactcacttgcatt

SEQ ID NO: 6942922 - DNA, 22 bp, Homo sapiens
gaagagagagtggggttctgcg

SEQ ID NO: 6942923 - DNA, 22 bp, Homo sapiens
tctttatgcctacctgggaaga

SEQ ID NO: 6942924 - DNA, 22 bp, Homo sapiens
gcaaagacaaattagaactcct

SEQ ID NO: 6942925 - DNA, 22 bp, Homo sapiens
gaggtttcactgtgttgtccag

SEQ ID NO: 6942926 - DNA, 22 bp, Homo sapiens
ctggccagagttggagggtgtg

SEQ ID NO: 6942927 - DNA, 22 bp, Homo sapiens
atccatttgtaaatgttagagt

SEQ ID NO: 6942928 - DNA, 23 bp, Homo sapiens
ctgtggagccctttgttgggaga

SEQ ID NO: 6942929 - DNA, 22 bp, Homo sapiens
attgctaggaacaggttgcacc

SEQ ID NO: 6942930 - DNA, 22 bp, Homo sapiens
agtctgcttttgtgaagagctg

SEQ ID NO: 6942931 - DNA, 22 bp, Homo sapiens
acatgcatacacgtacatacct

SEQ ID NO: 6942932 - DNA, 23 bp, Homo sapiens
cgtgtccttcagggagagtgtgg

SEQ ID NO: 6942933 - DNA, 22 bp, Homo sapiens
tagttaaagagatccacattcc

SEQ ID NO: 6942934 - DNA, 22 bp, Homo sapiens
cccctggggatcagctggaatt

SEQ ID NO: 6942935 - DNA, 22 bp, Homo sapiens
ttccctctttcactgtgatttt

SEQ ID NO: 6942936 - DNA, 22 bp, Homo sapiens
gctctgagcccccagaagcaga

SEQ ID NO: 6942937 - DNA, 22 bp, Homo sapiens
acagagcttaattcaggagctt

SEQ ID NO: 6942938 - DNA, 20 bp, Homo sapiens
agaaacagcacaattctgtt

SEQ ID NO: 6942939 - DNA, 22 bp, Homo sapiens
atttcttgtgggaaatgcagca

SEQ ID NO: 6942940 - DNA, 22 bp, Homo sapiens
aaatgtcctgagattcaactta

SEQ ID NO: 6942941 - DNA, 22 bp, Homo sapiens
cttgctgctctggagtcatgcc

SEQ ID NO: 6942942 - DNA, 22 bp, Homo sapiens
acaagttccactacagagttgt

SEQ ID NO: 6942943 - DNA, 22 bp, Homo sapiens
gcagaattgaaatgtgtcactt

SEQ ID NO: 6942944 - DNA, 22 bp, Homo sapiens
gcctatacaaactgagcttgag

SEQ ID NO: 6942945 - DNA, 22 bp, Homo sapiens
actgcagccccctattaggact

SEQ ID NO: 6942946 - DNA, 22 bp, Homo sapiens
gtgaataacctactccaggcct

SEQ ID NO: 6942947 - DNA, 22 bp, Homo sapiens
taagggaacagcttcaaactca

SEQ ID NO: 6942948 - DNA, 22 bp, Homo sapiens
gttgtaaatgactggcattggg

SEQ ID NO: 6942949 - DNA, 22 bp, Homo sapiens
aggctgtagtgcatgtgctatg

SEQ ID NO: 6942950 - DNA, 22 bp, Homo sapiens
aacacatatttttgctgagcat

SEQ ID NO: 6942951 - DNA, 22 bp, Homo sapiens
gtgagcatcaaaaacgtgtatg

SEQ ID NO: 6942952 - DNA, 22 bp, Homo sapiens
atggtcaaagataaagtgatct

SEQ ID NO: 6942953 - DNA, 22 bp, Homo sapiens
ggcaaaaaccataattactttt

SEQ ID NO: 6942954 - DNA, 22 bp, Homo sapiens
gcctgttaaacatgcggctcaa

SEQ ID NO: 6942955 - DNA, 22 bp, Homo sapiens
tgcaaattcaaacattttcctg

SEQ ID NO: 6942956 - DNA, 22 bp, Homo sapiens
gtgagagaaattggagggaatg

SEQ ID NO: 6942957 - DNA, 22 bp, Homo sapiens
cccagcctactctgccatagca

SEQ ID NO: 6942958 - DNA, 22 bp, Homo sapiens
agcagcagctctgttgccctac

SEQ ID NO: 6942959 - DNA, 22 bp, Homo sapiens
tccaggaaagtgggatgtgtgt

SEQ ID NO: 6942960 - DNA, 22 bp, Homo sapiens
atctttaaagacatgtgaactt

SEQ ID NO: 6942961 - DNA, 22 bp, Homo sapiens
agcaggcaaggtccgtgcctcg

SEQ ID NO: 6942962 - DNA, 22 bp, Homo sapiens
ttgggagttcctactgcggttt

SEQ ID NO: 6942963 - DNA, 22 bp, Homo sapiens
tcagagcaacttttcctgcttt

SEQ ID NO: 6942964 - DNA, 22 bp, Homo sapiens
atactacatactatgtaaacat

SEQ ID NO: 6942965 - DNA, 22 bp, Homo sapiens
gctgagcctagctgtctcctgt

SEQ ID NO: 6942966 - DNA, 22 bp, Homo sapiens
ctgcatccatgttgctgcaaag

SEQ ID NO: 6942967 - DNA, 22 bp, Homo sapiens
cagaaagccctatgtacagtgg

SEQ ID NO: 6942968 - DNA, 22 bp, Homo sapiens
gttaagaattcgttctcatgtt

SEQ ID NO: 6942969 - DNA, 22 bp, Homo sapiens
ttgaattcatttctcattgagt

SEQ ID NO: 6942970 - DNA, 22 bp, Homo sapiens
tcattgcagtagggagagaccc

SEQ ID NO: 6942971 - DNA, 23 bp, Homo sapiens
ttgagcatttgtggatactgaaa

SEQ ID NO: 6942972 - DNA, 20 bp, Homo sapiens
tggaaggtcccagaggaatt

SEQ ID NO: 6942973 - DNA, 22 bp, Homo sapiens
agagttgaagtataatagggat

SEQ ID NO: 6942974 - DNA, 22 bp, Homo sapiens
ttgtctgatgttccctcatgat

SEQ ID NO: 6942975 - DNA, 22 bp, Homo sapiens
ttttacaggtgtgagccaccat

SEQ ID NO: 6942976 - DNA, 22 bp, Homo sapiens
tattgattcctgctttctgctc

SEQ ID NO: 6942977 - DNA, 22 bp, Homo sapiens
catgatggatgtgcacttcgct

SEQ ID NO: 6942978 - DNA, 22 bp, Homo sapiens
ggtgatgtttgagttgagacag

SEQ ID NO: 6942979 - DNA, 22 bp, Homo sapiens
ggtggctccgcttccatgggct

SEQ ID NO: 6942980 - DNA, 22 bp, Homo sapiens
cagaggaagttccttgatgaga

SEQ ID NO: 6942981 - DNA, 22 bp, Homo sapiens
atgtttccagctcagctgcagg

SEQ ID NO: 6942982 - DNA, 22 bp, Homo sapiens
tggcaggcagctggcatcctaa

SEQ ID NO: 6942983 - DNA, 18 bp, Homo sapiens
ggtgagggagctggaagc

SEQ ID NO: 6942984 - DNA, 22 bp, Homo sapiens
tcccagaatctccagtgctaca

SEQ ID NO: 6942985 - DNA, 22 bp, Homo sapiens
ttggcagcatacagttggattg

SEQ ID NO: 6942986 - DNA, 23 bp, Homo sapiens
tgcttaattcctctgcttcacct

SEQ ID NO: 6942987 - DNA, 22 bp, Homo sapiens
taaggtttcttcagatactagt

SEQ ID NO: 6942988 - DNA, 22 bp, Homo sapiens
gcctttggatggtttttctatt

SEQ ID NO: 6942989 - DNA, 22 bp, Homo sapiens
agatgcctgccagttatttagc

SEQ ID NO: 6942990 - DNA, 22 bp, Homo sapiens
ggaagggaatccatctggttag

SEQ ID NO: 6942991 - DNA, 22 bp, Homo sapiens
tgggcggactcgggcatggaat

SEQ ID NO: 6942992 - DNA, 22 bp, Homo sapiens
aaggtgttcaggttttcccatt

SEQ ID NO: 6942993 - DNA, 22 bp, Homo sapiens
gtaacattttgagcagtaggct

SEQ ID NO: 6942994 - DNA, 22 bp, Homo sapiens
cagaagaaagtggggagacaag

SEQ ID NO: 6942995 - DNA, 22 bp, Homo sapiens
tggaaactatagtcacaataga

SEQ ID NO: 6942996 - DNA, 22 bp, Homo sapiens
cagcaggagcagtcagactcct

SEQ ID NO: 6942997 - DNA, 22 bp, Homo sapiens
gtacaggcagcaaacaccataa

SEQ ID NO: 6942998 - DNA, 22 bp, Homo sapiens
tcgggctcctgcacttggagac

SEQ ID NO: 6942999 - DNA, 22 bp, Homo sapiens
ggcattgatgggagatggtgga

SEQ ID NO: 6943000 - DNA, 22 bp, Homo sapiens
acagctggaggtctgtgagcac

SEQ ID NO: 6943001 - DNA, 22 bp, Homo sapiens
tatcctactccttcacaccttg

SEQ ID NO: 6943002 - DNA, 22 bp, Homo sapiens
tatttccagcagtaagaagaca

SEQ ID NO: 6943003 - DNA, 22 bp, Homo sapiens
cagtaatatctgttgaagctat

SEQ ID NO: 6943004 - DNA, 22 bp, Homo sapiens
cagcccttccttctgtttatac

SEQ ID NO: 6943005 - DNA, 22 bp, Homo sapiens
ctgggctctaagggagcaccgt

SEQ ID NO: 6943006 - DNA, 22 bp, Homo sapiens
agtatgttgacttattcttgga

SEQ ID NO: 6943007 - DNA, 22 bp, Homo sapiens
ccctccctgaagaagttactct

SEQ ID NO: 6943008 - DNA, 22 bp, Homo sapiens
tccaatgtgtttgtggcatgga

SEQ ID NO: 6943009 - DNA, 22 bp, Homo sapiens
agccctgagctggcctgggctt

SEQ ID NO: 6943010 - DNA, 22 bp, Homo sapiens
attcacacatactcatgtgtga

SEQ ID NO: 6943011 - DNA, 22 bp, Homo sapiens
atggctggaagagtcgaagagt

SEQ ID NO: 6943012 - DNA, 22 bp, Homo sapiens
acactgacgcttgacagtcacc

SEQ ID NO: 6943013 - DNA, 22 bp, Homo sapiens
cattttgtaagtctctcttgtt

SEQ ID NO: 6943014 - DNA, 22 bp, Homo sapiens
tcagccagtttgattctatttg

SEQ ID NO: 6943015 - DNA, 22 bp, Homo sapiens
accaggactttgtattcagctt

SEQ ID NO: 6943016 - DNA, 22 bp, Homo sapiens
gcccagcaggggatggcagctc

SEQ ID NO: 6943017 - DNA, 22 bp, Homo sapiens
ggtttccaatgacaaacactgt

SEQ ID NO: 6943018 - DNA, 22 bp, Homo sapiens
gggcctgactgagagctcctca

SEQ ID NO: 6943019 - DNA, 15 bp, Homo sapiens
tccagtggaggcact

SEQ ID NO: 6943020 - DNA, 22 bp, Homo sapiens
atcacattctttcaaagcagtc

SEQ ID NO: 6943021 - DNA, 19 bp, Homo sapiens
gctgggtgaggtcgttgga

SEQ ID NO: 6943022 - DNA, 22 bp, Homo sapiens
gtagagcaggacttgagatgtt

SEQ ID NO: 6943023 - DNA, 23 bp, Homo sapiens
caaaagttagcccttcccatctc

SEQ ID NO: 6943024 - DNA, 22 bp, Homo sapiens
aagagctgtgggtggtagtcct

SEQ ID NO: 6943025 - DNA, 22 bp, Homo sapiens
ctgccacaggggagcaggcaga

SEQ ID NO: 6943026 - DNA, 22 bp, Homo sapiens
actggctgatcacctgcctcag

SEQ ID NO: 6943027 - DNA, 22 bp, Homo sapiens
cacactgccacattcactcttc

SEQ ID NO: 6943028 - DNA, 22 bp, Homo sapiens
atgtggcagtgggaggtgaatt

SEQ ID NO: 6943029 - DNA, 22 bp, Homo sapiens
aaatttctaagcagccacttcc

SEQ ID NO: 6943030 - DNA, 22 bp, Homo sapiens
gaatgtccctgcagttgctgcc

SEQ ID NO: 6943031 - DNA, 22 bp, Homo sapiens
atcaggatgctgtcagttacca

SEQ ID NO: 6943032 - DNA, 22 bp, Homo sapiens
tcctaaagtccaggtgggaatt

SEQ ID NO: 6943033 - DNA, 22 bp, Homo sapiens
ttccagttggagcctgccttta

SEQ ID NO: 6943034 - DNA, 22 bp, Homo sapiens
cctctgtccccagtgcaggcct

SEQ ID NO: 6943035 - DNA, 22 bp, Homo sapiens
cccttcaagctctctgggtttt

SEQ ID NO: 6943036 - DNA, 22 bp, Homo sapiens
ccataaagtaggaaacactaca

SEQ ID NO: 6943037 - DNA, 22 bp, Homo sapiens
gttatatatagtatttctctga

SEQ ID NO: 6943038 - DNA, 22 bp, Homo sapiens
cttgaaagtcagcagagtggat

SEQ ID NO: 6943039 - DNA, 22 bp, Homo sapiens
acttcacaaagagatcatctaa

SEQ ID NO: 6943040 - DNA, 22 bp, Homo sapiens
ttgtttggaacttggtgccacc

SEQ ID NO: 6943041 - DNA, 22 bp, Homo sapiens
aagggattgatcttgacacagt

SEQ ID NO: 6943042 - DNA, 22 bp, Homo sapiens
tgattttattgaaacttcactt

SEQ ID NO: 6943043 - DNA, 22 bp, Homo sapiens
ggcatgtgcctgaggtcacaca

SEQ ID NO: 6943044 - DNA, 17 bp, Homo sapiens
acatttgcaaaggtctg

SEQ ID NO: 6943045 - DNA, 23 bp, Homo sapiens
tctgttcaaggctttctccttga

SEQ ID NO: 6943046 - DNA, 22 bp, Homo sapiens
ggaagagggaaccacgactgta

SEQ ID NO: 6943047 - DNA, 22 bp, Homo sapiens
accctggaggtggaggtgcagt

SEQ ID NO: 6943048 - DNA, 22 bp, Homo sapiens
aatggcttgcaaatgggtccat

SEQ ID NO: 6943049 - DNA, 22 bp, Homo sapiens
atctgtaactgctatcatctcc

SEQ ID NO: 6943050 - DNA, 22 bp, Homo sapiens
cacccacccagaagatcctggc

SEQ ID NO: 6943051 - DNA, 22 bp, Homo sapiens
gtggacatgcatacatatgttt

SEQ ID NO: 6943052 - DNA, 22 bp, Homo sapiens
gcatgcaaggggtgtgaagtga

SEQ ID NO: 6943053 - DNA, 22 bp, Homo sapiens
ttcctcagtgcccccatacggt

SEQ ID NO: 6943054 - DNA, 22 bp, Homo sapiens
tggctaggaatccatgactctc

SEQ ID NO: 6943055 - DNA, 22 bp, Homo sapiens
ttccttctattcagctccaaga

SEQ ID NO: 6943056 - DNA, 22 bp, Homo sapiens
atgtcttcatagcttatatcca

SEQ ID NO: 6943057 - DNA, 22 bp, Homo sapiens
agaggccagcagtgcctatctg

SEQ ID NO: 6943058 - DNA, 22 bp, Homo sapiens
attgagaaggagattggcatct

SEQ ID NO: 6943059 - DNA, 22 bp, Homo sapiens
ctcttgatgactgttgctggtt

SEQ ID NO: 6943060 - DNA, 22 bp, Homo sapiens
cctgggtggctgcctgcctttc

SEQ ID NO: 6943061 - DNA, 22 bp, Homo sapiens
tctgatgtggagacactgtttt

SEQ ID NO: 6943062 - DNA, 22 bp, Homo sapiens
atttcctgtacctatcaaggca

SEQ ID NO: 6943063 - DNA, 19 bp, Homo sapiens
acaatgttgttggacactc

SEQ ID NO: 6943064 - DNA, 23 bp, Homo sapiens
atgcaaagtgctgtcatgtagac

SEQ ID NO: 6943065 - DNA, 22 bp, Homo sapiens
gtgccgctggagctggaattga

SEQ ID NO: 6943066 - DNA, 22 bp, Homo sapiens
gtgcagtactagagcaccagga

SEQ ID NO: 6943067 - DNA, 22 bp, Homo sapiens
ggacagagcagacgagcagcgg

SEQ ID NO: 6943068 - DNA, 21 bp, Homo sapiens
tccactcgtattctgttggca

SEQ ID NO: 6943069 - DNA, 19 bp, Homo sapiens
atttgcttgtctgctctgc

SEQ ID NO: 6943070 - DNA, 22 bp, Homo sapiens
ttgttacttgcatgtagactaa

SEQ ID NO: 6943071 - DNA, 22 bp, Homo sapiens
aatttgttataacttgggctga

SEQ ID NO: 6943072 - DNA, 22 bp, Homo sapiens
ttacatacctcatagactcagg

SEQ ID NO: 6943073 - DNA, 22 bp, Homo sapiens
ttggtgaacacatacacatttt

SEQ ID NO: 6943074 - DNA, 22 bp, Homo sapiens
ggtcagagaaaagtagggtgtt

SEQ ID NO: 6943075 - DNA, 22 bp, Homo sapiens
tgtgcctgagtctcggcccacc

SEQ ID NO: 6943076 - DNA, 22 bp, Homo sapiens
gtttttatatcctgtggagtgt

SEQ ID NO: 6943077 - DNA, 22 bp, Homo sapiens
tagcaatgtgtgtgtataaatt

SEQ ID NO: 6943078 - DNA, 22 bp, Homo sapiens
tgtcctgccagcccggactgtg

SEQ ID NO: 6943079 - DNA, 19 bp, Homo sapiens
agctctgtcaggctacata

SEQ ID NO: 6943080 - DNA, 22 bp, Homo sapiens
aaagtgctgggattacaggcct

SEQ ID NO: 6943081 - DNA, 18 bp, Homo sapiens
tcttcatctcctgagctg

SEQ ID NO: 6943082 - DNA, 22 bp, Homo sapiens
ccagtctgaggcctggtgaggg

SEQ ID NO: 6943083 - DNA, 22 bp, Homo sapiens
cctcagaagctcaaggacattg

SEQ ID NO: 6943084 - DNA, 22 bp, Homo sapiens
taggtggtgtgcgaagagcgtg

SEQ ID NO: 6943085 - DNA, 22 bp, Homo sapiens
tgctggcagtggcagtgatggt

SEQ ID NO: 6943086 - DNA, 22 bp, Homo sapiens
ataattgtgggcagtgtgatat

SEQ ID NO: 6943087 - DNA, 21 bp, Homo sapiens
tctctaaaaagattctatttg

SEQ ID NO: 6943088 - DNA, 22 bp, Homo sapiens
ctttcaatgtgcctgccttggg

SEQ ID NO: 6943089 - DNA, 22 bp, Homo sapiens
cagaatttagcacaatgtatgg

SEQ ID NO: 6943090 - DNA, 22 bp, Homo sapiens
gtggatggagctggaagccatt

SEQ ID NO: 6943091 - DNA, 22 bp, Homo sapiens
cgcatgagacctgccggccatc

SEQ ID NO: 6943092 - DNA, 22 bp, Homo sapiens
ttcaactgggcggatctgagaa

SEQ ID NO: 6943093 - DNA, 22 bp, Homo sapiens
ggggtgagttagcgtcggcttg

SEQ ID NO: 6943094 - DNA, 22 bp, Homo sapiens
actgagacaactgtgtttctaa

SEQ ID NO: 6943095 - DNA, 22 bp, Homo sapiens
gtttgcagttgtcatcctcctg

SEQ ID NO: 6943096 - DNA, 21 bp, Homo sapiens
gtggccctggtgtggctgcac

SEQ ID NO: 6943097 - DNA, 22 bp, Homo sapiens
ctgaattatttaaggtgaaggg

SEQ ID NO: 6943098 - DNA, 22 bp, Homo sapiens
atgttcctcactattttggccc

SEQ ID NO: 6943099 - DNA, 23 bp, Homo sapiens
cacggcagcctccgagggtgctg

SEQ ID NO: 6943100 - DNA, 22 bp, Homo sapiens
tcagagtgttttactaaacaag

SEQ ID NO: 6943101 - DNA, 22 bp, Homo sapiens
gcagtagtccataagtactctg

SEQ ID NO: 6943102 - DNA, 22 bp, Homo sapiens
aggcttcgcaaggttagagctg

SEQ ID NO: 6943103 - DNA, 22 bp, Homo sapiens
actttgcatggaaaatggtcat

SEQ ID NO: 6943104 - DNA, 22 bp, Homo sapiens
gcaagtcctttgcatgcaggga

SEQ ID NO: 6943105 - DNA, 22 bp, Homo sapiens
agaagcacggttttgtctagca

SEQ ID NO: 6943106 - DNA, 20 bp, Homo sapiens
ctgcttaagtaagtgacaca

SEQ ID NO: 6943107 - DNA, 22 bp, Homo sapiens
gacattgacagtcctccttata

SEQ ID NO: 6943108 - DNA, 22 bp, Homo sapiens
ggaatactaaaggaagcaattg

SEQ ID NO: 6943109 - DNA, 22 bp, Homo sapiens
ttacagtgacagttgctatgat

SEQ ID NO: 6943110 - DNA, 22 bp, Homo sapiens
gtcctattagcatattgaatac

SEQ ID NO: 6943111 - DNA, 22 bp, Homo sapiens
ctgagaaggaagcctccactct

SEQ ID NO: 6943112 - DNA, 21 bp, Homo sapiens
atatgccaaatgccagtaacc

SEQ ID NO: 6943113 - DNA, 22 bp, Homo sapiens
tccttggaggtgttcatctgcc

SEQ ID NO: 6943114 - DNA, 22 bp, Homo sapiens
actagttttccataatatagga

SEQ ID NO: 6943115 - DNA, 22 bp, Homo sapiens
tccacttccacgtgtgcagaat

SEQ ID NO: 6943116 - DNA, 22 bp, Homo sapiens
gttcattcatcaaatatttact

SEQ ID NO: 6943117 - DNA, 22 bp, Homo sapiens
tcatcatctgcaagctcatgtc

SEQ ID NO: 6943118 - DNA, 22 bp, Homo sapiens
tgggttataatttgttatgaat

SEQ ID NO: 6943119 - DNA, 22 bp, Homo sapiens
tcagaaatcttgtcaaggcatc

SEQ ID NO: 6943120 - DNA, 19 bp, Homo sapiens
cttcttcttggcagccaag

SEQ ID NO: 6943121 - DNA, 22 bp, Homo sapiens
tgtgtatattaggacacattct

SEQ ID NO: 6943122 - DNA, 22 bp, Homo sapiens
ctgctagcccgccggccagcga

SEQ ID NO: 6943123 - DNA, 22 bp, Homo sapiens
agaatgtgatatagtgatatgt

SEQ ID NO: 6943124 - DNA, 22 bp, Homo sapiens
ggtcaacactgtgaccaacagg

SEQ ID NO: 6943125 - DNA, 20 bp, Homo sapiens
tggttgaatttttagtgacc

SEQ ID NO: 6943126 - DNA, 22 bp, Homo sapiens
gcagggctgggatttgagccca

SEQ ID NO: 6943127 - DNA, 19 bp, Homo sapiens
cagcaagaatgaaggcata

SEQ ID NO: 6943128 - DNA, 21 bp, Homo sapiens
tggacttatggagtgtttctt

SEQ ID NO: 6943129 - DNA, 22 bp, Homo sapiens
ctgcctgctgacattctttata

SEQ ID NO: 6943130 - DNA, 22 bp, Homo sapiens
agtggcagggacttcatataaa

SEQ ID NO: 6943131 - DNA, 22 bp, Homo sapiens
catggcaggaggctgctggcag

SEQ ID NO: 6943132 - DNA, 22 bp, Homo sapiens
ttacaacttgcagaggatgttg

SEQ ID NO: 6943133 - DNA, 22 bp, Homo sapiens
cctctgtgtgtgcatgcatgcg

SEQ ID NO: 6943134 - DNA, 22 bp, Homo sapiens
caagctgccaccagaagagcat

SEQ ID NO: 6943135 - DNA, 22 bp, Homo sapiens
acagtgtttggcaatgcatgca

SEQ ID NO: 6943136 - DNA, 20 bp, Homo sapiens
ctggaagcctttccagagca

SEQ ID NO: 6943137 - DNA, 22 bp, Homo sapiens
ccagcttttcctctcattgctt

SEQ ID NO: 6943138 - DNA, 22 bp, Homo sapiens
tcaggaagtggtaaaggatgtt

SEQ ID NO: 6943139 - DNA, 22 bp, Homo sapiens
agtccccctctgagcccaggga

SEQ ID NO: 6943140 - DNA, 22 bp, Homo sapiens
acagtggcagtcgtgttctcta

SEQ ID NO: 6943141 - DNA, 22 bp, Homo sapiens
atggtcttctcaagcaacactg

SEQ ID NO: 6943142 - DNA, 22 bp, Homo sapiens
taaattgtcctccccctggtat

SEQ ID NO: 6943143 - DNA, 22 bp, Homo sapiens
acagttagtgagatgtctgttt

SEQ ID NO: 6943144 - DNA, 22 bp, Homo sapiens
caaagccatagagtagataaga

SEQ ID NO: 6943145 - DNA, 22 bp, Homo sapiens
tgaaatagacttgcactatatg

SEQ ID NO: 6943146 - DNA, 22 bp, Homo sapiens
ctcagcactgacccaggagatg

SEQ ID NO: 6943147 - DNA, 21 bp, Homo sapiens
aggagaaacacaggtcagccc

SEQ ID NO: 6943148 - DNA, 22 bp, Homo sapiens
cagctggatgggagaccatgtt

SEQ ID NO: 6943149 - DNA, 22 bp, Homo sapiens
gatttggcctttcgcatggtat

SEQ ID NO: 6943150 - DNA, 22 bp, Homo sapiens
tcagtccctcgcaccctgccat

SEQ ID NO: 6943151 - DNA, 22 bp, Homo sapiens
acatagcttaaatgagaagata

SEQ ID NO: 6943152 - DNA, 22 bp, Homo sapiens
cctgtgtggccgcactgctccc

SEQ ID NO: 6943153 - DNA, 19 bp, Homo sapiens
tctgacagccccagtcaac

SEQ ID NO: 6943154 - DNA, 22 bp, Homo sapiens
gtcttttttacaccttacatca

SEQ ID NO: 6943155 - DNA, 22 bp, Homo sapiens
caaggaatatttaagaacgtca

SEQ ID NO: 6943156 - DNA, 22 bp, Homo sapiens
ttctcacattcagaacttttat

SEQ ID NO: 6943157 - DNA, 20 bp, Homo sapiens
acatgcgcaggccagtgggc

SEQ ID NO: 6943158 - DNA, 22 bp, Homo sapiens
tgcttctgctgatattttgtga

SEQ ID NO: 6943159 - DNA, 22 bp, Homo sapiens
ggaagtattcaatcctgccaca

SEQ ID NO: 6943160 - DNA, 22 bp, Homo sapiens
actttcatgttggtgaagggtt

SEQ ID NO: 6943161 - DNA, 19 bp, Homo sapiens
ccaggccatcccagttccc

SEQ ID NO: 6943162 - DNA, 22 bp, Homo sapiens
ggcctctgcaggcctcgacaag

SEQ ID NO: 6943163 - DNA, 22 bp, Homo sapiens
attagaatgcagggttcattgt

SEQ ID NO: 6943164 - DNA, 22 bp, Homo sapiens
gtgggcaggtaggcaccagcta

SEQ ID NO: 6943165 - DNA, 22 bp, Homo sapiens
tggccctgtcctcatttcatct

SEQ ID NO: 6943166 - DNA, 22 bp, Homo sapiens
gctctttagacatagtctgaag

SEQ ID NO: 6943167 - DNA, 22 bp, Homo sapiens
catctttgaactctgtataaac

SEQ ID NO: 6943168 - DNA, 22 bp, Homo sapiens
tcaacttggctttttaaagtcc

SEQ ID NO: 6943169 - DNA, 22 bp, Homo sapiens
ttcgtatttatattctcaatac

SEQ ID NO: 6943170 - DNA, 22 bp, Homo sapiens
agcagagcctgggctaggggtg

SEQ ID NO: 6943171 - DNA, 20 bp, Homo sapiens
aggctgcctaaggctctgca

SEQ ID NO: 6943172 - DNA, 22 bp, Homo sapiens
tgagagagggatgcaccctcct

SEQ ID NO: 6943173 - DNA, 22 bp, Homo sapiens
gggatctgagtaggcagaagct

SEQ ID NO: 6943174 - DNA, 22 bp, Homo sapiens
caccatcttttggaggggaatt

SEQ ID NO: 6943175 - DNA, 22 bp, Homo sapiens
caaagccaggctttctaatgta

SEQ ID NO: 6943176 - DNA, 20 bp, Homo sapiens
tctgggttgaaatcaagatc

SEQ ID NO: 6943177 - DNA, 22 bp, Homo sapiens
accaaataggcttcctgggttg

SEQ ID NO: 6943178 - DNA, 22 bp, Homo sapiens
tttaaatgctttaagcaagggt

SEQ ID NO: 6943179 - DNA, 22 bp, Homo sapiens
taatctgttaatatttgtatcc

SEQ ID NO: 6943180 - DNA, 22 bp, Homo sapiens
gggcactgaatgccaagctagg

SEQ ID NO: 6943181 - DNA, 22 bp, Homo sapiens
aatgaactggagaacaatgacc

SEQ ID NO: 6943182 - DNA, 22 bp, Homo sapiens
aagctgccctgtgttagagttc

SEQ ID NO: 6943183 - DNA, 22 bp, Homo sapiens
atgccactgcgctccagcctgg

SEQ ID NO: 6943184 - DNA, 22 bp, Homo sapiens
gccagccagggaagggagagac

SEQ ID NO: 6943185 - DNA, 17 bp, Homo sapiens
cagccagtcccttcatt

SEQ ID NO: 6943186 - DNA, 17 bp, Homo sapiens
acacatcttggctttgc

SEQ ID NO: 6943187 - DNA, 22 bp, Homo sapiens
ccaagtcctgtctctcaatcat

SEQ ID NO: 6943188 - DNA, 22 bp, Homo sapiens
ctttggtaccaccccagagtgg

SEQ ID NO: 6943189 - DNA, 22 bp, Homo sapiens
aatggcttttgcacttaaatcg

SEQ ID NO: 6943190 - DNA, 22 bp, Homo sapiens
acactagctaaatgctgattaa

SEQ ID NO: 6943191 - DNA, 22 bp, Homo sapiens
tgagccaggctccatgccacct

SEQ ID NO: 6943192 - DNA, 22 bp, Homo sapiens
ccttttctacaagcaaatgtgc

SEQ ID NO: 6943193 - DNA, 22 bp, Homo sapiens
attatagggaattctagaagtc

SEQ ID NO: 6943194 - DNA, 23 bp, Homo sapiens
accagcaaaaatgacagcccagg

SEQ ID NO: 6943195 - DNA, 22 bp, Homo sapiens
gcctgctggacattggccggcc

SEQ ID NO: 6943196 - DNA, 22 bp, Homo sapiens
aaacagtttcattttcatgacc

SEQ ID NO: 6943197 - DNA, 22 bp, Homo sapiens
tggtaaaaactgcaattacttt

SEQ ID NO: 6943198 - DNA, 22 bp, Homo sapiens
aagcagagaatctgggagcgag

SEQ ID NO: 6943199 - DNA, 22 bp, Homo sapiens
cctggatctaaggaagctggga

SEQ ID NO: 6943200 - DNA, 22 bp, Homo sapiens
tccagcttgcttcaggatggtc

SEQ ID NO: 6943201 - DNA, 22 bp, Homo sapiens
tcacagacgcctcccctcgcct

SEQ ID NO: 6943202 - DNA, 19 bp, Homo sapiens
aaatggctttctacttaat

SEQ ID NO: 6943203 - DNA, 22 bp, Homo sapiens
gtctatgtgtaatagcatgtgt

SEQ ID NO: 6943204 - DNA, 17 bp, Homo sapiens
atctctctaaggcaggc

SEQ ID NO: 6943205 - DNA, 20 bp, Homo sapiens
tgccccaggcctgcacctgc

SEQ ID NO: 6943206 - DNA, 22 bp, Homo sapiens
accacatagctttgctttttgt

SEQ ID NO: 6943207 - DNA, 22 bp, Homo sapiens
tcggagctgtagatgaaaccct

SEQ ID NO: 6943208 - DNA, 22 bp, Homo sapiens
tgtaggatgtaaggcaggcatc

SEQ ID NO: 6943209 - DNA, 22 bp, Homo sapiens
ttcacattgtgcagattatggt

SEQ ID NO: 6943210 - DNA, 22 bp, Homo sapiens
tttccaagactccagttctccc

SEQ ID NO: 6943211 - DNA, 22 bp, Homo sapiens
gggaggctgccatccttcagga

SEQ ID NO: 6943212 - DNA, 22 bp, Homo sapiens
gcagtcagacaggaggagctcc

SEQ ID NO: 6943213 - DNA, 22 bp, Homo sapiens
aattctgattagatgcctttgt

SEQ ID NO: 6943214 - DNA, 22 bp, Homo sapiens
ctgacagcgagagagttgcccc

SEQ ID NO: 6943215 - DNA, 22 bp, Homo sapiens
actggcagagggaaaaccattc

SEQ ID NO: 6943216 - DNA, 22 bp, Homo sapiens
gggctgcctttcttctgggagc

SEQ ID NO: 6943217 - DNA, 22 bp, Homo sapiens
ttgcaaagagtcatgtaagtca

SEQ ID NO: 6943218 - DNA, 22 bp, Homo sapiens
tggctttcgctatagagcacgg

SEQ ID NO: 6943219 - DNA, 22 bp, Homo sapiens
tatggcttctgctttcttgact

SEQ ID NO: 6943220 - DNA, 22 bp, Homo sapiens
agcacaggtacggagatgctac

SEQ ID NO: 6943221 - DNA, 22 bp, Homo sapiens
ctgtccagggtgtgcaggggct

SEQ ID NO: 6943222 - DNA, 22 bp, Homo sapiens
cacgatggagtcctatggggca

SEQ ID NO: 6943223 - DNA, 18 bp, Homo sapiens
caggccctgtctggcctc

SEQ ID NO: 6943224 - DNA, 22 bp, Homo sapiens
gtgcaggagctcccgcagtggt

SEQ ID NO: 6943225 - DNA, 23 bp, Homo sapiens
gctacagctgactgtcattccct

SEQ ID NO: 6943226 - DNA, 22 bp, Homo sapiens
gttgacagaaaaataacatagc

SEQ ID NO: 6943227 - DNA, 22 bp, Homo sapiens
tgccctgatgatcctcctcgca

SEQ ID NO: 6943228 - DNA, 22 bp, Homo sapiens
cgggtggttttcatcaagatgg

SEQ ID NO: 6943229 - DNA, 22 bp, Homo sapiens
tatgaactgtgagtgtgatggg

SEQ ID NO: 6943230 - DNA, 22 bp, Homo sapiens
agctgagggcaggatggggtga

SEQ ID NO: 6943231 - DNA, 22 bp, Homo sapiens
attggcatattggctactttca

SEQ ID NO: 6943232 - DNA, 22 bp, Homo sapiens
tgtaagaaaagtaaatagtgac

SEQ ID NO: 6943233 - DNA, 22 bp, Homo sapiens
tcagcctcaggtgttcagattt

SEQ ID NO: 6943234 - DNA, 22 bp, Homo sapiens
tggcaaggctgtgggggcagag

SEQ ID NO: 6943235 - DNA, 22 bp, Homo sapiens
gctgagcaggtgtaaggaaggc

SEQ ID NO: 6943236 - DNA, 22 bp, Homo sapiens
cagaatttaagtggattattct

SEQ ID NO: 6943237 - DNA, 22 bp, Homo sapiens
acgtggagagaatagggcacca

SEQ ID NO: 6943238 - DNA, 22 bp, Homo sapiens
attctgcataatttcctggcag

SEQ ID NO: 6943239 - DNA, 22 bp, Homo sapiens
ctgttatctgttattgccagtt

SEQ ID NO: 6943240 - DNA, 22 bp, Homo sapiens
cttgaatctggctttgccactt

SEQ ID NO: 6943241 - DNA, 22 bp, Homo sapiens
ccttccttgagaagcaattcct

SEQ ID NO: 6943242 - DNA, 22 bp, Homo sapiens
atacagtaattgcataggcttc

SEQ ID NO: 6943243 - DNA, 22 bp, Homo sapiens
aaggcagttcactcacgcagcc

SEQ ID NO: 6943244 - DNA, 22 bp, Homo sapiens
attagcaaattctaattcacta

SEQ ID NO: 6943245 - DNA, 22 bp, Homo sapiens
tacagaatgtgtatcattacca

SEQ ID NO: 6943246 - DNA, 22 bp, Homo sapiens
agggttgcaccatgttggtcag

SEQ ID NO: 6943247 - DNA, 22 bp, Homo sapiens
aaggtcattttttcctctgttg

SEQ ID NO: 6943248 - DNA, 22 bp, Homo sapiens
ttgatgcttaaggtaaaacaga

SEQ ID NO: 6943249 - DNA, 22 bp, Homo sapiens
ctgaggtggcatcctagctcta

SEQ ID NO: 6943250 - DNA, 22 bp, Homo sapiens
tcatgcttaaaagacacttgag

SEQ ID NO: 6943251 - DNA, 22 bp, Homo sapiens
atttggtagtgattgaaattat

SEQ ID NO: 6943252 - DNA, 22 bp, Homo sapiens
acagctcagacatcactgctct

SEQ ID NO: 6943253 - DNA, 22 bp, Homo sapiens
ggagcagcctgtgtagacgggg

SEQ ID NO: 6943254 - DNA, 22 bp, Homo sapiens
atgcatgtttaaggggcatgca

SEQ ID NO: 6943255 - DNA, 22 bp, Homo sapiens
acaggaagaaagtgcagtagat

SEQ ID NO: 6943256 - DNA, 22 bp, Homo sapiens
ttctctggaaggctctacggga

SEQ ID NO: 6943257 - DNA, 22 bp, Homo sapiens
caggcagagtgagaagcccttg

SEQ ID NO: 6943258 - DNA, 22 bp, Homo sapiens
atagtacagagggctactggtt

SEQ ID NO: 6943259 - DNA, 21 bp, Homo sapiens
gtacagggatagtagtgtcaa

SEQ ID NO: 6943260 - DNA, 22 bp, Homo sapiens
ccaaccattggctaagaattgg

SEQ ID NO: 6943261 - DNA, 22 bp, Homo sapiens
tgaggcttggaggctccagtgg

SEQ ID NO: 6943262 - DNA, 22 bp, Homo sapiens
cctgtgacccttccagtctact

SEQ ID NO: 6943263 - DNA, 22 bp, Homo sapiens
tgaacagtgatctacatgtggc

SEQ ID NO: 6943264 - DNA, 17 bp, Homo sapiens
ccttcctcatctccttc

SEQ ID NO: 6943265 - DNA, 22 bp, Homo sapiens
acaagcatgggctttgacatca

SEQ ID NO: 6943266 - DNA, 22 bp, Homo sapiens
tcatgctttgttaatgtggcac

SEQ ID NO: 6943267 - DNA, 22 bp, Homo sapiens
aaagtgcagtccatgaaattaa

SEQ ID NO: 6943268 - DNA, 22 bp, Homo sapiens
caggggctgaaatgttggggtt

SEQ ID NO: 6943269 - DNA, 22 bp, Homo sapiens
tcaggacaatagtgatttttac

SEQ ID NO: 6943270 - DNA, 22 bp, Homo sapiens
taggggtcccactctcagagtt

SEQ ID NO: 6943271 - DNA, 22 bp, Homo sapiens
gcacatgtgggtaagcacatgg

SEQ ID NO: 6943272 - DNA, 22 bp, Homo sapiens
tccatgtgccaaggggcagagg

SEQ ID NO: 6943273 - DNA, 22 bp, Homo sapiens
cagggcttctataccaattcat

SEQ ID NO: 6943274 - DNA, 22 bp, Homo sapiens
gccacacttattctcatgcaca

SEQ ID NO: 6943275 - DNA, 22 bp, Homo sapiens
aggcatttttgttaatctttgg

SEQ ID NO: 6943276 - DNA, 22 bp, Homo sapiens
gaggagccaaggtatgtgtgtt

SEQ ID NO: 6943277 - DNA, 22 bp, Homo sapiens
gaggtgttgggtgaggtgcctg

SEQ ID NO: 6943278 - DNA, 22 bp, Homo sapiens
agctgagttaattcatcactta

SEQ ID NO: 6943279 - DNA, 22 bp, Homo sapiens
ttcctcaggtgctacaaagcag

SEQ ID NO: 6943280 - DNA, 22 bp, Homo sapiens
gaagtcctggtcctctcattca

SEQ ID NO: 6943281 - DNA, 22 bp, Homo sapiens
aaagcagcctgctcatcctgga

SEQ ID NO: 6943282 - DNA, 22 bp, Homo sapiens
tctacactccagagtctcatca

SEQ ID NO: 6943283 - DNA, 22 bp, Homo sapiens
gggcggatcatttgaggtcagg

SEQ ID NO: 6943284 - DNA, 22 bp, Homo sapiens
ctgaggtttacaagctattgct

SEQ ID NO: 6943285 - DNA, 22 bp, Homo sapiens
attctgctcattttatttccag

SEQ ID NO: 6943286 - DNA, 22 bp, Homo sapiens
cagggtcaagagactccagcag

SEQ ID NO: 6943287 - DNA, 22 bp, Homo sapiens
ctgcctctgcgtcccacagagt

SEQ ID NO: 6943288 - DNA, 22 bp, Homo sapiens
ggctcagcccccacgcttcttc

SEQ ID NO: 6943289 - DNA, 22 bp, Homo sapiens
atttccagactttttccaggaa

SEQ ID NO: 6943290 - DNA, 22 bp, Homo sapiens
aacctagacagggcctctgtta

SEQ ID NO: 6943291 - DNA, 22 bp, Homo sapiens
tttagcaacgaagcactcgaca

SEQ ID NO: 6943292 - DNA, 22 bp, Homo sapiens
tcaggaagaaattctgtatctt

SEQ ID NO: 6943293 - DNA, 15 bp, Homo sapiens
aacccagagccttcc

SEQ ID NO: 6943294 - DNA, 22 bp, Homo sapiens
gaggttccagacagcttaggga

SEQ ID NO: 6943295 - DNA, 20 bp, Homo sapiens
ctgaccagcagcctgtctcc

SEQ ID NO: 6943296 - DNA, 22 bp, Homo sapiens
aggtgccaattttcagtgaaca

SEQ ID NO: 6943297 - DNA, 22 bp, Homo sapiens
agcattgaggtgggtttctctt

SEQ ID NO: 6943298 - DNA, 22 bp, Homo sapiens
tttccagtgattgctgctctca

SEQ ID NO: 6943299 - DNA, 22 bp, Homo sapiens
gcaaatgaactgatgccaatgg

SEQ ID NO: 6943300 - DNA, 22 bp, Homo sapiens
caatgatgtttagataaaatcc

SEQ ID NO: 6943301 - DNA, 22 bp, Homo sapiens
tttgtaaaggcctgaatttcag

SEQ ID NO: 6943302 - DNA, 17 bp, Homo sapiens
taggagactggctgtcc

SEQ ID NO: 6943303 - DNA, 22 bp, Homo sapiens
ccaggcccccgagcagaagaca

SEQ ID NO: 6943304 - DNA, 22 bp, Homo sapiens
atacagaagcctgtatttctgg

SEQ ID NO: 6943305 - DNA, 22 bp, Homo sapiens
tcacagtaactttgttgctttt

SEQ ID NO: 6943306 - DNA, 22 bp, Homo sapiens
ctccagattccgtttattcagg

SEQ ID NO: 6943307 - DNA, 22 bp, Homo sapiens
cactggaagttcattctcagaa

SEQ ID NO: 6943308 - DNA, 22 bp, Homo sapiens
tatccaaacatatagtctctct

SEQ ID NO: 6943309 - DNA, 22 bp, Homo sapiens
gatgcactgcagtatatactgt

SEQ ID NO: 6943310 - DNA, 22 bp, Homo sapiens
tcttaagccactgagaaaataa

SEQ ID NO: 6943311 - DNA, 22 bp, Homo sapiens
agatacagcctgccaggttctt

SEQ ID NO: 6943312 - DNA, 22 bp, Homo sapiens
ttgccagggctttggtggcatc

SEQ ID NO: 6943313 - DNA, 22 bp, Homo sapiens
atggccaagcatgcctgtggcc

SEQ ID NO: 6943314 - DNA, 22 bp, Homo sapiens
gtagaactccagttctgtggca

SEQ ID NO: 6943315 - DNA, 22 bp, Homo sapiens
ttacagtaacattttcagtctg

SEQ ID NO: 6943316 - DNA, 22 bp, Homo sapiens
attacagaagatatgctcaaca

SEQ ID NO: 6943317 - DNA, 22 bp, Homo sapiens
tggctcagagagggagtgtgga

SEQ ID NO: 6943318 - DNA, 22 bp, Homo sapiens
ggtcccaatctaatcacatgag

SEQ ID NO: 6943319 - DNA, 22 bp, Homo sapiens
cacatgcatgccaggctcacag

SEQ ID NO: 6943320 - DNA, 22 bp, Homo sapiens
ctcctgggggacagcggcaggg

SEQ ID NO: 6943321 - DNA, 20 bp, Homo sapiens
gagtatgtaggatggtatca

SEQ ID NO: 6943322 - DNA, 19 bp, Homo sapiens
gggagttgttctgatccta

SEQ ID NO: 6943323 - DNA, 22 bp, Homo sapiens
tctctgtgcccagtagttctct

SEQ ID NO: 6943324 - DNA, 22 bp, Homo sapiens
tcacttattaactcataccatt

SEQ ID NO: 6943325 - DNA, 22 bp, Homo sapiens
cctctgtgatttctgagccaat

SEQ ID NO: 6943326 - DNA, 22 bp, Homo sapiens
ctgtatggtggttatgtaagag

SEQ ID NO: 6943327 - DNA, 22 bp, Homo sapiens
ctaggaatccttttagagttgg

SEQ ID NO: 6943328 - DNA, 22 bp, Homo sapiens
tttagaagggctggtcagaaat

SEQ ID NO: 6943329 - DNA, 22 bp, Homo sapiens
agacataagccagtcactcact

SEQ ID NO: 6943330 - DNA, 22 bp, Homo sapiens
cactctgggctcttgtttcaga

SEQ ID NO: 6943331 - DNA, 20 bp, Homo sapiens
cctggctttgcatctgtgat

SEQ ID NO: 6943332 - DNA, 22 bp, Homo sapiens
tggcatgggcaaaccagggaaa

SEQ ID NO: 6943333 - DNA, 22 bp, Homo sapiens
cagctggctccacctctgggct

SEQ ID NO: 6943334 - DNA, 22 bp, Homo sapiens
gctggcttccatgcggacatca

SEQ ID NO: 6943335 - DNA, 19 bp, Homo sapiens
cctttggatttgtttagtc

SEQ ID NO: 6943336 - DNA, 22 bp, Homo sapiens
tgtctatagcctgatttgttgg

SEQ ID NO: 6943337 - DNA, 22 bp, Homo sapiens
ttggaattaaaaggagaacttc

SEQ ID NO: 6943338 - DNA, 22 bp, Homo sapiens
tacgggaagtacagcggaaccc

SEQ ID NO: 6943339 - DNA, 22 bp, Homo sapiens
tttggtgtctggctgtatggac

SEQ ID NO: 6943340 - DNA, 22 bp, Homo sapiens
aagtcgtcgaagatggaggttg

SEQ ID NO: 6943341 - DNA, 22 bp, Homo sapiens
tcaagaagtctgtaccatttga

SEQ ID NO: 6943342 - DNA, 22 bp, Homo sapiens
tgggctctgcatcagtgcccat

SEQ ID NO: 6943343 - DNA, 17 bp, Homo sapiens
aacagttaatgggggaa

SEQ ID NO: 6943344 - DNA, 22 bp, Homo sapiens
tgcctccaggaggggcagctct

SEQ ID NO: 6943345 - DNA, 22 bp, Homo sapiens
ttctggttctcaggaatgctaa

SEQ ID NO: 6943346 - DNA, 22 bp, Homo sapiens
tggaatcagttacatgtggttg

SEQ ID NO: 6943347 - DNA, 22 bp, Homo sapiens
catgtgggacaatctcaggtat

SEQ ID NO: 6943348 - DNA, 22 bp, Homo sapiens
gtctgtcactcaggggctggag

SEQ ID NO: 6943349 - DNA, 22 bp, Homo sapiens
ggctgagtctgtgacccatgcg

SEQ ID NO: 6943350 - DNA, 22 bp, Homo sapiens
ggaagaaagacatttattttga

SEQ ID NO: 6943351 - DNA, 22 bp, Homo sapiens
gagctttgtagcaggaaggaag

SEQ ID NO: 6943352 - DNA, 22 bp, Homo sapiens
tgcatatatttgagattatggc

SEQ ID NO: 6943353 - DNA, 22 bp, Homo sapiens
ctccaggaccagggctcctgga

SEQ ID NO: 6943354 - DNA, 22 bp, Homo sapiens
aggtccagttttcagttctcat

SEQ ID NO: 6943355 - DNA, 22 bp, Homo sapiens
tgtctgaaggcaggtggagaac

SEQ ID NO: 6943356 - DNA, 17 bp, Homo sapiens
tctcctggctctatcag

SEQ ID NO: 6943357 - DNA, 22 bp, Homo sapiens
gctgggtcctatgctggtagag

SEQ ID NO: 6943358 - DNA, 22 bp, Homo sapiens
ggttactcaagcctgccttctc

SEQ ID NO: 6943359 - DNA, 22 bp, Homo sapiens
agttctggtggtttggagatct

SEQ ID NO: 6943360 - DNA, 22 bp, Homo sapiens
accctttcttactcacacgctc

SEQ ID NO: 6943361 - DNA, 22 bp, Homo sapiens
ttgaggtccccagtacccactg

SEQ ID NO: 6943362 - DNA, 22 bp, Homo sapiens
ctcctccacagacctactgaat

SEQ ID NO: 6943363 - DNA, 22 bp, Homo sapiens
tcagctcctcagagcctcagtt

SEQ ID NO: 6943364 - DNA, 22 bp, Homo sapiens
gcagctgtcactttcacaatgc

SEQ ID NO: 6943365 - DNA, 23 bp, Homo sapiens
agagagagtttgtgtcaggtacc

SEQ ID NO: 6943366 - DNA, 22 bp, Homo sapiens
attgatggagagatttccattg

SEQ ID NO: 6943367 - DNA, 22 bp, Homo sapiens
aggcagtggaaggagaaagcaa

SEQ ID NO: 6943368 - DNA, 22 bp, Homo sapiens
caggggaagatgccaagggaga

SEQ ID NO: 6943369 - DNA, 22 bp, Homo sapiens
gctggagcgggttcgggccgct

SEQ ID NO: 6943370 - DNA, 22 bp, Homo sapiens
aagggccacttactcctgctgt

SEQ ID NO: 6943371 - DNA, 22 bp, Homo sapiens
tgaacacagggccaaacttgag

SEQ ID NO: 6943372 - DNA, 22 bp, Homo sapiens
gacatgcaatgcagtggtaagt

SEQ ID NO: 6943373 - DNA, 22 bp, Homo sapiens
taggtgtgggctcaggaatgtg

SEQ ID NO: 6943374 - DNA, 22 bp, Homo sapiens
gctgtacctccatcagcacctc

SEQ ID NO: 6943375 - DNA, 22 bp, Homo sapiens
tctcttcccggataaagtaagt

SEQ ID NO: 6943376 - DNA, 22 bp, Homo sapiens
aattgaaattctttgtggtcca

SEQ ID NO: 6943377 - DNA, 21 bp, Homo sapiens
tgaactctggtcatcttcatt

SEQ ID NO: 6943378 - DNA, 22 bp, Homo sapiens
ttggaccaattcctgatatttt

SEQ ID NO: 6943379 - DNA, 22 bp, Homo sapiens
ttattgacttattaattgtgct

SEQ ID NO: 6943380 - DNA, 22 bp, Homo sapiens
cccagcatggagtgaggactca

SEQ ID NO: 6943381 - DNA, 22 bp, Homo sapiens
atcactgagcttcagtgctggc

SEQ ID NO: 6943382 - DNA, 22 bp, Homo sapiens
agcatgcatttttggactgtgc

SEQ ID NO: 6943383 - DNA, 22 bp, Homo sapiens
agctggtcttaaatgtgtccag

SEQ ID NO: 6943384 - DNA, 22 bp, Homo sapiens
aggctccattcatgtgaaggca

SEQ ID NO: 6943385 - DNA, 22 bp, Homo sapiens
agactgagactggggaaagaca

SEQ ID NO: 6943386 - DNA, 18 bp, Homo sapiens
gggaagccgggaagccgg

SEQ ID NO: 6943387 - DNA, 23 bp, Homo sapiens
aggttcaggagatggaggaacaa

SEQ ID NO: 6943388 - DNA, 22 bp, Homo sapiens
agagaaatttccctgccttctg

SEQ ID NO: 6943389 - DNA, 22 bp, Homo sapiens
acgttttcagccttaatgtaga

SEQ ID NO: 6943390 - DNA, 22 bp, Homo sapiens
ttgaattataagtgtgtctact

SEQ ID NO: 6943391 - DNA, 22 bp, Homo sapiens
tttagatgctgtatgttatttc

SEQ ID NO: 6943392 - DNA, 22 bp, Homo sapiens
gctgggcagtgagtgagtcctt

SEQ ID NO: 6943393 - DNA, 20 bp, Homo sapiens
gcaaaataggctctgttggt

SEQ ID NO: 6943394 - DNA, 22 bp, Homo sapiens
tggaatgttgctctgccttgcg

SEQ ID NO: 6943395 - DNA, 22 bp, Homo sapiens
tctgagaagcaccttctggaca

SEQ ID NO: 6943396 - DNA, 22 bp, Homo sapiens
ctctttggggctggaagcctag

SEQ ID NO: 6943397 - DNA, 22 bp, Homo sapiens
tagggatgacgaaaggacagag

SEQ ID NO: 6943398 - DNA, 22 bp, Homo sapiens
cagccggacctgagggattcct

SEQ ID NO: 6943399 - DNA, 23 bp, Homo sapiens
ccctgcatctgtccctcaccagt

SEQ ID NO: 6943400 - DNA, 22 bp, Homo sapiens
gactgtggcaggctcagcactg

SEQ ID NO: 6943401 - DNA, 22 bp, Homo sapiens
ggctgtgattggtggatgtgaa

SEQ ID NO: 6943402 - DNA, 22 bp, Homo sapiens
tgccttttctgtagctctggaa

SEQ ID NO: 6943403 - DNA, 22 bp, Homo sapiens
ccagctgtctggttccagagcc

SEQ ID NO: 6943404 - DNA, 22 bp, Homo sapiens
ttagagtagagccatttctgtt

SEQ ID NO: 6943405 - DNA, 19 bp, Homo sapiens
acaaatagttacatatcct

SEQ ID NO: 6943406 - DNA, 22 bp, Homo sapiens
agggcctgtctgtagaactgaa

SEQ ID NO: 6943407 - DNA, 22 bp, Homo sapiens
agaatatagttaccaaattctg

SEQ ID NO: 6943408 - DNA, 22 bp, Homo sapiens
aaatgcatcagctcataagaga

SEQ ID NO: 6943409 - DNA, 22 bp, Homo sapiens
gtcccaggtcccagcacatctg

SEQ ID NO: 6943410 - DNA, 22 bp, Homo sapiens
gccaaggcctgcagcacctcat

SEQ ID NO: 6943411 - DNA, 22 bp, Homo sapiens
taggggtcttgttggcatcacg

SEQ ID NO: 6943412 - DNA, 22 bp, Homo sapiens
aagagcttccctgttgtagagg

SEQ ID NO: 6943413 - DNA, 22 bp, Homo sapiens
atatccttgagacgtggctact

SEQ ID NO: 6943414 - DNA, 22 bp, Homo sapiens
ttcctctgaaatggcttggaaa

SEQ ID NO: 6943415 - DNA, 22 bp, Homo sapiens
atcatcttcatattcctcagct

SEQ ID NO: 6943416 - DNA, 22 bp, Homo sapiens
aaattgctgttgggtgactctt

SEQ ID NO: 6943417 - DNA, 22 bp, Homo sapiens
gagatgttgttcaaagatttta

SEQ ID NO: 6943418 - DNA, 22 bp, Homo sapiens
tcaggagggagtgtggatagag

SEQ ID NO: 6943419 - DNA, 22 bp, Homo sapiens
tcagggcatccattgcctgttg

SEQ ID NO: 6943420 - DNA, 17 bp, Homo sapiens
ttccttgggtgctgggt

SEQ ID NO: 6943421 - DNA, 22 bp, Homo sapiens
ggcctgctgctggttagatggg

SEQ ID NO: 6943422 - DNA, 22 bp, Homo sapiens
caggtgacaagacaggtaatat

SEQ ID NO: 6943423 - DNA, 22 bp, Homo sapiens
ggcttctgagtgctctgctgtt

SEQ ID NO: 6943424 - DNA, 22 bp, Homo sapiens
tggaagcttctgaccatttttg

SEQ ID NO: 6943425 - DNA, 22 bp, Homo sapiens
tgctctgggctatctgagaaag

SEQ ID NO: 6943426 - DNA, 22 bp, Homo sapiens
tgccctgaggcactccatccat

SEQ ID NO: 6943427 - DNA, 22 bp, Homo sapiens
gagggccagatcccaggaggaa

SEQ ID NO: 6943428 - DNA, 22 bp, Homo sapiens
taggaatttttgtaatggtact

SEQ ID NO: 6943429 - DNA, 22 bp, Homo sapiens
tgtagaagctagcctggagcca

SEQ ID NO: 6943430 - DNA, 22 bp, Homo sapiens
aatcaggagctgaggtttagcc

SEQ ID NO: 6943431 - DNA, 22 bp, Homo sapiens
tccattcaggccagtgcaaagt

SEQ ID NO: 6943432 - DNA, 22 bp, Homo sapiens
taatggtatttcaagacttgcc

SEQ ID NO: 6943433 - DNA, 22 bp, Homo sapiens
tgtggccataaagcttaaaatg

SEQ ID NO: 6943434 - DNA, 22 bp, Homo sapiens
tttgaaagggacaaagtcactg

SEQ ID NO: 6943435 - DNA, 22 bp, Homo sapiens
ctggatcccgtctgagcctcct

SEQ ID NO: 6943436 - DNA, 22 bp, Homo sapiens
tcccacacttgaaacaaggctg

SEQ ID NO: 6943437 - DNA, 22 bp, Homo sapiens
tcagctgtccgcagcccacttc

SEQ ID NO: 6943438 - DNA, 22 bp, Homo sapiens
acctgaggcctccccagcagac

SEQ ID NO: 6943439 - DNA, 22 bp, Homo sapiens
agagaggttaaggagctcttgt

SEQ ID NO: 6943440 - DNA, 22 bp, Homo sapiens
catgcaggcacccagagcccac

SEQ ID NO: 6943441 - DNA, 20 bp, Homo sapiens
ttctctggatagccagatgt

SEQ ID NO: 6943442 - DNA, 19 bp, Homo sapiens
aaaaagaggctataatatt

SEQ ID NO: 6943443 - DNA, 22 bp, Homo sapiens
ttagtgtctcacctaaaatctg

SEQ ID NO: 6943444 - DNA, 22 bp, Homo sapiens
tttgttcacagggttgttgtag

SEQ ID NO: 6943445 - DNA, 22 bp, Homo sapiens
ctgaaagggagaacaccaagag

SEQ ID NO: 6943446 - DNA, 22 bp, Homo sapiens
caggctggagttcagtggtgtg

SEQ ID NO: 6943447 - DNA, 22 bp, Homo sapiens
ttaagagatttaggaacattat

SEQ ID NO: 6943448 - DNA, 22 bp, Homo sapiens
ccaataactgtaactttctgtg

SEQ ID NO: 6943449 - DNA, 22 bp, Homo sapiens
aattatgaggtagatatcacat

SEQ ID NO: 6943450 - DNA, 22 bp, Homo sapiens
gcacacagaacatttggatcct

SEQ ID NO: 6943451 - DNA, 22 bp, Homo sapiens
attgtctttaaaaatatacaac

SEQ ID NO: 6943452 - DNA, 22 bp, Homo sapiens
tatgtgataggcattttactga

SEQ ID NO: 6943453 - DNA, 22 bp, Homo sapiens
tccacctccatgctgggcagag

SEQ ID NO: 6943454 - DNA, 22 bp, Homo sapiens
aagacaatgagtcctgatggga

SEQ ID NO: 6943455 - DNA, 22 bp, Homo sapiens
tcagctccagagttgcacagtg

SEQ ID NO: 6943456 - DNA, 22 bp, Homo sapiens
gctcctggagagattgagaaag

SEQ ID NO: 6943457 - DNA, 22 bp, Homo sapiens
tagttaaaataatggagatgtt

SEQ ID NO: 6943458 - DNA, 22 bp, Homo sapiens
gacaatctggacccagtcttca

SEQ ID NO: 6943459 - DNA, 22 bp, Homo sapiens
tgtagtgaggaaagactggttg

SEQ ID NO: 6943460 - DNA, 22 bp, Homo sapiens
ctggcagatagtaagtgatcaa

SEQ ID NO: 6943461 - DNA, 22 bp, Homo sapiens
taggccaggacagagcttccag

SEQ ID NO: 6943462 - DNA, 22 bp, Homo sapiens
gaggcatgcagagctggagcag

SEQ ID NO: 6943463 - DNA, 22 bp, Homo sapiens
ctcaggctgtctaatggattag

SEQ ID NO: 6943464 - DNA, 22 bp, Homo sapiens
agatttgtcagctcagtcttta

SEQ ID NO: 6943465 - DNA, 22 bp, Homo sapiens
ggatggcttgcatttgaggact

SEQ ID NO: 6943466 - DNA, 23 bp, Homo sapiens
ttctaaggtatggtttatacctg

SEQ ID NO: 6943467 - DNA, 22 bp, Homo sapiens
cccaggaggtggaggttgcagc

SEQ ID NO: 6943468 - DNA, 22 bp, Homo sapiens
tggcacaggaatttagatgcag

SEQ ID NO: 6943469 - DNA, 20 bp, Homo sapiens
attcagaataggcatgtaaa

SEQ ID NO: 6943470 - DNA, 22 bp, Homo sapiens
ctgtgcagctggcttcctggaa

SEQ ID NO: 6943471 - DNA, 22 bp, Homo sapiens
tgctgctgaaaaggtgtgctta

SEQ ID NO: 6943472 - DNA, 21 bp, Homo sapiens
cagaggcctatcacagactcc

SEQ ID NO: 6943473 - DNA, 22 bp, Homo sapiens
ttccatgtactgggttttgtat

SEQ ID NO: 6943474 - DNA, 22 bp, Homo sapiens
gaggcaacttcctgtcctctcc

SEQ ID NO: 6943475 - DNA, 22 bp, Homo sapiens
ccaaggttgcaggcctcagaga

SEQ ID NO: 6943476 - DNA, 22 bp, Homo sapiens
gagtcagaattgtattttaaac

SEQ ID NO: 6943477 - DNA, 22 bp, Homo sapiens
tctgaggaataagaaggaagtg

SEQ ID NO: 6943478 - DNA, 22 bp, Homo sapiens
ctgggggtcttgaaagggagag

SEQ ID NO: 6943479 - DNA, 22 bp, Homo sapiens
aagagccatatatgcagctaga

SEQ ID NO: 6943480 - DNA, 18 bp, Homo sapiens
ggctatgcatttggggta

SEQ ID NO: 6943481 - DNA, 22 bp, Homo sapiens
aaatgtgcatgagtcagaagtg

SEQ ID NO: 6943482 - DNA, 22 bp, Homo sapiens
tatagctttgctgagaaaaaga

SEQ ID NO: 6943483 - DNA, 22 bp, Homo sapiens
agaaatagcagagtcaggcggg

SEQ ID NO: 6943484 - DNA, 22 bp, Homo sapiens
acagtgacactcaggtgggatg

SEQ ID NO: 6943485 - DNA, 22 bp, Homo sapiens
tgggccagtagctactcgcaag

SEQ ID NO: 6943486 - DNA, 22 bp, Homo sapiens
tctgtgcacaataggcattttt

SEQ ID NO: 6943487 - DNA, 23 bp, Homo sapiens
tccaggaccctggtagacacaca

SEQ ID NO: 6943488 - DNA, 18 bp, Homo sapiens
tccaggtcccaggggaag

SEQ ID NO: 6943489 - DNA, 22 bp, Homo sapiens
aataagagcactggctttggag

SEQ ID NO: 6943490 - DNA, 22 bp, Homo sapiens
ctggtcactggtctcatccagc

SEQ ID NO: 6943491 - DNA, 20 bp, Homo sapiens
tagcaagcaggaggtgcaga

SEQ ID NO: 6943492 - DNA, 22 bp, Homo sapiens
agactcctcggaccaatcagcg

SEQ ID NO: 6943493 - DNA, 22 bp, Homo sapiens
tcaggtgtatcatggagttgaa

SEQ ID NO: 6943494 - DNA, 22 bp, Homo sapiens
acctacagatctttgaatgtgt

SEQ ID NO: 6943495 - DNA, 22 bp, Homo sapiens
tggctaagcatgctccagctgc

SEQ ID NO: 6943496 - DNA, 22 bp, Homo sapiens
caacttgttcttggtagatcta

SEQ ID NO: 6943497 - DNA, 22 bp, Homo sapiens
ggagatggctctgcaaggtcta

SEQ ID NO: 6943498 - DNA, 22 bp, Homo sapiens
tggtcattggtagtgcagggag

SEQ ID NO: 6943499 - DNA, 22 bp, Homo sapiens
ttgatttgattgtaatggctct

SEQ ID NO: 6943500 - DNA, 22 bp, Homo sapiens
tgaaatgtctcacttagacttt

SEQ ID NO: 6943501 - DNA, 22 bp, Homo sapiens
agttcactttctgtagtggaag

SEQ ID NO: 6943502 - DNA, 22 bp, Homo sapiens
agagtgattcgttcaagaacca

SEQ ID NO: 6943503 - DNA, 22 bp, Homo sapiens
aaaagtgatgggatggcacttc

SEQ ID NO: 6943504 - DNA, 18 bp, Homo sapiens
taaacctttcttgtggca

SEQ ID NO: 6943505 - DNA, 22 bp, Homo sapiens
tagcaaaagctcaacaggaagg

SEQ ID NO: 6943506 - DNA, 20 bp, Homo sapiens
atcctctcctgattaattca

SEQ ID NO: 6943507 - DNA, 22 bp, Homo sapiens
gaccttgtgatccagccacctt

SEQ ID NO: 6943508 - DNA, 22 bp, Homo sapiens
tcacagctcactgtagcctcga

SEQ ID NO: 6943509 - DNA, 22 bp, Homo sapiens
tttggccaagaaagttctgtgg

SEQ ID NO: 6943510 - DNA, 22 bp, Homo sapiens
ttctctggagagtatcttctta

SEQ ID NO: 6943511 - DNA, 22 bp, Homo sapiens
ctgtttgtccaacttgtcccga

SEQ ID NO: 6943512 - DNA, 22 bp, Homo sapiens
atgtttaaatttatagacagtg

SEQ ID NO: 6943513 - DNA, 22 bp, Homo sapiens
agggctgaagggaggtgctcat

SEQ ID NO: 6943514 - DNA, 22 bp, Homo sapiens
agcagttactagttaaatgcat

SEQ ID NO: 6943515 - DNA, 22 bp, Homo sapiens
tttccaaaatgaatctaatgca

SEQ ID NO: 6943516 - DNA, 22 bp, Homo sapiens
ggcctgggcccactgtcaagag

SEQ ID NO: 6943517 - DNA, 22 bp, Homo sapiens
tttctgttgtacttaaactagg

SEQ ID NO: 6943518 - DNA, 22 bp, Homo sapiens
ctaacgaatatgtatgcatgtt

SEQ ID NO: 6943519 - DNA, 22 bp, Homo sapiens
cctcagaggtgaacatcagtgc

SEQ ID NO: 6943520 - DNA, 22 bp, Homo sapiens
tcttattcagtgggctctgcca

SEQ ID NO: 6943521 - DNA, 22 bp, Homo sapiens
ggtagtcatggatagctatgag

SEQ ID NO: 6943522 - DNA, 22 bp, Homo sapiens
agcacacatcacttctgctcat

SEQ ID NO: 6943523 - DNA, 22 bp, Homo sapiens
tagcaaccctatattgaagatg

SEQ ID NO: 6943524 - DNA, 22 bp, Homo sapiens
gggagctgtagtccagataccg

SEQ ID NO: 6943525 - DNA, 22 bp, Homo sapiens
ttgagtactccgggtgcacttg

SEQ ID NO: 6943526 - DNA, 22 bp, Homo sapiens
ctggaatgggagtcagacagag

SEQ ID NO: 6943527 - DNA, 22 bp, Homo sapiens
ccagacctaagcatcagtgcat

SEQ ID NO: 6943528 - DNA, 22 bp, Homo sapiens
cttcacataaacaaagggccat

SEQ ID NO: 6943529 - DNA, 22 bp, Homo sapiens
agctcagcccgttagtaagccc

SEQ ID NO: 6943530 - DNA, 22 bp, Homo sapiens
tcaaatctcattgcctaaaact

SEQ ID NO: 6943531 - DNA, 17 bp, Homo sapiens
ctcctgagtgaaaggga

SEQ ID NO: 6943532 - DNA, 22 bp, Homo sapiens
ctgctctaggttcctgcatatg

SEQ ID NO: 6943533 - DNA, 22 bp, Homo sapiens
ttgacaatgtcctttgaatttc

SEQ ID NO: 6943534 - DNA, 22 bp, Homo sapiens
ataagacacgccccactcactc

SEQ ID NO: 6943535 - DNA, 22 bp, Homo sapiens
atgacatcactacattattcct

SEQ ID NO: 6943536 - DNA, 22 bp, Homo sapiens
ggaggctcagactccatcctca

SEQ ID NO: 6943537 - DNA, 22 bp, Homo sapiens
tgcgatggcgtagacaaatccc

SEQ ID NO: 6943538 - DNA, 22 bp, Homo sapiens
agtggcttgctctgcctcagcc

SEQ ID NO: 6943539 - DNA, 22 bp, Homo sapiens
ctcctgtgaggcttaagcccag

SEQ ID NO: 6943540 - DNA, 18 bp, Homo sapiens
gccagaggtactactgat

SEQ ID NO: 6943541 - DNA, 22 bp, Homo sapiens
ggctcatatcccggccatcatt

SEQ ID NO: 6943542 - DNA, 19 bp, Homo sapiens
agcatctccctgatcattc

SEQ ID NO: 6943543 - DNA, 22 bp, Homo sapiens
ccacagggcacaagggaggttg

SEQ ID NO: 6943544 - DNA, 22 bp, Homo sapiens
acagttacatcacttactgaca

SEQ ID NO: 6943545 - DNA, 20 bp, Homo sapiens
ttttagcagaaagaaagctc

SEQ ID NO: 6943546 - DNA, 22 bp, Homo sapiens
ttggtacaatgtgctaggtagg

SEQ ID NO: 6943547 - DNA, 22 bp, Homo sapiens
atggcatcgtcaccttttcagt

SEQ ID NO: 6943548 - DNA, 22 bp, Homo sapiens
gggtctaggagacatgggcaag

SEQ ID NO: 6943549 - DNA, 20 bp, Homo sapiens
tgtcttccagcaggtgttta

SEQ ID NO: 6943550 - DNA, 22 bp, Homo sapiens
atgcatgagaatatcccatgct

SEQ ID NO: 6943551 - DNA, 22 bp, Homo sapiens
tcttctcccatctccaggcagg

SEQ ID NO: 6943552 - DNA, 22 bp, Homo sapiens
agcacagtggcttctatgtcta

SEQ ID NO: 6943553 - DNA, 22 bp, Homo sapiens
atgcagatgtttggttcattgt

SEQ ID NO: 6943554 - DNA, 22 bp, Homo sapiens
ctttatgtccaccagactgcaa

SEQ ID NO: 6943555 - DNA, 22 bp, Homo sapiens
atgaatgatttgtcagtcacag

SEQ ID NO: 6943556 - DNA, 22 bp, Homo sapiens
aagctgaaataatatctatgtt

SEQ ID NO: 6943557 - DNA, 22 bp, Homo sapiens
attgatccacagtttcgcttaa

SEQ ID NO: 6943558 - DNA, 22 bp, Homo sapiens
tgtctgaaccctggccctgcct

SEQ ID NO: 6943559 - DNA, 22 bp, Homo sapiens
aagcactggagatgccagagtg

SEQ ID NO: 6943560 - DNA, 22 bp, Homo sapiens
atttgtctttggacctgtgaga

SEQ ID NO: 6943561 - DNA, 22 bp, Homo sapiens
tggtctgaaggtggatttgaga

SEQ ID NO: 6943562 - DNA, 19 bp, Homo sapiens
gctcagagccatgggggct

SEQ ID NO: 6943563 - DNA, 22 bp, Homo sapiens
ttggggataagaattgaatgca

SEQ ID NO: 6943564 - DNA, 22 bp, Homo sapiens
cagcatgcctgggctgcctgcc

SEQ ID NO: 6943565 - DNA, 22 bp, Homo sapiens
gggcttgctaagaagagcgcat

SEQ ID NO: 6943566 - DNA, 22 bp, Homo sapiens
aagacgcttcctgccgccgcac

SEQ ID NO: 6943567 - DNA, 22 bp, Homo sapiens
tcatcccagtgtccatgctcag

SEQ ID NO: 6943568 - DNA, 22 bp, Homo sapiens
taggcagtagcaggatctgcca

SEQ ID NO: 6943569 - DNA, 22 bp, Homo sapiens
ttggcagaatgggcagcttgag

SEQ ID NO: 6943570 - DNA, 22 bp, Homo sapiens
actgaatagtgctgcattgtac

SEQ ID NO: 6943571 - DNA, 22 bp, Homo sapiens
ctgtcatggtttgaatgctcgc

SEQ ID NO: 6943572 - DNA, 22 bp, Homo sapiens
ctcctctggcttcctggaggca

SEQ ID NO: 6943573 - DNA, 22 bp, Homo sapiens
ctctgggtctataatgcagctg

SEQ ID NO: 6943574 - DNA, 22 bp, Homo sapiens
tagcacctgatacctagtatgt

SEQ ID NO: 6943575 - DNA, 22 bp, Homo sapiens
agcaacaggaaatagctgatta

SEQ ID NO: 6943576 - DNA, 22 bp, Homo sapiens
catcaaagcttttttctgtgtt

SEQ ID NO: 6943577 - DNA, 22 bp, Homo sapiens
tggcatgttaaataagatcata

SEQ ID NO: 6943578 - DNA, 22 bp, Homo sapiens
cagaagtggcctcagagggagt

SEQ ID NO: 6943579 - DNA, 22 bp, Homo sapiens
aaactcttcctttctttaaagt

SEQ ID NO: 6943580 - DNA, 22 bp, Homo sapiens
tcatttgggtcagttttccata

SEQ ID NO: 6943581 - DNA, 19 bp, Homo sapiens
tctgaggtggaactggggg

SEQ ID NO: 6943582 - DNA, 23 bp, Homo sapiens
tcacatttaacccctcagacctc

SEQ ID NO: 6943583 - DNA, 22 bp, Homo sapiens
cagcatcattcatctggggtaa

SEQ ID NO: 6943584 - DNA, 22 bp, Homo sapiens
agcaggtgatcgcgtgtgctcc

SEQ ID NO: 6943585 - DNA, 22 bp, Homo sapiens
acatgcagggctttttgcctct

SEQ ID NO: 6943586 - DNA, 22 bp, Homo sapiens
aggctcagtgatgtaaaatata

SEQ ID NO: 6943587 - DNA, 22 bp, Homo sapiens
atcaagagaaggggaagatgaa

SEQ ID NO: 6943588 - DNA, 22 bp, Homo sapiens
aagggctggccctgggaagagt

SEQ ID NO: 6943589 - DNA, 22 bp, Homo sapiens
agggcctctggaacactgaggg

SEQ ID NO: 6943590 - DNA, 22 bp, Homo sapiens
tgggctctgaagggtcccggat

SEQ ID NO: 6943591 - DNA, 22 bp, Homo sapiens
agtcccagcttcccccatgcag

SEQ ID NO: 6943592 - DNA, 22 bp, Homo sapiens
tcagtctttttctcttaagtac

SEQ ID NO: 6943593 - DNA, 22 bp, Homo sapiens
ccaggtggacggcgagtacagg

SEQ ID NO: 6943594 - DNA, 22 bp, Homo sapiens
cagcttcttcagtcctggagct

SEQ ID NO: 6943595 - DNA, 22 bp, Homo sapiens
ttcctctcgctctccggggccc

SEQ ID NO: 6943596 - DNA, 21 bp, Homo sapiens
tcacaggtcaatgtgtgaagg

SEQ ID NO: 6943597 - DNA, 22 bp, Homo sapiens
gagagcaggaggcagcgggacg

SEQ ID NO: 6943598 - DNA, 22 bp, Homo sapiens
tgaggcgtctccctgagctcac

SEQ ID NO: 6943599 - DNA, 21 bp, Homo sapiens
ttggagtagcactatgtaaac

SEQ ID NO: 6943600 - DNA, 22 bp, Homo sapiens
cagagtcattgacttccaggag

SEQ ID NO: 6943601 - DNA, 22 bp, Homo sapiens
gcagtatacactgatacatgag

SEQ ID NO: 6943602 - DNA, 22 bp, Homo sapiens
ggcaggtcaggtccatgaccaa

SEQ ID NO: 6943603 - DNA, 22 bp, Homo sapiens
gagaccaaggattgaatgctgg

SEQ ID NO: 6943604 - DNA, 22 bp, Homo sapiens
cagctcttcagagtgagcaatg

SEQ ID NO: 6943605 - DNA, 22 bp, Homo sapiens
ctcacagtgtcaacattaacta

SEQ ID NO: 6943606 - DNA, 22 bp, Homo sapiens
agctctgaagcttatctgatgt

SEQ ID NO: 6943607 - DNA, 22 bp, Homo sapiens
gcctgggattctcaaaggggtg

SEQ ID NO: 6943608 - DNA, 22 bp, Homo sapiens
gtcttatttaaagagatcatac

SEQ ID NO: 6943609 - DNA, 22 bp, Homo sapiens
acctcagagatacaaaccatgg

SEQ ID NO: 6943610 - DNA, 22 bp, Homo sapiens
cctcacagccctcctctagcac

SEQ ID NO: 6943611 - DNA, 22 bp, Homo sapiens
ctcctggaagcccgccctgctg

SEQ ID NO: 6943612 - DNA, 22 bp, Homo sapiens
tcatgcaaagccaattccagct

SEQ ID NO: 6943613 - DNA, 22 bp, Homo sapiens
tgaagatcctatctgcaaatat

SEQ ID NO: 6943614 - DNA, 22 bp, Homo sapiens
cctgctcagccccagctcaccc

SEQ ID NO: 6943615 - DNA, 22 bp, Homo sapiens
tgagtgctctgtatgtgccaga

SEQ ID NO: 6943616 - DNA, 22 bp, Homo sapiens
cactgagggggtggtttcagga

SEQ ID NO: 6943617 - DNA, 22 bp, Homo sapiens
agtgtctgctaggttcatcaac

SEQ ID NO: 6943618 - DNA, 22 bp, Homo sapiens
atgcacagaacaattttaagag

SEQ ID NO: 6943619 - DNA, 22 bp, Homo sapiens
aatcacattgaatctgctacct

SEQ ID NO: 6943620 - DNA, 22 bp, Homo sapiens
catttctccgccgagatcactg

SEQ ID NO: 6943621 - DNA, 22 bp, Homo sapiens
aaagggctcccaggatcatctc

SEQ ID NO: 6943622 - DNA, 22 bp, Homo sapiens
tgcacacaagttggagaatgaa

SEQ ID NO: 6943623 - DNA, 22 bp, Homo sapiens
agaccatagggacctcaggttg

SEQ ID NO: 6943624 - DNA, 22 bp, Homo sapiens
gtattacatttagtaattaggc

SEQ ID NO: 6943625 - DNA, 22 bp, Homo sapiens
gagaggctgggttggagatcga

SEQ ID NO: 6943626 - DNA, 22 bp, Homo sapiens
accattctggttaagaacccat

SEQ ID NO: 6943627 - DNA, 22 bp, Homo sapiens
aggaggaactcagaaagaaggt

SEQ ID NO: 6943628 - DNA, 22 bp, Homo sapiens
gggctcagccccattgaaccag

SEQ ID NO: 6943629 - DNA, 22 bp, Homo sapiens
gtcctgcttcccacagaaaccg

SEQ ID NO: 6943630 - DNA, 21 bp, Homo sapiens
catggggttgctatagcaaaa

SEQ ID NO: 6943631 - DNA, 20 bp, Homo sapiens
atattgcaaggaagctggat

SEQ ID NO: 6943632 - DNA, 19 bp, Homo sapiens
tttttaatgggctggagca

SEQ ID NO: 6943633 - DNA, 22 bp, Homo sapiens
atgtttctgaagtttacagata

SEQ ID NO: 6943634 - DNA, 21 bp, Homo sapiens
ctgccttgaatggtactggga

SEQ ID NO: 6943635 - DNA, 22 bp, Homo sapiens
attatttggaataggcattgca

SEQ ID NO: 6943636 - DNA, 22 bp, Homo sapiens
agtctgtcattaaacttcccaa

SEQ ID NO: 6943637 - DNA, 18 bp, Homo sapiens
ctctttctttggcacaaa

SEQ ID NO: 6943638 - DNA, 22 bp, Homo sapiens
cagggagggaggaaaatttgct

SEQ ID NO: 6943639 - DNA, 22 bp, Homo sapiens
atgttcttagcaaagtacttgc

SEQ ID NO: 6943640 - DNA, 23 bp, Homo sapiens
gctttatagttctcccaacatta

SEQ ID NO: 6943641 - DNA, 22 bp, Homo sapiens
cactatttgctttgggctagag

SEQ ID NO: 6943642 - DNA, 22 bp, Homo sapiens
tgcatgatgttaaacatcaggt

SEQ ID NO: 6943643 - DNA, 22 bp, Homo sapiens
tccaagacaagcacattcctgc

SEQ ID NO: 6943644 - DNA, 22 bp, Homo sapiens
cctgctgttagatttcagtcac

SEQ ID NO: 6943645 - DNA, 22 bp, Homo sapiens
tgtgcctggcattctgggcttc

SEQ ID NO: 6943646 - DNA, 22 bp, Homo sapiens
taggagggttagagggaaatat

SEQ ID NO: 6943647 - DNA, 22 bp, Homo sapiens
gaggaacaagctgctttatctt

SEQ ID NO: 6943648 - DNA, 22 bp, Homo sapiens
gtgctggcctcagagggtcatg

SEQ ID NO: 6943649 - DNA, 19 bp, Homo sapiens
tactccaatcaggaacaca

SEQ ID NO: 6943650 - DNA, 22 bp, Homo sapiens
gcagctttggaggtggaactct

SEQ ID NO: 6943651 - DNA, 22 bp, Homo sapiens
tccagagcctttccacccactt

SEQ ID NO: 6943652 - DNA, 22 bp, Homo sapiens
ttatagttatgaaagactgagg

SEQ ID NO: 6943653 - DNA, 22 bp, Homo sapiens
ttccctggctcttctacatcgt

SEQ ID NO: 6943654 - DNA, 22 bp, Homo sapiens
tctgcacaattgatcatggcaa

SEQ ID NO: 6943655 - DNA, 22 bp, Homo sapiens
aaacattgacctcatcctggca

SEQ ID NO: 6943656 - DNA, 21 bp, Homo sapiens
tgtctcctgttggcacatggc

SEQ ID NO: 6943657 - DNA, 22 bp, Homo sapiens
atgtgtcaggtacactcattag

SEQ ID NO: 6943658 - DNA, 22 bp, Homo sapiens
tagcagcactatttgttgtagt

SEQ ID NO: 6943659 - DNA, 22 bp, Homo sapiens
gtgctgatgttgcttcccttgg

SEQ ID NO: 6943660 - DNA, 22 bp, Homo sapiens
gccctgctgctggcagaggcgc

SEQ ID NO: 6943661 - DNA, 22 bp, Homo sapiens
tgtctccaggggcaggccagcc

SEQ ID NO: 6943662 - DNA, 22 bp, Homo sapiens
ctgtgggtggctgtgccccagg

SEQ ID NO: 6943663 - DNA, 18 bp, Homo sapiens
gggcggaagggaagataa

SEQ ID NO: 6943664 - DNA, 22 bp, Homo sapiens
caggtctgcagacagggccatg

SEQ ID NO: 6943665 - DNA, 22 bp, Homo sapiens
ctgtttgctggctatgaactcc

SEQ ID NO: 6943666 - DNA, 22 bp, Homo sapiens
atgcagatatgcaaactgtagt

SEQ ID NO: 6943667 - DNA, 22 bp, Homo sapiens
agtccttgaatgttttgaaatc

SEQ ID NO: 6943668 - DNA, 22 bp, Homo sapiens
acagtgatgggggtgcaggaag

SEQ ID NO: 6943669 - DNA, 22 bp, Homo sapiens
attgagcaatagtgtttgcagc

SEQ ID NO: 6943670 - DNA, 22 bp, Homo sapiens
aatcagaaagatcttgatgaga

SEQ ID NO: 6943671 - DNA, 22 bp, Homo sapiens
gctgcagtgttggacctcaggg

SEQ ID NO: 6943672 - DNA, 18 bp, Homo sapiens
gtttacacattctagaaa

SEQ ID NO: 6943673 - DNA, 22 bp, Homo sapiens
agtggggagtttccagatgtgt

SEQ ID NO: 6943674 - DNA, 22 bp, Homo sapiens
tctcttttatgtacaccctgac

SEQ ID NO: 6943675 - DNA, 22 bp, Homo sapiens
gaaattattgctagagactgca

SEQ ID NO: 6943676 - DNA, 22 bp, Homo sapiens
aagacctctgaggtagaagttc

SEQ ID NO: 6943677 - DNA, 22 bp, Homo sapiens
ggctgcagcggattggggattg

SEQ ID NO: 6943678 - DNA, 22 bp, Homo sapiens
atttcatgtaaatggaatgata

SEQ ID NO: 6943679 - DNA, 22 bp, Homo sapiens
tcaatgcaacttccacctccca

SEQ ID NO: 6943680 - DNA, 21 bp, Homo sapiens
tctggagctgcaggctgggca

SEQ ID NO: 6943681 - DNA, 22 bp, Homo sapiens
agctgcaggttcagcattccac

SEQ ID NO: 6943682 - DNA, 22 bp, Homo sapiens
tttcctttctcaagagccggca

SEQ ID NO: 6943683 - DNA, 22 bp, Homo sapiens
agcagaggtgtttattatggga

SEQ ID NO: 6943684 - DNA, 22 bp, Homo sapiens
gcatctgtgaatttgatataca

SEQ ID NO: 6943685 - DNA, 22 bp, Homo sapiens
cctgtacaagctcttggtgaca

SEQ ID NO: 6943686 - DNA, 22 bp, Homo sapiens
gtcatattgaagaagactggca

SEQ ID NO: 6943687 - DNA, 22 bp, Homo sapiens
agtcttccctgtgccagagtgt

SEQ ID NO: 6943688 - DNA, 22 bp, Homo sapiens
aatatttcaaaaggaaacacag

SEQ ID NO: 6943689 - DNA, 22 bp, Homo sapiens
tccttgtaacgttgggctgggg

SEQ ID NO: 6943690 - DNA, 22 bp, Homo sapiens
ttcctgcagcaaggagaagctg

SEQ ID NO: 6943691 - DNA, 22 bp, Homo sapiens
ggctgcaaaggaaaagtggtga

SEQ ID NO: 6943692 - DNA, 22 bp, Homo sapiens
agcatgctggtgttcatggcag

SEQ ID NO: 6943693 - DNA, 22 bp, Homo sapiens
aacactgagtatcagagttggg

SEQ ID NO: 6943694 - DNA, 22 bp, Homo sapiens
gacagcagacaaaccatgtttt

SEQ ID NO: 6943695 - DNA, 22 bp, Homo sapiens
ctggttcagtgaaaggcatggg

SEQ ID NO: 6943696 - DNA, 22 bp, Homo sapiens
ctagggtgtgcagattttgcct

SEQ ID NO: 6943697 - DNA, 22 bp, Homo sapiens
aagcttgtcagtgcaattttac

SEQ ID NO: 6943698 - DNA, 22 bp, Homo sapiens
tcacatcttattagagtatctc

SEQ ID NO: 6943699 - DNA, 22 bp, Homo sapiens
gcagcccaagagactctgttga

SEQ ID NO: 6943700 - DNA, 23 bp, Homo sapiens
tcctgagggtttcccagccttgg

SEQ ID NO: 6943701 - DNA, 22 bp, Homo sapiens
cagtgggtcctgcgtctgccag

SEQ ID NO: 6943702 - DNA, 22 bp, Homo sapiens
taggccagaggagcagctttgg

SEQ ID NO: 6943703 - DNA, 22 bp, Homo sapiens
gtgtgtacaaatttcatgtaaa

SEQ ID NO: 6943704 - DNA, 22 bp, Homo sapiens
atgtatttgcttgttatggatt

SEQ ID NO: 6943705 - DNA, 22 bp, Homo sapiens
ccctgaggcagtaggagctttt

SEQ ID NO: 6943706 - DNA, 22 bp, Homo sapiens
tcatgcttagtttaatgctctg

SEQ ID NO: 6943707 - DNA, 22 bp, Homo sapiens
tcagcccaccttcaggggagtt

SEQ ID NO: 6943708 - DNA, 20 bp, Homo sapiens
aacacactggtggcatcagg

SEQ ID NO: 6943709 - DNA, 22 bp, Homo sapiens
caatgttccctgtactgctttt

SEQ ID NO: 6943710 - DNA, 22 bp, Homo sapiens
caagaacagtttgccaaattgg

SEQ ID NO: 6943711 - DNA, 22 bp, Homo sapiens
tcagagcacttggctcatggca

SEQ ID NO: 6943712 - DNA, 22 bp, Homo sapiens
ttcacagtaatgtgcccaggta

SEQ ID NO: 6943713 - DNA, 22 bp, Homo sapiens
tcctggagtgtcttccccaagg

SEQ ID NO: 6943714 - DNA, 22 bp, Homo sapiens
tttctagatattccttgaagtg

SEQ ID NO: 6943715 - DNA, 22 bp, Homo sapiens
gtctggaagctctaggggagaa

SEQ ID NO: 6943716 - DNA, 22 bp, Homo sapiens
agtctattgcctaacagagagg

SEQ ID NO: 6943717 - DNA, 22 bp, Homo sapiens
gctctgcccaggaccgtccttg

SEQ ID NO: 6943718 - DNA, 17 bp, Homo sapiens
gctggctgacccatgcc

SEQ ID NO: 6943719 - DNA, 22 bp, Homo sapiens
tcatttaatagcttttgtcttt

SEQ ID NO: 6943720 - DNA, 19 bp, Homo sapiens
aaggtggtttgtctctgta

SEQ ID NO: 6943721 - DNA, 22 bp, Homo sapiens
ttccttgaccactgcataatga

SEQ ID NO: 6943722 - DNA, 20 bp, Homo sapiens
atgcaaatcccaaaatcagg

SEQ ID NO: 6943723 - DNA, 22 bp, Homo sapiens
ccttggcaggcacgtcctgcgg

SEQ ID NO: 6943724 - DNA, 22 bp, Homo sapiens
tgttttcaagtcaaggccaaat

SEQ ID NO: 6943725 - DNA, 19 bp, Homo sapiens
gcttcccaccagccagccc

SEQ ID NO: 6943726 - DNA, 22 bp, Homo sapiens
agaatatgatcggaatacagat

SEQ ID NO: 6943727 - DNA, 22 bp, Homo sapiens
cccgtaaagcatgggttatgct

SEQ ID NO: 6943728 - DNA, 22 bp, Homo sapiens
ttctagtgtccttggacttgct

SEQ ID NO: 6943729 - DNA, 22 bp, Homo sapiens
ctgcctgttagtctagcagtta

SEQ ID NO: 6943730 - DNA, 22 bp, Homo sapiens
tttgaacagggaatgttccaca

SEQ ID NO: 6943731 - DNA, 23 bp, Homo sapiens
gtgtgccaagcactgtgccagga

SEQ ID NO: 6943732 - DNA, 22 bp, Homo sapiens
cctggccaatctagggctgtta

SEQ ID NO: 6943733 - DNA, 23 bp, Homo sapiens
gctcatccacggagaggggctcc

SEQ ID NO: 6943734 - DNA, 22 bp, Homo sapiens
aggccaggtggtcatgcttgct

SEQ ID NO: 6943735 - DNA, 22 bp, Homo sapiens
atggttatgcaaacatgatgca

SEQ ID NO: 6943736 - DNA, 22 bp, Homo sapiens
tgggaacaacatgcactgccac

SEQ ID NO: 6943737 - DNA, 23 bp, Homo sapiens
aaagatgtgagtattcatatggc

SEQ ID NO: 6943738 - DNA, 22 bp, Homo sapiens
ctgggaggtgaacagaaaaact

SEQ ID NO: 6943739 - DNA, 22 bp, Homo sapiens
cagtaaatgagaagctagtaat

SEQ ID NO: 6943740 - DNA, 22 bp, Homo sapiens
ttcagtatttcatgactttctt

SEQ ID NO: 6943741 - DNA, 22 bp, Homo sapiens
cacaattattatctctttctac

SEQ ID NO: 6943742 - DNA, 22 bp, Homo sapiens
gcacatcagccactttgaatgg

SEQ ID NO: 6943743 - DNA, 22 bp, Homo sapiens
tgcagagtcacccagataatta

SEQ ID NO: 6943744 - DNA, 22 bp, Homo sapiens
acaacctgttcgtttccacaga

SEQ ID NO: 6943745 - DNA, 22 bp, Homo sapiens
attcctcattatttactgagga

SEQ ID NO: 6943746 - DNA, 22 bp, Homo sapiens
acttttcccttggtagagttgc

SEQ ID NO: 6943747 - DNA, 22 bp, Homo sapiens
cagtcaaacttataggcacatt

SEQ ID NO: 6943748 - DNA, 22 bp, Homo sapiens
tctaactctgccaggacacaga

SEQ ID NO: 6943749 - DNA, 22 bp, Homo sapiens
tcacatttgttcctctgcactt

SEQ ID NO: 6943750 - DNA, 22 bp, Homo sapiens
tgatgcatgaggagctgggtgc

SEQ ID NO: 6943751 - DNA, 20 bp, Homo sapiens
ctccaaggcttgcaggaggc

SEQ ID NO: 6943752 - DNA, 19 bp, Homo sapiens
agcacagacaagaccagca

SEQ ID NO: 6943753 - DNA, 22 bp, Homo sapiens
gagctcagcactaaaatcatgt

SEQ ID NO: 6943754 - DNA, 22 bp, Homo sapiens
cccagtgtggttgtgaattctg

SEQ ID NO: 6943755 - DNA, 22 bp, Homo sapiens
tgtctcctctgtcctgtcagga

SEQ ID NO: 6943756 - DNA, 22 bp, Homo sapiens
ttgcacatgatagatgatttct

SEQ ID NO: 6943757 - DNA, 22 bp, Homo sapiens
atgtgcagcctttcttcatcat

SEQ ID NO: 6943758 - DNA, 22 bp, Homo sapiens
gtggccattttttcctagcaca

SEQ ID NO: 6943759 - DNA, 18 bp, Homo sapiens
ggctgctcctctccctac

SEQ ID NO: 6943760 - DNA, 22 bp, Homo sapiens
tgtgtacacaatgattgcagag

SEQ ID NO: 6943761 - DNA, 22 bp, Homo sapiens
gtggccataggaggtcagatga

SEQ ID NO: 6943762 - DNA, 23 bp, Homo sapiens
attagacactttgggttgtcttc

SEQ ID NO: 6943763 - DNA, 22 bp, Homo sapiens
tctgcaaggggttctttaggcc

SEQ ID NO: 6943764 - DNA, 22 bp, Homo sapiens
attcactgtggtgactgatata

SEQ ID NO: 6943765 - DNA, 22 bp, Homo sapiens
ggctctatgtggtggttttgat

SEQ ID NO: 6943766 - DNA, 22 bp, Homo sapiens
tagatttctaacagtgtgcttg

SEQ ID NO: 6943767 - DNA, 22 bp, Homo sapiens
ccagttgggatttgtcctggtt

SEQ ID NO: 6943768 - DNA, 22 bp, Homo sapiens
ggacctggcaatttgcatctct

SEQ ID NO: 6943769 - DNA, 22 bp, Homo sapiens
ggtctgcgatggcaagggtctt

SEQ ID NO: 6943770 - DNA, 22 bp, Homo sapiens
gcatttcaaaattccaggcaag

SEQ ID NO: 6943771 - DNA, 22 bp, Homo sapiens
tgcttgattaagccttgtttgc

SEQ ID NO: 6943772 - DNA, 22 bp, Homo sapiens
tccagcattcttagacctctat

SEQ ID NO: 6943773 - DNA, 22 bp, Homo sapiens
aaactacactttgggaccagca

SEQ ID NO: 6943774 - DNA, 22 bp, Homo sapiens
cccttgaggtagactgaacacc

SEQ ID NO: 6943775 - DNA, 18 bp, Homo sapiens
gtccatccaggcagtgtc

SEQ ID NO: 6943776 - DNA, 22 bp, Homo sapiens
tctccaaactcagactaagtat

SEQ ID NO: 6943777 - DNA, 22 bp, Homo sapiens
aagtcaccctagggcctggact

SEQ ID NO: 6943778 - DNA, 22 bp, Homo sapiens
cccaggcacagattatcccaat

SEQ ID NO: 6943779 - DNA, 22 bp, Homo sapiens
cttgtaattataatgtactgtt

SEQ ID NO: 6943780 - DNA, 22 bp, Homo sapiens
ccagtggaattaaaaataagtg

SEQ ID NO: 6943781 - DNA, 22 bp, Homo sapiens
ttgagcaagcctgcggcgggaa

SEQ ID NO: 6943782 - DNA, 22 bp, Homo sapiens
gccctctcggcatagcaggggc

SEQ ID NO: 6943783 - DNA, 20 bp, Homo sapiens
gagggtgggacttcctaggc

SEQ ID NO: 6943784 - DNA, 22 bp, Homo sapiens
gttgtacatatgaggataagtt

SEQ ID NO: 6943785 - DNA, 22 bp, Homo sapiens
tcaacagtggcaaagaggcacg

SEQ ID NO: 6943786 - DNA, 22 bp, Homo sapiens
cagtggagaggcatgcttggca

SEQ ID NO: 6943787 - DNA, 22 bp, Homo sapiens
actttgaaactaaaattcatta

SEQ ID NO: 6943788 - DNA, 22 bp, Homo sapiens
gcttaagatgtttgtggcaatt

SEQ ID NO: 6943789 - DNA, 22 bp, Homo sapiens
gagccccagccctgcttctata

SEQ ID NO: 6943790 - DNA, 22 bp, Homo sapiens
gatgaagtcattatccttttgg

SEQ ID NO: 6943791 - DNA, 22 bp, Homo sapiens
ggcagtgagctggagggaagga

SEQ ID NO: 6943792 - DNA, 23 bp, Homo sapiens
gggaaaggatatgatcctagggg

SEQ ID NO: 6943793 - DNA, 22 bp, Homo sapiens
tgctttgcaaaagaacatagtg

SEQ ID NO: 6943794 - DNA, 22 bp, Homo sapiens
tctggccttatctgtccaagcc

SEQ ID NO: 6943795 - DNA, 22 bp, Homo sapiens
gaggcagagaccttcaggacct

SEQ ID NO: 6943796 - DNA, 17 bp, Homo sapiens
tccatgagacatgaaga

SEQ ID NO: 6943797 - DNA, 22 bp, Homo sapiens
aagagcatggagttcccctaaa

SEQ ID NO: 6943798 - DNA, 22 bp, Homo sapiens
gaatacacgaatagagcatggt

SEQ ID NO: 6943799 - DNA, 22 bp, Homo sapiens
tatttccacttaggtgcctgtt

SEQ ID NO: 6943800 - DNA, 22 bp, Homo sapiens
taacagcaaccacagtgctggt

SEQ ID NO: 6943801 - DNA, 22 bp, Homo sapiens
acttagcaggtactttcatatt

SEQ ID NO: 6943802 - DNA, 22 bp, Homo sapiens
ctgggacacagccttacctggg

SEQ ID NO: 6943803 - DNA, 22 bp, Homo sapiens
taatcactgtgagtctgttttc

SEQ ID NO: 6943804 - DNA, 22 bp, Homo sapiens
tcccactgtcttctcgtgctcg

SEQ ID NO: 6943805 - DNA, 22 bp, Homo sapiens
aaatatgatactcccttttagt

SEQ ID NO: 6943806 - DNA, 22 bp, Homo sapiens
ctctggcctggggcctgctccc

SEQ ID NO: 6943807 - DNA, 21 bp, Homo sapiens
tggcagagtgcagtctataca

SEQ ID NO: 6943808 - DNA, 22 bp, Homo sapiens
tgataaactggagaggtggagg

SEQ ID NO: 6943809 - DNA, 22 bp, Homo sapiens
tgttcctgcaaggaactggtgc

SEQ ID NO: 6943810 - DNA, 22 bp, Homo sapiens
gcagcatccccaggcagcaggg

SEQ ID NO: 6943811 - DNA, 22 bp, Homo sapiens
ccaggaggcggaaggtacagtg

SEQ ID NO: 6943812 - DNA, 22 bp, Homo sapiens
aaagctatagggtcaagcattt

SEQ ID NO: 6943813 - DNA, 21 bp, Homo sapiens
tggaagtggttcatttgctgc

SEQ ID NO: 6943814 - DNA, 22 bp, Homo sapiens
tctgctgtgaggaggcaggatg

SEQ ID NO: 6943815 - DNA, 20 bp, Homo sapiens
agtggagcagcccaagcagc

SEQ ID NO: 6943816 - DNA, 22 bp, Homo sapiens
atgcttgaaaaccccatgaata

SEQ ID NO: 6943817 - DNA, 23 bp, Homo sapiens
tctggctccatccttggggatcc

SEQ ID NO: 6943818 - DNA, 19 bp, Homo sapiens
ggtggctcagggcccagcc

SEQ ID NO: 6943819 - DNA, 22 bp, Homo sapiens
atgatggtgaggttgagcacag

SEQ ID NO: 6943820 - DNA, 22 bp, Homo sapiens
tcataaatgcagtgtcataaat

SEQ ID NO: 6943821 - DNA, 20 bp, Homo sapiens
tcgtagggtcagctcaccat

SEQ ID NO: 6943822 - DNA, 22 bp, Homo sapiens
cacttaagcagttaatttatct

SEQ ID NO: 6943823 - DNA, 22 bp, Homo sapiens
gctctgaaaaatggaggttggc

SEQ ID NO: 6943824 - DNA, 18 bp, Homo sapiens
tctcaaaaataatggctt

SEQ ID NO: 6943825 - DNA, 22 bp, Homo sapiens
cagaaaggcacccactgggtct

SEQ ID NO: 6943826 - DNA, 22 bp, Homo sapiens
tgtgtgattgcacttatatgag

SEQ ID NO: 6943827 - DNA, 22 bp, Homo sapiens
gaggacacatgactccagcagg

SEQ ID NO: 6943828 - DNA, 22 bp, Homo sapiens
cagaacacattttcagagtcaa

SEQ ID NO: 6943829 - DNA, 22 bp, Homo sapiens
ggaagtctcagcaacagagtta

SEQ ID NO: 6943830 - DNA, 22 bp, Homo sapiens
tgagatgaataactcctgctaa

SEQ ID NO: 6943831 - DNA, 22 bp, Homo sapiens
ctagagaaacgccgtgggagga

SEQ ID NO: 6943832 - DNA, 22 bp, Homo sapiens
gaaaggcatcttcagtctctga

SEQ ID NO: 6943833 - DNA, 21 bp, Homo sapiens
ttctagaaccgtgggcggttc

SEQ ID NO: 6943834 - DNA, 22 bp, Homo sapiens
gcccagccagagctgtgtgatg

SEQ ID NO: 6943835 - DNA, 22 bp, Homo sapiens
gctgctgggggaacagttaaaa

SEQ ID NO: 6943836 - DNA, 23 bp, Homo sapiens
tgtagctgtctgagcagacactg

SEQ ID NO: 6943837 - DNA, 22 bp, Homo sapiens
gctgctctgaaaatgactgttg

SEQ ID NO: 6943838 - DNA, 22 bp, Homo sapiens
ccagccacagcttccagctcct

SEQ ID NO: 6943839 - DNA, 22 bp, Homo sapiens
aaagagtttacaaattaggtaa

SEQ ID NO: 6943840 - DNA, 18 bp, Homo sapiens
ttgcttcttttctctagg

SEQ ID NO: 6943841 - DNA, 22 bp, Homo sapiens
aaaagcattacatggtacgtat

SEQ ID NO: 6943842 - DNA, 22 bp, Homo sapiens
aagtctgatcatttcttctata

SEQ ID NO: 6943843 - DNA, 23 bp, Homo sapiens
agtggctgagagtgtttcatatg

SEQ ID NO: 6943844 - DNA, 22 bp, Homo sapiens
gcctttcagttccatcaaagga

SEQ ID NO: 6943845 - DNA, 22 bp, Homo sapiens
acacaggggaaagtggagctga

SEQ ID NO: 6943846 - DNA, 22 bp, Homo sapiens
aagatactcagtggatatgcat

SEQ ID NO: 6943847 - DNA, 22 bp, Homo sapiens
catcagcactatgattaaagta

SEQ ID NO: 6943848 - DNA, 22 bp, Homo sapiens
aaaggccatggttggagtgttt

SEQ ID NO: 6943849 - DNA, 22 bp, Homo sapiens
aagatggctgcagcaattccaa

SEQ ID NO: 6943850 - DNA, 22 bp, Homo sapiens
taagagctgttcaggtacccat

SEQ ID NO: 6943851 - DNA, 22 bp, Homo sapiens
tctagaaaaaaactgctgtgga

SEQ ID NO: 6943852 - DNA, 22 bp, Homo sapiens
tcagccaagcgtaggatattgg

SEQ ID NO: 6943853 - DNA, 22 bp, Homo sapiens
gtcccagaaacatattgctggt

SEQ ID NO: 6943854 - DNA, 22 bp, Homo sapiens
tggtaggagatatggtctccga

SEQ ID NO: 6943855 - DNA, 22 bp, Homo sapiens
gggaggtgatggcaagcagcgg

SEQ ID NO: 6943856 - DNA, 22 bp, Homo sapiens
cagttgctacagttcaagtgtg

SEQ ID NO: 6943857 - DNA, 22 bp, Homo sapiens
agggccacagctcaattaaaag

SEQ ID NO: 6943858 - DNA, 20 bp, Homo sapiens
attagtgcatctggacatgc

SEQ ID NO: 6943859 - DNA, 22 bp, Homo sapiens
tacaggctagggagagtgactg

SEQ ID NO: 6943860 - DNA, 22 bp, Homo sapiens
cctgcagctttgcctcctgaac

SEQ ID NO: 6943861 - DNA, 22 bp, Homo sapiens
gggcagaggttcaacttcaaca

SEQ ID NO: 6943862 - DNA, 22 bp, Homo sapiens
aacacaggtttgtggtaaataa

SEQ ID NO: 6943863 - DNA, 22 bp, Homo sapiens
ccggcgaccgctgtcggaggcg

SEQ ID NO: 6943864 - DNA, 19 bp, Homo sapiens
agccagagtggcccagggg

SEQ ID NO: 6943865 - DNA, 22 bp, Homo sapiens
agtgaacctagcatggattatc

SEQ ID NO: 6943866 - DNA, 22 bp, Homo sapiens
gaactttaatcccttgggctta

SEQ ID NO: 6943867 - DNA, 22 bp, Homo sapiens
cctcagtgtgcagcagcatctg

SEQ ID NO: 6943868 - DNA, 22 bp, Homo sapiens
ctctgggcaccaaagagcagct

SEQ ID NO: 6943869 - DNA, 22 bp, Homo sapiens
agtgaaatatgcccattgctgt

SEQ ID NO: 6943870 - DNA, 22 bp, Homo sapiens
aaacttgaggcaatgaaggtgt

SEQ ID NO: 6943871 - DNA, 23 bp, Homo sapiens
tgtcttggtttcttcaccctagt

SEQ ID NO: 6943872 - DNA, 22 bp, Homo sapiens
atcttaatcgagtccatgaaaa

SEQ ID NO: 6943873 - DNA, 19 bp, Homo sapiens
tttatgtcattgaggtcat

SEQ ID NO: 6943874 - DNA, 22 bp, Homo sapiens
aggaccagtgagtctggcaagt

SEQ ID NO: 6943875 - DNA, 22 bp, Homo sapiens
tggccagctttgactgtaaacc

SEQ ID NO: 6943876 - DNA, 19 bp, Homo sapiens
caactgccccctcaaacat

SEQ ID NO: 6943877 - DNA, 22 bp, Homo sapiens
tagctgttaatatacaaatggt

SEQ ID NO: 6943878 - DNA, 22 bp, Homo sapiens
cactggtagtttcagcaaccag

SEQ ID NO: 6943879 - DNA, 22 bp, Homo sapiens
gatgtacaagattgtaggaatg

SEQ ID NO: 6943880 - DNA, 22 bp, Homo sapiens
actggagtccagacccaagagg

SEQ ID NO: 6943881 - DNA, 22 bp, Homo sapiens
tctatgtctccaccttcgcaga

SEQ ID NO: 6943882 - DNA, 22 bp, Homo sapiens
cacaggcttttttggctgatgt

SEQ ID NO: 6943883 - DNA, 22 bp, Homo sapiens
cttttgattgagcagtttcaaa

SEQ ID NO: 6943884 - DNA, 22 bp, Homo sapiens
tgaccgttttggcacccatgct

SEQ ID NO: 6943885 - DNA, 22 bp, Homo sapiens
agccttcagcagttcaggtgcc

SEQ ID NO: 6943886 - DNA, 22 bp, Homo sapiens
atgcaactacttctgcaccaat

SEQ ID NO: 6943887 - DNA, 23 bp, Homo sapiens
aaatgtgagggaaaatctttctg

SEQ ID NO: 6943888 - DNA, 22 bp, Homo sapiens
ctggctctgggcctcagacact

SEQ ID NO: 6943889 - DNA, 22 bp, Homo sapiens
aaatgtattgcataggatattt

SEQ ID NO: 6943890 - DNA, 21 bp, Homo sapiens
gttctggaggctgcaagtcca

SEQ ID NO: 6943891 - DNA, 22 bp, Homo sapiens
gcgaggtatgtggatggtgcca

SEQ ID NO: 6943892 - DNA, 22 bp, Homo sapiens
tgtgttatctatctcgatgctt

SEQ ID NO: 6943893 - DNA, 22 bp, Homo sapiens
ggcctgctgctatgacttcctg

SEQ ID NO: 6943894 - DNA, 22 bp, Homo sapiens
tgggccagttctttactcgtcc

SEQ ID NO: 6943895 - DNA, 22 bp, Homo sapiens
agaatcaattagattctatgag

SEQ ID NO: 6943896 - DNA, 22 bp, Homo sapiens
cggccttggtcggcccacagct

SEQ ID NO: 6943897 - DNA, 22 bp, Homo sapiens
ttgagggacagaggtgctgtct

SEQ ID NO: 6943898 - DNA, 22 bp, Homo sapiens
gaaaggtgccccataggcagga

SEQ ID NO: 6943899 - DNA, 22 bp, Homo sapiens
tttacatagtgctttcccacta

SEQ ID NO: 6943900 - DNA, 22 bp, Homo sapiens
tatgaccttaggaagcaagaag

SEQ ID NO: 6943901 - DNA, 22 bp, Homo sapiens
ccaggagctatgtacacactat

SEQ ID NO: 6943902 - DNA, 22 bp, Homo sapiens
cctgggcaacatagggagaccc

SEQ ID NO: 6943903 - DNA, 22 bp, Homo sapiens
cattcaagagtggacataatgc

SEQ ID NO: 6943904 - DNA, 22 bp, Homo sapiens
ctcagggacagtatcatttagg

SEQ ID NO: 6943905 - DNA, 17 bp, Homo sapiens
agatgctggccacatgt

SEQ ID NO: 6943906 - DNA, 22 bp, Homo sapiens
agaggccagatcatcatagatg

SEQ ID NO: 6943907 - DNA, 22 bp, Homo sapiens
cctatgtctgtatcccccgttt

SEQ ID NO: 6943908 - DNA, 22 bp, Homo sapiens
cgaggctagaggcaggctcggc

SEQ ID NO: 6943909 - DNA, 22 bp, Homo sapiens
aagatggcatctcctatagatg

SEQ ID NO: 6943910 - DNA, 22 bp, Homo sapiens
ctgatattattgaagctggagt

SEQ ID NO: 6943911 - DNA, 22 bp, Homo sapiens
catctttgggctgcatggaagg

SEQ ID NO: 6943912 - DNA, 22 bp, Homo sapiens
ccatgagccaggctgaggaagc

SEQ ID NO: 6943913 - DNA, 22 bp, Homo sapiens
gggcatttaaacaagcatacaa

SEQ ID NO: 6943914 - DNA, 22 bp, Homo sapiens
ggcagtggcatgtgggtagtgg

SEQ ID NO: 6943915 - DNA, 22 bp, Homo sapiens
gtgaagagctgttgcagagatt

SEQ ID NO: 6943916 - DNA, 22 bp, Homo sapiens
tccaggccaatgtagcaggccc

SEQ ID NO: 6943917 - DNA, 22 bp, Homo sapiens
ccagagctgcaggtaaaatgct

SEQ ID NO: 6943918 - DNA, 22 bp, Homo sapiens
gtggcagctggtatgcagacag

SEQ ID NO: 6943919 - DNA, 22 bp, Homo sapiens
tttctgcagtctctcagaagcc

SEQ ID NO: 6943920 - DNA, 22 bp, Homo sapiens
tggtggctgttgcagaactgag

SEQ ID NO: 6943921 - DNA, 22 bp, Homo sapiens
tctgattacttgagttatttag

SEQ ID NO: 6943922 - DNA, 22 bp, Homo sapiens
actcagacagaccaaagttctg

SEQ ID NO: 6943923 - DNA, 22 bp, Homo sapiens
tccagggaagagcagaggctac

SEQ ID NO: 6943924 - DNA, 22 bp, Homo sapiens
tctgtcactattggccagaaca

SEQ ID NO: 6943925 - DNA, 22 bp, Homo sapiens
agcccatgcaacaggcctagcg

SEQ ID NO: 6943926 - DNA, 22 bp, Homo sapiens
tgccttgctctgtaaaatctct

SEQ ID NO: 6943927 - DNA, 23 bp, Homo sapiens
ttgtgtctacttcctatctaggg

SEQ ID NO: 6943928 - DNA, 20 bp, Homo sapiens
ttatgcaggtcatctcaact

SEQ ID NO: 6943929 - DNA, 20 bp, Homo sapiens
tgtaaacaatagtgttcttg

SEQ ID NO: 6943930 - DNA, 22 bp, Homo sapiens
agagaattttaaaagccttgaa

SEQ ID NO: 6943931 - DNA, 22 bp, Homo sapiens
caggtctgaagagtcacatgcc

SEQ ID NO: 6943932 - DNA, 22 bp, Homo sapiens
gagagggctctgtgtgggtact

SEQ ID NO: 6943933 - DNA, 22 bp, Homo sapiens
cctgggagccaagcctctgtgt

SEQ ID NO: 6943934 - DNA, 22 bp, Homo sapiens
agtgcagggcctgcccagcagg

SEQ ID NO: 6943935 - DNA, 22 bp, Homo sapiens
cctgcaccacaaggcttcagag

SEQ ID NO: 6943936 - DNA, 22 bp, Homo sapiens
agaggcttggaggtgcaaggtt

SEQ ID NO: 6943937 - DNA, 22 bp, Homo sapiens
tggcctggttatattgctatca

SEQ ID NO: 6943938 - DNA, 22 bp, Homo sapiens
gcagggtccatggaggcagccc

SEQ ID NO: 6943939 - DNA, 22 bp, Homo sapiens
gttctctgcgctcccggcccgg

SEQ ID NO: 6943940 - DNA, 22 bp, Homo sapiens
ttgagaaaacattgagggccat

SEQ ID NO: 6943941 - DNA, 22 bp, Homo sapiens
cactggctatgagggagatggg

SEQ ID NO: 6943942 - DNA, 22 bp, Homo sapiens
tgagacttaagaggtcatgttg

SEQ ID NO: 6943943 - DNA, 22 bp, Homo sapiens
ctgctttgaaaataaacttgtc

SEQ ID NO: 6943944 - DNA, 22 bp, Homo sapiens
gtttacagagacagaaagtagt

SEQ ID NO: 6943945 - DNA, 22 bp, Homo sapiens
ttgaaaacagcgtagattcaca

SEQ ID NO: 6943946 - DNA, 22 bp, Homo sapiens
ttggcagagggaccagcctaca

SEQ ID NO: 6943947 - DNA, 22 bp, Homo sapiens
gactgcctttttgagcaaaatg

SEQ ID NO: 6943948 - DNA, 21 bp, Homo sapiens
tttctcagttgtgtgagcagc

SEQ ID NO: 6943949 - DNA, 22 bp, Homo sapiens
atgcagtttatctccaaatcat

SEQ ID NO: 6943950 - DNA, 22 bp, Homo sapiens
cactagatgataatcagctgga

SEQ ID NO: 6943951 - DNA, 22 bp, Homo sapiens
ctgacagctgaagggtcccaga

SEQ ID NO: 6943952 - DNA, 22 bp, Homo sapiens
agctgctttgctgggcaggccc

SEQ ID NO: 6943953 - DNA, 22 bp, Homo sapiens
gaggagagaacattcctccata

SEQ ID NO: 6943954 - DNA, 22 bp, Homo sapiens
tccaggtatgacatggctgttt

SEQ ID NO: 6943955 - DNA, 22 bp, Homo sapiens
aaactaaggtgctgtggactga

SEQ ID NO: 6943956 - DNA, 22 bp, Homo sapiens
catcataataacccagacacag

SEQ ID NO: 6943957 - DNA, 21 bp, Homo sapiens
tggaaacttctagcttacgta

SEQ ID NO: 6943958 - DNA, 22 bp, Homo sapiens
ttgcatgcaaggcctccgtggc

SEQ ID NO: 6943959 - DNA, 22 bp, Homo sapiens
aggtcatttttgccttctattt

SEQ ID NO: 6943960 - DNA, 22 bp, Homo sapiens
caagttcacttgtctacaaggg

SEQ ID NO: 6943961 - DNA, 22 bp, Homo sapiens
cagctgaagagaggtgctgagt

SEQ ID NO: 6943962 - DNA, 22 bp, Homo sapiens
tctaagaattgaagtggctctt

SEQ ID NO: 6943963 - DNA, 21 bp, Homo sapiens
aaatttctgcaagcctcaact

SEQ ID NO: 6943964 - DNA, 22 bp, Homo sapiens
taacatgtttgtacactgaaac

SEQ ID NO: 6943965 - DNA, 22 bp, Homo sapiens
tgcacccacttagctgaagttc

SEQ ID NO: 6943966 - DNA, 22 bp, Homo sapiens
acaatcccacaagaaacactgg

SEQ ID NO: 6943967 - DNA, 22 bp, Homo sapiens
ctagcccactgcaaatgttggc

SEQ ID NO: 6943968 - DNA, 22 bp, Homo sapiens
tgtctactgctgacactaacag

SEQ ID NO: 6943969 - DNA, 22 bp, Homo sapiens
aaagtaacaaaactgtgtgcca

SEQ ID NO: 6943970 - DNA, 22 bp, Homo sapiens
tggggagcccactcacctcccc

SEQ ID NO: 6943971 - DNA, 22 bp, Homo sapiens
ataaaggcagattttggacctc

SEQ ID NO: 6943972 - DNA, 22 bp, Homo sapiens
atgcataatgtatgtattgact

SEQ ID NO: 6943973 - DNA, 22 bp, Homo sapiens
gttctatttcagtaagcaggca

SEQ ID NO: 6943974 - DNA, 22 bp, Homo sapiens
tagcaaatgtaaaatgcctaca

SEQ ID NO: 6943975 - DNA, 22 bp, Homo sapiens
aggttatcatcagttgagcact

SEQ ID NO: 6943976 - DNA, 22 bp, Homo sapiens
ttgatcttggactttccagcct

SEQ ID NO: 6943977 - DNA, 22 bp, Homo sapiens
cagggctcaccactgggatcct

SEQ ID NO: 6943978 - DNA, 22 bp, Homo sapiens
agctctggctaagctgataaat

SEQ ID NO: 6943979 - DNA, 22 bp, Homo sapiens
attgtgaataatgctgcaataa

SEQ ID NO: 6943980 - DNA, 22 bp, Homo sapiens
ctgggtctcaggagttctgagg

SEQ ID NO: 6943981 - DNA, 22 bp, Homo sapiens
tctctgagttgtaaaaaatagt

SEQ ID NO: 6943982 - DNA, 22 bp, Homo sapiens
ctgtcacctctgtggacccact

SEQ ID NO: 6943983 - DNA, 22 bp, Homo sapiens
tgtgcctggtccctgagtcgag

SEQ ID NO: 6943984 - DNA, 22 bp, Homo sapiens
atgtctttataaatgtataatg

SEQ ID NO: 6943985 - DNA, 22 bp, Homo sapiens
gcctggagagcactgtgcgctt

SEQ ID NO: 6943986 - DNA, 22 bp, Homo sapiens
ttccacaacaaccaagcatata

SEQ ID NO: 6943987 - DNA, 22 bp, Homo sapiens
tcatatgtatgatctctgtaca

SEQ ID NO: 6943988 - DNA, 22 bp, Homo sapiens
gtgtgtgtatctgcctatcaca

SEQ ID NO: 6943989 - DNA, 22 bp, Homo sapiens
aatgtgaccttctttggaaata

SEQ ID NO: 6943990 - DNA, 22 bp, Homo sapiens
aggtcattgttaagtcaccata

SEQ ID NO: 6943991 - DNA, 22 bp, Homo sapiens
attgacaatgtatttgtatctg

SEQ ID NO: 6943992 - DNA, 22 bp, Homo sapiens
tccagcagggaattagtagtct

SEQ ID NO: 6943993 - DNA, 22 bp, Homo sapiens
atttctacagtacacatgcatt

SEQ ID NO: 6943994 - DNA, 22 bp, Homo sapiens
tacagggtataggtacagatga

SEQ ID NO: 6943995 - DNA, 22 bp, Homo sapiens
ttacagtcctttgtattgttta

SEQ ID NO: 6943996 - DNA, 22 bp, Homo sapiens
tggcggggcagctctggcttct

SEQ ID NO: 6943997 - DNA, 22 bp, Homo sapiens
agacaatggagagcagagtact

SEQ ID NO: 6943998 - DNA, 22 bp, Homo sapiens
agacatgaaaattccaaacatc

SEQ ID NO: 6943999 - DNA, 22 bp, Homo sapiens
cgccaggcttggtagctcatgc

SEQ ID NO: 6944000 - DNA, 22 bp, Homo sapiens
agcaggaagtagtctgtaagca

SEQ ID NO: 6944001 - DNA, 22 bp, Homo sapiens
aaagttggctcttatgcttgtg

SEQ ID NO: 6944002 - DNA, 20 bp, Homo sapiens
ccagaaggtaggatggaaca

SEQ ID NO: 6944003 - DNA, 22 bp, Homo sapiens
gcagcatacagggagagtactc

SEQ ID NO: 6944004 - DNA, 22 bp, Homo sapiens
cagtgggatatgggggcagcat

SEQ ID NO: 6944005 - DNA, 22 bp, Homo sapiens
gctggcagaatttcttcttgct

SEQ ID NO: 6944006 - DNA, 22 bp, Homo sapiens
tcccaccccttgactctttaag

SEQ ID NO: 6944007 - DNA, 22 bp, Homo sapiens
ctgcacagtgttggaagctgcc

SEQ ID NO: 6944008 - DNA, 20 bp, Homo sapiens
attctaaagctctgctcttt

SEQ ID NO: 6944009 - DNA, 22 bp, Homo sapiens
attagttggggtggagaaggat

SEQ ID NO: 6944010 - DNA, 22 bp, Homo sapiens
gagaccccctgagttatggcct

SEQ ID NO: 6944011 - DNA, 22 bp, Homo sapiens
gctagccaagatgggtcacaaa

SEQ ID NO: 6944012 - DNA, 22 bp, Homo sapiens
atcatttagtggggcattggaa

SEQ ID NO: 6944013 - DNA, 22 bp, Homo sapiens
ggctttatgcacagcagatggt

SEQ ID NO: 6944014 - DNA, 22 bp, Homo sapiens
gatgtaaactgggacttcctag

SEQ ID NO: 6944015 - DNA, 20 bp, Homo sapiens
gctggtgggggcttgacatg

SEQ ID NO: 6944016 - DNA, 22 bp, Homo sapiens
caaagtaatttggagatatata

SEQ ID NO: 6944017 - DNA, 22 bp, Homo sapiens
ttcatgtttcatttgttactat

SEQ ID NO: 6944018 - DNA, 20 bp, Homo sapiens
cctgcctggccattccttgg

SEQ ID NO: 6944019 - DNA, 22 bp, Homo sapiens
cgcccagctgaaatctccaggc

SEQ ID NO: 6944020 - DNA, 22 bp, Homo sapiens
ttgctgagtgaccaataaatat

SEQ ID NO: 6944021 - DNA, 22 bp, Homo sapiens
atccaaagatggaaagaacttt

SEQ ID NO: 6944022 - DNA, 19 bp, Homo sapiens
tccagcctgctgtttctct

SEQ ID NO: 6944023 - DNA, 22 bp, Homo sapiens
tggtattacagcattccatatt

SEQ ID NO: 6944024 - DNA, 20 bp, Homo sapiens
tcatggaatctcactctagt

SEQ ID NO: 6944025 - DNA, 22 bp, Homo sapiens
ggacatttttcttcctacaatg

SEQ ID NO: 6944026 - DNA, 22 bp, Homo sapiens
tgaaggcttggattggtcattt

SEQ ID NO: 6944027 - DNA, 22 bp, Homo sapiens
gctggtgtttcccgcggctcca

SEQ ID NO: 6944028 - DNA, 22 bp, Homo sapiens
gtgggcagtgcctgacggatga

SEQ ID NO: 6944029 - DNA, 22 bp, Homo sapiens
aagagccctctgtgtttctgag

SEQ ID NO: 6944030 - DNA, 22 bp, Homo sapiens
gcatccatggagagcactctga

SEQ ID NO: 6944031 - DNA, 22 bp, Homo sapiens
ttttcagaattagcataccatt

SEQ ID NO: 6944032 - DNA, 22 bp, Homo sapiens
agtgtgacaaatctatggctca

SEQ ID NO: 6944033 - DNA, 22 bp, Homo sapiens
gaactggttacagagggatgtt

SEQ ID NO: 6944034 - DNA, 22 bp, Homo sapiens
gaaagagtatgggagctttact

SEQ ID NO: 6944035 - DNA, 22 bp, Homo sapiens
ttccttgttgaaaatgtctgca

SEQ ID NO: 6944036 - DNA, 22 bp, Homo sapiens
gttctgctgtgtctcagcaggt

SEQ ID NO: 6944037 - DNA, 22 bp, Homo sapiens
agggagaagagaacaaagccct

SEQ ID NO: 6944038 - DNA, 22 bp, Homo sapiens
ccagagcctcgcccggagcctc

SEQ ID NO: 6944039 - DNA, 22 bp, Homo sapiens
aagcagctgcaggttcaaagga

SEQ ID NO: 6944040 - DNA, 18 bp, Homo sapiens
agtgtttatttaggtgaa

SEQ ID NO: 6944041 - DNA, 22 bp, Homo sapiens
tccaaaggcaaaactgtggtgt

SEQ ID NO: 6944042 - DNA, 21 bp, Homo sapiens
ctcttgtctttgctcagtagc

SEQ ID NO: 6944043 - DNA, 22 bp, Homo sapiens
ttctgtaggacttctgccaact

SEQ ID NO: 6944044 - DNA, 22 bp, Homo sapiens
accaggagttttgaccaggggc

SEQ ID NO: 6944045 - DNA, 22 bp, Homo sapiens
tccttgaatgaagagaggtgac

SEQ ID NO: 6944046 - DNA, 18 bp, Homo sapiens
tcagggaatcttggcctt

SEQ ID NO: 6944047 - DNA, 22 bp, Homo sapiens
tgcagcgaaacatgagtttaat

SEQ ID NO: 6944048 - DNA, 22 bp, Homo sapiens
tgtccattgcttatttctactt

SEQ ID NO: 6944049 - DNA, 22 bp, Homo sapiens
atgagttcatactttcagtacc

SEQ ID NO: 6944050 - DNA, 20 bp, Homo sapiens
gggctctgcttggcagaagt

SEQ ID NO: 6944051 - DNA, 22 bp, Homo sapiens
gatgacaaaacttttgccagca

SEQ ID NO: 6944052 - DNA, 22 bp, Homo sapiens
tatagcaaggacataatatgct

SEQ ID NO: 6944053 - DNA, 22 bp, Homo sapiens
gttcacaaatatgcacttacga

SEQ ID NO: 6944054 - DNA, 20 bp, Homo sapiens
tcacatctggcagctgatga

SEQ ID NO: 6944055 - DNA, 22 bp, Homo sapiens
ttgtcctgagataaggaacaga

SEQ ID NO: 6944056 - DNA, 22 bp, Homo sapiens
ctgcagtgaaatcaggaagcaa

SEQ ID NO: 6944057 - DNA, 22 bp, Homo sapiens
attccaaacgcctcgcggactt

SEQ ID NO: 6944058 - DNA, 22 bp, Homo sapiens
aatggcaagagccacagaggcg

SEQ ID NO: 6944059 - DNA, 22 bp, Homo sapiens
acatagaacctggcacatagta

SEQ ID NO: 6944060 - DNA, 22 bp, Homo sapiens
agcagcagccgtagccttatta

SEQ ID NO: 6944061 - DNA, 16 bp, Homo sapiens
ccttggactggactgg

SEQ ID NO: 6944062 - DNA, 22 bp, Homo sapiens
acaggccagcctggggtaaggt

SEQ ID NO: 6944063 - DNA, 22 bp, Homo sapiens
atggctcttgaattgatactct

SEQ ID NO: 6944064 - DNA, 22 bp, Homo sapiens
aaatatgtaagattagcactag

SEQ ID NO: 6944065 - DNA, 22 bp, Homo sapiens
taaggacattagaaatgatgct

SEQ ID NO: 6944066 - DNA, 22 bp, Homo sapiens
cagtaatagatttgagagtggt

SEQ ID NO: 6944067 - DNA, 22 bp, Homo sapiens
ggaaacagagggcacctgagcc

SEQ ID NO: 6944068 - DNA, 22 bp, Homo sapiens
tttgtattacaaagtcacagta

SEQ ID NO: 6944069 - DNA, 22 bp, Homo sapiens
actttgttcctttcacaaagaa

SEQ ID NO: 6944070 - DNA, 20 bp, Homo sapiens
actttatgagttcaattttg

SEQ ID NO: 6944071 - DNA, 22 bp, Homo sapiens
tgccctgtctaagctgtcagta

SEQ ID NO: 6944072 - DNA, 22 bp, Homo sapiens
ctttcacagctgtgcttatgat

SEQ ID NO: 6944073 - DNA, 22 bp, Homo sapiens
tcagacatatcaataggcactt

SEQ ID NO: 6944074 - DNA, 22 bp, Homo sapiens
catcccattggctaaggcaaat

SEQ ID NO: 6944075 - DNA, 22 bp, Homo sapiens
acgggtggtaatgagaaaagga

SEQ ID NO: 6944076 - DNA, 23 bp, Homo sapiens
gccagctttggtctgtctcctag

SEQ ID NO: 6944077 - DNA, 22 bp, Homo sapiens
ctcacccctgtaattccagcac

SEQ ID NO: 6944078 - DNA, 22 bp, Homo sapiens
gtaacagtttgggttccaattg

SEQ ID NO: 6944079 - DNA, 22 bp, Homo sapiens
ttctacacacctctgaggacat

SEQ ID NO: 6944080 - DNA, 22 bp, Homo sapiens
ttattcagttcccttcactctc

SEQ ID NO: 6944081 - DNA, 22 bp, Homo sapiens
ccatttggaggtcattaggaca

SEQ ID NO: 6944082 - DNA, 22 bp, Homo sapiens
tgccaagaccacaattgctttt

SEQ ID NO: 6944083 - DNA, 22 bp, Homo sapiens
cagccctcctttcactcccagg

SEQ ID NO: 6944084 - DNA, 22 bp, Homo sapiens
agccttcataatcttgggcttt

SEQ ID NO: 6944085 - DNA, 22 bp, Homo sapiens
aagacctgagtatagatccctg

SEQ ID NO: 6944086 - DNA, 22 bp, Homo sapiens
ttcttttaattgtgggggagtg

SEQ ID NO: 6944087 - DNA, 22 bp, Homo sapiens
tgtggagctcagaagtagcagt

SEQ ID NO: 6944088 - DNA, 21 bp, Homo sapiens
tgatcctaggcagtgtgattc

SEQ ID NO: 6944089 - DNA, 22 bp, Homo sapiens
gcagctcacacagcaagttttg

SEQ ID NO: 6944090 - DNA, 22 bp, Homo sapiens
ctggagggaggaggctgctatt

SEQ ID NO: 6944091 - DNA, 22 bp, Homo sapiens
tattgggaaaagggcgatggct

SEQ ID NO: 6944092 - DNA, 22 bp, Homo sapiens
gcccatccctgaaccaactggg

SEQ ID NO: 6944093 - DNA, 22 bp, Homo sapiens
cccaggctgatgggatgggcca

SEQ ID NO: 6944094 - DNA, 22 bp, Homo sapiens
gctctgccccaggaactcagcc

SEQ ID NO: 6944095 - DNA, 22 bp, Homo sapiens
agaagcttgaaggagcagtgac

SEQ ID NO: 6944096 - DNA, 22 bp, Homo sapiens
catctgttgagttctccgtgct

SEQ ID NO: 6944097 - DNA, 22 bp, Homo sapiens
ctatttgaattgtcacaggcta

SEQ ID NO: 6944098 - DNA, 22 bp, Homo sapiens
taacttgaacatggagagtaag

SEQ ID NO: 6944099 - DNA, 22 bp, Homo sapiens
ggctcagacctcccagctccag

SEQ ID NO: 6944100 - DNA, 22 bp, Homo sapiens
gaaacaatttttgttgtctaag

SEQ ID NO: 6944101 - DNA, 22 bp, Homo sapiens
tgtacaatgtggccagtgttaa

SEQ ID NO: 6944102 - DNA, 22 bp, Homo sapiens
ttataggaaatagttcatgcga

SEQ ID NO: 6944103 - DNA, 22 bp, Homo sapiens
tatctgttagctaatgaatgag

SEQ ID NO: 6944104 - DNA, 22 bp, Homo sapiens
gggggtttctgggctgagcaga

SEQ ID NO: 6944105 - DNA, 22 bp, Homo sapiens
tgcgatgcaacagcttggcgga

SEQ ID NO: 6944106 - DNA, 22 bp, Homo sapiens
atgcctccaagattcttacgtt

SEQ ID NO: 6944107 - DNA, 22 bp, Homo sapiens
tcctctggaacctcacccttgc

SEQ ID NO: 6944108 - DNA, 22 bp, Homo sapiens
atgtatgtatgtacttttgtat

SEQ ID NO: 6944109 - DNA, 21 bp, Homo sapiens
attggaaaaggtagttggctt

SEQ ID NO: 6944110 - DNA, 22 bp, Homo sapiens
gtacaaattaggaagctttgtg

SEQ ID NO: 6944111 - DNA, 22 bp, Homo sapiens
tagctgaattgtgggagaccta

SEQ ID NO: 6944112 - DNA, 22 bp, Homo sapiens
ctaggttaaagcggttttatgt

SEQ ID NO: 6944113 - DNA, 22 bp, Homo sapiens
aatgatggtcatggcaactttt

SEQ ID NO: 6944114 - DNA, 22 bp, Homo sapiens
ttgaagagacaatttggaaagc

SEQ ID NO: 6944115 - DNA, 22 bp, Homo sapiens
ctgaccagccctgcccagggaa

SEQ ID NO: 6944116 - DNA, 22 bp, Homo sapiens
tcactcagtttttggcctctgc

SEQ ID NO: 6944117 - DNA, 22 bp, Homo sapiens
agcagcagaaagttgatggcag

SEQ ID NO: 6944118 - DNA, 22 bp, Homo sapiens
ctggtccattctctccctgaag

SEQ ID NO: 6944119 - DNA, 22 bp, Homo sapiens
tcatttgtgctgtcagcatgca

SEQ ID NO: 6944120 - DNA, 22 bp, Homo sapiens
ggaagtatttgtttttgcatcc

SEQ ID NO: 6944121 - DNA, 22 bp, Homo sapiens
gtaattctagagtttggacagc

SEQ ID NO: 6944122 - DNA, 18 bp, Homo sapiens
tgttatgagactctagga

SEQ ID NO: 6944123 - DNA, 22 bp, Homo sapiens
tcctgggcacaagtgagtctcc

SEQ ID NO: 6944124 - DNA, 22 bp, Homo sapiens
ataatggtgaacaaaatgactc

SEQ ID NO: 6944125 - DNA, 22 bp, Homo sapiens
tctgtgcaagtatttgacattt

SEQ ID NO: 6944126 - DNA, 22 bp, Homo sapiens
ttgagcatcaattaagtgagtt

SEQ ID NO: 6944127 - DNA, 22 bp, Homo sapiens
ttgattttgcctgatctgagag

SEQ ID NO: 6944128 - DNA, 20 bp, Homo sapiens
ctgggctcaagtgatcctcc

SEQ ID NO: 6944129 - DNA, 22 bp, Homo sapiens
atgcttaatacactgttaaagg

SEQ ID NO: 6944130 - DNA, 22 bp, Homo sapiens
aggacctgtagggcctgcatcc

SEQ ID NO: 6944131 - DNA, 22 bp, Homo sapiens
gagagctgtcagcgtagcaccg

SEQ ID NO: 6944132 - DNA, 22 bp, Homo sapiens
caggttctgaggatggtgcctg

SEQ ID NO: 6944133 - DNA, 22 bp, Homo sapiens
caggtgtttaggtttcatggat

SEQ ID NO: 6944134 - DNA, 22 bp, Homo sapiens
atgtctgttttcatatcagata

SEQ ID NO: 6944135 - DNA, 19 bp, Homo sapiens
ccatggagagagatgcatt

SEQ ID NO: 6944136 - DNA, 22 bp, Homo sapiens
gcttctgagttcttgcttaata

SEQ ID NO: 6944137 - DNA, 22 bp, Homo sapiens
gagtccaccacagctcaaagag

SEQ ID NO: 6944138 - DNA, 22 bp, Homo sapiens
tatttcaggctatatttcttgt

SEQ ID NO: 6944139 - DNA, 22 bp, Homo sapiens
caagacttcaccgctctgtgct

SEQ ID NO: 6944140 - DNA, 22 bp, Homo sapiens
atcctgggcctcagaggtgtgt

SEQ ID NO: 6944141 - DNA, 22 bp, Homo sapiens
ttttgcgataaagtgtgtgtct

SEQ ID NO: 6944142 - DNA, 22 bp, Homo sapiens
tcaaataccagcaatttcatgt

SEQ ID NO: 6944143 - DNA, 20 bp, Homo sapiens
tgctgggcatgcagtggaaa

SEQ ID NO: 6944144 - DNA, 22 bp, Homo sapiens
gctgagtgaggtccagagcttg

SEQ ID NO: 6944145 - DNA, 22 bp, Homo sapiens
aacctttcaattatcctcatct

SEQ ID NO: 6944146 - DNA, 22 bp, Homo sapiens
gtcctctagggtgtccagttga

SEQ ID NO: 6944147 - DNA, 22 bp, Homo sapiens
ttatagaatgtttccaatgcct

SEQ ID NO: 6944148 - DNA, 22 bp, Homo sapiens
ataaatctcttaagactcaaca

SEQ ID NO: 6944149 - DNA, 22 bp, Homo sapiens
gctggtccagggcctctgtggg

SEQ ID NO: 6944150 - DNA, 22 bp, Homo sapiens
ctggcacacagaggccctcggg

SEQ ID NO: 6944151 - DNA, 22 bp, Homo sapiens
tcattttgcagagctgaggaac

SEQ ID NO: 6944152 - DNA, 22 bp, Homo sapiens
tgctgcaggccttggctgggaa

SEQ ID NO: 6944153 - DNA, 21 bp, Homo sapiens
gcagccactgccttcaacaat

SEQ ID NO: 6944154 - DNA, 18 bp, Homo sapiens
tcttccagcttctggagg

SEQ ID NO: 6944155 - DNA, 22 bp, Homo sapiens
cagaatgagtagcatcttcacc

SEQ ID NO: 6944156 - DNA, 22 bp, Homo sapiens
aggaatatgagctgctgcagtg

SEQ ID NO: 6944157 - DNA, 22 bp, Homo sapiens
ccagctgctgacatgggcaggt

SEQ ID NO: 6944158 - DNA, 22 bp, Homo sapiens
tattgaggatctcctgctaatt

SEQ ID NO: 6944159 - DNA, 22 bp, Homo sapiens
tctgccacttgaggtcattggc

SEQ ID NO: 6944160 - DNA, 22 bp, Homo sapiens
caggtctgtgtgccatttccaa

SEQ ID NO: 6944161 - DNA, 22 bp, Homo sapiens
tattgtccatggctgctttggt

SEQ ID NO: 6944162 - DNA, 19 bp, Homo sapiens
cagctgcaccgtgaccatc

SEQ ID NO: 6944163 - DNA, 20 bp, Homo sapiens
agcaggccttggggagagga

SEQ ID NO: 6944164 - DNA, 22 bp, Homo sapiens
agctttattaactctccaggtg

SEQ ID NO: 6944165 - DNA, 20 bp, Homo sapiens
agtggggagtcaggagtgcc

SEQ ID NO: 6944166 - DNA, 22 bp, Homo sapiens
caagggccctgtctatgtatcc

SEQ ID NO: 6944167 - DNA, 22 bp, Homo sapiens
gacaggcttcatgatggcagga

SEQ ID NO: 6944168 - DNA, 22 bp, Homo sapiens
tgtagaggaaagatgaaggccg

SEQ ID NO: 6944169 - DNA, 20 bp, Homo sapiens
catctcctgcctccatgttc

SEQ ID NO: 6944170 - DNA, 22 bp, Homo sapiens
agcagggcagcttttttcagaa

SEQ ID NO: 6944171 - DNA, 22 bp, Homo sapiens
tgtctcctactgcctgtggatc

SEQ ID NO: 6944172 - DNA, 22 bp, Homo sapiens
ggcactgagaacaggctgactt

SEQ ID NO: 6944173 - DNA, 22 bp, Homo sapiens
ggagccagattgtataaaaaag

SEQ ID NO: 6944174 - DNA, 22 bp, Homo sapiens
taatttacttgcaaataacaat

SEQ ID NO: 6944175 - DNA, 22 bp, Homo sapiens
ctgttcctgtagagtccaagtc

SEQ ID NO: 6944176 - DNA, 22 bp, Homo sapiens
ctattctgcttgaaattattct

SEQ ID NO: 6944177 - DNA, 22 bp, Homo sapiens
ctgcagattggcctgatgttca

SEQ ID NO: 6944178 - DNA, 22 bp, Homo sapiens
atggtatacaattatggactgt

SEQ ID NO: 6944179 - DNA, 22 bp, Homo sapiens
tattgcaggttccaaccgggaa

SEQ ID NO: 6944180 - DNA, 22 bp, Homo sapiens
gccaccagccccatgcgctgtg

SEQ ID NO: 6944181 - DNA, 21 bp, Homo sapiens
aaatacagaaacttgttttca

SEQ ID NO: 6944182 - DNA, 22 bp, Homo sapiens
cagaggccaggctgcctgactg

SEQ ID NO: 6944183 - DNA, 22 bp, Homo sapiens
tgtccttataagaaaaggaaat

SEQ ID NO: 6944184 - DNA, 22 bp, Homo sapiens
agtgaagcctgctgaaagtggc

SEQ ID NO: 6944185 - DNA, 23 bp, Homo sapiens
gggaagtggggatttgaagtcat

SEQ ID NO: 6944186 - DNA, 22 bp, Homo sapiens
ttagtgatgactagacttttgt

SEQ ID NO: 6944187 - DNA, 22 bp, Homo sapiens
agcacattaagtgagttcatgt

SEQ ID NO: 6944188 - DNA, 21 bp, Homo sapiens
atcagcaaatgcctgtctccc

SEQ ID NO: 6944189 - DNA, 22 bp, Homo sapiens
aatctcagaaactggtggattt

SEQ ID NO: 6944190 - DNA, 22 bp, Homo sapiens
cagagcagaaggtccaagcctg

SEQ ID NO: 6944191 - DNA, 22 bp, Homo sapiens
cctgtattaggtagacaactat

SEQ ID NO: 6944192 - DNA, 22 bp, Homo sapiens
cactgttgaagatacttcctct

SEQ ID NO: 6944193 - DNA, 22 bp, Homo sapiens
actcaggaaaaatgtagtgata

SEQ ID NO: 6944194 - DNA, 22 bp, Homo sapiens
ccagctttcctgcgagttgatt

SEQ ID NO: 6944195 - DNA, 22 bp, Homo sapiens
acccgggaggcaggagtcatag

SEQ ID NO: 6944196 - DNA, 22 bp, Homo sapiens
cagtgatgaatgaaccacaggt

SEQ ID NO: 6944197 - DNA, 22 bp, Homo sapiens
ctagtattaagtgtgagtaaaa

SEQ ID NO: 6944198 - DNA, 22 bp, Homo sapiens
aggtggcagactaacagaagga

SEQ ID NO: 6944199 - DNA, 22 bp, Homo sapiens
ttgctcacttggaactaggcat

SEQ ID NO: 6944200 - DNA, 22 bp, Homo sapiens
gagctctgtccacacttggaga

SEQ ID NO: 6944201 - DNA, 22 bp, Homo sapiens
cctgcccagggtcaccacagag

SEQ ID NO: 6944202 - DNA, 19 bp, Homo sapiens
gagttctctgcatcagtga

SEQ ID NO: 6944203 - DNA, 22 bp, Homo sapiens
cctgttgtggaaaaagcctgat

SEQ ID NO: 6944204 - DNA, 22 bp, Homo sapiens
ttacctgtgtcagtatatgaga

SEQ ID NO: 6944205 - DNA, 22 bp, Homo sapiens
tgcacagatctggtggcaagga

SEQ ID NO: 6944206 - DNA, 22 bp, Homo sapiens
atgtattgtctcttttccttaa

SEQ ID NO: 6944207 - DNA, 22 bp, Homo sapiens
ggcacacagcttggcaggagat

SEQ ID NO: 6944208 - DNA, 22 bp, Homo sapiens
atacacatgtgtatgtgcatgc

SEQ ID NO: 6944209 - DNA, 22 bp, Homo sapiens
ctccccaactcagccgaggctt

SEQ ID NO: 6944210 - DNA, 22 bp, Homo sapiens
atgaaaacagcctcctgtgata

SEQ ID NO: 6944211 - DNA, 22 bp, Homo sapiens
ttcacagactgcagactttttg

SEQ ID NO: 6944212 - DNA, 22 bp, Homo sapiens
tgtgctctacctcagtgtcatt

SEQ ID NO: 6944213 - DNA, 22 bp, Homo sapiens
gtacacaaataataaagttaca

SEQ ID NO: 6944214 - DNA, 22 bp, Homo sapiens
gtaaagtctggctgaaacatgc

SEQ ID NO: 6944215 - DNA, 22 bp, Homo sapiens
tcccacagtgaagttcatgata

SEQ ID NO: 6944216 - DNA, 22 bp, Homo sapiens
cttggggacacagagcccaggg

SEQ ID NO: 6944217 - DNA, 22 bp, Homo sapiens
tattcagtgacagggtattatg

SEQ ID NO: 6944218 - DNA, 22 bp, Homo sapiens
taagcagatgctgtctgcacaa

SEQ ID NO: 6944219 - DNA, 22 bp, Homo sapiens
tcagtgtgcacatggtagcagt

SEQ ID NO: 6944220 - DNA, 22 bp, Homo sapiens
attctgtatttctaataagatc

SEQ ID NO: 6944221 - DNA, 21 bp, Homo sapiens
ttctgctgttcaccaccaccc

SEQ ID NO: 6944222 - DNA, 22 bp, Homo sapiens
tggacactgtctccaggataaa

SEQ ID NO: 6944223 - DNA, 22 bp, Homo sapiens
acctgcagtggccactcctaat

SEQ ID NO: 6944224 - DNA, 22 bp, Homo sapiens
tgaggtatgagtgtgccaggtg

SEQ ID NO: 6944225 - DNA, 22 bp, Homo sapiens
tccaagatctacagcagtttag

SEQ ID NO: 6944226 - DNA, 22 bp, Homo sapiens
ggaagatgagaagtggggctcc

SEQ ID NO: 6944227 - DNA, 22 bp, Homo sapiens
attacaaaagaagggagaaggt

SEQ ID NO: 6944228 - DNA, 22 bp, Homo sapiens
aaacaatgacaacacagctgcg

SEQ ID NO: 6944229 - DNA, 20 bp, Homo sapiens
cacaggccttgtgagcagac

SEQ ID NO: 6944230 - DNA, 22 bp, Homo sapiens
tgcaccatgtaagtggccacgt

SEQ ID NO: 6944231 - DNA, 22 bp, Homo sapiens
cctggcctcagacagagggtgg

SEQ ID NO: 6944232 - DNA, 22 bp, Homo sapiens
acagtgcttagcacagagtaga

SEQ ID NO: 6944233 - DNA, 22 bp, Homo sapiens
tgactgtgcctgttgaatgaat

SEQ ID NO: 6944234 - DNA, 19 bp, Homo sapiens
ccacagagcatgctgaggc

SEQ ID NO: 6944235 - DNA, 22 bp, Homo sapiens
tggtccatgcccacggaatgtg

SEQ ID NO: 6944236 - DNA, 22 bp, Homo sapiens
ggctccttcaaagcacctggct

SEQ ID NO: 6944237 - DNA, 22 bp, Homo sapiens
agcatatacaaactcatataca

SEQ ID NO: 6944238 - DNA, 22 bp, Homo sapiens
tgtaccactctactaagggttc

SEQ ID NO: 6944239 - DNA, 22 bp, Homo sapiens
taggtacacagtaagtgctcaa

SEQ ID NO: 6944240 - DNA, 22 bp, Homo sapiens
gttcacatcccagaaagagcat

SEQ ID NO: 6944241 - DNA, 22 bp, Homo sapiens
aaaactcctgaaattgtttccc

SEQ ID NO: 6944242 - DNA, 22 bp, Homo sapiens
ttgatgatgtttctgccttgcc

SEQ ID NO: 6944243 - DNA, 22 bp, Homo sapiens
aggcactgtgcttcttatatgt

SEQ ID NO: 6944244 - DNA, 22 bp, Homo sapiens
ccagggcctcgtgttctgagtg

SEQ ID NO: 6944245 - DNA, 22 bp, Homo sapiens
tttggattccatgctctccggg

SEQ ID NO: 6944246 - DNA, 22 bp, Homo sapiens
ctgtgtccaatggccttagcag

SEQ ID NO: 6944247 - DNA, 22 bp, Homo sapiens
gcgccctccacccacagcggct

SEQ ID NO: 6944248 - DNA, 23 bp, Homo sapiens
caagtgcaccagatatacaggtc

SEQ ID NO: 6944249 - DNA, 22 bp, Homo sapiens
tctgctttatggctcagagact

SEQ ID NO: 6944250 - DNA, 22 bp, Homo sapiens
tcatggcacatgccctccaggg

SEQ ID NO: 6944251 - DNA, 18 bp, Homo sapiens
acagtgctgtcactgctt

SEQ ID NO: 6944252 - DNA, 22 bp, Homo sapiens
gaacttgtgcactgctggtgat

SEQ ID NO: 6944253 - DNA, 22 bp, Homo sapiens
tcagggctgcatacaggagata

SEQ ID NO: 6944254 - DNA, 22 bp, Homo sapiens
tagtacagttttggcacatgga

SEQ ID NO: 6944255 - DNA, 22 bp, Homo sapiens
tgttaagagaagctctctctga

SEQ ID NO: 6944256 - DNA, 20 bp, Homo sapiens
ctctaattgctttatgtgtg

SEQ ID NO: 6944257 - DNA, 22 bp, Homo sapiens
aatgtctgccagaactgatcat

SEQ ID NO: 6944258 - DNA, 22 bp, Homo sapiens
tcaagatgaaagatgtagccat

SEQ ID NO: 6944259 - DNA, 22 bp, Homo sapiens
catgcttacctgccaaagcact

SEQ ID NO: 6944260 - DNA, 22 bp, Homo sapiens
tttggagaatgttttggtcaga

SEQ ID NO: 6944261 - DNA, 21 bp, Homo sapiens
agaaactgactcctagaggca

SEQ ID NO: 6944262 - DNA, 22 bp, Homo sapiens
acagtgaaaattctattgattt

SEQ ID NO: 6944263 - DNA, 22 bp, Homo sapiens
attggtggtgaggacatgccag

SEQ ID NO: 6944264 - DNA, 22 bp, Homo sapiens
gttacaaaggtcataaaagtgt

SEQ ID NO: 6944265 - DNA, 22 bp, Homo sapiens
ggcgagcagagccattgcctat

SEQ ID NO: 6944266 - DNA, 22 bp, Homo sapiens
catacaagcgttcaatagatgt

SEQ ID NO: 6944267 - DNA, 22 bp, Homo sapiens
attggagccccagaagcaaggt

SEQ ID NO: 6944268 - DNA, 20 bp, Homo sapiens
gggctccagctgtgattctt

SEQ ID NO: 6944269 - DNA, 22 bp, Homo sapiens
gtgcctgtaagttgtatgggct

SEQ ID NO: 6944270 - DNA, 22 bp, Homo sapiens
ggagtcaggatcctggggatgg

SEQ ID NO: 6944271 - DNA, 22 bp, Homo sapiens
tgtctcaggggcattgaaataa

SEQ ID NO: 6944272 - DNA, 22 bp, Homo sapiens
ccttggactcactgtctggctg

SEQ ID NO: 6944273 - DNA, 18 bp, Homo sapiens
gggtccccagctgcaggg

SEQ ID NO: 6944274 - DNA, 22 bp, Homo sapiens
tacttttcaagcagctggttat

SEQ ID NO: 6944275 - DNA, 22 bp, Homo sapiens
ttaggattaaaagttaatgcaa

SEQ ID NO: 6944276 - DNA, 22 bp, Homo sapiens
tgtagcacagagctttgacact

SEQ ID NO: 6944277 - DNA, 22 bp, Homo sapiens
acaaaggtgcgtcccttcagct

SEQ ID NO: 6944278 - DNA, 22 bp, Homo sapiens
tcttaaagcagcttgtaaaatg

SEQ ID NO: 6944279 - DNA, 22 bp, Homo sapiens
tagtgattcgatgtgggtaagt

SEQ ID NO: 6944280 - DNA, 22 bp, Homo sapiens
aggatgaggctggacacttctt

SEQ ID NO: 6944281 - DNA, 22 bp, Homo sapiens
aacagctgcaaaaggttgcctg

SEQ ID NO: 6944282 - DNA, 22 bp, Homo sapiens
ctgggctgatttagtcacgttt

SEQ ID NO: 6944283 - DNA, 22 bp, Homo sapiens
gaccctttctgcatgcttatct

SEQ ID NO: 6944284 - DNA, 22 bp, Homo sapiens
tgtacaatgccgagactaactc

SEQ ID NO: 6944285 - DNA, 22 bp, Homo sapiens
tcttctgttaccacagcgatga

SEQ ID NO: 6944286 - DNA, 22 bp, Homo sapiens
gcactgcctcatgctaataaat

SEQ ID NO: 6944287 - DNA, 23 bp, Homo sapiens
tttatattcctaatgtcttgagc

SEQ ID NO: 6944288 - DNA, 22 bp, Homo sapiens
tgcatttataaaatgttcgtgg

SEQ ID NO: 6944289 - DNA, 22 bp, Homo sapiens
agggacctgctcactgcctggc

SEQ ID NO: 6944290 - DNA, 20 bp, Homo sapiens
agtgccaaatgttgtttgtt

SEQ ID NO: 6944291 - DNA, 22 bp, Homo sapiens
ccagaggtggtcatagaaagca

SEQ ID NO: 6944292 - DNA, 22 bp, Homo sapiens
cagagagtggcagttactgaag

SEQ ID NO: 6944293 - DNA, 22 bp, Homo sapiens
ttgcctttgacggtgcagcagt

SEQ ID NO: 6944294 - DNA, 20 bp, Homo sapiens
gctgctttcaaatgacacgt

SEQ ID NO: 6944295 - DNA, 18 bp, Homo sapiens
ctggctttcttatccatc

SEQ ID NO: 6944296 - DNA, 22 bp, Homo sapiens
ttaggatttgaaaaggggcaga

SEQ ID NO: 6944297 - DNA, 17 bp, Homo sapiens
aggaagggcaagtttct

SEQ ID NO: 6944298 - DNA, 22 bp, Homo sapiens
ctgtttcatagagttgtgaatt

SEQ ID NO: 6944299 - DNA, 19 bp, Homo sapiens
agcagctcagggaggcacc

SEQ ID NO: 6944300 - DNA, 22 bp, Homo sapiens
tatttctgtttatttgtacatc

SEQ ID NO: 6944301 - DNA, 22 bp, Homo sapiens
gggaggagtgaagattcacctg

SEQ ID NO: 6944302 - DNA, 22 bp, Homo sapiens
tccccatgaggctgaattgggc

SEQ ID NO: 6944303 - DNA, 22 bp, Homo sapiens
atggtttactgatctttttggt

SEQ ID NO: 6944304 - DNA, 22 bp, Homo sapiens
agccccaggcccggacgcctct

SEQ ID NO: 6944305 - DNA, 22 bp, Homo sapiens
gttcaaattttctaggtgggtg

SEQ ID NO: 6944306 - DNA, 18 bp, Homo sapiens
ttccagtagctgtatcac

SEQ ID NO: 6944307 - DNA, 22 bp, Homo sapiens
aagccaggaagagagccttcac

SEQ ID NO: 6944308 - DNA, 22 bp, Homo sapiens
agtaatgtcccttaaatgtggt

SEQ ID NO: 6944309 - DNA, 22 bp, Homo sapiens
acagagaccagcatcttctgcc

SEQ ID NO: 6944310 - DNA, 22 bp, Homo sapiens
ctgtcccttcattattcactac

SEQ ID NO: 6944311 - DNA, 22 bp, Homo sapiens
cctaggcacccgagttatgttc

SEQ ID NO: 6944312 - DNA, 22 bp, Homo sapiens
tgccctctcaagttgagtcaga

SEQ ID NO: 6944313 - DNA, 22 bp, Homo sapiens
tttgtacacaacctgtggtagt

SEQ ID NO: 6944314 - DNA, 22 bp, Homo sapiens
tatgaatgatgcagcctggagt

SEQ ID NO: 6944315 - DNA, 20 bp, Homo sapiens
gtgctggagttaggaaaggt

SEQ ID NO: 6944316 - DNA, 22 bp, Homo sapiens
tgtctccaaaacaatctcagat

SEQ ID NO: 6944317 - DNA, 22 bp, Homo sapiens
taatggtgcttctgtgagataa

SEQ ID NO: 6944318 - DNA, 22 bp, Homo sapiens
tttcttatgagcaagactctat

SEQ ID NO: 6944319 - DNA, 22 bp, Homo sapiens
ctggtagagtgtttagggtcct

SEQ ID NO: 6944320 - DNA, 22 bp, Homo sapiens
taaaatggtaactttcatttgc

SEQ ID NO: 6944321 - DNA, 20 bp, Homo sapiens
atatgcttaatctcactaca

SEQ ID NO: 6944322 - DNA, 22 bp, Homo sapiens
tgtgtgtgcaggagagcaggtg

SEQ ID NO: 6944323 - DNA, 22 bp, Homo sapiens
agttcacattccgaggtactgg

SEQ ID NO: 6944324 - DNA, 22 bp, Homo sapiens
gggttggcagcaccagaggagg

SEQ ID NO: 6944325 - DNA, 22 bp, Homo sapiens
agagtttggtgaagcaatttga

SEQ ID NO: 6944326 - DNA, 22 bp, Homo sapiens
caggcttggcagggaggctggt

SEQ ID NO: 6944327 - DNA, 22 bp, Homo sapiens
actctgcaatgtggcaagaaca

SEQ ID NO: 6944328 - DNA, 22 bp, Homo sapiens
ttttcctgtccaggcaattatt

SEQ ID NO: 6944329 - DNA, 22 bp, Homo sapiens
ttgctttattcctagcccttgt

SEQ ID NO: 6944330 - DNA, 22 bp, Homo sapiens
catttgaatggcatttcacttt

SEQ ID NO: 6944331 - DNA, 22 bp, Homo sapiens
gtccatctagaatttatttcta

SEQ ID NO: 6944332 - DNA, 22 bp, Homo sapiens
gtggtgcaggccagcaggggcg

SEQ ID NO: 6944333 - DNA, 22 bp, Homo sapiens
atatgcatatgtcaaaacttat

SEQ ID NO: 6944334 - DNA, 22 bp, Homo sapiens
aactacagggggtggcaggcgg

SEQ ID NO: 6944335 - DNA, 22 bp, Homo sapiens
taaggaatatcataagaagtag

SEQ ID NO: 6944336 - DNA, 23 bp, Homo sapiens
tccttcaggctcttcccctggac

SEQ ID NO: 6944337 - DNA, 22 bp, Homo sapiens
ctgcaaaattgttctttgctcc

SEQ ID NO: 6944338 - DNA, 17 bp, Homo sapiens
gaagaaggaatctagaa

SEQ ID NO: 6944339 - DNA, 22 bp, Homo sapiens
aagtgctgtttctgatgaatgc

SEQ ID NO: 6944340 - DNA, 22 bp, Homo sapiens
ccctgctagaacctccaacatg

SEQ ID NO: 6944341 - DNA, 19 bp, Homo sapiens
tcctgcaggtggcttgcag

SEQ ID NO: 6944342 - DNA, 22 bp, Homo sapiens
tatcctgttttgcacaattata

SEQ ID NO: 6944343 - DNA, 22 bp, Homo sapiens
tgggaaatataatttagctgtg

SEQ ID NO: 6944344 - DNA, 22 bp, Homo sapiens
tgaccagtgatctactgggatt

SEQ ID NO: 6944345 - DNA, 22 bp, Homo sapiens
aaggtcttatctccaaatacag

SEQ ID NO: 6944346 - DNA, 22 bp, Homo sapiens
tgagcctgggtggtcgaggctg

SEQ ID NO: 6944347 - DNA, 22 bp, Homo sapiens
gaggcaggcactgttatcagca

SEQ ID NO: 6944348 - DNA, 22 bp, Homo sapiens
tccaggctggctcttcaaaatt

SEQ ID NO: 6944349 - DNA, 22 bp, Homo sapiens
attgacaattctatgcagagca

SEQ ID NO: 6944350 - DNA, 22 bp, Homo sapiens
taggaatgaaagtgttttgaaa

SEQ ID NO: 6944351 - DNA, 22 bp, Homo sapiens
gctgcacaggagaccccattta

SEQ ID NO: 6944352 - DNA, 18 bp, Homo sapiens
tgcagcctgtagtcttgt

SEQ ID NO: 6944353 - DNA, 22 bp, Homo sapiens
tggaggccagtgaaagtagatt

SEQ ID NO: 6944354 - DNA, 22 bp, Homo sapiens
taagaactttgtagcctgttct

SEQ ID NO: 6944355 - DNA, 22 bp, Homo sapiens
agctctgacattgattctcagc

SEQ ID NO: 6944356 - DNA, 22 bp, Homo sapiens
tgagcagttcgacttcttcccc

SEQ ID NO: 6944357 - DNA, 22 bp, Homo sapiens
ttcctcagtgatggattcaacg

SEQ ID NO: 6944358 - DNA, 22 bp, Homo sapiens
catttgcttcctgggtcttgaa

SEQ ID NO: 6944359 - DNA, 22 bp, Homo sapiens
ctaggcagggtgctgtgccatg

SEQ ID NO: 6944360 - DNA, 22 bp, Homo sapiens
tggaaacacccacgcatgcata

SEQ ID NO: 6944361 - DNA, 22 bp, Homo sapiens
atttggaacttataataagttt

SEQ ID NO: 6944362 - DNA, 22 bp, Homo sapiens
aaactgccacaagagggacatc

SEQ ID NO: 6944363 - DNA, 22 bp, Homo sapiens
aggagggtcatgttgaagtgta

SEQ ID NO: 6944364 - DNA, 22 bp, Homo sapiens
catcatcaaactggggggctgg

SEQ ID NO: 6944365 - DNA, 22 bp, Homo sapiens
tcctcatcaccattgcaatgta

SEQ ID NO: 6944366 - DNA, 22 bp, Homo sapiens
ctggctcccgtctggtggccat

SEQ ID NO: 6944367 - DNA, 22 bp, Homo sapiens
ttaagttgttatcaccatttat

SEQ ID NO: 6944368 - DNA, 20 bp, Homo sapiens
tgaaggccagcagcataggg

SEQ ID NO: 6944369 - DNA, 22 bp, Homo sapiens
ttcaggcaagatattaacttct

SEQ ID NO: 6944370 - DNA, 22 bp, Homo sapiens
tctgggagtgtgtctggccatc

SEQ ID NO: 6944371 - DNA, 22 bp, Homo sapiens
aaagtgttgggattacaggcat

SEQ ID NO: 6944372 - DNA, 22 bp, Homo sapiens
gaagaagtatttttgtcctgtt

SEQ ID NO: 6944373 - DNA, 22 bp, Homo sapiens
gcaaactgatttccaagtccgt

SEQ ID NO: 6944374 - DNA, 22 bp, Homo sapiens
ccaattctgtagagttgattaa

SEQ ID NO: 6944375 - DNA, 22 bp, Homo sapiens
aaaggcattggagaccctggct

SEQ ID NO: 6944376 - DNA, 22 bp, Homo sapiens
ccctctctcggttgctgtggtt

SEQ ID NO: 6944377 - DNA, 22 bp, Homo sapiens
tcactgaaccagggatctctag

SEQ ID NO: 6944378 - DNA, 22 bp, Homo sapiens
cactctgcagctgaagggctgg

SEQ ID NO: 6944379 - DNA, 22 bp, Homo sapiens
agaaggctaaagtaacttagta

SEQ ID NO: 6944380 - DNA, 22 bp, Homo sapiens
agcctcctgtagccctcaccca

SEQ ID NO: 6944381 - DNA, 22 bp, Homo sapiens
agagatctatttaatagtgtta

SEQ ID NO: 6944382 - DNA, 22 bp, Homo sapiens
tagagaggccgcgggtcccctc

SEQ ID NO: 6944383 - DNA, 22 bp, Homo sapiens
gtaatctgtagtaaagcaccat

SEQ ID NO: 6944384 - DNA, 22 bp, Homo sapiens
tcaagctattggctgaggctgc

SEQ ID NO: 6944385 - DNA, 22 bp, Homo sapiens
tcctgggcttaagtgatcctcc

SEQ ID NO: 6944386 - DNA, 22 bp, Homo sapiens
tctgcacacttttattgacctc

SEQ ID NO: 6944387 - DNA, 22 bp, Homo sapiens
attcagagattgttattcagac

SEQ ID NO: 6944388 - DNA, 22 bp, Homo sapiens
tgaaaaggagtccttgttttca

SEQ ID NO: 6944389 - DNA, 22 bp, Homo sapiens
ctgggaggcggaggttgcagtg

SEQ ID NO: 6944390 - DNA, 22 bp, Homo sapiens
caacaatttcccagtttcccat

SEQ ID NO: 6944391 - DNA, 19 bp, Homo sapiens
tccctgagttccagcccag

SEQ ID NO: 6944392 - DNA, 22 bp, Homo sapiens
gcattcatacatcaataagctt

SEQ ID NO: 6944393 - DNA, 22 bp, Homo sapiens
ataatgtttgattgagcagata

SEQ ID NO: 6944394 - DNA, 22 bp, Homo sapiens
cctgagcacacatcagaatcac

SEQ ID NO: 6944395 - DNA, 22 bp, Homo sapiens
ctccagctgctggtctgagact

SEQ ID NO: 6944396 - DNA, 22 bp, Homo sapiens
taggaacacagggacttgatga

SEQ ID NO: 6944397 - DNA, 21 bp, Homo sapiens
accattctgcacatgctgtca

SEQ ID NO: 6944398 - DNA, 22 bp, Homo sapiens
ttgtaattagtttttgatctgg

SEQ ID NO: 6944399 - DNA, 22 bp, Homo sapiens
atgactgaagggttttaaacag

SEQ ID NO: 6944400 - DNA, 22 bp, Homo sapiens
tcctcttgggaatacctttcta

SEQ ID NO: 6944401 - DNA, 22 bp, Homo sapiens
gtgcccagcagcagcgtccccg

SEQ ID NO: 6944402 - DNA, 22 bp, Homo sapiens
gtctgggcagcagcatttctta

SEQ ID NO: 6944403 - DNA, 22 bp, Homo sapiens
ggccagcagtcacagggtcaga

SEQ ID NO: 6944404 - DNA, 22 bp, Homo sapiens
catgcagtttctctatgcgtag

SEQ ID NO: 6944405 - DNA, 22 bp, Homo sapiens
atgtgcaggatccaggctccta

SEQ ID NO: 6944406 - DNA, 22 bp, Homo sapiens
tctgatctgtcagtcatgaagg

SEQ ID NO: 6944407 - DNA, 22 bp, Homo sapiens
taaacgattcctctggaggggc

SEQ ID NO: 6944408 - DNA, 22 bp, Homo sapiens
ctgtggaattgatgcttagtgt

SEQ ID NO: 6944409 - DNA, 22 bp, Homo sapiens
tgtctacttgggctctacagca

SEQ ID NO: 6944410 - DNA, 22 bp, Homo sapiens
actgaggttgtagtaggaattc

SEQ ID NO: 6944411 - DNA, 22 bp, Homo sapiens
ctgctgcctagtccaagacgtg

SEQ ID NO: 6944412 - DNA, 22 bp, Homo sapiens
acttgcctgttacatttctagt

SEQ ID NO: 6944413 - DNA, 23 bp, Homo sapiens
attttaaccttgactaacatgca

SEQ ID NO: 6944414 - DNA, 22 bp, Homo sapiens
gtggccagggcccacaggatga

SEQ ID NO: 6944415 - DNA, 22 bp, Homo sapiens
gtccagaagcagtgcacatcac

SEQ ID NO: 6944416 - DNA, 19 bp, Homo sapiens
aagtgggtagcacattcac

SEQ ID NO: 6944417 - DNA, 20 bp, Homo sapiens
ttgcaataaatgaaagacca

SEQ ID NO: 6944418 - DNA, 22 bp, Homo sapiens
tgtatttaattgtatcatcaca

SEQ ID NO: 6944419 - DNA, 22 bp, Homo sapiens
agctgctctgagccctgattct

SEQ ID NO: 6944420 - DNA, 22 bp, Homo sapiens
ctggtgagacggttgacaggag

SEQ ID NO: 6944421 - DNA, 22 bp, Homo sapiens
tgtaagatatgagtacatgtaa

SEQ ID NO: 6944422 - DNA, 22 bp, Homo sapiens
atttattggatgcttacttggg

SEQ ID NO: 6944423 - DNA, 21 bp, Homo sapiens
cgcagctgagaaatatacaga

SEQ ID NO: 6944424 - DNA, 22 bp, Homo sapiens
aaaatgatgctgtaatttggca

SEQ ID NO: 6944425 - DNA, 22 bp, Homo sapiens
tgtctacaagccttgttcggca

SEQ ID NO: 6944426 - DNA, 22 bp, Homo sapiens
tagattctctgctggctgacat

SEQ ID NO: 6944427 - DNA, 21 bp, Homo sapiens
agctatgtcccaccatgacac

SEQ ID NO: 6944428 - DNA, 18 bp, Homo sapiens
aattccaagccataggag

SEQ ID NO: 6944429 - DNA, 22 bp, Homo sapiens
ttaaggaaccacagcatgttag

SEQ ID NO: 6944430 - DNA, 22 bp, Homo sapiens
gtcctctgggagccttgagcct

SEQ ID NO: 6944431 - DNA, 22 bp, Homo sapiens
atctcccagccacagcattctt

SEQ ID NO: 6944432 - DNA, 22 bp, Homo sapiens
atgtccctgagggtctctctga

SEQ ID NO: 6944433 - DNA, 22 bp, Homo sapiens
gcaggcctcccctgctggagct

SEQ ID NO: 6944434 - DNA, 22 bp, Homo sapiens
caacagtcagaatgaagctgag

SEQ ID NO: 6944435 - DNA, 22 bp, Homo sapiens
ccttcattcagctatagcatcc

SEQ ID NO: 6944436 - DNA, 22 bp, Homo sapiens
ggcgctctggacctggctctcg

SEQ ID NO: 6944437 - DNA, 22 bp, Homo sapiens
aatcagtctcatttagcaggga

SEQ ID NO: 6944438 - DNA, 23 bp, Homo sapiens
tttcacatttactgttagatggc

SEQ ID NO: 6944439 - DNA, 23 bp, Homo sapiens
atgataatgccattaactttgat

SEQ ID NO: 6944440 - DNA, 19 bp, Homo sapiens
ctttccaggagatgctgag

SEQ ID NO: 6944441 - DNA, 19 bp, Homo sapiens
tggaggggtttgaatgtgg

SEQ ID NO: 6944442 - DNA, 22 bp, Homo sapiens
tctctatttgcctaggcttgtg

SEQ ID NO: 6944443 - DNA, 22 bp, Homo sapiens
caagagagatgcagctcactca

SEQ ID NO: 6944444 - DNA, 22 bp, Homo sapiens
gttcacaagagttacagacaga

SEQ ID NO: 6944445 - DNA, 22 bp, Homo sapiens
attgttgataatcgtgttgtca

SEQ ID NO: 6944446 - DNA, 22 bp, Homo sapiens
ttgcagtttgtggcaactttga

SEQ ID NO: 6944447 - DNA, 22 bp, Homo sapiens
tctcagagcatcattttcttag

SEQ ID NO: 6944448 - DNA, 22 bp, Homo sapiens
agagccctgaagcagagctaaa

SEQ ID NO: 6944449 - DNA, 22 bp, Homo sapiens
ggtcagggggatctgtgaggta

SEQ ID NO: 6944450 - DNA, 22 bp, Homo sapiens
atggcatcatctttcttcatta

SEQ ID NO: 6944451 - DNA, 22 bp, Homo sapiens
tcttaaatgactgataagagga

SEQ ID NO: 6944452 - DNA, 22 bp, Homo sapiens
caacaatatgctgagtttttca

SEQ ID NO: 6944453 - DNA, 22 bp, Homo sapiens
ttctagctttttgcaccaaggt

SEQ ID NO: 6944454 - DNA, 22 bp, Homo sapiens
caagtatttcctgatggcctgt

SEQ ID NO: 6944455 - DNA, 22 bp, Homo sapiens
tctgagcattttaggtggtatc

SEQ ID NO: 6944456 - DNA, 22 bp, Homo sapiens
tctggcaccactgagtctgcag

SEQ ID NO: 6944457 - DNA, 20 bp, Homo sapiens
aggcttggcttggcaggaac

SEQ ID NO: 6944458 - DNA, 22 bp, Homo sapiens
agacaacatctagtttggtgga

SEQ ID NO: 6944459 - DNA, 18 bp, Homo sapiens
gatgggagcaagagaaga

SEQ ID NO: 6944460 - DNA, 22 bp, Homo sapiens
gaaatgtagaattgcttaactg

SEQ ID NO: 6944461 - DNA, 18 bp, Homo sapiens
ctgaagacaaaatgtcca

SEQ ID NO: 6944462 - DNA, 22 bp, Homo sapiens
tagcccagagagccaggggctt

SEQ ID NO: 6944463 - DNA, 22 bp, Homo sapiens
tggaatgtcaagaagcagtaag

SEQ ID NO: 6944464 - DNA, 19 bp, Homo sapiens
cataatacagtggatctga

SEQ ID NO: 6944465 - DNA, 22 bp, Homo sapiens
ttgatacatgctctagagttga

SEQ ID NO: 6944466 - DNA, 22 bp, Homo sapiens
tgaggcctctgtgccatccagg

SEQ ID NO: 6944467 - DNA, 22 bp, Homo sapiens
cagggcctcatggccggggtgc

SEQ ID NO: 6944468 - DNA, 22 bp, Homo sapiens
acagagactgggagcaagaggc

SEQ ID NO: 6944469 - DNA, 22 bp, Homo sapiens
gctaggttggggaagttctcct

SEQ ID NO: 6944470 - DNA, 20 bp, Homo sapiens
acatatgaatgatagagcca

SEQ ID NO: 6944471 - DNA, 22 bp, Homo sapiens
cctgggctttgagggcaggatg

SEQ ID NO: 6944472 - DNA, 22 bp, Homo sapiens
gctcagagcccgaggcttgcat

SEQ ID NO: 6944473 - DNA, 22 bp, Homo sapiens
agatgtggtgaaatgcctccca

SEQ ID NO: 6944474 - DNA, 22 bp, Homo sapiens
ctgccccaggcctccttttctt

SEQ ID NO: 6944475 - DNA, 22 bp, Homo sapiens
agggcccacagttcctatggcc

SEQ ID NO: 6944476 - DNA, 22 bp, Homo sapiens
tcctggttcttgaggagccatg

SEQ ID NO: 6944477 - DNA, 22 bp, Homo sapiens
agtcacagggtacacaaggatt

SEQ ID NO: 6944478 - DNA, 22 bp, Homo sapiens
actggtggctttcagacagaaa

SEQ ID NO: 6944479 - DNA, 22 bp, Homo sapiens
agctggcattctccttgttatt

SEQ ID NO: 6944480 - DNA, 22 bp, Homo sapiens
ctctttggtgcaccttgcagtc

SEQ ID NO: 6944481 - DNA, 22 bp, Homo sapiens
ggcagactgtaataggagaatt

SEQ ID NO: 6944482 - DNA, 22 bp, Homo sapiens
ttgcatgtatgtgatctgttca

SEQ ID NO: 6944483 - DNA, 22 bp, Homo sapiens
agctggcatcgagcatttgaac

SEQ ID NO: 6944484 - DNA, 22 bp, Homo sapiens
atttcccaggactagaaatata

SEQ ID NO: 6944485 - DNA, 22 bp, Homo sapiens
agagctgggacttggactcaat

SEQ ID NO: 6944486 - DNA, 22 bp, Homo sapiens
ttaaggaattacgaaaatattt

SEQ ID NO: 6944487 - DNA, 22 bp, Homo sapiens
gggaaggcagtgtctggttgaa

SEQ ID NO: 6944488 - DNA, 22 bp, Homo sapiens
gtgcagatgttatgtttcaaaa

SEQ ID NO: 6944489 - DNA, 22 bp, Homo sapiens
ttcacagagcgggatgctggga

SEQ ID NO: 6944490 - DNA, 22 bp, Homo sapiens
tgcctgggccttcccacctctg

SEQ ID NO: 6944491 - DNA, 22 bp, Homo sapiens
tcacagaaagctgtgtcctgac

SEQ ID NO: 6944492 - DNA, 22 bp, Homo sapiens
ctgcttccacacaagcaaagct

SEQ ID NO: 6944493 - DNA, 22 bp, Homo sapiens
attctacacaaagcaagaagac

SEQ ID NO: 6944494 - DNA, 21 bp, Homo sapiens
cagagggtttctcaggtgttt

SEQ ID NO: 6944495 - DNA, 22 bp, Homo sapiens
aaggctcagctactcagcctgc

SEQ ID NO: 6944496 - DNA, 22 bp, Homo sapiens
gtgcttctgccaactaattaac

SEQ ID NO: 6944497 - DNA, 22 bp, Homo sapiens
tggcacttttcccagttttggt

SEQ ID NO: 6944498 - DNA, 22 bp, Homo sapiens
gctgctgctgaggatgcacctg

SEQ ID NO: 6944499 - DNA, 20 bp, Homo sapiens
actggagccatctcagccta

SEQ ID NO: 6944500 - DNA, 22 bp, Homo sapiens
actggccatgaacttgggatct

SEQ ID NO: 6944501 - DNA, 21 bp, Homo sapiens
cagcccagagcagtggggcca

SEQ ID NO: 6944502 - DNA, 22 bp, Homo sapiens
gcgtgtgtgatatgcctctgca

SEQ ID NO: 6944503 - DNA, 22 bp, Homo sapiens
ttggaaagcaacttttgagagt

SEQ ID NO: 6944504 - DNA, 22 bp, Homo sapiens
agtgccaacggggcaggagagg

SEQ ID NO: 6944505 - DNA, 20 bp, Homo sapiens
tcagccagctaacatgggga

SEQ ID NO: 6944506 - DNA, 22 bp, Homo sapiens
tctggcttggctggcatctctg

SEQ ID NO: 6944507 - DNA, 22 bp, Homo sapiens
gtagtagctgtagatatcagga

SEQ ID NO: 6944508 - DNA, 22 bp, Homo sapiens
gaatccgtgtgatgtggactag

SEQ ID NO: 6944509 - DNA, 18 bp, Homo sapiens
gtattagttttcagagag

SEQ ID NO: 6944510 - DNA, 22 bp, Homo sapiens
ccctgccttcttggcctttaaa

SEQ ID NO: 6944511 - DNA, 23 bp, Homo sapiens
aatcacacgtttggccaggatgc

SEQ ID NO: 6944512 - DNA, 23 bp, Homo sapiens
aacagccaactttagcgggtggc

SEQ ID NO: 6944513 - DNA, 22 bp, Homo sapiens
ttcttacagccctattactaaa

SEQ ID NO: 6944514 - DNA, 22 bp, Homo sapiens
ttgctgattcatgatttgagaa

SEQ ID NO: 6944515 - DNA, 22 bp, Homo sapiens
agctgcccccagggctgtgctt

SEQ ID NO: 6944516 - DNA, 22 bp, Homo sapiens
aaggtagggatgtattcagctt

SEQ ID NO: 6944517 - DNA, 22 bp, Homo sapiens
ctctgtgggaagctgggtgtga

SEQ ID NO: 6944518 - DNA, 22 bp, Homo sapiens
aggaattatttgtcttagtctt

SEQ ID NO: 6944519 - DNA, 21 bp, Homo sapiens
gtgttggcatatggtggttga

SEQ ID NO: 6944520 - DNA, 22 bp, Homo sapiens
gacaagatgacatcatggcttc

SEQ ID NO: 6944521 - DNA, 22 bp, Homo sapiens
gctctgtgttccctccaggctc

SEQ ID NO: 6944522 - DNA, 22 bp, Homo sapiens
aacacttggagggagagtggga

SEQ ID NO: 6944523 - DNA, 22 bp, Homo sapiens
gcacatatgctgtaagcacatg

SEQ ID NO: 6944524 - DNA, 22 bp, Homo sapiens
gagagataggttgcaggaagct

SEQ ID NO: 6944525 - DNA, 22 bp, Homo sapiens
atatacctcattctttgagtgc

SEQ ID NO: 6944526 - DNA, 22 bp, Homo sapiens
tcatgcaacgatcctccaaatg

SEQ ID NO: 6944527 - DNA, 22 bp, Homo sapiens
ccaggggctctcagggtgtgtg

SEQ ID NO: 6944528 - DNA, 22 bp, Homo sapiens
tcagaagccaccttttgttggg

SEQ ID NO: 6944529 - DNA, 22 bp, Homo sapiens
ccccatgaagtagggtctctga

SEQ ID NO: 6944530 - DNA, 22 bp, Homo sapiens
ctgagagtaattttctacttga

SEQ ID NO: 6944531 - DNA, 22 bp, Homo sapiens
tgcagctgattaaagggcagac

SEQ ID NO: 6944532 - DNA, 22 bp, Homo sapiens
gactgaggaggtaaggtttgaa

SEQ ID NO: 6944533 - DNA, 22 bp, Homo sapiens
tggggtgccgacagggagggca

SEQ ID NO: 6944534 - DNA, 22 bp, Homo sapiens
tatgaattctgttcattgatga

SEQ ID NO: 6944535 - DNA, 22 bp, Homo sapiens
tcagaggagctgcagaacgctg

SEQ ID NO: 6944536 - DNA, 22 bp, Homo sapiens
tgggaggtgattaaattatggg

SEQ ID NO: 6944537 - DNA, 22 bp, Homo sapiens
tccagctggcttcggaagtgga

SEQ ID NO: 6944538 - DNA, 22 bp, Homo sapiens
tgtcccagttgggtattgaatt

SEQ ID NO: 6944539 - DNA, 22 bp, Homo sapiens
atcaattttgaggatacaagaa

SEQ ID NO: 6944540 - DNA, 22 bp, Homo sapiens
taatacagtagcttttacacag

SEQ ID NO: 6944541 - DNA, 22 bp, Homo sapiens
tgcctttaacttaaagcatgac

SEQ ID NO: 6944542 - DNA, 22 bp, Homo sapiens
tctagagaaaaaactcaagtga

SEQ ID NO: 6944543 - DNA, 22 bp, Homo sapiens
aagtgaatgatgtgaagtgtaa

SEQ ID NO: 6944544 - DNA, 22 bp, Homo sapiens
aagaaactgttgcgtgacagcg

SEQ ID NO: 6944545 - DNA, 22 bp, Homo sapiens
ttacatgcaggtcagactgcat

SEQ ID NO: 6944546 - DNA, 22 bp, Homo sapiens
agacatttattgaacacctagc

SEQ ID NO: 6944547 - DNA, 18 bp, Homo sapiens
tccagcagcatagtttcc

SEQ ID NO: 6944548 - DNA, 22 bp, Homo sapiens
cagcaagaacagcctgatgtgc

SEQ ID NO: 6944549 - DNA, 22 bp, Homo sapiens
ttaataagtagtagttattgtt

SEQ ID NO: 6944550 - DNA, 22 bp, Homo sapiens
aagaggaactgggggctgagtc

SEQ ID NO: 6944551 - DNA, 22 bp, Homo sapiens
ctgggtctttttcttccattga

SEQ ID NO: 6944552 - DNA, 22 bp, Homo sapiens
ttcctatgaataaatattgagc

SEQ ID NO: 6944553 - DNA, 22 bp, Homo sapiens
agcccagctttcacccctctgg

SEQ ID NO: 6944554 - DNA, 22 bp, Homo sapiens
caggatatttacgttctgctac

SEQ ID NO: 6944555 - DNA, 22 bp, Homo sapiens
aacagtaatggcattgccatga

SEQ ID NO: 6944556 - DNA, 21 bp, Homo sapiens
acagtcacaaaaccaaggcag

SEQ ID NO: 6944557 - DNA, 22 bp, Homo sapiens
tagtttctcagggaggaaagaa

SEQ ID NO: 6944558 - DNA, 22 bp, Homo sapiens
tgggcagtggcgcaatctctgg

SEQ ID NO: 6944559 - DNA, 22 bp, Homo sapiens
tgtgtttgagtcctcacagtgc

SEQ ID NO: 6944560 - DNA, 22 bp, Homo sapiens
ccagagaatccggagagtccat

SEQ ID NO: 6944561 - DNA, 22 bp, Homo sapiens
attcttctgcctactttcatcc

SEQ ID NO: 6944562 - DNA, 18 bp, Homo sapiens
tccttttctcccacccac

SEQ ID NO: 6944563 - DNA, 17 bp, Homo sapiens
agctgggttctcaggaa

SEQ ID NO: 6944564 - DNA, 22 bp, Homo sapiens
cagaaaatagagtttctctgag

SEQ ID NO: 6944565 - DNA, 22 bp, Homo sapiens
agggtgcaggggaagctgccct

SEQ ID NO: 6944566 - DNA, 22 bp, Homo sapiens
agcactgtggggaactcacaga

SEQ ID NO: 6944567 - DNA, 22 bp, Homo sapiens
gatgctgattttactgttttct

SEQ ID NO: 6944568 - DNA, 22 bp, Homo sapiens
gtcacagatctcttgagtcaag

SEQ ID NO: 6944569 - DNA, 15 bp, Homo sapiens
cagtttctgcttgaa

SEQ ID NO: 6944570 - DNA, 22 bp, Homo sapiens
agaaaagtgctctagtgagagc

SEQ ID NO: 6944571 - DNA, 22 bp, Homo sapiens
ctgccacttactaggcatggtg

SEQ ID NO: 6944572 - DNA, 20 bp, Homo sapiens
ctgtaaactgcgtctgtaat

SEQ ID NO: 6944573 - DNA, 22 bp, Homo sapiens
taacacattttaagccatttta

SEQ ID NO: 6944574 - DNA, 22 bp, Homo sapiens
ataccttttagacatgtagttg

SEQ ID NO: 6944575 - DNA, 22 bp, Homo sapiens
tctaaagatgtttattgacata

SEQ ID NO: 6944576 - DNA, 22 bp, Homo sapiens
tttctagtcagccatatctagt

SEQ ID NO: 6944577 - DNA, 21 bp, Homo sapiens
agtgatttatgagagaatgac

SEQ ID NO: 6944578 - DNA, 22 bp, Homo sapiens
aggaatattctcaagtggtcgt

SEQ ID NO: 6944579 - DNA, 22 bp, Homo sapiens
tcttatacagaagatgtttaat

SEQ ID NO: 6944580 - DNA, 22 bp, Homo sapiens
gtctggggaagtcagggcatca

SEQ ID NO: 6944581 - DNA, 22 bp, Homo sapiens
gcctggagaaaggaaggtggga

SEQ ID NO: 6944582 - DNA, 22 bp, Homo sapiens
ccttgaggagtccatagtatca

SEQ ID NO: 6944583 - DNA, 22 bp, Homo sapiens
tagtttcttcacctgtaaaatg

SEQ ID NO: 6944584 - DNA, 22 bp, Homo sapiens
gggccttgccatggagcctgag

SEQ ID NO: 6944585 - DNA, 22 bp, Homo sapiens
cttaatttttgtagtagatgga

SEQ ID NO: 6944586 - DNA, 22 bp, Homo sapiens
tgtggggtagcagtttccgtgt

SEQ ID NO: 6944587 - DNA, 22 bp, Homo sapiens
tgagggtggcacaggcacaaag

SEQ ID NO: 6944588 - DNA, 22 bp, Homo sapiens
tggacatgtcttctccaagaaa

SEQ ID NO: 6944589 - DNA, 22 bp, Homo sapiens
gggagctgccaccacccctggg

SEQ ID NO: 6944590 - DNA, 22 bp, Homo sapiens
cttctgcccctgtagcctgagt

SEQ ID NO: 6944591 - DNA, 22 bp, Homo sapiens
gctgtatgtgaggccacagtga

SEQ ID NO: 6944592 - DNA, 22 bp, Homo sapiens
actctcccagctatatgtggtg

SEQ ID NO: 6944593 - DNA, 22 bp, Homo sapiens
tttaagaagttatgttataaat

SEQ ID NO: 6944594 - DNA, 22 bp, Homo sapiens
tgaagagatagaagtacatgct

SEQ ID NO: 6944595 - DNA, 22 bp, Homo sapiens
ggaaagaatagagactttatca

SEQ ID NO: 6944596 - DNA, 22 bp, Homo sapiens
tccctgaaccactagtgatgag

SEQ ID NO: 6944597 - DNA, 20 bp, Homo sapiens
tgtatttcatgcattcctgg

SEQ ID NO: 6944598 - DNA, 22 bp, Homo sapiens
gcaggctgtagacaccaaacta

SEQ ID NO: 6944599 - DNA, 22 bp, Homo sapiens
atggcccagactcagactggtg

SEQ ID NO: 6944600 - DNA, 22 bp, Homo sapiens
aacctgagggcaggaccccata

SEQ ID NO: 6944601 - DNA, 22 bp, Homo sapiens
agcactgttatgggatgactta

SEQ ID NO: 6944602 - DNA, 22 bp, Homo sapiens
acattcttggactccactctag

SEQ ID NO: 6944603 - DNA, 22 bp, Homo sapiens
gggtagtttaattaggaagaaa

SEQ ID NO: 6944604 - DNA, 22 bp, Homo sapiens
ttcccagtgattgaacatccct

SEQ ID NO: 6944605 - DNA, 22 bp, Homo sapiens
ctgaagtccctgttttgtttac

SEQ ID NO: 6944606 - DNA, 22 bp, Homo sapiens
tgtggtggtaatgagccagatg

SEQ ID NO: 6944607 - DNA, 22 bp, Homo sapiens
tggtcaagggacagagctgaac

SEQ ID NO: 6944608 - DNA, 22 bp, Homo sapiens
gcaccagctgcagggtggctga

SEQ ID NO: 6944609 - DNA, 22 bp, Homo sapiens
tctcagtgcagcttgacagaga

SEQ ID NO: 6944610 - DNA, 22 bp, Homo sapiens
aaggctgaggctggagaattac

SEQ ID NO: 6944611 - DNA, 19 bp, Homo sapiens
cacaacttcgcttgattcc

SEQ ID NO: 6944612 - DNA, 22 bp, Homo sapiens
agtgctgtctccttcccccggg

SEQ ID NO: 6944613 - DNA, 22 bp, Homo sapiens
gcaaggtgttttaacaggaaaa

SEQ ID NO: 6944614 - DNA, 22 bp, Homo sapiens
tttgtgctgacatttgggtcat

SEQ ID NO: 6944615 - DNA, 21 bp, Homo sapiens
cagagggccggcatgtggtct

SEQ ID NO: 6944616 - DNA, 22 bp, Homo sapiens
tattgaagagataagtgacaga

SEQ ID NO: 6944617 - DNA, 22 bp, Homo sapiens
tctctgagctggatttgttctt

SEQ ID NO: 6944618 - DNA, 22 bp, Homo sapiens
tgggctctctcacctggaggct

SEQ ID NO: 6944619 - DNA, 22 bp, Homo sapiens
tttattcttgagagtgagaaga

SEQ ID NO: 6944620 - DNA, 22 bp, Homo sapiens
ttcagaggtaagggtctcagaa

SEQ ID NO: 6944621 - DNA, 22 bp, Homo sapiens
ttggctgaaggttaagtgctgg

SEQ ID NO: 6944622 - DNA, 22 bp, Homo sapiens
aagaaataagacttctctgtcc

SEQ ID NO: 6944623 - DNA, 22 bp, Homo sapiens
agaagccagaatattcatggat

SEQ ID NO: 6944624 - DNA, 22 bp, Homo sapiens
tctgagcttctgcatttccaac

SEQ ID NO: 6944625 - DNA, 22 bp, Homo sapiens
tgcctgggtccaggccaagcct

SEQ ID NO: 6944626 - DNA, 22 bp, Homo sapiens
gaggccaaggtgggcagatcac

SEQ ID NO: 6944627 - DNA, 22 bp, Homo sapiens
tttcaaagcaactgaaaaggaa

SEQ ID NO: 6944628 - DNA, 22 bp, Homo sapiens
aggttctggagcttagagggag

SEQ ID NO: 6944629 - DNA, 22 bp, Homo sapiens
cctggcagaaagagttacacct

SEQ ID NO: 6944630 - DNA, 22 bp, Homo sapiens
atacactgttcactagatcttc

SEQ ID NO: 6944631 - DNA, 22 bp, Homo sapiens
ttcattggtcctgctcctggac

SEQ ID NO: 6944632 - DNA, 22 bp, Homo sapiens
caggactatgttcaacagatag

SEQ ID NO: 6944633 - DNA, 22 bp, Homo sapiens
tagttaattctttaagaacaag

SEQ ID NO: 6944634 - DNA, 22 bp, Homo sapiens
gcctgggagagggatagtgcag

SEQ ID NO: 6944635 - DNA, 22 bp, Homo sapiens
aggaggtgtagatttcctgtca

SEQ ID NO: 6944636 - DNA, 22 bp, Homo sapiens
cagccctgcacgctgcctccgc

SEQ ID NO: 6944637 - DNA, 22 bp, Homo sapiens
ttgaatggcttctaggttctcc

SEQ ID NO: 6944638 - DNA, 22 bp, Homo sapiens
tattttcatcttgtccttggat

SEQ ID NO: 6944639 - DNA, 22 bp, Homo sapiens
ttattgactgaaatgagagtga

SEQ ID NO: 6944640 - DNA, 22 bp, Homo sapiens
atctccagaatggcttgttaat

SEQ ID NO: 6944641 - DNA, 22 bp, Homo sapiens
ctcagggggaatcaggtcacag

SEQ ID NO: 6944642 - DNA, 22 bp, Homo sapiens
aaagcaagtctctacaaagtac

SEQ ID NO: 6944643 - DNA, 22 bp, Homo sapiens
ctgtttcaccactggctctttg

SEQ ID NO: 6944644 - DNA, 22 bp, Homo sapiens
tgaggccaaaatgactcaaatg

SEQ ID NO: 6944645 - DNA, 22 bp, Homo sapiens
ggaaagaaccctggatggctgg

SEQ ID NO: 6944646 - DNA, 22 bp, Homo sapiens
gtggtgcatgcatgcatatgta

SEQ ID NO: 6944647 - DNA, 22 bp, Homo sapiens
tcctctgctccatctttactgt

SEQ ID NO: 6944648 - DNA, 22 bp, Homo sapiens
tctaatgagttagataattttg

SEQ ID NO: 6944649 - DNA, 22 bp, Homo sapiens
tgagaatagtaataatttctgg

SEQ ID NO: 6944650 - DNA, 22 bp, Homo sapiens
taacttctctgctatcatagga

SEQ ID NO: 6944651 - DNA, 22 bp, Homo sapiens
gtggaagcagtaaggcaagttt

SEQ ID NO: 6944652 - DNA, 17 bp, Homo sapiens
tcaaatgtacagaacta

SEQ ID NO: 6944653 - DNA, 22 bp, Homo sapiens
gctgtaggtaaggatggcaaag

SEQ ID NO: 6944654 - DNA, 22 bp, Homo sapiens
ttcccatttgtggtagtgaatt

SEQ ID NO: 6944655 - DNA, 21 bp, Homo sapiens
tcagggcagtgggaggttcct

SEQ ID NO: 6944656 - DNA, 22 bp, Homo sapiens
cataatttttttaagtcagaac

SEQ ID NO: 6944657 - DNA, 22 bp, Homo sapiens
atggactagccataagagaact

SEQ ID NO: 6944658 - DNA, 22 bp, Homo sapiens
tggtctgaaggacttctgaggg

SEQ ID NO: 6944659 - DNA, 22 bp, Homo sapiens
aattgtgctatgattatgaaag

SEQ ID NO: 6944660 - DNA, 22 bp, Homo sapiens
cttgagtaaagaagtattttag

SEQ ID NO: 6944661 - DNA, 22 bp, Homo sapiens
agagtcagactaagccatggtg

SEQ ID NO: 6944662 - DNA, 22 bp, Homo sapiens
gcagacagaagctaagtagaca

SEQ ID NO: 6944663 - DNA, 22 bp, Homo sapiens
gggcttcaggagggtcagccca

SEQ ID NO: 6944664 - DNA, 22 bp, Homo sapiens
ggtcagtggacaaaggagtttc

SEQ ID NO: 6944665 - DNA, 22 bp, Homo sapiens
agtcatcatgtacagagagcaa

SEQ ID NO: 6944666 - DNA, 22 bp, Homo sapiens
gtgaggaagtctgagagccaca

SEQ ID NO: 6944667 - DNA, 22 bp, Homo sapiens
aatgactctgctgcagagacac

SEQ ID NO: 6944668 - DNA, 22 bp, Homo sapiens
aacacattttgcctaggcaata

SEQ ID NO: 6944669 - DNA, 22 bp, Homo sapiens
ttggccctgaggaggcagctgc

SEQ ID NO: 6944670 - DNA, 22 bp, Homo sapiens
tgtccaggtcagcagcagggac

SEQ ID NO: 6944671 - DNA, 22 bp, Homo sapiens
tcctgtatttgttcatctgtac

SEQ ID NO: 6944672 - DNA, 19 bp, Homo sapiens
ggctcagtcaactgactgt

SEQ ID NO: 6944673 - DNA, 21 bp, Homo sapiens
ttcagggtttcacaatactaa

SEQ ID NO: 6944674 - DNA, 22 bp, Homo sapiens
atgttacttagaataattctgg

SEQ ID NO: 6944675 - DNA, 22 bp, Homo sapiens
atcaagagcacagtgctggcat

SEQ ID NO: 6944676 - DNA, 22 bp, Homo sapiens
atggccagcccttcccgcagct

SEQ ID NO: 6944677 - DNA, 22 bp, Homo sapiens
tcacagtgctctgggtggcaga

SEQ ID NO: 6944678 - DNA, 22 bp, Homo sapiens
agacacagtttgggatgggttg

SEQ ID NO: 6944679 - DNA, 22 bp, Homo sapiens
atgcttccaacagttctgtgaa

SEQ ID NO: 6944680 - DNA, 22 bp, Homo sapiens
aaggtacaccaaagttcaagtt

SEQ ID NO: 6944681 - DNA, 22 bp, Homo sapiens
ctgtgcccaggcccctggggat

SEQ ID NO: 6944682 - DNA, 16 bp, Homo sapiens
aaactgagttcagttc

SEQ ID NO: 6944683 - DNA, 22 bp, Homo sapiens
attgtctttgtttaagggatac

SEQ ID NO: 6944684 - DNA, 22 bp, Homo sapiens
agactcttggtcattggcatta

SEQ ID NO: 6944685 - DNA, 22 bp, Homo sapiens
gtgagcatcttggcagatatga

SEQ ID NO: 6944686 - DNA, 22 bp, Homo sapiens
cagcttgttaccgagggagggt

SEQ ID NO: 6944687 - DNA, 20 bp, Homo sapiens
agtgggagagggcagactgc

SEQ ID NO: 6944688 - DNA, 22 bp, Homo sapiens
agtgtgggtgagggaggccctc

SEQ ID NO: 6944689 - DNA, 22 bp, Homo sapiens
acagtctgcaggcaagttctac

SEQ ID NO: 6944690 - DNA, 22 bp, Homo sapiens
ttagcttttctctatgttggct

SEQ ID NO: 6944691 - DNA, 19 bp, Homo sapiens
tcataaaaatggtaaccca

SEQ ID NO: 6944692 - DNA, 22 bp, Homo sapiens
tgggggattgttttaatgaata

SEQ ID NO: 6944693 - DNA, 22 bp, Homo sapiens
cgggggcacccacaaatgagga

SEQ ID NO: 6944694 - DNA, 23 bp, Homo sapiens
acaagatagggataaaaagataa

SEQ ID NO: 6944695 - DNA, 22 bp, Homo sapiens
atgccagacgtgtgttggccgg

SEQ ID NO: 6944696 - DNA, 22 bp, Homo sapiens
agatgtgtttctagttcctgca

SEQ ID NO: 6944697 - DNA, 22 bp, Homo sapiens
tcacatgactttttggtggcct

SEQ ID NO: 6944698 - DNA, 22 bp, Homo sapiens
ttgattctttgagaccgtgata

SEQ ID NO: 6944699 - DNA, 22 bp, Homo sapiens
tgactcttaaatatactgttga

SEQ ID NO: 6944700 - DNA, 22 bp, Homo sapiens
ataagcatttcacaggtgtgtt

SEQ ID NO: 6944701 - DNA, 22 bp, Homo sapiens
cagtaggggttctttaagttgt

SEQ ID NO: 6944702 - DNA, 22 bp, Homo sapiens
tggtaaggtcttcactcagatt

SEQ ID NO: 6944703 - DNA, 22 bp, Homo sapiens
agacacagtataagcacaacaa

SEQ ID NO: 6944704 - DNA, 22 bp, Homo sapiens
tgtggggcttacaaaggcagat

SEQ ID NO: 6944705 - DNA, 22 bp, Homo sapiens
agcagcagaggtcagaaaggta

SEQ ID NO: 6944706 - DNA, 22 bp, Homo sapiens
aacatttcagcacctgattcct

SEQ ID NO: 6944707 - DNA, 22 bp, Homo sapiens
ctacaggtcagtaagacctaga

SEQ ID NO: 6944708 - DNA, 22 bp, Homo sapiens
gcaaggagactgtagggccaag

SEQ ID NO: 6944709 - DNA, 22 bp, Homo sapiens
ccatcttaattctaaagacaaa

SEQ ID NO: 6944710 - DNA, 23 bp, Homo sapiens
cctccccttcccacagctgggtg

SEQ ID NO: 6944711 - DNA, 22 bp, Homo sapiens
gccctgggctccctgctccaca

SEQ ID NO: 6944712 - DNA, 22 bp, Homo sapiens
gctgggcccagatcccaggatc

SEQ ID NO: 6944713 - DNA, 22 bp, Homo sapiens
attcacagttcattagctgtaa

SEQ ID NO: 6944714 - DNA, 15 bp, Homo sapiens
ttggaggatgtagta

SEQ ID NO: 6944715 - DNA, 22 bp, Homo sapiens
aacagcatgctgggtaacattg

SEQ ID NO: 6944716 - DNA, 22 bp, Homo sapiens
cagttagttataaatgaggaag

SEQ ID NO: 6944717 - DNA, 22 bp, Homo sapiens
ttggccagtgaaccaggcctgg

SEQ ID NO: 6944718 - DNA, 22 bp, Homo sapiens
aactctctttagagagggacaa

SEQ ID NO: 6944719 - DNA, 22 bp, Homo sapiens
atcgtattacctttgggattag

SEQ ID NO: 6944720 - DNA, 22 bp, Homo sapiens
tatgtgcattattaccagtgga

SEQ ID NO: 6944721 - DNA, 23 bp, Homo sapiens
tggcttgcccaaatcctgcctgc

SEQ ID NO: 6944722 - DNA, 22 bp, Homo sapiens
tgagcagtcatccatttctcct

SEQ ID NO: 6944723 - DNA, 22 bp, Homo sapiens
ggccactgcctccgccatggct

SEQ ID NO: 6944724 - DNA, 22 bp, Homo sapiens
aatgaacaaaatatgctttgca

SEQ ID NO: 6944725 - DNA, 22 bp, Homo sapiens
tatggaaagggagtttaatttg

SEQ ID NO: 6944726 - DNA, 22 bp, Homo sapiens
tcttttcattgagaacacactg

SEQ ID NO: 6944727 - DNA, 19 bp, Homo sapiens
ctgaggcaagtggtggtca

SEQ ID NO: 6944728 - DNA, 22 bp, Homo sapiens
ttcacaaacttcatgatggcac

SEQ ID NO: 6944729 - DNA, 22 bp, Homo sapiens
agccccaggatgggccgcagga

SEQ ID NO: 6944730 - DNA, 22 bp, Homo sapiens
atttgttccatgagtaaggcta

SEQ ID NO: 6944731 - DNA, 22 bp, Homo sapiens
tgcttaatcaagaagcctattt

SEQ ID NO: 6944732 - DNA, 21 bp, Homo sapiens
gagtggaacgctcttcacacc

SEQ ID NO: 6944733 - DNA, 22 bp, Homo sapiens
caattgtgaagacaacagctta

SEQ ID NO: 6944734 - DNA, 22 bp, Homo sapiens
atcatcatcattgctaacatct

SEQ ID NO: 6944735 - DNA, 22 bp, Homo sapiens
gatcttctgaactggagtatct

SEQ ID NO: 6944736 - DNA, 22 bp, Homo sapiens
gacatttatgaaggagatatgc

SEQ ID NO: 6944737 - DNA, 22 bp, Homo sapiens
ttgtgtctggatttcagctttc

SEQ ID NO: 6944738 - DNA, 22 bp, Homo sapiens
tcaacatttatgaagctgtggc

SEQ ID NO: 6944739 - DNA, 22 bp, Homo sapiens
ttccaatgtatgatagacttag

SEQ ID NO: 6944740 - DNA, 22 bp, Homo sapiens
tttaagacttagatttattggg

SEQ ID NO: 6944741 - DNA, 22 bp, Homo sapiens
ctgaagcagggagtgatgaagt

SEQ ID NO: 6944742 - DNA, 22 bp, Homo sapiens
tagtcccggaactccttcaggt

SEQ ID NO: 6944743 - DNA, 22 bp, Homo sapiens
cttctacaaggttgtcctctat

SEQ ID NO: 6944744 - DNA, 22 bp, Homo sapiens
attgttgtctttacctgtattt

SEQ ID NO: 6944745 - DNA, 17 bp, Homo sapiens
gatgaaatgatgcacac

SEQ ID NO: 6944746 - DNA, 20 bp, Homo sapiens
agatgggttaaagctatggg

SEQ ID NO: 6944747 - DNA, 22 bp, Homo sapiens
aaaattttactggtgtttcctt

SEQ ID NO: 6944748 - DNA, 22 bp, Homo sapiens
tttgtgccctgtagatccccag

SEQ ID NO: 6944749 - DNA, 17 bp, Homo sapiens
caatttcataggttttg

SEQ ID NO: 6944750 - DNA, 22 bp, Homo sapiens
agtggtctccccagtagaataa

SEQ ID NO: 6944751 - DNA, 22 bp, Homo sapiens
gccagagaatgaaaatcagatt

SEQ ID NO: 6944752 - DNA, 22 bp, Homo sapiens
ctgtacagagttctgagtgtac

SEQ ID NO: 6944753 - DNA, 22 bp, Homo sapiens
ttctgggatgtgaatggtttaa

SEQ ID NO: 6944754 - DNA, 22 bp, Homo sapiens
cctgtggacattctgtgtggaa

SEQ ID NO: 6944755 - DNA, 22 bp, Homo sapiens
tgtgggtggagtgatattagct

SEQ ID NO: 6944756 - DNA, 22 bp, Homo sapiens
gaggagtctttttagggcctga

SEQ ID NO: 6944757 - DNA, 22 bp, Homo sapiens
tgggacacacaaggtcagctct

SEQ ID NO: 6944758 - DNA, 22 bp, Homo sapiens
tttagagagtgtaaaaatatat

SEQ ID NO: 6944759 - DNA, 22 bp, Homo sapiens
agtgcaacagaagcaggctggc

SEQ ID NO: 6944760 - DNA, 22 bp, Homo sapiens
gaacctctcagcagccatgatc

SEQ ID NO: 6944761 - DNA, 21 bp, Homo sapiens
tggaaacagcgccatctgccg

SEQ ID NO: 6944762 - DNA, 19 bp, Homo sapiens
aagagtcacaggcagccct

SEQ ID NO: 6944763 - DNA, 17 bp, Homo sapiens
tttggaaagtgatcatt

SEQ ID NO: 6944764 - DNA, 22 bp, Homo sapiens
cagaggtccagcatacatttcc

SEQ ID NO: 6944765 - DNA, 22 bp, Homo sapiens
ctcaggccattcttccagctgc

SEQ ID NO: 6944766 - DNA, 19 bp, Homo sapiens
caataagtcagtagtgggc

SEQ ID NO: 6944767 - DNA, 22 bp, Homo sapiens
tttgtcatattgaaggtgctta

SEQ ID NO: 6944768 - DNA, 22 bp, Homo sapiens
tcatagttttacttagtggtgt

SEQ ID NO: 6944769 - DNA, 22 bp, Homo sapiens
tctatgtcctttctcccattcc

SEQ ID NO: 6944770 - DNA, 22 bp, Homo sapiens
acagccaggcccagcacgcagg

SEQ ID NO: 6944771 - DNA, 22 bp, Homo sapiens
tatgtgtctttatctggctctt

SEQ ID NO: 6944772 - DNA, 22 bp, Homo sapiens
taactagatatagactttctac

SEQ ID NO: 6944773 - DNA, 23 bp, Homo sapiens
atccatgcttaagtaatcatttg

SEQ ID NO: 6944774 - DNA, 22 bp, Homo sapiens
cttcctgaagaggttggtcagg

SEQ ID NO: 6944775 - DNA, 22 bp, Homo sapiens
tctggcttcaactttactgaaa

SEQ ID NO: 6944776 - DNA, 22 bp, Homo sapiens
cacagaacaccaaagaaccttc

SEQ ID NO: 6944777 - DNA, 22 bp, Homo sapiens
agtactttacttcttacagttt

SEQ ID NO: 6944778 - DNA, 20 bp, Homo sapiens
agctcctgagggttactttc

SEQ ID NO: 6944779 - DNA, 19 bp, Homo sapiens
ttcaggattgaccctactg

SEQ ID NO: 6944780 - DNA, 22 bp, Homo sapiens
gattatgatgcgaggtcagagc

SEQ ID NO: 6944781 - DNA, 19 bp, Homo sapiens
ccctcttgcacaaagcaaa

SEQ ID NO: 6944782 - DNA, 22 bp, Homo sapiens
tgctttaaccatcttgtttgga

SEQ ID NO: 6944783 - DNA, 22 bp, Homo sapiens
tacagatatgttccatgcatcg

SEQ ID NO: 6944784 - DNA, 23 bp, Homo sapiens
aactgagataatgtatgtaaagc

SEQ ID NO: 6944785 - DNA, 22 bp, Homo sapiens
aaagccatgaatgttatagagg

SEQ ID NO: 6944786 - DNA, 22 bp, Homo sapiens
ttcaaggtatggtagctggtca

SEQ ID NO: 6944787 - DNA, 22 bp, Homo sapiens
atgatacaagcaaaactaatca

SEQ ID NO: 6944788 - DNA, 23 bp, Homo sapiens
tttcacattaatgtttagcagga

SEQ ID NO: 6944789 - DNA, 20 bp, Homo sapiens
tcagaacagtagaggagcta

SEQ ID NO: 6944790 - DNA, 22 bp, Homo sapiens
cctgagcattagacatccatca

SEQ ID NO: 6944791 - DNA, 22 bp, Homo sapiens
ctccagtggtgatggggaagaa

SEQ ID NO: 6944792 - DNA, 22 bp, Homo sapiens
gcaggagtcagccctaccttga

SEQ ID NO: 6944793 - DNA, 22 bp, Homo sapiens
gctcaggcctcactccatttgg

SEQ ID NO: 6944794 - DNA, 20 bp, Homo sapiens
aagagctacttagcctttcc

SEQ ID NO: 6944795 - DNA, 22 bp, Homo sapiens
gctctgtgtatgtggcaggtgc

SEQ ID NO: 6944796 - DNA, 18 bp, Homo sapiens
gaacagcaatttcatgtt

SEQ ID NO: 6944797 - DNA, 22 bp, Homo sapiens
ttgcattctgttaaaatgtatt

SEQ ID NO: 6944798 - DNA, 22 bp, Homo sapiens
gcccagcacatctggccttgaa

SEQ ID NO: 6944799 - DNA, 17 bp, Homo sapiens
aggctggccttcacagt

SEQ ID NO: 6944800 - DNA, 22 bp, Homo sapiens
ctcatctgactgtaaggtaatg

SEQ ID NO: 6944801 - DNA, 22 bp, Homo sapiens
ttgctggatggcgtccaccagg

SEQ ID NO: 6944802 - DNA, 22 bp, Homo sapiens
tctggagatcatgtggggtgga

SEQ ID NO: 6944803 - DNA, 22 bp, Homo sapiens
gatttcagagtttattaggtta

SEQ ID NO: 6944804 - DNA, 22 bp, Homo sapiens
agtatgaatggaaactacctat

SEQ ID NO: 6944805 - DNA, 22 bp, Homo sapiens
gttcatgctaccctttcctaat

SEQ ID NO: 6944806 - DNA, 20 bp, Homo sapiens
agcaggtaaggcacagcagt

SEQ ID NO: 6944807 - DNA, 22 bp, Homo sapiens
cttctggttccagcttctgttg

SEQ ID NO: 6944808 - DNA, 22 bp, Homo sapiens
ccaagctggacagcagcaagga

SEQ ID NO: 6944809 - DNA, 22 bp, Homo sapiens
tccaggtctaatttgtccttga

SEQ ID NO: 6944810 - DNA, 22 bp, Homo sapiens
agcaggcagccatttggaaggc

SEQ ID NO: 6944811 - DNA, 22 bp, Homo sapiens
ttctgtcttcccactgaggagc

SEQ ID NO: 6944812 - DNA, 22 bp, Homo sapiens
atgtctgtcatcttccaggaag

SEQ ID NO: 6944813 - DNA, 22 bp, Homo sapiens
tcaagatgcatgggtggcataa

SEQ ID NO: 6944814 - DNA, 22 bp, Homo sapiens
agtggcatccctttaacagggt

SEQ ID NO: 6944815 - DNA, 18 bp, Homo sapiens
atctgtcctttctctgcc

SEQ ID NO: 6944816 - DNA, 20 bp, Homo sapiens
ttcatgcagtggttgctgtg

SEQ ID NO: 6944817 - DNA, 22 bp, Homo sapiens
aacaagtgatatataatggaag

SEQ ID NO: 6944818 - DNA, 22 bp, Homo sapiens
tgtctctgccagctagcagaat

SEQ ID NO: 6944819 - DNA, 22 bp, Homo sapiens
cacagcttatgccactgattgg

SEQ ID NO: 6944820 - DNA, 23 bp, Homo sapiens
atttacagctgtgtgagcaagtt

SEQ ID NO: 6944821 - DNA, 22 bp, Homo sapiens
ggggagtgttttcatgggcttg

SEQ ID NO: 6944822 - DNA, 22 bp, Homo sapiens
ctttccaatgtcactatgaatc

SEQ ID NO: 6944823 - DNA, 22 bp, Homo sapiens
gctggaaatgaatggagaggtg

SEQ ID NO: 6944824 - DNA, 22 bp, Homo sapiens
agaagggtagggacttatccaa

SEQ ID NO: 6944825 - DNA, 22 bp, Homo sapiens
gaaatgaaacaggcttttaagg

SEQ ID NO: 6944826 - DNA, 20 bp, Homo sapiens
ggctttctgtgatcctcagt

SEQ ID NO: 6944827 - DNA, 22 bp, Homo sapiens
aagaaggcctggtagacgtctt

SEQ ID NO: 6944828 - DNA, 21 bp, Homo sapiens
tgtctgctgaaggctggtcac

SEQ ID NO: 6944829 - DNA, 23 bp, Homo sapiens
aatattcctgccattaatgactc

SEQ ID NO: 6944830 - DNA, 22 bp, Homo sapiens
atttggaaaatctggttataga

SEQ ID NO: 6944831 - DNA, 22 bp, Homo sapiens
agctgcttcctctttgatgtca

SEQ ID NO: 6944832 - DNA, 22 bp, Homo sapiens
ctttggtatcttactagtattt

SEQ ID NO: 6944833 - DNA, 22 bp, Homo sapiens
tgtaagtctggcttatagcttt

SEQ ID NO: 6944834 - DNA, 22 bp, Homo sapiens
aagtctgagtgtcagtgcaagt

SEQ ID NO: 6944835 - DNA, 22 bp, Homo sapiens
aggtggggcccaccaatttgca

SEQ ID NO: 6944836 - DNA, 22 bp, Homo sapiens
tgaatgatttcttaggcaattg

SEQ ID NO: 6944837 - DNA, 22 bp, Homo sapiens
gggcatccagagggatgcctgg

SEQ ID NO: 6944838 - DNA, 22 bp, Homo sapiens
ttaggcatattgtacaatctag

SEQ ID NO: 6944839 - DNA, 20 bp, Homo sapiens
cctgtggagctgcctcctcc

SEQ ID NO: 6944840 - DNA, 22 bp, Homo sapiens
agaaatctaagatgctcaagga

SEQ ID NO: 6944841 - DNA, 22 bp, Homo sapiens
cagaaactttggccctcaagcc

SEQ ID NO: 6944842 - DNA, 22 bp, Homo sapiens
tgcaaatgggaaacccagcagt

SEQ ID NO: 6944843 - DNA, 22 bp, Homo sapiens
cacatattgtagttcaccagga

SEQ ID NO: 6944844 - DNA, 22 bp, Homo sapiens
acatttagagttctttactcca

SEQ ID NO: 6944845 - DNA, 22 bp, Homo sapiens
ccctggaggcaaaggttgcagt

SEQ ID NO: 6944846 - DNA, 22 bp, Homo sapiens
agttgggacatgttctttcccc

SEQ ID NO: 6944847 - DNA, 22 bp, Homo sapiens
tgctttggctgacacgctcctg

SEQ ID NO: 6944848 - DNA, 22 bp, Homo sapiens
gatttcccagaaaagtgatctc

SEQ ID NO: 6944849 - DNA, 22 bp, Homo sapiens
gcagatgtctgtgcctgcaggg

SEQ ID NO: 6944850 - DNA, 19 bp, Homo sapiens
aaatgtgcactgttttcca

SEQ ID NO: 6944851 - DNA, 23 bp, Homo sapiens
tgcagtgtttaacaatgacttga

SEQ ID NO: 6944852 - DNA, 22 bp, Homo sapiens
agcagcagattatggtctacat

SEQ ID NO: 6944853 - DNA, 22 bp, Homo sapiens
ctgtttccctccagggggtgga

SEQ ID NO: 6944854 - DNA, 22 bp, Homo sapiens
atggagtgtggccaggcagtaa

SEQ ID NO: 6944855 - DNA, 22 bp, Homo sapiens
agaggattgatcaaacactgca

SEQ ID NO: 6944856 - DNA, 21 bp, Homo sapiens
gttcaagttcctgctctgtga

SEQ ID NO: 6944857 - DNA, 22 bp, Homo sapiens
atgcagtaaaataggaggtaat

SEQ ID NO: 6944858 - DNA, 22 bp, Homo sapiens
ttggttatcctgtcggtaattc

SEQ ID NO: 6944859 - DNA, 22 bp, Homo sapiens
gtagaatatatggttagtattg

SEQ ID NO: 6944860 - DNA, 22 bp, Homo sapiens
ggagtcacacagagaagataag

SEQ ID NO: 6944861 - DNA, 22 bp, Homo sapiens
tacagcacagcaaagaggacgg

SEQ ID NO: 6944862 - DNA, 22 bp, Homo sapiens
actggtcagattttacttccca

SEQ ID NO: 6944863 - DNA, 22 bp, Homo sapiens
ccaggtgcaaactcccagcagg

SEQ ID NO: 6944864 - DNA, 22 bp, Homo sapiens
ctcctgggaaatgaaggggcag

SEQ ID NO: 6944865 - DNA, 22 bp, Homo sapiens
ctgtttcacgtgtttaagccca

SEQ ID NO: 6944866 - DNA, 22 bp, Homo sapiens
acagtgctaatgatgccaagat

SEQ ID NO: 6944867 - DNA, 22 bp, Homo sapiens
aagtcccaaagtcactctgctt

SEQ ID NO: 6944868 - DNA, 22 bp, Homo sapiens
tctctgtgttgcaggaaaatct

SEQ ID NO: 6944869 - DNA, 22 bp, Homo sapiens
gaggctgctgttagccctgggc

SEQ ID NO: 6944870 - DNA, 22 bp, Homo sapiens
ttaaacctcagagtctttttca

SEQ ID NO: 6944871 - DNA, 22 bp, Homo sapiens
tatcattgctgatgtgctgaga

SEQ ID NO: 6944872 - DNA, 22 bp, Homo sapiens
ggaggaaatccttagtaaggca

SEQ ID NO: 6944873 - DNA, 22 bp, Homo sapiens
tcatgcaggacttacaagagat

SEQ ID NO: 6944874 - DNA, 22 bp, Homo sapiens
attttactttgtgaatattgac

SEQ ID NO: 6944875 - DNA, 22 bp, Homo sapiens
agtgtttctggcaaatgaaagt

SEQ ID NO: 6944876 - DNA, 22 bp, Homo sapiens
tttgtacaattagcagaggcta

SEQ ID NO: 6944877 - DNA, 22 bp, Homo sapiens
aacactggaagggacatcaagt

SEQ ID NO: 6944878 - DNA, 22 bp, Homo sapiens
tttacccatattagcatcaagt

SEQ ID NO: 6944879 - DNA, 22 bp, Homo sapiens
tttatataacagagactgctat

SEQ ID NO: 6944880 - DNA, 22 bp, Homo sapiens
cgagaggctggacagggctggg

SEQ ID NO: 6944881 - DNA, 22 bp, Homo sapiens
cttgctggagcggagcgggtgt

SEQ ID NO: 6944882 - DNA, 22 bp, Homo sapiens
tgcagaccacagctaggctgga

SEQ ID NO: 6944883 - DNA, 22 bp, Homo sapiens
agagtttgtactttaccctgag

SEQ ID NO: 6944884 - DNA, 22 bp, Homo sapiens
tgtcagtgtaactcttatagca

SEQ ID NO: 6944885 - DNA, 22 bp, Homo sapiens
gctgtttctgtggtgtatagcc

SEQ ID NO: 6944886 - DNA, 23 bp, Homo sapiens
gctctgctctgtttcatagacag

SEQ ID NO: 6944887 - DNA, 22 bp, Homo sapiens
gctgtgtcagaaactctgggga

SEQ ID NO: 6944888 - DNA, 22 bp, Homo sapiens
gttcagagaaagagacacctta

SEQ ID NO: 6944889 - DNA, 22 bp, Homo sapiens
agggcctgcatcaggagcttgg

SEQ ID NO: 6944890 - DNA, 22 bp, Homo sapiens
gcagcacaaagtccccagggac

SEQ ID NO: 6944891 - DNA, 23 bp, Homo sapiens
ctgatccaggaggtctgtcgtga

SEQ ID NO: 6944892 - DNA, 22 bp, Homo sapiens
gtccaagagaactgaaatagga

SEQ ID NO: 6944893 - DNA, 22 bp, Homo sapiens
tagcaaggcttccaatgaacag

SEQ ID NO: 6944894 - DNA, 21 bp, Homo sapiens
tgtgagctttgtgaaagcagg

SEQ ID NO: 6944895 - DNA, 22 bp, Homo sapiens
tgaggtaggcttgagatgggag

SEQ ID NO: 6944896 - DNA, 18 bp, Homo sapiens
agctcctggtctcaggga

SEQ ID NO: 6944897 - DNA, 22 bp, Homo sapiens
gctgtatgtttatttgggaatt

SEQ ID NO: 6944898 - DNA, 22 bp, Homo sapiens
ctctgctgcccaggcctgctag

SEQ ID NO: 6944899 - DNA, 22 bp, Homo sapiens
atgtttcagggtgatagaaggt

SEQ ID NO: 6944900 - DNA, 22 bp, Homo sapiens
agctgccacagagcctggccag

SEQ ID NO: 6944901 - DNA, 21 bp, Homo sapiens
gcagcgccctctgaccttgat

SEQ ID NO: 6944902 - DNA, 22 bp, Homo sapiens
tgagtctgctcctggtagcaga

SEQ ID NO: 6944903 - DNA, 22 bp, Homo sapiens
ttgaaatactgcattgttcagt

SEQ ID NO: 6944904 - DNA, 22 bp, Homo sapiens
gagcttcagaatttaacagact

SEQ ID NO: 6944905 - DNA, 22 bp, Homo sapiens
acttggttggtctcaccctgtt

SEQ ID NO: 6944906 - DNA, 22 bp, Homo sapiens
tctgccagacctgactcagtag

SEQ ID NO: 6944907 - DNA, 22 bp, Homo sapiens
ggcatctgtccatctctccagc

SEQ ID NO: 6944908 - DNA, 22 bp, Homo sapiens
tctggcagagtcagtgcacaca

SEQ ID NO: 6944909 - DNA, 22 bp, Homo sapiens
tggtccctttgactgcccgcca

SEQ ID NO: 6944910 - DNA, 20 bp, Homo sapiens
acctggagacagcactctgg

SEQ ID NO: 6944911 - DNA, 22 bp, Homo sapiens
atgttcatcaacacattacaag

SEQ ID NO: 6944912 - DNA, 21 bp, Homo sapiens
tcagtaaaaaaactacctaga

SEQ ID NO: 6944913 - DNA, 22 bp, Homo sapiens
acggagcccgtgtcaggtggga

SEQ ID NO: 6944914 - DNA, 22 bp, Homo sapiens
acagtgtccccagctctgtgag

SEQ ID NO: 6944915 - DNA, 22 bp, Homo sapiens
acagtgtagaatcctgtactta

SEQ ID NO: 6944916 - DNA, 22 bp, Homo sapiens
atctctctatgcactgaggact

SEQ ID NO: 6944917 - DNA, 22 bp, Homo sapiens
acaatagacccatgacacatac

SEQ ID NO: 6944918 - DNA, 22 bp, Homo sapiens
tgtccaggcggccttgcctgtt

SEQ ID NO: 6944919 - DNA, 23 bp, Homo sapiens
catcatgcaatcttgggatttct

SEQ ID NO: 6944920 - DNA, 22 bp, Homo sapiens
tacaatgactctcagtttggct

SEQ ID NO: 6944921 - DNA, 22 bp, Homo sapiens
ccctcccaggagtggccagaga

SEQ ID NO: 6944922 - DNA, 22 bp, Homo sapiens
tggatttccagacagcttaatt

SEQ ID NO: 6944923 - DNA, 22 bp, Homo sapiens
agaatttagctccttggtcata

SEQ ID NO: 6944924 - DNA, 22 bp, Homo sapiens
tggtgacagcatggaagaagtg

SEQ ID NO: 6944925 - DNA, 22 bp, Homo sapiens
agccacagagagggagctgcaa

SEQ ID NO: 6944926 - DNA, 22 bp, Homo sapiens
ttaacatttcttttccactcat

SEQ ID NO: 6944927 - DNA, 20 bp, Homo sapiens
acatcctggtgactagaact

SEQ ID NO: 6944928 - DNA, 22 bp, Homo sapiens
cctgtcactctgagccgctccg

SEQ ID NO: 6944929 - DNA, 18 bp, Homo sapiens
aatgtgaatatttacttc

SEQ ID NO: 6944930 - DNA, 22 bp, Homo sapiens
aatgcaaagagttgcttatcaa

SEQ ID NO: 6944931 - DNA, 22 bp, Homo sapiens
agcaaagtggctttccaaacca

SEQ ID NO: 6944932 - DNA, 15 bp, Homo sapiens
ctaaaatccctgggc

SEQ ID NO: 6944933 - DNA, 22 bp, Homo sapiens
gcggggccatgtccaacggcct

SEQ ID NO: 6944934 - DNA, 22 bp, Homo sapiens
ttattcagtctgtctagggagt

SEQ ID NO: 6944935 - DNA, 22 bp, Homo sapiens
atgcccagggctggtgaggtcc

SEQ ID NO: 6944936 - DNA, 20 bp, Homo sapiens
aggagcttaggaggttattg

SEQ ID NO: 6944937 - DNA, 22 bp, Homo sapiens
gctgccttgccctcttcccata

SEQ ID NO: 6944938 - DNA, 22 bp, Homo sapiens
ataaggcagtcccttaacaagg

SEQ ID NO: 6944939 - DNA, 19 bp, Homo sapiens
aggcccagcgctgggggct

SEQ ID NO: 6944940 - DNA, 22 bp, Homo sapiens
cttgtagacccctggactcacg

SEQ ID NO: 6944941 - DNA, 22 bp, Homo sapiens
ctcagattctgaataataaaca

SEQ ID NO: 6944942 - DNA, 22 bp, Homo sapiens
ttacagagcctcattttagaga

SEQ ID NO: 6944943 - DNA, 22 bp, Homo sapiens
cttttcctcaggaggagacgcg

SEQ ID NO: 6944944 - DNA, 22 bp, Homo sapiens
ttgcaacttctcccatcactct

SEQ ID NO: 6944945 - DNA, 22 bp, Homo sapiens
tctcaaactaacaatgattata

SEQ ID NO: 6944946 - DNA, 22 bp, Homo sapiens
atgttcagtgcagtggcctgag

SEQ ID NO: 6944947 - DNA, 22 bp, Homo sapiens
tccccatgggtggggacacata

SEQ ID NO: 6944948 - DNA, 22 bp, Homo sapiens
gatactcatttcagtgctttac

SEQ ID NO: 6944949 - DNA, 22 bp, Homo sapiens
atttcctagggtagatgtcaca

SEQ ID NO: 6944950 - DNA, 22 bp, Homo sapiens
attccagttagtggcagcttat

SEQ ID NO: 6944951 - DNA, 22 bp, Homo sapiens
catgaacaaattctgtttgagg

SEQ ID NO: 6944952 - DNA, 22 bp, Homo sapiens
gagtgggtgagagacttggcac

SEQ ID NO: 6944953 - DNA, 22 bp, Homo sapiens
tgtatttcctggtttagatcaa

SEQ ID NO: 6944954 - DNA, 22 bp, Homo sapiens
caggtgagttttcctccttggt

SEQ ID NO: 6944955 - DNA, 22 bp, Homo sapiens
ttcatttgggatgagtcagaag

SEQ ID NO: 6944956 - DNA, 22 bp, Homo sapiens
aggcttagaaagggtaagtgac

SEQ ID NO: 6944957 - DNA, 22 bp, Homo sapiens
atgttacagttgagtaaattaa

SEQ ID NO: 6944958 - DNA, 22 bp, Homo sapiens
cttgggatgtaacctttgttcc

SEQ ID NO: 6944959 - DNA, 19 bp, Homo sapiens
tggttgtgcacgggttggt

SEQ ID NO: 6944960 - DNA, 22 bp, Homo sapiens
tgagatggagtctcactctgtt

SEQ ID NO: 6944961 - DNA, 22 bp, Homo sapiens
agctgtgttattagaaacctgc

SEQ ID NO: 6944962 - DNA, 22 bp, Homo sapiens
acatgtggaggaggcgagggta

SEQ ID NO: 6944963 - DNA, 22 bp, Homo sapiens
gcagagccatgggaggtttttg

SEQ ID NO: 6944964 - DNA, 21 bp, Homo sapiens
tcagagggccctggaggctca

SEQ ID NO: 6944965 - DNA, 22 bp, Homo sapiens
gagtgttttactcaaagaaaga

SEQ ID NO: 6944966 - DNA, 22 bp, Homo sapiens
aaaattcatggcttgggaaaag

SEQ ID NO: 6944967 - DNA, 22 bp, Homo sapiens
ttgtagaatcattatttctagt

SEQ ID NO: 6944968 - DNA, 22 bp, Homo sapiens
ctctcctcagaacaggccctct

SEQ ID NO: 6944969 - DNA, 22 bp, Homo sapiens
cggcttctgcccattcagtcct

SEQ ID NO: 6944970 - DNA, 22 bp, Homo sapiens
tctgggaagtcctctgtcatgc

SEQ ID NO: 6944971 - DNA, 22 bp, Homo sapiens
tggtggagcctaggctaagtct

SEQ ID NO: 6944972 - DNA, 22 bp, Homo sapiens
ccagtaattagactttcaggca

SEQ ID NO: 6944973 - DNA, 22 bp, Homo sapiens
tgcattagtaagtaattttaat

SEQ ID NO: 6944974 - DNA, 22 bp, Homo sapiens
ccagggatgtggcagcaccata

SEQ ID NO: 6944975 - DNA, 22 bp, Homo sapiens
ggttatctaagacagtttggca

SEQ ID NO: 6944976 - DNA, 22 bp, Homo sapiens
gttctagatgactgagcagctg

SEQ ID NO: 6944977 - DNA, 21 bp, Homo sapiens
tgtggcagagacaatgctagt

SEQ ID NO: 6944978 - DNA, 22 bp, Homo sapiens
tcaggcttataggtagtggtta

SEQ ID NO: 6944979 - DNA, 22 bp, Homo sapiens
ttctccccgtctctctgaggcc

SEQ ID NO: 6944980 - DNA, 22 bp, Homo sapiens
cttcataaactcagaaggcagc

SEQ ID NO: 6944981 - DNA, 22 bp, Homo sapiens
ggaggactcaggtctggccatg

SEQ ID NO: 6944982 - DNA, 22 bp, Homo sapiens
aggagctctcccatgctgcaga

SEQ ID NO: 6944983 - DNA, 22 bp, Homo sapiens
tctgggtcggaagccccaggga

SEQ ID NO: 6944984 - DNA, 22 bp, Homo sapiens
aattccagcctcagttctatta

SEQ ID NO: 6944985 - DNA, 22 bp, Homo sapiens
taatacagacaacttgccaaat

SEQ ID NO: 6944986 - DNA, 22 bp, Homo sapiens
ctgatgtgttttagtttggtaa

SEQ ID NO: 6944987 - DNA, 22 bp, Homo sapiens
ctgaagcaattgagagatgttt

SEQ ID NO: 6944988 - DNA, 23 bp, Homo sapiens
aagcttccttcacgtctcctggg

SEQ ID NO: 6944989 - DNA, 22 bp, Homo sapiens
agtggctgctggagtggagatg

SEQ ID NO: 6944990 - DNA, 22 bp, Homo sapiens
gctggtaggaagtgctcctgcc

SEQ ID NO: 6944991 - DNA, 22 bp, Homo sapiens
aaagtatgttgtggcttttaaa

SEQ ID NO: 6944992 - DNA, 22 bp, Homo sapiens
aagagttatgaaagcaaggcat

SEQ ID NO: 6944993 - DNA, 22 bp, Homo sapiens
ctagggctccaaagctgagaag

SEQ ID NO: 6944994 - DNA, 22 bp, Homo sapiens
cctgctggcagagggggttact

SEQ ID NO: 6944995 - DNA, 22 bp, Homo sapiens
ttggcacagctccatggctttg

SEQ ID NO: 6944996 - DNA, 22 bp, Homo sapiens
ggtcagaggtcacaagctggca

SEQ ID NO: 6944997 - DNA, 22 bp, Homo sapiens
ggcaggcattagagattcccag

SEQ ID NO: 6944998 - DNA, 22 bp, Homo sapiens
tgtaatgttagaaacaattgct

SEQ ID NO: 6944999 - DNA, 18 bp, Homo sapiens
ccagggagcttattagga

SEQ ID NO: 6945000 - DNA, 22 bp, Homo sapiens
gtgcaaaagtaactgtggtttt

SEQ ID NO: 6945001 - DNA, 23 bp, Homo sapiens
aaatggccaaggttaaaaataca

SEQ ID NO: 6945002 - DNA, 22 bp, Homo sapiens
tgtgtatatgtaaatatagttg

SEQ ID NO: 6945003 - DNA, 22 bp, Homo sapiens
taccttgtgagatgtcagtgag

SEQ ID NO: 6945004 - DNA, 22 bp, Homo sapiens
ttgtacccatgctactaatgtc

SEQ ID NO: 6945005 - DNA, 22 bp, Homo sapiens
ggtagccacatggctgaaatcc

SEQ ID NO: 6945006 - DNA, 22 bp, Homo sapiens
tgggacttaatatgcccttgat

SEQ ID NO: 6945007 - DNA, 22 bp, Homo sapiens
tttgacttctatctagtaagaa

SEQ ID NO: 6945008 - DNA, 22 bp, Homo sapiens
atgattgcctgtgtgtgagaaa

SEQ ID NO: 6945009 - DNA, 19 bp, Homo sapiens
cttctccagcttctagaag

SEQ ID NO: 6945010 - DNA, 22 bp, Homo sapiens
aaggcatggcagggtttacaca

SEQ ID NO: 6945011 - DNA, 17 bp, Homo sapiens
tctctttccctttctgc

SEQ ID NO: 6945012 - DNA, 22 bp, Homo sapiens
tgggcgacagagcaagactccg

SEQ ID NO: 6945013 - DNA, 22 bp, Homo sapiens
ttctcagagcactgctgacaaa

SEQ ID NO: 6945014 - DNA, 22 bp, Homo sapiens
gcagcagggtgccagctttgca

SEQ ID NO: 6945015 - DNA, 22 bp, Homo sapiens
tgggtgacagagcaagactctg

SEQ ID NO: 6945016 - DNA, 22 bp, Homo sapiens
ggctgcttcacttttttgagcc

SEQ ID NO: 6945017 - DNA, 23 bp, Homo sapiens
ccactgaagaatccagggagttt

SEQ ID NO: 6945018 - DNA, 22 bp, Homo sapiens
catatttggtataacttaagca

SEQ ID NO: 6945019 - DNA, 22 bp, Homo sapiens
caagtttgtgttctatcattct

SEQ ID NO: 6945020 - DNA, 22 bp, Homo sapiens
tccagcttttattggatgagga

SEQ ID NO: 6945021 - DNA, 22 bp, Homo sapiens
taactcccaacatcatggctct

SEQ ID NO: 6945022 - DNA, 22 bp, Homo sapiens
ctgcagtcaagctcaccagttc

SEQ ID NO: 6945023 - DNA, 22 bp, Homo sapiens
ctggcagctgtgtgaagaactg

SEQ ID NO: 6945024 - DNA, 19 bp, Homo sapiens
tgagacagggattcaggtg

SEQ ID NO: 6945025 - DNA, 22 bp, Homo sapiens
attaggcattctgaatgaggtc

SEQ ID NO: 6945026 - DNA, 18 bp, Homo sapiens
aggcctgggaagctgagg

SEQ ID NO: 6945027 - DNA, 22 bp, Homo sapiens
taaacagaattcaggcaagata

SEQ ID NO: 6945028 - DNA, 22 bp, Homo sapiens
ttacagcacagtgcttttactg

SEQ ID NO: 6945029 - DNA, 22 bp, Homo sapiens
gagctgcacgcagcatccaaga

SEQ ID NO: 6945030 - DNA, 21 bp, Homo sapiens
cctctgctcgggcatgcgttt

SEQ ID NO: 6945031 - DNA, 21 bp, Homo sapiens
gcttgcttggagtttaggagt

SEQ ID NO: 6945032 - DNA, 22 bp, Homo sapiens
tgccaggcctcaggagtctcca

SEQ ID NO: 6945033 - DNA, 22 bp, Homo sapiens
ttgtaaagaggggggatggtag

SEQ ID NO: 6945034 - DNA, 22 bp, Homo sapiens
ctatgaaaggatttggagttgt

SEQ ID NO: 6945035 - DNA, 21 bp, Homo sapiens
tttctgtcctttccatcagct

SEQ ID NO: 6945036 - DNA, 22 bp, Homo sapiens
gggaatgtgcaggatcgtgggc

SEQ ID NO: 6945037 - DNA, 22 bp, Homo sapiens
taagtgggcgccttgaattact

SEQ ID NO: 6945038 - DNA, 22 bp, Homo sapiens
acaatactagccaaggttatta

SEQ ID NO: 6945039 - DNA, 22 bp, Homo sapiens
attaatatgagaaagtggcaga

SEQ ID NO: 6945040 - DNA, 22 bp, Homo sapiens
taggtctggccccatgcagcca

SEQ ID NO: 6945041 - DNA, 22 bp, Homo sapiens
tggtcagttgagcagaagggaa

SEQ ID NO: 6945042 - DNA, 22 bp, Homo sapiens
tgccatttctcaaatatgacta

SEQ ID NO: 6945043 - DNA, 22 bp, Homo sapiens
gactggtaaggaaattcactaa

SEQ ID NO: 6945044 - DNA, 22 bp, Homo sapiens
cacctttgttctcggccagagt

SEQ ID NO: 6945045 - DNA, 22 bp, Homo sapiens
gtcctcagatgctgctgaaatg

SEQ ID NO: 6945046 - DNA, 22 bp, Homo sapiens
attacagtagcaaaagaccgga

SEQ ID NO: 6945047 - DNA, 19 bp, Homo sapiens
tggctctgtttctctggag

SEQ ID NO: 6945048 - DNA, 22 bp, Homo sapiens
atgtacattttcctaatgtttt

SEQ ID NO: 6945049 - DNA, 22 bp, Homo sapiens
gcacttggaggtgcccacacag

SEQ ID NO: 6945050 - DNA, 22 bp, Homo sapiens
tgttcaatccccaggtcctgaa

SEQ ID NO: 6945051 - DNA, 22 bp, Homo sapiens
agtgtgacagtcctgctgcttt

SEQ ID NO: 6945052 - DNA, 22 bp, Homo sapiens
gtgcccttcagcggcctcatct

SEQ ID NO: 6945053 - DNA, 22 bp, Homo sapiens
cagcatgatttatcacaaccct

SEQ ID NO: 6945054 - DNA, 22 bp, Homo sapiens
tgaaatgcttttacaggatatt

SEQ ID NO: 6945055 - DNA, 22 bp, Homo sapiens
cctggctttgaccttgctgttt

SEQ ID NO: 6945056 - DNA, 18 bp, Homo sapiens
ctattacaatgcagtggt

SEQ ID NO: 6945057 - DNA, 22 bp, Homo sapiens
ataagtttgtctttgtaaagat

SEQ ID NO: 6945058 - DNA, 22 bp, Homo sapiens
ttctctcctacccagtatccat

SEQ ID NO: 6945059 - DNA, 22 bp, Homo sapiens
gtaactgggatttttcaatgtg

SEQ ID NO: 6945060 - DNA, 22 bp, Homo sapiens
agtgaaatgactgaatcagata

SEQ ID NO: 6945061 - DNA, 22 bp, Homo sapiens
tggccctgaggacccagtgtgg

SEQ ID NO: 6945062 - DNA, 22 bp, Homo sapiens
acagaagtttcaagtaagaagt

SEQ ID NO: 6945063 - DNA, 22 bp, Homo sapiens
tgttggcatctctgagagagtt

SEQ ID NO: 6945064 - DNA, 22 bp, Homo sapiens
caactgaggtctcagccaatta

SEQ ID NO: 6945065 - DNA, 22 bp, Homo sapiens
aagtgggtgcactcaactttat

SEQ ID NO: 6945066 - DNA, 22 bp, Homo sapiens
tagactctgcatttacctccca

SEQ ID NO: 6945067 - DNA, 22 bp, Homo sapiens
gtacattttgaggttaaaacaa

SEQ ID NO: 6945068 - DNA, 22 bp, Homo sapiens
aaaggcttggtattttggagtt

SEQ ID NO: 6945069 - DNA, 22 bp, Homo sapiens
aggagtgagtgtcctcagcaga

SEQ ID NO: 6945070 - DNA, 22 bp, Homo sapiens
tttggcggggcaattctgaagc

SEQ ID NO: 6945071 - DNA, 22 bp, Homo sapiens
atcagtgggagatgctggtttt

SEQ ID NO: 6945072 - DNA, 22 bp, Homo sapiens
cttggaatcaagtttttggaga

SEQ ID NO: 6945073 - DNA, 22 bp, Homo sapiens
tctggcttttattcagttggca

SEQ ID NO: 6945074 - DNA, 22 bp, Homo sapiens
agtctagatgatcctaggaata

SEQ ID NO: 6945075 - DNA, 22 bp, Homo sapiens
tctttgctgagtacatctccaa

SEQ ID NO: 6945076 - DNA, 22 bp, Homo sapiens
cctttctctatcgacccatcgc

SEQ ID NO: 6945077 - DNA, 22 bp, Homo sapiens
tcaggaacataatgtgagtcag

SEQ ID NO: 6945078 - DNA, 22 bp, Homo sapiens
ataggctgatctagcagcacag

SEQ ID NO: 6945079 - DNA, 22 bp, Homo sapiens
atgtccagtttctacacacata

SEQ ID NO: 6945080 - DNA, 22 bp, Homo sapiens
tagctgatgtttctgggagaat

SEQ ID NO: 6945081 - DNA, 22 bp, Homo sapiens
atttgcttgttcaccagtactt

SEQ ID NO: 6945082 - DNA, 22 bp, Homo sapiens
agttctgagcatctaggcagct

SEQ ID NO: 6945083 - DNA, 22 bp, Homo sapiens
agctgcaaaccaggccggcgcg

SEQ ID NO: 6945084 - DNA, 22 bp, Homo sapiens
attcagactatgaacacgtcag

SEQ ID NO: 6945085 - DNA, 22 bp, Homo sapiens
acattaatgaggtgatgacaca

SEQ ID NO: 6945086 - DNA, 22 bp, Homo sapiens
atattcactgggtactaaaaag

SEQ ID NO: 6945087 - DNA, 22 bp, Homo sapiens
aattttattagaaggcaagggg

SEQ ID NO: 6945088 - DNA, 22 bp, Homo sapiens
aatagcatcttccctggtaacc

SEQ ID NO: 6945089 - DNA, 22 bp, Homo sapiens
tttctactcatcctttggagaa

SEQ ID NO: 6945090 - DNA, 22 bp, Homo sapiens
acagtagtcttaatttcatgta

SEQ ID NO: 6945091 - DNA, 22 bp, Homo sapiens
gttatagcagcacaaagtggac

SEQ ID NO: 6945092 - DNA, 22 bp, Homo sapiens
cagcaataagccaggttagaca

SEQ ID NO: 6945093 - DNA, 22 bp, Homo sapiens
cagtcctttctgaaatcctata

SEQ ID NO: 6945094 - DNA, 20 bp, Homo sapiens
ctgtagggtgcagcaggctc

SEQ ID NO: 6945095 - DNA, 19 bp, Homo sapiens
acctggctggcgcacttgt

SEQ ID NO: 6945096 - DNA, 22 bp, Homo sapiens
tgcaggtgcctcttgagcttgt

SEQ ID NO: 6945097 - DNA, 22 bp, Homo sapiens
ctgatattaacaggcaagtgag

SEQ ID NO: 6945098 - DNA, 22 bp, Homo sapiens
gcaagtttagctaactggccca

SEQ ID NO: 6945099 - DNA, 22 bp, Homo sapiens
ggaaatattgattgctctgtat

SEQ ID NO: 6945100 - DNA, 22 bp, Homo sapiens
tctcaaattcccttttcctcct

SEQ ID NO: 6945101 - DNA, 22 bp, Homo sapiens
atgtattcaagccacatacatt

SEQ ID NO: 6945102 - DNA, 22 bp, Homo sapiens
ctccaggagctgtgtctttctt

SEQ ID NO: 6945103 - DNA, 18 bp, Homo sapiens
tggctcagatggctttaa

SEQ ID NO: 6945104 - DNA, 22 bp, Homo sapiens
tcaagtctggagatctggaact

SEQ ID NO: 6945105 - DNA, 22 bp, Homo sapiens
tagtgtcagggagtgataaatg

SEQ ID NO: 6945106 - DNA, 22 bp, Homo sapiens
agtctgagttagtggaaatgta

SEQ ID NO: 6945107 - DNA, 22 bp, Homo sapiens
gctgaagttttgcagagagtaa

SEQ ID NO: 6945108 - DNA, 22 bp, Homo sapiens
tgtggactttggcattggactt

SEQ ID NO: 6945109 - DNA, 22 bp, Homo sapiens
ttctcttatctggcattattgg

SEQ ID NO: 6945110 - DNA, 23 bp, Homo sapiens
actcagtgaagcaaacagatagt

SEQ ID NO: 6945111 - DNA, 22 bp, Homo sapiens
tttgtgcaatttatgtactata

SEQ ID NO: 6945112 - DNA, 22 bp, Homo sapiens
agcaaagaagacacaggcttca

SEQ ID NO: 6945113 - DNA, 22 bp, Homo sapiens
ggtcatggatagctggagcctt

SEQ ID NO: 6945114 - DNA, 22 bp, Homo sapiens
cagcatgatcccagttgattgc

SEQ ID NO: 6945115 - DNA, 22 bp, Homo sapiens
ctgtctgtggagcttctgatgt

SEQ ID NO: 6945116 - DNA, 22 bp, Homo sapiens
atgtccaatagaagggagaagc

SEQ ID NO: 6945117 - DNA, 22 bp, Homo sapiens
tgagagagtaattgagtggtaa

SEQ ID NO: 6945118 - DNA, 22 bp, Homo sapiens
ctgttattttataattcaagaa

SEQ ID NO: 6945119 - DNA, 22 bp, Homo sapiens
cagatcaaacaaaatgggttag

SEQ ID NO: 6945120 - DNA, 22 bp, Homo sapiens
gcaaagtattaaccaacaggat

SEQ ID NO: 6945121 - DNA, 22 bp, Homo sapiens
agttagtactgaggacccagac

SEQ ID NO: 6945122 - DNA, 22 bp, Homo sapiens
acccactgtcatctctgaccac

SEQ ID NO: 6945123 - DNA, 22 bp, Homo sapiens
gtctgcagacaacttagaagca

SEQ ID NO: 6945124 - DNA, 22 bp, Homo sapiens
tagcaaaaaaactggcatctcc

SEQ ID NO: 6945125 - DNA, 22 bp, Homo sapiens
tgaatgatatgtgaaaaggaac

SEQ ID NO: 6945126 - DNA, 22 bp, Homo sapiens
cttagaaatgcagattctcagg

SEQ ID NO: 6945127 - DNA, 22 bp, Homo sapiens
cagtttctatggctgggctctg

SEQ ID NO: 6945128 - DNA, 22 bp, Homo sapiens
gtatatgcatgtgtctgttcac

SEQ ID NO: 6945129 - DNA, 23 bp, Homo sapiens
gattgctgtatgcaggagcattc

SEQ ID NO: 6945130 - DNA, 22 bp, Homo sapiens
gacctcgtgatccgcccgcttt

SEQ ID NO: 6945131 - DNA, 21 bp, Homo sapiens
gtcagcagatccagcacttgt

SEQ ID NO: 6945132 - DNA, 22 bp, Homo sapiens
aagtgggttggacaaatgaccc

SEQ ID NO: 6945133 - DNA, 22 bp, Homo sapiens
attccaggactaaaggaacagc

SEQ ID NO: 6945134 - DNA, 22 bp, Homo sapiens
atgttcattttatggcgatgcc

SEQ ID NO: 6945135 - DNA, 23 bp, Homo sapiens
tgaatgattgtactgagctttta

SEQ ID NO: 6945136 - DNA, 22 bp, Homo sapiens
gctctgtgccagggctgggcca

SEQ ID NO: 6945137 - DNA, 22 bp, Homo sapiens
actgccttccacctatggatga

SEQ ID NO: 6945138 - DNA, 22 bp, Homo sapiens
atgtacatttagatcatttctg

SEQ ID NO: 6945139 - DNA, 22 bp, Homo sapiens
agttttgactaagatggcttgg

SEQ ID NO: 6945140 - DNA, 22 bp, Homo sapiens
agagatctgtggattcattgtc

SEQ ID NO: 6945141 - DNA, 22 bp, Homo sapiens
tctcttgtaatttaaaaaatct

SEQ ID NO: 6945142 - DNA, 22 bp, Homo sapiens
tggcctcaatctgtcctccagc

SEQ ID NO: 6945143 - DNA, 22 bp, Homo sapiens
tgctattttggtctacagcact

SEQ ID NO: 6945144 - DNA, 22 bp, Homo sapiens
tccagctggggacatgggcttc

SEQ ID NO: 6945145 - DNA, 22 bp, Homo sapiens
ctctgatttccttattctgtca

SEQ ID NO: 6945146 - DNA, 22 bp, Homo sapiens
tgcatttatggagcaaggcagt

SEQ ID NO: 6945147 - DNA, 22 bp, Homo sapiens
ttggcagaggggccacctgccc

SEQ ID NO: 6945148 - DNA, 22 bp, Homo sapiens
actgttacagggcactgaacat

SEQ ID NO: 6945149 - DNA, 22 bp, Homo sapiens
ccttggttttaccaggtgttca

SEQ ID NO: 6945150 - DNA, 21 bp, Homo sapiens
gctggctggctgaccggcctt

SEQ ID NO: 6945151 - DNA, 22 bp, Homo sapiens
tcagaagtgctgtccttatccc

SEQ ID NO: 6945152 - DNA, 22 bp, Homo sapiens
ttgcatcagaattacttggagg

SEQ ID NO: 6945153 - DNA, 22 bp, Homo sapiens
atgctgagataaggctttagtc

SEQ ID NO: 6945154 - DNA, 22 bp, Homo sapiens
gagaggggacctgtgtgtctag

SEQ ID NO: 6945155 - DNA, 22 bp, Homo sapiens
gtgcttcctgtattgattccat

SEQ ID NO: 6945156 - DNA, 16 bp, Homo sapiens
tcccaggccaggtgga

SEQ ID NO: 6945157 - DNA, 22 bp, Homo sapiens
gttcaaaggcctgtggaaaggg

SEQ ID NO: 6945158 - DNA, 22 bp, Homo sapiens
ctgggccagaagacatttagga

SEQ ID NO: 6945159 - DNA, 22 bp, Homo sapiens
tacttctgcaccaaccttaata

SEQ ID NO: 6945160 - DNA, 22 bp, Homo sapiens
ctattgcttttgtgtgctccca

SEQ ID NO: 6945161 - DNA, 22 bp, Homo sapiens
ggcttggagtcatactgagaat

SEQ ID NO: 6945162 - DNA, 22 bp, Homo sapiens
ctttttactctgttgtctcagc

SEQ ID NO: 6945163 - DNA, 22 bp, Homo sapiens
gtatgtctatagtttttaaata

SEQ ID NO: 6945164 - DNA, 22 bp, Homo sapiens
tcaagacagatgggtaacttgg

SEQ ID NO: 6945165 - DNA, 22 bp, Homo sapiens
acagctgctgcttctcactggg

SEQ ID NO: 6945166 - DNA, 22 bp, Homo sapiens
acattcatgcaccttcctatcc

SEQ ID NO: 6945167 - DNA, 22 bp, Homo sapiens
atggctgtccagtttctagaga

SEQ ID NO: 6945168 - DNA, 19 bp, Homo sapiens
atgctgcatatggttttct

SEQ ID NO: 6945169 - DNA, 22 bp, Homo sapiens
tcagttgctatgagaaataaat

SEQ ID NO: 6945170 - DNA, 22 bp, Homo sapiens
tcttgcaggcatgaaaggactc

SEQ ID NO: 6945171 - DNA, 22 bp, Homo sapiens
agagataccaaataggcagtta

SEQ ID NO: 6945172 - DNA, 22 bp, Homo sapiens
gaggaggctggcgccgcctgcc

SEQ ID NO: 6945173 - DNA, 19 bp, Homo sapiens
catgctgacctgctgtggt

SEQ ID NO: 6945174 - DNA, 22 bp, Homo sapiens
cagtttcttcatctgcagaatc

SEQ ID NO: 6945175 - DNA, 20 bp, Homo sapiens
ctccagactacagaagagcc

SEQ ID NO: 6945176 - DNA, 22 bp, Homo sapiens
cagtccctagtggagctcacag

SEQ ID NO: 6945177 - DNA, 22 bp, Homo sapiens
tatctaaaggatttaatttagt

SEQ ID NO: 6945178 - DNA, 22 bp, Homo sapiens
caatagctaggctggtaaagga

SEQ ID NO: 6945179 - DNA, 22 bp, Homo sapiens
tttgatgacctgtatctttttc

SEQ ID NO: 6945180 - DNA, 22 bp, Homo sapiens
aggtgcttccaggagacaaggt

SEQ ID NO: 6945181 - DNA, 19 bp, Homo sapiens
cagtcctttccgctttctc

SEQ ID NO: 6945182 - DNA, 21 bp, Homo sapiens
atatggctcagagctggtact

SEQ ID NO: 6945183 - DNA, 22 bp, Homo sapiens
aggctcaagcactgatattttt

SEQ ID NO: 6945184 - DNA, 22 bp, Homo sapiens
tggaaatatttgctcattatct

SEQ ID NO: 6945185 - DNA, 22 bp, Homo sapiens
gacatgtattagtcatgcacag

SEQ ID NO: 6945186 - DNA, 22 bp, Homo sapiens
gataacccccaagaaggtcttt

SEQ ID NO: 6945187 - DNA, 22 bp, Homo sapiens
agtggcatatcatagctctctt

SEQ ID NO: 6945188 - DNA, 19 bp, Homo sapiens
ttctttgagttcttctgag

SEQ ID NO: 6945189 - DNA, 22 bp, Homo sapiens
gttaaagagtttggctttcttc

SEQ ID NO: 6945190 - DNA, 21 bp, Homo sapiens
ctctacattcccagcaactct

SEQ ID NO: 6945191 - DNA, 21 bp, Homo sapiens
gaagccaagacaggatcaagg

SEQ ID NO: 6945192 - DNA, 22 bp, Homo sapiens
tgtgaggcctctgcaggagcag

SEQ ID NO: 6945193 - DNA, 22 bp, Homo sapiens
aggtctgagtagagaaaaggca

SEQ ID NO: 6945194 - DNA, 22 bp, Homo sapiens
tcttatgtcaagaatgaatatt

SEQ ID NO: 6945195 - DNA, 22 bp, Homo sapiens
tgagccaagttcacaccattgc

SEQ ID NO: 6945196 - DNA, 22 bp, Homo sapiens
caggcgcagtcaaagaaatact

SEQ ID NO: 6945197 - DNA, 22 bp, Homo sapiens
aggccagccttgtaaatgcctc

SEQ ID NO: 6945198 - DNA, 22 bp, Homo sapiens
cactgcactccagctgggtgac

SEQ ID NO: 6945199 - DNA, 22 bp, Homo sapiens
ggtcatgtgtccaggaggtagc

SEQ ID NO: 6945200 - DNA, 22 bp, Homo sapiens
gcattcttgtttttcctaccct

SEQ ID NO: 6945201 - DNA, 22 bp, Homo sapiens
caggctggagtgcagttgtgca

SEQ ID NO: 6945202 - DNA, 22 bp, Homo sapiens
gagggcctagaagctccatatg

SEQ ID NO: 6945203 - DNA, 22 bp, Homo sapiens
ctgcatcccagggagcaatggg

SEQ ID NO: 6945204 - DNA, 20 bp, Homo sapiens
cagtccaggctgcagcatct

SEQ ID NO: 6945205 - DNA, 22 bp, Homo sapiens
cagcattctactttgtgaactg

SEQ ID NO: 6945206 - DNA, 22 bp, Homo sapiens
gcatttgttgactgaccttccc

SEQ ID NO: 6945207 - DNA, 22 bp, Homo sapiens
tctctgcagtcttgggcaggca

SEQ ID NO: 6945208 - DNA, 22 bp, Homo sapiens
tatttacttttaaattgagaac

SEQ ID NO: 6945209 - DNA, 22 bp, Homo sapiens
tccaggtcctactggcccatag

SEQ ID NO: 6945210 - DNA, 22 bp, Homo sapiens
aataacagagaagggtggcttc

SEQ ID NO: 6945211 - DNA, 22 bp, Homo sapiens
tccagtgtacaaaagctatctt

SEQ ID NO: 6945212 - DNA, 19 bp, Homo sapiens
atgacagagttgataagtg

SEQ ID NO: 6945213 - DNA, 22 bp, Homo sapiens
tgaatgatgtataatattgaga

SEQ ID NO: 6945214 - DNA, 16 bp, Homo sapiens
aacccacagctcccga

SEQ ID NO: 6945215 - DNA, 22 bp, Homo sapiens
ctgaggatggtgtggtcttctc

SEQ ID NO: 6945216 - DNA, 22 bp, Homo sapiens
caagctttatccgccatgtagg

SEQ ID NO: 6945217 - DNA, 22 bp, Homo sapiens
cctcagagttggccacgagagc

SEQ ID NO: 6945218 - DNA, 22 bp, Homo sapiens
cagcaggataggtttctttgga

SEQ ID NO: 6945219 - DNA, 22 bp, Homo sapiens
gctcctctgtcaaatgagagtg

SEQ ID NO: 6945220 - DNA, 22 bp, Homo sapiens
gaggccttcacttatttaaggg

SEQ ID NO: 6945221 - DNA, 22 bp, Homo sapiens
tgacatctgtcaccctgctgac

SEQ ID NO: 6945222 - DNA, 22 bp, Homo sapiens
tcagatcacaaaagtttctatt

SEQ ID NO: 6945223 - DNA, 23 bp, Homo sapiens
ctgtggcaagtcctgcacctgcc

SEQ ID NO: 6945224 - DNA, 22 bp, Homo sapiens
gaggctcttcaataggtcaatg

SEQ ID NO: 6945225 - DNA, 22 bp, Homo sapiens
aattagaaccagaagccatatt

SEQ ID NO: 6945226 - DNA, 22 bp, Homo sapiens
ggcagctgaagaggaactttgg

SEQ ID NO: 6945227 - DNA, 21 bp, Homo sapiens
gttgctcttcaagaaaatccc

SEQ ID NO: 6945228 - DNA, 22 bp, Homo sapiens
ctaactacaagcggggcatcct

SEQ ID NO: 6945229 - DNA, 22 bp, Homo sapiens
gctgtcttgtatgttgtaggac

SEQ ID NO: 6945230 - DNA, 22 bp, Homo sapiens
tatgttgatcataggtaaaaga

SEQ ID NO: 6945231 - DNA, 22 bp, Homo sapiens
cgtcccgggttcacgccattct

SEQ ID NO: 6945232 - DNA, 22 bp, Homo sapiens
ccctggctggctctgcccggac

SEQ ID NO: 6945233 - DNA, 22 bp, Homo sapiens
cacccacccactgctcattggc

SEQ ID NO: 6945234 - DNA, 22 bp, Homo sapiens
cagcaggggaactgtgggccag

SEQ ID NO: 6945235 - DNA, 19 bp, Homo sapiens
actgagaacctgacccagg

SEQ ID NO: 6945236 - DNA, 22 bp, Homo sapiens
gaaggctgtttctggtagtgat

SEQ ID NO: 6945237 - DNA, 22 bp, Homo sapiens
actacttgtgagagattatctc

SEQ ID NO: 6945238 - DNA, 23 bp, Homo sapiens
ggagaggggtgtgggcatcttta

SEQ ID NO: 6945239 - DNA, 22 bp, Homo sapiens
tccagcagaggttgataatacc

SEQ ID NO: 6945240 - DNA, 22 bp, Homo sapiens
ggaaatgtgggctgtttctgta

SEQ ID NO: 6945241 - DNA, 22 bp, Homo sapiens
atgattctaggcattgaagata

SEQ ID NO: 6945242 - DNA, 22 bp, Homo sapiens
tcagctgtactgtgccatagct

SEQ ID NO: 6945243 - DNA, 22 bp, Homo sapiens
agaacgtctttactcttacgaa

SEQ ID NO: 6945244 - DNA, 22 bp, Homo sapiens
gggaggcttgagccatactgcc

SEQ ID NO: 6945245 - DNA, 22 bp, Homo sapiens
ggcatggcacgggaaacaccag

SEQ ID NO: 6945246 - DNA, 22 bp, Homo sapiens
tcttgctgtgccccagcagggc

SEQ ID NO: 6945247 - DNA, 22 bp, Homo sapiens
tggacatcttagtcatgtcaat

SEQ ID NO: 6945248 - DNA, 22 bp, Homo sapiens
ggctctgcactcagagtcattc

SEQ ID NO: 6945249 - DNA, 22 bp, Homo sapiens
gcccaggggagtagtcaattta

SEQ ID NO: 6945250 - DNA, 22 bp, Homo sapiens
aaaacccttctgcagactctga

SEQ ID NO: 6945251 - DNA, 22 bp, Homo sapiens
gctgacctgaatcattcggggt

SEQ ID NO: 6945252 - DNA, 22 bp, Homo sapiens
tagacaatctcagcaaacacac

SEQ ID NO: 6945253 - DNA, 16 bp, Homo sapiens
gagcagcctgggcctt

SEQ ID NO: 6945254 - DNA, 22 bp, Homo sapiens
atgccagtcaaagaagatgaca

SEQ ID NO: 6945255 - DNA, 22 bp, Homo sapiens
tggcatgtatacttgagtagga

SEQ ID NO: 6945256 - DNA, 22 bp, Homo sapiens
cttggttaggttatgaatgccc

SEQ ID NO: 6945257 - DNA, 22 bp, Homo sapiens
caagctgcttattctctgctct

SEQ ID NO: 6945258 - DNA, 19 bp, Homo sapiens
agactctgtgtgagacttt

SEQ ID NO: 6945259 - DNA, 22 bp, Homo sapiens
attgtgctcagaatctgtcgtg

SEQ ID NO: 6945260 - DNA, 22 bp, Homo sapiens
ctgctttcttgttgcatcttaa

SEQ ID NO: 6945261 - DNA, 22 bp, Homo sapiens
tctgcctgttgctagaatgtca

SEQ ID NO: 6945262 - DNA, 22 bp, Homo sapiens
ttctcttagtattgctagttta

SEQ ID NO: 6945263 - DNA, 22 bp, Homo sapiens
ttatgtcaaaatggttgagatt

SEQ ID NO: 6945264 - DNA, 22 bp, Homo sapiens
gaggtaggtgtaggaggcctgc

SEQ ID NO: 6945265 - DNA, 22 bp, Homo sapiens
ccaggacctggagctctatgaa

SEQ ID NO: 6945266 - DNA, 22 bp, Homo sapiens
aaatatgttttccagttgtcat

SEQ ID NO: 6945267 - DNA, 22 bp, Homo sapiens
agggcctgggtctgtactcctc

SEQ ID NO: 6945268 - DNA, 22 bp, Homo sapiens
gaggctcagagtggttaaataa

SEQ ID NO: 6945269 - DNA, 20 bp, Homo sapiens
gggctaggtagccatttggc

SEQ ID NO: 6945270 - DNA, 22 bp, Homo sapiens
ccatgaccatacctgggcctga

SEQ ID NO: 6945271 - DNA, 22 bp, Homo sapiens
acctggccagtggggccgcgct

SEQ ID NO: 6945272 - DNA, 22 bp, Homo sapiens
gatgtcctgcagaaacatgaga

SEQ ID NO: 6945273 - DNA, 22 bp, Homo sapiens
aggcagcaattgaaatcattgt

SEQ ID NO: 6945274 - DNA, 22 bp, Homo sapiens
gcacttggtaggacttcagtga

SEQ ID NO: 6945275 - DNA, 22 bp, Homo sapiens
tcacatctgttgatacagcatc

SEQ ID NO: 6945276 - DNA, 22 bp, Homo sapiens
tgaattcaagttgttgagccat

SEQ ID NO: 6945277 - DNA, 22 bp, Homo sapiens
tttgagtctgcttccattttca

SEQ ID NO: 6945278 - DNA, 22 bp, Homo sapiens
aatgttacaggacctaagatga

SEQ ID NO: 6945279 - DNA, 22 bp, Homo sapiens
aggtggtgatgacagaagacag

SEQ ID NO: 6945280 - DNA, 22 bp, Homo sapiens
aactgtgggagaaggcgatgtg

SEQ ID NO: 6945281 - DNA, 23 bp, Homo sapiens
tccctgagatgctgctctgtccc

SEQ ID NO: 6945282 - DNA, 22 bp, Homo sapiens
cctgccagcatcttcagcccct

SEQ ID NO: 6945283 - DNA, 22 bp, Homo sapiens
tgacccattggtccctagatcc

SEQ ID NO: 6945284 - DNA, 22 bp, Homo sapiens
tttagaggaattgggagaacgt

SEQ ID NO: 6945285 - DNA, 22 bp, Homo sapiens
ctcatatatttctgcattcaat

SEQ ID NO: 6945286 - DNA, 22 bp, Homo sapiens
tttctttccatgagcctatgta

SEQ ID NO: 6945287 - DNA, 22 bp, Homo sapiens
tgcagtgtgattttctggctga

SEQ ID NO: 6945288 - DNA, 22 bp, Homo sapiens
tgtctctgataagtagttcagt

SEQ ID NO: 6945289 - DNA, 22 bp, Homo sapiens
ttcctgctccatttgctgagct

SEQ ID NO: 6945290 - DNA, 22 bp, Homo sapiens
tgagagctgggaaatgttagct

SEQ ID NO: 6945291 - DNA, 22 bp, Homo sapiens
gcactggccgcacgcgtagggc

SEQ ID NO: 6945292 - DNA, 22 bp, Homo sapiens
cattgttggtcattgtcggttg

SEQ ID NO: 6945293 - DNA, 22 bp, Homo sapiens
cacagcagtctttcactaaata

SEQ ID NO: 6945294 - DNA, 22 bp, Homo sapiens
ctcaaaagacttaaacataaga

SEQ ID NO: 6945295 - DNA, 22 bp, Homo sapiens
tggaggcaggagacagggcaaa

SEQ ID NO: 6945296 - DNA, 22 bp, Homo sapiens
gccaggctggaaagaacagaca

SEQ ID NO: 6945297 - DNA, 22 bp, Homo sapiens
gaaagtattctccctgaatttt

SEQ ID NO: 6945298 - DNA, 21 bp, Homo sapiens
aggtcccaggtttgggcagca

SEQ ID NO: 6945299 - DNA, 22 bp, Homo sapiens
cattatattacagcactgttaa

SEQ ID NO: 6945300 - DNA, 21 bp, Homo sapiens
ttggttttctgagtctgtaca

SEQ ID NO: 6945301 - DNA, 22 bp, Homo sapiens
gtgcaaatgtaattgtgatttt

SEQ ID NO: 6945302 - DNA, 22 bp, Homo sapiens
attcacaactgatccttgctca

SEQ ID NO: 6945303 - DNA, 22 bp, Homo sapiens
tctcagagaaatgtgtcaccat

SEQ ID NO: 6945304 - DNA, 22 bp, Homo sapiens
ggcagccagagggcagctggat

SEQ ID NO: 6945305 - DNA, 19 bp, Homo sapiens
tgcccccagcacctccctg

SEQ ID NO: 6945306 - DNA, 22 bp, Homo sapiens
ctgccgttgaggagctgtcgat

SEQ ID NO: 6945307 - DNA, 22 bp, Homo sapiens
tctttggtgatatctctttggt

SEQ ID NO: 6945308 - DNA, 22 bp, Homo sapiens
tctatggggcctcacaggcact

SEQ ID NO: 6945309 - DNA, 22 bp, Homo sapiens
gaagcagctggtgagatggagc

SEQ ID NO: 6945310 - DNA, 21 bp, Homo sapiens
tgtctgagtgactgggtctgc

SEQ ID NO: 6945311 - DNA, 21 bp, Homo sapiens
atatttttgtttggactgtca

SEQ ID NO: 6945312 - DNA, 22 bp, Homo sapiens
atgacaaaagaagacatgaggt

SEQ ID NO: 6945313 - DNA, 16 bp, Homo sapiens
caggtgcctctcccga

SEQ ID NO: 6945314 - DNA, 22 bp, Homo sapiens
cagcacaggtcagttttttaag

SEQ ID NO: 6945315 - DNA, 19 bp, Homo sapiens
atgtctctgtagcacatac

SEQ ID NO: 6945316 - DNA, 22 bp, Homo sapiens
caggatgtgaggaggccatttg

SEQ ID NO: 6945317 - DNA, 22 bp, Homo sapiens
atgtggcacagcacagtaagag

SEQ ID NO: 6945318 - DNA, 22 bp, Homo sapiens
tagcagagatatgggcatagat

SEQ ID NO: 6945319 - DNA, 22 bp, Homo sapiens
tgctcatttgcccattagcatc

SEQ ID NO: 6945320 - DNA, 22 bp, Homo sapiens
gtcagtgtagcaggtgcaagcc

SEQ ID NO: 6945321 - DNA, 22 bp, Homo sapiens
gtctgagggttgtgctggagga

SEQ ID NO: 6945322 - DNA, 22 bp, Homo sapiens
ttgaagttctaagccccagtac

SEQ ID NO: 6945323 - DNA, 17 bp, Homo sapiens
agtgtcagggcccttcc

SEQ ID NO: 6945324 - DNA, 22 bp, Homo sapiens
aacctgagcgcgttgctttcta

SEQ ID NO: 6945325 - DNA, 22 bp, Homo sapiens
ctggctgatctcaatcatggct

SEQ ID NO: 6945326 - DNA, 22 bp, Homo sapiens
tggttttgctccagtataaata

SEQ ID NO: 6945327 - DNA, 22 bp, Homo sapiens
aattttactaatctgagtgtga

SEQ ID NO: 6945328 - DNA, 22 bp, Homo sapiens
ccagctcccctcagcaggtaat

SEQ ID NO: 6945329 - DNA, 22 bp, Homo sapiens
acattatagctttgagtttgga

SEQ ID NO: 6945330 - DNA, 22 bp, Homo sapiens
tactgcctggagatgaatcaat

SEQ ID NO: 6945331 - DNA, 22 bp, Homo sapiens
gagcagggcttgtcctcctcat

SEQ ID NO: 6945332 - DNA, 22 bp, Homo sapiens
gtccaagtacatgtgtgtacat

SEQ ID NO: 6945333 - DNA, 22 bp, Homo sapiens
tcttgcatacactatatgtaca

SEQ ID NO: 6945334 - DNA, 22 bp, Homo sapiens
acactttatgtctagatctggg

SEQ ID NO: 6945335 - DNA, 22 bp, Homo sapiens
ttctacatagtctcttggagct

SEQ ID NO: 6945336 - DNA, 18 bp, Homo sapiens
gcctgccatccccacagc

SEQ ID NO: 6945337 - DNA, 22 bp, Homo sapiens
gagggtccccatgcagagctca

SEQ ID NO: 6945338 - DNA, 22 bp, Homo sapiens
aagtttgttgtacatgttagta

SEQ ID NO: 6945339 - DNA, 22 bp, Homo sapiens
ttttaagtttattccagtacat

SEQ ID NO: 6945340 - DNA, 22 bp, Homo sapiens
tgcaaattggtgaggaccactt

SEQ ID NO: 6945341 - DNA, 22 bp, Homo sapiens
tcatgacaactatattattcca

SEQ ID NO: 6945342 - DNA, 22 bp, Homo sapiens
cattatgtgcgtacatgtatct

SEQ ID NO: 6945343 - DNA, 22 bp, Homo sapiens
tccatttagctggcaaacaatg

SEQ ID NO: 6945344 - DNA, 22 bp, Homo sapiens
ttgcttcctttacagatgggca

SEQ ID NO: 6945345 - DNA, 22 bp, Homo sapiens
cagaagcacatgtttacatgta

SEQ ID NO: 6945346 - DNA, 22 bp, Homo sapiens
ctgataatttcaaaaatcttca

SEQ ID NO: 6945347 - DNA, 22 bp, Homo sapiens
tggattagtgctgaaatgatgg

SEQ ID NO: 6945348 - DNA, 23 bp, Homo sapiens
gggctgctccaggccaaggctgg

SEQ ID NO: 6945349 - DNA, 22 bp, Homo sapiens
tctgagagctgccatctcattt

SEQ ID NO: 6945350 - DNA, 22 bp, Homo sapiens
ctttaacaaatgactcttgtct

SEQ ID NO: 6945351 - DNA, 21 bp, Homo sapiens
aacattagtaatttgactttt

SEQ ID NO: 6945352 - DNA, 22 bp, Homo sapiens
ttcctctcaacatgcctgccgg

SEQ ID NO: 6945353 - DNA, 22 bp, Homo sapiens
tttgacagtaataaagcacaag

SEQ ID NO: 6945354 - DNA, 22 bp, Homo sapiens
ccagctgtttctgatgctaggc

SEQ ID NO: 6945355 - DNA, 21 bp, Homo sapiens
actggccctgccttacaaata

SEQ ID NO: 6945356 - DNA, 22 bp, Homo sapiens
tgtgcctttcatcatgcttttg

SEQ ID NO: 6945357 - DNA, 22 bp, Homo sapiens
gcacagtatttagtagaatgag

SEQ ID NO: 6945358 - DNA, 22 bp, Homo sapiens
gcctaatgtctcattccctagt

SEQ ID NO: 6945359 - DNA, 22 bp, Homo sapiens
gaggtagacttcttggaagtag

SEQ ID NO: 6945360 - DNA, 22 bp, Homo sapiens
tgccctggcttcagctttggct

SEQ ID NO: 6945361 - DNA, 22 bp, Homo sapiens
ctctgcaggcacccagggtggg

SEQ ID NO: 6945362 - DNA, 22 bp, Homo sapiens
agccgagctctgagcagggcct

SEQ ID NO: 6945363 - DNA, 21 bp, Homo sapiens
tggcggggacttgtggctgcc

SEQ ID NO: 6945364 - DNA, 22 bp, Homo sapiens
agacctggatgtgagggaagta

SEQ ID NO: 6945365 - DNA, 22 bp, Homo sapiens
tggtcctggtcatctgggctgg

SEQ ID NO: 6945366 - DNA, 22 bp, Homo sapiens
tttcttctaagatttcaaacta

SEQ ID NO: 6945367 - DNA, 22 bp, Homo sapiens
ctaggctgagctgggctgagct

SEQ ID NO: 6945368 - DNA, 22 bp, Homo sapiens
attcaaagagctgccagaactg

SEQ ID NO: 6945369 - DNA, 22 bp, Homo sapiens
atgccctgctctcgggaaggga

SEQ ID NO: 6945370 - DNA, 22 bp, Homo sapiens
gagctttgtgctggtaggtggt

SEQ ID NO: 6945371 - DNA, 22 bp, Homo sapiens
ctctgggcttcctttgtgggtt

SEQ ID NO: 6945372 - DNA, 22 bp, Homo sapiens
agccctgcatagaagggaacac

SEQ ID NO: 6945373 - DNA, 22 bp, Homo sapiens
tcgaaatactgtttccccttta

SEQ ID NO: 6945374 - DNA, 22 bp, Homo sapiens
acatgttagctactattgttat

SEQ ID NO: 6945375 - DNA, 22 bp, Homo sapiens
gaccttgtgatccacccgcctt

SEQ ID NO: 6945376 - DNA, 18 bp, Homo sapiens
gctcctggagtctgactc

SEQ ID NO: 6945377 - DNA, 22 bp, Homo sapiens
cagcttccccccgggcttgaga

SEQ ID NO: 6945378 - DNA, 22 bp, Homo sapiens
tccctaggagaattgccgcagc

SEQ ID NO: 6945379 - DNA, 22 bp, Homo sapiens
atagtcttagaatcttgagtgt

SEQ ID NO: 6945380 - DNA, 22 bp, Homo sapiens
agctgctgggagaagtgagcca

SEQ ID NO: 6945381 - DNA, 22 bp, Homo sapiens
ggaatgttctggaacaccgctt

SEQ ID NO: 6945382 - DNA, 22 bp, Homo sapiens
agcagccacagcagatctgagt

SEQ ID NO: 6945383 - DNA, 18 bp, Homo sapiens
ctgtcttttttctctcca

SEQ ID NO: 6945384 - DNA, 22 bp, Homo sapiens
tggccacccctttctctgcact

SEQ ID NO: 6945385 - DNA, 22 bp, Homo sapiens
ttggagagggcttggatcacac

SEQ ID NO: 6945386 - DNA, 22 bp, Homo sapiens
ttgatgtaggtttatctattgt

SEQ ID NO: 6945387 - DNA, 19 bp, Homo sapiens
tccatgcccaggcaccaag

SEQ ID NO: 6945388 - DNA, 22 bp, Homo sapiens
caaagtgctgggattacaggct

SEQ ID NO: 6945389 - DNA, 22 bp, Homo sapiens
ggtcatgaggagggagaaggtt

SEQ ID NO: 6945390 - DNA, 20 bp, Homo sapiens
tctgagacttgtagtgtgga

SEQ ID NO: 6945391 - DNA, 22 bp, Homo sapiens
gggcattgcaactggtccagac

SEQ ID NO: 6945392 - DNA, 22 bp, Homo sapiens
ttatttgtatcaaggacggttg

SEQ ID NO: 6945393 - DNA, 22 bp, Homo sapiens
gggctggatctcacgtgagacc

SEQ ID NO: 6945394 - DNA, 22 bp, Homo sapiens
atatagaatacacagggaaagt

SEQ ID NO: 6945395 - DNA, 21 bp, Homo sapiens
ttgaaggatcacttctgtacc

SEQ ID NO: 6945396 - DNA, 22 bp, Homo sapiens
gttacagtgagaagatagccta

SEQ ID NO: 6945397 - DNA, 18 bp, Homo sapiens
attgagcatgacagacct

SEQ ID NO: 6945398 - DNA, 22 bp, Homo sapiens
gccatatacccactgtctccat

SEQ ID NO: 6945399 - DNA, 22 bp, Homo sapiens
tcagtaacttggccgaggtcat

SEQ ID NO: 6945400 - DNA, 22 bp, Homo sapiens
gtgaggagggctggtcccaggc

SEQ ID NO: 6945401 - DNA, 22 bp, Homo sapiens
ccttcctcatccatttctcttg

SEQ ID NO: 6945402 - DNA, 20 bp, Homo sapiens
tgtttcataagctgtcctat

SEQ ID NO: 6945403 - DNA, 22 bp, Homo sapiens
tgttctcttccacggcgctcgg

SEQ ID NO: 6945404 - DNA, 22 bp, Homo sapiens
atgcttcttgtatttggctgac

SEQ ID NO: 6945405 - DNA, 22 bp, Homo sapiens
gccttgttgctcctatttgttt

SEQ ID NO: 6945406 - DNA, 22 bp, Homo sapiens
tatgagaaattatacctaggtt

SEQ ID NO: 6945407 - DNA, 22 bp, Homo sapiens
cagttaaacgggccatgtgagt

SEQ ID NO: 6945408 - DNA, 22 bp, Homo sapiens
aagcatttgtgaaattcagatg

SEQ ID NO: 6945409 - DNA, 22 bp, Homo sapiens
gggggggtcttcagacctcaga

SEQ ID NO: 6945410 - DNA, 22 bp, Homo sapiens
ttcagggcttagggaaatagtg

SEQ ID NO: 6945411 - DNA, 22 bp, Homo sapiens
cctcccttggccatagccagcc

SEQ ID NO: 6945412 - DNA, 22 bp, Homo sapiens
ctctgaggtcctacagtgaccc

SEQ ID NO: 6945413 - DNA, 22 bp, Homo sapiens
aaagagttaagagtcttaagct

SEQ ID NO: 6945414 - DNA, 22 bp, Homo sapiens
agacagactggtttgaattggt

SEQ ID NO: 6945415 - DNA, 22 bp, Homo sapiens
aaattttcctggtaaagatgga

SEQ ID NO: 6945416 - DNA, 22 bp, Homo sapiens
cagtgagctcctgtctgtccct

SEQ ID NO: 6945417 - DNA, 22 bp, Homo sapiens
tcagaagtaggagacattcttg

SEQ ID NO: 6945418 - DNA, 22 bp, Homo sapiens
tctagttttggtatgagatgca

SEQ ID NO: 6945419 - DNA, 22 bp, Homo sapiens
caagcactgttaggttgcttgc

SEQ ID NO: 6945420 - DNA, 22 bp, Homo sapiens
taaacagaatgcgtaagaagtg

SEQ ID NO: 6945421 - DNA, 22 bp, Homo sapiens
gcttggcatttgctgggagctg

SEQ ID NO: 6945422 - DNA, 22 bp, Homo sapiens
agcttcttttacagctcatgct

SEQ ID NO: 6945423 - DNA, 22 bp, Homo sapiens
aggctacgacccaactgggcaa

SEQ ID NO: 6945424 - DNA, 23 bp, Homo sapiens
tggacagtagggtagacagtgcc

SEQ ID NO: 6945425 - DNA, 22 bp, Homo sapiens
atagttatgctctagacaagaa

SEQ ID NO: 6945426 - DNA, 22 bp, Homo sapiens
gattcagtgggctttgggacag

SEQ ID NO: 6945427 - DNA, 21 bp, Homo sapiens
tcctgcaccctccctgtggct

SEQ ID NO: 6945428 - DNA, 22 bp, Homo sapiens
atgtgcgaggtgcttgtcagca

SEQ ID NO: 6945429 - DNA, 22 bp, Homo sapiens
agaccagtgagtaggccttaga

SEQ ID NO: 6945430 - DNA, 20 bp, Homo sapiens
tcccaggctgggctccagct

SEQ ID NO: 6945431 - DNA, 22 bp, Homo sapiens
ttgtgtaccttgggtacttgct

SEQ ID NO: 6945432 - DNA, 22 bp, Homo sapiens
gtttattattcaacttcatgtt

SEQ ID NO: 6945433 - DNA, 22 bp, Homo sapiens
aactcagatatgatagcaggag

SEQ ID NO: 6945434 - DNA, 22 bp, Homo sapiens
gaagcctttgcctaaaacatta

SEQ ID NO: 6945435 - DNA, 22 bp, Homo sapiens
ctggcatgccttgggtgcctct

SEQ ID NO: 6945436 - DNA, 21 bp, Homo sapiens
ctgccacctgctccatcagca

SEQ ID NO: 6945437 - DNA, 22 bp, Homo sapiens
ctctggagtgtctggccagggt

SEQ ID NO: 6945438 - DNA, 22 bp, Homo sapiens
tagttaatggaaatgatggaaa

SEQ ID NO: 6945439 - DNA, 22 bp, Homo sapiens
actgcacaaggcctggacacac

SEQ ID NO: 6945440 - DNA, 22 bp, Homo sapiens
agcataattcctgacacacaag

SEQ ID NO: 6945441 - DNA, 22 bp, Homo sapiens
gactgaggtgacctaggactac

SEQ ID NO: 6945442 - DNA, 22 bp, Homo sapiens
aagggggcacagtcactgtaat

SEQ ID NO: 6945443 - DNA, 22 bp, Homo sapiens
catgtcaataaatataactgca

SEQ ID NO: 6945444 - DNA, 22 bp, Homo sapiens
atgggtaggagaacaaatataa

SEQ ID NO: 6945445 - DNA, 22 bp, Homo sapiens
ttgtatgctgatgacaccacct

SEQ ID NO: 6945446 - DNA, 22 bp, Homo sapiens
gcttctcctcccgctcccaggc

SEQ ID NO: 6945447 - DNA, 22 bp, Homo sapiens
agcctctgactgtcagcaaggt

SEQ ID NO: 6945448 - DNA, 20 bp, Homo sapiens
tctcacagacatcgtctcat

SEQ ID NO: 6945449 - DNA, 22 bp, Homo sapiens
acctttggaggactagggtcat

SEQ ID NO: 6945450 - DNA, 22 bp, Homo sapiens
gtctagaatggatgagcatttt

SEQ ID NO: 6945451 - DNA, 21 bp, Homo sapiens
agatgctgtgctccaggagca

SEQ ID NO: 6945452 - DNA, 22 bp, Homo sapiens
gctgagctagctatctcagtct

SEQ ID NO: 6945453 - DNA, 22 bp, Homo sapiens
ggcttctctgtctagtttctac

SEQ ID NO: 6945454 - DNA, 22 bp, Homo sapiens
ctgtgatggtcaggccctatct

SEQ ID NO: 6945455 - DNA, 18 bp, Homo sapiens
tataacctctgttactca

SEQ ID NO: 6945456 - DNA, 22 bp, Homo sapiens
atatactgtagtggtttagagc

SEQ ID NO: 6945457 - DNA, 22 bp, Homo sapiens
gaaacgttaaaccatatgtaat

SEQ ID NO: 6945458 - DNA, 19 bp, Homo sapiens
cagcaataatgccagatgg

SEQ ID NO: 6945459 - DNA, 22 bp, Homo sapiens
gaaggagctaaagggagccctg

SEQ ID NO: 6945460 - DNA, 22 bp, Homo sapiens
ttgacatatagcataaggataa

SEQ ID NO: 6945461 - DNA, 22 bp, Homo sapiens
tacatctgtctggctttccatt

SEQ ID NO: 6945462 - DNA, 22 bp, Homo sapiens
atagtgaaaatgctgtcagcat

SEQ ID NO: 6945463 - DNA, 22 bp, Homo sapiens
tcacaggagtcataattacagt

SEQ ID NO: 6945464 - DNA, 22 bp, Homo sapiens
atatgctattgctgtaatttaa

SEQ ID NO: 6945465 - DNA, 22 bp, Homo sapiens
aattaaaaaaggagagcttgct

SEQ ID NO: 6945466 - DNA, 20 bp, Homo sapiens
caggtccagcacgtgcacgg

SEQ ID NO: 6945467 - DNA, 22 bp, Homo sapiens
cagcgcctcctggacctcctct

SEQ ID NO: 6945468 - DNA, 22 bp, Homo sapiens
cacacagaaccgctcgccactt

SEQ ID NO: 6945469 - DNA, 22 bp, Homo sapiens
tgggtcctttttggacttcttc

SEQ ID NO: 6945470 - DNA, 22 bp, Homo sapiens
tatgacaccattttggtcagtg

SEQ ID NO: 6945471 - DNA, 22 bp, Homo sapiens
atatggaagagcctgggaattt

SEQ ID NO: 6945472 - DNA, 22 bp, Homo sapiens
ttagtgaaaagaaaatgagtgg

SEQ ID NO: 6945473 - DNA, 22 bp, Homo sapiens
aatggccagctgggagagttga

SEQ ID NO: 6945474 - DNA, 22 bp, Homo sapiens
caggcctgcttcttacccttca

SEQ ID NO: 6945475 - DNA, 22 bp, Homo sapiens
ggtttgctgcagtctcgtcatc

SEQ ID NO: 6945476 - DNA, 22 bp, Homo sapiens
agtgaaccaggctgcgtccctg

SEQ ID NO: 6945477 - DNA, 20 bp, Homo sapiens
ggtccctgccctctgtcatc

SEQ ID NO: 6945478 - DNA, 22 bp, Homo sapiens
gggggaaatagaaatgcttaga

SEQ ID NO: 6945479 - DNA, 22 bp, Homo sapiens
agctgggaggtgggcagtgaga

SEQ ID NO: 6945480 - DNA, 22 bp, Homo sapiens
tcagcagaatcttcctacacct

SEQ ID NO: 6945481 - DNA, 22 bp, Homo sapiens
tcatatttagttcacgctcaat

SEQ ID NO: 6945482 - DNA, 22 bp, Homo sapiens
ttggtcacttgctatgtgccaa

SEQ ID NO: 6945483 - DNA, 22 bp, Homo sapiens
cctgagcatcagcgcctcctta

SEQ ID NO: 6945484 - DNA, 22 bp, Homo sapiens
ttcaatcattgcaaagtaatgg

SEQ ID NO: 6945485 - DNA, 22 bp, Homo sapiens
tctagggggacagctggctgtg

SEQ ID NO: 6945486 - DNA, 22 bp, Homo sapiens
ttctgatgaggaggtctctaag

SEQ ID NO: 6945487 - DNA, 22 bp, Homo sapiens
ggagagaattcagcttaagatt

SEQ ID NO: 6945488 - DNA, 20 bp, Homo sapiens
ccactccgcccccagagggc

SEQ ID NO: 6945489 - DNA, 22 bp, Homo sapiens
agagttagtggcctcagcaggg

SEQ ID NO: 6945490 - DNA, 22 bp, Homo sapiens
ctcttagtttgtaaaaataatt

SEQ ID NO: 6945491 - DNA, 22 bp, Homo sapiens
tggagcagccttttctaagcaa

SEQ ID NO: 6945492 - DNA, 22 bp, Homo sapiens
tctcatctcggatcagaagtga

SEQ ID NO: 6945493 - DNA, 22 bp, Homo sapiens
gccggaagatgaagtttggtca

SEQ ID NO: 6945494 - DNA, 22 bp, Homo sapiens
gtgccctggctcacagtgtctc

SEQ ID NO: 6945495 - DNA, 22 bp, Homo sapiens
aggccagaagccagaaatgctt

SEQ ID NO: 6945496 - DNA, 22 bp, Homo sapiens
cagtcccagacccagaaggtgg

SEQ ID NO: 6945497 - DNA, 21 bp, Homo sapiens
tgcatattcttctggtggctg

SEQ ID NO: 6945498 - DNA, 22 bp, Homo sapiens
tgtgcaatttagagacttggga

SEQ ID NO: 6945499 - DNA, 22 bp, Homo sapiens
tccctgcagcccctgagccttc

SEQ ID NO: 6945500 - DNA, 22 bp, Homo sapiens
tctcattattatttgtatgggt

SEQ ID NO: 6945501 - DNA, 22 bp, Homo sapiens
ggatttgaattgttgaaatgat

SEQ ID NO: 6945502 - DNA, 22 bp, Homo sapiens
tgtgctggtacatgtgaggatg

SEQ ID NO: 6945503 - DNA, 22 bp, Homo sapiens
atatgccatactgtacaatact

SEQ ID NO: 6945504 - DNA, 22 bp, Homo sapiens
aggtctggtatttttctatact

SEQ ID NO: 6945505 - DNA, 22 bp, Homo sapiens
tcctcaggatgtggagtagaat

SEQ ID NO: 6945506 - DNA, 22 bp, Homo sapiens
tcaaagtttgtggcaatttatt

SEQ ID NO: 6945507 - DNA, 22 bp, Homo sapiens
tagagggccagctggacagcga

SEQ ID NO: 6945508 - DNA, 22 bp, Homo sapiens
gaggaaggaatgcagtgtatgc

SEQ ID NO: 6945509 - DNA, 22 bp, Homo sapiens
ctttcttcatctgtaatatgga

SEQ ID NO: 6945510 - DNA, 22 bp, Homo sapiens
taaggcaagaaactcctgtgta

SEQ ID NO: 6945511 - DNA, 19 bp, Homo sapiens
tgtgttcaaactccatctc

SEQ ID NO: 6945512 - DNA, 22 bp, Homo sapiens
gctcagcgtggacctggagctt

SEQ ID NO: 6945513 - DNA, 22 bp, Homo sapiens
cacagtcacatatctatgtgtg

SEQ ID NO: 6945514 - DNA, 22 bp, Homo sapiens
taagataaggaacattctgtga

SEQ ID NO: 6945515 - DNA, 22 bp, Homo sapiens
agcatcagtactaatctggcca

SEQ ID NO: 6945516 - DNA, 22 bp, Homo sapiens
tattatcattaactgttgaatt

SEQ ID NO: 6945517 - DNA, 19 bp, Homo sapiens
atgaccagttccatgccct

SEQ ID NO: 6945518 - DNA, 22 bp, Homo sapiens
ccaagggcccttctaaaattct

SEQ ID NO: 6945519 - DNA, 22 bp, Homo sapiens
cagtaacacaaccactccgtga

SEQ ID NO: 6945520 - DNA, 22 bp, Homo sapiens
caggttgggatcggttgcaatg

SEQ ID NO: 6945521 - DNA, 22 bp, Homo sapiens
gaatagatatccttgagggtct

SEQ ID NO: 6945522 - DNA, 22 bp, Homo sapiens
atatgtgtgccatttcagcagt

SEQ ID NO: 6945523 - DNA, 22 bp, Homo sapiens
agcaggaccaagaaggggaaaa

SEQ ID NO: 6945524 - DNA, 22 bp, Homo sapiens
tggctgagtgatatttgcaaag

SEQ ID NO: 6945525 - DNA, 22 bp, Homo sapiens
gaagcagtcagcagcacctttg

SEQ ID NO: 6945526 - DNA, 20 bp, Homo sapiens
ccaaagactgccccttccag

SEQ ID NO: 6945527 - DNA, 22 bp, Homo sapiens
cttggtcctgcagggtctcttg

SEQ ID NO: 6945528 - DNA, 22 bp, Homo sapiens
cagagccagtcagtcagaaact

SEQ ID NO: 6945529 - DNA, 22 bp, Homo sapiens
tcagcactgatgtttcagaaga

SEQ ID NO: 6945530 - DNA, 22 bp, Homo sapiens
ggtgaggggcacctctgcccgg

SEQ ID NO: 6945531 - DNA, 23 bp, Homo sapiens
tgagcctgctgatagacacaatt

SEQ ID NO: 6945532 - DNA, 22 bp, Homo sapiens
acagtggatgtgatgtccaggt

SEQ ID NO: 6945533 - DNA, 22 bp, Homo sapiens
cactatttcctggattttgacg

SEQ ID NO: 6945534 - DNA, 21 bp, Homo sapiens
ttctgggccatgctgcttctc

SEQ ID NO: 6945535 - DNA, 22 bp, Homo sapiens
cttcacaatcaccttttcggaa

SEQ ID NO: 6945536 - DNA, 22 bp, Homo sapiens
ctggaaagtcaggtcagaaact

SEQ ID NO: 6945537 - DNA, 22 bp, Homo sapiens
ttgcacaccagttttgatgtgg

SEQ ID NO: 6945538 - DNA, 22 bp, Homo sapiens
atggctggtgatactggagtga

SEQ ID NO: 6945539 - DNA, 22 bp, Homo sapiens
attgcccttgtcaggcacgggt

SEQ ID NO: 6945540 - DNA, 22 bp, Homo sapiens
actttctgcagtgttggaaatg

SEQ ID NO: 6945541 - DNA, 22 bp, Homo sapiens
agtagcaatgtttgagaagcac

SEQ ID NO: 6945542 - DNA, 22 bp, Homo sapiens
atttggtagtcctgataagatt

SEQ ID NO: 6945543 - DNA, 22 bp, Homo sapiens
aggatgtcagtcagcttggatt

SEQ ID NO: 6945544 - DNA, 22 bp, Homo sapiens
aattaccaggatttttcagtat

SEQ ID NO: 6945545 - DNA, 22 bp, Homo sapiens
tgaaatgttggtaattttatat

SEQ ID NO: 6945546 - DNA, 22 bp, Homo sapiens
aatgttgtatggtgccttcaga

SEQ ID NO: 6945547 - DNA, 22 bp, Homo sapiens
gggaaacaacaaagtatctatg

SEQ ID NO: 6945548 - DNA, 21 bp, Homo sapiens
tcctgatgtgtaaaaggcagg

SEQ ID NO: 6945549 - DNA, 22 bp, Homo sapiens
tagggctctgagagttcagcct

SEQ ID NO: 6945550 - DNA, 22 bp, Homo sapiens
gtatggcactatcctctctgat

SEQ ID NO: 6945551 - DNA, 23 bp, Homo sapiens
tctgctggtgacacggtcacatt

SEQ ID NO: 6945552 - DNA, 22 bp, Homo sapiens
cagaggctggatggacttgcct

SEQ ID NO: 6945553 - DNA, 22 bp, Homo sapiens
agctgaagttcagtccagagaa

SEQ ID NO: 6945554 - DNA, 22 bp, Homo sapiens
gggaacttgccccagaggaatt

SEQ ID NO: 6945555 - DNA, 22 bp, Homo sapiens
gttaagtgaatgtcatgtcagg

SEQ ID NO: 6945556 - DNA, 22 bp, Homo sapiens
tgagacatcacaaaatcctcaa

SEQ ID NO: 6945557 - DNA, 22 bp, Homo sapiens
agaaaatttattcatgttagtt

SEQ ID NO: 6945558 - DNA, 22 bp, Homo sapiens
gttcacagaaggccagatggta

SEQ ID NO: 6945559 - DNA, 22 bp, Homo sapiens
ttaattggtaacctctggacta

SEQ ID NO: 6945560 - DNA, 22 bp, Homo sapiens
aggtccagttttctgacaaggg

SEQ ID NO: 6945561 - DNA, 22 bp, Homo sapiens
tcacaaagctttgataagcaga

SEQ ID NO: 6945562 - DNA, 22 bp, Homo sapiens
cgcttctctactcccagccagt

SEQ ID NO: 6945563 - DNA, 22 bp, Homo sapiens
ttggtcagctaataaggacagg

SEQ ID NO: 6945564 - DNA, 22 bp, Homo sapiens
tttgacagaggttgtggtgtat

SEQ ID NO: 6945565 - DNA, 22 bp, Homo sapiens
gtctggccatttgcccattgtg

SEQ ID NO: 6945566 - DNA, 22 bp, Homo sapiens
tccagggagtcaaatgaactac

SEQ ID NO: 6945567 - DNA, 22 bp, Homo sapiens
aggactcatccctgcttgtcag

SEQ ID NO: 6945568 - DNA, 22 bp, Homo sapiens
ttgtgcattagggaaaggaact

SEQ ID NO: 6945569 - DNA, 22 bp, Homo sapiens
aatgtcagcctgaaagctattc

SEQ ID NO: 6945570 - DNA, 22 bp, Homo sapiens
ggagagcctgtgcagccgggtt

SEQ ID NO: 6945571 - DNA, 22 bp, Homo sapiens
ccacagaggacaactgcctggc

SEQ ID NO: 6945572 - DNA, 22 bp, Homo sapiens
gtccacagctggccagggcctc

SEQ ID NO: 6945573 - DNA, 22 bp, Homo sapiens
ggtggagctggaccaggagagg

SEQ ID NO: 6945574 - DNA, 22 bp, Homo sapiens
tcaggctttgggtcaggctctg

SEQ ID NO: 6945575 - DNA, 22 bp, Homo sapiens
agcagactcttctcctggggct

SEQ ID NO: 6945576 - DNA, 22 bp, Homo sapiens
cttccctggtgttagcccaatg

SEQ ID NO: 6945577 - DNA, 22 bp, Homo sapiens
tgtctgtgacctcttaggcaag

SEQ ID NO: 6945578 - DNA, 22 bp, Homo sapiens
gttaaatgcattttccaagcac

SEQ ID NO: 6945579 - DNA, 22 bp, Homo sapiens
acacactcaattgcataagcac

SEQ ID NO: 6945580 - DNA, 22 bp, Homo sapiens
taataaatgaaagtgctggcat

SEQ ID NO: 6945581 - DNA, 22 bp, Homo sapiens
ctatttgtcagtttggctttaa

SEQ ID NO: 6945582 - DNA, 22 bp, Homo sapiens
tgggaatgtgagcattcattca

SEQ ID NO: 6945583 - DNA, 22 bp, Homo sapiens
aagctggcatgtcacctgagaa

SEQ ID NO: 6945584 - DNA, 22 bp, Homo sapiens
tagagcagtgggtaccatggca

SEQ ID NO: 6945585 - DNA, 23 bp, Homo sapiens
ctgagcaaagggggaagctgctt

SEQ ID NO: 6945586 - DNA, 22 bp, Homo sapiens
agaggatgattttaaggacact

SEQ ID NO: 6945587 - DNA, 22 bp, Homo sapiens
gctttgtgtagaaggaggatgg

SEQ ID NO: 6945588 - DNA, 22 bp, Homo sapiens
aatatttctggtgcttctcact

SEQ ID NO: 6945589 - DNA, 22 bp, Homo sapiens
aatatgttcaaaatagatcact

SEQ ID NO: 6945590 - DNA, 22 bp, Homo sapiens
ttgtcatagcttcatgggtagc

SEQ ID NO: 6945591 - DNA, 22 bp, Homo sapiens
acatgcatgtctatgggcaggt

SEQ ID NO: 6945592 - DNA, 22 bp, Homo sapiens
tgtgaagctggatcctggagct

SEQ ID NO: 6945593 - DNA, 22 bp, Homo sapiens
tggctgtgtcatcatagctgtg

SEQ ID NO: 6945594 - DNA, 22 bp, Homo sapiens
cttctttcccaggcatgtttta

SEQ ID NO: 6945595 - DNA, 22 bp, Homo sapiens
aagcatctcacctgcccccacg

SEQ ID NO: 6945596 - DNA, 22 bp, Homo sapiens
gacagacactattggtatgcct

SEQ ID NO: 6945597 - DNA, 22 bp, Homo sapiens
tgcaagcaagtttttgaagtgg

SEQ ID NO: 6945598 - DNA, 22 bp, Homo sapiens
aatatctgtggccatacaattt

SEQ ID NO: 6945599 - DNA, 22 bp, Homo sapiens
cctgcacaggccaggcatctga

SEQ ID NO: 6945600 - DNA, 21 bp, Homo sapiens
gtggccctgccgcagtgtcca

SEQ ID NO: 6945601 - DNA, 22 bp, Homo sapiens
agttgaatatacttgctgttgc

SEQ ID NO: 6945602 - DNA, 20 bp, Homo sapiens
ccacccacgcgggctctgcc

SEQ ID NO: 6945603 - DNA, 22 bp, Homo sapiens
gcccactggctggagtgctggt

SEQ ID NO: 6945604 - DNA, 22 bp, Homo sapiens
aatgggctttcttggacaggag

SEQ ID NO: 6945605 - DNA, 22 bp, Homo sapiens
gacctgatgccactgcctgtca

SEQ ID NO: 6945606 - DNA, 22 bp, Homo sapiens
acagctatgacagatggataat

SEQ ID NO: 6945607 - DNA, 22 bp, Homo sapiens
ctaaggtgtccctcttgctgga

SEQ ID NO: 6945608 - DNA, 20 bp, Homo sapiens
cacaagaggagttccctgag

SEQ ID NO: 6945609 - DNA, 22 bp, Homo sapiens
aaggcactgtactagttagtta

SEQ ID NO: 6945610 - DNA, 22 bp, Homo sapiens
tcaggcagagttaatttgctcc

SEQ ID NO: 6945611 - DNA, 22 bp, Homo sapiens
tgtgaaattgagaaactttcac

SEQ ID NO: 6945612 - DNA, 20 bp, Homo sapiens
acaacaaacttgcttaagga

SEQ ID NO: 6945613 - DNA, 22 bp, Homo sapiens
atttgctggtgaatgtatagct

SEQ ID NO: 6945614 - DNA, 22 bp, Homo sapiens
agggagctgagagctactattt

SEQ ID NO: 6945615 - DNA, 22 bp, Homo sapiens
atttcaaggactacttttcaat

SEQ ID NO: 6945616 - DNA, 22 bp, Homo sapiens
agagccaggcggctgggcacct

SEQ ID NO: 6945617 - DNA, 22 bp, Homo sapiens
gtccctgcatcaccacgggact

SEQ ID NO: 6945618 - DNA, 22 bp, Homo sapiens
ctgagcatccagcaggtactgc

SEQ ID NO: 6945619 - DNA, 22 bp, Homo sapiens
agctgcctttgcatcactttaa

SEQ ID NO: 6945620 - DNA, 22 bp, Homo sapiens
tctgcagcttgcacaggcaggc

SEQ ID NO: 6945621 - DNA, 22 bp, Homo sapiens
actggaaaattcaaatggggtc

SEQ ID NO: 6945622 - DNA, 22 bp, Homo sapiens
ccagtgttacggcttgaactat

SEQ ID NO: 6945623 - DNA, 22 bp, Homo sapiens
ttcagccagtcatcagtcttgt

SEQ ID NO: 6945624 - DNA, 22 bp, Homo sapiens
actgtctgtacttcttgcaagg

SEQ ID NO: 6945625 - DNA, 21 bp, Homo sapiens
atgaggtaattcactaagcag

SEQ ID NO: 6945626 - DNA, 22 bp, Homo sapiens
ggctaagtacaagggatacagc

SEQ ID NO: 6945627 - DNA, 22 bp, Homo sapiens
ctccatgtccaaagtttccttg

SEQ ID NO: 6945628 - DNA, 22 bp, Homo sapiens
actacagtgtgataagaggggc

SEQ ID NO: 6945629 - DNA, 21 bp, Homo sapiens
gaagacacataacctctctcc

SEQ ID NO: 6945630 - DNA, 22 bp, Homo sapiens
tgctcagaaacgaggtgcagcc

SEQ ID NO: 6945631 - DNA, 22 bp, Homo sapiens
acagtatatatggttatctgat

SEQ ID NO: 6945632 - DNA, 22 bp, Homo sapiens
caatgtcatgattttccattag

SEQ ID NO: 6945633 - DNA, 22 bp, Homo sapiens
ccacagcttcgcagtctgctgc

SEQ ID NO: 6945634 - DNA, 22 bp, Homo sapiens
agcagctcaacagtgtctctat

SEQ ID NO: 6945635 - DNA, 22 bp, Homo sapiens
cctgtacatggccatctttacc

SEQ ID NO: 6945636 - DNA, 22 bp, Homo sapiens
atgtctaaaagataaagtttaa

SEQ ID NO: 6945637 - DNA, 19 bp, Homo sapiens
ttctgggcagcacatgaat

SEQ ID NO: 6945638 - DNA, 22 bp, Homo sapiens
gagcagccctagggcataagca

SEQ ID NO: 6945639 - DNA, 17 bp, Homo sapiens
gggagatgaagggatat

SEQ ID NO: 6945640 - DNA, 22 bp, Homo sapiens
cctcggagcgggtcagagaggg

SEQ ID NO: 6945641 - DNA, 22 bp, Homo sapiens
catttgaacctggatgttctta

SEQ ID NO: 6945642 - DNA, 23 bp, Homo sapiens
tcactgctactcagcctgagatt

SEQ ID NO: 6945643 - DNA, 22 bp, Homo sapiens
ggcccaaaccaagtacctcaaa

SEQ ID NO: 6945644 - DNA, 22 bp, Homo sapiens
ggtgaatagggaaaggttactt

SEQ ID NO: 6945645 - DNA, 22 bp, Homo sapiens
gtaaagttctatttgaatttag

SEQ ID NO: 6945646 - DNA, 22 bp, Homo sapiens
cctgaggtggctgcagcactgc

SEQ ID NO: 6945647 - DNA, 22 bp, Homo sapiens
agttacagtaagccagccagca

SEQ ID NO: 6945648 - DNA, 23 bp, Homo sapiens
tccagtcccctaaatctcactgt

SEQ ID NO: 6945649 - DNA, 22 bp, Homo sapiens
aaccacatgaaaagagtaatat

SEQ ID NO: 6945650 - DNA, 22 bp, Homo sapiens
ctcagagcaatgaacatgcaaa

SEQ ID NO: 6945651 - DNA, 16 bp, Homo sapiens
agccaggctgcctcgg

SEQ ID NO: 6945652 - DNA, 22 bp, Homo sapiens
ttatggaatggagaaagtctgc

SEQ ID NO: 6945653 - DNA, 22 bp, Homo sapiens
aagtgattgctggttttgccat

SEQ ID NO: 6945654 - DNA, 23 bp, Homo sapiens
tcttcctgaactatcaggcacat

SEQ ID NO: 6945655 - DNA, 22 bp, Homo sapiens
atacactggacatcattgcatt

SEQ ID NO: 6945656 - DNA, 22 bp, Homo sapiens
gctcattcagccagggcccggt

SEQ ID NO: 6945657 - DNA, 19 bp, Homo sapiens
tgtggtctctgttctcagg

SEQ ID NO: 6945658 - DNA, 20 bp, Homo sapiens
tacaggaatcaagactgcat

SEQ ID NO: 6945659 - DNA, 22 bp, Homo sapiens
atctcttatgtcacataaacca

SEQ ID NO: 6945660 - DNA, 23 bp, Homo sapiens
acagggctggcagctgcaagacc

SEQ ID NO: 6945661 - DNA, 22 bp, Homo sapiens
cagcctggcctgggactgctga

SEQ ID NO: 6945662 - DNA, 22 bp, Homo sapiens
attattgcaatttgacattcag

SEQ ID NO: 6945663 - DNA, 22 bp, Homo sapiens
tgtactgtattcatctttaact

SEQ ID NO: 6945664 - DNA, 22 bp, Homo sapiens
agcatagagaatctagatgcct

SEQ ID NO: 6945665 - DNA, 22 bp, Homo sapiens
ataggccaatactgtagagttt

SEQ ID NO: 6945666 - DNA, 22 bp, Homo sapiens
ccaaggccacaaacagcctggc

SEQ ID NO: 6945667 - DNA, 22 bp, Homo sapiens
tgttttctagaaacaatgccta

SEQ ID NO: 6945668 - DNA, 22 bp, Homo sapiens
agtgcatgaaagcatacaaggc

SEQ ID NO: 6945669 - DNA, 22 bp, Homo sapiens
atgccagaaggcagaatttatc

SEQ ID NO: 6945670 - DNA, 22 bp, Homo sapiens
agtcaaacaaatgtttattgag

SEQ ID NO: 6945671 - DNA, 22 bp, Homo sapiens
cattgctgcttccaggcacagg

SEQ ID NO: 6945672 - DNA, 22 bp, Homo sapiens
attcagaatggcaaacttctag

SEQ ID NO: 6945673 - DNA, 22 bp, Homo sapiens
agggatggaagacttgaagacc

SEQ ID NO: 6945674 - DNA, 22 bp, Homo sapiens
ttcatagagcagctcactgaat

SEQ ID NO: 6945675 - DNA, 22 bp, Homo sapiens
gctcagagcttgaagttccact

SEQ ID NO: 6945676 - DNA, 20 bp, Homo sapiens
tgtcatgcattagatgaaga

SEQ ID NO: 6945677 - DNA, 22 bp, Homo sapiens
tgcttaaacacatacatacata

SEQ ID NO: 6945678 - DNA, 22 bp, Homo sapiens
agtcacccaggtgtgatggatg

SEQ ID NO: 6945679 - DNA, 22 bp, Homo sapiens
aatgtgtaaaaggttttcttca

SEQ ID NO: 6945680 - DNA, 22 bp, Homo sapiens
agtgctttacctagataatgtt

SEQ ID NO: 6945681 - DNA, 22 bp, Homo sapiens
acgatggttcatcttttgggga

SEQ ID NO: 6945682 - DNA, 22 bp, Homo sapiens
agagtggcttctttgacatgct

SEQ ID NO: 6945683 - DNA, 22 bp, Homo sapiens
actgaatgaggggtgatctggg

SEQ ID NO: 6945684 - DNA, 22 bp, Homo sapiens
aaggtgtcatccaggatggtgg

SEQ ID NO: 6945685 - DNA, 22 bp, Homo sapiens
cccgtcccttttgcccgctggt

SEQ ID NO: 6945686 - DNA, 20 bp, Homo sapiens
gccaggcactgttctcaata

SEQ ID NO: 6945687 - DNA, 22 bp, Homo sapiens
ccactgttaccagtcaatcaca

SEQ ID NO: 6945688 - DNA, 22 bp, Homo sapiens
gaatcttatgtggtgttttcta

SEQ ID NO: 6945689 - DNA, 22 bp, Homo sapiens
ctcaccacaccgtcggcctcct

SEQ ID NO: 6945690 - DNA, 22 bp, Homo sapiens
ttgtgctcttattgtgcaggga

SEQ ID NO: 6945691 - DNA, 22 bp, Homo sapiens
tccagccccggcttccttacag

SEQ ID NO: 6945692 - DNA, 22 bp, Homo sapiens
ctgagcccgggtgctctacccc

SEQ ID NO: 6945693 - DNA, 22 bp, Homo sapiens
tctggccctatggcatgtacct

SEQ ID NO: 6945694 - DNA, 22 bp, Homo sapiens
tccagggcgtgtgtgaaggaaa

SEQ ID NO: 6945695 - DNA, 22 bp, Homo sapiens
atggcaggatgagacaacaatt

SEQ ID NO: 6945696 - DNA, 22 bp, Homo sapiens
agtctgaaataatgtcactaag

SEQ ID NO: 6945697 - DNA, 21 bp, Homo sapiens
ctgccctagatggctctggaa

SEQ ID NO: 6945698 - DNA, 22 bp, Homo sapiens
gagcagttatttttagacatga

SEQ ID NO: 6945699 - DNA, 22 bp, Homo sapiens
acccttccaaatgagcttatta

SEQ ID NO: 6945700 - DNA, 21 bp, Homo sapiens
gttcttagttatattctcaat

SEQ ID NO: 6945701 - DNA, 22 bp, Homo sapiens
tctgcacaccgccaggctgact

SEQ ID NO: 6945702 - DNA, 21 bp, Homo sapiens
ctgattgattgtcctgactct

SEQ ID NO: 6945703 - DNA, 22 bp, Homo sapiens
ttcacactgtcccgggtggaaa

SEQ ID NO: 6945704 - DNA, 22 bp, Homo sapiens
aagctgaatctgaaatagaatt

SEQ ID NO: 6945705 - DNA, 22 bp, Homo sapiens
caggctgatcagggctgggatg

SEQ ID NO: 6945706 - DNA, 18 bp, Homo sapiens
aaaataacaaagttggct

SEQ ID NO: 6945707 - DNA, 22 bp, Homo sapiens
ggttcacagctgtggggttccc

SEQ ID NO: 6945708 - DNA, 23 bp, Homo sapiens
acaggcaataaagggagtctcca

SEQ ID NO: 6945709 - DNA, 22 bp, Homo sapiens
gctgagtgtaatgatggcagag

SEQ ID NO: 6945710 - DNA, 22 bp, Homo sapiens
agtcagaagccggcctaaggga

SEQ ID NO: 6945711 - DNA, 22 bp, Homo sapiens
aaacattgagcacttgctattt

SEQ ID NO: 6945712 - DNA, 22 bp, Homo sapiens
actgtacacgtgtcatttacag

SEQ ID NO: 6945713 - DNA, 22 bp, Homo sapiens
caaaaaacacagatgtctgtgt

SEQ ID NO: 6945714 - DNA, 22 bp, Homo sapiens
gcagccattgagcgaaaaaatc

SEQ ID NO: 6945715 - DNA, 22 bp, Homo sapiens
tggagctggcttgtggaagttg

SEQ ID NO: 6945716 - DNA, 22 bp, Homo sapiens
gtccatccatgttgtattatgt

SEQ ID NO: 6945717 - DNA, 22 bp, Homo sapiens
ggcagtggcagagcttggtcta

SEQ ID NO: 6945718 - DNA, 22 bp, Homo sapiens
ttccagttctatgaattcaaga

SEQ ID NO: 6945719 - DNA, 22 bp, Homo sapiens
aaaggttttatgttttccactt

SEQ ID NO: 6945720 - DNA, 22 bp, Homo sapiens
ttctctgagtcttggtttctta

SEQ ID NO: 6945721 - DNA, 22 bp, Homo sapiens
ccaggaccacacgacaggagag

SEQ ID NO: 6945722 - DNA, 22 bp, Homo sapiens
agtcatctctgagatagaagct

SEQ ID NO: 6945723 - DNA, 22 bp, Homo sapiens
tagtaaacccatgaggcttaaa

SEQ ID NO: 6945724 - DNA, 22 bp, Homo sapiens
agctaaactaggtaaacagcag

SEQ ID NO: 6945725 - DNA, 23 bp, Homo sapiens
ctggaagtgcttttatagctttg

SEQ ID NO: 6945726 - DNA, 22 bp, Homo sapiens
ctgcctggctaaactcaagtcg

SEQ ID NO: 6945727 - DNA, 22 bp, Homo sapiens
gactctggatgatggctttttt

SEQ ID NO: 6945728 - DNA, 22 bp, Homo sapiens
tagatgattttcagtcaaagca

SEQ ID NO: 6945729 - DNA, 19 bp, Homo sapiens
tgggttgtatctctaatgg

SEQ ID NO: 6945730 - DNA, 22 bp, Homo sapiens
gaggatggtatgaggcaagcaa

SEQ ID NO: 6945731 - DNA, 22 bp, Homo sapiens
cagctcacagccacgccattcc

SEQ ID NO: 6945732 - DNA, 22 bp, Homo sapiens
tctagcaggtggcggccagcga

SEQ ID NO: 6945733 - DNA, 22 bp, Homo sapiens
tgctgaggcccaggagcacttt

SEQ ID NO: 6945734 - DNA, 22 bp, Homo sapiens
acccagggtcaccccgtagggt

SEQ ID NO: 6945735 - DNA, 22 bp, Homo sapiens
tgagatggggagggctgcagaa

SEQ ID NO: 6945736 - DNA, 22 bp, Homo sapiens
cagaagttttgctctcttgggt

SEQ ID NO: 6945737 - DNA, 22 bp, Homo sapiens
ctcagggatgggcagatgttaa

SEQ ID NO: 6945738 - DNA, 22 bp, Homo sapiens
gatttgtagcttttcagtctgt

SEQ ID NO: 6945739 - DNA, 22 bp, Homo sapiens
tggtggctcacgtctgtaatct

SEQ ID NO: 6945740 - DNA, 22 bp, Homo sapiens
gtctgcccggccttcctccacc

SEQ ID NO: 6945741 - DNA, 22 bp, Homo sapiens
cagaattgagagaggctgttct

SEQ ID NO: 6945742 - DNA, 22 bp, Homo sapiens
agtacagcccaggccaggctgg

SEQ ID NO: 6945743 - DNA, 22 bp, Homo sapiens
tcaggtgtgtggtggaaggcag

SEQ ID NO: 6945744 - DNA, 19 bp, Homo sapiens
atgcattgtttgaagttga

SEQ ID NO: 6945745 - DNA, 22 bp, Homo sapiens
tgggattcaccatgggcttcag

SEQ ID NO: 6945746 - DNA, 22 bp, Homo sapiens
gcactgagaactgttttctaga

SEQ ID NO: 6945747 - DNA, 22 bp, Homo sapiens
agccagagggatctttctaaga

SEQ ID NO: 6945748 - DNA, 22 bp, Homo sapiens
aatgctttctcagagtccttca

SEQ ID NO: 6945749 - DNA, 18 bp, Homo sapiens
acaatctgaaacctgtca

SEQ ID NO: 6945750 - DNA, 22 bp, Homo sapiens
agcaggcctgccacctcggggt

SEQ ID NO: 6945751 - DNA, 22 bp, Homo sapiens
tcagggcatggctgcacttggc

SEQ ID NO: 6945752 - DNA, 22 bp, Homo sapiens
tgcacagagcaggcaccagcgg

SEQ ID NO: 6945753 - DNA, 22 bp, Homo sapiens
taactttatgacatgtcttgct

SEQ ID NO: 6945754 - DNA, 22 bp, Homo sapiens
ttggctgaaagccatgagaccg

SEQ ID NO: 6945755 - DNA, 22 bp, Homo sapiens
tgagctgtcaaggtacagtgaa

SEQ ID NO: 6945756 - DNA, 22 bp, Homo sapiens
aatccacgagcagtaggtaatt

SEQ ID NO: 6945757 - DNA, 15 bp, Homo sapiens
gcatatcacattcat

SEQ ID NO: 6945758 - DNA, 22 bp, Homo sapiens
ggagggtccccagcagcatgaa

SEQ ID NO: 6945759 - DNA, 22 bp, Homo sapiens
agcccaaactcatggtcctttg

SEQ ID NO: 6945760 - DNA, 22 bp, Homo sapiens
catccaggctgaagtgcagtgg

SEQ ID NO: 6945761 - DNA, 22 bp, Homo sapiens
ttcagtatacattatctaattg

SEQ ID NO: 6945762 - DNA, 21 bp, Homo sapiens
agtttgatgcaatttctgaga

SEQ ID NO: 6945763 - DNA, 20 bp, Homo sapiens
tgatatggtttggctgtgtt

SEQ ID NO: 6945764 - DNA, 20 bp, Homo sapiens
catcattttaaaatctctcc

SEQ ID NO: 6945765 - DNA, 22 bp, Homo sapiens
taggctcagaaggcactgaaaa

SEQ ID NO: 6945766 - DNA, 22 bp, Homo sapiens
ggcagcagtccatggcccaagg

SEQ ID NO: 6945767 - DNA, 22 bp, Homo sapiens
tgcagctgctcttcatttcccc

SEQ ID NO: 6945768 - DNA, 22 bp, Homo sapiens
cctcaggctgggctgcccctgg

SEQ ID NO: 6945769 - DNA, 23 bp, Homo sapiens
agctttgaggactttaaaagata

SEQ ID NO: 6945770 - DNA, 22 bp, Homo sapiens
tgcttcgaattgggcttctgga

SEQ ID NO: 6945771 - DNA, 20 bp, Homo sapiens
tactcacaaatggtttagca

SEQ ID NO: 6945772 - DNA, 22 bp, Homo sapiens
ttctctaggttttagatgaaga

SEQ ID NO: 6945773 - DNA, 22 bp, Homo sapiens
ttatatgattgagcatcttggt

SEQ ID NO: 6945774 - DNA, 22 bp, Homo sapiens
agctgctgcaagtggtgctaac

SEQ ID NO: 6945775 - DNA, 23 bp, Homo sapiens
tggccacagggtgctccattgta

SEQ ID NO: 6945776 - DNA, 22 bp, Homo sapiens
taggaggaactttttgtttgga

SEQ ID NO: 6945777 - DNA, 21 bp, Homo sapiens
ttgaccaagggtgcgtgctcc

SEQ ID NO: 6945778 - DNA, 22 bp, Homo sapiens
tccgggaggcagaggttgcagt

SEQ ID NO: 6945779 - DNA, 22 bp, Homo sapiens
ctgcttcatatttcatagtgat

SEQ ID NO: 6945780 - DNA, 22 bp, Homo sapiens
catggcaggtgcagattctgtg

SEQ ID NO: 6945781 - DNA, 22 bp, Homo sapiens
aattcaggttatatttgcaact

SEQ ID NO: 6945782 - DNA, 22 bp, Homo sapiens
tagtaacacactggtatttgga

SEQ ID NO: 6945783 - DNA, 22 bp, Homo sapiens
cttattgtgattcctgcctctt

SEQ ID NO: 6945784 - DNA, 22 bp, Homo sapiens
catggctgggagacggctgagg

SEQ ID NO: 6945785 - DNA, 22 bp, Homo sapiens
tcagactttaaaggctaacagg

SEQ ID NO: 6945786 - DNA, 22 bp, Homo sapiens
ccctttaaggaaaggaaggatg

SEQ ID NO: 6945787 - DNA, 22 bp, Homo sapiens
gaaaattgaatcagtagctgat

SEQ ID NO: 6945788 - DNA, 22 bp, Homo sapiens
gccagtggatgaggacttaact

SEQ ID NO: 6945789 - DNA, 22 bp, Homo sapiens
aggcagatgtttggcattgctt

SEQ ID NO: 6945790 - DNA, 22 bp, Homo sapiens
tgttctctctccttttgaagtg

SEQ ID NO: 6945791 - DNA, 22 bp, Homo sapiens
agacctggaagttcaagagaaa

SEQ ID NO: 6945792 - DNA, 22 bp, Homo sapiens
gcagatagggtattaggagtaa

SEQ ID NO: 6945793 - DNA, 22 bp, Homo sapiens
gccgtggccagagcccagtctc

SEQ ID NO: 6945794 - DNA, 22 bp, Homo sapiens
acaactttaatgggtttcagct

SEQ ID NO: 6945795 - DNA, 22 bp, Homo sapiens
tgtatcactcagcaaagtgtct

SEQ ID NO: 6945796 - DNA, 22 bp, Homo sapiens
ccctgagagtgagtgccacctt

SEQ ID NO: 6945797 - DNA, 22 bp, Homo sapiens
tatgggtgttaatggtgagaga

SEQ ID NO: 6945798 - DNA, 22 bp, Homo sapiens
atcatgtgaagtggggggttga

SEQ ID NO: 6945799 - DNA, 22 bp, Homo sapiens
agacttctataaatttgggaat

SEQ ID NO: 6945800 - DNA, 22 bp, Homo sapiens
ctaaataatccctctggtctta

SEQ ID NO: 6945801 - DNA, 22 bp, Homo sapiens
ttctaggggacataatatgaaa

SEQ ID NO: 6945802 - DNA, 22 bp, Homo sapiens
cttgagaacatctccagctcac

SEQ ID NO: 6945803 - DNA, 22 bp, Homo sapiens
tctgcccaggacacctgccact

SEQ ID NO: 6945804 - DNA, 20 bp, Homo sapiens
agtaggcaaaggaaagatct

SEQ ID NO: 6945805 - DNA, 22 bp, Homo sapiens
tcccacatatgcaatcctgaat

SEQ ID NO: 6945806 - DNA, 22 bp, Homo sapiens
gttgtattcttcaatatcagag

SEQ ID NO: 6945807 - DNA, 22 bp, Homo sapiens
aaggataaaaaccacttctaat

SEQ ID NO: 6945808 - DNA, 22 bp, Homo sapiens
aggtgggcttggtgccaacatg

SEQ ID NO: 6945809 - DNA, 22 bp, Homo sapiens
atctgtgtgttgagttctcagc

SEQ ID NO: 6945810 - DNA, 22 bp, Homo sapiens
ctggagaaaatccatgtgtatg

SEQ ID NO: 6945811 - DNA, 22 bp, Homo sapiens
cacatctatgtagaggcttctg

SEQ ID NO: 6945812 - DNA, 22 bp, Homo sapiens
tctggcagtaataggggagaga

SEQ ID NO: 6945813 - DNA, 22 bp, Homo sapiens
gatggggttttgccaggctggt

SEQ ID NO: 6945814 - DNA, 22 bp, Homo sapiens
attatccagcaccaatgtcaga

SEQ ID NO: 6945815 - DNA, 22 bp, Homo sapiens
tggctcccaaggagctcctgcc

SEQ ID NO: 6945816 - DNA, 22 bp, Homo sapiens
tgggagatatccggcctccgtg

SEQ ID NO: 6945817 - DNA, 22 bp, Homo sapiens
gtcaaggcattaaaaaggaata

SEQ ID NO: 6945818 - DNA, 22 bp, Homo sapiens
tcttccttttgtaccttctgaa

SEQ ID NO: 6945819 - DNA, 22 bp, Homo sapiens
atcaagcacttctacatgacat

SEQ ID NO: 6945820 - DNA, 17 bp, Homo sapiens
tagctgccccgaatgct

SEQ ID NO: 6945821 - DNA, 17 bp, Homo sapiens
tggttttgtttaaaggc

SEQ ID NO: 6945822 - DNA, 22 bp, Homo sapiens
caggcacacagcacatggcctg

SEQ ID NO: 6945823 - DNA, 22 bp, Homo sapiens
gtttcttagacagacattatct

SEQ ID NO: 6945824 - DNA, 22 bp, Homo sapiens
gtcttcaacaaatggtagggtc

SEQ ID NO: 6945825 - DNA, 23 bp, Homo sapiens
atcaaatgattggccattcagtg

SEQ ID NO: 6945826 - DNA, 22 bp, Homo sapiens
cagtggttgcttgcatggctcc

SEQ ID NO: 6945827 - DNA, 22 bp, Homo sapiens
ctcagagaagatggatgaggta

SEQ ID NO: 6945828 - DNA, 22 bp, Homo sapiens
ggaatgcaattttacaattctg

SEQ ID NO: 6945829 - DNA, 22 bp, Homo sapiens
ttccctggtgggtgagaacctg

SEQ ID NO: 6945830 - DNA, 20 bp, Homo sapiens
ataaggctgtgatagtctga

SEQ ID NO: 6945831 - DNA, 22 bp, Homo sapiens
atatgtgtgtgtgagaaaagct

SEQ ID NO: 6945832 - DNA, 22 bp, Homo sapiens
atgctgtggatgccttgcccca

SEQ ID NO: 6945833 - DNA, 22 bp, Homo sapiens
accctttgcctagaggggcttt

SEQ ID NO: 6945834 - DNA, 22 bp, Homo sapiens
tgccaggccctgtgctggatgc

SEQ ID NO: 6945835 - DNA, 22 bp, Homo sapiens
aggctctgcagaccccagctgt

SEQ ID NO: 6945836 - DNA, 22 bp, Homo sapiens
aatgtataatatttaatgcttt

SEQ ID NO: 6945837 - DNA, 22 bp, Homo sapiens
ttcactatgcttggaaacttct

SEQ ID NO: 6945838 - DNA, 22 bp, Homo sapiens
agcagggtgtggtggccctgga

SEQ ID NO: 6945839 - DNA, 22 bp, Homo sapiens
atttggcataggcagaggccca

SEQ ID NO: 6945840 - DNA, 22 bp, Homo sapiens
ttgttataaagactaaatatgt

SEQ ID NO: 6945841 - DNA, 22 bp, Homo sapiens
ctttgacctctctgtgcccctc

SEQ ID NO: 6945842 - DNA, 18 bp, Homo sapiens
tccttagctgagcttgtc

SEQ ID NO: 6945843 - DNA, 22 bp, Homo sapiens
gaggcccagaggcccaggacgt

SEQ ID NO: 6945844 - DNA, 22 bp, Homo sapiens
aaaggtttatttgttgctcaca

SEQ ID NO: 6945845 - DNA, 22 bp, Homo sapiens
aaaccctgagacttggggccag

SEQ ID NO: 6945846 - DNA, 22 bp, Homo sapiens
gaaggccctgttttccctattt

SEQ ID NO: 6945847 - DNA, 22 bp, Homo sapiens
agacaggtaaatagagatgctg

SEQ ID NO: 6945848 - DNA, 23 bp, Homo sapiens
gtaggaattttcacttcctcttg

SEQ ID NO: 6945849 - DNA, 22 bp, Homo sapiens
acagataaagaaacaatcacag
